United States Patent 7,314,974 (EXPRESSION OF MICROBIAL PROTEINS IN PLANTS FOR PRODUCTION OF PLANTS WITH IMPROVED PROPERTIES) - sequence listing, part 12

SEQ ID NO: 35575 - DNA, 840 bp, Mesorhizobium loti
atgacaaacaaggtttggttcatcaccggatcgtcgaagggttttggccgtgtttgggccgaggctgcactggcgcgcggcgaccgcgttgccgcgaccgcccgtgacgctggcacgctcgccgatctggtcgagaagtatggcgacaacatcgccgcgataaagctcgacgtcaccgacaagaaagccgtcgatacggccgttgccgaggcgcacaagcgctttggccggctcgacgtcgtcatcaacaatgccggctatggccatttcggcgccattgaggaggtcagcgagcaggaagcccgcgaccagatcgaaaccaatgtgttcggcgcgctgtgggtcacgcaggcggtactgccgatcatgcgggcccagcgttccggccgcatcatccagatctcgtcgatcggcggcgtcaacgccttcgcctcgctcggcctctaccacgcctcgaaatgggcgctggaagccttcagccagtcgctcagcatcgaggtcgcggaattcggcatccatgtcacgctggtcgagccaggcggcttctccaccgactggtccggtgcctcagccaaggtctccaagccgatcgaggcctacgcgcccgcccgcgccaagatggccgagcgccgcgccaattcggtcgccggcgaccccgaagccaccggtccggcgatgctggccatcgtcgacgccgccgagccgccgctgcgggtgttcttcggcgatggcggcctgccgatgatccgccaggaatacgccaaccgcctcgccacctgggacaaatgggaccacgtgtccgtcatggcacaaggcgcgaacaagaaccgcaagggctga

SEQ ID NO: 35576 - DNA, 945 bp, Mesorhizobium loti
gtgaaatcccgtcatgtcatcgagcgggaaggcattctcgacccgacgcggatgacgccgcgcattccagcgcggcccgacgatgcgctgtcgctggaggccgagttcggcatcgcttcggccaggaaggcgctcgaccatgccggagttgaaccgtcccagatcgacctgatcatctgctcggcctcgcaccaccagcggccctatccggcgatcgccatcgaaatgcaggaggcgctcggcacgaccggcgccggcttcgacatggggctcggctgttcgtccgcggcggcggcgctgcacatggcggtcaatctggtgcgctcgggcgcgcacaagcgcatcctggtaaccacgccggaaatcatcaccggccatctcaatttccgcgaccggcagacgcatttcatcttcggcgacgcctcggtgtcgatggtggtggaggggcttgcccagggcgacaaacggccggggcgtttcgaggtgctggacacgcggctgtggacgcagatgtcgaacaacatccgcaccaatctgggctaccacacccgcacggcccaggatgatccctacatgatcaatctggaaggcaatctgatcaaacaggtcggcaacaaggtgtttaaggaagtcaccgtcgccggccagaaattcatcgtcgagttcctggccgagcacgggctgacgccgcaggcgatccggcgcttctggctgcatcaggcgaatgcccgcatgaatgcgatgatcctgaaactgtcgttcggccacgatgtcgatcacgatcgcgcgccgatggttctggagcggctgggcaacacggctggcgccggcgccatcgtcgcgctgtcggagaaccatgctgacatgaagcccggtgatttcggcttgatctgcgcctttggcgcggggtattcgataggcggcgcgcttatccgcatgctttga

SEQ ID NO: 35577 - DNA, 1284 bp, Mesorhizobium loti
atgaccgcgccacgcccgtcgaaaacccatatcggcaaccataagctccatccggagacgctgatgctgagctatggcttcgatccgcagctttcggaaggcgcggtcaagccgccggtgttcctgacctcgaccttcgtgttcaaatcggcagaagaggggcgcgatttcttcgactacacgtccggccgcaaggaaccgccgagcggcacggcgtcgggtctcgtctattcacggttcaaccatcccaacagcgagatcgtcgaggaccggctggcgatctatgagggcacggatgcctgcatcctgttttcatccggcatgtcggcgatcgccacgacactgctcgcctatgcccgtccgggcgacgtcatactgcattcgcaaccgctctatggcggcaccgagacgctgctgacacgcacgctgtcgggcttcggcatcggcgctgtcggcttcgccgatggtgtcgacgagaaggcggtgcgcgcagccgccgatgccgcggtggcgaaggggcgcgtttcggtcatcctgatcgagacgccgtccaatccgaccaacagcctggtcgatatcgcgctgatgcggatgatcgccgacgagattggtgcgagccaagggtcagcaccgatcatcgtctgcgacaacacgctgctcggcccggtgttccagcggccgatcgaacatggcgccgatgtctccgtctattcgctgaccaaatatgtcggcggccactccgacctgatcgcgggcgcggccatgggcagcaaggcggtcaccaagccgatcaaagcgctgcgcggcgcgatcggcacgcagctcgacccgcattcctgctggatgctcggccgttcgctggagacgctgtcaatccgcatggagcgggccaacgacaatgcgcgcctggtcgcggaattcctgcgcgatcatgccaaggtcgagaaggtgcactatctgccgttcctgggcgaggatacgccggcggggcgcgcctatgtgaggcaatgcagcggcgccggctcgaccttctccttcgacatcaaaggcggagagaaggcggctttcgcgtttctcaacgccctgcagatcttcaagctggcggtaagtctcggcggcaccgagtcgctcgccagccatccggcggccatgacccattccggcattcccttcgacgtgcgccagcgcatcggcgtcctggagaccacggtcaggctgtcgatcggtgtcgagcatccggacgatctgatcgccgacctgacgcaggcgctggcggcggtctga

SEQ ID NO: 35578 - DNA, 792 bp, Mesorhizobium loti
atgacagggatttcgccagccgtcgtcgcggcaagcaaacttggcctcaccttccagaccaatgacggccccgtccaggcgctgtccaatgtcgacctgaccatcggcaagggggaattcgtctccttcatcggaccgtcgggctgcggcaagaccacgctgctgcgcgtcatcgccgatctggagaagccgacatcgggcacgatctcggtcaacggcatgacgcccgaacaggcgcgcgagaagcgcgcctatggctatgtcttccaggccgccgcgctgtttccgtggcgcaccatcgaacgcaatgtcgggctgccgctggagatcatggggctgtcgaaggcggagcaggcggaacgcatcaagcgcacgctcgatctcgtcaacctgtcgggcttcgagaagaaatacccctggcagttgtccggcggcatgcagcagcgcgcctcgatcgcccgagcgctggccttcgacgccgacctgcttttaatggacgagccgttcggcgcgctggacgagatcgttcgcgaccacctcaacgagcaattgctgcagctgtgggcgcgcaccaacaagacgatctgcttcgtcacccactcgattccggaagccgtgtatctgtcgacgcgcatcgtcgtcatgtcgccgcgccctggccgcgtcagcgacatcatcgaatcgacgctgccgaaggagcggccgctcgacatccgcgagacgcccgagttcctggcgatcgccgcgcgcgtgcgcgatgggctgcgggcagggcacagctatgatgattga

SEQ ID NO: 35579 - DNA, 1329 bp, Mesorhizobium loti
atgtccaaccggctgaaagtcacgccgaacgatctcagcgcattctggatgccgttcacggcaaaccggcagttcaaacaggcgccgcgtatgttcgtgtccgccaaggacatgcattacaccaccagcgatggccgcaaggtgctggacggcaccgccggtctgtggtgcgtcaacgccggccactgccggccgaagatcaccgaggcgatccagcaccaggccgccgaactcgattacgcgccggccttccagatgggtcacccgatcgtgttcgagctggccaaccgcctggtcgacatcgcacccaagggcatggaccatgtcttcttcaccaattccggttcggaatcggtcgagacggcgctgaaaatggcgatcgcctatcaccgcatgaagggcgagggcgcgcgcacccgcctgatcggccgcgagcgcggctatcacggcgtcaacttcggcggcatctcggtcggcggcatcgtctccaaccgcaagatgttcggcacgctgctcggcggcgtcgaccacatgccgcacacgcatctgccggaaaagaacgctttctcgaagggcgtgccggaatatggcgcggagctcgccaacgaactggagcgcatcgtcgccctgcatgacgcctcgaccatcgccgccgtcattgtcgagccggtcgccggctccaccggtgtcatcctgccgcccaagggctatctgcagaagctgcgcgaaatctgcaccaagcacggcatccttttgatattcgacgaggtcatcaccggtttcggccgtctcggcgcgccgttcgcggccgactatttcggtgtggttcccgatatcatgaccaccgccaagggcgtctccaacggcgtcatcccgatgggcgcggtgttcgtgaagaaggaaatccacgacgccttcatgaccggccccgagcacatgatcgagttcttccacggctacacctattcgggcaatccgatcgcctgcgccgcggccttgggcacgctcgacacctacaaggaagagggcctgctcacccgtggcgaggaactggcgccctattgggaggacgcgttgcattcgctgaagggcgagccgcatgtcatcgacatcaggaacatcggcctgatcggcgcgatcgaactggcgccgatcgccggcagcccgaccaagcgggccttctcggccttcgtcaaggcgttcgagcgcggcgcgctgatccgcaccaccggcgacatcatcgcgctgtcgccgccgctgatcatcaccaagggccagatcaacgaactgatcgaccatgtgcgtgaagtgctgcggtcgatcgactag

SEQ ID NO: 35580 - DNA, 723 bp, Mesorhizobium loti
atgaccaacagaacagaacacacagtcatcatcggcggctcatccggcatcggcctggcaaccgcgcgaaaattgctcggcccgggcatgaaggtgacgatcaccgggcgcaaccaggacaagctcatcagcgcttggaagagcctcggcggtgccgccgacaaggccgcgttcgatgcatcgaagccggacgaggtccgccagttcttcgagcgcctcggcccgttcgaccacctcgtcctggcggccagcggcggcaagggcctcggcccgttcgaaacgcttgaccttgccgatatcggcagcggcgtcgaagagaaagtgcggccgcaactgtcctgcctgcaggccgctttgccgacactgaacaaatcgggctcggtcaccttcatatcggcggtgtcggctcaggccacaatgcctggcatcgcgggtatcggcgccatcaacggcatgctcttgaccgtggcgccgatcctggcggtcgaactgaagccgctgcgcgtcaacgtcgtggcgcccggcgtcatcgacacgccgtggtgggactttttgcccgacgaacagcggcaagcggtctttgccgagtacgccggcaagacgccggtcggccgcatcggccgcgccgaggatgtcgcctccgcgatagccttcctcgtctccaacggcttcatgaccggccaggtgctgacctgtgacggtgggttgcggttcgcggcgtga

SEQ ID NO: 35581 - DNA, 483 bp, Mesorhizobium loti
atgggcgtcgccggttgcggcaagtcggctgtcggcatcgcgctggcggccgcgctggatgccgtcttcatcgaaggcgacaggctgcatccgccggagaatgtggcgcgcatggcaagcggcgagccgctcaccgaccagttgcgtgaaggctggctcgacgccatcggcgagcgcatcgcgacgtcgatcggcgaagggcagggcgtggtcgcggcctgctcggcgctcaagcgcagccatcgcgaacgcctgcgcggtttttgccccgatatcgtcttcctctatctggagatcgacccgacgaccgcaaggcggcgggtcgccagccgcaagggccatttcatgccggcaagcctggtcgacagccagttcgccattctcgagccgccgggcagcgatgagcgggcgctgacaatcgacgcgacgcgtcccgtcgccgatgccgttgccgacgcgatgcgcctgctggccaattcatga

SEQ ID NO: 35582 - DNA, 1092 bp, Mesorhizobium loti
atgacgacggcggccaagacgaagcgcgattacagcctggtcggcgaaagcacccgggccgcgatcgagaccggcctggcctcggccgaatggtaccacaccgacgtgccgcgcaaggcgatgaaggagcttatgcagcgctccgacggtccggcgatccgcgacaccatcatctggatcgccgcgatcctgggttcggccgccggcatcgtctggttctggggctcgtggtgggtggtcccgttcctgttcgtctatggcgtgctctacggctcgtcgagcgactcgcgctggcacgaatgcggccacggcacggccttccgcacgcgctggatgaacgatgtcgtctaccacatcgcctccttcatgctgatgcgcaatcccgtgcagtggcgctggagccatgcccgccaccacaccgacaccatcatcgtcggccgcgacgccgagatcgcggtcatgcgcccgccggacctgctgaaggcggcactggccttcaccggcattctcgatttccgctattcgctgccgacgctggtgcgccaggccttcggcacgctgtcggaggaggagaagagctacatccccgagatggaacagcacaaggcggtggtcgccgcccgctggcacatggccgtgtacgttgcgacgatcgctttcgcgatcgcgctggaatcatggcagccgctggtactggtcggcctgccgcgtctctacggcacctggcacatggtgatgaccggcctgctgcagcatatcgggttggccgacaatgtcgtcgaccaccggctcaacacccgcaccgtctacatgaacccgatcagccgcttcatctactggaacatgaactaccatgtcgaacatcacattttcccgatggtgccgtatcacgcgttgcccaagctgcatgaattgatcaagcatgatctgccggagccaaacccgtcgatgtggcacgcctatcgcgaggtctggccggtcctgctgcggcagctgaaatacgaggatttttatctcaagcgcgaactgccgccgacggccaggccctatcgcggcgagtttcacgaggtcgatatgtcggcggccgaatag

SEQ ID NO: 35583 - DNA, 978 bp, Mesorhizobium loti
atgagcgcgcgcctcgtccatatcggcagcgcggtggtggactacgtctaccgcatcgacgccttgccggcgccgggtaccgagaagacggcatcgagctttgcccaggtcgccggcggcggcttcaacatgatggtcgcggccagccgcaccggcatgacggtggtgttcggcggccagctcggcagcgggccgaacggcgatttcctgcgcgccgccttcgccgcggagggcatcgagacgctgacgccgccatcgcccgcgatggacagcggcaattgcgttgccatgatctcgagcgatgccgaacgcactttcgtctcgtggccgggtgcggagagcattctcaccctcgacatgatggcggcgctatcggtagcgcccgatgattgggtgttcacctcgggctatacgctgagctatgcgggcagccgcgacgcgctcgcagactggatcgaggcgctgcctgcgcaaacgccgttcgtctttgacccgacgccgattatttcagacattccgcgcccgatcctgtcgcgggtgcttgcccgcgccacatggctcagctgcaacgcgacggaagcggccgagattgccggcccaggtgatgtcgaggctttggcggcgcggcttcttgacgaccattgtccgcaggcaaccggtgtcgtcatccgctcggcggccaagggctgccatgtcaggctggccgacggcacggcacagaccattcccggcttcaaggtctcggcagtcgacaccaatggcgccggcgacacccatatcggcgctttcgtcagtgcgctggcgcgcggcgtgcatcccttcgaggcggggcgttacgccaatgcggcggcggccatttcggtcacccgccatggcggctcatcggcgccgaccgatgcggaaatccagactttcctgagccaggccgccgcgaccggcacgccgggccagaaccagaaggcccatcagacagcctga

SEQ ID NO: 35584 - DNA, 519 bp, Mesorhizobium loti
atggcgacttcgaccgaacgcgcagtgcttgccggtggctgtttctggggcatgcaggatttgatacggcgctatcccggcgtcatctccacgcgtgtcggctatagtggcggcgatgtagccaacgccacctatcgcaaccacggtacccatgccgaagccatcgagatcaatttcgatccggccgtgatcagctatcgcacgctgctggagcgctttttccagatccacgatccgacgacgcgcaaccgccagggcaacgatgtcggcatgagctaccgttcggcgatctactacacaagcgatgagcaaaagcgcgtcgccgaagacaccattgccgatgtcgatgcttccggcctgtggcccggcaaggtcgtcacggaagtcgcgccggccggcgccttctgggaagccgagcccgagcaccaggattatctggagaaatatccgaacggctatacctgccatttcgtcaggccgggctggaagctgccggtacgcgagaaggccgtatcctaa

SEQ ID NO: 35585 - DNA, 705 bp, Mesorhizobium loti
atgagtgtagaaaaagtggctgttgtcgtggccggtggcagcggcatgggggcggcggcggccaagcgcctggcggcggatgggttcaaggtcgccattctctcttcctcgggcaagggcgaggcgctggccaaggagctgggcgggctcggcgtcaccggctccaaccagtcgagcgacgatttgcagcgcctcgccgacctgacgctggagcgttttggccgcatcgacgtgctggtcaacagcggcggccacgggccgcgcgcgccgatcctggagatcacggacgagcagtggcgcaccggcatggacgtctatctgatgaacgtcatccggccggtgcgcatcgtggcgccgcaaatggtcaagcagaagggcggcgccatcatcaacatctcgacggcctgggtcgccgagccgaacgtgatgttcccgacctcggccgtgttccgcgccggagtgaccgcctacaccaagatcttctccaacacttacgccgccgacaatgtgcgcatgaacaatgtgctgcccggctggatcgacagcctgccgaccgtcgaagagcgccgcgacaacgtgccgatgcagcgctacggcacatcagaggaggtcgccgcgacgattgcgttcctggcttcggagggggcgggctatatcaccggccagaacatccgcgtggatgggggggttataagggcgctgtga

SEQ ID NO: 35586 - DNA, 1488 bp, Mesorhizobium loti
gtggccctgcatgccggcgcgcagccggaccgcgtcgcctgcgtcgacctggcctccggccggcgctggacctatgccgcgcttgacgaggccatccagcgcactgtgcgcgtcctcgaaaccggctacggcatcaagcccggccaacggatcgccacgctggcccgaaacagcgccgatctcctgatcctgcagcaggccgcaatgcggctcggcgccatcttcgtgccggtcaactggcggcttgccagtgcggaacagcaggcgatccttgccgattgcgatccggcgctgctgttgcatgacgcggccccgcaggcggcattgcccgggcgctgcatccctgtcgatgtcgccgccttcacggcggcggtcgaggcagagacgctggcgccgcgccgtcccctgcccgctgacgatgcgccctcgataatcctctacacatcgggcacgtcgggccggccaaagggcgtcatcgtcaccgagcgcaatgccttcgccacggcggtcaatttcagcgtgctgggccgggtcggcaatgccagcatcttcctctgcgacgcgccgatgttccatgtcatcggcctcatcaccagcctgcgcccgacgctgcttcagggcggcaccgtgctgatctcgcccggcttcgatgccggtgccaccaatcgccgcctcgccgatcctgccctcggcgtcactcattatttctgcgtgccgcagatggccaggatgctgcgtgaccaccccgacttcgcgccgtcgcgctggacctcgctcaccgccatcttcaccggcggcgcgccaaatccggccacggatatccgctggtggctggcccagggcgtgcgcatggccgacggcttcggcatgaccgaggcgggcacggtgcttggcatgccggtcgaggccggccgcatcgccggcaaggcaggttcggccggcctgccggcgccgacgatcggcctgcgcctcgtcgacgacgatggccgcgacgtcgcggccggcgagcccggcgagatatggctgtccggcccctcgatcacgccaggctattggaaccggccggaagaaacgcagcgcgctttcaccgccgatggctggttccgcaccggcgatatagcgcggcgcgacggggaaggcttcgtcaccctcgtcgaccgccgcaaggacatgttcatttccggcggcgagaacgtctatcccgtcgaaatcgaaaccgtgctgctcgaccatcccggcatcgccgaagccgccgtgatcggcatcgccgatgcgcgctggggcgaagtcgggcgcgccttcgtcgtggtgaaacccggatgcgccgtcgatccggccgatctggcaagccattgcggcgcccgcatcgcccgcttcaaggtgccgaaagagttcctgctcaccgatgcactgccgcgcaccgcatccggcaagatccagaaacacattttgcgcagctggacagcacctgtccgcaagcacagctga

SEQ ID NO: 35587 - DNA, 783 bp, Mesorhizobium loti
atggagcttcatctccaaggcaaggtcgtgctggtcaccggcgcgacgcaaggcatcggccgcgccattgccgaggcgctcgcgcgggccggcgccggcgggctgctgatcaccggacgcgaccgcaaacgcggcgacgccgtggcggcggaattgtcggccatcggcacgccgactatcttcgtcgccgccgaccttggagacacgcagaccccagccttgctggcgcaggcctgcattgagcgcttcggccgcatcgacggcctcgtcaacgccgccggcctgaccgaccgcgcctccttcctcgatgccggcctcgacgactgggccgcgctgttcgccgtcaatgcgcgcgcgccgttcttcctgatgcaggcggcgattgccgacatgaggaagcgcggggagcccggcgcgattgtcaacatcctgtcgatcaacgcccattgcggctcccccgaactcgccgtctattccgccaccaagggtgcgctggcgacgctgaccaagaacgccgccaacgcccaccgtttcgaccgcatccgcgtcaacggcatcaatgtcggctggaccgacacgccggccgaacgcgtgatgcagtctaagacattgggtcacggcccgggctggctcgacgccgccaatgccgcgcagcctttcggcagattgctcaagccggacgacatcgccaacctgtccgtcttcctgctttccgacgcggccgggccgatgaccggcgctgtgatcgaccaggagcagtcggtgatcggggcgaaccggtga

SEQ ID NO: 35588 - DNA, 837 bp, Mesorhizobium loti
atgacaaagacatggttcatcaccggcgcaagcagtggctttggacggcagttgacggagctcttgctcgaacgcggagatcgcgtcgccgccacggttcgcaagcccgacgctctccacgacctcgccaccaaatatggcgagcggctttgggtcggcatcctcgatgtgacagacagttccgctgtccgtgacatcgtcggcaaagcctttgccgagctcaagcggatcgacgtcgtcgtcagcaatgccggctatgcccttttcggcgccgccgaggaggttgctgacgcacagatcgaacgccagatcgacacgaatcttgtcggctcgatttcggttgcccgcgcggtgatccctgatttgcgccagcaagggggtggccggattgtccagatttcgtcttccgtaggacagtcggcctatccgacgatgggcgtctatgccgccaccaaatggggcattgagggcttctacgagggcactatcccggagatcgcgccgttcggcatcgaggtgaccctggtcgaaccgggtgcctcgcgcacaaacttcgcgtcgtccagcgcggatgccggacagatcctcgacgtctacgaccagacgccggtcggggacttccgtcgcctggtcgcatcggctggtctcgccatgtttcccggagatcctcgcaaggtcgcttcggcgatcatcgcatcagcggagcagaccccggcacccaggaggctaacgcttggaagcgacgcctacgcgcttgtccataccgcgctgactgaacgtctggccgcgctcgagagccagaaggcattggcccgctccaccgatgtggacgcctag

SEQ ID NO: 35589 - DNA, 831 bp, Mesorhizobium loti
atgcccgaactgatcacgctgaacgacggcgccgccattccccagctaggccttggcgtgtggcaggtcgatcacggcatcaccgccgatgtcgtgggctgggcgatcaaggccggctaccggctgatcgacaccgcgcagggttaccagaacgaggaaggcgtcggcgaggcgatccgcgccgccgatgtggcgagaagcgagctgtacatcacctcgaagctgcgcaacggcgcgcacgagcgcgacgcggccctgcgcgctttcgacgacacgatggaaaagctcggcatcgagcagatcgacctgttcctgatccactggccggtgcccagccgcgacaaatatgtcgaggcctggaagaccctcatcgaactgaagcaggccggccgcatcaagtcgatcggcgtttcgaatttcaacagggaccatctggagcgcatcatcggcgagaccggcgtggttccggtggccaaccagatcgagctgcatccgcgcttccagcagcgcgagctcagggaatttcatgccgggcataacatccaaacggagagctggagcccgctcggcagcggccggctgctcggcgacccgacgatcgccggcattgccaagaagcacggcaagtcggccgcgcagacgatcatccgctggcatctccagcaagggctgatcgtcattcccaaatcggtccgccaggaccgcatcgcggccaatttcgatgtcttcgacttcgaactggacgcgcaggacctgaagacgatcgcgggcatggattcggctgatggccgcgacggcccgaacccggcgacggcggcttttttgttttaa

SEQ ID NO: 35590 - DNA, 759 bp, Mesorhizobium loti
atggctagcagcatcgatcctgccgaaatcctcgcggttcgcgggctcagtgcaagctatggtggccgggcggtggtcagcggcatcgatctgtcgctcgaacggggcgacgtccttggcctgctcggcgccaacggttcgggcaagtccaccttgctcagagccatcaccggccagatccggccgctcgggggaaccgtggcgatcgacggcgccgaccttgccagggcaccggaacgcgccaagtccggcttcggccttgccgtggatccatccgatctgccggcggcgctgagcgggcggcaatatctccaactcgtcgcctcgatccgcggctgtgccgaagacgactggcctggcgtcaatgttgccgatcggctcgggctcaatcgctggatcgaacggccgatcgctgaatattcacttggcacgcgggccaagatcgccattgccgcggccctgctcggcgcaccaccgctgctgatcctcgatgagtccctgaacggcctcgatccgcttgccgccttcgaggtgaagtgcatcatcctggccttggcttccagtggccgccatgccgtcatcatctccacccatgtcgtggagtccgtaccgggcctgtgcaaccgcgccatgctcctggccgacggccgcatggcgcgcgcgtggcacgcaaggcaattggccgaggccggccggattcccggcgccttcgaagccgaagtcatgcgggcgctgacggtccaggcggccgatgcgtga

SEQ ID NO: 35591 - DNA, 1572 bp, Mesorhizobium loti
atggtcgaacagggttcgattgcgccattttccgggacgcccttgctgcgcgtcgagggcgtcaggaagcggttcggcggcgtcaatgcgctgcgcggcgtcggtctcgaaatcctctccggcgaagtccacgcactgctcggcgaaaacggcgccggcaaatcgacgctgatcaagatcctgagcggcgtgcatgtgcatgatggcggctcgatcgaaatcgacggcaagcctgtctcgttttcttcgccggcccagtcgcgcgatgccggcgttgcggtggtttaccaggatctgagcctggtcgagtcgctgtcggtcgccgacaatctgcttctggggcgagagccgaagacccggctcggcttcctgaaaaaacgccagctggtagcgcaggccgaggcgttcctcaaatcgcagaacattccgctcgatgcccgcgccatggtcgggtcgctgcccttcgcctatcgccagatgaccgagatcgccaaggcgctgatgggcgatgtccgcctgctcatcctggacgagccgacctcggcgttgaccgatgatgaggagaagatcctgttcgaggcgatccgggcggtcgcagcacgtggcgtcggggtgatctacgtcacccaccgcctcaacgaagtgttccgcatctcgaaccgggtgactgtgttccgcgacggccagaacgccgggaccttcgtcacggcgcagaccaatatgcggcaattggtcggcgcgattgtcggggcggatcacgctgtgctgaaggcggatggcgccgcatctggacaaggcatggcgccatccgccggttcatctgaaaatcccgtgctcgaattgaaaagcgtcagcaatgaccggctcgacggggccagtctccaattgcgcgccggcgaaatccacggccttgccgggctgatcggcagcggtcgcaccgaaatcctgcagaccatcttcggcctgcggccggtccagtcgggcgaggccagcctggacggcgtgtcgctgaagggcacagacccggcggcggcgatcgggctgggcatcgcgctggtgccggaggaccggcacgtccagggcctggttctcgaacattcgatcgagcgcaacctgactttgccgcgcctgccttatttctcgcgccttggctggctgcagcgccggccggcgagcgagcatgccaatgcggcgatgcgccggctggccgtgaaggcgccaggcgcgtcgaccatggtgaagaacctgtcgggcggcaaccagcagaaggtggtgttcggcaagtggaacgagccgcggccgcgcgtgctgttgctcgacgagccgacggtcggggtcgatgtcggcgcgcgcgaggagatttacggcgtcattcgcgccgcggcggtggccggcagtggcgtgctgctggtgtcttcggatctctccgaactgctgcagctttgcgaccgcatctcgatcgtcgtcgatggccggatcaccaggactgtcgcgcggccggaattcggcagcgccgaggacctccatcacctcattcagatatcgcagccatcggaagagcacgcggcatga

SEQ ID NO: 35592 - DNA, 1707 bp, Mesorhizobium loti
gtggtcctcggcctggtcggcgctgccctcgaagggttcggcatcggcctgatcatcccgctgctgggcatcatcatgggacacagcgatgcgacgggaatggccggcttctccgctgttctccagcaggtcggatcgggcttcagcgagcgcgaccggcttgtcgtcatctcggccgccatcctcggctctatcgtcctgaagaacatcttcgccttcgccaacacgctgctgacgaccttcatctccggcaaggccagtcattcgatccgcagcgccctgtcggagcagctcctgcgggtcggctaccccttcttcctgcggcagagccccggacggctgctcaacatcatctccaacgaatcctggcgggcgtccgatgcgatccagatcatgctgtcggcgatcatcagcgcatcggccgccgccatcctcctggccttcctgctgctgttgtcctggcgcatgacgctgttggtcacgctcggactggcgctcgtgcagatcgcgcacgccatcctctcggccaatctgaaggagcccagccgcagcgtcgcttcgcgcaacagccacctcgcctcgcagatgctgcatctggtgcatgccggacgcctgatccgcatcttcggccaggagggccgggagaaggcgatcttcgacaccgcgtccgatggggtccgccgcgcctccttcgtcctgcaggtccgccagggtgcattgccgccgctgacggaggttctccacgccatgctgttcctggcggtggtgatcggcgcctggcttgcgcaggtgagtttcccgctgatcatcgccttcgtcatcctgctctacaggctgcagccgcatatgcgggccctgcagggatcgtggagccagctgcagggcttgagcggatcgctggaagaggtgacatggatgctggatccggcagacaagcccaggccgccacaaggcgacggaccgttccacggtttgcgccggggcatcaagttcgatgacgtgacattcacctattccggcacggaccagcgtgaagtggtgctgcatgcggcgacgttcgaaatcaacagtggccgctcgacggcgctgatcggccgctccggcgccggcaagacgacgatcgtcaatcttctgtgccgcttcgtggaaccggacacgggcaggatcctcgtcgatggatcgccactggaccgtatcgacgccaaccagtggcggcgccacatcgcgctagccagccaggagctggagctggtcgacggcaccattttcgagaacataagctacgggcaggatgcggcgacgctcgcagacgccgagcgcgccgcgaggctggccgaggcgcatgagttcatcgaacggctgcctcagggctacgagacgctggtcggctacaggggcgtcaatctgtcggcgggacagaggcagcggatcgcgctggccagggcgctggtgcgcgaccccgatctgctcatcctcgacgaggccaccaatgccgtcgacggactgtcggaggcggccatcgtcgagacgctgaagtcgagagcgggacggcgcacgaccatcgtcatcagccaccatcacagcaccatctcgttctgcgacgacgtggtgatcctgagccgtggccgggtgaagaagcaggcccctttcggcgccctggcgtcgctctcaatggacgagctctaccagcatgaaccgcaggactga

SEQ ID NO: 35593 - DNA, 777 bp, Mesorhizobium loti
atgacaaaccagcagacaagtacgggccagcagacaagcacgggcaatccaatcagaaccgcgatcgtgaccggcgcctccaagggcattggtgcggcgatcgcgcagcggcttgcccgcgacggtttggccgtcgtcgtcaattatgcacggggccgcgccgaggccgacgcggtccgcggcgcgatcgaggccggaggcggcaaggcgatcgccgtgcaggccgacatcgccgatcccaccggtattgccacccttttcgatgccggcgagaaggcgttcggcggcgtcgatatccttgtcaacaatgccggcatcatgaagctgtcgcccatcgccgggaccgacgacgcctccttcgacgcgcagatcgcggtcaatctcggcggcgtgttccggggcacgcgcgagggcgcgaaacgccttcgcgacggcggccgcatcgtcaatttctcgagcagcgtcgtcggcctctatcagccgggctacggcgtctacgccgccaccaaggcggcggtcgaggcgatgacgcatatcctggcgaaggagcttggcgcgcgccgcgtcaccgtcaatgcggtggcgcccgggccggtcgagaccgcgctgttcatggacggcaagagcgcgacgcagatcgaggccatcggcaagatgatcccgctcggccggctcggccagcccgacgacattgccggcgtcgtgtcgttcctggccgggccggacagtggctgggtcaacggacagatcatccgcgccaatggcggcgtgatctga

SEQ ID NO: 35594 - DNA, 1680 bp, Mesorhizobium loti
atggggagatgggcgccaccagggaggactgacatgaccggcttgccacgctacgaggacgccgttgcgcgcttccgcatcgaggatgagatcgccaggctcgatggcgatcccctcaccggcatcaacggctatgtcgaatgctgcggccgccacaccgggcagaaccggctggcgctgcgcgcgatctcggccgggggcgaactccggctgttcagcttcgacgacctcgctgatatgtcgggccgcgtcggcaacctgctcaaggatgcaggcgtcgggcccggcgatgtcgtcgccggcatgctgccgcgcattcccgaactcatagcgctcatcctcggcacctggcgcatcggcgccatctaccagccgctgttcaccgctttcggcccgaaggcgatcgagcatcggctcggctatagcggcgcgaaattggtggtgaccaatccggccaatcgcggcaagctcgacgagatgaagacctgcccgccgatcgccaccattcttggccccggcgatcccctgcccgctggcgacatcgacttccgcgccgcgcttgccgccgcctcccctgactgcgaacccgtgatgcgcaaaggcgaggacctgttcatgatgatgtcgacctcgggcacgacgggcctgcccaagggcgtgccggtgccgctcaacgcgctgctctccttcggcgcctatatacgcgatgcgatcgggctgcgccccgacgacgtcttctggaatatcgccgatcccggctgggcctatggcctctactacgccatcactggcccgctgctgctcggcatcgccaccaccttcaacgagggcgccttcaacgctgggaacacctatgacgtcatcgagcggctcggcgtcaccagccttgccggctcgcccaccgccttccgcctgctgctcgccgaagggcctgaggccgctgcccgcatcaagggccggctgcgcgtggtgagcagcgccggcgagccgctcaacccggaagtgatccgctggttcgacgctcatctcgccgcgcccattcacgaccattacggccagaccgagaacggcatgatggtcaacaaccaccatggcctcgcgcatgccgtccgcgcgggctcggccggctttgccatgccgggttatcgcatggtggtgctggacgatgaaggcaacgagctcggcctcaatcagcccggcatcctcgccgtcgatgtcgccaattcgccgctgcgctggttcgacggctaccaccaggccgagacgccggcgatcgcaggcggctactaccgcaccggcgacacggtggaatacgagcccgacggctcggtctcctttatcggccgcgccgacgatgtcatcacctcgtcgggctaccgcatcggccccttcgacgtcgaaagcgcgctgatcgaacatcccgcggtcaacgaggcggcggtggtcggcgtgcccgacccgcagcgcaccgagatcgtcaaggccttcgtcatcctggcgccggcctaccagggcagcacggaactcgccgaagaactggcgcagcatgtccgcaagcggctctcggcccacgcctacccgcgcgagatcgatttcgtcgccgaattgccgaagacgccgagcggcaagatccagcggttcctgctgcggcaggcggaggtggagaagcggaaggggtag

SEQ ID NO: 35595 - DNA, 1887 bp, Mesorhizobium loti
atgacgacggacacgaaagcgacggaaaccagggcattcgaggcggatgtttcgcggctgctgcacatgatggtgcattcggtctattccgataaggacgtgttcctgcgcgagctgatttccaacgccgccgacgcctgcgaaaagctgcgcttcgaggccgtcagccgtcccgaattgctgggcgacgatcccaagccgcgcatttcgatttcggccgatccggacaacaaggagatcaccgtcgaggacaacggcatcggcatgagccgcgacgacatggccgaggccctgggcacgatcgcccgctcgggcacgcgcgccttcatcgagcgcgtcggctcaggcacggaggacacgcagctcatcggccagttcggcgtcggcttctattccgccttcatggtcgccgaccgcgtcgatgtcatcagccgcctggccggaagcgaagaggcctggcgctggtcctccgacggcaagggttcctacgaaatcgcccccgcccctctcgaagcagcacccaggcgcggcacccgcgtcgtgctccatctgatggacgacgccgtttcctacaccggctcctaccggctcgagcagttggccaagtcgcagtcgggccatgtgccggtgccgatcacgctcatcgaaaaacccggcgccgaggcgcgcgacattgccgatggcacggcactctgggtgcgaccgaagagcgagatcaagcccgaggaatataccgacttctaccgcagcgtcgccggccagtatgacgagccggccgccaccatccatttccgcgccgagggccggcaggaatactccgtgcttgccttcgtgcccggctcgcgcccgttcgatctgttcgaccaggaccgcaagggccgcatgaagctctatgtgcgccgcgtcttcatcaccgacgatgccgacctgctgccgcgctatctgcgcttcgtgcgcggcctggtcgattccgccgacctgccgctcaacgtctcgcgcgaaatgatccaggaaagcccgctgctggcctcgatccgcaagggcctgaccaaccgcgtgctgggcgacctcgccaagctggcggagaacgaggccgaggcctatgccaaggtctgggagaatttcggcgtcgtcctgaaggaagggctctacgaggattacgagcggcgcgagcaattgctgaagctcgcccgcttccactcgaccgcctcgggcgaaggctggcgcggcctggccgactatgtcgcggcgatgaaggaaggccagaaggcgatcttcttcatggccggcgacgaccgcgccaggctcgaagcctcgccgcagctcgaaggtttcaaggcgcgcggcatcgaggtgctgctgctcaccgacccggtcgacagtttctgggtgacgatggcgccggacttcgacggcaagccgttcaagtcggtgacgcaaggcgtcgccgaactgtccgacattccgctgctcgacgacgcaaagaagccggatacggctgcagcgccggaggtcgacggcttcctggccttcgtcaaatcggcgcttggcgatgccgtctcggatgtgaaggcctccgaccgcctgaccgagagcgccgtctgcctggtcgcgcccgaacatggccccgaccggcagttcgagcggctgatgaacgccgccggccgcctcgacaaggcggccaagcccatcctcgaaatcaacccgcgccacgagcgcgtgctggcgctcgccggcctcggcgacgaggaccaggccttcaaggatgacgcggcccatctcctctacgacgaggcgcgcgtgctcgacggcgacaagccggccgacgccagggcattctcggagcgtctggcgcggctgatcgcacgcggcatcgcgaagggctga

SEQ ID NO: 35596 - DNA, 729 bp, Mesorhizobium loti
atgaacctttcgaaccagaagatcctgatcgtcggcggcggctccggcatgggcctggcgctggccaggcgttgcgtcgaggctggtgccacggtcatcatcgcaggacgtagcgacgacaggttgcgacaggcgcgcgagacacttggcaatcccgccggcctggaggtagccgtcgtcgacatcgccagggaagaccaggttgcggcgctgttcgccgaggtcggtggcctcgaccacatcgtcagcacggcggccgacatagaaggcgcctacaggctgctgccggagcttgacctgaaggcggcgcagcgcatggtcaacagcaagctctttggcccgctactgcttgccaagcacggcgcgccacggcttgccgcgagcggctcgatgaccttgatctccggcatcgccgcttaccggccggccgcgcgcggctcggtcgtcgccgccgtcaatgccgcgctcgaagggctggtgcgggcgctggccgtcgaactcgcgccgctccgcgtcaacgccgtttcgcccggctgggtcgacaccgagatctgggcgcaggtcgccggcgaccgcaaggccgaaatgcttgcagcgatggccgagcggctgccggtcggcagggtcggccagcccgaagacatcgccgacgctattttcttcctcatcggcaacggatttacgaccggcacgacgctgcatgtcgaaggcgggcaccggctggtttag

SEQ ID NO: 35597 - DNA, 771 bp, Mesorhizobium loti
atgaaactcgccaccttcaacatcaacaacatcaacagccggctggaaaacctgctggcctggctggcggcggcaaagcccgatgtcgtctgcctgcaggaactcaaggcgcgcgacatgcagtttccgcgcaccgcgcttgccgatgccggctatggcgcggtgtggaagggcgagccgacatggaacggcgtcgccatcctggcgcgcggcgcggagccggtgctgacccgcgatgccttgcccggcgacgatgccgaccggcaaagccgctatatcgaggcggcggtcgacggcatcgtcatcgcttgcctctatgcgccgaacggcaatccgcagccggggccgaaattccagtacaagcttgcctggcacgcgcggctggaggcgcatgcggcgcagcttctcgacaccggcctgccggtcgtgctggccggcgactacaacatcgtgcccgagccgcgcgacatctatgccacgcgctcctatgacgacaacgcgctggtgcagccggaaagccgcgccgccttcgccgccctcatcgagcagggctgggtcgacgcgctgcgaaaaatctatccgaaagagacgctctacaccttctgggactatcggcggaaccgctggccgcgcgatgcgggcctcaggctcgaccacatcttgctgtcgaagacgctcgcccgccggctgaaaggggcgggtatcgaccgcgacgtgcgcggtgaggacggcgccagcgaccacgcgcctgtctgggtggagctgaagtag

SEQ ID NO: 35598 - DNA, 2109 bp, Mesorhizobium loti
atggcgaagcaagcatccaaattggccggaacggccgcgaccatccacgatcagaaactgcagcgcggcgaaggcggcgaactgcaccagaccgcgtccggttcgacagccgtactgaccaccgcacagggcggccctgtctcggacgaccagaactcgctgaggatcggtgcgcgtgggccaaccgtgctcgaggacttccacttccgcgaaaagatcttccatttcgatcacgagcgcattcccgagcgcgtcgtccatgcgcgtggctatggcgcgcacggctatttcgaaacctatgaatcgctggccaaatacacccgcgccgacatcttccagcgcgccggcgaaaagacgccggctttcgtgcgcttctccaccgttgccggcaataagggctccgccgatcttgcccgcgacgtccgtggcttcgccgtaaaactctacacgcaggaaggcaattgggacattgtcggcaacaacatgccggtgttcttcatccaggatgcgatcaagtttcccgacctgatccatgccgcgaaggccgagcccaacagcgatttcccgcaggcacagaccgcgcacgacaatttctgggatttcatctcgctcacgccggaaagcatgcacatgatcatgtgggcgatgtccgaccgcgccatcccgcgctcgctgcgcttcatggaagggttcggcgtccacactttccggctgctcaacgcgaaggatgaatcgaccttcgtcaaattcctctggaagccgaagctcggcctccagtcggtcgcctggaacgaggcggtcaagatcaacggcgccgaccccgacttccatcgccgcgacctctgggacgcgatccacgccgggaatttccccgaatgggaactgcagctgcagctcttcgaccaggccttcgccgacagcttcgacttcgacatcctcgatccgaccaaactcatccccgaggaggtgctgccgccgatcgcggtcggccgactggtcctcgatcgcatgcccgacaatttcttcgccgagaccgagcaggtggcgttcatgacgcagaacgtgccgcccggcgtcgacttctccaacgacccgctgctgcagggccgcaatttttcctatctcgacacgcagatcaaacggctgggcagcaccaacttcacccacctcccgatcaacgcgccgaaatgccccttccacactttccagcaggacgggcacatggcgatgcgcaacccggtgggccgcgccaactaccagcccaattcatgggatgaaggcccgcgcgaatctccgcaaaagggcttccgatcctttgccgaagccgaagccggaccgaaggcccgcctgcgggcggaaagctttgccgatcactacagccaggcacgccaattctacatcagccagcaccccgtggaacaaggccacatcgcctcggcgctgaccttcgaactgagcaaggtgcacaccccggtcatccgcgagcgcatcgtatcccacctcctcaatatcgatgatgcgttggctcgcaaggtggcggatgcgctgggcctgaaggcgatgccgaagcccgccgatgcgggggcgccgacgcgcaccgaccttcccgcgtccgacgcgctcagcatcctcaagaacggccccggccgcttcgagggacgcaagctcggcatcctggtgaccgacggcaccgacgcagctctgctcaatgctctgaagcaggcgctgaccaaggccggcgccaagttcgagatcatcgcgccgaaggtcggcggcgccaaggccagcgacggcagctggatggacgcgcagcagatgatcgccggcgcgccgtctgttctctacgacgccattgcgctgctggcggcaaagcctgcaatggccgggctgctgagggaatcgaccgcccgcgacttcgtcgccgacgcctttgcgcactgcaaattcatcggcttcgtcgaggcggcggcaccactgctggacaaggccggagttgtcgaggacgaggcggtgatcccgcttgcatccgccaaggatgtcgcgggcttcatcaccaggctcggcgacctgcgcctctgggcacgcgagccgaaggtgaagctgggctga

SEQ ID NO: 35599 - DNA, 816 bp, Mesorhizobium loti
atgaaccggaattcgggaaagaccgcgatcgtgaccggcgcctcctcaggtattggccgtgccagcgccgagattttggcacgcgccggcttcactgtcttcggcaccagccgcaaggcatccggccagagctcgaacgggatatcgatgctggtttgcgacgtcaccgacgacgcgtctgtagcgtcccttgtctcaactgtcctcggcaagaccggccggatagacctgttggtcaacaatgccggtatcgggctgctgggaggcgcggaagagtcctcggtctcgcagtcgcaggcgctgttcgacgtcaacctctttggcgtcatgcggatgaccaacgcggtgctgccgtcgatgcggcggctgggcgaggggcgcatcgtcaatatcggctcgatcctggggctggtccctgcgccgtactcggcccattattcagccgtcaagcacgcgcttgaaggctattcggaatcgctcgaccatgaggttcgcgccttcaatattcgcgtttcggtcatcgaaccggcattcgtgcgcaccgtgttcgaccagaacggattcgagcccgattccgtcatgaaggtatatgatgaggcgcgggccggtttggaggcattgcttcgcgacgtgatgcccaaggccgatctgccggaagtggtggcgaaggtggttctgcgggctgcgaccgaccggcatccgctgcggcgctacaccgccggcaaggcagcgcggcaggtaagcatgctgcgccggttcgcgccgacagggatgttcgacaaaatcttgcgcaagcaatttcgcctgcctgtctga

SEQ ID NO: 35600 - DNA, 882 bp, Mesorhizobium loti
atgaccgacatcagcaaggccggaaccttcaagctcggtgaccgcaccgtgaagcgcctcggctacggcgccatgcaactggcaggaccgggcgtcttcggcccgccgaaggaccgcgacgcggcgctcgccgtgctgcgtgaggcgatcgccagcggcgtcgaccacatcgacacatcggatttctatggcccgcacgtcaccaaccagatcatccgcgaggcgctgcacccctaccccgccaacctcaccatcgtcaccaaggtcagcgcccggcgcggcgccgatgcatcctggattccagcaatgtcgcccaaggagctgaccgaggccgtgcacgataatctgcgcaatctcgggcttgatgtgatcgaggtcgtcaacctgcgctccatgcatggcatccacggccccgccgaaggatcgctcgagccgcagttgaacacgctcgccgaattgcagcgccagggcctcatccgccatatcggcatgagcaacgtcacatcgacccagatcgcccagggacgcagcatcgccgatattgtctgcgtacagaaccagtacaatatcgcgcaccgcgacgacgacgcgctcatcgacgcgcttgccgccgacggcatcgcctatgtgccgttcttcccgctcggcggcttcacgccgctgcagtcggacacgctggccaatgtcgcccggaaactcggcgcgaccccgatgcaggtggcgctcgcctggctgctacgccgcgcgcccaacatcctgctcatccccggcacctcttcggtcggccatctccgcgagaacctggcagcggccgaactcgacctgccggccgacgcgctcgccgtgctgaacggcatagcggacgagaaggccgccgcctga

SEQ ID NO: 35601 - DNA, 1977 bp, Mesorhizobium loti
atgcttcatggatttttgcgattggctgcgggggcagggcggtctctggctgttcctgcgatcctgctcgcactcggcgctcccgcccaggctggaagccttctggaggattgcgcgaacgacaagcttacaccgcccaaccggatcgtcgcctgcaccaatgtgctggaggacaaggccgcttcggcgagcgaccaggccgttgcctatttcaaccgcgccaacgcgctggacaggaacggcgagttcgaccgtgccatcgccgactacgacaaggcgatcgccttcaatcccaaagacgccgaggctttcaacaaccgggggctgatctggggccacaagaaggattttgaccgcgccctggccgactatgacaaggcgatcgagctcaatccgcagattgccattgcctatgccaaccgcggcctgatctggaacgatataaagcacgactatgtgaaggccatcgccgatttcgacaaggcgatccgcctcgatccggaaaacaacggcctgtacaatcttcgcggcaatgcctatctgcgcaagggcgactacgaccaggccatcaccagctacagccaggcgatctttctcgactcgcaagatccgaaccagtatttcaacctcgggctggcctggaccaccaagggcaatctggagcgcgccatagcggattacagccaggcgatcagcctcgatgcgaaccatgccgaagcctatcgctggcgcgccgacgcctgggtgaagcgaggcgatacggaccaggccctgtcggactataccgaggcgatcaggctcgatcccggcgacgccgagacgttccgcaaccgcgccaggatctgggagcgcaaacgggactacgaccgcgccatcgcggattacgatcaggcgatcgccttcgctccgaacgacgcggtggcctacaatggccgtggctggatgtggtcgctgaaacatgagaccgaccgcgccatcgttgactatgtcaaggcaaccgccttcgatccgaactatgtgctggcttacgacaatctgggcctggcgtggtgggataagggcgaccttgaccgtgccatatcggccttcgaccaggccgtgatcgtcgatccgaaatatgcgccggcctataatgacagggggctcgcgcggatggacaagaaccagtacgaccttgccatcgccgactacaatatggcgatcctgatcgacgccggatttgtcagcgcttaccgcaaccggggcaatgcctggaaccggaagggccagttcgactacgccatagccgacttcgaccaggcgatcgatcacgacccggacgatgccgacgcctatgtcggccggggccgcagcaggatctacaaggcagactatactaaggccatcgccgatctggatcaggcgatccgcatcggacccaaaagcgctagagcccacgacacgcgcggcctggcgatggtctacaaggccgactatgccggcgcgctggccgattatgatgaagcgatccgcctcagcccgaaaaatgccagcgcctaccggaaccggggcattgccagcttctatttcggcccgcccgccaaggcgcaggccgacttcgagcaggcggccgcgatcaagcccggggattcctatcatgcgatctggctcgatctcgcgcggcggcgcaacgggcagccctccatccttgtggatgccaagctcgacatgacgagatggccggcggcggtggttcgcctgctgcttggccagcagacgccggaggccacgctcctcgccgccgacaatccggatgcgacgaagaaaagcgagcagctctgcgaggcgaatttctacgtcgcggagttccagcggctgcaacaccatgatgaggaggcgttgcggctctaccggctggcccttggcggctgtcctcgcgatttcatcgagtacaccgccgccaccagcgcactgcgcgtgatgggcaaggcgccatga

SEQ ID NO: 35602 - DNA, 1434 bp, Mesorhizobium loti
atgtcacacaatctgcagttctatgtcgacggcgcgtgggtcgatcctgtcgtgcccaacacgctcgatgtcatcgatccgtcgaacgaggatgccttcgcgcagatctcgctcggctccaaggccgatgtcgacaaggcggtggccgccgccaagcgcgccttcaattcgttcggcttcacctcggtcgaagaacgcctcgatatcctaaaccgcgtcatcgaggtctacaagaagcgctccaaggacctcgcgctcgccgtgtcgcgcgaaatgggcgcgccgcgccagatggcgctcgacagccaggttggcgtcggcctggcgcatctggagaagatggccgaagtgctcaggacttttcagttccgtcacgtcaaggggagtgcgctgatcgtcaaggaaccgatcggcgtcgtcggcctgatcacgccatggaactggccgctgaaccagatcacctgcaaggtcggcccggcactcgccgccggctgtacaatggtgctgaagccatcggagatcgcgccgctcgacgccatcatcttcgccgagatcatcgacgaggccggcgtgccgaagggcgtgttcaacctcgtcaatggcgacggtcccggtgtcggccaggcgctctccagccatcccgacgtcgacatgatgtcgttcaccggttcgacccgggccggcatattggtggccaaggccgccgccgacacggtcaagcgcgtgcaccaggaactgggcggcaagtcggccaacatcctgttcccggatgtcgacctggcccgcgccgtcaccaagggcgtcgccggctgcttcggcaatagcggccagtcctgcaatgcgcccacccgcatgttcgtgccgcgcgaccgccatgacgaggccgccggttatgccaaggcggcggcggaaaagttcgtggtcggcccggccgacggcgccaacaccaagcttggccccgtcgtcagccagatgcagttcgacaagatccaggacctgatccaggccggcatcgacgagggtgcgacgctggtggccggcggccccggccgcccggccgaactcaaccgcggctactatgtcaggccgacggtgttcgccgacgtcacccacgacatgcgcattgcgcgcgaggaaatattcgggccggtgctggcgatcctgccctacgacacggtcgaaaaggccgtcgaacaggccaacgacaccgtctacggccttgcctcctacatccaggccaaggacatccagaaggcgcgcgacgtggccgcacgcatgcgctccggcaatgtctacatcaactatccggcctgggacgccggcctgccctttggcggctacaagcagtcgggcaacggccgcgaatatgccgaatacgggctggaggattttctggagatcaagggcatcgcggggtatgaggcggcggagtag

SEQ ID NO: 35603 - DNA, 1632 bp, Mesorhizobium loti
atgtctgccaaggaaatcaaattcgccaccgacgcgcgtgaccgcatgctgcgcggcgtcgagatcctcaccaatgcggtgaaggtcacgctgggccccaagggccgcaacgtcatcatcgacaaggcctatggcgcgccgcgcatcaccaaggacggcgtcaccgtcgccaaggaaatcgagcttgccgacaagttcgagaacatgggcgcgcagatggtgcgcgaagtggcctcgaagaccaatgatctcgccggcgacggtaccaccaccgcgaccgtgctggccgcctcgatcctgcgcgagggcgccaagctggttgccgccggcatgaacccgatggacttgaagcgcggcatcgaccaggcggttgccgccgtcgtcgtcgagatcaaggcgaaggccaagaaggtcaagtcgtcggccgagatcgcccaggtcggcaccatcgccgccaacggcgatgcaaccgtcggcgcgatgatcgccaaggcgatggacaaggtcggcaatgacggcgtcatcaccgtcgaggaagccaagaccgccgaaaccgaactcgacgtcgtcgagggcatgcagttcgaccgtggctatctcagcccgtatttcgtcaccaatgccgacaagatgcgcgtcgagctggaagagccctatgtgctcatccacgagaagaagctcggcaatctgcaggcgatgctgccgatcctcgaagcggtggtgcagagcggcaggccgctgctgatcatctccgaggacgtcgaaggcgaagcgcttgccacgctggtcgtcaacaaattgcgcggcggcctcaaggtcgcggccgtcaaggcgccgggcttcggtgatcgccgcaaggcgatgctggaagacatcgcggtgctgaccgcaggccagatgatttccgaggatctcggcatcaagctcgaaaacgtcaccatcgagatgctcggccgcgccaagcgtgtgctgatcgagaaggacaccaccacgatcatcgacggcgccggcaccaaggcgaccatccaggcgcgcgtcgcccagatcaagggccagatcgaggagaccacctccgactacgacaaggagaagctgcaggagcggctggccaagctgtcgggcggcgttgccgtcatccgcgtcggcggcgtcaccgagtcggaagtcaaggaaaagaaggaccgcatcgacgatgcgttgaacgcgacgcgcgcggcggtcgaggaaggcatcgtgcccggcggcggcgtcgccctgctgcgcgcaaggtcggcgctgtcgggcctcaacggcgccaatgccgatgtcaccgccggcatttcgatcgtgctcagggcgcttgaagcgccgatccgccagatcgccgagaattccggcgtcgagggctcgatcgtcgtcggcaagctcgccgacagcaaggaccacaatctgggttttgacgcccagaacgagacctatgtcgacatgatcaaggccggcatcgtcgacccggcgaaagtcgtgcgcaccgcactgcaggacgccggctcgatcgcagcacttctgatcaccgccgaagccatgatcaccgacatcccggccaaggatgcggcgcctgccggcggtggcggcggcgggatgggcggctactaa

SEQ ID NO: 35604 - DNA, 315 bp, Mesorhizobium loti
atgaagtttcggccactccacgaccgcgtcgtcatccggcgcgccgaaggcgataccaaatccaagggcggcatcatcattcccgacaacgccaaggaaaagccgcaggaaggcgaagttatcgccgtcggccccggcgcacgcgacgaaaacggcgcgcttgtgccgctcgacgtaaaggccggcgacctgatcctgttcggcaaatggtcgggcaccgaggtcaagatcgacggcgaggaccttctgatcatgaaggaagccgacattatgggcgtcatcgacaagagcgtcgaagccaagaaggccgcctga

SEQ ID NO: 35605 - DNA, 813 bp, Mesorhizobium loti
atgagcacagtcatcgttgtcggccacgttaatcacgaccaggtctggtcgctgtcagcgcccctcgcctcgggctcgcgcctcacctattccgatcgtgttgtcaggcttggcggcggcggctttcacaccggcacccagctggcgaagctcggcaacgatgtccggctgatcagcaatctgatggacgacgaccatggccgggcggcactcgccaagttgcaggcgagcggcatcgataccggctacgtcaccatgtggaccggcgaaacccggttcaccgaaatcctgcttgagccgaatggcgagcgcacaattttgaaccccggcggccagttgcgccctcccttcgccgcaccggagcctgtcagcggcgacgccgcctatctcaacgccctggtgctcgacgatggtctcgttgcctcgctgcggacgatcccgcttgtcatctcgcagtttccgttgcgcagcccatcgcaccgcccggccgacatcgtcatcggatcgcgcgccgactttcccggcgaggacgtgcaagggatctgggagcgagcgtcaaggattgccgggccccgcctgaggacgctggtgctgaccgatggaatgcggccgatctcgctctatgacggcaaggcgctcaatcatgtcacgccgctgaagcaggtctcagtgcccgacacgatcggcgccggcgactgtttcaccgggatcttcctgcacggcctgctgcaggggctaatccctgagctttccgctgaacaggcaagccagcaaaccgccgaatggctgtcggaacgatcacgtaccggctga

SEQ ID NO: 35606 - DNA, 1497 bp, Mesorhizobium loti
atgacgctgagcttcgacccgagggcgaaggccacgacgctctaccatggcgaattccggccgatgttcatcggcggcaagtgggtcgcggcgcagtccggccaggaaatgcaggcgctgaacccggcgacgggcgaggtgctgaccacggtgccgcgcggcggggccgccgatgttgacgctgcggtggccgccgcacgtgcggccttcgaagggccgtggtcgaaattctcgccctatgaacggcaatgcgtgctgttgcgcatcgccgatctgttcgagacgcattgggaagaactcagcgtttccgacacgctcgacatggggctgccgatcacccgcacgctggccaaccggcgccgcgttatcggcatgctgcgcttctatggcggcatggcgacggcgctgcatggcgaggcgatcgacaattcgatccctggcgagatcgtctccttcacaaggcgcgagccggtgggtgtcgtcggtgcgatcatcccctggaacgcgccgaccgccgcctcgatctggaagatcgcaccggcgctggcgacaggctgcaccatcgtgctgaagccctccgaggaggcgtcgctgacgccgctgctgatcgcgcgtctgatgcaggaagccggcgtgcccgacggcgtcgtcaacatcgtcaccggcaccggggcggaggccggcgcgcggctcgccgaacatcccgacgtcaacaagatcgtcttcaccggttcgacgctgaccggacaggcgatcgcgcgggcgggtgtgaccaatcttaaacgggtttcgctggaactcggcggcaagtcgccgatcatcgtctgccgcgacgccgacatcgacaaggccgttccggtcgcggcgatggcggtgttcgtgcattcgggccagatctgcatcgccggctcgcggcttttcgtggcgcgtgaaatccacgacgagttcgtgcgccgcgtcgcggaattcgctggcaggctgcgcatcggccacggcatcgaggcggaaaccgaaatcgggccgctgatcaatgccaggcaggccggcaaggtggaaggctatatcaaggccggcagtgacgagggcgcgaaactggtcgccggcggctcgcggctgacgggcgcgctttatgacggcggcaacttcatcgcgccgaccgtcttcggttcggtatcggacaagatgaccattgcacgcgaggagattttcgggccggtcatttcggccatgcccttcgacacgctcgatgaggtcgtggcgcgcgccaatgcgacgccttatgggctggcggccggcatcttcaccacgcatctgggcaccgcgcacaaactggcgcgccgcatcagggccggctcggtctgggtcaacatgtaccatgccatcgacccggcggtgccgttcggcggcatgaagatgtccggctatggccgcgaaggcggcatcgagcatctgcatgagtatctggagaccaagtcagtctggatccagaccgactga

SEQ ID NO: 35607 - DNA, 2838 bp, Mesorhizobium loti
atggaacagcgccgatcgtcgcagagtttcaagcgcaaggaactggttgcaaagctcaatcccacggggttgcgcgccttcaaggctgccgcggacacggcgaagatgcgcggcaacccctatgtcgagctcgtccatttcgtccagcaactggtgctgtccgagcgttcggatgtgcagatgatcgttgccgatgccgggctggatgtcagccggctgacggccgatatgacccgcgccatcgacaagcttccctacggcgcgacctcggtggaggaattctccgatcacatcttccacgccatacaggaaggctggagcctggccacactggaattcggtgtcgaggaggtgcgcagcgcgcatattcttctcgcctgtctgaagacaccggcgctggaagggctggtttcgaaaatcagcgccgaattcgacaagatcgatgcggacggggtcatagcccgcttcgccgacgtcactgagggctcgctcgaagccggttcacctccggccgcagctgcggccgaaacaccgatgaaacgcggtttgggcggggattcggcactcgccaaatacgccaccgacctgacccagcgtgcccgcgacggcaagatcgatccggttatcggccgcgatcccgaaatccgccagattgtcgatatcctgatgcggcgccggcaaaacaacccgatcctgaccggcgaggcaggtgtcggcaagacggcggtcgtcgagggctttgccttgcgcatcgcccagggcgacgtgccgccgacgcttcaaaatgtcagcgtacgcatgctcgatgtcgggctgatgcaggcgggcgccagcgtcaagggcgagttcgaaaagcggctgaaggccgtcatcgacgaggtccaggcctcggagacgccgatcatcctcttcatcgacgaggcgcacacgctgatcggtgccggcggcgcggcgggaaccggcgatgcggccaatctcctcaagcccgcgctcgcgcgcggcgagcttcgcaccatcgccgccacgacctgggccgaatacaagcaacatatcgagaaggatccggcgctgacccgtcggttccaggtggtcaagatcgaagagccttccgaaacggtggccgtgctgatgttgcgcggtgtcgccggtgttctcgagcagcaccacaaggtacagatcctcgacgaggcgatcgaggcctcggtttcgctttcgcaccgctacattccggccagacagctgcccgacaaggcggtcagcctcctcgacacagcctgcgcccgcgttgccgtctcgcagcacgctacgccggcggaggtcgaggacattctgcggcgccgccaggcgctcgaggtcgaggaaggcatcatcggccgcgaggcggcgatcggcatcgaagtggtcgacagacaggctcgcgtggaggccgggttggcggaaaccgagaccacgcttgcggcagcgcaagcacgctgggatcgggaaaaggcgctggtcgccgagattctcgatctgcgcgccaaactccggggcgagggcgtgccgcttgacgcggtggagggcggggaagccgctccgggcgaggccgtcgatgcgccagctgccacgtcgcatgaaaggaaggcgcctgaggccaaaacgccgaaacccgagacggctgaacccaagggctcgaagagcaagtccgcgaaaacaaaggcggcaaagatggaggccgttgctgcgcacgagcctgttcctgtgccggattccgctgcagatctggctcgactgcgcgaattgatggcggaacttgccgaggcgcagggcgagaccccgctgatcctgccgtcggtcgatcgcaatgccgtggcggccgttgtccaggactggaccggcattccgacgggacggatgctgtccagccagaccgagaaggcgctcaagctcgccgccaccttggctgagcgcgttgtgggtcaggaccatgcgatggagatgatcgcgagacgtgtgcagaccagccgcgccggcctcggcgcgccggagaagccggtcggcgtgttcctgctttgcggcccctcgggcgtcggcaagaccgagacagccctggcgctggccgaaacgctttatggcggcgagcagaacctgatttcgatcaacatgtccgaattccaggaggcgcacacggtctcgacgctgaagggcgcgccgcccggttatgtcggttatggcaagggcggcatcctgaccgaggccgtgcggcgcaagccctattcggtgatcctgctcgacgaggtcgagaaggcgcatccggacgtacacgagatcttcttccaggtcttcgacaaggggatgatggacgacagcgaaggccgccggatcgacttcaagaacactctgatcctgctcacctcgaatgtcggctccgaggttatcatggaccgcacgaagaacggcaccttgcgcaccggcatggacgatctggacaccgccttgcgcggcccgctgctgaaagtgtttccggccgctttcctcggccgcgtggtgacgatcccttactatccgctctcggacgcgatgatcgaggcgatcaccaggcaccagttcggcaagatcgcgcgccgcctcaaggcaaccaacgatgccgagctggtgatcggcgacggtgtcatggacatggtcaaggcgcgctgcaccgagatcgaatccggcggacgcatgatcgacgcgatcctcaccaacacgctgctgccggaactcagccgcggcgtgctcaatcgctcgctggagggcaagaagatgacaaaagtcaccgtcggcgcctcgtcggaaggatttacctactccttcgaatag

SEQ ID NO: 35608 - DNA, 315 bp, Mesorhizobium loti
atgacgttccgtccattgcatgaccgtatcctggtccgccgcatcgaagccgaggagaagacggccggcggcatcatcatccccgataccgccaaggagaagccgcaggagggcgaggtgattgccatcggcccaggcgcccgtgacgagagcggcaagctcacgcctctcgacgtcaaggcgggcgatcgcatcctgttcggcaagtggtccggcactgagatcaagctcaacggcgaggatctgctgatcatgaaggagagcgacgtgatgggcgtgatcgagcagaccgcgacggtcaagaaagccgcctga

SEQ ID NO: 35609 - DNA, 1629 bp, Mesorhizobium loti
atggctgccaaggaagtgaaattccattccgacgcccgtgagaagatgctgcgcggcgtcaacatcctcgccgacgcggtgaaggtgacgctcggccccaagggccgcaacgtcgtcatcgacaagtcgttcggcgccccgcgcatcaccaaggacggcgtcaccgtcgccaaggaaatcgagctcgaggacaagttcgagaacatgggcgcccagatggtccgcgaggtcgcctcgaagaccagcgatctggccggcgacggcaccacgactgcaacggtgcttgcccaggcgatcgtcaaggaaggtgcgaaggccgtcgcctcggggatgaacccgatggacctgaagcgcggcatcgataaggccgtcgaagcgattgttcaggagttgaagaccaacgcccgcaaggtgaccaggaatgacgagatcgcccaggtcggcaccatctcggccaatggcgacgccgagatcggccgcttcctggccgaggcgatgcagaaggtcggcaacgaaggcgtcatcaccgtcgaggaagccaagaccgccgagaccgaactcgaagtcgtagagggcatgcaattcgatcgcggctatctcagcccgtacttcatcaccaatcaggacaagatgcgcgtcgaactcgaagagccctatgtgctgatccacgagaagaagctgtccaatctgcaggcgctgcttccggtgctggaggccgtggtccagtcttccaaaccgctgctgatcatcgccgaggatgtcgagggcgaggccttggccaccctggtcgtcaacaagctgcgcggtggccttaaggtcgctgccgtcaaggcgcccggcttcggcgaccgccgcaaggcgatgctggaagacatcgccatcctgaccggcggcacggccatcagcgaggatctcggcatcaagctggagaacgtcacgctggagatgctgggccgcgccaagaaggtggtgatcgagaaggagaacaccaccatcgtcgacggcgccggttcgaaggacgagatccagggccgcgtcagtcagatcaagtcgcagatcgaggagactacctccgactacgacaaggaaaagctgcaggagcggctggccaagctcgccggcggtgtcgccgtcatccgcgtcggcggctcgacggaggtcgaggtcaaggagcgcaaggaccgtgtcgacgatgccatgcatgcgacgcgcgctgcggtcgaggaaggcgtgttgccaggtggcggcgtggcgcttctgcgtgccgccaaggcactggacagcgtgcaggccgagaatgaagaccagaagcacggtatcgagatcgtgcgccgcgcgatcgaagcgcccgtgcgccagatcgccgagaacgccggcgcggaaggctcgatcatcgtcggcaagctgcgtgagaaaccggagttcggctggggctggaacgcacagaccaacgcgttcggcgacctctacaacgagggcgtcatcgacccggtgaaggtggtgcggaccgcgctccaggatgcggcatcggttgccggcctgctggtaacgacggaagcgatggttgccgagaagccgaagaaggaacccgccgttccggcaatgccggctggtggcatggacttctga

SEQ ID NO: 35610 - DNA, 771 bp, Mesorhizobium loti
atggataaggtcgtggtagtcaccggagccgcgagtggtattggcaaagagatagcccttaccttcgcccgcaagggggcaaaggttgtcattgcggatcttgacctagacgcggccgaggagacggcccgtgagatcgatccggccgctctgcgcgccctcggcgttggcatggacgttagcaacgaggatcaagtcgagagcggaatatcgcgggttgtcgaaaccttcggacgcatcgacgtccttgtcagcaacgctggcgtccagaccgtcgcgccgctcgtcgaattcgatttcgacaaatggaggaagttgctttcgatccacctggatggagccttcctgaccacccgtgctgccttgcggcaaatgtaccgacagaacagcggcagcatcatttacatgggatccgtccactccaaggaggcgtctccgttcaaggctccctatgtcaccgccaagcacggcttgattggcctggccaaggtcgtggccaaggagggcgccgcccatggcgtccgcgccaacgtgatctgccctggattcgtccgcacgccgctggtggaaaaacagatcccggaacaggcgcgcgagctcggaatctctcccgaagacgtggtcaagacaatgatgctgagggaaacggtcgacggtgaattcacgaccgtgcaggacgtcgcggaaacagcgctgttccttgcggcgttcccgtcgaacgcactgaccggccagtcgatcgtggtgagtcacgggtggttcatgcagtag

SEQ ID NO: 35611 - DNA, 669 bp, Mesorhizobium loti
atgtctcttcgtatcgccgacaccgcgcccgatttcgccgccgaaaccacccacggcccaatcagcttccacgattggctgggcaattcatggggcatcctgttttctcatcccaaggattttacccccgtctgcaccactgaactcggttacatggccaagctgaagcccgagttcgacaagcgtaacgtcaagatcatcgggctttccgtcgatccggtcgagcgtcatgccggatgggctgatgacattgccgagacccagggacaggcgccgaatttcccgatgatcggcgacccgatgctggccattgccaagctctacgatatgctgcccgccacggccggcgacagcgccgaggggcgcacggcggcagacaaccagacggtgcgccatgtctacgtcatcggacccgacaagaagatcaagctgatgatcgcctatccgatgaccaccggccggaacttcgacgagatcctgcgtgtggtggactccatgcaactgaccgccaagcatcgcgtcgccacgccggtgaactggcggccgggcgacgacgtgatcatcgcgggttcggtttcgaacgacgaagccaaggtgctctaccccgatggctggaagcagcccaagccgtatatccgcatcgtgccgcagcctcacagcaacgcctga

SEQ ID NO: 35612 - DNA, 2250 bp, Mesorhizobium loti
atgacttctcctctgaggcagacacggttcaagatcggcggcatggactgcgcttcctgcgcggccaagatcgccacggcggtgcgccgtcttgacggtgtcgcggatgtctcggtttcggtgaccggcgccagcatgacggtcagccatggcggtccgctcaatgacgacaaggtgctgcggcaggtggcgtggctgggctacggcatcgtcaaggcggaggccaggaccgatgggccggcggccaaggcgcatgaccatgccgctcacgatcacgaaggccatgaccatcaaggtcacgaccatgaaggccatgaccatggcggcggccaagaaatcaccaaagaggccgctggggcatcccatctgcatagccacgccgaacccgggcaggtgtggtggcgcagccgccgcgcggcgatgacgctggcttgtgcggtagcgcttctcgccgcctatagcatctgtcatctgtttccttcggctgagcgctgggttttcctggctgcattgctggtcggtctcgtgccgatcgcgcggcgcgcgctgatggcggcgctggccggcacgccgttctcgatcgagatgctgatgaccatcgccgccgctggcgccgtgatgatcggcgcgacggaagaagccgccgccgtggttgtgctgttcctgatcggcgagcttctggaaggggtcgccgcgggccgggcgcgggccagcatccagggcctggccgacctggtgccgaagacggcgctggtcgagcggggcggcggcacggtcgaagttcccgccgaacagcttgccgtcggcgccgtcatcgttgtgcggccaggcgaccgcatcccggccgatggcgagattgtggaaggctcgagtgacatcggcgaggcgccggtgaccggcgaaagcacgccgaagcgcaagggtgtcgcggaacccgtcttcgccggcacgatcaacagcgatggcgtgctcaaggcgcgggtgacggcggccgcttccgacaacaccatcgctcgcgtcgtgcggctggtggaggaggcgcaggaggccaaggcgccgaccgagcgcttcatcgaccgcttctcgcgcatctacacgccgggcgtgctggcagtcggcgcgctggtggccgtgctgccgccgctcgtcgccggcggcgactggaacgaatggatctacaagggcctggcgattcttttgatcggctgcccctgcgcgctggtcatctcgacgcccgccgcgatcgccgccggtctcgcgaccggtgcacggcgcggcctgctgatgaagggcggcgcggtgctggaaggctttcgccggatcacggcggtcgccttcgacaagaccggcacgctgaccgtgggcaagccagtcgtcaccgacatcgtcgcctttggccgcgacgagcgcagtgtgctggcgttggcggcggcgctcgaacagggctccagccatccgctggcggtggcgatcctggacagggcgagagccgacaaggcgccggtgccgccggcttttgccgccaaggcgatctcgggcaggggtgtcgagggcagcgtcggcggcgtggccgtcttcctcggctccggcccggcggcgggcgaacgcgccgacataacgcaagcgcagcgcctggccgtcgacagcctcaacggccagggcaagaccgtgtcggtgctggtcgccgatggcgtggtggccgggctgatcgccatgcgcgacgagccacggccggatgcggcggccggcatcgcggccctcaaggcagaaggcatccgcgcggtgatgctgaccggcgacaaccgccgcactgctgaggcaatagccgcttcgctcggcatcgaggcgcgggcggaattactgccgcaggacaagcagcgcatcgtcggcgaattgcagggcgaggggctgacagtggccaaggtcggcgacggcatcaatgacgcgccggcgctcgccgccgccgatatcggcatcgccatgggcggcggcaccgatgtggcgctggagacggcggatgcggcgatcctgcatggccgcgtcctggacgttgcccgcatggtgcggctgtcgcgggccgtgatggccaatatcagccagaacatcaccgtggcgctggggctgaaggcagtgttcctggtcaccaccatttcaggcatcaccggcctgtggccggcgatcctggccgacaccggcgccaccgtgctggtcaccgccaacgccatgcgcctgttgcgctggcgcgggtga

SEQ ID NO: 35613 - DNA, 1197 bp, Mesorhizobium loti
atgacgcccgcctgggccaccgaaaagccgaccgcccttctggtgctggccgacggcaccgtcatcgagggtcggggcctcggcgccaccggttccgccgtcgccgaagtctgcttcaacaccgcgctcaccggctaccaggagatcctcaccgacccgtcctatgccggccagatcgtcaccttcaccttcccgcatatcggcaatatcggcaccaatggcgaggacatcgaggacctcaatccggccgcccgcgccggcgctgtcggcgccgtgttcaaggccgatgtcaccaacccgtccaactaccgcgccgccggccacctcgaccagtggctgaagaagcgcggcatcgtcgcactctcgggcatcgacacccgcgcgctgaccgcgctgatccgcgaaaagggcatgcccaatgccgtcatcgcgcatgcgccggacggtgtcttcgacctcgacgatctgaagcaacgcgccgccgcatggtcgggcctgatcgggctcgacctcgccaaggaagtcacgtcgggccagtcctcggtctggcgcgagacgccttgggtgtggaacgaaggttttggcgagcaggccgagccgtcgctgcacgtcgtggccatcgactacggcgtcaagcgcaacatattgcgcctgcttgccggcctcggcgccaaggtgactgtcgttccggcaaacaccggttcggaagaaatcctcgccatgcagcccgacggcatcttcctctccaacggccccggcgacccggaagccaccggcgactatgccgtgccggtcatccaggatctgctgaagaccgacattccggtgttcggcatctgcctcggccaccagatgctggcgctggcgctgggcggcaggaccgccaagatgcaccagggccatcacggcgccaaccatccggtcaaggaccacaccaccggcaaggtcgagatcgtctcgatgaaccacggctttgccgtcgacgccgactcgctgccagagggcgtcgaggaaacccatgtctcgctgttcgacggctcgaactgcggcatcgcgctcaccggccgtccggtgttctcggtccagcatcaccccgaagcctcgcccggcccacaggattcccactatctgttccgccgcttcgtcaacctgatccgcgagaagcgcggcgaggaacagctggccgagcgggtctga

SEQ ID NO: 35614 - DNA, 921 bp, Mesorhizobium loti
atgagccatgacggccgcatcgcgctgaccagggacggggtatcgctgtcgcggctggtcttcggcgcctggcgcctgctcgacggcggtgtccgcccggatgccgatcaggtcgcgcggctgattggcaccgccgtcgatctcgggctgaccagtttcgaccatgccgacatctatgggaattacgaggtggaagcggcgttcggcgccgggctgtcgcgctggaggggcaagcgcgatcagatcgagctggtctcgaaatgcgacatcatgctgccctcggccaaccggccgcaaaaccggctgaagcattacgacaccagcgccgcccacataaccgcatcggtcgaccgctcgctcgccaatctcggcaccgactatctcgacctgttgctgctgcaccggccggacccgctgatggacgccgacgagacggcggcggcactggccgggctggtcaacgcgggcaaggcgagggcggtcggcgtttccaatttcacgccgtcgcaattcgatctcctggcctcgcggctgccgttcgcgctcgccaccaaccagatcgaaatgtcggtgctgaagacgtccgcattgaccgacggcagtctcgaccacgcgcagcgtctggcctacgcgccgatgatctggtcgccgctcggcggcggctcgctgttcaccggcaaggaaggccgggaagcacgggtgcgggcagcgctcgcggcggtggccgccgaggtcggcgccggcgatctcgccactgttgccatcgcctggctgttgcggcatccggcccggctggtgccggtgctggggtcgatgaagccggaacggctggcggccatggtcaaggcgctggagatcagtctcgaccgccagcaatggttcgccatactggaggcgagtgaaggccggccagtggcgtaa

SEQ ID NO: 35615 - DNA, 795 bp, Mesorhizobium loti
atgagtggacaggcaaacaagggcacggcggtcgtcaccggcgcgtcgtctggcatcggcgcgatctatgcggacaggctggcagggcagggctatgatctcgtgctggtagcgcggcgcgccgaccggctcgaggaactggccgagaagctgcgttacgcctacgaccgcaaggtcagcgtgatcagcgccgatctctccgacgacgatgatgtgcgccgcgtcgagcaggcgatatcggccgacgacagcgtgacgctgctggtcaacaatgccggccttggcggccagcaggtggtggcaacggccgacgccgacgcggccgaacgcatgatcaaggtcaatgtcatcgccttgacccgtttgacccgtgcggtgctgccgggtcttctggcgcgcaaccgcggcgccatcgtcaacatcgcctcggtgctcgcctatgaaacctcgttcggcggcatctacagcggcaccaaggcctatgtcgtcaacttcaccgaggcgctgcaccgcgaggtggcgggtactggcgtgaaggtgcaggtggtgcttcccggcgcgacccggaccgatttctgggaactggccggcagcgatatcgaccagcttccgaaggaaatcatcatgtccgccgacgatatggtcgatgccgcgcttgtcggcctggccaggggcgaagccgtcaccgtgccggcacttgccgatgccgccaagctggacaccttcctcggcgcccgccaggccttttacggcagcctgcacgccgacaagccggcggcgcgttacgcggcttga

SEQ ID NO: 35616 - DNA, 3504 bp, Mesorhizobium loti
atgccaagacgcaccgacatcaagtcgatcctgatcatcggggccggccccatcgtcattggccaggcctgcgagttcgactattccggaacccaggcctgcaaggcgctgaaggaggaaggcttccgcgtcatcctggtcaattccaacccggccaccatcatgaccgacccggaactggccgacgccacctatatcgaaccgatcacgccggaggtggtcgccaagatcatcgccaaggagcggccggacgcgctgctgccgaccatgggcggccagaccgcgctcaacaccgctttgtcgctgcgccgcatgggcgtgctcgaccgctacaatgtcgagatgatcggcgccgacgccacggccatcgacaaggccgaggaccgcgcgctgttccgcgaggcgatgagcaagatcgggctggaaacgccgaagtcgatgctggccaacgccaccgacgtcaagaacgccgaccgcaagacgcacgaggcggagcgcgccgcactcaaggccgagaagcctgacaatctcgacgccgaactcgacgcgctggaaacccgctggaacctcggcgaaggcgaccgcaagcagcgctatatcagccatgccatggcgatcgccgcccaggcgctcgaccatgtcggcctgcccgccatcatccgcccctccttcaccatgggcggcacaggcggcggcatcgcctacaacagggccgaattctacgacatcgtccagtccggcctcgacgcctcgccgaccaccgaagtgctgatcgaggagagcgtgctcggctggaaggagtatgagatggaggtcgtccgcgacaaggcggacaattgcatcatcgtctgctcgatcgaaaacatcgacccgatgggcgtgcatacgggtgactcgatcaccgtcgccccggcgctgaccctcacggacaaagaataccagatgatgcgcaacgcctcgatcgcggtgctgcgtgagatcggcgtcgagaccggcggctccaacgtgcagttcgccgtcaacccggccgatggccgcctcgtcgtcatcgagatgaacccgcgcgtctcgcgctcctccgcactcgcctccaaggcgaccggcttccccatcgccaagatcgccgccaagcttgccgtcggctacacgctggacgagttggagaacgacatcaccggcggcgcgacgcccgcctcgttcgagccgtcgatcgactacgtcgtcaccaaaatcccgcgctttgccttcgaaaaattccccggcgccgagccggtgctgacgacagccatgaagtcggtcggcgaagtcatggccatcggccgcactttccaggaatcgctgcagaaggcgctgcgtggcctggaaaccggcctcaccggcctcgacgagatcgaaatccccggcctcggccacggggcgacggttgccaaccacgccgacgaccgcaacgccatccgtgccgcgctcggcacgccgacgcccgacaggctgcgcatggtggcgcaggcgatccgcatgggcacctcgctggaagacgtgcacgcaatgtgcaagatcgacccgtggttcctcgaacagatcgccggcatcctggccatggaagcccgcatccgcgagcacggcattccgcaggatgccgtcaatctgcgcatgctgaaggccatgggtttctccgacgcccgcctggcgtcgctgaccaggaccgacgccgaagtggtcacgaagatccgcgaaaaactcgacgttcatcccgtctacaagcgcatcgacacgtgtgccgccgagttcgcctcgcccaccgcctacatgtactcgacctatgaagtgccgtttgccggtgcgctcgccaacgaggcacaggtctcgtcgcgcaagaaggtcgtcatcctcggcggcggcccgaaccgcatcggccagggcatcgagttcgactattgctgctgccatgctgccttcgcactgcgcgatgccggctatgaagcgatcatgatcaactgcaacccggagacggtctcgaccgactacgacacgtcggaccggctctatttcgatccgctgacggcggaggacgtgctggagatcctgcgcgccgagcaggcctcgggcgaactgttgggcgtcatcgtccagttcggcggccagacgccgctgaagctggccgacgcgctggagaaggccggcatcccgatcctcggcacctcgcccgacatgatcgatctggccgaagaccgcgaccgcttccagaagctcctgcacaagctcggcctcagccagccgaagaacggcatcgcctattcggtcgagcaggcccgcctcgtcgccggcgagctcggcttcccgctggtggtgcgcccgtcctatgtgctgggcggccgcgccatgcagatcatccatgacgagagcatgctgcagagctacctgctcgacaccgtgcccggcctggtgccggaggacatcaagcagaaataccccaacgacaagaccggccagatcaacacgctgttgggcaagaacccgctgctgttcgacacctatctctcgggcgccatcgaggtcgatgtcgactgcctctgcgacggcaaggcgaccttcgtctccggcattctcgagcacatcgaggaggccggcatccattcgggcgacagcgcgtgctcgctgcccgtgcactcgctgccttcggagctggtcgacgagctggagcgccagacggcggccctcgcccgcgcgctcaatgtcggcggcttgatgaacgtgcagtacgcgatcaaggacggcacggtctatgtgctggaggtcaacccgcgcgcgtcacgcacggtccccttcgtcgccaagaccatcggtcgtcccatcgcgaaaatcgccgcccgcatcatggccggcgagacgctggaagacgccttcgcccattacggcgccatgcccgaccccagaaatcccggccacatcgcggtcaaggaagccgtcttccccttcgcccgcttccccggcgtcgacatattgctcggaccggaaatgcgctcgaccggcgaggtcatgggccttgaccgcgattttgcgctcgccttcgccaagagccagctcggcgccggcgtcgacctgccgcgctccggcacgctgttcgtctcggtgcgcgacgaggacaagaaaggcatattgccggcggtcaagcgcctggccggcctcggcttcaaggtgctggcgacctcaggcacgcagcgctttctcgccgaaaacggcgtggtggccgaaaagatcaacaaggtcctcgaaggccgcccccacatcgaagacgccatccgcaaccgccaggtccagatcgtcttcaacaccacggacggccagaaggcggtgtcggactcgaagtcactgcgccgggcgacgctgatgcagaaggtgccgtattacacgacactgtcgggtgcagccgcggtggccgaggcgatcgcggcgctgaaggcgggcagcctggaagtcaggccgctgcaggagtattttgcttaa

SEQ ID NO: 35617 - DNA, 570 bp, Mesorhizobium loti
atggaaacgacaccgtcgatcacagccggccacgcagtgttagaaacagtgatcggtttcatgggcatcgcctggagcgaaaagggcctgatccggctctgcctgcccgaacgcagccgtgaatcagtggagcggcggctgatgcgccatgccggcgtttccgcctccaccgcgcagccgccatgggtggtcgagctgattgcctcgatcaaggcttacgccgcgggcgaggacgtcgatttctccaatgtgccggtcgatctcgacggcgtcgacgatttccgcctggccatctatgacgcggcacgcaaactcagctatggcgagacaaccacctatggcgaactcgccaagcgcgccggccatgccggcctgccgcgcgagacgggagcggcccttggcgccaaccccgtgccgctggtcatcccctgccaccgcatcctggcggccggcggcaagatcggcggcttctcggcgcccggcggctccgtcaccaaggaaaagatgctggccatggaaggcgtgcgcgtcggcccgccgccgccggcgcaggtgtccttcggcttctga

SEQ ID NO: 35618 - DNA, 789 bp, Mesorhizobium loti
atgaccatcaaagctgatccgatcgagttcgcgggaaagcgtgtgctcatcagcggcggcaccaagggtctgggccgcgccaccgttgaccgcttccttgccggcggcgcccgagtgatcacctccgcccgcggagccctagatcccgttgatggtgtcgagttcgtccaggcggacctgacgacggccgagggcggcgaagccctggccaaggcggcgctcgatcgtctggggggcgtcgacattctcgcccatgtgctcggcggctcgaccacgccaggcggcggcttcgtcgccttgaccgacgactactggctatccgaactgaacttaaacctgctggccacggttcgtcttgatcgtctcctgatcccgcagatgatcgcgcggggcgccggcgcggtggtgcatgtcacctccatccagtccgtcctgccgcttcccgaggcaaccactgcgtacgccgccgccaaggccgcactccggacctacagcaagtcgatttccaaggaactggggccgaagggcgtgcgggtcaacgccgtgtcccccggttggatcatgaccgaggggaccgaggtgtttttggaacgtatccaagccgccaacggcggcacgctagaggacgcgcgccagctcgtcctggacggccttggcggcattgccatcggacgcggagccgaaccattcgaggtcgccgaagccatcgccttcctggcctcggatcgcgcctcttcgatccatggttcggaactcgtcgtcgacggcggcacggtcccgactgtctga

SEQ ID NO: 35619 - DNA, 609 bp, Mesorhizobium loti
atgatactctacagcatgatcgacagcggcaattgctacaagccgcgcctgctgatggccaagcttggcctggccttcaccacgatcgaggtgagttcgcatacaggcgagacgcgcaaggccgacttcgtcgccaagaacccgaacgccatggtgccgctgctcgaactcgacgacggccgccggctggccgaatccaacgccatcctgctctatctcgccgaaggcacacgcttcctgccggcggacaaatatgagcgcgggcttgcctatcaatggctgttcttcgagcagtacagccacgagccttatatcgccgtgcgcaaggcgctgctgaccttccccgaacgcgccagggatgcgacgcccgaacggctggcgatgacgctggagcgcggccacaaggcgctcggcgtgatgaacagatatctggagaacaacgccttcttcgccgggaacgccttcagcgtcgccgacatcgcgctctatgcctacacgcatacggccgagcaaggcggcttccagctcgacgcctatccggccgtcgtggcctggcttggccgcgtcgaggcggatccggggcatgtgccgatcgagtgggtgggttga

SEQ ID NO: 35620 - DNA, 1203 bp, Mesorhizobium loti
atggcctttcttgccgacaccctttcccgcgtaaagccttccgccaccatcgcggtgacgcagaaagcgcgcgagctgaaaaatgccggccgtgacattatcggcctcggcgccggcgaaccggatttcgacacgcccgacaacatcaagaatgcggcgatcgaagccatccgccgtggcgaaaccaagtacccgccggtttcgggcatcgtgccgctgcgcgaggcgatcgcaaaaaaattcaagcgtgagaacaatctcgactacaagcccgagcagaccattgtcggcaccggcggcaagcagatcctgttcaatgccttcatggcgacgctgaaccccggcgacgaggtcatcatcccccgcccctactgggtcagctaccccgaaatggtggcgatctgcggcggcacgtcggtgttcgccgacacctcgatcgagaatggcttcaagctgacggccgaagtgctggaaaaggcgatcacgccgaagaccaaatggctgctgatgaactcgccgtccaacccgtcgggcgcggcctacacgcaagccgaactgcgcgcgctggccgacgtgctgttgaagcatccgcatgtctggacgctgaccgacgacatgtacgagcacctgacctatggcgacttcgccttcaagaccatcgccgaggtcgagccgaagctctatgagcgcacgctgaccatgaacggcgtgtcgaaagcctatgccatgaccggctggcgcatcggctatgccgcgggtcccgtccagctgatcaaggcgatggacatgatccagggccagcagacctcgggcgcctgcaccatcgcgcaatgggcttccgtcgaggcgctcaacggcccgcaggatttcatcgccaggaacaaggcgatcttccagggccggcgcgacctcgtcgtctcgatgctcaaccaggcgcgcggcatcacgtgcccgtcgccggaaggcgccttctatgtctatccgtcctgcgcccagctgatcggcaagaagaccaaggccggcaaggtgatcgacaccgacgaggccttctgttcggaactgctcgaggcggaaggtgtggcggtggtgttcggctctgccttcggcctcggccccaacttccgcatctcctatgccacgtcggatgcactgctggaggaagcctgcacgcgcatccagcgcttcacggcatcgctgacctga

SEQ ID NO: 35621 - DNA, 1023 bp, Mesorhizobium loti
atgagcacccaaatcaaccgatcctggcaaatgagcggtttcggcctgtccaggctgagccaggtgacgggcaagatgccgcaacccgggccgcacgagcttctggtgcgcacgaaggccgtgtcgctgaactacaaggacagactgatcgtggacggcacgctgatccccgagctcacctttcccttcgtgccgacatcggatgccgtgggtgagatcgtcgctgtcggcagcgcggtcagccgcttccaggtcgggcaacgcgtgctcggccaggtcatcgccgactggccggatggcgacgcgccgcccgtgccgcacaagcacacgctggggtcctcgctgccgggcatgctttcagaccatgtggtctttggcgaggacgccgccgcgctggcgccgccgtcgctcagcgatatcgaggcggcaacgctgccgatcgcggccttgagcgcctggtttgcgatggccgaggcgacaaggccggtggcgggccagaccgtcctcatccagggcactggcggcgtgtcgctgtttgcgctgcaattcgccagggcgttcggcctgcgtgccatcgtcacctcgagcagcgacgacaagcttgaacgggcaaaaaatctcggcgcctggcaggtgatcaactatcgcacccggccggcatgggacgaggccgcacgtgaactgaccaatgggttgggggtgaaccatattctggaaatggtcggcggcgacaatgcgcggcgatcgctgaacgcgctggccgcgggcggccggctgtcggtcatcggcctcttgggcgcgatggagctcaatttcccgatcgtgccattcatgcgcaaccgcattgtcgtgcagggtctgtcgatcggccatcgccgggccttcgagcggatgaaccaggcgatcgaggcgctcggcatcaagccggtcatcgacaaggtctttggcttcgacgaggtgccgcaggccctccagcatctcgagaaggggccgttcggcaagatcgtgatcagcacgacctga

SEQ ID NO: 35622 - DNA, 1617 bp, Mesorhizobium loti
atgcagatctatgacttcatcatcgtcggctccggctcggccggctcggtgctcgccgagagactgtcggcctcgggccgcttctcggtgctggtgctggaggccggcggcacggaccggcgcttctacgtgcagatgccgctcggctatggcaagaccttcttcgacccggcggtcaactggaactacaagacggaagccgatcccggtctcggcggcaatgtcgaccactggccgcgcggcaagctgctcggcggctcgagttcgatcaacgccatggtctggattcggggtgcgcgcgaggatttcgacgactggcgcgccgccggcaatcccggctggagctatgacgagctgttgccgatcttcaaggcgctcgaggacaatgaggccggcgccgacagatggcgcggcaccggtggtcccctgcacatcagcgatacggccaacgccgtccacccgctgacaaagcgttatctcgccgccggccagcaggccggcctgccgctcaaccccgatttcaacggcgctgcccaggaaggcgtcggcacctaccagatctcgaccaagaacggccgccgcatgtccgccgcgcgcgccttcctgcgcccggcgatgaagcgcggcaatgtccgcgtcgagaccaacgcgctggccagccgcatcctgttcgaaggcaaacgcgcggtcggcatcgaatatctgcagaacggtcagacgaagacggcgcgggccggccgcgaggtgatcctctccgccggctcgatcaactcgccgcagctgctgcaattgtcgggcgtcggcccctcggcgcttctgaaagggctgggcatcgctgtcgtccacgccaacgagaatgtcggtgcgcatctgcaggaccatgtcggcatcaactacaccttcaagggcaaggtgccgacgctcaaccagatcctgcgtccctggtggggcaagctgctggtcggcatgcagtacatactgacgcgctcgggaccgctgtcgctgtcgatgaaccatggcggcggtttcttccgcaccgacccggcgttctcgcgccccaacatgcagctctatttccaggccttctcgacggtcatcccgaagagcggcgagcggccgatcctgacgccggacccatggccgggcttctccatcggcctgtccaattgccgcccgtcgagccggggcgagatcatgatccgctccagcaatccgctggactatccgaagatcaccgccaatgcctattctaccaatgccgatgtcgaggagatgctggcggcggtgaagttcgtgcgcaagatcgcctcgatgccagcgttggcggaaatcatccaggaggaagtcctgcccggcccgtcgatccagtcggacgccgacctgatcaccgatttcaggaaacgctccggcactgtctatcacccggtctcgacctgccgcatggggcccgatcccacgcgcgccgccgtcgatccgcgtctgaaggtgcatgggcttgaaggcttgcgcgtcatcgacgcctcgatctttcccgacaacatcaccggcaacaccaacgccgcctcggtcatgaccgggtggaagggtgccgaactggttctggaggaccaaaaatga

SEQ ID NO: 35623 - DNA, 726 bp, Mesorhizobium loti
atggtggccaatcgcggcgaggatccgaagtttttggcgcagcgattcgatcgcttccagatcatggtctacaacaaggacgtgctggacgaccgcaacaagcgcgccttccttttgactccgcgtgaggaattcgtgctgccgcagaatctggggcgcgcctacgaccatgccttcctcgacatcggctatggcgtgacgatttcgggtccgcacctggtcgggcggatgacgacggcgatcgacgtgcaattcggcgaggccgtactcgagatcggcaccggttcgggttaccagtcggcctatctcgccaacctcaccgacaaggtgcacacgatcgagatcatcaatccgctggcgcagcgcacgcggcgcacctatgacgggctggtcgagcgcggctacagcgaattcggttcggtcaccagccgcaatgccgacggctattatggctgggaaagcgtcggcccgttcgacaagatcatcgtcacctgcggcatcgaccacattccgccgtcgctgctgcagcagttgaagcccaatggcgtgatggtcattccggtcggcccgccgggcgcgcagcacgtgctcaaggtgaccaagcagcagctcgcggacggcacgttcaacatcgtccgctcggacatctacaatggcaaggtggtgccgttcgtgccgttcaccaagctggaaggcgaccagatcgtcggcacgcacaacagctga

SEQ ID NO: 35624 - DNA, 936 bp, Mesorhizobium loti
atgaaactcttcgcgggcaattccaacagggtgctggccgaagcggtcgcccgctatctcaacatcccgctgggcaaggccactgtcaggcgcttcgccgaccaggaaatcttcgtcgaaatccaggaaaacgtgcgcggcgaggatgtcttcatcctgcagtcgacctcgtttccgaccaacgatcatttgatggaactgctcatcatgatcgacgccttcatgcgctcctcggccaagcgcatcacggcggtgattccctatttcggctatgccaggcaggaccgccgggcgtcgggccgcacgccgatctcggccaagctggtcgccaacatgatcacccgcgccggcgtcgaccgcgttctgacgctggacctgcatgccggccagatccagggcttcttcgacatcccgaccgacaacctgttctcggtgccggtgatggcccgcgacgtgaaggcgaaatacaagcagctcggcaacgtcgtggtggtgtcgcccgacattggcggcgtggtgcgggcgcgggcgcttgccaagcgcttcgacgcgcagctcgccatcgtcgacaagcgccgtgagcgcccgggcgaatcggaagtcatgaacattatcggcgcggtcgccggcaaggactgcctgctgatcgacgacatcgtcgattccggcggcacgctgtgcaatgccgccgatgcgctcttggccaacggtgccaccagcgtcaccgcctatatcacccatggcgtgctgtcaggcggcgctgtggcccgtatcagcggctcgaaactgcaggaactggtgatcaccgattccatccagccgacgcaaggcgtgctcgacgcccccaacatccgcgtcatctcgatcgccgacctgatgggcgaagcgatctcgcgcacggcaaccgaggagtcggtgtcgagcctgttcgactaa

SEQ ID NO: 35625 - DNA, 546 bp, Mesorhizobium loti
atgaaaccttcgctcgaagacacgctgctggcttcgatccgcaccattccggattacccgaagcccggcatcctgtttcgcgacatcaccacgctgcttggcaatgcgcgcgctttccgccgcgccatcgacgaactggtgcatccctatgccggccagaaggtcgacaagatcgccggcatcgaggcgcgcggctttatcctgggcggcgccgtcgcccaccagctttcggccggtttcgtgccgatccgcaagaagggcaagttgccgttcgacacggtgcgcgtcgcctacagtctggaatacgggctggacgagatggagatgcacaaggatggcgttgccccgggcgaaaaggtgatcctggtcgacgacctgatcgccaccggcggcaccgcggaagcggcggtcaagctgctgcgccagatcggcgccgatattcttgccgcttgcttcgtcatcgacctgccggatcttggcggccgcgccaagctcgaggcgcttggcgtgccggtaaggacgctgatcgggttcgagggacactaa

SEQ ID NO: 35626 - DNA, 1881 bp, Mesorhizobium loti
atgacagccatctatcgctggttcgagaactgggtctatccgttcagggagccggcgaatcttcggccgccatcgagcgtcggcggctttctctggcactatgtcggccaggcgaagttcgccttcttcgccatgctggtcatcggcggcatcgctccgctggtcgaggccggcctgttctacttcgttgggcggctggtcgatatacttgaccagcttcccggcgaacgcagctggcacgcgctgtggaccgccgccggccccgaactggtgttcatgatcgcggtcgtgctggtcatccgcaccatcgtcgtcggcctgtcggcgctggtcgacgagcagacgatcacgcccggcttctacaatctggtgcgctggcaggcgcaccggcatgtctcgcgccagtcctacgccttcttccagaacgatttcgccggccgcatcgcgacgaaagtctggcaggcgggccaagcgaccggcgacctgatggagagcttcatcgaggtcatctggttcatggtcgtctacacagtgacgacgctggcgctggtcgccggactggatctgcggctggcggtgctggtggtgatctggatctccgccttcggctggctggcgaagctctatctgccggcgatccgaaagcatgccgaggcgaccgccgaggccggctcgatgatcaatggccgcatcgtcgattcctattccaacgtgcagacgctgaagctcttcgcggccgacggcgacgaccgctacatccggaacggcttcgacatctatctcgacgcgctgcgccccttcacccgccggctgaccggcgtgcgtatggcgctgacgacactgtcgggcatcatgatcacgacgatcggttgctttgccgtctatctctgggtcgaaggctcgatcaccgtcggcgcggttgccttcacgctgtcgctggtgctgcggctcaacatgctgctcggccgcgtgatgatgcagctcaacggcatattgcggaacctcggtgtgctggagaattccaaggcgctgatctcgcagtcgctcgggcttgtcgatgcgcccgacgccagggagcttgtcgtggccggcggtcgcatcgacgtgaagggggtcgagttccactatggcaaggggttcggcgtgctgaacggcatcgacctggtcgtgcggccgggcgaaaaggtcgggctggtcgggccttcaggtgccggcaagacgactctcgccaatctgatcctgcggctctacgacctggaaggcgggtccatcaccatcgatggccagaacgtcgccaaagtcacgcagaattcgctgcgcgccaatattggcgtcgtcagccaggatacggcgctcttccaccgttcgctgcgcgacaacatcaagctcggcatgcccgacgcgaccgacgccgcggtgatcgcggcggcgaagaaagccgaggcgcatgacttcatcctgggcctgcgcgacaaccgggaccgcgccggctacgaggcctttgtcggcgagcgcggcgtgaaactgtcgggcggccaacgccagcgcgtggcgatcgcccgggtcttcctcaaggacgcgccaatcctgatcctcgacgaggcgacgtcggcgctcgattccgacatcgaggcggcgatccaggagaatctcgcccggctgatggagaacaagacggtcattgccatcgcccaccggctgtcgacgatcgccgcgctcgaccgtctggtggtgctggacggcgggcgtatcgtcgagcaaggcacgcatgacgagctggtggcgctcgacgggctttatgcgcggctgtggaagcgacagtctggcggcttcctctatcacgaggaaagcgtgctcgaagagacgcggccggcggagtag

SEQ ID NO: 35627 - DNA, 1887 bp, Mesorhizobium loti
atgttgttgttcagctggtttgaaagaaggctcgatccgttccccgcggcggaaccggtcgagccgcccaagacgctggtagccttctgcctgcattatacgcgcggcgcctggcgctatatccttgtcgacgcggtgctggtggcggccatcgccatcgcggaagtgtggatgttcggcttcctcggccgcatcgtcgactggctgtcggggcagaatcgcgaaaccttcctgcaaacggaaggctggaagctcgccggaatggccttcatcgtgctgttcgcactgccgggcacggtatgggtgcattcgctgcttaaccagcagacgctgatgggcaactatccgatgcgcatccgctggcaggtgcaccgctacctgctcaaccagtcgatgagcttctaccaggacgagttcgccggccgcatcgccaccaagctgatgcagaccgcgctcgccgtgcgcgaatgcgtcatcaaggtgatcgacgtgctcaactacgtcatcgtctatttcctcggcatgctgttgatcgtcggctccgccgactggcggctggccgcgcctctggcggtctggctggtcggctacatcttgctgctgcgctacttcattccgcgcctgggcaaggtcggcgaggagcaggccaatgcgcgctcgatcatgaccggtcgcgtcgtcgacagctactccaacatccagacggtcaagctgttcagtcatgccaagcgcgaggcgactttcgccagggaaggcatgatgggcttcctcgacacggtctaccggtcgatgcggctggtgacggtgcttttcggcacgctctacattctgaatgccttgctgctgttctccgtcaccgccatttcgctgtggctgtggatggggcaagtggtgacgatcggcgcggtcgccgtggtcatcggcctggtgctgcggatgtggggcatgtcgcagtggatcatgtgggagatgtcgggcctgttcgagaacatcggcacggtgcaggacggcatcgcctcgatctcgctgccgcggctggtcgaggacaggccggattcgaaggagatcgccgtttccaggggcgagatccgcttcgaggatatacgcttccactatggcaagcagaaaggcgtgatcgaaaacctgtcgctgacggtgaaaccgggcgagaaggtcggcattgtcggccgttcgggcgccggcaagtcgacgctggtcaatctgctgttgcgcttctacgatctggaaagcggccagatcctgatcgacggacaggagatcgccggcgtgaagcaggattcgctgcgcgcccagatcggcatggtcactcaggacacctcgctgctgcatcgttcggtgcgcgagaacatcctctatggccggcccgatgcatcggacgagatgcttgtcgaggcggcgcggcgggccgaggcgctggacttcattggcgggctcgcggatcacaatggccgaaaggggttcgacgcctatgtcggcgaccgtggcgtcaaattgtccggcggccagcgacaacgcatcgccattgctcgcgttatgttgaaggatgcaccaatacttatccttgacgaggcgacgtcggcgctggattccgaggcggaagctgccatccaggagaacctctacaagctcatgcagggcaagaccgtcatcgccatcgcccaccggctgtcgacaatcgcggcgatggacaggcttgtggtgatggatcagggccgtgtcatcgaggaaggttcgcatgacgaactggtcgccaagggcgggctctacgcgcagctctggcagcgccagtcgggcgggttcctgctggaggacatcccggccgatgtcgccaatgacgtgatcgcgaaggggcaagccgcagaatga

SEQ ID NO: 35628 - DNA, 861 bp, Mesorhizobium loti
atgaaggcccgcctgtggttcgaggcgcttcgcgaacgcatctgcggcgctttcgagcagatcgagcaggatctccagggccctctcgcctcatggtcgccgggccgtttcgaaaagacgccttgggaacgcgatgccggcaaggggggcggcggcaccatgtcgatgatgcatggccgcgtcttcgagaaggtcggcgtccacacctcgacggtttacggcgagttctcgcccgaattcaggaagcagatgcccggtgccgaggaagacccacgcttctgggcctccggcatctcgctgatcgcgcacccctggaaccccaacgttccggccgtgcacatgaacacgcgcatggtggtcacctcgaggcaatggttcggtggcggcgccgatctgacgccggtgctcgaccgccgccgcacccaggacgaccctgacacgatagccttccatcgcgccatgcagttcgcttgcgagaagaacgtcgccgtcgccgaccacccgaaattcaagacttggtgcgacgagtacttcttcctgccgcaccgcaacgagccgcgcggcgttggcggcattttcttcgactggctgcattctggcgaggacagaggcggctggaacgccgacttcaacttcgtccaggacgtcggacgctccttcctcgtcgtctacagccacctcgtgcgcgccaacttcaacgagaactggacggatggcgaccgcgacgaacagctcatccgccgtggccgctatgtcgaattcaacctgcttcacgatcgcggcaccatcttcggcctgaagaccggcggcaatgtcgcctcgatcctgtccagcctgccgccggaggtgcgctggccgtaa

SEQ ID NO: 35629 - DNA, 1377 bp, Mesorhizobium loti
atgacggcaaagactttcgacgccatcatcattggcgccggccaggccggcacaccactcgccggcaggctgaacgcagccggcatgagcgtggcgctgatcgagcgcaagctggtcggcggcacctgcgtcaacaccggttgcatcccgaccaagacaatggtggcgagcgcctatgccgcgcatctggcgcggcgcgccaccgattatggcgtgacgctcggtggccctgtcggcgtcgactacaaggcgatcaaggcgcgcaaggacaaggtttcgggcgcctcccgcaccgggctggaaagctggatcgccggcatggacaaatgcacgctctatcgcggccatgcgcgcttcgaatccgccaatacggtgcgcgtcggcgacgaccttctgaccgccgacaagatcttcctcaacaccggcggccgggcttccgtgcctgatttgcccggcatccacgacatcgactatctgaccaattcctcgatgatggatctcgaggtcctgccgcgccacctgatcgtcgtcggcggcagctacatctcgctcgaattcgcgcagatgttccgccgtttcggcagcgaaatcaccgtcatcgagaagagcccgcgcctgaccggccgcgaggacgaggacgtctcggcaaccatcctgtccatcctcgaaaatgaaggcattacggtccatgtcggcgccgacgacatcggcttcgccaaacagggcgacgatatcgccgtgaccttctcggccggcaagccgccggccgtcggctcgcatgtgctgctggcgctcggccgaacgctcaacaccgacgatctcggcctcgacagagccggcgtcgccgtcgacaagcgtggtgccattatcgtggacgaccagctgcgcaccagcgtcccaggcatctgggcgatgggcgactgcaacggcaagggcgccttcacccacacctcctacaatgactacgagatcgtcgccgccaacctgctcgacaacgacccacgcaaggtcagcgaccgcatcgaggcctatgcgctctacatcgacccgccgctcggccgctgcggcatgaccgaggcggcagtgaagaaatccggacgccgcgcgctggtcggccagcggccgatgacccgcgtcggccgcgcggtcgaaaaaggcgagacgcaaggcttcatgaagatcctcgtcgatgccgacacgcggcagatcctcggctgttccgttctcggtcccggcggcgacgaggcggtgcattgcgtgctcgacctgatgtacgccaaggcaccggtcgacacgcttgcgcgcgcgacgcacatccaccccactgtctcggaactgctgcccaccattgcccaggagctgaagccgctggcctga

SEQ ID NO: 35630 - DNA, 783 bp, Mesorhizobium loti
gtgccagccaccaatacgctcagcatccccgatctcgccggcaaggcggtgcttgtcaccggcgcctcgaccggcatcggtgcggccctcgcgctggcctatgccgcacagaaatccaaagtggcgctgcactacaattcgagccaggaggccgccgagaaactcgccaagaccattcgtgacagcggcggcgaggtgttcctcgtccagggcgatttttccgttccagccgatgtcgagcgggtcgtcgaggacagcgcccagcatttcggccgcctcgacgggctggtgaacaatgccggcggcatgctcggccgcataccctatgccgaacagaccgaagcgcattacgatgccgtgatggacctcaacgcgcgttccgtgctgaccgcctcgcgcaaggcgatgccgtggctgaagaagcagggcggcttcatcgtcaatacctcgtcgatcgccgcgcgcaacggggccggcggcggcgccggcctctacggctccgccaaggcgttcgtctccaatgtgacgcgtggcatggccaaggaactgatcggcttcggcatccgcgtcaacgccgtggcgcccggcacgatcctgacacccttccatgagcgctattcgaccgacgagcagatcaagggcatggtcgcgaccattccacagggtcgggccggcacggcggaggactgcgtcggcgcctatctattcctctcgtcgaaccttttgagcggctacatcaccggccaggtgatcgaggtgaacggcggccagttgatgccgtga

SEQ ID NO: 35631 - DNA, 762 bp, Mesorhizobium loti
atgaacccgaacggccagatcgcgatcgtcaccggcggcggctccggccttggcgaggcaacggcgcgcgcgcttgccgccaagggtgcccgcgtcgccatcttcgatgtcggtatcgagcgcgcggccaaggtcgcggccgacatcggcggcatttccgtccaatgcgacgtcagcagcgccgacagtggcactgcggccctcgccgagacagcgagcaagctcggcgagccacgcatcctggtcaattgcgccggcatcgccattggcgtgaagaccatcggcaaggacggaccgcatccgctcgatcaataccgcaaggttatcgaggtcaatctgatcggcaccttcaacatgatccgcctcgtcgccgaccgcgccgccagcctcgagccgctgcagggcggcgagcgtggtgtcatcgtcaacaccgcttcggtcgccgcctatgacggccagatcggccaggccgcctactccgcttcgaagggcggcgtggtcggcatgaccctgccggtggcgcgcgaccttgcccgttccggcatccgcgtctgcaccatcgcacccggcatcttcaagacaccgatgatggccggcatgccgcaggaggtgcaggattcgctcggcgccgccgtgcccttcccgtcccgtctcggcgaaccatccgaatatgcggcacttgccttgcacatcatcgaaaaccagatgctgaacggcgaaaccatccgtctcgacggcgccatccgcatggcgccgaaatag

SEQ ID NO: 35632 - DNA, 1302 bp, Mesorhizobium loti
atgcgacggattgttgttacaggcatgggagcggtcacgcccctagctgccaatgtcgaagcgtcatggtcgcgtctgctggccggtcgttcgggcatccgtaggcttccggacgatgtggtgggagacctgccggcgaagattggcggcgtggtgccctccttggatgaagatccgggcgctggtttcgatcctgatggcatcctggctgcgaaggatcagcgcagggtagatcggtttattctctttgcgctggcggcggcggaagaggcgcttgcacaggcgaaatggaagcctgccttggagacggatcgcctgcgcacagcaacgattatcgcttcaggggtcggcggattccccgccatcaccgaggcggtgcgcacggtcgatctgcgtggcgcccgccgcctgtcgcccttcacggtgccgtccttcctggtgaacctcgcagcgggccacatctcgatccgtcatggcttcaaaggcccattgggcgcaccagtgacagcgtgcgcggccggcatccaggcgatcggcgacgccgcccgtctcatccgcgcgaacgaggctgatattgccgtgtgcgggggcacggaagcatgcatgaacaccgtcagtctcggtgggtttgctgccgcacgctccctttcaaccggcttcaattgggcgccggctcaagcctcacgtcccttcgacatttcgcgggacggcttcgtcatgggcgaaggcgccggcgtgctggtcatcgaggcgttgggccacgcgctggcgcgcggcgcaaaaccgctcgccgagctcgtcggctacggaacgacggccgatgcttatcacgtcacttctggtcccgaggacggcggcggtgcgcgccgggccatggagatcgcgattgcgcaagcagggatttcaccgagcgaggttcgtcatctcaatgcacatgcgacctccacgccagtcggcgacctgggtgaaatcgaagcgatcaagagcgtattcgggcgcgatttagcgatagctgtcagcgcaacgaaatccgcgaccgggcacctgctgggcgcggccggcgggcttggtgccatcttctcgatcctggcgatcagggaccaggtggcaccgccgacactcaatttgagcgcacccgatccggccgccgacggcatcgacttcgtcgcaaacgagccccggccaatggagatggaatacgcaatctccaatggcttcggttttggcggcgtgaatgccagcgccttgttcaggcgctggatcgccccggcggcccgacgcgagcgccaggggcagtcatga

SEQ ID NO: 35633 - DNA, 816 bp, Mesorhizobium loti
atgaacaagatcaatcctggcgtcgccctggtgacaggggcatcttccggcatcgggcgggctaccgccgacgccttgctcagcgcgggctatcgtgtattcggaaccggtcgtcgcacggcctccaaacaatccgacggcgttaccatgctgacctgcgacgtgaccgacgacacgtccgttgcgaaaatggtcgatgacgttttggccaaggccgggcgcatcgacctgctcgtcaacaatgccggcatgggtctgtttggaggtgcggaggagtcctcgaccgcccaggcccaggcgctgttcgatgtgaacgtcttcggcgttttccgcgtgaccaacgcggtgttgccggcaatgcggcgtcaaggaacgggcaggattgtcaatttgagctccgtgcaggggttaatcccagctccctatttcgcgctttacgcgtcgaccaaacatgccattgagggttattccgaatcgctcgatcacgaattgcgcccgttcggcattcgcgtgtcgttggtggagcccgcctatacccgtacgtcattcgaggacaatctcgccgcccccgatcagttgcttgatatttatgattccgcgcgcgctggcatgactgtagccgtgcggaaagcgatggaaaaaggcgatgcgcccgaagtggtagccaagaccgttttggcggctgcgaccgatcccgctcccaagaagcgctatgcggcgggcaaaatggcgcgccaggtcagtctcctgcgccgtttcgtccccgcgtccgcattcgacaaaagcctgcgaaagcagctcgggctgccggcctga

SEQ ID NO: 35634 - DNA, 2919 bp, Mesorhizobium loti
gtgaggaccacctgcccctattgcggggtgggctgcggcgtgctggcgaaggtcgccgcggacgggcaagtgtccgtccgcggcgaccccgatcatctcgcgaatttcggccggctgtgctccaagggctcggcactggccgagaccatcggcctcgacggcaggctgctccatcccgaaatccacggccgccggacaggctggaacgaggcgctcgacatcgtcgcctcgaccttctcccagaccattgccgagcacgggtcggatgcggtcgccttctatgtctcgggccagttgttgaccgaggattattacctcgccaacaagctgatgaagggttttgtcggctcggccaacatcgacaccaattcgcggctctgcatggcctcgtccgtcgccggccaccgccgcgccttcggctccgacacggtgccgggaacctacgaggatctggaacgcgccgatctcatcgtgctggtcggatccaacgtcgcctggtgccaccccgtgctctaccagcgcatcgccgccgcgcgggaaaagcggccggagatgaagatcgtgctggtcgatccgcgccgcaccatgacatctgatatcgccgacatgcatctggcgatcgcgcccgatggcgacgtcgccctgttcaccggcctgcttgcctggctcggccagcacaatgcgctcgaccgcgcctatatcacggcgcacacaaccggcttcgggcaagctcttttcgccgcatcggcgcttgaccttgccggggttgccgctgccacaggcctcagcgaagacgagctcggcggtttctacagcctgttcgccgcgaccgcgaagacggtcaccgtctacagccagggcgtgaaccagtcgtcgtccggcaccgacaaggtcaacgccatcatcaactgccatctcgccaccggccgcataggcaaaccgggagccggcccgttctcggtgaccggccagcccaacgccatgggcggccgcgaggtcggtggcatggccaacatgctcgccgcccatatggagatcgaaaatcccgaacaccgcgaccgcgtccagcgcttctggaatgcgcccggcatcgcgcaaaagcccgggctgaaggccgtcgagatgtttcaaggcgtggccgacgggcgcatcaaggcgctgtgggtcatggccaccaacccggtcgattcgatgccggacgcggacgccgtcgaagcagcaatcaaggcttgcccgttcgtcgtggtttcggatgtgctggccagcaccgacactgtccgtcacgcccatgtccggctgcccgccgccgcctggggcgaaaaggacggcaccgtcaccaactccgagcgccgcatctcgcgccagcggtcgtttctgtcggcgcccggcgaggcgaggcccgactggtggatcatcgcggaggtggcgcggcggatgggttttggcgaggcgttcgcgcacgagacgccggcggagatctttggcgagcacgccgcgctgtcggggttcgagaatgatggtgggcgggacttcgatattggggcttatgccggaattgatagtgtaagctacgcatcgcttgagccattccaatggccagcgccgagccaaggcacccccctctggcctgccggccatatcccccgcaaggggggagatcagccctcattgctgccttccccaatcgtcaacgtttcggaaagggtggcaggtccgaaactgccaatctccccccttgaggggggtgaggagtggtccgcgcagcggacggaaagccaattgcttggctttccgaacgacgaacgcccggagcgacagcgaagggctggcaccggtaggacagaggggggcgatcaagctcgacatttgcaacaagcgaacggcacgaccgaacgcgatcccacccgtttcttcgccaacggccatttctacacagccgaccgcaaagcccgcttcatcgccatccgtcccaccacggaaacccgcaccacccccgacttcccgctcatcctcaacaccggccgcatccgcgaccattggcacacgatgacgcgcaccggcaaaagcccgcgcctgtcccagcacatcgccgagccctttgtcgaaatccatcccctggacgcacagcaccacggcatcggcgacgccgacatcgtgcgtatctccagcccgcgcggcgacgtactggtccgcgccctgatcacgccacgccagcgccaaggcagcgtcttcgcgccgatgcactggaccgatcagttcgcggcaaaaggccggctcgacgcattgaccgcaccgctcatcgatccggtctcaggccagccggcgctgaaacatgtcgcggcccgcatcgagaaatttgccgcaaaggcctttgcgttcgccgtgatgcgccgccgtcccgaggcgattgccgctgactactgggcggttgccaggtgccggggcggatggcgggttgaacttgcctttgccaacgacgacgccgactggacagccttcgccggctcgctcttcgaggccccctcgaccgaaatgctcgcctatcacgaccgcgacgccggccagcaccgcatcgccgccttcgacggtgagcacctcacgggtgctttgttcgtcgcccggggcccggtcgcggtatcgcgcggctgggcggccgaacagctcgaagaggtccaggccagccagcgcgagcgcttcaggatcgtcgccggtcgtgccggtgccgaacggccggacgcgggcgccaccgtctgctcctgtttcagcgtcggagccaaccagatcgtggcggcagtggcagccggctgcacaaccgtcgaagccatcggcggcgcgctgaaggccggcaccaattgcggctcctgccggtcggagatccgcgccctcatccaggcgagccgcgttcaagcggccgagtga

SEQ ID NO: 35635 - DNA, 1515 bp, Mesorhizobium loti
atgaccattgcgaaggaaacggccgagcttttggcgaaactgggtgtggccaaggacgcacttgtcggcggcgacctgatcgtgcgcagtccggtgacgggcgaacagatcgcggcgctgaagaccatctcgccggccgatgcggccaagaccatcgatgccgcgcacaaggcgttccagtcctggcggctggtgcccggcccgaagcgcggcgaactggtgcggctgctcggcgaggaattgcgtgcgcacaaggccgagcttggccggctggtgtcgatcgaggtcggcaagatcccgtccgaggggctcggcgaagtgcaggagatgatcgacatctgcgatttcgccgtcggtctgtcccggcaattgtatggcctgaccatcgccaccgagcgtccgggccatcgcatgatggaaacctggcatccgctcggcgtggtcggcgtcatttccgccttcaacttcccggtcgcggtatggtcgtggaatgcggcactggcgctggtctgcggtgacgcggtggtgtggaagccgtcggaaaagacgccactgacggcgcttgcctgcgaggcgatcttcaagcgcgccgtcaagcgtttcggcgctgacgcgccgcaggggctggcgccagtactgatcggcgaccgcgccgtcggcgagatcctggtcgaccatcccaaggtgccgctggtttcggccaccggctcgacccgcatgggccgcgacgtcggcccgcgcctggccaagcgctttgcgcgcgccgtgctggagctcggcggcaacaatgccggcatcgtctgtccgaccgccgatctcgacatggcactgcgcgccatcgctttcggcgccatgggcacggctggccagcgctgcacgaccctgcggcgcctgttcgtgcatgagagcgtctacgatgccttggtgccgcgtctgaagaaggcctatcagagcgtctcggtcggcaatccgctggagacctcttcgctggtcgggccgctgatcgacaaggccgcctttgacgccatgcagaaggcgctgacggaagccgccgcccatggcggcaaggtggccggcggcgcacgcgtcgagaatggccacccggatgcctattatgtgcatccggcgctggtcgagatgccgaagcaggtgtcgccggtgaccgaagagaccttcgcgccgatcctctatgtgatgaaatattccgacttcgacgccgtgctcgacgagcacaatgcggtgggtgcgggcctgtcgtcgtcgattttcacccgcgacttgcaggaatccgagcgtttcctcggtgtcgacggttcggactgcggcatcgccaacgtcaatatcggcacgtcgggcgccgagatcggcggtgctttcggcggcgaaaaggagaccggcggcggccgcgagagcggctccgatgcgtggaaggcctatatgcggcgtgccaccaacacggtgaactattccaaggcgctgccgcttgcccagggcgtgtcgttcgacattgactga

SEQ ID NO: 35636 - DNA, 1197 bp, Mesorhizobium loti
atggccgccgacaagaatgcattcgtgtgggaagacccgttcctgatcgaggaccagctttcggaagaagagcgcatggtgcgcgacggcgcggcggccttcgccgccgacaagctcgcgccgcgcatcgaggatgcctatctcaatgaaaagactgatgccggcatctttcgtgagatgggtgaggccggcctgctcggcattaccatcccggaagagtatggcggcctcggcgccaactatgtgacctacgggctggtcgcgcgggaagtcgaacgcgtcgattccggctatcgctcgatgatgtcggtgcagtcgtcgctggtgatgtatccgatccacgcctatggctcggacgaacagcgcaagaaatatctgcccaagctcgccagcggcgagtggatcggctgtttcggcctgaccgagccggatgccggctcggacccgggcggcatgaagacgcgcgccgagaagaccgcgaacggctacaagctcagcggctccaagatgtggatttccaacgcgccgatcgccgacgtcttcgtcgtctgggccaagctgaaaggcgagaccggcaaggacgagatccgtggtttcgtgttggaaaagggcatgaaggggctgtcggcgccgaagatcggcggcaagctgtcgttgcgcgcgtcgatcaccggtgaagtggtgatggaaggcgtcgaggtcggcgaggacgcgctgctgcccaacgccaagggccttggcggcccgttcggctgtctcaaccgggctcgctatggcatctcctggggctcgatgggtgcggcggaagattgctggcaccgcgcccgccagtatggtctcgaccgcaagcagttcggcaagccgctggccggcacgcagctttaccagaagaagcttgccgacatgcagaccgagatcgcgctcgggcttcaggcatccttgcgcgtcgggcgactgctcgatgcaggcaagatggcgccggagatgatctcgatcgtcaagcgcaacaattgcggcaaggcgctcgacatcgcccgccaggcccgcgacatgcatggcggcaacggcatccagatcggctaccacgtcatgcgccacgcgcagaatttggagacggtcaacacctatgaaggcacgcatgacgtgcacgcgctgatcctcggacgggcgcagacgggtatccaggcgttcttttaa

SEQ ID NO: 35637 - DNA, 1401 bp, Mesorhizobium loti
atgtcgctcgaccggtcctccatccgtgcacccgaaaggcagctgcagccggcgcccgatgatcggctcgccgcactggaacgggttatcaggcgtttcagcaacaccgacgggctggtcaagcgtggcggtctcgtcaccgaagtcacgcagacgcactacaaggtgcgcggcctttccgatttcgccaggctgggcgacatggtcgagcagcgcggccaggccggctcgcgccgcggcgagatcgtcaagatcagtcgcgacgaggtcgtcgtcgctcccttcgaacgcagcgccgatgccggtatcggcgacgccgtgttccgcaggggtccgctcgcggttgggccgcacaattcatggcgggggcgcaccatcgatgcgctgacccgggcgatcgatggcggccccccgctgatcaggggcgaagacctgtcgggcggcgccacgacgcccggcgccatggcgcggcagcgcgtcggcaccgccttcatgaccggcgtcaaggtcatcgacatcttcacgccgctgtgcttcggccagcgcatgggcgtctttgcgggttcgggcgtcggcaagtcgacgctgctcgccatgctcgccggcgccgacgcattcgacaccgtcgtcgtggcgctgatcggcgaacgcggccgcgaagtccgcgaattcctcgaggacacgatcggcgacagcatggcgaagaccgtggccgtcgtagcgaccagtgacgagagcgccatgatgcgccggcgcgcgcccgacaccgccatgcgcgtcgccgagcactttcgcgaccagggccaccgcgtgctcctggtgctggattcgatcacccgcttcgcccatgcgttgcgcgaggtggcgacgggaaccggcgagccgccggtcgcccgcggctatcccgcctcggttttcaccgaactgcccaaattgctcgagcgcgccgggccgggggccgaaggcaaggggtcgatcaccgccatcatttccgtgctggtcgacggcgacgaccacaatgatccggtcgccgattccgtgcgcggcatcctcgacggccatgtcgtgctcgaccgcgcgatcgccgaacagggccgctatccgccggtcaatccgctgtcgtccatatcgcgcctggccggcaaggcctggagcgtcgaacagcgcgctttggtgacgcggctgaaatcgatgatctctcgcttcgaggacacgcgcgacatccgcctgctcggcgcctatcagggcggcgccgacgccgagctcgacatcgccgtgcgccaggtgccgctgatctacgaggcgctgacgcaatcgcccagggaccgcccgtcagccgatccgttctccgatctcgcccgccatctcaagggaaagctgaatgccgaatcaggagactga

SEQ ID NO: 35638 - DNA, 1134 bp, Mesorhizobium loti
atggctacccagcgcatcctcgacttcctcgccacccgacgtccgtccggcccctgcctcgtcgtcgacctcgatgtcgtgcgcgacaatttccgcgccttcgagaaggcgttgcccgattccaagatctactatgcggtgaaagcaaacccggcgccggaaatcctgcgcctccttgctgcgatgggctcgtccttcgacaccgcttccgttgccgaggtcgagatggcgatggacgcgggtgcgcccgcggaccgcatctccttcggcaacactatcaagaaggagcgtgacatcgcacgcgcctaccagctcggcatccgtctgttcgcggtcgattgcgtcgaggaggtcgagaagatcgcccgcgtcgctcccggcgcgcgcgtgttctgccgcgtgctgaccgacggcgaaggcgccgaatggcctctgtcgcgcaagttcggctgcgtgccggccatggccgtcgacgtgctgcgccatgccaagggcctcggcctcgacgcctatggcgtgtcgttccatgtcggctcgcagcagaccgatctgaccgcctgggaccgtgcgctcgccgacgccaagaaggtgttcgcgacgctcgccgaggaaggcatcgtgctcaagatggtcaatatgggcggcggtttcccgacgcgctatctgcgtgacgtgccggcggcccaggcctatggccaggcgatcttctcggcgctgcgcaagcatttcggcaatgccattcccgaaaccatcatcgagccaggccgcggcatggtcggcaatgccggcgtcatcaagtcggaagtcgtgctgatctcgaagaaggccgacaatgacaatgtgcgctgggtgttcctcgacatcggcaagttcggcggtctggccgagacgatggacgaggcgatccgctatcccctcgtcacccgccatgacggctcggagaccgcgccttgcgtgctcgccggaccgacctgcgattcggccgacgtgatgtacgagaagacaccgtatccgctgcctctgtcgctgaccatcggcgacgaggtgctgatcgaaggcaccggcgcctacacgaccacctactcggcggtcgccttcaacggcttcgagcctctccgatcctacgtgatctga

SEQ ID NO: 35639 - DNA, 747 bp, Mesorhizobium loti
atgggcaagctcaacaacaaggtcgccatcgtcaccggtgccgcgcgaggcattggtgcgggcatcgccaaacggctggcggcggaaggcgccgccgtcgtcgtcaactacgccaccagccgtgaggctgcagaacgcacggtcaaggagatcgtcgccgccggcggcaaggccaccgcggttcagggtgacgtggccgaggccgccgaagtcgagaagatgttcgaggccgccgagatcgcattcggtaagccaagcattctgatcaacaacgccgcgaccgccagctttggcactttcgaggaagccagtgaggcggattatcggcggctgttcgacaccaacgtgttgggcacgatcctgaccaccaaggcggcgatgcgccacttccccgagaccggcggcagcatcgtcaacatcggcacgatctcgagctggaacccggtgccgaacaccagcctctattccgccagcaaagcggcgatcgatacgttgacgcttagcctgtcgagggaactcggagcccgcaacatccgcgttaacatcgtggcgcctggctatacccataccgaaatgacagaaggcatggttggcaccgatttcggcaatatgctgatcgctggcgtcccccttggccagcgcttcggcaagccggacgacatcgctccgaccgtggccttcctcgcctcggacgaggcggcgtggctgaccggcgaacgcatcaacgcgtccggcggcgctcgctga

SEQ ID NO: 35640 - DNA, 2121 bp, Mesorhizobium loti
atgaagaagcttgccgccattgccgccctgtccgtatcgacgcttggcctgtcggccggcgcatcctttgccgactacacattgaacattctgcatttcaatgactggcacagccgcatcgaaggcaacaacaaatacgagtcgacctgttcggccgacgaggagaccaagggcgaatgcatcggcggcgccggccggttgatcacggcgatcgcccaggaacgcaagaagctcgaaggccagaacgtgctgctgctcaatgcaggcgacagcttccagggatcgctgttctacaccacctataaaggcaccgtggaggaggaattcctcaatcagatgaaacccgacgcggtgacgctcggcaaccatgaattcgacgacggcgagagcgccctggtgccttacctcgacaaggcgaaattcccgatcgtcagtgccaatgtcatgcccaacgacaagtccggcgcggcgggcaagatcaaaccgtcgatcgtcgtggaagtcggcggccagaagatcggcattgtcggcgccgtcaccaacgacacgcccgaactcgcctcccccggccccaacatcgcgatcgcggacgacgtcgagtcgatcaccgcggaagtcgagaagctcaaggcgcaaggggtcaacaagatcatcgcggtgacccatatcggctacaacagggaacgcgacatcatcgccaagatcccgggcgtcgacgtggtcgtcggcggccacagccatacgctcctgtcgaacaccgatccgaaggcggcgggcccctatccgacgatggtcgacaaccccggcggctacaaggtgccggtggtgcaggcggcctcctattcgaaatatctcggcgagttcaaggtggtgttcgacgacaacggcgtcgtcaagtcggcaagcggcgatccgatctttctcgacaagtcgatcacgcccgatcccgccgtgctcgcccgcatcaaggaactcggcgcgccgatcgaggcgctgaagaacaaggaagtggccgagaccaccgatgtcatcgacggcagccgcgagaattgccgcgccaaggaatgcgagatgggcaacctcgtctccgacgccatcctcgaccgcgtcaagggacagggcgtcgagatcgtcatctccaatggcggcggcctgcgcgcctcgatcgacaagggcaccgtcaccatgggtgaggtgctgaccgtgctgccgttccagaacacgctggcgaccttccagatttccggcaaggacctggtcgccgggctggaaagcggcctcagccagatcgaggacggcgccggccgcttcccgcaggtggcgggcctcaaatattccttcgacaagtcggtcgcgcccaatgccggccgcgtcaaatccgtcgaggtcatggagaacggcgcctggacgccgatcaagccagacaaggactatctggtcgccaccaacaattacgtccgtcagggcggcgacggctacaaggtcttcgccgaaagggccaagaacgcctacgactacggccccggtctcgaacaggtcgttgccgactatctcggcgcccaccggccctacacgcccaagctcgacggccgcatcaccgagatcgccgcgaccgtcgcggcggccccggcagcggaaccggcaaagccagccgaggcaaccccagcccccgcgccggcgcaacctgccaaaccggccgaggcagcgaaaccggctgaaccagcaaagcccgctgaagcggcaccggcaatgcccgaattgcccgccaactcgggcaacatcgccaacacgccgccagccatatcgacggaggcggcacctccgccagctcccgccactccagcacctgcgccagccgaaccggcgaaaccagctgaggctgcgcccgcaccagcggcaccggtgccagcggaacctgccaagccggccgaaccggcaaagcccgctgaagccgcacccgccacgggcagccatgtcatcgttgccggcgacacctattgggacctggccaagaaggcctatggcgacgccaccaagtggaaactcatctacgaggccaacaagggtcaaaggccacatcggcttacccctggcgcaacgttgaccatcccggcgaagtaa

SEQ ID NO: 35641 - DNA, 1062 bp, Mesorhizobium loti
atgacgtctgccatcgctgtcgatcccaaagccgccaagccggttggcgtgacggcggggcacgcaccggccggggccggcaaggtcggcgtcctgctggtcaatctcggcacgcctgacggcaccgagttcaagccgatgtggcgatatctcagggaattcctgtccgatccgcgtgtcatcgagctcaacaaggcgatctggtatccgatcctctacggcctggtgcttactacgcggccgaagaagtcgggcgccaactatgcccggatctggaaccaggagaggaacgagtcgccgctgcgcacctacacgcgcgcgcagtctgaaaagctggccgaggcgctgggcgacctgcccgatgtcaccgtcgattgggccatgcgctacggcaacccttcgacggcgagcgtcgccgaaagactggtcgcgcaaggctgcgaccgcattctttcgtttccgctctatccgcaatactccgcaacaacgacggccaccgccaacgaccagttgtttcgcgcgctgatgaagctgcgccgcgcgccggccatccgcagcgtgccgccctattatgccgagcccgtttacatcgaagcgctcgccagttcgatcgaacggcatctggcaacgctcgatttcgagccggaagtggtcatcacctcctaccacggcatcccgaaaccctattccgacaagggcgatccctatcaggcgcattgcctggaaacgacgcggctgctgcgcgaaaaacttggttgggatgagaagaagctgatcaccaccttccagtctcgcttcggcgcacaggaatggctgcagccctacaccgacaagaccgtggagaagctgggcaaggacggagtgaaatcgatcgccatcgtcaatcccggtttttcagtcgactgcatcgagacgctagacgaaatcggccgcgaggccgccgagacctttcatcacgccgggggcaagaatttcgctcacatcccttgtctcaacgacagcgccgaaggcatgacggtgatcgaggcgatggtgcggcgcgaactgtccggctgggtctag

SEQ ID NO: 35642 - DNA, 906 bp, Mesorhizobium loti
atgaagagagttcgcaaggcagttttcccggtcgccggtctcggcacgcggttcctcccggccaccaaggctgttcccaaggaaatgctgaccgtcgtcgaccggccggtcatccaatatgtggtggacgaggcgcgcgaggcgggcatcgagcatttcatcttcgtgaccggccgcaacaaggcggtcatcgaggaccatttcgatatccagttcgagctctatgacacgcttgcccagcgcggcaaggacgagcagctggcccgcctgcagcggctgcagccggcgccggggcagaccagtttcacccgccagcaggtgccgatgggccttggccacgccgtctggtgcgcccgcgaactggtcggcgacgagccgttcgcgctgctcttgcccgacatgatcatgcagtcggaaaagagctgcatgaagtcgatggtcgagctctacgaggaaaccggcaacaacatcattgccgtacaggaatgcgacccggcagaggcccacaaatatggcatcgtcggccgtggcgaggatacgcatcacggcttccgcatcaccgagatggtggagaagccgaaaaccggcacagcaccctccaacctctacatcaacggccgctatatcctgcagcccgagatcttcaagatcctcgaaggccaggaaaagggcgccggcaacgaaatccagctcaccgacgcgatgctgaagctggagaagcagcaggccttctacggctaccactatcagggccgcaccttcgactgcggttccccggaaggtttcgtcgaggccaatgtcgccttcgcgctgtggcgcagcgacatgaaggagaacatggccggcgtcatccgcacgcttcttgacgagatgacgccatcggagcggcgagtcgcggtatcttag

SEQ ID NO: 35643 - DNA, 978 bp, Mesorhizobium loti
atgacggaccttctccacgacacgccgcttttccatgaaactgagggcaatccgcgaccggaaaacgctaccggcggctttttcattacgcgcgaccgcaagaagatccgctatggcctcttcgcggcggtggcgcgcccgatgcggggcaccgtggtgctcctgtccggccgcaacgagtgcatcgagaaatatttcgaaaccatccgcgaccttgccgcccgcggctttggtgtcgccacgctcgattggcgcggccagggcgattccgaccggctgatccgcgatcgccagcgcggctatgtcaggtccttccgcgactacacggccgatctggagcagttcttcgaggagatcgtgctgcccgattgccgcgggccgtattacatcctcgcccattcagccggagcggtgatcgcgctgcttgccgcgccgtcgatggtgaaccgcgtgcggcgcatggtgctgatcgcgccattcctgacgttgcccgacctgccggtctcgatccgaacggtccgccgcgtctgttcggtcttctgcgctttggggctcggccggctctatgccgcctggggtccacggcccagacacacgctgccgttcgaggccaacaaggtaacgtcggatccgcggcgctaccgccgcaacacgcgcatctacgaagagtatccgcgaatggcgcttggcggtccgacgatccgctggctgcaggcggcggcgaaggcgtcggaagccatcagcgaccccgacttcatggcccgcatacaggtgcctctgctgatcatcgccgccggcgccgaccgggtcgtctcgaccagggcggtggaagcctatgccagaagcctgaggctcggttcgctgctgatgatcgacggctccaagcacgaaatcctgcaagaggtcgatctctaccgcgaacaattccttgccgccttcgacgccttcatccccggctcggacgacccgacggcctga

SEQ ID NO: 35644 - DNA, 1575 bp, Mesorhizobium loti
gtgtcgacgccttcaaggccaagcagatgccggtattctcaagaagctagagaaacagtcccgatgaacgcacccctcaacatcgccatgcccgccgaggcctcggcagcgccgaaaaattaccggctgctgatcgacggcaagcatgtcgatgcccgtgacggccgcacgattgcgcgcaagagccccggccacggcttcaccgtctcgcgctatgcgcaggccggcgaggccgaggtcgaagcggccgtgcaggccgcgcacaaagcgttcgagaccggaccatggccacgcatgaaggccggcgagcgtgccgcgatcctgttcagggcggccgatctgattgaggcgcggctggaagacatcgcccggctcgatgcgctggaatccggcaagccgatcgcccaggcgcgcggcgagatcggcggcgccgtcgacatctggcgctacggcgcctcgctcgcccgcacgctgcacggcgagagctacgccaatctcggcgacgcgatgctgggcgtcgttttgcgcgaaccgatcggcgtcgtctcgatcatcacgccgtggaatttcccgttcctcatcgtcagccagaaactgcctttcgcgctagccgcaggctgtacggcggtggtcaagccgagcgaaatgacttccgcctcgaccttcgtgctgggcgacatcctgctagaggccggcctgcccgccggcgtcgtcaacatccttgccggactgggcgccgatgtcggcgcgccgatggtcagccatcccctggtcgagatggtctccttcaccggctctacccgcgtcggcaagatgacaatggcgtccgccgcgcagtcgctgaagaaggtctcgatggaacttggcggcaagaacggccagatcgtctttcccgatgccgacctcgaggctgccgccgacgcggcggtgttcggcggtttcttcaatgccggcgaatgctgcaatgccggcagccgactgatcgtacacgaggcgatcgccgacgactttctcagcgccgtcaaggcgctcaccgccagggtgacggtcggcgacccgctcgacgatcaaaccaaggtcggcgcgatgatctcgtccgaccatctggccaaggtgacagattacgtcacggcagcggcaggcgaaggcagcaatgtctatagcggcggcaagcagctggcctcgaatgccggccaatatctcgaccccaccatcattcgtggcgtcaccgaggacatggccatcgcacgcgaggaagtgttcggaccggtgctctccgtgctcacttttgaatcgattgaaaaggcgttgcacatcgccaacaacacgccctatggtctgtccgcaggtgtgtggagcgccagcatcgacacttgcatgtcggtggcgcgtggggtgcgttcgggaacggtttgggtgaacacattcatggaaggttatcccgagctgcctttcggaggctacaagcagtccggtctcggacgcgaactcggcaaacgcgctgtcgaggactataccgaggaaaagacaatccagtttcatcgcggccagcgcaccggatggtgggtcggctga

SEQ ID NO: 35645 - DNA, 762 bp, Mesorhizobium loti
atgacccgccccgcagccatcgtcaccggcggcgcacgcggcatcgggctggcttgcgcggaagcgctggccgatgccggcttcgacattctggttgccgaccttgccgaacaggcgcctgacgggctcgacacagacatctcggctcgcggtgcgaaactcgcctatgtcagttgtgacgtcgccaatctcgacagccacgccgtgttgatcgatgccgcgatgcgcgtcttcggccgcatcgactgtctcgtcaacaacgccggcgtcggcgccgtggtgcgcggcgacctgctggaactgaagccggaaaatttcgaccgcacgctgggcatcaacctgcgcggcacggtcttcctcagccaggccgtcgccaaggcgatgctggccacactgggcgatcacacaagatcgatcatcaccgtcacctccgtcagcgccgaaatggcctcgccggagcgctccgaatactgcgtgtcgaaggccgggctttccatgtgggtgaagaacctggcgctgcggctcgctccggaaaacatcggcgtgttcgaggtgcggccaggcattatccgcaccgacatgaccgcaggcgtcaccgccaaatatgatgccttgatcgaaggcgggctggtgccggccaagcgctggggcgaagcgtcagacatcggcgcgatggtggcgacgcttgccgccggcaggctcggcttttcgaccggctcgatcatcaatgtcgacggcgcgctctccgtgccgcggctgtag

SEQ ID NO: 35646 - DNA, 1629 bp, Mesorhizobium loti
atgaccgactacatcatcgtgggcgccggcccggccggctgtgttctggccaaccggctgagcgaggaccccggcaattccgtgctgcttctggaagccggcggcaaggactggcatccctacatccacatgccggcgggcttcgccaagatgaccaagggcattgcgtcctggggctggtccaccgtgccgcagaaaaacatgaaggaccgcgtcttctggtacacacaggccaaggtggtcggcggcggctcctccatcaacgcccagatctacacacgcggcaatgcccgcgactatgacgcctgggagaaggaagagggtctcgccggctggggctaccgcgacgtgctgccctatttcaagcgcgccgagaacaaccagcgtttcgccaacgactttcatggcgaccaggggccgctcggcgtatcgaacccgatctcgccgctgccgatctgcgaagcctatttccgcgccggccaggagatgggcatccccttcaacccggacttcaacggcgccaaccaagaaggcgtcggctattaccagctcacccagaaggatgcccggcgctcctcggcctcggtcgcctatctcaagccgatccgtgcgcgcaagaacctgacggtcaggaccgatgtgctggtgacccgcatcgtcgtcgagaagggccgcgctgtcggcgttgaagtcgtcgaccggccaggcggcgagaagaagatcctgcacgccgagcgcgaggtgatcgtctcgtccggcgccatcggctcgccgaagcttttgatgcaatcggggatcggtccggccgaccacctgaaatcggtgggcgtgacgccggtgcatgacctgcctggagtcggctccaacatgcaggatcatctcgatctgttcgtcatcgccgaatgcactggtgaccacacctacgacaattacgccaagctgcaccgcacggcctgggccggcctgcaatatctgttgctgaagaaagggcccgtggcctccagcctgttcgagaccggcggcttctggtacgccgacccgacggccgcctcgcccgacatccagttccatctcggcctgggatccggcatcgaggccggcgtcgagaaactgaacaaccccggcgtcaccttgaactcggctttcctgcggccgcgctcgcgcggcacggtgcggctgaagagcgccgacccggccaaccatccgcttatcgatccgaactactggtccgatccctatgaccgcgccatgtcgatcaaggggttgcggctggcgcgcgaaatcatgcgtcagaaggcacttgagccctacgtgctgcgcgaagtgctgcccggtccgtcgctggctagcgacgacgaactgttcgactatgcctgccgcagcgcaaagaccgaccaccatccagtcggcacctgccgcatgggccatgacgagatggccgtcgtgacgccggacctgcggctgcgcggcatcgaaggcctgcgcgtctgcgacgcctcggtgatgccgcgcgtgccctcctccaacaccaatgcaccgaccatcatggtcggcgaaaagggtgccgacctgatccttggccgcgaaccgctgccgccggcggtgttttccggcaaccgggccgcttga

SEQ ID NO: 35647 - DNA, 1173 bp, Mesorhizobium loti
atgtccaaactcatctccaaatggaactaccccaccaccgtccgcttcggcgccgggcgtatcaaggaattgcctgaggtgctcgaggccaccggtatcaagcggccgctcttcgtcaccgatccgggcctggcgaaactgccggtcgtcgcttcgacgctgaagatcctcgacgatgccaaggtgccttacggtgtgttttccgaggtgaagccgaatccggtcgattccaacctcaccgccggcatcgccgtgttcaagaagggcaagcatgacggcgtcatcgccttcggcggcggctcggcgctcgatctcggcaagctgatcgccttccaggccggccagacgcggccggtgtgggatttcgaggatgtcggcgactggtggacgcgcgccaattcggatgcgatcgcgccgatcatcgccgtgccgacgacggccggcaccggctcggaagtcggccgcgccggcgtcatcaccaatgaggagacgcacaccaagaaggtcatcttccatccgaagctcttgccggcgatcgtcattgccgatccggaactgtcggtcggcatgcccgccttcatcaccgccggcaccggcatggatgcgcttgcccactgcctcgaggcctattgcgcgccgggttaccatccgatggctgacggcatcgcggtggaaggcatccggctggtgtttgaaaacctgccgaaggcctatgccaacggcaaggacctggtcgcgcgtgcccatatgatgagcgcggccgccatgggcgccgccgccttccagaaggggctgggcgccatccactcgctgtcgcacccgatcggcgcgctctacgacacccatcacggcatgaccaatgcggtgttcatgccttatgtgctcgccttcaatcgtgactccatcgaggagcgtatcgcccggctcgccgcctattgcggcatcaagggcggcttcgacggcttcgccaaggcgatcatcaagctgcgcaaggagttgaaggtgccgcacgcgctgccgggcctgatcaaggggctcgacatggacaagaagcgcaaggcgctgatcgccgacatggcggtggtcgatccgaccgccggcggcaacccggtcaagctgaccaagaaggcggcgctgacgctgctggaaaacgctatcgccggcacgatctga

SEQ ID NO: 35648 - DNA, 1389 bp, Mesorhizobium loti
atgaccgaaacggtcaagttgaaatcccccatcgatggctcgatctatgccgagcggcccgtggcaacggaccaggcggtcaatgccgcggtcgagcgcgccaaggcggcgcaggagaaatgggccgagacgccgatcgtcgagcgcggcaaatacatgctggcgatgctcgaagcgctggtcgcgatgaccgacgagatcgtgccggaaatcgcctggcagatggggcgtccggtgcgctatggcggcgagttcggtggcgtcaaggaacgcaccaattacatggtcgagatcgccgaacaggcgctgaaatccgtgccggcctcaaacccgaaggatgggtttcgccgttacgtgaagaaggatccgctcggcgtcgtcatggtgatcgcgccgtggaattatccttacctgaccgccgtcaacaccatcgtgccggcgctgatggccggcaacgccgtcatcctcaagcacgcggcgcagacgctgctggtcggcgagcgttttcagcaagccttcgacaaagccggcctgccaaagggcgtgttccagaatgtcgtgctcaaccatgctcagaccgaaaagctgctcggctccggcaagatcgaccatgtgaactttaccggttcggtcggcggcggccgcgccatcgaaagggcggcggccggcaccttcatgacgcttggcctcgagcttggcggcaaggacccggcctatgttctgcccgacgccaagatggaccatgcggtggccaatctggtcgacggcgccttctacaattccggccagtgctgctgcggcatcgagcgcgtctatgtccatgaaaaggtctatgacgagttcgtcgaaggcttcatcgccgagacgaaaaactatgtcgtcggcaatccgctggaacagacgacgacgatggggccgatggcgcaggcgcgtttcgccgacctgatccgcgagcaaaaggccgaagcgctgcgcaagggcgccaaggcgcacatcaacatgaagatggctaacgacaaggccggttcgccctatctggcgccggaagtgctgaccgaagtcgaccaccagatgagcgtcatgcgcgaggaaagctttggcccgatcgtcggcatcatgaaggtacgcaacgacgaggaagcgatcgcgctgatgaacgacagcgcctatgggctgacggcctctatctggacgcgcgataccgagcacgcggtggcgatcggcaaccgcgtcgagaccggcacggtgttcatgaaccgctgcgactacctcgatccggcgctggtctggaccggcgtcaaggacaccggaaagggcgcgggactgtcggccatcggctacgacaatctgacccggccgaaatccttccacctgcgcgaagccatctga

SEQ ID NO: 35649 - DNA, 783 bp, Mesorhizobium loti
atggaggtcatcatgaccaagacgccgttcaagacacttgaagataaggtcgcactcattacaggagcgagttccggcattggccgcgccaccgccgttgaactggcgcgccgtggggcaaaggtgattgcgagcgcccggcgcgcttttgaaattgaaactctcgtcgccgacatcaagaacgaaggctttgaagccaccgctgtggttgccgacgtcaatgtcgagcacagcgtgatcgacctggtcgccaaaacgatctcgacctacggccggatcgacatcgccttcaacaatgccggcaccgagggcatgttttcgccattcgtcgaccaaaccaacgaaacctatgacaccatcttcaacgccaacgtccgcggtgtcttctggtcgatgaagcacgaggcgaaggcgatgctggcccaggggggcggcgccatcatcaacaacgcctccatggggggcgtgatcggcttcgccaacgcaggcctctacatcgccagcaagcacgctgttctcggcctgacgaagaccgcgtcgatcgaactgttcaagcaaggcgtccgcgtcaacgccatcaatcccggcatcatcgacacgccgttccaggatcgcatctggccgagcgccgaggcaaaggacgcctttgccgcatcgaccgtaccaggccgggcggggtcgcccgaagagatggcggcagtcgtggccttcctcgcctcggatgatgcttcgttcgtctccggccacggcctgcttgccgatggcggctattcgatcgcctga

SEQ ID NO: 35650 - DNA, 1233 bp, Mesorhizobium loti
atgaatctcggcatgaccgagcggctgaagccgatccacgcgcgcgtcgcggccatggtacgtgacgagatcatgccgctcgacaaggaattcctgggcgaggtgggcaaggcgggcgaccgctgggtgtacagcccacgccagagtgaaatcctcgaagggctgaagaagaccgccagggagcgcggtctgtggaatttctggctgaccggctccgaacgcggctacggcctgtccaccgtcgaatacgcctatctggcggaggagatgggcaaggcgcatctcggcgccgaaaccttcaactgctcggcgcccgacaccggcaatatggaggtgctggagcgttacggctcggccgaccacaagaaggagtggctcgagccgcttttggatggaaaaatccgctcggcctatctgatgaccgagcctgatgtcgcctcgtccgacgccaccaacattgggatgcgctgcgagcggcagggcgacgattatgtgctcaatggcgagaaatggtgggcctcgggggccggcgacccgcgctgcgccatctacatcgtcatggtgcggaccggcggcgacggcgagccgcagcaccgccgccattcgatgatcctggtgccttccgacacgaaaggcgtgaccaagctccgcgccatgcaggtttacggcgacgacgacgcgccgcatggccatatgcacctgcgcttcgacaatgtgcgtgtgcccgcctcgaacctgatcctcggcgagggcagggggttcgagatcgcgcaagggcggctcggtcccggccgcatacatcactgcatgcgcgccatcggtcaggccgagatggcgctggagatgctgtgccagcgctccgtgcgccgtgaggccttcggccagaagctggccaaactcggcgccaatttcgacatcatcgccgaatgccgcatggagatcgagatggcccggctgctctgcctcaaggcggcgtggatgatcgaccagggcgatgcgcgcgccgccgcgccctggatcagccagatcaaggtcatcgcgccgcgcgtcgcgttgaggatcaccgacgaggcggtgcagatgttcggcgcgcaaggcatcagccaggacacgccgctggcgcggtcgtggacgcatctgaggacattgcgcctcgccgacgggccggacgccgtgcatcgccggcaggtggcgcggacggagctgaagaagtacacgcaggagaagctctga

SEQ ID NO: 35651 - DNA, 816 bp, Mesorhizobium loti
atggcctatctggacgagctgttttcggtggccggcaagaccgcgctggtgacgggcgcggcgaccggtatcggccgcatggcggcggcagcgctggtcaaggccggcgccagcgtcatgatcgcttcgcgcaagggcgaggattgcatcaaggtcgccaatgcgttcaacgggctcggcgcccctggccgggccgagggctttgccggcgacgtctccagcgaggccggcatcgcggcactcgtcgccgaggtcaaggcgcggaccggcaaactcggcatcctgatcaacaatgccggcgtttcctggggcgcgccgctggagagttttccctattcggcatgggccaaggtgctcggcgtcaatgtcacagccgtcttccacctgacccgcgaattgctgccgctgcttgaagccgcggcaagcgacgccgatccggcccgggtgatcaatctgggttcggtgatggggacgcagccattggccgacgacgcctattcctacacggcctccaaggccgcggtgcatcatctgacgcgcacgctcgcgctcgaattcgccgcccgccgcatcaccgtcaacgcctttgcccccggccctttccaaagccgcatgacggcctttgccacgggtacggatgaacaggccaaacatgtcggcggccatgttccgatcggccgtatcggcgcaccggatgacattgccggcgcaacgctctatttgtgcagccgtgcaggcagctatgtcaccggcgccatcctgccgatagacggcggacagtcggtgcagcatggcttgaccttgttcaaggaatga

SEQ ID NO: 35652 - DNA, 777 bp, Mesorhizobium loti
atgggccgctttgacggagcaaccgtgctgatcacaggtgccgccggggggctcggccggggtgccgcgaaaggctttgccagcgagggcgcgcggctggtgctgtcggacatcgacgaaaaggcgctcgccgatcttgccgcaacgctgccggccgaaacggcgatcctggccggcaacgtagccgacgaaaaactgtccgaggatctggtcaggctggcggtcgaaaaattcggccggctggatgtcaccgtcaacaatgccggcatcgtccagagtttcgtgcgcctgccgcaggttccttcggacgaggcgcgccgcgtgcttgagatcgacctgcttggcgtcttctatgccatgaagcaccagatcccgcagatggagcggcagttcagggctacggccaagggcggcgccatcgtcaacatcgcctcggttgccggactggtcggcgcgccgaaactctcggtttatgccgccgccaagcatggcgtcgtcgggctgaccaaatcggcggccgccgaatatgcaaccaagggtgtgcgcatcaacgccatctgtccggctcacaccaggacggcaatggtggacagtttcgtgcgcgcctccggtgcgccggaggcagaggcgttggccgaactgacacgcggtgtgccgatgaaacgcgtggcggaagtcgacgaaatcaccaccgccatcctgttcgccgccgacccggccaactccttcatgaccggccatgcgctggccgtcgacggcggcgtcggcgccatctga

SEQ ID NO: 35653 - DNA, 780 bp, Mesorhizobium loti
atgcaaaaaatgctcgcactcgccaacaagatcgccatcgtcaccggcgccagttccggcatcggccgcgccacggcgaaactcttcgccgaggaaggggccagggtcgtcgtcgccgcccgccgtcaggccgaactcgatacgcttgtcgccgagatatcggacgcggaaggcacggccgtcgcgcttgccggcgacgtcagggacgaagcctatgcgaaggcccttgtcgatctggcggtcgaaagcttcggcggcctcgacgtcgccttcaacaatgccggcgccgtcggccagatggggccgatctcaggcctgtcactggagggatggcgcgaaaccctcgacaccaacctcaccagtgcgtttctcggcgcgaaataccaggtgccggcgatgatcgagcgaggcggcggctccctgatcttcacttccaccttcgtcggccacaccatcggcatgccaggcatgaccagctatgccgcaagcaaggccggcctgatcgggttgacgcaggtgctggccgcagaacacggcccccagggcgtgcgggtcaacgcgctgctgcccggcggcactgacacacctgcaagcatcaccaacgcgccggatgccggaccggaagtgctggcttttgtccaagccctgcatgcgctgaagcgcatggcgcagccggaggagattgcccgctcggcgctttatctcgcctccgatgcctcgagcttcacaacgggaaccgcgctgttcgccgatggcggcgtctcgatcaaccggacgtga

SEQ ID NO: 35654 - DNA, 843 bp, Mesorhizobium loti
atgaacgcaatgagcgtggagcgcgggaccgcattgcgtggtttcgccctgacggcagccctgctttccggattgttgctggccggctgccagacatcaggcccgaccggcgagttcaacaacatcgacaaggcgcaggggtcgagcgagaacatttcctcgctgtccgcagtcatccagcgcaatccccaggatcccgaaggctacaatgtgcgcggctcggcctatggccgcggcggccagtatcaggcggcgctcaaggacttcaaccaggccatccagctcaatccgaatttctaccaggcctattccaaccgcgcgctcatccagcgcttcctcggcaatcaggcggccgcgctcggcgactataacaagtcgatccagatcaacggcaattatgacgccgcctatatcggccgcggcaatctctaccgcaaggcgggccgcacccaggacgccttcaacgacttccagaaggcgatccagctcgacacgacggacgctcgcgcctaccacaatcgcggcctgatctatcagagccagggccagcacaaattcgccatcgaggatttctcgaccgccatctcgctggcgccggatgcagccgagccctacaacggccgtggcctttcctatctggcgacgggcgacgaggacaacgccttctccgacttcaacatggccatcaagctcgacggccagaacgctgaggcctgggccaatcaggcgctcatctacgagcggcgcggcgacaaggcgaaggccgcgaaatcctataaggaagccgtccgcctcaaccccaattaccagcctgccaaggacggcctcgcccgcgtcagctga

SEQ ID NO: 35655 - DNA, 1575 bp, Mesorhizobium loti
atgagcagcgtcggcgctggtttcaggctcgcgcgggccggctgggtgctggtgcgcgagggcgttatcgccgccctaccgggcgaggaactgtccggtctgccgaaattcggctggcaactggcgcggctgttcacccgccgccgcgcgctcgcctatcagcgcagcgaccggctggccaaggccgtggtccggctcggcccgtcctatgtcaagctcggccagttcctggcaacacggcccgacgtcgtcggcaacgacatggcgctcgatctcgccatgttgcaggacaagatgcacaccttcccgaaggccgaggctgtcgcggccatcgaagcctcgctcgggcgcaaggtgcgcgatctctacgcggagttcggcgacccggtcgccgccgcttccatcgcccaggtccatgccgccgaagccatccatgatggcgttgccaccaaggtcgcggtgaaggtcatccggcccggtgtgcgccgccggttcttccaggatctcgaaagctatttcctcgccgcccgcctgcaggagaagtacatcccgtcctcgcgccggctgcggcctgtcgaggtgaccgagacgctggcgcagaccaccaagatcgagatggatttgcgcctcgaggcggcggcactctccgaacttggtgagaacaccaaggacgatccgggcttccgcgtgccatccgtcgactgggaacgcaccggccgcgacgtgctgaccatggaatgggtcgacggcgtcaagatgaacaacatcgccggcctggaggaggccggccatgatctgaaggcgatcgccgccaatctcatccagtcgttcctgcgccatacgctgcgtgacggtttcttccacgccgacatgcaccccggaaacctgttcgtcgaagccaacggcaccatcgtcgccgtcgatctcggcattgccggacgtctcggcaagaaggagcgccgcttcctcgccgaaatcctctacggcttcatcacgcgcgactatctgcgcgtcgccgaagtgcatttcgaggccggctacgtgccgcgccagcacaatgtcgcggccttcgcgcaggcgattcgcgccatcggcgagccgattcacggccagccagccgagaccatttccatggccaagctcctgacgctgctgttcgaggtgaccgaactcttcgacatggcgacacggccggagctgatcctgctgcagaagaccatggtcgtggtcgaaggcgtggcgcgcacgctcgatccagccttcaacatgtggaagaccgccgagccggtggtcggcggctggatcgccggaaaccttggcccgcgcatcatgatgatcgatgcgcgcgacggtgccaaggcgctgctgacgctggcccgccaggcgccggagcttgccgcgcgcaccgaccggctgtcgcgcgagatcgacctgatggccgagcacggcctgcgtttcgacgagaccacggcgcgtgccatcggcaaggccgaggcgcgctacagccgctccggccgcgtcgcgctgtgggtgatcgcattgacgctggtctatatcgcctggaagattctctag

SEQ ID NO: 35656 - DNA, 921 bp, Mesorhizobium loti
ttgatagtcgtcgtcggctcgatcaatctcgaccttatcgccaaagtcgaccgcttgccgagccccggcgaaacggtgaggggttccggtttctccacggcgcccggcggcaagggcgccaaccaggcgctggccgccgcgcgcgccggtgtcccggtgcgcatggtcggcgccgtcggcaaggacagtttcgccggcgaggcgctggcattgctgcgcgaggccaaggtcgacctgtcgggcgtggcggaaacctttgcctcgaccggaacggcactgatcatggtcggtgacgacggcgagaacatcatcgccgtggtttccggcgccaatgcgtccgtggtgaccggcgacctctccaaggccttcctgaaaaagggcgacgtcgtgctgcttcagcacgagatcccgctggcgaccgtcgatgcggcactcgaccaggcacgcgcggccggcgccatcaccgtgctcaacaccgctcctttccagggcgacgcgacggctttcctcggcaaggccgattatgtcgtcgccaacgagaccgagttcgacctctatggcgaggcgctggcgctgaacggccgcgaccgtgcggcacgcatgcgcgacttcgccgcgaaaaccggccgcagcatcgtcgtcaccctcggcggcgacggcgtcatggcggcgacgccgagcgatttcctgaccgttgcggccatgaagatcacgcctgtcgacacggtcggcgccggcgacaccttctgcggctacttcgctgccggcctgtcgtccggccttgcgctcgaccaagcgctggcgcgcgccggtgcggcaggctcgctcgcatgcctgaagcctggcgcccagccggcgatcccgctggccaaggatgtcgatcaagccttgcaggaagtcagcagaaatgatgcgccctga

SEQ ID NO: 35657 - DNA, 819 bp, Mesorhizobium loti
atggccagcctgtcatcgctgacggcgcgtcttccggggcgcgccgcagccaaggtttcggctccggccacgatcaccgtcgacaagacgaagttcaagggaaccttgatcgccaagggcctgaccaagagctacaagggccgcaaggtggtcagcggcgtcacgctgggcgtgcgtgccggcgaggccgtcgggctgctcggccccaacggcgccggcaagacgacctgtttctacatggtcaccggcctggtgccggtggatgaaggcacgatcgagattgacggtttcgacgtcacctcgatgccgatgtatcgtcgcgcccgcctcggcatcggctatctgccgcaggaggcgtcgatcttccgcggcctcaacgtcgagcagaatatccgcgccgtgctcgaagtggtcgaaaaggaccgcaaggtgcgcgagcgcaatctcgatgagttgctcgaggaattccacatcagccatctgcgcaaggcgccatccatgtcgctctccggcggcgagcggcggcgcctggaaatcgcacgcgcgctggccacgcgcccggcctacatgctgctcgacgagccctttgccggcatcgatccgatcgccgtcgccgatatccagcaactggtgcggcatttgacggcgcgcggcatcggtgtgctcatcaccgaccacaatgtgcgcgagacgctcgggctgatcgaccgcgcctacatcatccatgccggccaggtgctgacccacggccgcgccgacgaagtggtggcgaacccggatgtgcggcggctttatctcggcgaggggtttacgctctga

SEQ ID NO: 35658 - DNA, 1023 bp, Mesorhizobium loti
atgaacatgatttcccccgatgcggccgccaacagcaagcgtgcctggctgaagatcctcgcgcgctacaagaagccggaccggcgacgcagcgccgtcgaacttgccatcaccctcatcccgttcgccacgctctgggcgctgtcctcggccgcctatgcctatggccattggtgggggctgatcctgatccttccggcggccgggttcttggtgcgcatcttcatgatccagcacgattgcggccatggctccttcttcgccaaccgctatgccgacgactggatcggccgcgcgctcggcgtcctgactttgacgccctacgattgctggcggcgcgcccacgcgacgcatcatgccagcgccggcaatcttgacgagcgcggcatgggcgatatcaggacgctgaccgttgccgaataccggcaattgtcctggcgcgggcgcctcgcctaccgcctctatcgccatccgctggtgatgttcgggcttggaccgatctggctgttcatcttctcgcaaaggctgcccatcggcatgatgcgcggcggcctgacgccctgggtgtcgtccatgaccaccaatctcgccatcgcgctggctgcggccctgcttatctgggccgtcggccccggtgctttcctggtcgtccatctgccgatcgtcatccttgccggctcggccggaatctggctgttctatgtccagcaccagttcgaggagacggaatgggctaaggatgacgactgggagtttcagcatgccgccttgcacggctcgtcctattacgacctgccgccggtgctgaactggttcaccggcaatatcggcgtccatcacgtccaccatctctccgccaaggtgccgggctaccggctgcaggaagtgctgcgcgattatccggaactgcgcggcatcggtcgcgtcacgctgctcgacagcctgcgctgcgtcaaactggcactatgggacgagaaccgccgcaagctggtgtcgttccgcgaggcacgggcgacgatgtag

SEQ ID NO: 35659 - DNA, 1608 bp, Mesorhizobium loti
atggatttcgactatgtcatcgccggcggcgggtccgccggctgcacgcttgccgcgcgtctgtccgaagatccgtcgaaaacggtctgcctgatcgaagccggcggcgcgggcagcaacctgcttatccgcgcgccggcaggcatcatcgcactgttgccgggccggccgaaaatcaacaactgggcgttcgagacggtgccgcagcaaggtcttggcggccgcaagggctaccagccgcgcggcaaggcgctgggcggatccagcgccatcaatgccatgctctatacgcgcgggcaccgcggcgactatgacgaatgggccgacctcggctgcgacggctggtcatgggacgaggtgctgccctatttccggcgggcggaaggcaatcaacgcggcgctgatgccctgcatggcggtgacgggccgctgcgggttgccgagcagcaagagccacgcccgctctcccgggcctttgtcgaggcctgcggcgaaaaccagatccgccgcaacgatgatttcaacggcgtcgaacaggaaggtgccggcctttatcaggtgacgcaattctggggcgaacgccgcaatggcgagcgctgctcggtggccgccgcctatctgcaaccggccatgaacaggtcgaaccttaccgtcatcaccggagcgcacgccacggcggtcatcctcgatggcaagcgcgccaccggcgtgcggtatcgcgcggggaaggacgaagccgtcgcgaaagccaggcgtgaggtgatcgtctgtggtggcgccttcggttcgcctcaactcctgttgctgtcgggcattggcccggctgccgagcttgccatgcatggcattccggtcattcatgaattgcccggtgttggcaagaacctgcaagaccatctcgatttcatcatgggctggacgtccaaggatgccgacatgatgggcatcggcctgcgcggcctgcctggcctgctgcggcacatgctgcgctggcgcaaagatggcggcggcatgatcgccacgccctatgccgaaggtggtgccttcctcaaatccgatccggcgatagaacggcccgacctgcaactgcatttctgcatcgcgatcgtggatgatcatggccgcaagctgcatatgggatatggcttttcctgccatgtctgcgtgctgcggccgcattcgcgcggcgaggtcgggctgtcgactcatgatcccatggcaccgccgcgcatcgatcctcgctttctttcggacgaacgcgacgccgagcttttgctcaagggggtcaggatgatgcgcggcatcctggaggcgccggcgctggccaggtatcgccacaaggaaatctacaccgccggtgtttcgagcgacgcggatttgatgtcccacatccgtgcccgcgccgacacgatctatcacccggccggcacctgcaagatgggcgtcgacgagctggcggtggtcgatccgcaattgcgggtgcacgggcttgaagccttgcgggttgttgacgcctctgtgatgccgaccctgatcggcggcaacaccaacgctccgaccatcatgattgccgagaaggcggcggatatgatcaaggcagccgcctga

SEQ ID NO: 35660 - DNA, 765 bp, Mesorhizobium loti
atgctggcgaaaccaaggccgcttgaccatatcggcgatgcagatgacggcgtcgccgccaaggcggcggggctcgatgcgctgtacggccatctgaagccgctcgagatcatcgaacgctcggcccgcgaactgtttcacgacgagatcgctgccgtgtcgtccttcggggcggattcggcggtgctgctgcacatgattgccgagatcgaccgcacgctgccggtcatcttcctcgacaccggcaagcatttcgaggagacgctcggctatcgcgacgcgcttgtcgctgatttcgggctgaccaacatccaggtcatcaagcccgaggaagccgcgctcgcgcggatcgacccgacgggcaatctgcaccagagcaacaccgatgcctgctgcgacgtgcgcaaggtcgagccgctggcacggggcgtggcgccgttccgtgcctggttcaccggccgcaagcgttttcaggcctcgacgcgggcagcgctgccggtgttcgaggcggtcggcgcgcgcatccgcatcaatccgctggcgcactggacgacatcggaccaggccgactacatgcgggcgcatgcgctgcgcgagaatccgctggtcgcctatggctatctgtcgatcggctgtttcccgtgcacgcaaccggtgcagccgggcgaggatgcgcgcagcggacgctgggccggtcatgccaagaccgaatgcggcattcacctgtcggggctggaagtgtcgctgaccgacgcatcactatag

SEQ ID NO: 35661 - DNA, 1671 bp, Mesorhizobium loti
atgtaccgttacgatgagttcgaccacgattttgttcaggcccgcgtcgccgagttcagcgaccaggtccagcgccggctgtccggcgagatatcagaggaccagttccggccgctgcggctgatgaacggcgtctatctgcagcttcacgcttatatgctgcgtatcgcggtgccttacggcacgctgaacggcaagcagctgcgcatgctcggccacatcgcccgcaaatacgacaagggctacggccatttcaccacgcgccagaacatccagttcaactggccggcgctgtcggacattccggcgatcctcgccgatctggcaagtgtggagatgcacgccatccagaccagcggcaactgcatccgcaacgtcaccgccgaccactttgccggtgccgccgccgacgaggtcgccgatccgcgtccctatgcggaaatcctgcggcaatggtcctcggtgcatccggaattctcgttcctgcccaggaaattcaagatcgcggtgaccggggcagagcgcgaccgcgctgccatccagacgcacgatatcggcctgcacctgaagaagaacgccgccggcgagctcggtttcgctgtctatgtcggtggcggccagggccgcacgccgatggtggcaaggaagatccgcgacttcctgccggaagccgaccttctgtcctactgcacggcgatcctgcgcgtttacaacctctatggccgccgcgacaacaagtacaaggcacgcatcaagatcctggtgcacgagaccggcgtcgaggagatcacccgccaggtcgaggccgaatggcaggacttgaaggacgccgagctgaagctgccggatgccgatatccgcgccatccaagcctatttcgcgccgccggaactggctgatcggccggaaggcgaccaggcggtcaagctggcgcgtcttgattccaaaggcttctcggagtggctcgaccagaatgtggtgacgcaccgccatcccgattatgcggcggtgacgatttcgctcaagggcatcggcgaggtgccgggcgatgcttccgacagccagatggaagcgattgccgacatcgccgagaaatacgccttcgacgagctgcgcgtcagccatgagcagaacctgatcctgccgcatgtggcgcgcgccgacctcaaggcggtctacgacgcgctggtcgatatcgggctggcgacggccaactccaatttgatatcggacatcatctcgtgccccggcctcgactattgcgcgctggccaccgcacgctcgatcccgatcgcgcaggaaatctcgcaacgcttcgcctcgctggagcggcagcgtgagatcggcgaactgaagctgaagatctccggctgcatcaatgcctgcggccatcaccatgtcggccatatcggcatcctcggcgtcgagaagaagggctccgagctctatcaagtgacgctgggcggttcggccgatgagaacacgtcggtcggcgagatcatcggccgcggcttctcgtcggaagagatcaccgacgccatcgagcagatcgtcgaaacctatctcggcctccggctcaacccacaggaaaaattcatcgacgcataccgccgtgtcggtcccgcgccgttcaaggaggcgctctatgctggcgaaaccaaggccgcttga

SEQ ID NO: 35662 - DNA, 1071 bp, Mesorhizobium loti
atgcatagattgccaaaagaagtcggaagctggatttataattttttttataacgagcactctatcgcttatctgaaaattgacgcccagctttgcgtagctgcgaagggcggtaacgttaaacattacgggctctcatcgcttcgcattggtcagccggttgccgatcagcttgaattcatggaaggtttgctgccttccccggagctcccatatcatatggccatggtcgaactgcccagcgggcgtgtcgcggaccttcatctttttgctgacaatgcctacgtgtggctgctctttctcgacgccaccgccgaacgcgacaataagcagcggcttcaacagaaggcttatgaaatgacgctcctgcaagagagggagcgtcaactcaacgagaaattacaatcgatgaacgaggcgttgagggagagccaagagggattgcagcgtgaataccagcgcgccgaaaccctgctcctcaacattcttccggcgtcgatcgcggagcggttaaaagcggacgaacaaattgcagacaaccacgcagaggtaagtgtgctttttgccgacatcgtcggttttacggaaagagcgcggagcgtcggagccgtgacgacgctcgctattttaaattacttcttcaaagcggcggatcggctgtcggaacaatacggctgcgaaaagatcaagacaatcggcgactgtgtgatggtggtcgccggcctgcctgctgcgcgacccgatcatgcagaagccctcgcgcgctatgcacttgaactgcgggaggcggttcagcacgaacgcttcgcaggagaacggctaaggctcagaattggaattcactcaggaccaatcgtcgcgggcgtcataggcaaaaggcggtttgcttacgacctgtggggcgagaccgttaatctcgccgcacgtattcaaacgtccgcggagcccgatgaaatccgtatttcggatgcaacacgcagactgcttgggccagattttgcttgtgacccactcgcggaaacggaactgcgtggtacaggaagagtgcgaatgtggcgccttccggcttga

SEQ ID NO: 35663 - DNA, 507 bp, Mesorhizobium loti
gtggagctcaagatgttgcaaaaaaagatctgcatgttgggcgggttcggtgtcggaaagacgagtctggttcgcaggtttgtacaaagcatcttttcagaaacctacttgaccacggtgggagtgaaaatcgacaagaagagcgtcgcactcccggacaaaaccgtggatctgattttgtgggatttggccggcgaagacgatatcggctcattccgcgtcagccatgtgcgaggtgcgactgggctcgtgcttgtcgttgatggaacccgtgccgctactcttgccgcggcgctcacgctgcgtgagcgagtcgaggctgaattcggcactatgccgtttgtattgctgttcaacaaatccgatcttgctgatcggtgggaaatatcggatggtgacattgacaatctgaggcagcttggatggcaaatctatttaacaagtgcgctttctggtgagtatgttgatgatgcgtttcatcaacttgcttcgatggttgccaaatag

SEQ ID NO: 35664 - DNA, 1275 bp, Mesorhizobium loti
gtgatcggattgggctatgtcgggctgccgctggcggttgcgaccgcacgtgccggcttcccggtatccggcttcgacatcgaagcccggaaggtcgagcgcctgaacaacggccaatcctacattgaggcggtaacgtcgactgcccttgccggcgaggtggctagcggacggttccgcgccactgcggattttgccgaattgaccgtctgcgatgtcatcatcatctgcgttccaacaccgctgacgaaacaccgtgagccggacctctccttcgtcaggaacacggcaggcaccatcgcgaagcatctgcgtctcggccagctgatcgtgctggaatcgaccacctatcccggcaccaccgacgatgtgatcaagcccatattggaagaaaccggcttgcagtcgaagatagatttcttcctcggcttctcgcccgaacgcgaggatcccggcaaccgcagctttgaagtcgcgacgatccccaaggtcgtggcaggcgacggcgttgacgcggcgacgctcgtgcaggctttctaccagggcgtgatcgagaccgtcgttccggtttccaccacggcgaccgccgaggcggtcaagttgacggaaaacatcttccgctcggtcaatatagccctcgtcaacgagttgaaaatcgtgctcggtgcgatgggcatcgatatctgggaggtgatcgaggcggcgaagaccaagcccttcggctacatgcctttctatcctggccccggacttggcgggcactgcgttccgatcgatcccttctacctgacatggaaggcgcgcgaatacgaactgcccacccgcttcatcgagctggcggcagagatcaacacggccatgccacgtcatgtggtcgatgaactggcgaaagctctggaccggcgctgcggcaaggcgctcagccgctcgcgcattctcatcatcgggctggcctataaaaagaatgtgcccgacatccgcgaaagcccctcactgcggctcattgaactcatcgaggaatggggcggcaaggcggaattccacgacccgcatgtcaccgagatcccgaccacacgggagcatatggcgatcaaggggcgtcgctcggtcgaattgaccgaggcggccttgaaggatttcgatgctgtcgtcgttgcaaccgaccacgacgcaatcgactatcaggcgatcgccgatcacgctcttctgatcgtcgacacacgcaacgtttttggccgactcgggctagcccgggagacggtggtgaaggcttga

SEQ ID NO: 35665 - DNA, 969 bp, Mesorhizobium loti
atgcatcgggtgaccgaggccagggccaaggcggccgccgagaaccctgacggcaccgaccgggtctacggcggcaaccaggccgaaaagggcgcctatccgttccaagtcgcgctgctcaccaccgccaggctggacgataacccggcctcgcaggccaatgcacaattctgcggcggcagcctgatcgccccgcaatgggtgctgacggcggcacactgcctcaacgacaagggccggccgatctcgccggactccgtcaccgtgctgaccggcgccaccgacctcagcgaaggcaaccgccacaaggtcttggaggtcatcgtcaacgagggttacagcgagcagacgctagacaacgacctcggcctgctccggcttgccgagccggccgatgcgccggccatcaagcttacccgcgaggcgacccccgacaccggcaagaccaccgtcaccggctggggcaagatgcaggacgggacatttccgaccacgctgatggtcgcggacctcgatctgcagccgaacagcacctgcaacagcggcatcaaggccatctatgcgcatgacctcaaggccgcgctcggtgatctgtcccaccgcatgcgctattcggaaaagggcatcgatgccgccgccaatgcgattgccgccgacatgactgacccgctgaccggcaacatgatctgcgccggcaccaccagcggcgtacgcgatgcctgcaatggcgacagcggcggtccgctgttcatgaccggcgccgacggcccggtccaggtcggcgtcgtcagctggggcgaaggccccgccgacggcagcgcggcctgcggccacaaggacgcctatggcatctacacgcggctggccaactacggcggctggatcgaggcgaagatgaagacccctgctcccgcgccggaaaagccgaaagccgggctgggcaccgcccagaagccgaagacgccctga

SEQ ID NO: 35666 - DNA, 1428 bp, Mesorhizobium loti
atggaaaaagccgaaatcggcctgatcggccttggcacgatgggctccaacctggcgctgaacatcgccgaacacggacaccgcatcgccgtcttcaatcgcaccagggcacgtaccgacgctttcgtcgagaatgccggcgcgctgaaggacatggtggtgccctgctacagcctggaagaacttgccgccgcgatccggccgccgcgcccgatcatcatcatggtgctggccggcaagccggtcgatgagcagatcgaagccttgcgtggcgtgctgtccggcaacgacatcgtcatcgatgccggcaacgccaatttccgcgatacgatgcggcgcttctccgaactgtccggttccgggctgaccttcatcggcatgggcgtgtccggcggcgaggagggcgcgcgccatggtccgtcgatcatggtcggcggcacggaggattcgtggaagcgggtcgagaaagtgctgaccgccatctccgccaagttcaaggacgagccctgtgccgcctggctcggcaccgatggcgccgggcatttcgtcaagaccatccacaacggcatcgaatatgccgacatgcagatgattgccgagatctacggcatcctgcgtgatgggctcggcatggggccgaaggacatcggcacggtgttctccaactggaacaagggccggctcaactcctacctgatcgagatcaccgccaaggtgctggccgccgacgatcccaagaccggcaagccggtggtcgacattatcctcgaccgcgccggccagaagggcaccggcaaatggtccgtcatcgaggcgcagcagctcggcattccggcgacagcgatcgaggcggccgtggcggcccgcgtgctgtcgtcgatcaaggacgagcggctggcggccgagaaagcctacggtaacatcggggtatcgaagatttccggcgacaaggatgcgctgctgaaagatctcgaactggcgctgttcgccggcaagatcgcggcctatgcgcagggcttcgcggtgatgagcggcgcctcgaaggagttcaactggaacctgccgatgccgaccatcgcccggatctggcgcgccggctgcatcatccgctcgcagatgctggatacgatggccgaggccttcagcagcggcggcgcttcgaccaatcttttgatggcgccggctttcatcagcttgatgcaggaagcgcatccgtcgctgcggcgcatcgtggcaaaggcttccgaggccggcgcgccggtgccggcgctgtcttcggcacttgcctatttcgacagctatcgccagggccgcggcacttcgaacctgatccaggcacagcgcgacttcttcggcgcgcatggcttcgaacgcatcgacgagcagggtgccttccacggcccgtggggcagcggcgccgccggttag

SEQ ID NO: 35667 - DNA, 1017 bp, Mesorhizobium loti
atgaaagccgttatctgccgctcgcccggggaactcgtcctggaagaccgccccgcgcccggcgcgcctcctgccggctgggcgctggtcgccgtcagccatgtcggcatctgcggcaccgactaccacattttcgagggcaagcacccgtttctcgcctacccccgcatcatgggccatgaagtctccggcaccgtcatcgagaccggcgagggccccgaccttgccattggcgaaccggtcgtcatcaacccctacctctcctgcggcaagtgcatcgcctgccggcacggcaaaccgaattgctgcgtcaagatcgaggtgctgggcgtccatcgcgacggcgccatgtgcgaacgcattcttgtcccggcgcagaatctctatccggccaatggcctgtcgctggccgacgccgccgctgtcgaattcctggccatcggcgcgcatgcggtacgtcgcgcccgcgccgattctggcgcccgcgcgctggtcatcggcgccggcccgatcgggctcggcaacgccatcttcgcccgcatcgccgggctcgacgtgacgctgctcgacatgagcagtgaacgcctcgcattcgccgaaaacgaacttgggttcagtatcctcgacggctcgcgcggagcggtgccagacctggtcaaggacgcgacatcaggcgaaggcttcgacgtggtcttcgacgccaccggcaacacccggtcggtgcagtcggccttcgcccatgtggcgcatggcggcacactggtgctggtcagcgtcgtcaaggacgacatcgtcttttccgatccggaattccacaaacgcgaaatgacgctggtcggcagtcgcaatgccttgcgtgccgatttcgatcatgtcgctgcctcgatccgaaacggcgcggtgccgttggccaagctcgtcacccaccgcaccacgcttgccgatacgccgagcgatctcgcccgctgggcgcacgagaaatccggcctgatcaaggccgtgatcgagatcggatag

SEQ ID NO: 35668 - DNA, 909 bp, Mesorhizobium loti
atgacgttgcaaggaaaagttgccctggtcgccggcggcacaaggggtgccggacgcggcatagcggtcgagctcggcgctgccggcgccacagtctatgtcacggggcggagcacgcgtgcccagcaatccgaatatgcccggccggaaacaatcgaggagacggcggaactggtcacagcgaacggtggcagcggcatcgccgtccaggccgatcatctcgtggccgatgatgtgcgcgggctgatcgagcgcatccgcaaggaacagggccgcctcgacatactggtcaacgacatctggggcggtgaaaagctgttcgaatgggacaagccggtctgggagcacaatctggacaatggcttgcgtatgctgcgtctggccatcgacacacatctgatcaccgcacaccatgcgctgccgctgatgatcgagcagccgggcggactgctggtggaagtcaccgacggcaccgctgaatacaatgccgagcactaccgcctgtcgcccttctatgaccttgccaaggtcgcggtgaaccggatggcatgggctcacgccaaggatcttgcgaagcacggcgccacctccgtctctttgacgccaggctggctgcggtcggagatgatgctggaggcctttggcgtgcgcgaggtgaattggcgcgatgccacggcaaaggtgccgcatttcattatttcggagacaccgcgcttcatcggccgtgccgttgctgcgttggcggcggacacggaccgctcgcgctggaacgggcagtcgctgtccagcggcggcctggcgcaggtctacggctttaccgatctcgacggctcgcggcccgatgcctggcgctatgtgccggaggttcaggacgccggcaaacccgccgacgcaacggggtatcgatag

SEQ ID NO: 35669 - DNA, 2607 bp, Mesorhizobium loti
atgaaccttgagaagtactccgagcgcgtgcgcggcttcatccagtccgcgcagacgatggcgctctcccgtaatcaccagcaattcacccccgaacacattttgaaggtgctcgtcgacgatgacgagggcctggccgcctcgctgatcgagcgcgccggcggcaatgtccgtgacgtcaagctcggcgtcgagacggcactcgaggcaatgccaaaggtcgaaggcggcaacggccagctctatctggcgcagccgctggccaaggtgttctcgacggccgaagaactggccaagaaggccggtgacagcttcgtcacggtcgagcggctgctgcaggcgctcaccatggagaagtcggcaaagaccgccgacatcctggccaaggctggcgtcaccgcgcaggcgcttaaccaggtcatcaacgatgtccgcaagggccgcaccgccgattcggccagtgccgagcaaaactatgacgcgctgaagaagtacgcacgtgatctcacggctgatgcccgtgcgggcaagctggacccggtgatcggccgtgacgacgagatccgccgcaccatccaggtgctctcgcgccgaaccaagaacaatccggtgctgatcggcgagccaggcgtcggcaagacggcgatcgccgaaggcctggcgctgcgcatcgtcaatggcgacgtgccggaatcgctgaaggacaagcaactgatggcgctcgacatgggcgcgctgatcgccggcgccaaatatcgcggcgaattcgaggagcggctgaaggctgtgctctccgaagtgacctcggccaatggcaacatcatcctgttcatcgacgagatgcacacgctggtcggcgccggcaaggcggatggcgcgatggatgcgtcgaacctgttgaagccggcgctggcgcgcggtgaactgcactgcgtcggcgcgaccacgctcgatgaataccgcaaacatgtcgagaaggatccggcactggcacgccgcttccagcccgtcttcgtcgacgagccgacggttgaggacaccgtctccatcctgcgcggcttgaaggaaaaatacgagcagcaccacaaggtgcgtatctcggactcggcgctggtggcggcggcaacgctgtccaaccgctatatcgccgaccgcttcctgccggacaaggcgatcgacctggtcgacgaagccgcttcgcggctcaggatgcaggtcgattccaagcccgaggcgctggatgagatcgaccgccgcatcatgcagctcaagatcgagcgcgaggcgctgaaggtcgagacggacgatgcctcgaaggaccggctcgtccgcctggagaaggagcttgtcggccttgaggaggaatcgaccgagatcaccgccaagtggcaggccgagaagcagaagctcgggcttgcggccgacttgaagaagcagctcgacgaggcacgcaacgagctcgccattgcccagcgcaagggcgagttccagcgcgccggcgagctcgcctatggcaagatcccggaactggaaaagaagctgaaggaagccgaagcccaggacggcaaggccggcatggtcgaggaagtggtcacccccgaccacgtcgcccatatcgtctcgcgctggaccggcattccagtcgacaagatgctgcagggcgagcgcgacaagttgctgcgcatggaagacgagatcggcaagcgggttgttggccagggcgaggcggtgcaggccgtttccaaggcggtgcggcgcgcccgtgccggcctgcaggatccgaaccggccgatcggctcgttcatcttcctggggccgacgggcgtcggcaagaccgaactgaccaaggcgctggcaagcttcctgttcgacgacgacagcgccatggtgcgcatcgacatgtcggagttcatggagaagcactcggtcgcccggctgatcggcgcgcctcccggctatgtcggctatgaggagggtggtgcgctgaccgaagcggtgcggcgccggccctatcaggtcgtgctgttcgacgaaatcgagaaggcgcatcccgatgtcttcaacgtgctcttgcaggtgctggacgacggccggctcaccgacgggcagggccgcacggtcgatttccgcaacacgctgatcatcatgacgtcgaacctcggcgccgaatatcttgtcaatctcggcgaagaccaggatgtcgatgccgtgcgcgacgaggtgatgggcgtggtcagggcatcgttccggccggaattcctcaaccgcgtcgacgaggtgatcctgttccaccggctgcgccgcaaggacatggaccgcatcgtcgagatccagttcaagcggctggaaagcctgctcgtcgatcgcaagatcacgctgtcgctggatcacgaggcaatcgagtggctggcggccaagggctacgacccggcctatggcgcgcggccgttgaagcgggtgatgcagaaggaactgcaggatccgctggcggagaagatcctgctcggcgagattctcgacggttcgaccgtcaaggtcacgtccggttccgaccggctgaacttccgctcgaagccgacggtcgtcgcgaccgaagcggcggcctga

SEQ ID NO: 35670 - DNA, 2271 bp, Mesorhizobium loti
atgcgtgaccaggccagtggcccgcgcgttttgctgaaacggctccgcgagctcatgcaagagccgctggagccgcaggagcggcttgaccggatcgtgcgcgatatcgcttccaacatggtcgcggaagtgtgctcgctctatgtgctgcgcgccgattcggtgctcgagctctatgccaccgagggtctgaacccgaacgctgtccacctggcgcagctgcggctcgggcaaggccttgtcgggaccatcgccgccagcgcgcggccgctcaatctttccaatgcgcaggaacatccggccttcgcctacctgccggagaccggggaagagatctacaattccttcctcggcgtgccggtgctcagggcagggcgcacgctgggcgtcctggtcgtgcagaacaagaccatgcgccattatcgcgacgacgaggtcgaggcgctggaaaccaccgccatggtcatcgccgagatgatcgccactggcgatctggcgcggctgacgcggccgggcctcgaactcgacctgcgccggccggtcagcttcaccggcctgtccttcaacgacggcgtcgggcttggccatgtcgtgctgcatgagccgcgcatcgtcgtcaccaatctgttcaacgaggacagcgaggaagaggtccgccggctcgagacctcgctcggctcgctgcggctctccatcgacgatatgctggaacgccgcgacgttgccttcgagggcgagcatcgccaggtgctggaagcctaccgcatgttcgccaatgaccgtgggtgggtgcgccggctggaagaggccatccgcaacggcctgacggccgaagcggccgtggaaaaggtgcagagcgacatgcgcgcgcgcatgctgcacatgaccgatccctatctgcgcgagcggatgagcgatttcgacgacctcgccaaccggctcttgcgccagctgatggggcgtgggccggaagatgtcgcggcctcgctgccgaaggacgccatcatcgtcgcccgctcgatgggcgcggccgagctgctcgactatcccagggagaaaatgcgcgggctggtgctcgaggatggcgcggccaccagccatgtcgtcatcgtcgcgcgcgccatgggcattccggtcgcgggccagatgaagggcgccgtttccatggcggaaaacggcgatgccatcatcgttgacggcgaggagggcgtgatccatctgcggccgcagtccgatctcgaagccgcctatgccgaaaaggtgcggttccgtgcgcgccggcaagaggtctatcgcgaactgcgcaagaagccgtcgacgaccagggacggcgtccaggtcgatctgttgatgaatgccgggcttgccgtcgacctgccgcagctggccgaggcgggtgcggccggcatcggcctgttccgcaccgagctgcaattcatggtcgcctcgaccttcccgcgcgccgaggcgcaggagaaactctatcgcgacgtgctggaggcggcgcgtggcaagcccgtcaccttccgcaccatcgatatcggtggcgacaaggtgctgccctacttcaagggcgccatccaggaagagaacccggcgctcggctggcgggcgatccggctgacgctcgaccggccggggctgctgcgcacccagatccgcgccctgctgaaggccagtggcgggcgcgagctcaagctgatgctgccgatggtgaccgaactcagcgagattgcgcaagcaagagaaatcatcgaccgcgaggtgcggcatctctcgcgcttcgcccaccatctgccgaccagcctcaaattgggcgcgatgctggaagtgccgtcgctgctgttccagctcgacgaattgatgaaggcggtcgacttcgtctcggtcggttcgaatgatctgttccagttcgtcatggcggtcgaccgcggcaacacgcaactggccaaccgcttcgacacgctgtcggcgccgttcctgcgcgtgctcaagcagatcgccgatgcaggcatccgcaaccacacgccggtgacgctgtgcggagaactcgccggcaagccgatctcggcgatggcgctgatcggtctgggcttccgttcgatctcgatgtcgccggcctcgatcggcccggtcaaggcgatgctgacggaactgccgctggatgagctgacggcgttcttcgacgacaatctgatggcgccggcgcaggggctgccgatgcgggcgctgctgcaggccttcgccgacgaccgctcgattccgttgtag

SEQ ID NO: 35671 - DNA, 1254 bp, Mesorhizobium loti
atggcgcgtatcgtgatgaaattcggcggaacctccgtcgccgacatcgcccgcatccgcaatgtggcgcgtcacgtcaaacgcgaggtcgacgccggccatgaggtggcggtggtggtttcggcgatggccggcaagaccaacgagctggtcggctggacgcgcgaggcctcgccgatgcacgacgcacgcgaatatgacgcggtggtcgcttccggcgaacaggtcaccgccggtctgctcgccatcaccttgcagaacatgggcgtgcatgcccggtcctggcagggctggcagatcccgatcaagaccgacaatgcacatggcgcggcgcgcatcctcgacattgacggcgccttcctgatcaagcgtttcggcgagggccaggtggccgtcatcgccggcttccagggcatcgggccggacaatcgcatcgcgaccctcggccgcggcggttccgacaccagcgcggtcgccatcgccgcggcggtcaaggccgatcgctgcgacatctacaccgacgtcgacggggtctacaccaccgatccgcgcatcgagcccaaggcgcggcggctggccaagatctctttcgaggaaatgcttgaaatggcctcgctcggcgccaaggttctgcaggtgcgttcggtcgagcttgccatggtgcacagggtgcgtaccttcgtgcggtcgtccttcgacgatcccgatgcgcccggaatgggggatttgctcaatcctccgggaacgctcatttgcgacgaggaagagatcgtggaacagcaggtcgtcaccggaattgcctacgccaaggacgaggcccagatttcgctgcgccgcgtcggcgaccgccctggcgtcgccgccggcattttcgggccgctggccgaagccaacatcaatgtcgacatgatcgtccagaacatctccgaggacggcaagttcaccgacatgaccttcaccgtgccttcgggtgacgtcgacaaggcgctggccgtgctcgaccggctgaaggccgaggtcggctatgatgtcgtgcagtcggaagccggcatgtcgaaggtttcggtcatcggcatcggcatgaggagccacgccggtgtcgccgccaccgctttcaaggcactggccgacaaggcgatcaatatccgcgccatcaccacctccgagatcaagatttcgatactgatcgacggtccgtacaccgaacttgcggttcgcactttgcattccgtctacggtctggataagcagtag

SEQ ID NO: 35672 - DNA, 1242 bp, Mesorhizobium loti
atgtccacgacgatttcgccgctcgcgccgaagaagtaccccaaaatgcctgtcattgaaggggtgcgcatcgccaccgccgaagcggggataaagtacaagaaccgtaccgacctgctggccatggtgttcgatgccggcactgcggtcgccggcgtgttcaccaagtcgaaatgcccctcggcgcccgtcgatttctgccgccagaaccttgccgccggcaaggcccgggtgctggtcgtcaattccggcaatgccaacgccttcaccggcaagaagggccgcgaatccaccgcgctgaccggcgaggcggcggcaaaggctgccggctgcacggcaggtgaggtgttcctggcctcgaccggcgtcatcggcgagccgctcgacacgaccaagttcagccatctgcttgccggactggtcagtgatggcaagcccgacctgtggaccgaggcggcgaaggccatcatgaccacggacacctatccgaaagtggcgacgcagaccgtcaagcttggtgacaccgatgtcaccatcaatggcatctccaagggcgccggcatgatcgcccccgacatggcgacgatgctgtccttcatcgccaccgacgcgccgatcgcggcccccgtgctgcaggacctgctgtcgcgcggcacggccaagaccttcaacgcggtgaccgtcgacagcgacacctcgaccagcgacacactgctgatcttcgccaccggcaaggccgccaagcgcggtgcgcctgaaatcaccgacccgaaagacgcacggctcggtcagttccgccgggcgctcggcaaggtgctgaagtcgctggcgctgcaggtggtgcgcgacggcgagggcgcccgcaagcaggtcgaagtcaccgtcaccggcgcgaaatcggcccgctcggccaagcgcatcgcgctgtcgatcgccaattcgccgctggtcaagacagcggtcgccggcgaggacgccaattggggccgtgtcgtcatggccgtcggcaaggccggcgagcccgccgaccgcgaccggctgtcgatctggttcggcgatatcaggctggcgcatgagggcgagcgcgaccccggctattccgaggaagcgacgtcgacttacatgaagcgcgacgatatccgcatccgtgccgacatcggcatcggccgcggcaaggcgacggtgtggacctgcgacctcaccaaggaatatgtcgccatcaacggcgattatcggagctga

SEQ ID NO: 35673 - DNA, 879 bp, Mesorhizobium loti
atgagcaagatcgagacgatcggcatcatcggcgcgggccagatgggcgggggtatcgcccatgtctccgcgctatcgggctacaaggtgctgatctacgatatttcgcccgaccgcattgaaaagggcatcgccaccatcagcggcaacatggcccgccaggtgggctccggcaagcttgacgagaagcttcgcaaccaggcgatggcgcgcattgcctcggcaccggctatggccgatctcgccggcgccgatctggtgatcgaggcggcgaccgaggacgagacgatcaagcgcaagatctacgcgcagctctgtccgcagctcaatcccgaagccatactggcgaccaacacctcgtcgatctcgatcacgcggcttgccgcgcagaccgaccggccggagcgcttcatcggcatacatttcatgaacccggtgccgctgatgaagctggtcgagctggtgcgcggcatcgccaccgaggaccagaccttcgaggcggccaagacctatgtgaagcagctcgacaagacgatcacggtctcggaagatttcccggccttcatcgtcaaccgcatcctgctgccgatgatcaacgaggcgatctacacgctctatgagggtgtcggctcggtcgacgccatcgacaccgccatgcggctcggagccaaccatccgatgggaccgctgcagctggccgatttcatcggcctcgacacctgcctgtcgatcatgcaggtgctgcatgacggcctgtcggattcgaagtaccgcccctgcccgctgctggtgaaatatgtcgaagctggttggctcggccgcaagaccgggcgcggtttctacgactatcgcggcgagcaccccgttccgacgcgctga

SEQ ID NO: 35674 - DNA, 1401 bp, Mesorhizobium loti
atgagcgacaagaagaccagcaaccagatgtggggcggacgatttgcctcgggtccggccgcaatcatggaagcgatcaacgcgtcgatctcgttcgaccgcaaactctacgcgcaggacatacgcggctcgatcgcccatagcgagatgctggcgcaaacgggcattatttcgacggccgatcaagaaaaaatcgctcacggcctgaacacgatcctgaaagagatcgaggcgggcagcttcgagttttcgaccaggctcgaagacatccacatgaatgtcgaggcccgcctcgccgacctgatcggctcggccgccggccgcctgcacaccgcgcgctcacgcaacgaccaggtggcggtggatctgcggctctgggtcaaggatgagtgcttccgcgtcgccgaggcgttgaagggcctgatcaccgcgctgctggcgcgggccgaggagcacgcggcgaccgtgatgccgggcttcacccatatgcaggcggcgcagccggtgaccttcggccatcactgcatggcctatgtcgagatgtttgcacgcgacctgtcgcgcgtgcgcgacgccatcgagcgcatggacgagagcccgctcggcgccgccgcccttgccggcaccagcttcccgatcgaccgccaccggaccgccaaggcgctcggcttccgcgagccgatgcgcaattcgctggacagcgtctccgatcgcgatttcgcgctggacttcctcgccatggcggcgatctgcgccacgcatctgtcgcggctggccgaggagatcatcatctggtcgacgccgcaattcggcttcatcaggctgtcggatagtttttccaccggctcctcgatcatgccgcagaagaagaaccctgacgccgccgaactggtgcgcggcaagaccggccgcgtcaacggccatctggtcggcctgctgacggtgatgaagggcatgcctttgacctatggcaaggacatgcaggaggacaaggaatcggtgttcgacgccgccgagacgctcgacctgatgctggcggcgatgaccggcatggtctcggacatgacggtcaacgcggccgcgatgaagaaggccgccggctccggccacgcgaccgcgaccgacctcgccgactggctggtgcgcacgctcggcctgcccttccgcgaggcgcatcatgtcaccggccgcgcggtggcgctggccgaggagaagaaggtgagcctggaaaagctttcgctggaggacctgcagtcgatcaatcccggcatcacggcggacatattttcggtgctggcggttcagaactcggtcaagagccgcaccagtttcggcggcaccgcgccgtcggaagtgaggaagcagatccgctattggaaaaagcggctggccaaagcctga

SEQ ID NO: 35675 - DNA, 1269 bp, Mesorhizobium loti
gtgaaccatttcgactaccgcgacggcgtgctgcatgccgaggacgtggcaatccctgatatcgccgctcaggtcggcacgccgttctactgctattcgacggccacgctgaccaggcactaccgtgtgtttgcacaggcctttgccggcctcgacgcgctggtctgctacgccatgaaggccaactccaaccaggccgtgctgcgcaccctggccaggctcggcgccggcgccgacgtggtctcggaaggcgagttgcgccgagcgctggcggccggcatcccggccagcaagatcctgttttccggcgtcggcaagaccgcccgcgaaattgacctcgcgctcgaagcgggcatcctttgcttcaacgtcgaatccgagccggagcttgaactgttgtcggcccgcgccgtggcactcggcaaggtggcgccgatctcgctacgcatcaatcccgatgtcgacgccaagacccacaagaagatctccacgggcaaggccgagaacaagttcggcattgcatggcagcgcgcgcggcaggtctatgcccgcgcggcgacgcttccgggcatcaaggtcaccggcatcgacacccatatcggcagccagatcaccgagctgcagccctttgacgacgccttcgcccttttggtcgatctggtcggcgcgctgcgcgccgatggccacgccatcgagcatgtcgatctcggcggtggcctcggtattccctaccgcgtcgacaacaacccgccgcccttgcccgacgcctatgcccagatcgtcaggaagcatgtcaccaagctcggtctcaaggtgatgttcgagccaggacgcctgatcgttggcaatgccggcatcctcgtctcggaagtgatcttcgtgaaggaaggcgacgccaagaatttcctggttgtcgacgccgccatgaacgatctgatccggccgacgctttacgacgccttccacgacatcaggcccgtcgtgcagccgccggccgacacgccgcgcatgatggtcgacgtggtcggccaggtctgcgagaccggtgactatctcggcctcgaccgcgacctgccgaggctgaaggccggcgatctcgttgccgtttccacagccggtgcctacggtgccgtgcaggccggcacctacaacacccgcctgctggtgccggaggtgctggtcgacggcgaccgtttccacatcgtgcgcccgcgcctgacctatgacgatctgatcgggctggattcggtgcccgactggctggcatag

SEQ ID NO: 35676 - DNA, 543 bp, Mesorhizobium loti
atgccaatcgtacgcgacaaggacatcgaagtcctgttttcagcgtcggcaatcgcgcggcgcaatctcgagctcgccaaggagatcgccgggcacgactatcacgatctgctggtgatttcggtgctgaagggctcgttcatcttcgccgccgacctgattcgcgccatgcatgatgtcggcctgtcgcccgaggtcgagttcatcttcatttccagctatggcgccggcaccaccagcggcgaggtgagggtgctgcgcgacatcgacaatgaggtcgccggccgtgacgtgctgctgatcgacgacattctggagtcgggtaagacactgaccttcacccgcgacctgatgctgtcgcgcggcgcgaaaagctgttccatcgccgtgctgctcgacaagcgcatgcgccgccagacggcgctggtcgccgactatgtcggcttcgactgccccgattatttcgtcgtcggttacggcatggacgtcgcgcacgccttccgcgaattgccgttcgtgggtgtcgtgaaaggcgatgcgtga

SEQ ID NO: 35677 - DNA, 930 bp, Mesorhizobium loti
atggcaagccccccgaggctcctcagcgtcggcgcgctgacgctggataccatcctgcgtgtcgagacgctgcccacgcaccagggcaagttcatcgccgcagacggtgtccagatcgcctcgggcatggccaccagtgctgcctgcgccgcgcatcgcctcggcgccgaggtgtcgctgtgggccagcgccggcgatgacctcattggcgaacagctgattgccggaatcgaggccgagggtgtcgattgcagctatgtccgccgagtcagcggcgcccgctcggcattggcttcgatcctggtcgacgcccatggcgagcgcatcatcgtgcctttctacgacagcctggcgcaggccgatcccgaaaccttgcctttcgccgacatcacggcattcgatgccgtgctggtggacgtgcgctggcctgacgccgcggcccttgccctcaaggcggcgcgcgcggccgggcggccggcaatcctcgatgccgacacggcctcgctggcggtgctggagcggctgttgccgctggcttcgcacatcgtcgcctccgagccggcggtccgcatcatatgcggccaggcgctggatctggcgagcgcttgcaccgacatggcctcccgcaccgacgcattcgtcgcggtcaccggcggcgcagcaggcatctggtggttcgatcgcaaagcgggatcatcccgtcatgtcgcggcgccgaggatcaaagcggtcgacacgctcgccgccggcgacgtctttcacggcgcctttgccgtcggactggcggaggccatgccggtcgagcaggccttgcgctttgcaagtgccgccgccgcgctcaaatgcctgcgcttcggcggcaggctcggcgcgccggaccgggccgagacgctggcgatggtcacggcgacctggcccgaaacagcctag

SEQ ID NO: 35678 - DNA, 1110 bp, Mesorhizobium loti
atgaaccagacaccggatcaggcacgtccaaccccgcgcgcgggcatcatggacatcgacgcctatgtgccgggcaagagcgccgcacccgccggtgtcgccaaggtctacaaactgtcgtccaacgagaatccgcttggcccttcaccgaaggcgatcgaggccgcgcgtgaagtcgccgccaggctcgacatctatcccgacggcaccgccagacggctgcgcgaggcgatcgcggaagtgcatggcctcaccgcgcagaacatcatctgctccaacggctccgacgagatcctcgggctgctggcgcagacctatctggcacccggcgacgaggcgattttcaccgaacacgccttcatggtctacaaaatctacatccagtcggccggggctgcgccgatcgccgtcaaggagaccgacgagcgcgccgacatcgatgcgatgctggcggccgtcacgccgcgcacgaaaatcgtgttcctcgccaatcccaacaatccgaccggcacctatgtgccgttccaggaggtgcgccgcctgcatgccggcctgcccaggcatgtgctgctggtgctcgacgcggcctatgccgaatatgtccgccgcaatgactatgaagccggcatcgaactggtccgcagtgcagagaatgtggtcatgacccgcaccttctccaagatcggccttggtggcgcgcggatcggctggatgtatgcgcccatgcacatcgtcgacgccatcaaccgcgtgcgcggtcccttcaacgtcaacgcgacggcgatcgaggccggcatcgcggcaatccgcgaccgcgcccatgtcgagcgcagcgtgacgcacaacgagacctggctgacctggctgagccaagagatgaccgggctcgggttgcgggtgacgcccagcgtcggcaatttcctgctcattcactttcccgatgatcagaagcattcggcggctgcggcggacgactatctgaccgcgcgcggctatatattgcggcgcgtttccggctacggctttcccaacgcgctgcgcatgaccgtcggcacggaagaggccaatcgcggcgtcgtcgccgcgctcacgacattcctgaaaagctag

SEQ ID NO: 35679 - DNA, 768 bp, Mesorhizobium loti
atggcggtcgaaatcgaacaattcatgtgccggagcgacaatttcggcgtgctggtgcatgaccccaagagcgggcagaccgcgatcatcgacgcacccgaggaagcgcccatcctggccgcgatcaagcgcaccggctggacgccgacgatgatcctgaccacgcatcatcatatggaccacgtcgaggccaatctggcgctgaaggagcgcttcaagctgcgcatcgtcggcccggaggcggaaaaggccaagatccccggcatcgacgaaaccgtcgaggagggctccgtccttcatctcggcgatgagcgcatcgaggtgatcgccacccccggccataccgccggtcatgtctcctatcatctgccggcatcgaaggtggccttcaccgccgacacgctgttcgcgctgggctgtgggcggctgttcgaatgcaagccgccggtgatgtatgaatcgctgcggaaactcgcagcccttcccgccgcgacgacaatctattgcggccatgaatacacgcttgccaacgcccgtttcgcgctgaccgtcgacccgaccaattcggcattgaaggagcgcgccaccaggatcgaggcgctgcgggtcgacaacaagccgacactgccgacgacgatcggcgaggaactgtcgaccaatcccttcctgcgctggcacgatccggcgatccgcaagcatcttggcatggaaaaggccggggatgccgaggtgttcgccgaaattcgcaagcgcaaggacaatttctga

SEQ ID NO: 35680 - DNA, 1137 bp, Mesorhizobium loti
gtgagcgcggaccagccagtcaccgtcgaagtcggccttggcgaccgggcctacgacatattgatcggctccggccttttgtcgcgcgccggcgaagagatttcgcgccggctgccgggtacgcgcgcggctgtcgtcaccgacgagaatgtcgctgccgcgcatctcgatacgttgaaggcagggctcgagaagggtggcatccagcccaccgtcatcacgatgccgcccggcgagaagaccaagagctttgcccatctcgaagaggtggtcgatgggattctggccgcaaggctggagcgtggcgacgtcgtcatcgcgctgggcggcggcgtcatcggcgatctcaccggtttttccgcgggcatcgtgcggcgcggcatgaatttcgtacaggtcccgacctcgctgctggcgcaggtcgattcctcggtgggcggcaagaccggcatcaacagcccgcgcggcaagaaccttgtcggcgtcttcctgcagccgaaactggtgctggccgacacggaagtgctcgacacgctgccgatccgcgaattccgcgccggctatgccgaactcgccaagtacgggctgatcgaccggccggaacttttcgcttggctggaggcgaactggcagaaggtgttcgccggcgggccggagcgagcgcaggcgattgccgaagcctgccgcgccaaggccgatgtcgtcgcgcgcgacgagttcgagaccggcgaccgggcgctcctcaatctcggccacacattcggccatgcgctcgaagccgccacgcagtatgacggcgcccgcctcgtccatggcgagggggtcgccatcggcatggcgctggcgcatcgcttctcctcgcggctcaatctggccagccccgacgacgcggcacgcgtcgagacgcatctgcgcgccgttggcctgccgtggcggatggccgatattccaggtgaattgcccgatgccgaggcgctgcttgccttcatcacccaggacaagaaggtttcgcgcggcgcgctgaccttcatcctgacgcgcggcatcggccaggctttcatcgccaaggacgttccggcttcggaagtgctgtcgttcctgagggaaaaccatccaaccagccggaaagccggctga

SEQ ID NO: 35681 - DNA, 612 bp, Mesorhizobium loti
atgaacgcgcaccaggcaaatcccccaggcgagagcctcgccgcgctgcttggccggctgggcagccggtccatcgtctttgtcggcctgatgggcgccggcaagacggcgatcgggcgcaaggtggcgacgatgctttcgctgcctttcatcgacagcgaccaggagatcgagagcgtctcgcgcatgaccgtgccggagctgttcgagcgctatggcgaggccgagttcagggccctggagcagcgcgtcatcctgcgcgtgctggaaaatggcccgcaggtgctgtcgaccggcggcggcgccttcatgaacgcgcagacgcgcgaggccatcgccggccatggcgtgtcggtgtggctgaaggccgagctcgaccttctgatggaccgggtctcgaagaagcagaaccggccgctgttgaagagtgccgatcctcgcgccgtgctggagcggctgatgagcgagcggtatccggtctacgcgacatcggatgtcaccgtgccgacccgcgacgaccgcaaggaagtcatcgctgccgaggtgctgaatgcgctgtgccggcatttcggcatcgatgaaattgcagcgacgggcgagatcgaatcgtga

SEQ ID NO: 35682 - DNA, 1506 bp, Mesorhizobium loti
atgaaggccagagtcacggcgaacgcggcctatgccatcgcggatatcgacaaacgtctctacggctcgtttctcgagcaccttggccgggcggtctacacgggcatctacgagcccggacatccgcaagcggacgcagaggggatgcgcaaggacgtgatcgagctggtgcgtgcgctcgacacaccgatctgccgttacccgggtggcaacttcgtgtccgcctacaattgggaggacggcataggcccaaaggagaaccgcccgcggcggctcgatcttgcctggcgcaccacggagccgaacctggttggaatccacgaattcgccgactgggccgaaaaagccggcaccgagatgatgcttgcggtcaatctcggttcccgcggcctcgacgaggcgcgggccttcgtcgaatacgtcaaccacccgggcggcagctactggtccgacctcagggccacgaacggacgcgcgcaaccctggaactgccgcctctggtgtctcggcaatgaaatggacggtccctggcaggtcggccacaagtcggcgagcgaatacggccatctcgccaacgagaccgccaaggcgctgcgcggtctcgacccgacggtggaactggtcgtctgcggctcgtcgcattccaatatgccgacctatccgcagtgggaagcgaccgtgctggaggcgacctacgagcaggtcgactacatctccctgcacatgtatttcgagaattacgagaagaatacgtccgaatatctcgctcttccggccaagctcgaccgctacattggcacggtcgcgggtatcatcgactatgtgaaggcaaagacccgctcaaagcgggacgtgaagatctccttcgatgagtggaacgtctggtaccatcagcgcaagcaggacgccgagcgcatgcgcggctgggactggccggaagcgcccaggcttttggaagacatctacaatttcgaggacgtgctgcaggtcggctgcatcatcaacaccttcatccgccggtcggacgttgttcgcatcgcctgcattgcgcagctggtgaacgttatcgcgccgatcatgaccgatcccggcggcggcgcctggcggcagacgatctactggcctttcatgctggcctccaggcacggccgcggcaccgcgctgcagctcgcggtcgaggtgcctacttatgacgcggccgcggccgacaaggtgccatggctcgacatcgcaggtgtgcacgattcgaatgccggcacgctgaccttcttcgccatcaaccggcatggggccgagacgatagaggccgatgtcgccctcgagcggttcgccgccaagtccatcgagcatacgatcatccgtcatgacgatctcggggcctgcaacaccaaggacgcgccggacaccgtatcgccggtcaagggcaacggggcagcgctcagcagcaagggaatgacgctgaacttgccgccgcactcctactcgatggtgcgcgtgacgctctga

SEQ ID NO: 35683 - DNA, 1650 bp, Mesorhizobium loti
gtgccggctgtaacaggcgaagcgaacggcttgcgcggtgtcgcagccagcgagggcgtcgcgatcgggccggccttcgcgcatttcccgcccgagatcgccgcacagggccgcgtgttgcaggccagcgagatcgtcggcgagattgacaggttccgtgccgccgtcgccgccgtccaggcgcgcatggaccgggccttggcgcaggacagcctgtcggccggagaccgaggcatcgtcgcggcactcagggatatcgccgccgacgacagcctgaccggcgaggccgaaaaggcgatcaggggcggcaacgacgcggtctcggccgtcattaccgcagccgccaccatcgccgccgatttcagcgcggttgacgatcactacctcaatgcgcgggccgacgatgtccatgccgtcggacggcagatctgcctggtgctgcttggccaggacgacgtcagcctcgaaagcatgcccgaaggcgccattctgatcgccgacgatatcggcgcctgggatttggcgcgtgcgccgctgaaacgcattggcggggtgatttgcggccatggcggcgccacctcgcacatcgccatcatcgcgcgctcgcacggcattccggcggtgctgggccttggcgaccaggtcaatgccttgcgcaccgcgcgcgacgtcgcgctcgacggcaacaccggccatgtgatcgtcgacccggacgcggcgacacgcgccgactatgggggccgcgtcgaagcagcggcgaaggaacgcgccggcctgaccaccttcaagacggtgacgccgaagcgcgccgacggcaaggtgatcgaggttgcggccaatatcggttcgctcgaggaaatcgaggcggcgcaggaagcgggcgccatgggcgtcgggctgttccgcaccgagttgctgttcatgcgccatatgcacctcccctcggaggacatgcaggccgagacctatgcggcgctggccaaggccttcgccccccatccggtcatcgtacgcacgctcgacatcggcggcgacaagccgatcgccggcatcgagtttcccgacgaggacaatccctttctcggctggcgcggcatccgcatgtgcctcgaccggccggatatcttcaagcgccagctcagggcgctgctgagggcggccgtgcagggcaacatcaaggtgatgctgccgatggtgtccgatatttccgaagtcacgcgcacccgcgcactggtcgatgaatgcgccgccgaactcaaggccgaaggcgtgccgcatgcaacattcgatctcggcgtgatgatcgaaactccggccgccgtgctgatcgctccggcgctggccaaggaagtggccttcttctcgatcggcaccaacgatctgacccagtacatcatggccgccgaccggctcaacccgaccgtcgccaagctcaatgacgtcaccaatccggcggtcatgtcggcgatcgagctgacggccaaagccggcgtcgccgccggcatcatggtgggcatgtgcggcgaggcggccggacgcccggatctgatcccggccttcatcgagatgggcctgaccgagctttcgatgagcccggcctcgatccagcgcgccaagaagacaatcacggccatggccgctggggaatag

SEQ ID NO: 35684 - DNA, 675 bp, Mesorhizobium loti
gtggcgcgaccaaggcctatcattttcgattgcgacggtgttctcgtcgacagcgagccgctggccgccagggcatatgagcgcgtctatgaaaagcacggcatgccgggcgtccatggcggcatcatcgcccaatgcgtcggcatgaagcagtccgacatcatcgcccggatcagggaactgaccggccaccagtttcccgctgccgccgatggcgatatctgggcagagaccaaagtgctgttcaccgaggaattgaagccgaccccggggatcgcggcatttctggaaacgctcgagggcgaccgctgcgtcgcctcatcgtcctccgtcgagcgcataaaccacagccttgccgtcaccgggctggcgcatatcttcggcgaggcgatctacagctcctcgatggtcaagaacggcaagccggcgcccgacatcttcctgttcgccgccgccaggatgggcgccgacccggccgactgcatcgtcattgaggattcgcccttcggcatccagggcgcggtcgccgccggcatgacggcgatcggctacaccggcggcggtcacacctatgccgagcacgctgcgcgactgacggcggccggcgccgatttcgtctgcgccgactggcacgaagttagccggcaattgtccgggctcggcgtgccggcctga

SEQ ID NO: 35685 - DNA, 1365 bp, Mesorhizobium loti
atgccgaccgaagtcattctccccaaggtcgatatggacatggcgaccggacagatctcgcgctggttcgccgaagaaggtgcccgggtcaagaagggcgatgtgctgttcgagatcgagaccgacaaggcggccatggagatcgatgcgccggccagcggcgtgctgcgcgacgtctcaggcaaggaaggcgtcgacattcccgtcggcgcgccggttgcgtggatttacgccgacgatgaggcttatggggccaagcaagacgcggcgccaatctccccccttgtgggggagatgtcggcgaagtcgacagagggggacgtcgtcccaccaacgtcgcattctgtcatgcccccctctgccctgccgggcatctcccccacaaggggggagattggccaatcaccgccaggcgaacgcgcgacaccgcttgcccgacgtctggctcgtgaggcaggtcttgcccttgccggcatcatcggcaccggcccgcatggccgtgtggtgaaggccgatgtcgatgcagcgattgccggcggtggtgccaaggcagcgcccgccgccaaggctccggccggtgcgccggctgccgctcccgcgccggctgtgaagccgatgtcggacgaccaagtgctgaagctgttcgagcaaggctcctacgaactcgtcccgcacgacaatatgcgcaagaccatcgcgcgccgcctggtcgaggccaagtccaccatcccgcatttttatctaacgctcgactgcgaactcgatgcgttgctggccttgcgcacgcagatcaatgccgccgcaccgatgaagaagaccgaaaagggtgacgtgcctgcctacaagctgtcggtcaacgacatggtgatcaaggcgatggcgatggcgctgaaggcggtgccggatgccaatgcctcgtggaccgaaaccgccatggtcaagcacaagcatgccgatgtcggcgtcgccgtgtcgatccccggcggcctgatcacgccgatcattcggcatgcggacgaaaaaacgctgtcgaccatttccaacgagatgaaggacctggccagccgtgcccgcagccgcaagctgaagccggaagagtatcagggcggcacgacggcggtctccaacctcggcatgttcggcatcaaggacttcgccgccgtcatcaatccgccgcatgcgacgatcctggcggtcggcgccggtgaagagcgggctgtggtcaagaatggcgagatcaaaatcgccaccgtgatgtcggtgacgctgtcgaccgatcatcgcgccgttgatggcgcgctcggcgccgaattgttggtcgccttcaagcggctgatcgagaacccgatgggcatgctggtgtag

SEQ ID NO: 35686 - DNA, 999 bp, Mesorhizobium loti
atggacgcgacggtgcgtgaactgagctacgcccaggcgatccaggaagccatggcgatcgccatggacatggacgagcgcgtcttcctgatgggcgaggatatcggcgtctatggcggcgccttccaggtgaccggcgatctggtggagcgttatggcactgagcgcgtgatcgacacgccgatctcggaactgggcggcgcgggggtggcggtgggtgcggcgctcaccggcatgcggccgatcttcgaattccagttttccgatttcgccacgctcgccatggagcagatcgtcaaccaggcggccaagatgcgattcatgctgggaggcgaggtttcggttcccgtggtgatgcgctttcccgccggttcgggtacgggtgcggccgcgcagcacagccaaagcctcgaagcctggcttggccatgtgccaggcctgaaggtcatccagccggcgacgccctatgatgccaagggcatgctcctggctgcggtcgccgatcccgatccggtgatgatcttcgagcacaagctgctctacaagatgaagggcccggtgccagagggctattacaccgtgccgatcggcaaggccgacatccgccgcgagggccgcgatctcaccatcgtcgccacctcgatcatggtgcagaaggcgctcgacgccgccgccacgctggaagccgaaggcatcgacgtcgaagtcgtcgatctgaggaccatccggccgatggacaagcagaccgtcatcgacagcgtcaagaagacgtcgcggctgatgtgcgtctacgaagcggtcaagacgctgggcatcggcgccgaggtcagcgccatgatcgccgagagcgaggcgttcgactatctcgacgcgccgatcgtgcggttgggcggcgcggaaacgccgatcccctacaatccggagctcgaaaaggccacggtgccgcaggttcccgacatcatcagcgccgcgcgcgacctcgtgaaaggggttcgctga

SEQ ID NO: 35687 - DNA, 1029 bp, Mesorhizobium loti
atggctggtgccagcaaagccgtcgcggacagtcgcgccaacctgcctttcgtctatcgccagtacagcgccgagcagctcagagaggtgctctacaagatgtatcttatccgccgcttcgaggagggcgcggaggaaagctacatgcgcggcctgatccacggcaccatgcatctgtcgatcggccaggaagccagcgccatgggtatctgcatgccgcttggcgaggatgaccagatcacctcgacccatcgcggccatggccattgcatcgccaagggcgccgaggtcaagcgcatgttcgccgagttcttcggcaagaccacgggctactgcaagggccgcggcggctcgatgcacattgccgatgtcgccaagggcaatctcggcgccaacggcattgtcggcggcggtattccgatcgccgtcggggcggcgctctcgtccaagatgatgaagaccggcaaggtggtcgtctccttcttcggcgacggcgccaacaatgaaggcgccttccacgaggcgctcaacatggcggcggtctggaagctgccggtcatcttcgtctgcgagaacaatggctatggcatgtcgacctcgaccgcccgttcgaccgcggtgaagaacatcgccgaccgcgccgccgcctattcgatgcccggcgtcatcgtcaacggcaatattttttcggaagtcgccgaggcgtcctacagggccgtcgagcgcgcccgcgccggtgaagggccgacgctgatcgaatccaagacctatcgccatcgcggccattccaagagcgaccgcaatcgctatcgcaccaaggaagagatcgaggactggatgtcgaaccgcgacccgatcacgctgttcgagaacgagctgcgcgaattcggcttcatcgacgacaagggcatcgaggccattcgcagtgcggtgtcgcaggagatcgccgacggcatcgagttcgccaaggcgagcccgtcgcctgacgtcagcgagaccggaaattacgtgtatacggagcaggcgtga

SEQ ID NO: 35688 - DNA, 789 bp, Mesorhizobium loti
atgggttccctgtcttcgaagaatgccctcgtcaccggctcgaccagtggtatcggcctggccatcgcccgcgccttcgccgccgagggcgccaatgtcaccatcaacggtctcggcgatccggcggccatcgagcaggagcgcgcgggcatcgagaaggatttcggcgtcaagtgccgctactccgacgccaacatgatggatggcgccgcggtcagcgccatggtgcatgacgccgaggctgcattcggcagcctcgacatcctggtcaacaatgccggcatccagcatgtcgcgccgatcgaggagtttcccgacgacaaatgggaagccatcatccgcatcaatcttctggcggccttctatgccatcaaggcggcggtgcctgggatgaaggcgcgcaaatggggccgcatcatcaacacggcctcggcccacgcgctggtcgcctcgccgttcaagtcggcctacgtctcggccaagcacggcattgcagggttgaccaagacggtggcgctggaagtggcgcaggacggcatcaccgtcaacgctatcgcgcccggctatgtctggacgccgctggtcgagaaacagatccccgacacgatgaaggcgcgcggcatgaccgaggaacaggtcaagcatgacgtgctgctcgccgcacagccgacgaaggaattcgtcaccgtggaggaacttgcggcgttgacactgttcctgtgctcagatgcggccaggcagatcaccggcacgaccttgccgatggacggcggctggacggcgcagtag

SEQ ID NO: 35689 - DNA, 1419 bp, Mesorhizobium loti
atggctgcggtgagagacctgaaggcgaccgaaatggcagcgtccggcggtgacgatgccattgaactgggcaagcgccatctcatccagccctggccttatgccggttccgtcggtgccgaagcccgcgcgctgattggcgaaggcgacggcatatacatcaccgacaacaccggcaagcggctgatcgacgggcctgccggcatgtggtgcgtcaatgtcggccaccgccgcgaggaactggccagggtgatgtacgaccaggcgatggcgctgtcctacaacacgccctggtacacgatgaacgcgccgtcggccgaacttgccatgcgtatcgccggccatgcgcctgatgatctcagccatgtcttctatacgaccggcggctcttcggccgtggagacggcgctgcgcttcatgcagttctacaacaatgtgcgcggccggccggaaaagaagctgatcctgtcgcgcggcggcgcctatcatggctcaacctatctatcggcctcgctcaatggccgcccgcgcgaccgcgactggatggacggcgccgacgagctggtgatcaaactgtcctctcccgatccgttccgccgcccgcaaggcatgagccttgccgccttcaccgacttcctcgtcgaccagttccgcgacacggtcgcccgtgtcggcgcagacaaaatcggcgctttcgtcggcgagccggtgcaagcatcgggaggcgtcgtgatcccgcccgacggctatctcaagcgcatccgcgagatctgccgcgtcaacgatatcctctacgtctccgacgaggtggtgacgggcttcggccggcttggccatgtcttcgcctcgggtgacgtgttcggcatcgatcccgacatgatcaccttcgccaagggcgtcacctcaggctatttcccgctcggcggcgtcatcatctcggaacggctgctgcaggagttgcgccgttcgaaccatcccgatgcgatgttcggccatggcttgacctataccagccatcccgtcggctgtgccgtggcgctgaaaaacctcgacctgctggaagagagcgtgcttgcccatacgcaggcggtcgcgccctatttccaggcgcagctgaagacgctggaagagctgccgctggtcggcgaggtgcgcggcgccgggctgatgggctgcgtcgaatgcgtcgccgaccgcgaaagcaagaacccgctgcagctcgacaaggatgtcggcaaacgcatcgacgcccactgccatgagctcggcctgctggtacggccactgatcaacatgtgcgtgatgtcgccgccgctgatcatcacgcgcgagcagatcgacgacatggtcggcattttgcgcgaaggcatttcgcggaccatggatgatctgtggaaagagggcgtgtggcgggggtaa

SEQ ID NO: 35690 - DNA, 1311 bp, Mesorhizobium loti
ttgacggacgaactggaaagaaccgacgtcgtcatcgttggtgccggcttcaccggcctgtcggcggcgcttgaactgaagcgggctggcatcaatttcgtgctgctggaggcacgcgatcgtgtcggcggacgggtggaagccgttcggaatggacttggcgagcgcatcgacagcggcggccaattcctgtgcgaggacatgccggaactgatggcgctggcgagggcgcgcggcaagacattcgtcgaaacctatgtcgagggcgacttcatcacgcatccgtcgatgccgcccaaagacgccaagcagacttatcacggcgcgatggcgatccgcgagcgcatgaacggcatcgagccggacgacccgtcgataaaaggcatgagtgtcgccgcctggctcgagcgccagcctgatcccatcgatgccaggacggccttccgctcgatgatcgaaggcctgtggtgcctgccgatggacagggtgccgctctggtacctgatcgacaatgatcggcgcatcaccaacgaggtgccggagctgcaatattccttgcgcgagaccatgcagtcgcttgccgaggatatttctggtgatctcggcgaccgggtgcggctcggcgaaccggccacgcgcgtcgagcataggccgcagggcgttcgtgtcgtcacgggcaaaggtgcgatggaagcgcgccagctgctggtcgcgctgccgccggcgacggccgcgaagctcgatttcgcgcctaccttgccggcgagactcgcgaaggcgcttggcgtctgggaaagtggcgcggtgatcaagatcctcgtgcgctatcccaggccattctggcgcgagcagggtttgagcggcatggtgatgtggcgcgatctgccggggctgtttgcctgcgacgccagcaaggacgcggagcatgccgcgctcgtcgtcttcgtcggcgggccgctggcgttgcgctggcgtgtgctggacgaggcggggctgcgcgcggaagtgaccggccgattgcaggaggcgctcggccccgatgccggcgacatcatcgatttcagctcgcgcgactggataaaggatcgctggagcggcggcgcctatagcgacctcatcgtcgacgtgacggccagggatgccgagcggacgattctttcgggtgcgccgccggtgcatttcgccgcttcggagctgtcgccgtcatttcccggttatgtcgaaggcgcgatcgtcgccgggcgcatcgcggccagaaaaataatcgccgagcttcaatcccccatcgccaccagcgcctcgggatcgtag

SEQ ID NO: 35691 - DNA, 795 bp, Mesorhizobium loti
atgatcgaaacggcagatgccgagtatgacgacaccgccatccgcttcctcgaggcgctgtggggcgatggctacctgtctccgggcggacctgaagaggtcgaccgggtcgtcgaagggctttcgctcgagggcaagacggttctcgatatcggctgcggctccggcggcatcaccttgcatctggtcgagcgccatggcgctgcccgcgccaccggtttcgatgtcgaacagccagtgatcgaggcggccaggcggcgagctgccgggcgcgggctctcggaccgcgccagcttcgtccaggcgccacccggagcgctgcctttcgccgatcgctccttcgatgccgttttttccaaggacgcgctgctgcatgtgccagacaaggacggcgtgttcgccgaaatcttccgcgtgctgaagccgggtggcgtctttgccgcctccaactggatgatcgggcatgacagtgaaccgtcgcccgagatgaaggcctatatcgccgccgaagggctgtccttcgccatggcctcgccggcgcgctatgcgcacgcgatgcgcaacgccggctttgccgatgtcaccgtcagggaccgcaacccctggtatcgcgaggtggcgcgcggcgagctggaaaggctgaaaggaccgctctatacgccggtcgccgccgtggtcggcgctgcctatgtcgacaagaacatccgaacctgggaggccatgcagaaggtgcttgacagtggcgagcaccgtcccactcatctgcgcggttggaagccggatgcgattggatag

SEQ ID NO: 35692 - DNA, 1620 bp, Mesorhizobium loti
atgaaagcttgggatgcgatcgtcatcggcggcggacacaacggcctcgtcaatgcctgctatctgcagcgcgccgggctcgacgtgctggtggtggagaagaacgactgggtcgggggcgcggccaccagccgcgagttgacgccgggcttcgtctattccaattgctcctatgtctgctcgctgttccgccccgaaatcatgcgcgacctcgaactgccgcgcttcggcctgcaggtcatttcctatgagggcggcgcggtgttcacccgcgacggcgattacctcgccaattaccgcgaccatgatgcgcaccgccgcgaattcgcgcgcttctccaggcgcgacgccgaagcctatgaccgctacgcccgcgacgtgacgcggcagtgccgcttcatccagccgctgctgatgcgcaccgctccggacccgaccagcttcaagccgcgcgacatcggcgagttgctctatctcggcaagaaattcgccggcctgtcggcggaggaaatggcgctgacgctgcgcttctggacgatgtcgatctcggatttcctcgacgagtatttcgagacggatgtcatcaaggcgaacttcgctttgtccggcatcatcggcaccgcgctcgggccgatgtcgcccggcacggcctacgtgctgctgcaccactatatgggcgaggtcgatggctcggtcggcgcctggggctatgcgcgcggcggcatgggcgccgtcaccaaggcgctggccgcgtcgttcaaggcctcgggcggcaccatccgcaccggcgccgaggtcgaccacgtgctggtgagccgcggcaaggccaaaggcgtggtgctggccggcggcgaggaggtttacggcaagctcgtcgtctccaatgccgacgtgaagcgcaccttcctgaagctggtcgaggaaaaggaactgcccgatattttcctgcgccgggtgaagaacttcaagatccgcggctcgtccggcaaggtcaacatcgcgctcgattcgctgccggaattcccggcgctggcgaaggattcgccggtctatcgcggcgacatgcatttcaccgattcgatcgagcgcatggagcgcgcctatgacgactggaaggccgggcgctggtcggcggaccccttcctcgacatggtcatcccgacgacgctcgacccgaccatggcgccgccgggcaagcacttcatgagctgcttcgtgcaatacgccccgcccaaggtgaatggccgcgactggaccgacgccgatcgcgacggcttcgccgagagcgtagttgcgcagatcgccgagtactcgcccggcttccgcgaccgcattgtccatatggaggtacgcacgccgcgcgagatcgaggccgaggtcggcttgaccgaaggtaatattttccagggtgaactgaccttcgaccagcttctgttcaaccgcccggtgcccggctacgcgcagtaccgctcgccggttggcgggctctatatgtgcggctcctcgactcatccgggcggcggtgtcatgggcgcgcccggccgcaatgccgccgccgaaatcctgcgcgatctcgccaaatccacctcgcatatgagcctcgcccatgacgtcatttga

SEQ ID NO: 35693 - DNA, 1059 bp, Mesorhizobium loti
atgaccgaaaccgacctcgtccccgtcttcgacggccacaacgatacgctgctgaggctgtatcaatcgaaggacagggacgtcgaaaagctgttcgtcgaaggcaagtcgggcggccatatcgacctgccgcgcgccaaggcgggcggctttgccggcggcatgttcgcgatctttccgccgccggtcgagaaagccaggcgcagcgccgtgcccctggcgccgagcgacagcgagccgctgccgccggaggtgccgcgcgccgaagcgctcaactcgacgatggcgatggcctcgatcctgtttcggctggaacgggccggggctctggccgtctgccgcaccgccggcgatgtgcgcaacgccatggccaaaggcacgatcgccgcggtgtttcacatcgagggcgtcgaggcgatcgatccggaactgaccatgctcgacgtgctgcatgccgccggcctgcgctcgctcggcatcgtctggagccggccgaatgctttcggtcacggcgtgccgttccgctttccgtcctcgccggataccggcccggggctgaccgatgccggcaaggcgctggtcaaggcgtgcaacgaactgaagatcatgatcgatctttcgcatctcaacgagaagggttttcgcgatgtcgccggtctcagtgacgcgccgctggtcgccacccactccaacgtgcatgcgctctgcacccattcacgcaacctcaccgactggcagctcggcgccatacgtgagtccggcggtatggtcgggctgaacttcgccaccggcttcctgcgcgaggacggccgcatgaatgccgacaccagcctcgacatcatggtgcgtcatgtcgattccctgctgcaggcgctgggcgaggacggcgtcggtctcggctcggatttcgacggcgcgatgatcccggccgtcatcggcgacgtcgccggcctgccgaagctgatcgatgccctggccgcgcgtggttttggccgcgcgctgatcgagaagatcgcgtatcgcaattggctgggtatgctcgaaagaaccattggctag

SEQ ID NO: 35694 - DNA, 1569 bp, Mesorhizobium loti
gtgacaggaaaagccagacgcccgaacgttctcctgatcacctgcgaccagtggcgcggtgattgcctgtcggctgccggccatcccgtggtgaagacgccgaatgccgacgcgctggccgccgagggcgtgctgttcaagcagcattatggcggcgcggccccttgctcgccggcacgtgcctgcctctataccggcctctaccagatgaacaaccgcgtctgccgcaacggctcaccgctggacgcccgtcatggcaacatcgcgcagcacgcacgcagcatcggctacgatccgacgctgttcggctacactgacgtggcgctcgacccgcgcctgctgacctcgggtgatccaaggctgaaaacctatgaaggcgtgctgccggggttcacggtacgccagctgctgccggagcatcagaagcagtggctctcctggctgaagcagcagggcgtcgacgccagcgccggatctccaggcatccaccgtcccgtaggcgatgaagacgatgacagcgtgaccgaggcgccgccgatctattcgaaagaccatacgccggcggctttccttgccggtgagttcatccgctggctcggcgagcaggagcaggccgccccctggttcgcgcatctgtccttcatcagtccgcacccgcctttcatcgtgccagagccctacaacacgctatacgatccggccgacggccccgccttttaccgcgccgacagctggcgggccgaagcgcagagccatccctatctcgcctatgatctcagccagcggaatcgcgcgaatttccgccccggcgccgcaggcaaggtgcatgactggagcgaggatgatttccgccgcatccgggcgatctattacggcatgatctcggaggtcgatgcacagcttggcctgatatggcaggcgctcaagctttcaggcacatgggacgacaccatcgttgttctcacctcggaccacgccgagatgatgggcgaccatttcatgctgggcaagggcggctacttcgacggcagctaccatatcccgctgatcattcgtgacccgcggcatcgcaaggcggccggcagcgcggtcgatcgtttcaccgaggcggtggatatcttgcccacgctcatagacctgcttggcgagccgcccgagccgcatctcgacggatgctcgctgaaaccattcctgagcggcggaagccccgccgcctggcgcgacgccgcacactgggagtttgatttccgctcgatcgcggacggcgaagccgaagcgcatttcggcattggctcgcgccagtgcaacctggctgtcatccgcaccaaaaaattcaaatacgtgcattttggcggcggtttgccgcctctgcttttcaacgtcgaggcagaccctggcgaactgaccaacctcgccaccagccctgcgcatctgtccacccgtctgcaattcgccgagcggcttctcgcctggcgggccgaacatctcgaccagtcgctggcgctggcggagctgacggaaaatggcgtggtgggacatgtcagcaagggaataggcagtagggaatag

SEQ ID NO: 35695 - DNA, 660 bp, Mesorhizobium loti
atgagccttcgtatcaacgacatcgcaccggatttcaccgccgagaccacgcaagggacgatcagctttcacgactggatcggtgacggctgggcgatcctgttcagccacccgaagaatttcacgccggtctgcacgaccgagcttggcacgatggccgggctggaaggcgagttcaagaaacgcaacgtcaagatcatcggcatctccgtcgatccggttgcgagccacgacaaatggcaggccgacatcaagacggcgaccggccagacggtgcattatccgctgattggcgacaaggacctcaaggtcgccaagctctacgacatgctgcccgccggcgccggcgagacctcggaaggccgaacgcccgcagacaacgccaccgtgcgctcggtctatgtcatcggaccggacaagaagatcaagctggtgctgacctatccgatgactacgggccgcaacttcgatgagatcctgcgcgcggtcgattccatgcagctcaccgccaagcatcaggtggcgacaccggcaaactggaagcaaggcgaggacgtcatcatcaccgccgccgtttccaacgaggatgcgatcaagcgctttggcgcctttgacaccatcctgccttatctcaggaaaaccaaacagccgtccgcctga

SEQ ID NO: 35696 - DNA, 2052 bp, Mesorhizobium loti
gtgtcgcgcaccttttcaagggcgctcccaagcccccaaacccccacctttggaggaaccatgacgtcgcgtgaacaacatgatcggatggccaatgcgatccgctttctctccatggatgccgtcgagaaggcccagtccggccatcccggcctgcccatgggctgcgccgacattgcaacggtgctgttcacccgcttcctgaaatacgatcccaaagccccgcactggcccgaccgcgaccgcttcatcctgtcggctggccatggctcgatgctgctctattcgctgctgcatctgaccggctacgaagacatgaccatcgaccagatcaagcacttccgccagctcggctccaagaccgccggccatcccgaatacggccacgccaccggcatcgagacgacgaccggcccgctcggccagggcctcgccaattcggttggcttcgcgctcggcgagcgcatcatgaacgccgctttcggcaacgacctcgtcagccactacacctatgtgctggccggcgacggctgcctgatggagggcgtttcccaggaagccattgcgctggccgggcatctcaagctcaacaagctgatcgtcttctgggacaacaacaacatctcgatcgacggcccggtctcgctggccgacaacaccgaccaggttgcccgtttccaggcctccggctggaacgccagccatatcgacggcaccgatccggaagccatcgcctacgccatcgaagccgcccgccattccgacaagccgacgatgatcgcctgcaagacgaccatcggcttcggcgcgccgaccaaggccggcaccaacaaggcacacggttcgccgctcggcgccgacgagatcgccggtgcgcgcaagttcttcaactgggagtcgccgcccttcgagattccggccgacatcctcgatgcctggcgcaccgccggcaaggccggagccaagccgcgcgccgactgggaaggccgtctcgccaaggccgagccgaagctgaaggccgagttcgagcgccggctcgccggcaagctgccgtccaatttcgacgccgtcatcgccgactacaagaagaagctctcggccgacaagccgaaggtcgccacccgcaaatcgtcggaaatggcgcttgaggtcatcaacggcgccgttccggaaactatcggcggctccgccgacctgaccggctccaacaacaccaagaccagccagaccaagaacatcacgccggacgattacggccagcgctatgtccactacggcatccgcgagcacggcatggcggcggccatcaacggcctgacgctgcatggcggcctcatcgcctatggcggcaccttcatgtgcttctccgactatgctcgcccgtcgatgcggctttcctcgctgatgggcatccgctcgatcttcgtcatgacccatgattccatcggtctgggcgaggacggcccgacccaccagccggtcgagcatctggcagcgctgcgcgccattcccaaccacaatgtcttccgcccggccgacgccgtggaaaccgcggaatgctggcagatcgcgctcgaatccgaaaagacgccgtcgacgctggcgctgacccgccagaacctgccgacggtgcgcatcgagcactcggccaagaacctgagcagccagggcgcttacgaactggccgcggccagcggcgaggcggcagtgacgatcttcgccaccggctccgaggtcgagatcgcactcggcgcccgcgacctgctcgagaagcatggccacccgacccgcgtcgtgtcggtgccttgcttcgagctgttcgacaagcagagcgacgactaccgcaagaagacgatcggcaacgcgcctatcaagatggcgatcgaggccggcatccgccagggttgggaccatctcatcggctcggacggcatcttcgtcggcatgaccggcttcggcgcctcgggcacgatcgagcagctctacccgcatttcggcatcaccgccgaggcggcggccaaggcggcggaagcccgcctgcacgccaagtaa

SEQ ID NO: 35697 - DNA, 1011 bp, Mesorhizobium loti
atgaccgtcagagttgccatcaacggattcggccgcatcggccgcaacatcctgcgcgccatccatgaatccggccgcaaggacatcgacgtcgtcgccgtcaacgatctcggtccggtcgagaccaatgcgcacctgctgcgctacgacagcgtgcacggccgcttcccgcatgaagtgtcggtttccggcgaccagatcaccgtcggcaaggaaaagttcaaggtcaccgccatcaaggatccgacgcagctgccttggaaggagctcggtgtcgacatcgcgctcgaatgcaccggcatcttcaccgctcgggacaaggccgcctcgcacctgaccgccggcgccaagcgcgtgctggtctcggcacctgccgatggcgccgacctgaccgtggtctacggcatcaaccacgacaagctgaccaaggaccatatcgtcatctcgaacgcgtcctgcaccaccaactgcctggcgccgctggccgccgtgctgcatgagacggtcggcatcgaaaaaggcatgatgacgacgatccactcctacaccggcgaccagccgacgctggacaccatgcacaaggatctctaccgcgcccgtgcagcggcgctgtcgcagatcccgacctcgaccggcgcggccaaggccatcggcctcgtgctccccgacctcaagggcaagctcgacggcatctcgatccgcgtgccgaccccgaacgtctcggtcgtcgacttcaagttcatcgccaagcgcgccaccaccgtgcaggaaatcaacgaagcggtcatcgccgcctccaatggcaagctgaagggaattctcggcgtcacccatcacccgaatgtctcgatcgacttcaaccatgatccgcgctcctcgatcatggcgctcgaccagaccaaggtgatggacggcaacttcgtttcggtgctgtcctggtacgacaatgagtggggcttctccaaccgcatgggcgacaccgccgtcgccttcggcaagaccatcgcctga

SEQ ID NO: 35698 - DNA, 1197 bp, Mesorhizobium loti
atggccgccttcaagacactggacgatatcggcaacatcagcggcaagcgcgtgctggtgcgcgtcgacctcaacgttcccgtcgccgacggcaaggtcaccgacgccacccgcatcgaacgcatcgcgccgaccatcgccgaactgtcgggcaagggcgccaaggtcatcctgctcgcccatttcggccggcccaaggatgggccatccccggaattctcgctggagccgatcgccagggcgacggccgaggtgctcggccgtcccgtcggctttgcctcggattgcgtcggcgacatggcgggaagtgctgtcgcggccatgaacaagggtgacgtgctgctcttcgaaaatacccgtttctacaaggccgaggagaagaacgacccggccttcagcgagcggctcgccgccaatggcgacattttcgtcaacgacgccttttccgcggcgcaccgcgcccactcttccacagaggggctggcgcgtctgttgccttcctttgctggccgcaccatgcaggccgagctcgaagcgctggagaagggcctgggcaacccggtccgcccggtcgtggcgatcgtcggcggcgccaaggtctcgaccaagatcgacctgctgatgaacctggtgaagaaggtcgacgcgctggtcatcggcggcggcatggccaacaccttccttgccgcgcgcggcaccgatgtcggcaagtcgctgtgcgagcatgatcttgcccccaccgccaagcagatcatgatcgaggccgccgaggccggctgcgccatcatcctgccggtcgacggtgtcgtcgccaaggaattcaaggcgggcgccgcctgcgagaccgtcgccatctccgacgtgccggccgatggcatgatcctggatgtcggcgaaaagaccgtgaagacgatcggcgaatggatcgaccgcgccgcgacactggtctggaacggcccgcttggcgccttcgagatcgagccgttcgatcacgccacggtggcggcggcaaaacacgcggccgcgcgcaccaaggccggcaagctggtctccgttgcgggtggcggcgacacggtggcggcgctcaaccacgccggcgtcgccgacgacttcacctatgtctctaccgccggcggcgccttcctggaatggatggaaggcaagcctctgccaggcgtcgacgtgctgaagcgctga

SEQ ID NO: 35699 - DNA, 1029 bp, Mesorhizobium loti
atgatgagcgaacgtctcgaagacattgccgccgcgatcgtggccaacggcaagggcctgctggccgccgacgaaagttccggcaccatcaagaagcgtttcgacgtcatcggcgtcgaatcgaccgccgacagccgccgcgactatcgcgagatgatgttccgcgccagggacgcgatgaccaagtacatttccggcgtcatcctctatgacgagaccatccgccagaaggccgccgacggcacgcctctggtcgacatcatcaaggcatcaggcgccatccccggcatcaaggtcgatgccggcgccaagccgctggccggctttcccggcgacactgtcaccgagggcctcgacggcctgcgcgagcggcttgccgactattacaagctcggcgcccgcttcgccaaatggcgcgcggtgatcgacatcgacaccggcaagggcgtgccctcggccaattcgatcaactcgaacacccacgcgctcgcccgctatgccgccctttgccaggaagccggcatcgtgccgatcgtcgagccggaagtgctgatggacggcgcccacgacatcggcacctgctacgacgtctcgaaggcgacgctgatcaagctttatgatgaactccatgcggcgcgcgtcgtcctcgaaggcacgatcctgaagcccaacatggtgctgtcgggcaagaagtcgggcactgtggacagtcccgaaaaggtcgccgagatgaccataaaactgttccgcgagacggtgccggcggcggtcccgggcatcgccttcctctccggcggccaggaggacgaggaggcgaccgccaacctcaacgccatcaacgccatcggcccgcacccgtggaagctgaccttctcctatggccgcgcgctgcaggccgctccacagaaggcatggagcggcaaggcgtcgaacgtcgccgccggtcaggccgccttcacccatcgcgcccacatgaactatctggcggcgctcggaaaatggaaggcaagcctcgaacaggccgcctga

SEQ ID NO: 35700 - DNA, 657 bp, Mesorhizobium loti
atgtccctcacgctgcatttccatccgctggcctccttctgctggaagccgctgattgcgctttacgagaatggcacggccttcaagccggtcatcgtcgatctcggcgacgagcactcgcgcgcggccttcctgaagatatcgccgagcggcaagatgccggcgctgcgcgacgatgcgcgcgaccgctcggtgctggaatcgaccatcgtcgtggaatatctggccgcgcactatccggggccggtcgagctcgttcccgccgatatcgaccaggcgctggcggtccgccaggccgaccgcttctatgatttctatgtgcaggagccgatgcagaagatcgtcggcgaccggttgcggccgcaggacaggaccgatccgttcggcgtcgagcaggcgcgcggccagctgcgcaattcctacgccatcgtcgaacaggagatgcaatcgaagacctgggcggtgggcgaggccttcagcctggccgattgcgcggcgtctccggcgctcttctatgccaacaaggtcgagccgttcggcgacaaatatcccgccgtgaagcgctatcacgaccgcctgctgcagcgccccgcctttgccaaggtgatcgaggaggcgcagccctacttcaagttcttcccctacaataacggctga

SEQ ID NO: 35701 - DNA, 918 bp, Mesorhizobium loti
atgacgaatgacgacgaaatggcgttcgaaatggcgctcatcaggcgggcagccgccgtcgaggtgctgctgcggcgcttgctcgacgatcgcccgctttcgggagagatcgcgcggcccgaccgcctgatggcggcgatgcgccatggcgtgctgaacggcggcaagcgcctgcgccccttcctggtcatggaaagtgccgcccttttctccgccgatggcgaagcagcactgcgcgtcgcggcggcactcgaatgcgtgcattgctattcactgatccatgacgacctgccggcgatggacgatgatgatctgcgccgcggccagccgaccgtgcacaaggccttcgacgaggcaaccgcgatcctggccggcgacgccttgctgacgctggccttcgacatcgtcgccagcgaggcgaccgtcctgccggcggatcggcgagcggccttggtgctggcgcttgcccgtgcggccggagccggcggcatggtcggtggccagaagctcgacctcgaagccgagcagacaccgcccgacgaagcgggcatcataacgctgcaggcgatgaagaccggcgccctgatccgcttcgcctgcgaggccggcgccatcatcgccggcgctccggccgaggaccgcgaaaggctggccgagttcggctcggccatcggccttgccttccagcttgccgacgacctgctcgatttgaccgccgacgccggccagatgggcaaggcgaccggcaaggacgccgccgccggcaagggaacgctggtggcgttgcatggcgcgaattgggcgcacagccagttgcacggccttgtcgggcaggcccacgcgctgctcgacccctatggcgaccgggcggcgctgctgaaggaggctgcgaccttcgtcgcgacgcgcaacagttga

SEQ ID NO: 35702 - DNA, 756 bp, Mesorhizobium loti
atgtcggccaatctgttcgatctcagcgggcgccaggcgctcgtaaccggctcgtcgcaaggcattgggctcgctctggccaaggggctggcgcaagccggcgcaagcgtgatcctcaacggccgtgacacggcgaagctcgccgccacggcggcgcagatccctggagcgcaaacgcttgccttcgacgcgaccgagcatgacgccgtccgttccgcgatcgacaatttcgagctgtcaggcggaccgatcgacatattggtaaacaatgccggcatgcagttccgcacgccgctcgaggattttccggccgatgcattcgagcggctgctgcagaccaatgtcgccagcgtcttccacgtcggccaggcggtcgcgcgccacatgatcaggcggggccgcggcaagatcatcaacatcgcctccgtgcagacagcactcgcccgccccggcatcgccccctacacggcgacaaaaggcgcggtcggcaacctgaccaaaggcatggcgacggactgggccaaacacggcctgcaatgcaacgccatcgcccccggttatttcgacacgccgctcaatgcggcccttgtcgccgatccggctttcagcggctggctcgaaaagcgcaccccggccggccgctggggcaaggtggaggaactggtcggcgcctgcgtgttcctggcctccgacgcctcgtccttcgtcaacggccatatcctttatgtcgacggcggcatcaccgcatcgatctga

SEQ ID NO: 35703 - DNA, 2361 bp, Mesorhizobium loti
gtgttggggttgcgcatgccggaatattcttccttcatccggtttgtccgggttcgctatctttcaggattgctgattttcgcgctggcttccacggccatcatggtcgcgctcaaccgcgtcaattcctttcgtcatgagatcgacgcgctgagcagcaacctcgtcgtctttactcgcgacctgcgcaacgcgaccagcttcgccgagaccaccggttccgcctggcgcaacgaaacgcgcgacgcgctgaccgcctcggcccgcgaccattccgaacgcctgaccagcgagatcgacacactctccgcccagttcgccgcgctgcgctcacgcctgtcggccaagaccctcaacgaactcgaaaccgcctcggtcaacggcgatctgttctggtcggcgcacgacatggtgcgcaatttcaacctgatgtcggtggcgcagaaggccgatgaatggagctatcgggaaatccgcaaccagaacgacctgttcgtccagccgatgctggtccgcgtccgcaccgcaatggatgaagagcgccatctggccgacgcgtccagcgaccgcttgctgttgtgggcgagcggcctgttgttcggcgtgctggccattgtcgccttctggatcttccggccgatggagcaggcgatccgccgcgcctttgcccaatcggccgaatccctgttcaaggccgaggccgccgaccgcgccaagtcggaattcctggccaatatgagtcacgagatccgcacgccgatgaacggcgtgctcggcatggccgaactcctggccaagaccgaactgaccccacgccagaagaccttcaccgacgtcatcgtcaaatccggcaatgcgctgctcaccatcatcaacgacatcctcgatttctccaagatcaatgccggacagctcaccctggaccccgcccctttccgtctcaccgaagcggtcgaggatgtggcgacgctggtctcggcgcgcgtcgccgaaaagaacctcgaactgatcgtgcgtgtcgatccgcgcctgccggcccatgtcgtcggcgacgccggccgcttccggcagatcgttaccaatctggtcggcaatgcggtgaagttcaccgagaagggccatgtgctgatcgatgtcggcggcgaaaccgtcaacgatgtcgtccagctcagactgcgcgtcgaggacaccggcatcggcatcccggccgagaaactgcagaacgtgttcgagaaattcgcgcaggtcgacggctcctcgacccggcgtcacgaaggcaccggccttgggcttgccatcgccgcccgcctcgtcgacctgatggccggcaagatcggggtcgagagcgagatcggacgcggctccgtcttctggttcgcggtgccgctgcccgtgcaccatgccgaggcgcgcgaagcgatcgtgccggtcgacgtcaccggcgcgcgtgtgctggtcatcgacgacaatccggtcaaccgcgaaattctgctcgagcagctcagaagctggagcttcgactgcgccgccgccgaaagcggcgcggtggggctggccttcctcgatcgcgcctgccagctgggcgccagcgtcgactgcatcatcctcgactaccagatgcccggcatgaatggcgccgatgtcgccagggcgatcgccgccgacagccggctgtcggccatcccgatcgtcatcctgacctcggtcgaccaggtcgatttcggcaagatgatcatcgatttcggcatatcggcgcatctgaccaagccggcgcgctcggcggtcctgctcggcacggtcatctcggtcatccagaaggcccgctcgcagggcggcaaggcgcaattcattcgcgaaccggtccagccgaagcctgtcccgcaggcggctccgcccgccttcaccgtcatccgcggccccgccgtgccggtcatggcagtgccggaatcgaccgccatgccgaacggcccgatcgacatcctcatcgccgaggacaatgaggtgaaccagctggtgttcggccagatcctcaacgggctcggtctgagctaccgcatcgccggcaatggccgcacggcggtcgagatgtaccggtcgctgcatccgaaactgatcctgatggatgtctcgatgcccgagatgaacggctatgaggcgacccgcgccatccgggcgatcgagacctcgtcgggcggtcacatcccgatcatcggcgtcaccgcgcacgcgctgaagggcgatcgcgacaagtgcatcgaggccggcatggacgactatctgccgaagccggtttcgcccgatcgcctggggacgaaaatcggcacctggctcagcgaaacggtggtggccaagacggcgtga

SEQ ID NO: 35704 - DNA, 1437 bp, Mesorhizobium loti
atgagacgcagccgcaaggtcaagatcctagccacaatcggtccggcctcctcctccgaggagatgctgcagaagctgttcgaagcgggcgccgatgtgttccgcatcaacatgagccataccgaccacgaactgatgcgcacgctggtcgggcgcatccgcgccgtcgaggaaaaggtcggccggccgatcggcatcctcgccgacctgcaaggccccaagctgcgcgtcggcaagttcgccaatggcaaggaggtgctgacgccaggccagaccttcacgctcgacgacaatcccgagcccggcacgtcgagcagggtctatctgccgcatccggaaatcctgagttcggtcgagcccggtcaccgtcttttgatcgacgacggcaagctcgagctgaaggcggtgaagagcgatggcaagtcgatcgtctgcacggtcgtcgccggcaccacgatttccgacaagaagggcgtcagcctgcccgataccgacctgccggtcggcgctctgaccgaaaaggaccgcaaggatctcgacgcggtgctcgccacgggcgtcgactggatcgcgctgtccttcgtgcagcgccccgaggatctggccgaggcgcgcaagatcgcgcggggccgggcgctgatcatggccaagatcgaaaagccgcaggccgtcgcccgcttggccgagatcatcgaactgtccgacgcgctgatggtcgcccgtggcgatctcggcgtcgaaatgccgctggaagccgttcccggcatccagaagcagatcacgcgcgccgcgcgccgcgccggcaagccggtggtggtcgccacgcaaatgctggaatcgatgatcaccgccccggtgccgacccgcgccgaagtctccgacgtctcgatcgccgtcttcgagggcgccgacgccatcatgctgtcggcggaatcggcggcgggtgcctatcccgtcgaagccgtggcgatgatggaccgcatcgccaccaaggtcgaaaccgatccgacctatgccggcatcatcaacgcccagcgctccgagccggaagcgaccggagccgacgcgatctcgctggctgcccgcgaaatcgccgagactctgaaactgtcggcgatcatcacctacacggcgtccggcaccaccgggctgcgcgccgcgcgcgaacggccacaggtgccgatcatcgctctgtcgccgatcctcaacaccgcacggcggctgtcgcttctgtggggcacgcactgtgtcgtttcgcccgatgccaccgatctcgacgacatggtcaaccgcgcctgccgcattgcgctggaagaagagttcggcaagccgggcgaccgcgtcatcatcacggccggtgtgccgctgaggacgcccggctcgaccaacatgctgcgcattgcctatgtcgggtcggaaaagcagggcagccggtaa

SEQ ID NO: 35705 - DNA, 1179 bp, Mesorhizobium loti
atgtccgattccatcgtcattgccagcgccgcgcgcacggccgtcggctccttcaacggcgcgtttgccgccacgcccgcgcatgagctcggtgccgtcgtcatcaaggaacttctatcgcgcgcgggtgtcgaggcagccgaggtcgacgaggtcatcctcggccaggtgctgacggcggcccagggccagaacccagcccgccaggcttctatcattgccggcctgcccaaggagaccaccgcctggggcctcaaccaggtttgcggctcgggcctgcgcgccatcgcgctcggcatgcagcagatcgccaccggcgacgccaaggttatcatcgccggcggccaggaatcgatgtcgctgtcgccgcacgccgagcatctgcgcgccggcgtcaagatgggcgactacaagatgatcgacaccatgatcaaggacggcctgtgggacgccttcaacggctaccacatgggcaacaccgccgaaaacgtcgcccgccagttccagatcacccgcgacgatcaggaccagttcgcgctggcctcgcagaacaaggccgaggccgcgcagaaggccggcaagttcaaggacgagatcgtcgccttcaccatcaagggcaagaagggcgacaccatcgtcgaccaggatgaatacatccgtcatggcgccacgctcgacgccatgaccaagctgaagcctgccttcgacaaggacggcacggtgaccgccgccaacgcctccggcatcaatgacggtgcggccggcgcgctgctgatgagcgaagcggaggccgcaaggcgcggcatcacaccgctggcgcgcatcgcgtcctgggcaaccgccggcgtcgatccggcgatcatgggcaccggcccgatccccgcctcgcgcaaggctttggagaaggccggctggtcggccggcgatctcgacctggtcgaggccaacgaggcattcgccgcgcaggcctgcgccgtcaacaagggcatgggctgggatccctcgatcgtcaatgtcaatggcggcgccatcgccatcggccatccgatcggcgcctcgggcgcccgcgtcttcaacacgctggtctacgagatgcgccgccgcggcgccaagaagggcctcgccacgctgtgcattggcggcggcatgggcgtcgccatgtgcgtggaagccctctga

SEQ ID NO: 35706 - DNA, 726 bp, Mesorhizobium loti
atgaccaaggttgcaatcgtcacgggcggatcgcgcggtatcggcgcggcgatctcgatcgctttgaagtccgccggctattcggttgccgcgaactatgccggcaatgacgaggcggcggcgaagttcaaggccgagaccggcattccggtctacaaatggtcggtcgccgactatgacgcttgcgccgccggcatcaaacaggtcgaggccgacctcggcccggtctcggtgctggtcaacaatgccggcatcacccgcgatgccatgttccacaagatcacccgcgaccagtggaaagaagttatcgacaccaatctgtccggcgtcttcaacatgacgcatccgctgtggaacggcatgcgcgaccgcaagttcggccgcgtcatcaccatctcctcgatcaacggccagaagggccaggccggccaggtcaactattccgccgccaaggccggcgacatcggcttctcgaaggcgctcgcccaggagggcgctcgcgcgggcatcaccgtcaacgtcatctgccccggctacatcgccaccgaaatggtcaaggccatcgacgagaaggtgctcaacgagcgcatcctgccgcagatcccggtcggccgcctcggcgagccggaagagatcgcacgctgcgtcgtcttcctcgcctcgcaggatgccggcttcatcaccggctcgaccatcacggccaatggcggccagtacttcgtctga

SEQ ID NO: 35707 - DNA, 1299 bp, Mesorhizobium loti
atggccaatgtggtggtcgtcggctcgcaatggggcgacgaaggcaagggcaagatcgtcgactggctgtcggagcgcgccgatgtggtggtgcgtttccagggtggccacaatgccggccacacgctggtcgtcgacggcaaggtctacaagctgtcgctgttgccgtccggcgtcgtgcggcagggcaagctgtccatcatcggcaatggcgtcgtcttcgacccgcatgctttcgtggccgaagtggcgaagctcaaggcgcagggcgtcgaagtgacgccggatcgcctgaaaatagccgaaaacacagcgcttatcctgtcgctgcaccgggagctggacggattccgcgaggacgccgcgtcaaattccgggacgaagattggcacgacccgccggggcattggtccggcctatgaggacaaggtgggtcggcgcgcggtgcgggtgatggatctggcggatttggaaacgcttcccctgaaggtcgacaggctgctgacgcaccacaatgcgctgcgccgcgggcttggccatggcgaagtcacacatgacgcgatcatggctgaattgacctcggtcgccgacgagatcctgccctatatggaccgtgtctggaaaatcctcgacgacaagcgccgcgccggcgagcgcatcctgttcgaaggcgcgcaaggcacgctgctcgacatcgaccacggcacctatcccttcgtcacctcgtccaacacggtggccggccaggccgccgccggctcgggcgtcggcccgggcgccatcggctacgtgctcggcattaccaaggcctacacgacgcgcgtcggcgaaggcccgttcccgaccgaacagaagaacgagatcggcgagttcctcggcacgcgcggtcatgaattcggcgtcgtcaccgggcgtaagcgccgctgcggctggttcgacgcggtgctggtgcgccaggccgtcgccgtcaacggcatcaagggcatcgcgctgaccaagctcgacgtgctcgatgggctggacgagatcaaggtctgcaccggctatcgcctcgacggcgagatgatcgactatttgccggccagccagggcgcgcaggcccgtgtcgaaccggtctacgagacgctggaagggtggaaaggcaccactgccggcgcgcgcagctggaacgaccttccggcccaggccgtcaaatatgtccgatacatagaggagctgatcggcgcgccagtggcactcctctccaccagcccggaacgggacgatacgatacttgtgaccgatccgtttcaagactag

SEQ ID NO: 35708 - DNA, 1176 bp, Mesorhizobium loti
atgacgacgcatacgaagcccggactccgtccggcaaatcccaatttctcctcaggtccttgcgcaaaacgccccggctggtcggtcgaggcgctgaagaatgccgcgctcggccgttcccatcgcgccaagatcggcaagaccaagctcgaacaggcgatcgagctgacgcgcgaaatcctccaggttcctgcggaccaccgcatcggcatcgtgccggcgtcggacacgggcgccgtcgagatggcgctgtggtcgctgctcggtgagcgtggtgtcgacatggtcgcctgggaaagttttggctccggctgggtcaccgacgtggtcaagcagctgaagctgcccgacgtgcgcaagctcgaggccggctacggcgaattgccggatctggccaagatcgatttcgaccgcgacgtggtcttcacctggaacggcacgacctcgggcgtgcgcgtgccgaacggtgatttcattcctgccgaccgcaagggcctgaccatctgcgacgccacttcggccgcgttcgcgcaaaggctcgatttcgaaaagctcgatgtcgtcactttctcctggcagaaagtgctgggcggcgagggcgcgcatggcatgctgatcctgtcgccccgcgccgttgcccggctggagagctacaagcctgcatggccgctgccgaaaatcttccgcctgacctccggcggcaagctgatcgagggcatcttcaagggcgagaccatcaacacgccgtcgatgctgtgcgtcgaggattatctcgacgcgttgcactgggcgaagtcgatcggcggcctcgatgtgctggtcgccagggcggatgccaatgctgccgtgctcgacgggtttgtcgacaagtcctcatggctcggccatctcgccgtccagccggcgacgcggtcgaacacatcagtctgcttgtccttcaccgatcccgatgtggcggcgctcgatgccgacgggcaggcgactttcgccaaggggctggtctcggcgctcgacaaggaaggtgtcgcctatgacatcggctcctatcgcgacgcgcctcccggcctgcgtatctggtgtggcgcgacggtcgagacctccgatctcgaaacgctgctgccctggctcgattgggccttcgccgcgcaaaaggcgtcgctgaaagcggcggcctga

SEQ ID NO: 35709 - DNA, 1353 bp, Mesorhizobium loti
atggcagggaattacttcggcacggacggcatccgcgggcgcgccaacaagtttccgatgaccgcggaaatcgccatgcgggtcggcatggccgccggcctttcgttccagcgtggcagccaccgccaccgcgtcgttctcggcaaggacaccaggctttccggctacatgatcgagaacgcgatggtggcgggtctctgcgccgccggcatggacgtgttcctgctcggaccgatcccgacgcccgccgtcgccatgctggtgcgttcactgcgcgccgatatcggcgtcatgatctcggcttcgcacaacccctattacgacaacggcatcaagctgttcgggccggacggctacaagctctcggacgagatcgaagagcgcatcgagagcatgctcgacaaggatgtcgaactgacactcgccgattccgacgggcttggccgcgccaagcgtgttgatggcgtgcatgaccgctacatcgagttcgccaagcgtacattgccgcgctcgatgtcgctttcgggcctcaggatcgtcgtcgattgcgccaatggcgcggcctacaaggtggcgcccgaggcgctgtgggaactcggcgccgaggtcgtcgccatcaatatcgaacccaacggcttcaacatcaacaaggaatgcggctcgacccatccggccggactgcagaagaaggtgcatgaagtgcgcgccgatatcggcatcgcgcttgacggcgatgcagaccgcgtcgtcatcgtcgacgagaatggcgcgatcgtcgacggcgaccaaatcatggcgatgatcgccgagtcctggcaccagagcggacggcttgccggcggcggcgtggtttcgacggtcatgtccaatctcggcctcgaacgcttcctcggcgacatgaagctgcaattgcaccgcaccaaggtcggcgaccgctatgtcgtggagcatatgcgcgcgcatgggctcaatgtcggcggcgaacagtccggccacatcgtgctgtcggatttctcgaccaccggcgacggcctagtgtcggcgctgcaggtgctggcctgcatcaagcgccagggccgcccggtcagcgaactgtcgaagaaatttgagccggtgccgcaactcttgaagaatgtccgtatcgccggcggcaagccgctcgaggaagctccggtcaaggcggcgatcgaggatgcgcgcaaccgtctcggcaaggccggtcgtctggtcatccgtccgtccggcaccgagccgctgatccgtgtcatggcggagggcgacgatccgcaactggtggaggccgtcgtcaacgacattgtcgaggtcatttcggagacccgcagcgccgcctga

SEQ ID NO: 35710 - DNA, 1929 bp, Mesorhizobium loti
atgaatccgaactatcgcaacctcgcgctctgggcgatcatagcggtcctgctcatcgctctcttcaatctgttccagacgccgcagacgcgcggggcttcgagcgatgtgccttattcgcaattcctgcaggatgtcgcggccggccgggtcaagacggtgaccattgcgggcgcccgcatcaccggcacctacaccgacaattccaccggcttccagacctattcgcccggcgatccccagctggtctcgcggctgcaggacaagaacgtcaccatcaatgcgcggcccgaggccgacggttccaattcgctgtttggctacctgatctcctggctgccgatgatcctgatcctcggcgtctggatattcttcatgcgccagatgcagtctggatccgggcgcgccatgggttttggcaagtcgaaggccaagcttctgacggaggcgcatggccgcgtcaccttccaggacgtcgccggcgtcgacgaagccaaggaagatttggaagagatcgtcgagttcctgcgcgatccccagaagttccagcggctcggcggcaagatcccgcgcggcgtgcttttggtcggccctcccggtaccggcaagacgctgcttgcccgctcggtcgccggcgaggccaacgtgccgttcttcaccatttcgggttcggacttcgtcgagatgttcgtcggcgtcggtgcatcccgcgtgcgtgacatgttcgaccaggccaagaagaacgcgccctgcatcatcttcatcgacgaaatcgacgcggtcgggcgccatcgtggcgccggcctcggcggtggcaatgacgagcgcgagcagacgctgaaccagctgctggtcgagatggacggcttcgaatccaacgaaagcatcatcttgatcgccgccaccaaccgtcccgacgtgctcgatccggcgctgctcagaccgggccgtttcgaccgccaggtcgtggtgccgaaccccgacatcgtcggccgcgagaagatcctcaaggtgcatgtgcgcaacgtgccgctggcgcccaatgtcgacctcaaggtggtcgcgcgcggcacgccgggcttctccggcgccgacctgatgaacctggtcaacgaatcggcgctgatggcggcgcggcgcaacaagcgcctcgtcaccatggccgagttcgaggacgccaaggacaagatcatgatgggtgccgagcgccgctcgtcggccatgacccaggccgagaaggagctgaccgcctatcacgaggccggtcacgccatactggcgctcaacgtgccgtcggccgacccgctgcacaaggccaccatcatcccgcgtggccgcgcgctcggcatggtgatgcagttgccggaaggcgaccgctattcgatgagctacaaatacatgatctcgcgcctcgccatcatgatgggcggccgcgtggccgaggagttcaagttcggcaaggagaacatcacctcgggcgcttcctcggatatcgaacaggcgaccaagctggcgcgtgccatggtcacgcgctggggcttctccgacaagctcggccatgtcgcctatggcgacaaccaggaggaagtgttcctcggtcattcggtggcgcgcacgcagaacatctcggaggagaccgcgcagatcatcgacgccgaagtgcgccgcctgatcgacgaggcttattcgacggcgaaatccatcttgaccaagaagaagaaggaatggatcgcgctggcgcaggggctgctcgaatacgagacgctgtcgggcgacgagatcaagcaattgatcgccggcgaaaagcccgcgcgcgacctcggcgacgacacgccgcccagccgcggctcggccgtgccgaagtccggcggccgccgcaagaaaggccccgagcccgaaggcggcatggagccacagccgtcgagttga

SEQ ID NO: 35711 - DNA, 1017 bp, Mesorhizobium loti
atgaagacgatcgaattgcgggcccccggcggcatcgacaatctcagactggtcgagcggccaatgccggaaccgggccgccaggagatgatcatcaaggtcaaggcaacagcgctcaactaccgcgatgtggagatcgcccgtggcagctaccacaccgcctttgcgctgccgctgataccgctttcggatggtgtgggtgaagtggtcgcggttggcgccgaagtgacccgtttcaaggtcggcgaccgcgtctgcggcacattctggcagcgctgggtcggtggcagtttcgccatggccgagccctcctatcagcgcggcggccccattgacggtttgctcagcgagttcgcgcggctggacgaacaggcggccgtgcttgcgccgccccatctgagcgatgtcgaggcggcgacattgccttgcgccgcggtgacggcctggcacgcgctgttcaccgaaggccagttgaaaccgggcgagacggttctcagcctgggcactggcggcgtctcgctgtttgccgtgcagttcgccgcggcagccggcgcacacgtcatcgtcacgtctagcagcgacgacaagctcacgcgggcaaaggcgcttggcgcgcatcacggcatcaactatcgcgtcaatcccgattggtcgtcggcagtgctggcgctgaccgacggccgcggcgcggaccatattatcgaggtcggcgggccgcaaagcttcgctcagtcgctgaaggcttcggcacgaggcgcccagatcaacgtcatcggctatctcggcggcagcgaagggtcgatcaatcccctcgatatcttccgccgccaggtcagggcgcgcggcatacctgtgggctcacgcgaatccttcgaggcgatgaaccgaggcctgacagtcaaccggataagacccgtgatcgagaaggtgtttgcctggaaggacgcggctgcagccttccggcacctcgaacacggttcgcccttcggcaaggtcgtcctcgatcacacgcaatga

SEQ ID NO: 35712 - DNA, 1800 bp, Mesorhizobium loti
atggcgcaatcaagcagcgcagacgagcgccgacgctcgctcaagccgctcaggcgcctgttcccctatatcgctggatatcgcacgctggtcgtcggcgccctcatctcgctggccatcgcggcggcaacgacattgacgctgccgctggccgtacggcggatgatcgatcacggtttctcgtcgtccagcaccactttcatcgccgaatatttcgccgcactggtggcgatggccgccgtgctggcggcggcatccgccggccgctactatttcgtcatcacgcttggcgagcgcgtcgtcgccgatatccgccgcgatgtctttgcccatgtgacgacgctgtcgcccgccttcttcgacaccgcccagtcgggcgagatcgtgtcacggcttgccgccgacaccacgcagatcaaatcggcggtcggcgccaccgcttcggtcgcgctgcgcaacgtcatcctcggtctcggcgcggtgggaatgatggtcgtgaccagtccaaaactgtccggcctggtcattgcagccattcccgtcatcgtgctgccgctggtcgccttcggccgttcggtgcgccgcaagtcgaggcaggcgcaggacacgcttgccgaggcgacagcctatgccagcgagcaaatcggcgcggtgcgcacgctgcaggccttcaccaatgagaagctggtcaccgggcggttttcgggcgcggttgaggctgccttcgaggcggcgcgcgcctcgatcttcgcccgctccttcctcaccttctttgccatcttcaccatcttctcgtccgttgtggcggtgctctggttcggctcgcgcgacgtgctcgaaggcacgatatcgccgggcacgctcggccagttcctgctctattcggtgttcgccgccggcgcgctcggcgcgctgtcggaggtctggggcgaacttgcccaggcagcgggtgcggccgagcggctgaccgagatcctggccgagaacccggcgatccaggcgccggccgagccgaagccgctgcctacggtcgccaagggcgcgatcgtcttcgacgacgtctccttctcctatccggcgcggcccgaccgggccgccgtccacggcttgagtttccaggtcatgcctggcgagacggtagccatcgtcggtccctcgggggccggcaagagcacggtcttctcgctgatcctgcgcttctacgatcccgaaaccggcaagatcctgatcgatggcgtcgacgtgcgcgaagccgatccggtttcggtgcgcgagcgcatcgccatcgtgccgcaggacgtcaccatcttcgcggcgagcgcgcgcgacaatataggcttcggccggccgggcgcaggcaataccgaaattgaggcggcggcgaaggacgcgctggccgacgaattcatcctcaagctcgaacacggctatgacagccaggtcggcgagcgcggcgtgacgctgtccggcggccagcgccagcgcgtggccatcgcccgcgccatcctgcgcgacgcaccgatcctgctgctcgacgaagccacctcggcactggacgccgaaagcgagacgctggtgcagacggcgctagagcggctgatgcagggccgcaccacgatcgtcatcgcccaccggctggcgacggtgctgaaggccgacaggatcctggtgatggatggcggccgcatcgtcgaggaaggcacgcaccagagcctggtcgccaagggcggcatctatgccaggctggccaagctgcagttcgagaccggcgccagcgccttcaggggcgcggcggagtag

SEQ ID NO: 35713 - DNA, 447 bp, Mesorhizobium loti
atgtccgagattattgtccgcccgctcgcgcagtccgaccacgccgactggaagcgcctgtggaccgactacctgaccttctatgagaccaagctgccggaagaggtctacgccgtcacctggaagcggctgttcacggcaggcgaattcgagccgaagggttttatcgccacgctcgacggcaaggccgtcggcctcacccactatctctaccatcgctcaggctggtccgagaggaacaactgctacctgcaggacctgttcgccgacccggacgtgcgcggcaagggcatcggtgcggcgctgatcaatgccgtgaagcaggaggccgcaaagatcggcgtcaagaacgtctactggatgacgcacgagaccaacgcaaccgcgcgcaagctctacgaccacgtggcgcgccgcaccggcttcatcgagtatgatctgctgtaa

SEQ ID NO: 35714 - DNA, 3459 bp, Mesorhizobium loti
ttggccatcacgaagatcctcgtcgccaaccggtcagaaatcgccatccgcgtctttcgcgcggccaatgaactgggcctcaaaaccgtggcgatctgggccgaggaagacaaatattcgctgcaccgcttcaaggccgacgagagctaccaggtcgggcgcggtccgcatctcaccaaggatatggggccgatcgagagctatctgtcgatcgaggaggtgatccgcgtcgcccggctctcgggcgccgatgccatccaccccggctacgggcttctgtccgaaagccccgaattcgccgaagcctgcgcgcaagcgggcatcaccttcatcgggccgaagccggacacgatgcgccgcctcggcaacaaggtcgcggcgcgcaatctcgccatcgaggtcggcgtgcctgtcattcccgccaccgatccgttgccggacgatatggaggcggtcaagaaactggccaaggagatcggctatccagtgatgctcaaggcctcctggggcggcggtgggcgcggcatgcgcgccatccgctccgaggccgatctcgcccgtgaggtcacggaaggcaagcgcgaggcgaaagccgccttcggcaaggacgaggtctatctcgaaaagctgatcgagcgcgcccgccacgtcgaggtgcaggtgcttggcgacacgcatggcaatgccgtgcacctgttcgagcgcgactgctcgatccagcgccgcaaccagaaggtcgtcgagcgggcgccggcgccctatctcgaaatgtcgcagcgcgaggagctttgcggctacgcgctgaagatcgcgcgcgagaccagctatatcggcgccggcacggtcgagttcctgcaggatgccgataccggaaaattctatttcatcgaggtcaacccgcgcatccaggtcgagcataccgtcaccgagcaggtgaccggcatcgatatcgtcaaggcgcagatccacatcctcgacggcttcgccatcggcacaccgcaatcgggcgtgccggcgcagaaggatatcaggctgaacggccatgccttgcagtgccgcatcaccaccgaggatcccgagcacaatttcatcccggactatggccgcatcaccgcctatcgcggcgccaccggcttcggcatccggctggatggcggcaccgcctattctggcgcggtcatcacccgcttctacgatccgctgctggagaaggtgacggcgtgggcgccgacgccggccgagaccattgcccgcatgaaccgggcgctgcgcgaattccgcattcgcggcgttgccaccaacctcaccttcctcgaagcgatcatcaaccacccgagcttcgccgacaattcctacacgaccaagttcatcgacacgacgccggagctgttccagcaggtcaagcggcaggaccgcgcgaccaagctgctcaactatctggccgatgtcagcgtcaacggccatcccgagacgcgcggccggccgacgccgaaggccgatgcggccgcaccggtcgtgccctatctcaacggcaatgtgccgggcggcagcaagcagaagctggacgtgctcggtccggaaaaattcgccggctggatgcgcgaacaaaggcaagttctggtcaccgatacgacgatgcgcgacggccaccagtcgctgctcgcgacgcgcatgcgcacgcacgacattgccaatattgccggcacctatgcgcgcgccctgccgcagcttctgtcgctcgaatgctggggcggcgcgaccttcgacgtcgccatgcgcttccttaccgaggatccttgggagcggctgtcgctggtgcgcgaggcggcgcccaacctgttgctgcagatgctgctgcgcggcgccaacggcgtcggttacaccaattatcccgacaatgtcgtgcagcatttcgtcaagcaggcggcgagcggcggtatcgacctgttccgcgtcttcgactgcctgaactgggtcgagaacatgcgcgtcgccatggacgcggtcggcgccgaaggcaagctgatcgaagcggcgatgtgctacaccggcgacattctcgatccggcgcgggccaaatacgatctgaaatattatgtcggcctggccagcgaattgcaggccgccggcgcccacatcatcgccgtcaaggacatggccggcctgttgaagcccgccgccgcccgcgtgctgttcaaggcgctgcgcgaggcgaccgacctgccgatccatttccatacccacgacacgtctggcctgtcggcggcgaccgtgctggcggcggttgagagcggcgtcgacgccatcgatgcggcgatggacgccttctccggcaacacgtcgcagccttgcctgggctcgatcgtcgaggcgctgaagggcaccgagcgcgacccgggcctcgacccgcaatggatccgcaagatctcgttctactgggaagcggtgcgcaaccagtacgccgccttcgaaagcgacctcaaagggccggcttcggaagtctacctgcatgaaatgccgggcggacaattcaccaacctcaaggagcaggcgcgctcgctcgggctggaaacgcgctggcatgaggtggcgcagacctatcacgacgtcaatctgatgttcggcgacatcgtcaaggtgacgccgtcatccaaggtcgtcggcgacatggccctgatgatggtcagccaggacctgaccgtcgccgatgtcgagaacccggccagggatattgccttcccggactcggtcgtctcgatgctgcgcggcgatctcggccagtcgcccggcggttggccggcggcgctgcagaagaaggcgctgaaaggcgacgagccgatcacggcacggccaggctcgctgctcaagcccgccgatctcaaggccagccgcaaggagatcgaggagaagctcgagcgcaagctctcggaatacgaattcgcctcctggctgatgtatccgaaggtgttcactgacttcgccggcgcgcaggaaacctacggcccggtcagcgtcctgccgacgccgacctatttctacggcatgaaatcggaagacgagatcttcatcgacatcgagaagggtaagacgctggtcgtgcggtgccttgccatcggcgatgtggacgacaagggcatggtcacggtgttcttcgagctcaacggccagccacggcgcgtgaaggtgccggaccgggcgcatggcgcctccgccgccaaggcgcgccgtaaggccgagcctggcaacgaggcgcatgtcggcgcgccgatgccgggcgtggtttcggcgctttcggtcgccacggggcaagcggtgaaagccggtgacgtgctgctgtccatcgaggcgatgaagatggaaacggcgctgcatgccgagcgtgacggcaccgtcgccgaggtgctggtcaaggccggcgaccagatcgatgccaaggatctgctgatagccttcgcttga

SEQ ID NO: 35715 - DNA, 1002 bp, Mesorhizobium loti
atggccaagaaatccttcttctgcatcgacggccacacatgcggcaatccggtgcggctggtcgccggcggcggcccgctgctcgaggggtcgacgatgatggagcggcgtgcgcatttcctggccgagtatgactggatccgcaccgggctgatgttcgagccgcgcggccatgacgtgatgtcgggttcgatcctctatccgccgacgcgcgaggattgcgacatcgccatcctgttcatcgagacctccggctgcctgccgatgtgcggccacggcaccatcggcacggtgacgatggccatcgaacacgggctgatcaagccgaagacgccgggcgtgctgaggctggatacgccggccgggctggtcatcgccgaatacaaacaggtcggcgaatatgtcgaggaggtgcgcatcaccaacgtgccgtctttcctccacgccgagggtctgacggtcgaatgccccgggctcggcgagatcaccgtcgatgtcgcctatggcggaaatttctacgccatcgtcgagccacaggagaactatcgcgacatggccgaccattcggctggcgacctcatcgcctggagcccggtggtgcggcagcggctcaacgagaagtattccttcgtgcatccggaaaaccccggcatcaacaggctgtcgcacatgctgtggaccggcaagccgacagtggaaggggccgacgcccgcaacgccgtcttctacggcgacaaggcgatcgaccgctcaccatgcggcacaggcacctcggcgcgcatggcgcagcttcatgccaagggcaaactcaaggccggcgacgccttcgtgcacgaatcgatcatcggttcgctgttcaagggcaaggtcgaaaaggaggtcactgtcgcgggcaaaccggcgatcatcccttcgatcggcggctgggcgcgcctgaccggactgaacacgatcttcatcgacgaccgcgatccgttcgcgcatggtttcgtagtcacgtga

SEQ ID NO: 35716 - DNA, 936 bp, Mesorhizobium loti
atgtggaccggagttttccccgccgttacgaccaaattcaccgccgacgaccggctcgaccatgccgaaatggagcgctgtttcggcctgcagatggaggccggctgcgacggcatcatcgtctgcggctcgctcggcgaagggccgatgctgtcgcctgacgagaagatcgaagtgctgaagaccgcgcagaaagtcgccggcaagaagccggtgctgctgaccgtcaacgaagcgggcacccgtgaggccgccgctatcgccaggcgcgccgccagggagggcgccgatggcctgatggtggtgccgagcccgatctaccacaccaacgcggaagagacggtggctgcgctgcgcgcggtcgccgaggccggcgacctgccggtgatgatctactccaaccggctcgcctatcgcgtcgacgtcaccgtcgaccagatggaggagctggcatcggacaagcgcttcgtcgccatcaaggaatcctccgacgacatcaggcgctcgaccgagatcatcaaccggcttggcgatcgctacgatctgttcaccggtgtcgacaatctcgccttcgaagcgctgtcggtcggcgccatcggctgggtggccggcctggtcaccgccttcccgcgcgaaaccgttgccatcttccagctgatgaagcagggccgccgcgaggaggcgcttgccgtataccgctggttccggccgctgctcgatctcgacgtctcgacctatctggtacagaacatcaagcttgccgaagtgctggcaatcgataccaatgaccgcgtgcgcatgccgcgccaaccgttgtcgggcgagcgccgcaaggcggtcgagaagatcatacgggatgcgctggcggcgcggccgaagctgccgtcgctccagacgtctcctctatcggcggacagacaggtggcagccgaataa

SEQ ID NO: 35717 - DNA, 1497 bp, Mesorhizobium loti
atgatagaatacggtcatttcatcggcggcaagcgtgtcgccggcaccagcggccgcaagcaggacgtcatgcagccgatggacggttccgtgcgcggcacggtggcgctggcctcgcaggcggaattgcgcgcggcggtcgagaatgccaaggcggcgcagccgaaatgggccgccaccaacccgcagcgccgcgtgcgcgtcttgatgaaattcctcgaactggtcgcccgcgactatgacgaactggccgacatactggcgcgcgagcacggcaagacgatcgccgacgccaagggcgacatccagcgcggcctcgaagtggtcgaagtctgcatcggcgcgccgcacatgatgaagggcgaattcaccgatggtgccggcccgggcatcgacgtctattcgatgcgccagcctctcggcgtcgtcgctggcatcaccccgttcaacttcccggcaatgatcccgctgtggaagatcgcgccggcgatcgcctgcggcaatgccttcatcctgaagccgtcggagcgggatcctggcgtgccgatccgcatcgccgaactgttcctcgaggcggggctgccggcaggcatcctcaacgtcgtcaacggcgacaaggaagtcgtcgacgccatcctcgacgatcccgacatcaaggccgtcggcttcgtcggctcgacgccgatcgcccactacatttattcgcgcggcaccgcggccggcaagcgcgtgcagtgcttcggcggcgccaagaaccatatgatcatcatgcccgacgccgacatggaccagaccgtcgacgcgctgatcggcgccggctacggctcggctggcgagcgctgcatggcgatctcggtggctgttccggtcggcaacgacaccgccaaccggctgatggaaaagctgatcccgcgcgtcgagagcctgaaggtcggcccgtcgacggattcggccgccgatttcggcccgctcgtgaccgcgcaggcactggagcgcgtgaaaggctatgtcgacaccggcgtcaaggaaggcgccacgctcgtcgtcgacggccgcggcttcaagatgcagggctatgaggacggctactatatgggcggctgcctgttcgataatgtcacggcggacatgcgcatctacaaggaagagatcttcgggccggtgctctcggtggtgcgcgcaccgacctatgagagcgcgatcaagctcgccaacgaccacgagatgggcaatggcgtcgccatcttcacccgcgacggcgacgccgcgcgtgacttcgcaagccgtgtccaggtcggcatggtcggcgtcaacgtgccgatcccggtgccgatcgcctattacacgttcggcggctggaaggcgtcgtccttcggcgacctcaaccagcacggcccggacgccttccgcttctacaccaagaccaagacggtgacctcgcgctggccgtccggcatcaaggacggtgcggagttcgtcatcccgacgatgaactga

SEQ ID NO: 35718 - DNA, 1422 bp, Mesorhizobium loti
atgctgcaggtgagacaggatgtcctcggcgaacggttccggctgcagcgcgccgccttcgagaagcagccctttccggatccaagcgtgcggaaagaccgcctgaagcgcctgctggcgctgaccgagcaccatgaggcggacatttgcgccgcgatcgacgccgacttcggtggccgctcggcgcatgagacgcggctggccgaactgtttgtcgtgcgcgccggcatccgccacacgctgtctcatctgagcggctggatgcgggaacgtcgtgtcgccaccaccttgccgttcctgccgggccgcaatcgcctcctgccgcagccgctgggtgtcgtcggcatcgtctcgccgtggaattacccgttccagcttgccgtcgcgccggtcacggcagcgctcgccgccggcaaccgcgtgctggtcaagccctccgaactgacgccggccttctcggcgctgctcgccagactggccggcgagcacttcgccccggacgagttgagcgtcatcaccggcgatgccgagatgggcaaggctttcgtgtcgaagcctttcgatcacctgctgttcaccggctcgaccgcggtcggccgccaggtcgcgatcgccgccgccgccaacctgaccccggtcacgctcgaactcggcggcaaatcgccggcgatcttcgacccctcctgcgatctcgatgcggcaacagccagcatcgcctatggcaagctgctcaatgccgggcagacctgtatcgcgccggactatctgctggtgcccaaggggcaggccggcacggtcgccgccaaactcgcgaccgcggtggcgcagctctaccccaccttgcgcgacaaccccgactataccgccatcatcagcgaacggcattttcagcgcctgcgcgccatgatcgctgaagcccgcgatgccggtgccgatgtcgtcgaaatcaacccggccggcgaagacttcggcgccgcgagccgcaagcttttgccgaccctggtcagcaatgccggcccggatttgcggctgatgcgcgaagagattttcggtccggtgctgccgatcatcgaatacgccaccatcgacgaggcgatcagccatgtgaaccaggccgaccggccgctggcgctctactggttcggcaaagacagcaccaaccgccagcgcatcctgcgcgagaccgtcgccggcggcgtcaccatcaacgactgcatgctgcacctggtgcaggagaaccagcccttcggcggtgtcggcgccagcggcatgggcgcctatcacggcgaatggggattccgcaccttcagcaaggagaagccggttttcctgcagtcgcgcctgagcgccggcgccctgctgcgcccgccctacggcaagacgttcgagcggcttttcggcctgctccggcacatcacctga

SEQ ID NO: 35719 - DNA, 777 bp, Mesorhizobium loti
atgaacagcaccggcatcgatctctccgccttcagcctggccggcaagcgcattctggtcaccggcgccaacaccggcatcggacaaggcattgtcctctcgatcgcgcgcgccggcggtgtggtgatcggcgtcggccgttcgtcgatggacgagacggcgagcaaggtcgcggccatcggtgccaggttcgagacggtgagcgccgaccttgccgacacggcgaccgccggtcctatgctcgatcgggtctgggacgaaagcgggccgctcgacgggttggtcaacaatgccggtatcatccgacgcgccgatgcggtcgatctgaccgagaccgactgggacgatgtcatggacgtcaatttgaagacggtctttctgctttgccagtccttcgccaggcgcgcccttgccgacggtcgccggggcaagatcgtcaacatcgcctcggtgctgagtttccagggcggcatccgcgtcgcctcctacaccgcctcgaaacatggcgtgctcgggatcacccggctgctcgcctgcgaatgggcggccaagggcatcaacgtcaacgccatcgcgccgggctatgtcgagaccaacaacacgcaggcgctgcgtgccgaccctgaccgcagcgccgccattctcggccgcattccggcggggcggtggggcgagccttccgatattggcgatgccgccgtcttccttctggcccgggcttccgactatatgcatggcgcggcggtgccggtggatggcggctggctggcgcgatga

SEQ ID NO: 35720 - DNA, 1434 bp, Mesorhizobium loti
gtggccgccaaggcaaccggcgttgtcggcaaggtccgccaggtcatcggcgcagtcgtcgacgtgcagttcggcgatcaccttccggcgatcctgaacgcgctcgagacgaccaatgtcggcaatcgcctggtgcttgaagttgcccagcatctgggtgaaaacaccgtgcgctgcatcgccatggactccaccgaaggtctggtgcgcggccaggaagtgcgtgacaccggtgcgccgatcaccgtaccggtcggcccgggcatgctgggccgcatcatcaacgtcatcggcgagccggtcgacgaagagggcccggtcgatgcgatcgagatgcgctccatccaccagccggctccgacctatgtcgagcagtcgacggaagcgcagatcctgatcaccggcatcaaggtgctcgacctgctggcgccttacgccaagggcggcaagatcggcctgttcggcggcgccggcgtcggcaagaccgtgctgatccaggaactgatcaacaacatcgccaaggcacacggcggctattcggtgttcgccggcgtcggtgagcgcacccgcgagggcaacgatctctatcacgagttcatcgaatccggcgtcaacaagaagggcggcggcgaaggctccaaggcggctctcgtgtacggccagatgaacgagccgccgggcgcgcgcgcccgtgtcggcctgaccggcctgacggtggctgaatatttccgcgaccagggccaggacgtgctgttcttcgtcgacaacatcttccgcttcacgcaggcgggttcggaagtgtcggctctgctcggccgtatcccgtcggccgtgggctatcagccgacgctcgccaccgacatgggcgcgctgcaggaacgcatcaccaccaccaccaagggctcgatcacctcggtgcaggccatctacgtgcccgccgacgacttgaccgacccggcgccggcgacctcgttcgcccaccttgacgcgacgacgacgctgaaccgcgccatcgccgaaaagggcatctatccggcggtcgatccgctggattcgacctcgcgcatgctcgacccgatggttgtcggcgaagagcactatgcggttgcccgccaggtgcagtcgatcctccagcgctacaagtcgctgcaggacatcatcgccatcctgggcatggacgagctgtcggaagaggacaagcagaccgtggcccgcgcccgcaagatcgagcgcttcctgtcgcagcccttcttcgtcgccgaagtgttcaccggcgcgccgggcaagctcgtcgacctcgccgacaccatcaagggcttcaagggcctctgcaacggcgactacgatcacctgccggaagctgccttctacatggtcggcggcatcgaggaagcggtcgagaaggcacagcgcctggcggctgaagcggcataa

SEQ ID NO: 35721 - DNA, 885 bp, Mesorhizobium loti
atgccttcattaaaagaccttcgtaaccgtatcgcctcggtcaaggcgacgcagaagatcaccaaggcgatgcagatggtcgccgcggcgaagctgcgccgtgcgcaagaggcagcggaagcggcgcgcccctattcggagcgcatgggttccgtgctggccaacatcacccaggcaatcggcggcggcggcgatgccccggcgctgatgaccggcaccggcaaggacaacgtgcatctgctcgtcgtctgcaccgccgagcgcggcctgtgcggcggcttcaattcgcagatcgcccgtcttgcccgcgatcatatccggcggcttctggccgacggcaagcaggtcaagatcatctgcgtcggcaagaagggtttcgacatcctgcgccgcgactatgcctcgatgatcctcgaccgtgtcgacctgcgcgaggtcaagacgctcggcttcgtcaatgccgacgcgatcgccaagaaggtcatccacctcttcaacgagggcgccttcgacatctgcacgctgttctattcgcagttcaaatcggtgatcagccaggtcccgacggcgcagcagatcattcccgccggcgtcgcttcggctcccgccgcagcggtggatggcggcaatgccgtctacgaatacgagccggagccgggcgagatcctctccgacctcatcccgcgcaacatttccgtgcaggttttccgggcgctgctcgaaaacgcggccggcgaaatgggcgccaagatgagcgccatggacaatgcgacgcgcaacgccggcgagatgatcaacaagctgtcgatcacctataaccgccagcggcaggcgcagatcaccaaggaactgatcgaaatcatttcgggcgctgaagcgctctag

SEQ ID NO: 35722 - DNA, 1530 bp, Mesorhizobium loti
atggacatccgcgccgcggaaatttccgcaattctgaaagaccagatcaagaatttcggcagggaggccgaggtctccgaagttggacaggtgctgtccgtcggtgacggtatcgcccgcgtctacggcctcgacaatgtccaggccggcgagatggtcgaattccccggcggcatccgcggcatggcgctcaacctcgaagccgacaatgtcggcgtcgtcatcttcggcgccgaccgcgacatcaaggaaggcgacaccgtcaagcgcaccggcgccatcgtcgacgttccggtcggtccgggcctgctcggccgcgtcgtcgacgcgctcggcaacccgatcgacggcaagggcccgatcaaggcgaccgaacgcaagcgcgtcgacgtcaaggcgcccggtatcatcccgcgcaagtcggtgcatgagccgatgtcgaccggcctcaaggccatcgatgcgctgatcccggtcggccgtggccagcgcgagctggtcatcggcgaccgtcagaccggcaagaccgccatcatcctcgacacgatgctcaaccagaagtcggtgcacgacaacggccccgagaaggaaaagctctactgcgtctatgtcgccgtcggccagaagcgctcgaccgtcgcgcagttcgtcaaggtgctggaagagcgcggcgcgctcgaatattcgatcattgtcgccgccaccgcttccgatccggcgccgatgcagttcctggcgccgttcgccggctgcaccatgggcgagtatttccgcgacaatggcatgcatgcgctgatcagctacgacgatctgtcgaagcaggccgtcgcctatcgccagatgtcgctgctcctgcgccgcccgccgggccgcgaagcctatccgggcgacgtcttctatctgcactcgcgcctgctcgagcgcgccgccaagctcaatgacgatctgggcaatggctcgctgacggcgctgccagtcatcgaaacgcaggccaacgacgtgtcggcctacatcccgaccaacgtgatctcgatcaccgacggccagatattcctcgaaaccaacctgttcttccagggcatccgtccggccgtcaacgtcggtctgtcggtgtcgcgcgtcggttcctcggcgcagatcaaggcgatgaagcaggttgccggctcgatcaagggcgagctcgcgcagtaccgcgaaatggcggccttcgcgcagttcggctcggatctcgacgccgccacgcagcgcctgctcaaccgcggatcgcgcctgaccgaactcctgaagcagccgcagttctcgccgctgaagacggaagagcaggtcgcggtgatcttcgccggcgtcaacggctatctcgacaagctgccggtcaaccaggtcggcaagttcgagcatggcctgctcagccatatgcgtgcggccggcaaggacgttctcgacgccatccgcaaggaaaaggcgctgtcggacgatctgcgcgccaagctgaaggcagagatcgacgctttcgccaagaccttcgcctga

SEQ ID NO: 35723 - DNA, 561 bp, Mesorhizobium loti
gtggcccaatcgtcatcgccaatctcaggtgtcgcagaacgctacgcgggttcgctgttcgaactcgccctgcaggcaaattccgtggccaaggtcgagtccgacctcaacagtttcgaggcgatgctggctggcagttccgacctgacccggctgatcaacagcccggtgttctccggcgaggagcaggccaaggccatcgcggcgatcgccgacaaggctgggatcaccggcctcaccggtaatttcctgcgcgtcgtcgcccgcaatcgccggctgttcgccgtgcccggcatgatcaaggcgttccgccagatcgccgccgaacaccgtggcgagaccgctgctgaagtgacgtcggctcacgagctgacggctgcccagcagaccgaactcaaggcggcgctgaaaagcgttgccggcaaggacgtggccatctccgtcaccgtcgatccgtcgctgctcggcgggctggtggtcaagataggctcgcgccagatcgatacgtcgctcaaaaccaaactcaattcgctcaagcttgcactgaaagaggtcggctga

SEQ ID NO: 35724 - DNA, 657 bp, Mesorhizobium loti
atgaaattttttgtcgataccgccgacatcaaggatatccgtgaactcaacgatctggggctgctcgacggcgtcaccaccaatccgtcgctgattctcaaatccggcggcaagatcgccgacgtcaccaagcagatctgcgacatcgtccagggtccggtttcggccgaagtcgtggcgaccgagtacaaggacatgatggcggaggccgaggtgctggccaagatcgcgcccaatgtctgcatcaaggtgccgctgacgctggacggcctgaaggcctgcaagacgatccgcacccagatgaaccgcatggtcaacgtcacgctgtgcttctcggccaaccaggcgctgctcgccgccaaggccggcgcctcgttcatctcgcccttcgtcggccgcatcgacgacaccggctcggacggcatggagctgatccaggagatccgccagatctacgacaattacgattaccagaccgagattctgaccgcttcggtgcgcacggtgaaccacgtcaagcaggcggccctgatcggcgccgacgtcatcaccgcaccgccggcgacgctgaaggcgctggtcaaccatccgctgaccgacaagggtctcgccgccttcctcgccgactgggccaagaccggccagaagatcggctga

SEQ ID NO: 35725 - DNA, 858 bp, Mesorhizobium loti
atgcgttacaaccagcttggaaatacggggatgttcgtctccgaactgtgcctcggcaccatgactttcggcgccgccggccagaatgcccaatggggcctgatcgccagcctcgaccagaagggcgtcaacgacatcgtcggccgctcgatcgccgccggcgtcaatttcttcgacacggccgacgtctactccttcggtgagtccgagcgcctgctcggccagtcgctcagggacctcggcgtcaaacgttcggatgtcgtcatcgccaccaaggtgcatggcaccatgggccagggtccgaacgagcgtggctcctcgcgcggccacatcatggattcggtcgatgccagcctcgaacggctgcagctcgaccatattgatctctatcagctgcacggtaccgacgcggtgacgccgatcgacgagacgctgcgggcgctggacgacctcgttgccagcggcaaggtccgctatgtcggcgtttccaactgggcggcatggcgcatcgccaaggcgctcggcatcgccgaccgcaagggcttcgcccgcttcgagaccatccagtcctattattcgatcgccggacgcgacctcgagcgcgagatcgtgccgctcatcagcgaagaaaaactcggcctgatggtgtggtcgccgatggcgggcggcctgctttccggcaagtacggtcctggcgcgccgggcaatggcgagggccgccgtgcgtccttcaacttccctccggtcaacgaggaccgcgcctgggcggccgtcgccgtcatgcgcgagattgccaagaagcatgacgtcagcgttgccacggtggcgctcggctatgtcctggccaagccttcgtga

SEQ ID NO: 35726 - DNA, 1035 bp, Mesorhizobium loti
atggactatcgacgtctcggcgcgtcaggcctgaaagtgcccgcactctcatttggcgcgggaacctttggcggctccggaccgctgttcggcgcctggggcaacagcgacgccaaggaagcgcggcggctggtcgacatctgcttggaagctggcgtcaatctgttcgacaccgccgacgtctattcgaacggcgcctcggaagaagtccttggtgaagccatcaagggccggcgcgacgccgtgctgatctcgaccaagacgtccttgcctatgggtgatgggccggccgactacggctcttcccgttcgcgcctgatcaaatccgtggacgccgcgctgaagcgcctcggcaccgactatatcgacctgttgcaactgcatgccttcgacgccggcacgccggtcgaggaggtgctgtcgacgctggacgagctcgtgcgcgccggcaagctgcgttatgtcggcgtctccaacttttccggctggcaggtgatgaagtcgctggcgcaagccgacaggcacggctatccgcgctacgtcgcgcaccaggtctactattcgctggtcggccgcgactatgagtgggagctgatgccgctcggcctcgaccagggcgtcggcgcgctggtgtggagcccgctcggctggggccgcctgaccggcaagatccgccgcggccagcctttgccggaaaagagccggctgcacgacaccgccggcttcggcccgccggtcgaagacgagcatctttaccgggtgatggatgcgctcgacgcggtggcgcaggaaaccggcaagaccgtgccgcagattgccatcaactggctgttgcagcgccccaccgtttcctccgtcatcatcggcgcccgcaacgaggaacaattgcgccagaatctcggcgccgtcggctggtcgctgacgccggagcagatgaaaaaactcgacgccgcaagcgaagtcaccgcgccctatccgtatttcgcctatcgccgccaggaaggttttgcccggctgaacccgcaggcggtgtga

SEQ ID NO: 35727 - DNA, 1956 bp, Mesorhizobium loti
atgtccgaggttcatgtccatcgcgtccagccggcgtggaagaagaatgcgctgatcgacaacgacacgtacctgaaatggtatgccgacagcatcaagaacccggacaagttctggggcaagcacggcaagcgcatcgactggttcaagcccttcagcaaggtcaagaacacctccttcgacggcaaggtctcgatcaaatggttcgaggacgggctgaccaatgtttcctacaactgcatcgaccgccatctgaagaagcgcggcgaccagacggccatcatctgggaaggcgacaacccctacgacgacaagaagatcacctacaacgagctctacgagcgcgtttgccggctcgccaatgtgatgaagaagcacggcgtcaagaagggcgaccgcgtcaccatctacatgccgatgatcccggaagccgcctatgcgatgctggcctgcacgcgtatcggcgccatccattcgatcgtcttcggcggcttttcgcccgatgcgctggccggccgcatcgtcgactgcgaatcgaccttcgtcatcaccgccgatgaaggcctgcgcggcggcaagtcgattccgctgaaggagaacaccgacaaggcgatcgacatcgccgcgaagaacttcgtcatggtgaagaacgtcctcgtcgtgcgccgcaccggcggcaaggtcggctgggcgccgggccgcgacctctggtatcacgacgaggtcgcgacggtgaaggccgagtgcaagcccgagaagatgaaggcggaagacccgctgttcatcctttatacctcaggctcgaccggcaagccgaagggcgtgctgcacaccaccgccggctatctcgtctatgcctcgatgacgcaccaatatgtcttcgactaccatgacggcgatatctactggtgcaccgccgatgtcggctgggtgacgggccacagctacatcgtctatggcccgctcgcgaacggcgccaccacgctgatgttcgagggtgtgccgaattacccctcgcagtcgcgcttctgggaagtcatcgacaagcacaaggtcaacatcttctacaccgccccgacggcgctgcgcgcgctgatgggcgccggcaacgacccggtgaagaagacctcgcgcaaatcactgcgtgtgctcggctcagtcggcgagccgatcaatccggaagcctgggagtggtatttcaacgtcgtcggcaacggcaaggtgccgatcgtcgacacatggtggcagaccgagaccggcggcatcctgatcacgccgctgccaggcgccaccgacctcaaggcaggctcggcgacgcggcccttcttcggagtcaagccgcagctagtcgacggcgaaggcaaggtgctggaaggagccgccgacggcaatctttgcatcaccgattcctggccgggccagatgcgcaccgtctatggcgatcacgaccgcttcgtgcagacctatttctccacctacaagggcaagtacttcaccggcgacggctgccgccgcgacgccgacggctactactggatcaccggccgcgtcgacgacgtcatcaacgtctccggccaccgcatgggcacggccgaggtcgaatcggcgctggtgagccatgacaaggtctcggaggccgccgtcgtcggctacccccacgacattaagggccagggcatttacagctacgtcaccttgatgaagggcgaggaaccgaccgaggatctgcgcaaggagctcatcgcccatgtccgcaaggagatcggcgccatcgcctcgcccgacaagatccagttcgcccctggcctgcccaagacacgttccggcaagatcatgcgccgcatcctgcgcaagatcgccgaggacgatttttctacccttggcgacacctcgacgctcgccgatccggccgtcgtcgacgacctcatcgccaaccggcagaacaagaagggctga

SEQ ID NO: 35728 - DNA, 666 bp, Mesorhizobium loti
atgtttgctggcagaaaattcgcggccttccttttcgacatggacggcacgctgatcaattccatcgcctcggcggagcgggtgtggagcgattgggcgcgccgccatggcctcgacgtcgcttccttcctgccgacgatccacggcgtgcgggcgatcgagaccatcaccaaccttgcccttccaggcgtcgacccggcgcatgaggccgacctgctgctgaaagccgaggccgccgatctggatggcattgtcccgatcgccggcgccgtggcatttctcaaggcgctgccgggcgaaagctgggcgatcgtcacctcggcgccgcgctccctggcgcttgcgcgcatggaggctgccggcattcctgtccccgcggtcatcgttgcggctgaagacgtctcgcgtggcaagccggcccctgactgtttccggcttggcgcacaacggctcggcgtcgatgcgcgcgactgcctggtgttcgaggatgctccggccggcatcgcggcggccgaggccgcgcaggcttcggtcatggtgatcagcgccacacattcgcacccgctgccgacgcagcatgccgcgatcgctggctatgacggcgtcggcatcaccatcgacgagcgcggctggctggcgctcgaggcccagcgcgacgctgcttga

SEQ ID NO: 35729 - DNA, 2055 bp, Mesorhizobium loti
atgccctccacgaaaaccgtcgacatcgccgcccatccgctgaccgcgtggcaagggccgctcggcctgcccgactttgcccatattggcgacagcgatttttcgccggtcttcgacgcggcgctaacggcgcatgaggcggagatcgatgcgattgccggcaacaaggacgcgccgacgatcgagaacacgcttgccgcgctggaactcggcggcgaggcgctcgatcatgtctcgtcgatcttctggtgccgcgccggcgcttacaccaacgagaccatccaggcgctggagcgcgacatctcgccgaagatgtccaggcatttttcggcgatatcgatgaacgagaagctgtttgcccgcatcgacgacctctaccagcgtcgcgagagccttgacctcgacgccgagaccctgcgggtgctggagaagacctggaagggtttcgtccgctccggcgccaagctcgatgccgagggcaagaagcggctggccaggatcaatgaagagctgtcttcgctcggtacggctttcggccagaacgtgctggccgatgagcgcgactgggcgctgttcctcgacgaggccgaccttgccggcctgccggatttcctgaaaagctcgatggcagaggcggccgagatgcgcggccagaagggccgctacgccgtcactttgtcgcgctcgatctacgagccgttcacgaccttctcggaacgccgcgacctgcgcgagatcgccttcaaagctttcaccatgcgcggccagaatggcggcgccagcgacaacaccgaagtcgtgcgcgacatgctgaaactgcgcgccgaaaaggccgagctgctcggctacgcctccttcgccgcgctgaagctcgacgacaccatggccaagacgccgaaggcggtgcacgacctgctcgatccggtctgggaaaaggcgctggaaaaggccgccgccgaccagaaggaattggagcgcctggcggcgcaagccggcagcaacgagaaattcgccgcctgggactggcgcttctaccaggagaagctgcgcgcggaaaaattcgccttcgatgaggcggagctgaaaccctatctgcagctcgaccgggtgatcgacgcctgcttcgacgtcgcgaccaaactgttcggcatcaccttcgaggagaaaaagggcatcgtcgcctggcacccggacgcgcgcgtcttcgtggtgaaaaatgccgatggcagcgagcgcgcactgttcctggccgattatttcgcgcggccctcgaagcgttccggcgcctggatgagcgcgctgaagtccggctacaaacttggcaacggctcgaagccggtgatctacaacatcatgaacttcgccaagccgccggcaggcgaaccggcattgctgtcggtcgacgaggcgaagactctgttccacgaattcggccacgcgctgcacggcatgctgaccgacgtcacctggccgtcggttgcgggcacctcggtcagccgcgattttgtcgaactgccctcgcagctctacgagcactggctgacggtgccggcggtgctggagaagcacgcgctgcacgtcaagaccggcaagccgatgccgaaggcgctgctcgacaagatgctggccacgcgcaccttcggcgccggcttcgccaccgtcgagtttacgtcttccgccttgatcgacatggcctatcacgctcggccagatgcaccggccgaaccgcttcgtttcgaagccgaaacgttggaaaaactcgacatgcccgacaccatcgcgatgcgccaccgcaccccgcatttcggccatgtcttctcgggcgacggctattcggccggctactattcctacatgtggtcggaagtgctggacgccgacgccttcgccgccttcgaggagaccggcgatcccttcaacccggcactggccgaacggctgcgcaagaacatctacgccgccggcggctcgaaggaccccgaagagctctacacggcctttcgcggcaagatgccgtcgccggaggcgatgatggtgaagcgcggattggtgtag

SEQ ID NO: 35730 - DNA, 768 bp, Mesorhizobium loti
atgggcgaaagactggccggcaaggtcgccatcatctcgggcggcgcgacgggaatgggcggcgcggcttctgagttgttcgcggccgaaggcgccaaggtggcgatcatcgaccgcaatggggaggcagccgctgccacggcagcggcgatacgcgcgcggggccgtgtcgccgagcattttgtcgccgacgtgtccgacgaggcgcaggtccaggcggcggtgaagggcgcgaccgaaaaactcgggcctgtcacggtgttgttcaatcacgccggcaccatcgtgatcaaaccgttcctggagacgaccgtgcaggaatgggactggctgcatgcggtcaacgtgcgctcgatgttcctgatgacgcgtgccgtgctgcccggcatgatcgcggcgggcggcggctcgatcgtctgcacctcgtcgatctcggctgtggcggcaacaccgatggaggtgctctacgacaccaccaagggcgcctgccacatgttcgcgcgcgccatcgcggtggagttccgtgaccgcaacatccgctgcaacgccgtctgccccggctttatcaggacgccgcacggcctgcgcgaggtcgccgacctcggcaagctcggcgtcgacgtttcggacgcggcattggcggcacagcagggccgcatcggcgagccggaagaggtggccaaggctgccctgtatttggccagcgacgagtcgagcttcgtcaacggcgcgcatctgttcgtggacaatggctttacggcgatgtga

SEQ ID NO: 35731 - DNA, 1206 bp, Mesorhizobium loti
atggccgaggcctatatctgcgattacatccgcacgccgatcggccgcttcggcgggtcgctgtcctcggtccgatcagacgacctcggcgccattccgctgaaggctttggccgagcgcaatgccggtatcgactggcaggcggtggacgacgtcgtctatggctgcgccaaccaggccggcgaggacaaccgcaacgtggcgcgcatggcgctgctcctggctggcctgccgaaggaaatcccgggttcgaccgtcaatcgcctgtgcgggtccggcatggatgcgttgaccatcgcggcgcgcgccatcaaggccggcgaggcggaattgatgattgccggtggcgtcgaatcgatgagccgggcgcccttcgtcatgcccaaggccgacacggcgttttcgcgcaatgccgagatttacgacaccacgatcggctggcgcttcgtcaacccgctgatgaagaagcaatatggcgtcgattccatgccggaaaccggcgagaacgtcgccgaggattttgccgtgtctcgcgccgaccaggacgcctttgccgtgcgcagccaggacaaggctgtcgccgcgcaggccaatggcaggctggccaaggagatcacagcggtgacgatcccgcagcgcaagggcgatccggtggtggtctcgaaagacgaacatccacgcgccggcaccacggtcgaggcgctggccaagctgccgacgccgttccgccagggcggcacggtgaccgccggcaatgcctccggcgtcaatgacggggcggcggtgctgatcgttgcttccgaggctgcggtgaaaaaatatggcctgacgccgattgcccgcatcctcggtggtgcagccgccggtgtggcgccgcgcatcatgggtatcggcccggcgccggcgacgcagaaactgtgcgcgcggctcggcctgacgccgcaacagttcgatgtcatcgagctcaacgaagcctttgcctcgcaaggcatcgccgtgctgcgccagctcggcattgccgaggatgccgagcacatcaacccgaatggcggcgccatcgcgctcggccatccgctggggatgtcgggtgcgcgcatctccggcacggcggcgctggagctgcgtgagcgcggcggtcgctacgcgcttgcgacgatgtgcatcggcgtcggccagggcatcgccatcgcgctcgaacgggcctga

SEQ ID NO: 35732 - DNA, 1524 bp, Mesorhizobium loti
gtggaggaggacaacatgcatttctcccctgaccggccgaccttcttcgtcaatccggattaccggcagatggccgatacgagcaaaccggtgatcgatccggcaacgctggagacggtcggcgccatcgcgtccgccagcgatggcgagatcgatgcggcgctcgctgccgcgacgaaggcgcaggccgcctggaaaaggctcgatgccaagagccgggcaaaacatttgcatgccgtcgccaatgccatcgaggccgccgatttcacccgttgcgccgagctgatggtgcgcgagatgggcaagccctatcccgaagccatcggcgagatcgccaattgcgcaccgatcttccgctattatgccgagatggcgcgcgacgacgccggcaaggtcgccggcacgacgcaggccggttcgttccagtacgcgcgctacgagccctatggcgtctcggtccacatcatgccctacaacttcccgatcctgctgatgtgctggaccgtcgcggcatcgcttgccgccggcaatgcctgcatcatcaagccggccgaggcgacgacgctgtcgacgctggactacatggccgtgttccgctcgctgccggaaggcctggtctcctgcctgcccggcggcgcggccacggcgcaagcactgatcacgtccgaccgcacccatgccgtcgccttcaccggctcggtcgccgcaggcaaggcggtcgcggtcgcctgcgccgaacgcatgaagccttgcgtcatcgaggccggcggcagcgatccgctgatcatcagcaaacacgcgccactggaggtcgccgcggccggcagtgtcaccgccgccttccatctcaccggccaggtctgcacttcggccgagcgcttcttcgtcgtcgatgccgtgcatgaccgcttcgtcgagttgtttgccgaaaggacacgcgcgctgcgcatcggcaacggcatggacaagaccgagatcggtccgctggtcagcgaagcggcccgtgccaaggtcatgcgtcttgtcgatgacgccattgcccatggcgccaaggccgtcaccggcgggcgcatcccgccgtcgcacaacaccggttggttctacgagccgacgatcctgaccggcgtcacccctgatatggcgatcgtgcgcgaagagtgttttgggccggtcgccgccatctgccgggtgaaggatttcgacgaggcgatacggcttgccaatgacagcctgttcgggctcggcgcctccgtcttcaccaccgacctcgccgaagcgcatgaagcggccgaacggctcgaggccggcatggtctgggtcaacaacccgctgatcgacaatgacgccctgcccttcggcggctggaaggcgtcaggcctcggccgtgaactcggccgccaggggctcgacgccttccgtcgctcgaaaatggtcatcatcgaccacagaccggcgatccaggactggtggtatccctatcccgacagctggttccgcgagaccggcggccgcaagcacgtgtga

SEQ ID NO: 35733 - DNA, 2070 bp, Mesorhizobium loti
ttgtccaattctgtcagcgccgtgaatgacaatggcgtcgccatcgtcaccatcgacaactcgccggtcaacgcactgagtttccatgtccgcgcgccgctgatgcaggcgcttgtcgacttgcgcgatgacgcttcggtcacggcaatcgtgattgcctgcgcaggacggaccttcgttgccggcgccgacatcaccgaattcggcaaaccggtgcagcagcccgatctgcgcgccatcgtagcgatgctggaaaccatcgccaaaccgacggtcgccgccatccacggcaccgcgctcggcggtgggctggaactggcactcggctgccatttccgcgttgccgatgccggcgccaaactcggcctgcccgaagtgaagctcggtctcttgccgggcggcggcggcacggtgcggctgccgcgcctggtcggcgcggtgaaggcgctgaagatgatcgtttccgggactccgatcggcgcggacgaagcgcatgaagccggtctggtcgatgccgttttcgagggagatctgaccacgcatgccgtgaacttcgcaggggaaatcgcccgcaagggcggtccgttcacgccggtgcgcgatcgcgatgagcggcttggggaaaccgaccttgcggctttcgacgccgaggcggcggacctcgccaggaaagcgcgcgggctggaagcgcccgtcgcctgcgcgcaagccgtgcgcaacgccgtcacactacccttcgacgaggcgctggcggcggagcgggcgctgttcgtaaaactggtcgccagtgaccagtcgcgggcgcagcggcatctgttcttcgccgaacgtgaggcggcaaagcttcctgccaaggacacgtacaagcgtaggatcgcccgcgtcggcgtcattggcgccggcacgatgggcggcggcatcgccatggccttcgccaatggcgggttctcggtcaccttgctggaaaccagcgcggaagcgctgcagcgcgggctgggcacgatcgagaagaactatgccgtttccgtttcgcgcggttccctggccgaagacgccaagcatcagcggctcgcccagttcaagggctcgaccgactatgccgatctcgccgaatgcgacttgatcatcgaggcggtgttcgaggacatggcggtgaagaaggaggttttcggcaagctggatgctgtcgccaagccgggcgccatcctcgccaccaacacctcctatctcgacatcaatgaaatcgccggctcgatctcgcggccgcaggatgtgctcggcctgcatttcttctcgccggccaatgtcatgaagctgctggagatcgtgcgggccgacaagaccgcgccggatgcgctggcgacggtgatcgacctggcgcggcggatcggcaaggtggcggtcgttgtcggcgtctgccacggcttcgtcggcaaccgcatgctggccgcgcgcggttcggaatcggaggcgctgcttctggagggtgcgacacccagccagatcgacaaggcgttcaccgatttcggctggccgatggggccgttccagatgggcgatctcgccggcctcgacattggctggcgcaaccgcaaggcgcgtggcctgacggccgtcatcgccgacacgctgtgcgaacaggggcgcttcggccagaagaccggccggggtttctatctctacgaggccggcgcccgggcgggcattcccgatcccgaggttgaggcgctaatccgtgacaaggccgccgagcgtggcatcgcgccgcgtgcgatcagcgcggacgaaatcatcgagcgcacgctctatcccctggtcaatgagggcgcgaagatcctcgaggagaagatcgcggcccgtgcctcagacatcgatgtcgtctgggtcaacggctacggttttcccatcggcaagggcggcccgatgttctgggccggtctcgaaggggcggcaaagatcgtccagcggctcgaccactggcatcagcggaccggcaaggatgtgttcaagcctgccccgctgctgaagcggatggccgagaccggctcctgggagggcgtcgaggcgtaa

SEQ ID NO: 35734 - DNA, 2415 bp, Mesorhizobium loti
atggcagtgacgccgatcgttcccccgggcgcaccgggcattccggcgcgctggacatcgagcgccaagagcggcgtcgggacgtcgctttcgccggccggccacatctggttcaccatcagccacggcatcctcgaagtctactatccacggctcgacagcgcctgcacgcgcgatctcggcctgatcgtcaccggtcccggcggctatttctccgaagagaagcgcgatgccgcgcatgaaatcgagcccttcgaggccggcgtgcccgcctaccggctggtcaacacggccggcgacggcgcctaccgcatcgagaagcgcatcctctgcgaccctgcgcggcccgtgctgctgcaggaaatcaccttcacggcgcttaaaggtgcgcccgacgattaccgcgtctacgcgcttctggcgccgcatctggtcaatgccggcatgggcaacaccgcctgggtcggcgaccacaagggaaagcccgtgctgttcgcctcgggccgcggctcttgcctggcgctggcctcgtcgctgccctggcgggactgttcagccggctatgtcggcttctccgacggctggcagcagctcaatcataccggcatccttgatcaggcttgccaacgggcggaagacggtaatgtcgcactgaccggcgagatcggctttacatcaacaacgacaaaagccgtgctggcgctgggtttcggcgcgacaccggacgaggccgccgaaaatgccttcgccagtctggaacagggctttgagcccgcagccaagacctacctccagaattggcgcgaatggcaggcgcggctgctgcccctggaccggcacgcggcatccggcatcaacacctatcgcacctcgaccgcggttctggcgacgcaccgctccatcgccatgccgggcgcggcggtcgcaagcctgtccattccctggggcttcaacaagggcgacgacgaccttggcggctaccatctggtctggccgcgcgatctggtcgagactgcgggcggcttcctcgccgccggcgacgccgcctcggcgctgcagatccttgagtatctgcgctccatccagcagccggacggccattggccgcaaaatgcctggctcgacgggtcggcctattggcccggcatccagatggacgagtgcgcctttccgctgcttctggccgacgccttgcaccgcgccggccatctgccgcgcgccaggcttgccaccttactgccgatgatcgaacgcgccgcgacctatgtcgtgcgcaatggacccgtcaccggcgaagaccgctgggaagaggatgccggctacagcccgttcacgcttgccgtcgagatcgccgccctgcttgctgcggccgacctgctcgacgcctgcggcaagaaggacgaagcaacctatctgcgcgagacatcagatggctggaacgaccagcttgagcgctggacctatgccaccgacacggcgatctgcagggcagccggcgtcgaaggttattatgtccgtatcgcgccacccgacagcgccgaggccggctcgcccaaggacggctatgtcccgatcaagaaccggccgcccggcgacaccgaccgcccggcgcaggaaatcgtcagccccgacgcgctggcgctggtgcgctttggcctgaggtcggccgacgacccgcgcatcgtcgacacagtcaaggtcatcgacgcgcagttgcgctgcgcgctgccgcagggcccgatctggtatcgatacaatggcgacggctatggcgaacaccaggacggcacgcctttcgacggtaccggccagggccggccctggccgcttctggccggcgagcgcgcccattatgagctggcggcggggcgcaaggatgaggcggccaacctgctcaaggcgctggaggattcggccgagccgggcggcctgctgccggagcaggtctgggatggcgccgacctgcccgagcgccaattgctgcatggccgcccctcgggcagcgccatgcccctggtctgggcgcactccgagcatatcaagctgctgcgctcgctgcgcgacggcgccgtcttcgacatgccgccgcaaggcgtgaagcgctacatcgaggccaagaccgtatcgccattcaggacctggcgcttcaacaacaagatccgcgcgctgcccgaaggcaagacgctgcgcatcgaattgctggccgcggccacggtgcattggagcaccgacaattgggcaaccgcccatgacagccagacggtggaaaatgccttcggcatccatcttgccgatttgcccacgaccagcctccccgagggaagcgcgctgatcttcacttttttctggcccggaaccggcgattgggagaatgtcgacttctccgtcacatcaggcgagcgggatagcggctaa

SEQ ID NO: 35735 - DNA, 1017 bp, Mesorhizobium loti
atgcagatcggaatgatgggactgggccggatgggcgccaacatggtgcggcgcctgatgcgagacggccatgaatgcgtcgtctacgacatcaacccggcaagcgtcgcggctctggtcagcgacggcgcgctcggcgcggcctccctgacggaattcgtcggcaagctcgccaagccgcgctgtgtctggctgatgctgccggcggcgatcaccggcaagattatcgatcaggtctcggccctgatggaacccggcgacatcgtcatcgacggcggcaattcctactatcacgacgccgtcaaccaggcggccaaactggccgccaagggcatccatcttgtcgatgttggcaccagcggcggtgtctggggcctggagcgcggctactgcctgatgatcggcggtcccgacgtagcggtgcagcacctcgattcgatcttcgccacgctagcgcccggcgccgatgccggcgcgccggctcccgacaaggccgccggaaccgcgcccttcggctacctgcattgcgggccgagcggcgccggccatttcgtcaagatggtgcacaacggcatcgagtatggcgtcatggccgcctatgccgaaggcatgaacatcttgaagtcggccaatgccggcaagcggcaacgcacggccgacgccgagaccagcccgctggaaaacccgcaatattatcagttcgacatcgacctcccgcaggtggccgaggtctggcggcatggcagcgtcatcggctcctggctgctcgatctcaccgccggcgcgctgaagagcgatccgggcctggcccagttcggcggccgcgtctcggattccggcgaaggacgctggacgctgaaggcggcgatcgacaccggcgtgccggcgccggtgctgtcctcggcgctgttcgaccgcttctcctcgcaaggcgaatccgaattcgccgacaagctgttgtccgccatgcgctatgccttcggcggccatgtcgaaaagccgaaggccggcaagtga

SEQ ID NO: 35736 - DNA, 1428 bp, Mesorhizobium loti
atgtcgaaaagccgaaggccggcaagtgacgccacagcgggagacgcacgcatgagccaggaacggtccgacacgctggtgctcttcggcgccaccggcgacctcgcccacaagaagatatttccggcgctttaccagatggtcgccaagggcacgctcaccgaaccggtgatcggcgtcgccttcgacgcctgggacatcaagcagttgcaggcccgcgcccgcgacggcatcgtcaacgcgctgggcaagatcgacgagaaggtgttcgccaaattcgcttcgttgctgcgctatgtcagcggcgactaccgcgatccggccaccttcgagaaactgaagaccgcgcttggcaccgcccagcggccgctgcactacatggcggtgccgccgaccatgttcgagactgtcgttcaagggttggagcagtcgggaaccgcgcgtggcgcacggctgatggtggaaaagccgttcggccatgatctgcagtcggcgcgctggctgaaccgggtgctgcatctggtgttcgacgaacagtcgatcttccgcatcgaccactatctcggcaaggaagcgatccagaacctgctttatttccgcttcgccaattccttcctcgagccgatctggaaccgcaatttcgtcgagagcgtgcagatcaccatggccgaggatttcggagtcgaggggcgcggccgcttctatgacgatgtcggctgcataagggatgtcatcgagaaccatctgctcaacatcctcctgctgctggccatggagccgccggtcggccgctccgccgacgacctgatcgacgagaaggtccaggtgctccgggcgatccggacgctgacgaaagacgatgtcgtgcgcggccagttcaccggctatctcgccgagcccggcgtggcgccgaattcgccggtcgaaaccttcgctgcggtgcggttcttcgtcgacacatggcgctggcaggacgtgccgttcttcattcgcgccggcaagaacatgccggtgcatgttacggaagtggtggtgcggctgaagcgcccgccgctcgacgtcttcgacccgatcaagcccgccgaccagaattacgtgcgcttccgcatcgacccgcaggtggtgatcgccataggcgcgcagcgcaaggcgcccggcgacgacatggtcggcgagcaggtggaactgacggcgctcgacgacagcaaggccgacatgccgccttacgagcgcctgatcggcgacgccatgaacggcaatggccagctcttcacccgccaggacgcggccgagctcgcctggcgcatcgtcgggccggtgcttggcgacaccacgccgccgcatctctacgagccgaaaacatggggaccggcgcacgccatggccggcttcgggccgcccaatggctggatcgacccggtggcatga

SEQ ID NO: 35737 - DNA, 927 bp, Mesorhizobium loti
atgcaaacaaccttgaaaatcggaacacggggcagcccgctggcgctggcccaggcgcatgaaacgcaggcgcggctgatggccgcgcatggcctgccggcggaagccttcgaggtcgtcgtcatctcgaccagcggcgaccgcatccaggaccggccgctgtcggaggccggcggcaagggcctgttcaccaaggaaatcgaggaagcgctgctcgccggtgcgatcgacatcgccgtgcattcgtccaaggacatgccgacgcaattgcccgatggcctggagctttccgccttcctgccgcgcgaggacgcgcgcgacgcctttgtcggcaaggcggcaaagaccatcgccgacctgctgcgcggggccaaggtcggctcgtcgtcgctcaggcggcaggcactgatccgccgcatgcggccggatctcgacgtggtgatgttccgcggcaatgtgcagacgcggctgcgcaagctcgacgaaggggtcgccgccggcaccatcctcgcctatgccgggctgaagcggctgggtctggagcatgtcgccaccgacttgatgccgctcgacatttttccgcccgcacccggccagggggcgatcggcatcgagacgcgcatcggtgatcgcgccgtcgaaaagatgctggtcgccatccacgatgtgccgacggggcaggcgctggcctgcgagcgcgccttcctggcggcgctcgacggctcctgccgcacgccgatcgccggccatgcgactatcgagaccggaaatctctctttcgccggcctgatcatctcacccgacgggacgcagtcgcatacggtcgaattgcagggaccagcacaggatgccgcccgcatcggcgatgaggccgcacggacggtgcgggccaaggccggggaaaaattcttcgacggctgggtctga

SEQ ID NO: 35738 - DNA, 807 bp, Mesorhizobium loti
atgcccttttccatcgccacctggaacatcaactccgtgcgcctgcgtatgccgatcgtcgagcggctgctcgatgaatacgcccccgatgtgctctgcttgcaggaaacgaaagtgcccgatgagctgtttcccgaaaaggcattccgcaggcttggctaccagtacatcgcctttcatggccagaagggctatcacggcgtcgccacggtggcgcggcggccgatcgaggtggtcgaaaagcgccgcttctgcgacatcgaggacagccggcatctgtcggtgacggtgcgcgccggcggcaagacgatcctgctgcacaatttctacgttccggcgggtggcgacgagcccgatcccgaaatcaacaagaaattcaagcacaagctcgactttgtcgccgagatgaacgccatccgcgccgagcacacagaggtgtctgcctcggtgctggtcggcgacctcaacatcgcgccgctcgagcacgacgtctggtcgcacaagcaattgctcaacgtggtcagccacacgccggtcgagaccgaaaacttcgaggcgatgcggctcgccggcaattgggtcgacctgatgcggcacaacgtgccattggaccagaagctctacacttggtggagttatcgcgcacaggattgggagctgtccaatcgcggccggcggctcgaccatgtctggtcgtcgcccaatctggtgcaggatttcgccggctacgaaatcctgcgggcggcgcgcggctgggagcggccgtcggaccatgttcccgtcatcgcacggttcgatctggattag

SEQ ID NO: 35739 - DNA, 780 bp, Mesorhizobium loti
atggtcgaactcacgctccccaagaattcgaagatccagcagggcaagacctggccgaagccggaaggcgccacaaatctgcgggaataccgcatctaccgctggtcgccggacgatgacgagaacccgcgcatcgacacctatttcgtcgacatggacgattgcgggccgatggtgctcgacgcgctgctgtggatcaagaacaagatcgacccgacgctgaccttgcgccgctcctgccgcgaagggatttgcggctcctgtgccatgaacatcgacggctccaacacgctggcctgcaccaagggctgcgacgacatttccggtgcggtcaaagtctacccgctgccgcatatgcaggtggtcaaggacctggtgcccgacctcaccaatttctacgcccagcatgcttcgatcgagccgtggctgaagacggtgtcgccgcagccggccaaggaatggttgcagagccatgaggaccgcgagaagctcgacgggctctacgagtgcatattgtgcgcctgctgttcgacctcgtgcccgagctattggtggaacggcgaccgctatctcggtccggcaaccctcttgcaggcctatcgctggctgatcgacagccgcgacgaggccaagggcgagcggctcgacaatctcgaagacccgttccggctctatcgctgccacaccatcatgaactgcgcgcagacctgccccaagggcctgaacccggccaaggcgatcgccgagatcaagaagatgatggtggagcgacgggtctga

SEQ ID NO: 35740 - DNA, 1809 bp, Mesorhizobium loti
atggcaggctataattttgtcgaccacaaattcgatgtggtggtggtcggcgccgggggtgcgggcctgcgtgccacgctcggcatggccgaacagggcctgcgcaccgcctgcatcaccaaagtgttcccgacgcgctcgcacacggtggccgcgcaaggcggcattgccgcttcgctgtccaatatgggtcccgattcctggcagtggcacatgtacgacaccgtcaaggggtcggactggctcggcgatgtcgacgccatggaatatctggtgcgcgaagcgccggccgcggtctacgagctcgagcactatggcgtgccgttctcgcgcaccgaagagggcaagatctaccagcggccgttcggcggccacatgatgaattacggcgaaggcccgccggtgcagcgcacctgtgccgccgccgaccgcaccggccacgcgatcctgcacacgctctacggccagtcgctgaagaacaacgcacagttcttcatcgagtatttcgccctcgacctgatcatggagccggatggcacctgcaccggcgtcgtcgcctggaacctcgacgacggcaccatccaccgtttctcggccaagatggtggtgctggcgaccggcggctatggccgcgcctatttctcggccacctcggcgcacacctgcaccggcgacggcggcggcatggcgtcgcgggccggtttcccgctgcaggacatggaattcgtgcagttccatccgaccggcatctacggcgccggctgcctgatcaccgaaggcgcgcgcggcgagggcggctatctcgtcaattccgagggcgagcgcttcatggagcgctatgcgccgtcggccaaggaccttgcctcgcgcgacgtcgtctcgcgctgcatgacgctggagatccgcgagggtcgcggcgtcggcaagaagaaggaccatatcttcctgcatctcgaccatctcgatccggccgtgctgcacgagcggctgcccggcatttcggaatcggccaagatcttcgccggcgtcgacctcaccaaggagccgatcccggtgctgccgacggtgcactacaatatgggcggcgtgccgaccaactactggggcgaggtgctgaacccgacgacgcgcagccccgacaaggtgtcacccgggctgatggcggtcggcgaggccggctgcgcctcggtgcatggcgccaaccggctgggctcgaactcgctgatcgatctcgtcgtgttcggccgcgccgcggcaatccgcgccggccaggtcatcgaccgcaaatcggcgatcccgtcacccaacgaagcctcggtcgagaagatcatggatcgcttcgacgggctgcgccacgccaatggctcgacgccgacggccgtgctgcgcgagaagatgcagaaggcgatgcaggaagacgccgccgtgttccgcacgcaggaatcgctggagaacggctgcaagcgcatttcgcagatctggggcgagctcaaggacatcaaggtgttcgaccgctcgatgatctggaactccgacctggtcgagacgctggagctggaaaacctgatggccaacgccatcaccaccgtctatagcgccgaggcacgcaaggagagccgcggcgcgcatgcccgtgaagacttttccgcgcgcgacgacgccgcctggcgcaagcacacgctggccagggtgagcgaagacggcaaggtgacgctcagctaccggccggtgcacaccgagccgctgctggccgagaaggacggcggcatcagcctcgccaagatcgcgcccaaggccagggtgtactga

SEQ ID NO: 35741 - DNA, 1407 bp, Mesorhizobium loti
atggcttatgacgtcgttatcatcggatcgggacccggcggctatgtctgcgccatcaaggcggcacagctcgacctgaaggtcgcggtggtcgaaaagaacgcgaccttcggcggcacctgcctcaacatcggctgcatcccgtccaaggcgctgctccatgcctccgaaatgttcgccgaggccggccattccttcgacacgctgggcgtcgagatcccggcgccgaagctcaatctgacgaagatgatggcgcacaaggatgcgacggtggcgtccaacgtcaacggcgtcgccttcctgttcaagaagaacaagatcgacagcttccgcggcaccggcaaggtggtggcggccggcaaggtgtcggtgacgggcgaggacggcaaggtcgaggagatcgagacgaagaacatcgtcatcgccaccggttccgatgtcgccggcattcccggcgtcaaggtcgacttcgacgagaaaatcatcgtgtcgtcgaccggcgcgctgtcgctggacaaggttccgggccacctggtggtggtcggtggcggcgtcatcgggctcgagctcggctcggtctgggcgcggctcggcgccaaggtcaccgtggtcgagttcctcgacacgatcctcggcggcatggacggcgaggtctccaagcagttccagaggatgctgtcgaagcagggtttcgagttcaagctcggcgccaaggtcaccggcgtcgccaaggccaagaaaggtgcaaccgtcaccttcgagccggtgaagggcggcgccgccgaaaccatcgcggccgatgtcgtgctgatcgccaccgggcgccgtgcctatgccgacagtctcgggttgaaggaagcaggcgtcgaggtcgacgagcgcggccgcgtcaagaccgacgggcatctcaagaccaacgtccccggcatctacgccatcggcgatgtcatcgccgggccgatgctggcgcacaaggccgaggacgagggcgtggcggtggccgaaaccatcgccggccaggccggccatgtgaactatgaggtcatcccgagcgtcgtctacaccagcccggaaatcgcctcggtcggcaagaccgaggaagagctgaagaaggccggcatcgattacaaggtcggcaaattcccgttcagcgccaatggccgtgcgcgcgccatgctgcacacggacggtttcgtgaaaatcctcgccgacaaggccagcgaccgcgtgctcggcgtgcacattgtcggcttcggcgccggcgagatgatccacgaggcggcggtgctgatggaatttggcggctcgtcggaagacctcgcccgcacctgccacgcgcatccgacgatgtcggaagcggtgaaggaagcggcgctggccaccttcttcaagccgatccacatctaa

SEQ ID NO: 35742 - DNA, 756 bp, Mesorhizobium loti
atgagcgaggcgcagaaggtcctgctggtcaccggcggcagccgcggcatcggcgccgcggtctgccggctcggggcgaaggccggctatcgcgtcgcggtcaactacgcctcgaatagggctgccgccgacgccctggttgccgagatcaaggctgccggcggcgacgctttcgcggtcaagggcgatgtcggcggcgaggccgacatcatcgccatcttcgaggccgtcgaccgcagctatggccggcttgacgccttcgtcaacaatgccggcattgtcgatgccaaggcgcgcgtcgacgagatgagcgcggcacggctcgaacgcatgatgcgcatcaacgtcgtcggttccattctgtgcgcccgtgaggcggtcaagcgcatgtcgacccgccatggcggcaagggtggagcgatcgtcaacatctcctcggccgcggcggtgctgggcgcgccggacaattatgtcgactatgccgcctccaagggcgccatcgacacgttcaccgtcgggctggcccgcgaggtggcgctggaaggcatccgcgtcaacgcggtgcggccgggcatcatcgacaccgacatccatgcttccggcggacagcccgatagggtggcgctgatccaggacacgctgccgatgaaaagggccggcaccgccgatgaagtcgcggctgcggttctctatcttctatccgacgcagcgtcctatacgacgggcgcgatcctgaatgtcagcggcggccgctga

SEQ ID NO: 35743 - DNA, 1275 bp, Mesorhizobium loti
atggctaccgaaatccgcgttcccactctcggcgaatccgtcaccgaggcgaccatcggcaaatggttcaagaaggtcggcgatgccattgccgtcgacgagccgctggtcgagctcgaaaccgacaaggtgacggtggaagttccggccgccgccgccggcacgctgggcgaaatcgtcgccaaggaaggcgagacggtcggtgtcggcgctttgttgggctcgatctcggctggtggctctgcgccggcgaccaagccgcaggcggtgtcgcaggcctcgtcgcctgatgcggcgtcgaccagcaagcaggccgcggccgagaccgccaagatcgccggcgatgccggcgcggtcgagccgcgcagcatgccgccggcgccggctgcggcaaaactgatcgccgagaacaatctgtcggttgaccagctttccggctcgggcaagcgcggccaggtgctgaagggcgacgtgctcgacgccatcgccaagggcgcgccgtcgcagccggccgagacgccgagggctgcgccggcaccgatcgcggtgcgtgcgccatcctccggcgacgatgcttcgcgggaagaacgcgtgcgcatgaccaaattgcgccagaccatcgcgcgccggctgaaggaagcgcagtcgaccgccgccatgctgacgaccttcaacgaggtcgacatgtcggcggtgatggcgctgcggaccaagtacaaggacgtgttcgagaagaagcatggcgtgaagctcggcttcatgggcttcttcaccaaggccgtcacccatgcgttgaaggaaatcccggcggttaatgccgagatcgatggcaccgacatcatctacaagaactttgcccatgtcggcgtcgccgtcggcaccgagaagggcctggtcgtgccggtcgtgcgcgatgccgaccagatgtcgatcgccgagatcgagaaggagatcggccggctcggcatcgccgcgcgcgacggcaagctgtcggtcgccgacatgcagggcggcacgttcacgatttccaatggcggcgtctacggttcgctgatgtcgacgccgatcctcaacgcgccgcagtcgggcattctgggcatgcacaagatccaggaccggcctgtcgtggttggcggccagatcgtgatccggccgatgatgtatctggcgctcagctacgatcaccgcatcgtcgacggcaaggaagccgtgaccttcctggtgcgcgtcaaggaaagcctggaggatccggaacggctggtgctcgatctctag

SEQ ID NO: 35744 - DNA, 2988 bp, Mesorhizobium loti
atggcacgacaagatcaaaccaacgaccaattctcgctcacctcattcctctatggcggcaacgccgattacatcgacgcgctctatgccgcctatgaggacgatcccgcctcggtcaatcccgagtggcaggagttcttcgccgggctgaaggacgatgccggcgacgtgcgcaggaacgccaagggcgcctcctgggccaagccgtcctggccgctgcaggccaatggcgaattggtgtcggcgctcgacggcaattggggcatcgtcgagaagcacctggaaaagaaggtcaaggacaaggcggtcaccaatggcgtcgtcttgtccgatgccgacgtgcatcaggcgacgcgcgattcggtgcgcgccatcatgatgatccgcgcctatcgcatgcgcggccatctgcacgccaatctcgatccgctcggcatcgccaagccgctcgaggactacaacgagctgtcgccggagaattacggcttcaccgcagccgattacgaccggccgatcttcctcgacaatgtgctcgggctcgaattcggcaccatccggcagatgctggagatcctcacccgcacctattgctcgacgctcggcgtcgagttcatgcacatctccgatcccgaggagaaggcctggatccaggcgcgcatcgagggcgccgacaaggagatctccttcaccaacaccggcaagaaggcgatcctgcagaagctggtcgaggccgaaggcttcgagcagttcatcgacgtcaagtacaagggcaccaagcgcttcggcctcgatggcggcgaggcgctgatcccggcgctggagcagatcgtcaagcgcggcggccagctcggcatgaaggagatcgtgctgggcatggcgcatcgcggccggctcaacgtgctctcccaggtgatggcaaagccgcaccgcgccatcttccatgagttcaagggcggctcggccgctcccgacgaggtcgaaggctcgggcgacgtcaagtaccatctcggcgcctcgtcggaccgcgagttcgacggcaacaaggtgcatttgtcgctgaccgccaacccgtcgcacctggaaatcgtcgatcctgtggtgatgggcaaggcgcgcgccaagcaggactatctgttcggccgcggccgcgaggagatcgtgccgctggaggaacgcgccaaggtgctgccgctgctcctgcatggtgatgctgccttcgccggccagggcgtgatcgccgaaatcctcggcctgtcgggcctgcgcggccaccgcgtcgccggcacgctgcacttcatcatcaacaaccagatcggcttcaccaccaatccgcgcttctcgcgctcgtcgccctatccgtccgatgtcgccaagatgatcgaggcgccgatcttccacgtcaatggcgacgacccggaagccgtggtgcacgccaccaaggtggcgatcgagttccgcatgaagttccacaagccggtggtcgtggacatgttctgctaccgccgcttcggccacaatgagggcgacgaaccggccttcacccagccgatcatgtatcgcaacatccgcacccataagacgacggtgcagatctatgccgaccggctgatcgccgagggccacatcacccaggccgaactcgaccagatgaaggccgactggcgcgcgcatctggaatccgaatgggaagtcggccagcactacaagcccaacaaggccgactggctggatggcgcctggtcgggcctgcgcacggccgacaaccaggacgaacaaaggcgcggcaagaccgccgtgccggtcaagacgctgaaggaaatcggcaagaagctgaccgaggtgccgaagggtttcgaggcgcacaagaccatcatccgcttcctcgaaaaccgccgcgaggcgatcgaatccggcgaaggtatcgactggtcgacggccgaggccctggctttcggcgccatcctgctcgacggcaatccgatccgcctgtcggggcaggattccgaacgcggcaccttctcgcagcgccattcagtgctctacgaccagcgcgacgagactcgctacatcccgctcaacaatctgtcggcggcacaggccggctacgaagtcatcaactccatgctgtcggaagaggcggtgctgggcttcgaatatggctacagcctggccgagccgaaggcgctgaccttgtgggaagcgcagttcggcgacttcgccaatggcgcccaggtggtgttcgaccagttcatctcgtcgggcgagcgcaagtggctcagaatgtcgggcctcgtctgcctgttgccgcatggctatgaaggccagggtccggaacattcctcggcccggctggagcgcttcctgcagctgtgcgccgaagacaatatgcaagtggccaactgcacaacgccggccaactatttccacatcctgcgccggcagctgaagcgcgacttccgcaagccgctgatcctgatgacgccgaagtcgctgctgcgccacaagcgggcggtgtcgacgctgccggaaatctcgggcgaaagctcgttccaccggctgttgtgggacgacgcgcagctgttgccgaaccagccgatcaagctcaccaaggactcgaagatccgccgcgtcgtgctgtgctcgggcaaggtctattacgacctctacgaggagcgcgagaagcgcggcatcaacgacatctacctgctgcgcgtcgaacagctctatccgttcccggccaaggcgctgatcaccgaactgtcacgcttccgcaacgccgagatggtgtggtgccaggaggagcccaagaacatgggcgcctggtcgttcatcgacccatatctggaatgggtactggcgcatatcgacgccaagcatcagcgggtgcgctacaccggccggccggcggccgcgtcgccggcgaccggattgatgtccaagcaccttgcccaactcgccgccttgctcgaagacgcgctcggcgaataa

SEQ ID NO: 35745 - DNA, 903 bp, Mesorhizobium loti
atgtccattctcgtcgacaagaacaccaaggtgctggtgcagggcctgaccggcaagaccggtacgttccacaccgaacaggcgctggcctatcacggcaccaagatggtgggtggcatccatcccaagaagggcggcgagacgtggaccggctcgaagggcgagagcctgccgatcttcgccaccgtcgccgaaggtaaggcaaagaccggggccaacgcctccgtcgtttacgtgccgccggcaggtgccgccgaagcgatcctggaagcgatcgaggccgagatcccgctgatcatctgcatcaccgaaggcattccggtgatggacatggtcaaggtcaaggcgcggctcgaccgctcgacctcgcggctgatcggcccgaactgcccgggcgttctcacccccgacgaatgcaagatcggcatcatgcctggaaacatcttccgcaagggctcggtcggcgttgtttcgcgctcgggaacacttacctatgaggccgtgttccaaaccaccaatgtcggcctcggccagaccaccgccgtcggcatcggtggcgacccggtcaagggcaccgagttcatcgacgtgctcgagatgttcctggccgacgatgagaccaagtcgatcatcatgatcggcgagatcggcggttcggccgaggaagacgccgcgcagttcctcaaggacgaagccaagcgtggccgcaagaagccgatggccggcttcatcgccgggcgcacggcgccggccggccgcacgatgggccatgccggcgcggtcatctccggcggcaaaggcggcgccgaggacaagatcgcggcgatggaatcggccggcatcaaggtctcgccgtcaccggcgcggctgggaacgacgctggtcgaggcgatcaagggataa

SEQ ID NO: 35746 - DNA, 1194 bp, Mesorhizobium loti
atgaacatccatgaatatcaaggcaaggcgctgctgaagagctttggcgcgccggtggccgaaggcgtgccggtgttcaaggcgagcgaggcggaagccgcggcacgcgcgctgcccggcccgctctatgtggtgaagagccagatccatgccggcggccgcggcaagggcaagttcaaggaactgtcgcccgacgccaagggcggcgtgcggctggcgaagtcggtcgccgacgtcgtcgccaacgccaacgagatgctcggccacacgctggtgaccaagcagaccggcccggccggcaagcaggtcaaccgcctctatatcgaggacggcgccgatatcgagcgggaactttatctgtcgatcctggtcgaccgttccgtcggccgcatcgccttcgtcgtttcgaccgaaggcggcatggacatcgaggcggtcgcccacgacacgccggaaaaggtcatcaccgtcgccatcgacccggaaaggggcgtgacggcggatgatgtgaagaagctcaacgcagccctcaagctcgacggcgacgccgccaaggatggcggcacgctgttcccgatcctctacaaggccttcatcgagaaggacatgagcctgctcgaggtcaatccgctgatcgtcatgaagaacggccggctgcgcgtgctcgacgcaaaagtgtcgttcgacaacaacgcgctgttccgccacccggacgtgctcgaactgcgcgacaccactgaagaggacgagaaggaaatcgaggcgtcgaaatacgacctcgcctatgtcgcgctcgacggcaatatcggctgcatggtcaacggcgccggcctcgccatggcgacgatggacatcatcaagctctatggcgccgagcccgccaacttcctcgatgtcggcggcggtgcctccaaggagaaagtgacggcggcgttcaagatcatcaccaaggatccggcggtcaaaggcatactgatcaacatcttcggcggcatcatgaagtgcgacatcatcgccgagggcgtgatcgccgcggtcaaggaagtcgggctggaagtgccgctggtggtgcgtctggaaggcaccaatgccgaactcggcaagaagatcatcaacgacagcggcctcaacgtcgtgtcggccgatgatctcgacgacgcagccaagaagatcgtcgcggcggtgaagggctga

SEQ ID NO: 35747 - DNA, 969 bp, Mesorhizobium loti
atggcacgcaacaagatagcgcttatcggctcgggcatgatcggcggcacgctggcccacatgatcggcctcaaggacctcggcgacgtggtgctgttcgatattgccgagggtattccgcaaggcaaggggctcgatatcgcgcagtcgtcgccggtcgatggtttcgattcccggctgaccggcgtcaacgactatgccggcatcgagggtgccgacgtctgcatcgttacagccggcgtgccgcgcaagcctggcatgagccgcgacgatctgctgggcatcaacctcaaggtcatggaacaggtcggcgccggtctgaagaagtatgcgcccaaggccttcgtcatctgcatcaccaatccgctcgacgccatggtgtgggcgctgcagaagttttccggcctgcccaagacccatgtcgtcggcatggccggcgtgctcgacagcgcgcgcttccgctatttcctggccgaggaattcaaggtctcggtcgaggacgtcaccgccttcgtgctcggcggccacggcgattccatggtgccgatgatccgctactcgacggtatcgggcatcccgctgcccgacctcgtcaagatgggctggacctcgaaggagaagctcgaccagatcgtccagcgcacccgtgatggcggcgccgagatcgtcggcctgctcaagaccggctcggcctattacgcgccggcggcctcggcgattgccatggccgaatcctacctcaaggacaagaagcgcgtgctgccctgcgctgcccacctttccggccagtatggcgtcaagggcacctatgtcggcgtccccgtggtgatcggcgccggcggcgtcgagcgcatcatcgagatcgacctcaacaagagcgaacagaaaatgttcgagagttcggtggcgaccgtgcagggcctgaccgaggcctgcgtcaagatcgcgccgcagctcgcttcgaagtga

SEQ ID NO: 35748 - DNA, 885 bp, Mesorhizobium loti
atggcaagcactgcccctttcgccaagatgaacggcatcggcaacgagatcatcgtcgccgatatgcgcggccgtgccgatcaggtgacggcggccgccgcccttgcgctgaacggagatgccgcgacccgcttcgaccagatcatggcgatccatgatgcgaggacgccgggcaccgcctactatgtcgacatcctgaattccgacggcaccagtgcacaggcctgcggcaatggcatgcgttgcgtcgtccaggcgctcgccgccgagaccgggcaaaagaccttcaccttcgagacccgcgccggcattctcaatgcccgggagcatgccgacggcacgatctcggtcgacatgggcatgccgcatttcggctggcaggagatcccgctcgccgaggagttccgcgacacccgcatgatcgaattgcagatcggcccgatcgacgcgccggtgctgcattcgccctcagccgtctcgatgggcaacccgcacgccatcttctgggtcgaccgcgacgtctggtcctatgagctcgaacgtttcggcccgctgctcgaaaaccacccgatctttcccgagcgcgccaacatcaccatcgcccaggtgacctcgcccgagagcatgatcatccgcacctgggaacgcggcgccggcctgaccaaggcctgcggctccgccgcctgcgcatcggtggtggccgcggcccgcaccaggcgcaccggccgcagcgtcaaccttttgacgcccggcggcggcacgctgcatgtcgaatggctagataacgaccacgtcatcctgaccggtgccgccgagtgggaattttccggcagcttcgatccctcgaccggcacctgggcccgcgacaccgaaagcgcggcctga

SEQ ID NO: 35749 - DNA, 921 bp, Mesorhizobium loti
atggcggccgcagactattacgaggttctcgatccgcgcttcgcgcggctgttcaacggcaacgcgcaggtggacaagctgttcaccggatgccgctgggcggaggggccggcctggttcgccgccggccgctatgtcgtctggtccgacatcccgaacaaccgcatgctgcgctatgacgagaccgacggcagcgtcagcgtcttccgccagccctcgggcaattccaacggcaacaccgtcgaccggcacggccggctggtcacctgcgagcattcgggccgccgcgtcagccgcaccgagcatgacggctcggtcaccactattgccgccaaatggaagggcaagcggctgaactcgcccaacgacgtggtggtgaagtccgacggctcgatctggttcaccgatccgagctacggcatcgacaccgactatgagggcgacaaggccgagagcgagatcggtgcctgctacgtctaccgggtcgatccccacagcggcgaggtcgaggccgtcatcaccgatatggtgcgacccaacgggctcgccttctcgctcgacgaaagcctgctctatgtcgtcgacaccggccgcacccatggcgctgagaatccggcgcatatgcgggtgttcaacgtcggcaagcacggcaagaaggtgtcgagcggcaaggtcttcgccgactgcaccgccggcctgttcgacggcttccggctcgacgccgacggacgcatctggaccagtgccgccgacggcatccattgctacgatcccgacggcacactgatcggcaaggtcaaggtgccggaggtgaccgccaattgcgtgttcggcggcgccaagctgaactgcctctacatcgccggcacgacctcgctctattcggtgcggctgatggtaaacggggccaagactttttga

SEQ ID NO: 35750 - DNA, 2691 bp, Mesorhizobium loti
gtgtcaaaatccctcgatagtttcaattgccgtcgcacgctgaccgcgggcggcaccgaatatgcctatttcgacctcgtcgaggccgagaagaacggcctcaccggcatcgcccagctgccctattcgatgaaggtgctgctggagaacctgctgcgcaatgaggacggccgctccgtcaccaaggaatcgatccaggcggtggccggctggctgaccgacaagggcaccgccggcgtcgagatcgcctatcgcccggcccgcgtgctgatgcaggatttcaccggcgttccggccgtggtcgaccttgccgccatgcgcgacgccatggcctcgctcggtggcgacccgcaaaagatcaacccgctggtgccggtcgacctcgtcatcgaccattccgtcatcgtcgacgaattcggcacgccgatggccttcgcccgcaatgtcgagctcgaatatgagcgcaacgaggaacgctacaagttcctgaaatggggccagcaggcgttccgcaacttccgcgtcgtgccgcccggcaccggcatatgccaccaggtcaacctcgaatatctcggccaggtggtgtggaccaacaccgaggacggcgaaaccacggcctatcccgacacttgcgtcggcaccgattcgcacaccaccatgatcaacggccttggcgttctcggctggggcgtcggcggcatcgaggccgaggcggccatgctcggccagcccgtctccatgcttttgcccgaagtcatcggcttccgcctcaccggcaagctcaaggaaggcgtcaccgccaccgacctggtgctgaccgtcacccagatgctgcgcaagaagggcgtcgtcggcaagttcgtcgaattcttcggcccgggcctctccaacatgacgctcgccgaccgcgccaccatcggcaatatggcgccggaatatggcgccacctgcggcttcttcccggtcgatgcggagaccatccgctacctgacaatgtccggccgcgaggaaagccgcatcgccctggtcgaagcctattccaaggcgcaaggcatgtggcgcgaggccggctccgccgacccggtcttcaccgacctgctcgaactcgagctgagcagcgtcgtaccgtcgatggccggccccaagcggcccgaaggccgcgtcgcgctggaaggcattccggccggcttcgccaaggcgatggacaccgaatacaagaaggcggcggagatttccaagcgctacgccgtcgaaggcaccgaccatgatctcggccatggcgacgtcgtcatcgccgccatcacgtcgtgcaccaacacctccaacccgagcgtgctgatcggcgccggccttctggcccgcaacgccaaccgcctcggcctcaagcagaagccgtgggtgaagacctcgctcgcccccggcagccaggtggtcgccgaatatctggagaagtcaggcctgcagaaggagctcgaccagatcggcttcaacctggtcggcttcggctgcaccacctgcatcggcaattccggcccgctgccggcgccgatctccaagaccatcaacgataaaggtttgattgctgccgcggtcttgtccggcaaccgcaacttcgaaggccgcgtctcgcccgacgtgcaggccaactacctggcgtcaccgccgctggtcgtggcgcatgcgctggccggcaccgtcaccaaggacctcacgaccgagccgctcggcgaggacaagaacggcaacccggtctacctcaaggacatctggccgagctcggccgagatccaggaattcatcgagaagaacgtcacccgcgagctgttcgcccgcaaatatgccgacgtcttcaagggcgacgagtactggcagaacgtcaaggcgcctgaaggccagacctacgcctgggacgacaactcgacctatgtgcagaacccgccctatttcgccggaatgaccgccggtttcggcaagatcggcgacatcaagggcgcccgcgtgctcggcctgttcggcgacaagatcaccaccgaccacatctcgccggcgggttcgatcaaggccgcctcgccggccggcaagtacctcaccgaccatggcgtcggcgtcgccgacttcaaccagtacggcacgcggcgcggcaatcatgaggtgatgatgcgcggcaccttcgccaacatccgcatccgcaaccacatgctgggcgagaacggccgcgagggcggctacaccatccactacccgtcgaaggaagaggaatcgatctacgacgcggcgatggagtacaagaaggaaggcgtgccgctggtgatcttcgccggcgtcgaatacggcaacggctcgtcgcgcgactgggcggccaagggaacgaatctccttggtgtccgcgccgtcatcgcccggtccttcgagcgcatccatcgctcgaacctggtcggcatgggcgtcatccccttcgtcttcgaggaaggcacatcctgggcttcgctcaacctcaagggcgacgaactggtcgagatcgacggcctgagcaccatcaagccgcgccagacgatgaccgccaagatcacctatggcgacggcacggtgaagaacgtgccgatcatctgccgcatcgatacgctggacgagctcgactacttcaagaacggcggcatcctgcagtacgtgctgcgcgatctggctgcgtag

SEQ ID NO: 35751 - DNA, 1224 bp, Mesorhizobium loti
atgtccaagaccaaagacgtcaagaaagtcgtgctcgcctattccggcggcctcgacacatccatcatcctgaaatggctgcagaccgaactcggcgccgaagtcgtcaccttcaccgccgatctcggccagggtggcgagttggagccggcacgcaagaaggccgagatgatgggcatcaaggacatccgcatcgtcgatgtgcgggaggaattcgtcgccgacttcgtcttcccgatgttccgtgccaacaccgtctatgaaggcacctatctgctcggcacctcgatcgcgcggccgctgatctccaagcaccttgtcgacatcgccagggagaccggcgccgatgcgatcgcccatggcgccaccggcaagggcaacgaccaggtccgcttcgagctgtcggcctatgcgctgaaccccgatatcaaagtcatcgcgccctggcgcgactggtcgttcaagtcgcgcaccgacctgatcaacttcgccgagcagcaccagatcccggtggccaaggacaaaaggggcgaggcgccgttctcggtcgacgccaacctgctgcactcctcttccgagggcaaggtgctggaagatccgtggagcgagccgccggaattcgtccaccagcgcacggtctcgccgatggacgcgccggacaaggtaaccgagatcgagatcgagttcctgaagggcgacccgatcgcgctcaacggcaagaagctgtcgccggcgaccatgctggccgccctcaacgatcttggccgcgacaacggcatcggccggctcgacctggtcgagaaccgtttcgtcggcatgaaatcgcgcggcgtctacgagacgccaggcggcgccatcctgatcgtggcccaccgcgccatcgaatcgatcacgctcgaccgcggcgccgcgcacctcaaggacgagttcatgccgcgctacgccgagctcatctacaacggcttctggttctcgcccgagcgcctgatgctgcaggcgatgatcgacaagagccaggaagacgtcgaaggcacggtacggttgaagctctacaagggcaatgtcatggtcaccggccgcaagtcgaagaagacgctctattccgacgcgctggtcaccttcgaggacgatcgcggcgcctacgaccagaaggacgccgccggcttcatccgcctcaatgcgctgaggctgcgcacgctggctgcgcgcaaccgcaagggctga

SEQ ID NO: 35752 - DNA, 1035 bp, Mesorhizobium loti
atgagtttcaaggttgcagtcgtcggcgccacgggcaatgtgggccgggaaatgctcaacatactggaagagcgcggctttccggtaagcgaagtggtggcgctcgcgtcgcggcgcagccagggcacggaagtgtcgttcggcgaccgcacgctgaaggtcaaggcgctcgaccagtatgatttttccgacaccgacatctgcgtcatgtcggccggcggcaatgtctccaaggaatggtcgccgaagatcggcaagcagggctgcgtcgtcatcgataattcgtcggccttccgctacgaccaggacgtgccgctgatcgtgccggaagtgaatccggacgcgatctcgctgttcacgcgcaagaacatcatcgccaacccgaactgctcgacggcgcagctggtcgtggcgctgaagccgctgcatgatttcgccaccatcaagcgcgtcgtcgtcgccacctaccagtcggtgtcgggcgccggcaaggaaggcatggacgagctcttcacgcagacccgtgccgtgttcgtcgccgaccaggtcgacgtcaagaagttcaccaagcgcatcgccttcaacgtcattccgcatatcgacgtcttcctcgacgacggcttcaccaaggaagagtggaagatggtcgccgagaccaagaagatgctcgaccccaagatcaagctgacggcgacctgcgtgcgcgtgccggtgttcatcggccattcggaagccgtcaacatcgagttcgagaagccgatcaccgccgacgaggcgcgcgacatcctgcgtgacgcgccgggctgccaggtcttggacaagcgcgaggacggcggctacatcacgccgctggaatcggccggcgaggacgccaccttcatctcgcgcatccgcgaggattcgaccgtcgacaacggcctgtcgatgtgggtcgtctccgacaatctgcgcaagggcgcggcgctcaacgcggtccagatcgccgagcttctggtcgagcgcggcctgatccagccgaagaagaaggcggcctga

SEQ ID NO: 35753 - DNA, 1863 bp, Mesorhizobium loti
atgtccaactttgtaggtatcgtcccggcgctggcacaggcgctggaaaaacgcggctattccgaactgacaccggtgcagaaggcggtgcttgaacttgggtccgccgatgcgctggtgtcggcgcagaccggctccggcaagaccgtggccttcggccttgccatggcgccgacgcttctcgacggcgccgagcgctttggcgcggccatggcgccactggcattggcggtggcgccgacgcgcgaactggcgctgcaggtgacgcgtgaactggaatggctttacgagccgaccggcgccacggtggcgtcctgcgtcggcggcatggacatgcgcaccgagcggcgcgcgctggagcgcggcgcccatatcgtcgtcggcacgcccggccgtttgcgcgaccacatcacgcgcaactcgctcgacatgtcggcgctgaaggcggtggtgctcgacgaggccgacgagatgctcgatctcggttttcgcgaggacctcgaattcatcctcgatgccgcgccggccgagcgccgcacgctgatgttctcggctaccgtgccgcgttcgatcgcaacgctggcgcaaggctatcagcgcgatgccgtgcgcatctccgccgccggcgaggaaaagcagcatctcgacatcgaataccgggcgctcaacgtcgcccaggccgatcgcgagaacgccatcatcaacgtgctgcgtttctatgaggccaagaacgcgctggtgttctgcaacacgcgtgccgccgtcaatcatctgaccgcgcgcttcaacaaccgcaatttttcggtcgtggcgctttcgggcgagctcagccagaacgagcgcagccacgcgctgcaggcgatgcgcgacggccgcgccaaggtatgcatcgcaacggatgtcgcggcgcgcggcatcgacttgcccaacctcgaactggtcatccacgccgacctgccgaccaatcccgaaacgctgctgcaccgcagcggccgcaccggccgcgccgggcgcaagggcgtcagcgcgctgatcgtgccaggcagtgcccgcaggcgcaccgagcggctgttgcagaacgccggcctcaaggcgacctgggcaagcccgccctcggccgacgacgtgatccgccgcgacgacgagcgcatcctggccgatccggccttcgacgagccggtgaaggacgatgagcgcgctttcatcgacgcgcttctcgccaagcatggcgccgaacaggtggccgccgccttcgtgcgccagtgccgcgccagccgctcggcgcccgaggatctgatagacgtcgctcccttcacgccttcacgcgaaaggccggcgggcgaaaaattcgcgcagcgcgacgaggcgccgagccgccgcgacgatttcggcgccagcgtctggttctcgctgtcggtcgggcggaggcagaatgcagaaccgcgctggctgatcccgatgctgtgccgcaccggcagcatctccaagcgcgagatcggcgccatcaagatgcagccggaagaaaccttcgtgcagatcgccgcggactgggccgatcgctttcttgccgccatcgggcccgaccgcaaactgcagggcaatatcctggtgaagcggctcgacggcacgccggacctgtcgcgggccggctatcaggcgccgagccccgacaagaagccgcatcgcggcaaggcgccattcgacccgaacgcgccgaagcgcaaattcgagaagcgcacgccggcttcagccgagcagcgcccagcccatgaggcaaagccgtgggcgaaaaagccgggcaagccgaaattcgacaatgccggcccgccgaagcacaagaagccgaagaagcggccttcgtag

SEQ ID NO: 35754 - DNA, 1395 bp, Mesorhizobium loti
atgaaagagatctcctgcaagctgctcgtcatcggcgccggcccgggcggttacatctgcgccatccgtgccggccagctcggcgtcgacacggtcatcgtcgaggccggtaagcccggcggcacctgcctcaatgtcggctgcatcccgtccaaggcgctgatccatgcggcggaagagttcgagaaggtcgcccacatggccggcggcaagagcccgctcggcatctcggtatcggcaccggtgctcgatcttggcaaaaccatcgcctggaaggacggcattgtcagccggctcaacagcggcgtcgccgggctgctgaagaaggccggggtgaagaccgtgcatggctgggcgatgttccgcgacggcaagaccgtcgaagtcgagaccgagacgggaagccaggtgatccgggccgagacgatcgtcatcgccaccggttcggcgccggtcgaactgccgtttctgccctttggcgggcctgtgatatcgtcgacggaagcgctggccttgagcgtggtgccgaagaagcttgcggttgtgggcggcggctatatcgggctggagcttggcatggccttcgccaagatgggcgctgaagtgaccttggtcgaggccttgccgcgcgtgctggcacagtatgacgccgagctgacccggcccgtggtcaagcggcttgcggcgcttggcgtcgaagtcatgaccgaggccaaggccaaggggctgtcgaccaagggcgacgcgctgctggtcgaaacagcggacggcaagaataccaaggtttccgccgacaagatcctggtgacggtcggccgcaagccggtgaccgaaggctggggcctcgaccagatcgacctcgacatgtcaggcaaattcatccgcatcgacgaccagtgccgcacctcgatgcgcggcatcttcgccatcggcgacgtcaccggcgagccgatgctggcgcatcgggcgatggcgcaaggcgaaatggtcgcggagatcgtcgccggccacaagcgcaactgggacaagcgcgcaatccccgccgtctgcttcactgatccggagctggtgacggttgggctgtcgcccgaggaagccaaggcccagggcgagatcaagatcgggctgttcccgttcgccgccaacggacgggcgatgacgaagctcggcgaggatggtttcgtccgcgtcgtggcgcgggccgacaaccatctggtgctcggcatccaggcggtcgggcagggcgtgtcggaactgtcgacggcgttcggcctggcgctggagatgggggcgcggctggaggacatcgccggcaccatccatgcgcacccgacgcaaggcgaggggttccaggaagcggcgctgaaggcgctcgggcacgcgctgcatatttag

SEQ ID NO: 35755 - DNA, 1317 bp, Mesorhizobium loti
atgggcgaacacatcatcaagcttcccgatgtcggcgaaggcgtcgctgaggccgaactcgtcgaatggcacgtcaaggtcggcgacatggtgcgcgaggacacggtgctcgccgccgtcatgaccgacaaggcgacggtcgagatcccgtcgcccgtcgatggcgagatcctgtggctgggcgccgagatcggcgacacggtggcgatcggctcccctatcgtgcggctgaaagtggcgggagagggcaatgtaaagccgaaaggcgatgccaaggccgaggcggtggccgccgaaccgccggccaagctcccgacgccgaagcccgaaaccgccgggccggtcgcgaaggcctcgccaaaggccggcgccccggaggcgaaacccgctccggccgttgcgaaaagcactgggcagaggtccatctccggcgcgccgcgcccggagggtgaaaggccgttggcgtcgccggccgtgcggctgcgggcgaaggaggccggcatcgatctccggcaggtcgcgggaagcggcccggccgggcgcatcggccatgaggatatcgaggcgttcctggcgcgcggcccgcaggtcgccaagacgtccggcctaacccgcaacgatgcggtcgaggacatcaaggtggtgggtttgcggcgcaagatcgccgagaagatgacgctgtccaaatcgcgcatcccgcacatcacctatgtcgaggagatcgacgtcacggcactcgaggagttgcgcgccgcgctcaacaaggagaagcgggcagacaggccgaagctgacattgttgccgttcctgatgcgggcgatggtcaaggcgatcgcggagcagccccagctcaattcgctgttcgacgacgaggccggcatcatccaccagcatggcggcatccatatcggcatcgccgcgcagacgccgtccgggcttgtggtgcctgtcgtcaagcatgccgaggcgcgcgacatctgggattgcggcgccgaggtcaacaggctggccgaggcggccaagtccggcacggcgacgcgcgacgagctgtccggctcgaccatcaccatcacctcgctcggcgccatgggcggcattgcgacgacgccggtcatcaaccatccggaagtggcgatcatcggcgtcaacaagatgatggtgcggccggtgtgggacggcacccagttcatcccgcgcaagatgatgaacctgtcgtccagcttcgaccaccgggtgatcgacggctgggatgccgcggtgttcgtgcaacggatcaaggcgctgctggaaacgccggcgctgatctttgtggattga

SEQ ID NO: 35756 - DNA, 1014 bp, Mesorhizobium loti
atgccgagacggaccatgatcgaggccattcgtgacgccatggatgtgtcgatgggacgtgacgacaaggtcgtcgtgttcggcgaggatgtcggcttcttcggcggcgtcttccgctgcacgcagggcctgcaggccaaatacggcaagagccgctgcttcgacgcgccgatcaacgaatccggcattgtcggctcggccatcggcatggccgcctacgggctgaagccctgcgtggaaattcagtttgccgactacatgtatccggcctacgaccagctgacccaggaggcggctagactgcgctaccgttcgaacggcgatttcacctgcccgatcgtggttcgcatgccgaccggcggcggcattttcggcggccagacgcacagccagtccccggaagccttgttcacccacgtctccggcttgaagactgttgtgccctccaacccgcatgatgccaaggggctgctgatcgcggcgatcgaggatcccgatccggtgatcttcctcgagccgaagcggctctacaacggccccttcgacggccatcacgaccggccggtgacgccctggtcgaagcatgagctgggtgaggttgccgacggtcactacaccgtgccgctcggcaaggcggcgatccgccgagccggctcggcggtcaccgtgctcgcctacggcaccatggtctatgtcgcgcaggccgcggccgaggagaccggcatcgatgccgagatcatcgatctgagaacgctcttgccgctcgacctcgacgccatcgtcgcctcggtcaagaagaccgggcgctgcgtcatcgtgcatgaggcgacgctgacctcgggcttcggcgccgagctgtcggcgctggtgcaggaaaactgcttctaccatctggaggcgccggtggcgcgggtcgccggctgggacacgccctatccgcacgcgcaggaatgggattatttccccggtcccgcccgggtcggccgcgcgctcatcgaaacattggaagcctaa

SEQ ID NO: 35757 - DNA, 1233 bp, Mesorhizobium loti
atggccgatgctggcatgttgcgtttccatgttccggaaccggaagtgcggccgggcggcacgcctgatttttccaacgtgaccatcgccgcggccggttcggtgccgcgccccgacatcgatgtcgatccgcgcaccatccgcgacatggccttttccatcatccgcgtgctgaaccgcaatggcgaagccgtcggcccgtgggccgggctgctctccaatgaggagctgctcgaaggcctgcgccatatgatgacgctcaggaccttcgacgcgcgcatgcagatggcgcagcgccagggcaagacctccttctacatgcagcatctcggcgaagaggcggtgagctgcgccttccgcaaggcactcgagccgggcgacatgaatttcccgacctatcggcaggccggcctgctcatcgccgacggctatccgatggtcacgatgatgaaccagatctattccaacgaggccgacccgctgaagggccggcagctgccgatcatgtattcgtcgaaggagcacggcttcttctcgatctccggcaatctggcgacgcagtacatccaggcggtcggctgggcgatggcctcggcgatctcgaacgattcgaagatcgcggcggcctggatcggcgacggctcgacggcggaatccgattttcactcggcgctggtgttcgcttccacctacaaggcgccggtcgtgctcaatgtcgtcaacaaccagtgggcgatctcgacctttcaaggcatagcgcgcggcggctccggcaccttcgcggcgcgcggtctcggcttcggcatcccgtcgctgcgtgtcgacggcaatgactatctcgccgtgcatgcggtggccaaatgggcggccgagcgggcgcggaagaatctcgggcccacgctggtcgaatacgtcacctaccgcgccggcgcccattccagttcggacgatccttcggcctaccgaccgaagaccgaatccgacgcctggccactcggcgatccggtcgtgcggctgaagaaccatctgatcgggctcggggtctggtcggacgaacgccacgcgcaggccgaggccgaaatcctcgacacggtgatcgcggcgcagaaggaggcggaaagccacggcacgctgcatgccggcggcaagccgtcgacccgcgacatgttcgagggcctctatgccgagatgccgccgcatctcaggcgccagcgccagcaggcgggagtctga

SEQ ID NO: 35758 - DNA, 1032 bp, Mesorhizobium loti
atgcccaaaagccggatcatgctggacgtcctgaagggcgaggctcattttccgcctccgctctggatgatgcgtcaggctgggcgctatctgccggaatatcgtgaaacacgcaggcgcgccgggtcgtttctcgacctctgctacgatcccgaccttgcggtggaagtgacgctgcagccgatcgagcgcttcggcttcgacgcttcgatcctgttctccgacatccttgtcgttccgcatgcgcttggccgcgatgtgcgcttcgaagaggggcgaggaccgttgctgacgccgatctccgtggccgagatcatggctctggaaagcgatgtgtttcacgtgaatctcgaaccggtctacgagacggttcgccggctgcgggcaaaactgcctgacgagaccacgctgatcggcttctgcggcgcgccgtggacggtggcgacctatatgatcgccggccatggaacacctgaccaggcgccggcgcggctgttcgcctatcgcgagccggcggcttttcaacatctcctgaaggtgctggccgatcattcggctgcctatctgatccgccagatcgaagccggcgcggatgtggtgcagattttcgattcatggtccggcgtgctcgacgatgcgtcgttcgaccagttctgcgtttggccggtggcggagatcgtccggcaggtacaggctgtccatcccgatgtgccgatcatcggttttcccaagggtgccggcgcgcgctaccggacctatcgccagaagactggcgtgacggggctggggatcgactggacggtgccgctggcggcggcgaaggatctgcagcgctcgggtgcggtccagggcaatctcgatcccttgcgcctcgtagccggcggcaaggcgctgtcagatggcgtcgaggcgatcctgaaagcgctgggagacgggccgctgatcttcaatctcggccacggcatcacgccggagacaccgatcgcgcatgtcgaggcgatggtgaagcaggtgaggagcgcggcacgctga

SEQ ID NO: 35759 - DNA, 843 bp, Mesorhizobium loti
atggttgaggcaacgaagaaggccttcgtcaccgggcatccgatcaagcattcgcgctcgccgaagatccacggccactggctggcccagcacggcatcgacggcagctacgaggcgatcgacgtggcgccgcaggattttgccgaattcatcgcggcattgcaggcaaacgggtttcgcggcggcaatgtcaccattccgcacaaggaagccgccttcgctgttgcccagcgccgcgaccaggcggctgaagagatcggcgccgtcaacacgctgtggttcgaggacggcgtcctgcggggcggcaacaccgatggtcacggctttgccgccaatctcgatgactgcgcgccgggctgggcgaacaccggccccgcggtcgtgctcggcgccggcggcgcgtcgcgcgccgtcatccaggcgctgaagcaacgcggtttttccgacatccgcatcgtcaaccgcacgctcgcccgggcgcaggaattgcgggatcgtttcggcgccggcgtttcggcgcatggcacggcggcgaccgacgaattgctggccgacgccggcctgctggtcaacaccacggcacttggcatggtcggcaatgaaggcctcgccgccgatccggccttgctgccggaccatgccatcgtcaccgaccttgtctatgtgccgctcgaaacacccttgctcgccgccgcgcgcgccagggggctgaagacggtcgacggcctcggcatgctgctcaaccaggccgtgcccggcttcgaacattggttcggcgtcaggcctcaggtcacggctgagctgcgcgcactcatcgttgccgatctggtgccgaagccatga

SEQ ID NO: 35760 - DNA, 1185 bp, Mesorhizobium loti
atgaccagccacacaccaccaccatcgggcaagaatcgcctggccttctcgacacgcaccatccatggcggccagagccacgatccgctgaccggcgcggtgatggtgccgatctatgcgacctcgacctatggccagcagtcgccgggcgtgcacaaggggtttgagtacgcccgcagccagaacccgacgcgcttcgccttcgagcgcgcggtggccgatctcgaaagcggaacggcggctttcgccttcgcctccggcctggcggcgatctcgacggtgctggagttgctcgattccggcgcgcatatcgtcgccaccgacgatatctatggcgggtcgttccggctgatggagcgggtgcgcaagcgctcggcgggcctgcaggtctcgttcgtcgacttcaccgaccttgcggcggtcgaagccgcgatccggccggagacgaagctgctctgggtcgagacgccgaccaacccgctgctgcgcatcgtcgacctcgaaggcgtcgccgcgctcgccaagcgcaagggcgtcctcaccgtcgccgacaacacgttctgcagcccctatatccagcggccgctggaactcggcatcgatatcgtcgtgcactcgacaaccaaatatctcaacggccattccgacatggtcggcggcgtggctgtggtaggcgacaacaaggaattggcgacccagctgaaattcctgcagaacgccatcggcgccatatcgggcccgttcgacagtttcctggcgctgcgcggcctgaagacgctggcgctccgcatggagcggcattccgacaacgggctgaaaatcgcgcagtggctggaggcccgcaaggacgtgcgccgcgtcctctatcccggcctcgccagccatccgcagcattccatcgccgtccagcagatgcacgccttcggcggcatgatcacggccgtgctcgaccgcgatctcgccggcacaaaacgtttcctcgaacgcacgcaattgttcacgctggccgaaagcctcggcggggtggagagcctgatcgagcatccggcgctgatgacgcatgggtctattccggccgagaaacggtcggagatcggcatttcggattcgctggtaaggctgtcggcggggatcgaggatggcgatgatctgatcgcggatctggagcaggcgctggggggatga

SEQ ID NO: 35761 - DNA, 927 bp, Mesorhizobium loti
atgccctccattttgtccatttccggggtctccaagacctacgccaccggcttcaccgcgctcaaggaagtcaatctcgacatccagcgcggcgagattttcgcgctgctcgggccgaacggcgccggcaagacgacgctgatctcgatcgtctgcggcatcgtcaaccgctcgaccggcaccgtcaccgtggacggccacgacatcggcaaggattaccgcgccgcgcgcagcctgatcggcctggtgccgcaggaactgaccatcgacgctttcgagagcgtctgggcgacggtcaactacagccgcggcctgttcggcaagccgcctaatcacggtttcgtcgagaaggtgctgcgcgatctgtcgctgtgggacaagaaggacgccaaggcgatcacgctgtcgggcggcatgaagcgcaggctgatgatcgccaaggcgctgtcgcatgagccgcgcatcctgttcctcgacgagccgaccgccggcgtcgatgtcgagctgcgccaggacatgtgggagatggtgcgccggctgcgcgaggatggcgtcaccatcatcctcaccacccactatatcgaggaggcggaagcgatggccgaccgcgtcggcgtcatcaaccgcggcgagatcatcctggtcgagaacaaggccgagctgatgcacaagctcggccgcaagcggctggtgctggagctgcgcaatccgctgacggcgattccggaaaccatctcgcgctacgcgttggagctgtcgccggatggcgggcaattgacctacacctatgacaaccaggccgagcggccgggcgtcgcctcgctgatccgcgatctcgaggcagccggcatccagttccgcgacatcgacacgcaaaacagctcgctcgaggagatcttcgtcaatctggtgaggagagagccatga

SEQ ID NO: 35762 - DNA, 588 bp, Mesorhizobium loti
atggacgagaaggcggccccgggcagcgagacggcgatcttcgccggcggctgcttctggggcgtgcagggcgtgttccagcacgtcaagggcgtcagcaaggccgtctccggctatactggcggcgccaaggatgacgccgtctacgagactgtcggcaccggccgcaccggccacgccgaatccgtcgagatcacctacgatccgtccaaggtgacctacggccagctgctgcaggtctatttctcggtcgcccacaatccgacgcagctgaatttccagggaccggattccggcacccagtaccgctcgacgatcttcgccgagaacgacacgcaaaagcagatcgcgcagagctatatcgaccagcttgacaaggccaagctctacccggcgccgatcgttaccacgatcgagaccggcaagaccttctacccggccgagaactaccaccaggactttctgacgctgaacccgacctatccctacatcgtctataacgacctgcccaaggtggcgaacctgaagcagctgttcccggcgctgtacagcgagaagccggtgctggtgctgtcggcgagcaattga

SEQ ID NO: 35763 - DNA, 627 bp, Mesorhizobium loti
atgggtcgagcgcataccgtgagccgtggtgaggatcatccgccgatcgctcgttcggagctgcctgatgatacggccgctctcgcccgttacctcatcggcaagctggtggtgcgcgacttgcccgaaggcatggtcagcggccgcatcgtcgagaccgaggcctatgtcgtcggcgatgccgccgggcatggtttcagggggatgaccccgcgcaaccgttcgctgttcctcgagcgcggccacgcctatgtctatctcgcctatggcgtctccatgatgctgaatgtctcaagcgaggtaccggggatcggcaccggcgtgctgatccgggcgctcgagccgctcgacggtattgaaatcatgcggcgcaatcgcggcgtcgagcgcctgcgcgacctggcgcgcgggccgggaaggctggcggcggcgctgcggatcgaccggtcgctcgacgggctcgacctctgccggaaaggccctctatggctggcgaaggataaccaaaaacccggcgagatcgggcagagcacaaggatcggcatcaccaaagatgccgcccggctgctgcggttctatgtcaggggcagcctgttcgtcagcggtccgagatcgcttcaggaataa

SEQ ID NO: 35764 - DNA, 921 bp, Mesorhizobium loti
atgaacgccatcgacgttcacggcctggtcaagcggttcggcgacaagaccgtcgtcgaccaagtgacgatgtcggtcgccgaaggcgagatcgtcggtttcctcggccccaacggttcgggcaagaccaccaccatccgcatcatgtgcggcctgctgacgccggacgaaggcgaaggcaccgtgctggggttcaacatccgcaccgactcgctcagcatcaagcgcgaagtcggctacatgacgcagaaattctcgttctacgaggatctgaccatcggcgagaatctcgaattcgtggcgcggctctaccagctgagaccggtcgaggagtatgtcgccaggacactggaggaactcggcctcaccacgcgccgcgaccagctggccggcacgctgtccggcggctggaaacagcggctggcgctcgccgcgtgcatcatgcacaagccgaaattgctgctgctcgacgagccgacggccggcgtcgacccgaaggcgcggcgcgaattctgggacgagatccatcgcctcgccagcggcgggctgaccgtcctggtctcgacccactacatggacgaagccgagcgctgccaccgcatcagctacatctcctacggcaagatgctggccaccggcaccgttgaggaggtggtgaaaaacgccggcctgacgacgttcgtggtgcagggtccgcggctcgccaaggtggccgaagcgctgcagggccgccccggcgtcgaccaggtggcgccgttcggcgccacgctgcatgtcgtcggttccgacagcaagaagctcgaagcagcgcttgccgatatcgagaaggagcataagggcgtgacggtggcgccgggcgaaaccagcctggaggatgtcttcatccagttcatgtcggggtcgaaggacaatatggcatga

SEQ ID NO: 35765 - DNA, 627 bp, Mesorhizobium loti
atgtacaagctctatacccgtcccggcagcggcggcttcgtcgtcgaggcggcgctggcgctggccaacgcaccattccagcagatcgacgtgccgaaatccgaccgccccgatccggccttcctcgacatcagcccgctgaaccaggtgccagtgctgaccttgccggacggcagctcgatgaccgaatcggccgcgatctgcatcctgctcgccgagcgccatcccgatgcaggcctcgcgccagcggtcaatgcgcctgcccgcgccgatttcctgcgctggatggccttcatgtcgtcggtgctctacccggcggtgctgcggttctactacgcccatcgctacacggccgacgccgacggcacgaaagccgtcaagcaggcggcaatcgccgagatggaccgtggcttcgccgtcctcgatgccgcactgaagggtcgtgactggctggttggtgaccagatgtcgctggccgacatctatctcgtcatgcttgtggcctggcatcccgacatcggcacggcgcgggcggcatggcctgatattgaacgtctctgggccaggctgcgcgaccatccgctgctgaagacgctcaacacgtcacacgagatgtggccgacctga

SEQ ID NO: 35766 - DNA, 693 bp, Mesorhizobium loti
atgctgacgcttttccaccatcccatgttcgccacctgccgcttcgtccgccttgctttcggcgagtatggcgaggagctggcgctgatcgaggaaaagccgtggacgcggcgcaaggagtttttggcgctgaacccggccggcacgctgccgatcctgctcgccgaaggcgacgtgccgatcgtcggcgcgacggttatctcggagtatctcgacgagacccgcggtgtgctcaagcgcgacaagcggctgttcgccgaggacccgatgcagcgcgccgaaatccgccggctgatcgactggtacctcaacaaggccgaaagcgaagtcacccgccatctggtgcgtgaacgcgtgctgaagccgatcatgcccgaaaccgccggcggtggctcacccgattcgggcgcgatccgtgccgcgcgcgccaacatccgccagcatatgaaatacaccaactggctggccggcacccgccattggctggccggcggcagggtcacctatgccgatctcgccgccgccgcgacgctgtcggtgctcgactatctcggcgagatcgactggcgcgaacacgccgcggcgcgcgaatggtatacgcgggtgaagtcgcggccctccttccggccgctcttgaccgaccgcgtgcgcggcctgtcgccggtgtcgcattatgcggacctcgacttctga

SEQ ID NO: 35767 - DNA, 1902 bp, Mesorhizobium loti
ttgcagcccggccccaggcggaaaacccacgaagctcccgatttgacacttcaagctccaaacaagcagaaagccagcgttggcgaagtcaacgcggtgctgcgccgcattctctccgaaaacggccgcgatcatcgctggtcctacgtcgtcgccatctcctgcatgctgctggtgtcgggcacgaccgccttcacggcctggatcatgagtccgatcgtcaaccagatcttctacgaacggcgcggcgacctggtggtgtggatttgcgccgggatcatgggggccttcctggtgcgcggtttcgccggctacggccaggcggtggcgctggccacgatcggcaacaatctggtggcgcgctaccagaaacgcatcttcgaccatctgatgaagctcggcgtcggcttcttcaacgatacgcgctccggccggctggcggcgcaggtcaacgagaatgtcggcggcatccgcgacctcttgtcgatcacgctgacatccatcacccgcgacgcggtgaccctggtcggccttgtcggcatcatgatctaccaggatccggttttatcgctgagttcgctgctgattggaccgccgctgatctgggcggttgtctacctgacgcgtcgggtgcggcgcatcacgcgggaatccgtgctgatcaattctcgcctcatcggcgccgtccaggaggccacgcaaggcatcgccatcgtcaaggccttcaccatggaggaccagttggcgagccgcatcggcgccttggccgacacggcggaacagcgctctaacaagatcgcccgcgtctcggagcggctggcgccgatttccgacatgctggccggcctcgccgtcacctccgtcatcgcctattccggctatcgggcgctggttctcggccagccgccgggtgcggtgttttcgttcatcaccgcgctgatcctggcttacgatccggcccggcgcctggcgcgcatgcaggtcggcatggagcgggcgctggtcaacgcccgcatgatctacgaactgctcgacctcaagccgcaacagggcgacgcgccggatgccgtcgaggcacaattcacgtcgggcgaagtgcgcttccacaacgtgtccttccgctatgtcgaggagacgccggtgctgcaggagctgagcttcgtcgccgccgccggcaagatgaccgctatcgtcggcgcctcgggcgccggcaagaccacgctggtggcgctgctgcagcgcttctacgacgtcgagtccggcaccatcgaggtcgacggccaggacatttccaaggtgacgaagcagtcgctgcgcggctcgatcgcctatgtctcgcaatcgccctatctgttcgaaggcacgatccgcgacaacatccgctatggccgcatgtcggccaccgacgccgagatcgagcgtgcggcgcaacaggcggccgccgacgggttcatccgccagcagccgcagggctacgacacgccggtcggcgagaacggcgccacgctgtccggcggccagcgccagcgcgtctcgatcgcccgtgccatcgtgcgccaggcgccgatcctgcttctcgacgaggcgacctcggcactcgacaacgaggcggaggcccgtgtccaggaagcgcttacccatgtcatggaagggcgcacgacgatcgtcatcgcgcatcggctgtcgacggtggtcaatgccgaccacatcgtcgtcatggaacagggccgggtggtcgaggaaggcacgcatgccgcgctgatggccgacccgcacagtgtctatgcacggttccaccgggtgcagggcaagaaggggctggggcttgtcgacgacagcaagccgatccaaactccggtccgggccacgcgtgcgaaaaagacggcggtgaggagcacatga

SEQ ID NO: 35768 - DNA, 822 bp, Mesorhizobium loti
atgagcgaagcaggcgatatgggccttgtggtggtgggggcagccggccgcatgggccagacgctgatccgcgccatccacaccattccgggcgcccgtgtcatcggcgcggtcgaacgcgcggattcgccgcatctgggcaaggatgccggcgagctcgcaggcatcggcatcatcaatgtgccgatcggtgacgatccgctgccggtcttcgccaaggccgacggcgtgctcgacttcaccacgccggcctcgtcggtcgaattcgccggctacgcggcgcaggcccgcatcgtccatgtcatcggcacgaccggctgttcggccgacgacaatgccaggatcgccgcggcggcgcgccacgccaccatcgtcaaatcaggcaatatgagcctcggcgtcaatctgcttgcggtgctggtcgaacaggcggcgcgcgcgctcgacgccgatgatttcgacatcgagattttggaaatgcaccacaagcacaaggtcgacgcgccgtcgggcacggcattgttgctgggtgaagccgccgccgccgggcgcggcattgcgctcgccggcaatgacgtgcgttcacgcgacggccataccggtgtgcgaaaaaccgggtcgatcggcttcgccacgctgcgcggcggctcggtcgtcggcgaccacagcgtcatccttgccggcactggcgagcgcatcacgctgtcccatcatgccgaggaccgcgccatcttcgcccgcggcgctgtcaaggcggctctgtgggcccgtggcaagaagccaggactctattcgatgcgggacgtgctcggcctgagctga

SEQ ID NO: 35769 - DNA, 621 bp, Mesorhizobium loti
atgtcgagaacccttgtgctcgtgcgccatggccagagcgaatggaatttgaaaaacctgttcaccggttggcgtgacgttgacctgaccgagcagggtcatgccgaggccaaggccgccgggcagaaactcaaggcgcgcggcctgaagttcgacatcgccttcacctcggcgctgagccgcgcgcaaaagacctgccagcatattctcgacgccgtcggccagagcgatctcaagaccatccgcgaccaggcactcaacgagcgcgactatggcgacctttccggcctcaacaaggacgacgcccgcaagaaatggggcgaggagcaggtgcatgtctggcgccgctcctacgacgtgtcgccgcccggcggcgaaagcctgaaggacaccggcgcccgcgtctggccttactacctgcacgacctgcagccgcacgtgctgcgcggcggcaccgtgctggtcgccgcccacggcaattcgctgcgcgcgctgatcatggcgctggacggcaagtcgggcgaggagatcgtcaagctggagctcggcaccggcgtgccggtcatctaccagctcaacgccgattcgaccgtggcgtcgaaggaagtgctggagggctga

SEQ ID NO: 35770 - DNA, 1554 bp, Mesorhizobium loti
atgccgaggagatggcgctgtcgcgctcgacgcccggcggccagttcccggcggcttgacgggagcccggtcatggacatcgcgcaggaaaccgtcggcaccgaggaaacgctcgaccccgccgactgggccgcagtgcaagccctgtcgcaccaggtcatcgacgatgccgtcgactatctcagcgacatcagggaccgcccggcctggcgcgagatgccggcggaggtgcgagaagccttcgcggcacctctgccgcgatcgccggtgccgctggccgccgtctatgacgaggtctcgcgcacggtgatgtcctatccgatgggcaacatccatccgcgattctgggcctggtatatggggtcgagcaacttcaccggcgcgctcggcgacttcctggcggcaatccagggttccaacctcggcggcggcaaccacgccgccgggctgatggacagccaggtggtcaactggtgcaagcagatgctgggctttccggcttccgcctccggcacgctggtcagcggcggctcgatggccaacgtgatcggcctgaccgtggcgcgcaacgccaaggccggcatcgacgtgcgcgagcacggcgtcgcggcgatcgaaaagccgctgcgcttctatggctcggaccagatccattcctgccaccgcaaggcaatggaagcacttggcctcggcaaccgggcgctgcggcgcatcccgacggatgccgacctgcgcatcgacataccggccttgcgcgcggcgatcgttgaggaccgcgaagccggtttcaagccggcctgcgtcatcggcaatgccggcacggtcaacaccggcgcgatcgacgatttgcgggcgcttgccaaactcgcgcatgaggaaggcctatggttccatgtcgatggctgcatcggcgcgctgatcgcgatcgcccccgacaatgcgcatcgcgttgccggcatcgaatgggcggattccgtcgcgctcgatccgcacaaatggctgcatgccccgttcgaggtcggctgcgccctggtcagggatgccgtcgcccaccgccggaccttcgcggtgacgccggaatatctggaatcgacgccgcgcggccttgcctccggcgaatggctgcacgattacggcctgcagacgtcgcgcggctttcgcgcgctgaaagtctggatggcgctgaaggaacatggtgtcgacaaattcggccgcctgatcgaccagaacatcgcgcaagcctcctatctcgccggggtggtcgaggccgagccgctgatggagctggcgacgtcgccgaccatcaacatcgtctgcttccgctaccagcccggcgtcaccggcgaggcgctgaaggtgctcaacaccgagatcatgctgcggctgcaggaacagggcatcgccgtcctttccgacactaccgtgcatggcgaacactggctgcgcgtggcgatcgccaaccaccgcacaaggcgcgaggacctcgaccttctggtcgaggaaacggtgcggttgggacgtgagatcgcagcagaaggctccccccggaaatag

SEQ ID NO: 35771 - DNA, 528 bp, Mesorhizobium loti
gtgaacatcctgattgtctatggaacgaccgaaggccagacggggaaaattgctgcacggacggcaactcatttacgcgagcgcgggcaccaagtcgagttgcgtgacagcgcagcgctcgcgtccgatttgaagctcggacacttcgacgcgttcgtcatcgccgcgtcggtccaccaggagcaccaccaggaaaccgtcacgaacttcgtatttgcgcatcacgaagccctgagcaccaagccttcggccctcatatccgtcagtttgtcggcggcgctgggagaccaaaagaaggatgctcaaaaatacgtggatcgcttcgtctccgtgacagattggcaaccatccatgaccctccttcttgggggtgctttgcggttcaacaagtacgattactttcaggagcagttcgtcaaattcgtcgtcatgaaaagcggcgatccgagccccgagcgcgatcacgaattcactgactggaacgcactcgctaacttcgctgatcgatttcttgagacggccggctag

SEQ ID NO: 35772 - DNA, 765 bp, Mesorhizobium loti
atgccatcggcggattttgccgacctcaagggcgcctcggtgctgatcaccggcggcggttccgggatcggcgcggcgctgaccgaggggtttgtgcgccagggtgccaatgtcgccttcatcgacatcgccgagggtccgagcacgctgcttgccgaccgcatcgagaaggaattcggccggcggccgctctacctcaagaccgatctgcgcgacatcgaggcgctgcgcgcctcggcggccagggcggcggaggcgcatggcgatgtcacggtgctgatcaacaatgccgcctgggacgagcgccacgccgtcgaggacgtgacggtggagttctgggacaacaaccaggcgatcaacctcaggccgcatttcttcaccgcgcaggcggtggcgccgggcatgaagcgggccggcggcggctcgatcatcaacttcacctcgacatcctacctcatcaaccatcccgacatgccggcctacaccgccgccaaggcgggcatcctcggcctcaccaaggggctcgccggcaagctcgggccggaccgcatccgcgtcaacgccgtcgcgcccggctgggtgatcaccgaacggcagcaggaacgctgggtgaccgaaggagcgctagcagcccatgtcgccaagcagtgcatcaaggaggtcatgcgcccggacgacatggtcggcacggtgctgttcctggcctcggatgcctcgcgcatgctgaccgcgcagatgctgatcgtcgacggaggttttctgtga

SEQ ID NO: 35773 - DNA, 873 bp, Mesorhizobium loti
atgagcgcggtttcgattttctccgatcacatctgccagctcggcgagggcccgagctacgatccggccagcgatgcgctgttctggttcgacatcgtcaacggccagcttctggaaaagccgctcacgggcgcgttgaaaatccacgagcttggccagatggccagcgccatcgccatcatcgacgaccagcgccagctgatcgccaccgagaccgggctttttgtccgcgacgtcgcgaccggcacgatgacgctgcatacgcccatcgaggccgataacccgctcacccgctccaacgattcgcgcgtccatccctgcggtgccttttgggtcggcacgatggcgaaggacgagagcaagggtgcgggctcgatctactggttctctaggggcgaattgcgccgcctgttttcggacatcaccgtgtcgaactcgatctgcttttccgaggacggggcgattgcctactacaccgacaccgcgaccggtctgttgatgcgcgtcggctgcgatccggtgacaggcctgccggttggcgaaccgaaagtgttcgtcgaccatcgctcgtcgaagggctatgtcgacggctccgtcgtcgaccgcgacggcgtgctgtggaatgccgtctggggcggcaaggcggtgaaggcctattcgcccgacggcacattgttgcgcgaaattcccatgccggtgacgcaggcctcctgcccggcctttgtcggcgccaaggccgaccggctggcggtgacctcggcctggaagggcaaggacgacaagcagcgcaagctcgacccgcaggcgggcatgaccttcctcatcgacatccccgtcaacggccggttcgaaccgcgcgtgctgatcgcctga

SEQ ID NO: 35774 - DNA, 1131 bp, Mesorhizobium loti
atgaaagctgatttctacgaaacgctgggcgtgcaaaagggcgccgacgagaaggagctcaagagcgctttccgcaagctcgccatgcagttccatcctgaccgcaatcccggcgatcattcctgcgagcacaagttcaaggaaatcaacgaagcctacgagacgctgaaggacccgcaaaagcgcgcggcctacgaccgtttcggccacgccgccttcgaacagggcggcatgaatggcggcgcgcaaggctttggtgccggcggcttcgccgacatcttcgaggatattttcggcgacatgatgggcgggcgccagcgccgctcgtcaggcggccgcgagcgcggcgccgacctgcgctacaacatggaaatctcgctggaagaggcctttgccggcaagaccgcgcaaatccgcgttccggcctcgatatcgtgcaccgaatgctccggcagcggcgccaaacccggcacccagccggtgacatgctcgatgtgccacggccacggcaaggtgcgggcgacgcaaggcttcttctcgatcgagcgcacctgcccgcaatgccagggccgcggccagacgatcaaggatccatgcccgaaatgcgccggccagggccgcgtcaccgaggaacgctcgctgtcggtcaacattccggccggcatcgaggacggcacccgcatccgccttgccaatgagggcgaggccggcctgcgcggcgggccttcgggcgacctctatattttcctggcggtgaagccgcatgaattcttccagcgcgatggtgccgacctctattgcaaggtgccgatctcgatgacgacggcggcccttggcggttccttcgaggtgacgacgctggacggcacccagaccaaggtgaaagtgcccgaaggcacgcagaacggccgccagttccgcctcaagggcaagggcatgccggtgctgcgccagcccaatgtcggcgacctctatatccagaccgctgtcgagacgccgcagaacctgtcgcgccgccagcgcgagttgctggaggagttcgaacagctctcctcgcaggacaattcgccccaatcgagcgggtttttcgcccgcatgaaggattttttcgagtctttcggcgagcgttga

SEQ ID NO: 35775 - DNA, 1917 bp, Mesorhizobium loti
atggcaaaagtaatcggtatcgatctcggcaccaccaattcctgcatcgccatcatggatggcaaggagcccaaggtaatcgagaatgcggaaggcgcgcgcacgacgccttccatcgtcgccatctcgggcgacggcgaacgtctggtcggccagccggccaagcgccaggcggtcaccaatcctgaaaacaccatcttcgcggtcaagcgcctgatcggccgccgttatgacgatccggtgacggaaaaggacaagaagcttgtcccctacaagatcgtcaagggcgacaatggcgatgcctgggtcgaggccggcggcaagaagcagtcgcccagccagatctcggccatgatcctgcagaagatgaaggaaacggcggaagcctatctcggcgagaaggtcgagaaggcggtcatcaccgttccggcctatttcaacgacgcccagcgccaggccaccaaggacgccggcaagatcgccggcctcgaagtgctgcgcatcatcaacgagcctacggctgccgcactcgcctacggcctcgacaagaaggatggcaagaccattgccgtctatgaccttggcggcggcacgttcgacatttcggtgctcgaaatcggcgacggcgtgttcgaggtgaagtcgaccaatggcgacaccttcctcggcggcgaggatttcgacatgcgcctggtcgaatatctggcggccgagttcaagaaggaacagggcatcgacctgaagaacgacaagcttgccttgcagcgcctcaaggaggcggctgaaaaggccaagatcgagctgtcgtccaccacgcagaccgaaatcaacctgcccttcatcaccgccgacgcgaccggcccgaagcacctgacgctgaagctgacgcgcgccaagttcgaaagcctggtcgaagacctcgtccagcgcaccatcgacccgtgcaaggcggcgctcaaggatgccgggctgaaggctggcgagatcgacgaagtggtcctggtcggcggcatgacccgcatgcccaagatccaggagatcgtgaagcagttcttcggcaaggagccgcacaagggcgtcaacccggatgaggtcgtcgctctcggcgccgccatccaggccggcgtgctgcagggcgacgtcaaggacgtgctgttgctcgacgtgacgccgctgtcgctcggcattgagacgctgggcggcgtgttcacccggctgatcgagcgcaacacgacgatcccgaccaagaagagccaggtgttctcgaccgccgaggattcgcagtcggccgtgaccatccgcgtcttccagggtgagcgtgaaatggccgccgacaacaaggcgctcggccagttcgacctggtcggcattccgccggcgccgcgcggcgtgccgcagatcgaggtcaccttcgacatcgacgccaacggcatcgtcaacgtttcggccaaggacaagggcaccggcaaggagcatcagatccgcatccaggcctcgggtggtctttcggacgccgacatcgagaagatggtcaaggacgccgaagccaatgccgagaccgacaagaagcggcgcgccgtggtcgaggcccgcaaccaggccgaggcgctggtgcattcgtccgagaagtcgctgaaggaatatggcgacaaggtctcggaagccgagcgcacggcgatttccgatgccatcgcggcgttgaagaccgccgccgagggcgacgacgcggccgacatcgaggccaagagccaggcgctcgccgaagcttcgatgaagctcggccaggccatgtacgaggcctcgcagaaggaagcggcggaagccgacgccaaggcggatgccgccaaggactccgacgtggtcgatgccgatttcgaggaaatcgacgaggacgacgacaagaagaagtcggcctga

SEQ ID NO: 35776 - DNA, 1515 bp, Mesorhizobium loti
atgagcaatcatctgttcgatgcgttccggtcccggatgccggcgcccgggcatctgttgatggaaaccgatgacgggcgctcgctgagctatggcgacatgctggcgcggtcggcacagttcgcgcacgcgctgctgcaattggatgtcgagcccggcgaccgggtggccgtgcaggtcgagaagagcccggaggcgctgctgctctatctcgcctgcgtgcgcgccggtgccgtcttcctgccgctcaacaccgcctacacgctgaccgaactcggctatttcttcggggatgcagcgccgcgcgtcatcgtctgcgatccggcaagggcggccgatatcgggcgcatggtcgagccatccggcgccgtcgtcgtcacgctcgaccgcaacggccggggatcgctggcggaccaggcctcgcgtctgccgtcggattttcacgatgtggcgcgcgggccggatgatctcgcggcaatcctctacacgtcgggaacgaccggccgctcgaaaggcgccatgctcagccacgagaacctggcctcgaatgcacgggtgctggtcgagcaatggcgcttcacatcaggcgacgtgctgatccacgcactgccgatctttcacacccatggcctgttcgtcgccaccaacgtcgtcctgatggcgggcgccgcgatgctgttcgagcagaaattcgatccggcccgcatcgtcgcgctgctgccgcgcggcaccgcgctgatgggcgtgccgaccttttatgtgcgcctgctgcagcaggatggactggaccggcaggcggcgaagactatccgcctgttcgtgtccggctccgcgccgctgctggccgacacgcacaaggcctggcgcgagcgcaccggccacgccatcctcgaacgctacggcatgaccgagaccaacatgaacacctcgaacccctatgagggcgaacggcgcgccggcacggtcggcttccccttgccgggtgtcgctttgcgcatcgccgatcccgacacgggcaagccgctggcccaaggcgaagtcggcatgatcgaggtcaagggtccgaacgttttcggcggctattggcgcatgccggaaaagaccaaggcggaattccgcgccgacggtttcttcatcaccggcgatctcggcatggtcgacaccgacggctatgtccatatcgtcggccgcggcaaggatctgatcatttcgggcggctacaacatctatccgaaggagctcgaaagtgagatcgacgcgcttgatggagtgagcgaaagcgccgtcatcggcgtcgcccatccggatttcggcgaaggcgtcaccgcggtcgtcgtgcgagcgccgggggcagcgatcaccggagccgaagtgcttggcgcaatcgccggacgcctggctaggtacaagcatccgaagcaggtgatcttcgtcgacgaattgccgcgcaacacgatgggcaaggtccagaagaatcttctgcgagacgcctacaaggatctctacacatcctag

SEQ ID NO: 35777 - DNA, 1035 bp, Mesorhizobium loti
atgatctccaacaccacccatatgcaacgcgagatcgaggagatcccgaaggccgtcgcccgcctgctcgacggctccggcgccgcgctcgccgaggccgggcgcggtatcaaggagcgcgacccgcatttcgttgtcaccgtggcgcgcggctcgtccgaccatgccgcgaccttcatgaaatatgccgtggagctgaccgcgggccttgccgtcgcttcggtcggtccgtccattgcctcgatctatggccgcaagctgaggctcgacggctcggcctgtctggcgatctcgcagtcgggcaagagccccgacatcgtcgccatggccgaaaccgcacgcgccggcggcgcgctgaccatcgccatcaccaacaccgccgactcgccgctggcgcgcgcctcggactatgcgatcgacatccttgccggcccggagcgcagcgtcgcggcgaccaagaccttcgtcaattccgccgtcgccggtcttgccctgatggcgcattccaccggcgacgaagctcttctggcagcgctggcccgattgccagagcatttcggcaaggcgatcgcctgcgactggatgagcgtgctggctgaaaccatcgagaagcagaaatcgctgttcatccttggccgcggcccgtcggcggcgatggccaacgaggcggcgcttaagttcaaggagacctgcggcatgcatgccgaggcctatagcgcggccgaggtcatgcatggcccgctggcgctgatcggtcccgactttccggtgctggctctggccgcgcgcgatgcgtcagaaccctccatcactgaggcggccgacgggctggcggccaagggggcgccggtgttcgtcacttcggcgcttgccaaccgcgccacgcgcctgccgcatgtcgccaccggtcatccgctgaccgatccgctgacactgatcgtttcgttctacgtgttcgtcgaggccttcgcgcgccatcgcggcctcgatccggacacgccgcgcaatcttcgcaaggtgacggagacagtatga

SEQ ID NO: 35778 - DNA, 732 bp, Mesorhizobium loti
atggcggatctggcaggcaaggtcgttgtcatcacggcggcggcgcaaggcatcggcaaggcgagcgcgctggccttcgccaagactggagccaccgtccacgccaccgacatcaacgagacgcttctcgccgaactcgccaagacgccagggatcaagacccgcaagctggatgtgctcaacgacgaggccgtcaacaccaccttcgccgagatcggccgcgtcgacgtgctgttcaactgcgccggcttcgtccattccggctcgatcctggagatgaaggatggcgatctcgatttcgccttcaacctcaatgtccgcgccatgatccgcaccatcagggccgtgctgcccggcatgctggaacgaggcgacggatcgatcgtcaacatgtcttccgtcgccggcgccggcaaaggcgtgccgaaccgcttcgcctatggcgtcaccaaggccgccgtcatcggcctgaccaaggcgattgccgccgactatgtcggcaagggcatacgctgcaacgccatctgccccggcacggtcgaaagcccgtcgctgcaggaccgcatgcatgcgcaaggcgactacgaagccgcccgcgccgccttcatcgcccgccagccaatgggccggctcggcacgcctgaggaaatcgccgatctcgcggtctatctggccggcgcgacctacacgtccgggcaggcctataatatcgacggcggctggtcgatctga

SEQ ID NO: 35779 - DNA, 2346 bp, Mesorhizobium loti
atggaatacggcccggcgccggaagcccgcaacgaggccgatgcgtggcttgccgcgcgcgatttcggcaaggcgctgttcatcgacggtgcctggaaggccgcttccggcggcaagaccttcgacaccagcgagccgtcttccggcaagctgctggccaaggtctccgacgccagtgccgccgatatcgacgcggcggttgcggcggccaccaaggcattgccgaaatggagcgccagttcaggctacgccagggcaaaggtgctctacgccattggccgcgccatgcagcggcatcagcgcctgttcgcggtgctggagtcgatcgacaatggcaagccgatccgcgaaagccgcgacatcgacgtgccgctcgccatccgccatttcatccatcacgccggctgggcgcaggcgctggacagggattttcccggtcacaagggcgtcggcgtcgtcggccagatcatcccgtggaatttcccgctgctgatgctggcctggaagatcgcgccggcgctggccgccggctgcacggtggtgctgaagccggccgaattcacgccgctgaccgccatcctgttcgccgaaatctgcgagcgcgccggcgtaccgaagggcgtcgtcaacatcgtgcagggcggaccggaagcgggcgcggccatcgtcaaccatcccggcatccagaagatcgccttcaccggctcgtccgaagtcggcaagatcatcaggaaagccaccgccggatcgggcaaaaaactgtcgctggagctcggcggcaaatcggccttcatcgtcttcgaggatgccgatctcgacagcgcggtcgaaggcctggtcgacggcatctggttcaaccagggccaggtctgctgcgccggttcgcggctcctggtgcaggaaggcatcgccgaggctttgatcgccaaggtcaagacgcggatgagccggctgcgcgtcggcagcccgctcgacaagaacaccgatatcggcccgttggtcgatctgacccagctcgaccgcgtcaagggcctggtcgccgaaggcgcgaagcaaggcgccgtctgctggcagccggatgcagcgctgccgtcttccggctactatcatctgccgacactcgccaccggtgtttcgccggctaatatcctggcgcaggaagaggtgtttggcccggttctggcgactatgaccttccgcaacaccgaggaagcgatcgagcttgccaacaacacgcgctatgggctcgcggcgagcgtgtggagcgagaacgtcaacctcgccttgcacgtggcgccgcaattgaaggccggcgtggtctgggtcaacggcaccaacatgttcgacgccgcctgcggttttggcggctaccgcgaaagcggcttcggccgcgagggcgggcgcgaaggcatgttcgaatatctcacggcaaaactgccgctcggaccggtcatcaagccggcggcggtttcggcgcaaccggtcgagcaggctgacggcgcggccatcgaccgcaccgcaaaactgttcatcggcggcaagcaggtgcggccggacggcaattattcactggccgtcgccaccgccaagggcaagctggccggcgaagtcggctttggcaaccgcaaggacatccgtgacgccgtttccgccgcccgcgcctgcaagggttggcccgaggcgaccgcctataaccgctcccaggtgctttattatctggccgagaacctttccggccgcgcgggggagtttgccgcgcgtctcaccgaactgaccggggcgacgcccaaggccgcgcgcgaagaggtcgaccagtcgatcgaacggctgttcctctatgccggccttgccgacaagttcgaagggcgcgtgcaccagccgccagcccgcgccgtgacgctggcgctgcatgagccggtcggcgtcgtcggcatcgtcgcgccggatgcctcaccgctgctcggcctgatctcgctggtcgcgccggcgctggccatgggcaatacggtggtcgcggtgccttcggaacgctatccgctgctcgccaccgatctctatcaggtcatcgaatattccgacgtcccggccggcgccatcaacatcgtcaccggccgcagcgccgaacttgccggcgtgctggccaagcatgacgatgtcgacgggctctgggtgttcgccgatgccgagacctgcgccagggcggaagccgagtccatcggcaacctcaagcgcgtctggagcggcaatggccgcagcctcgactgggcttccgacgaggcggccggcgatgctttcctgcgccgcgccgtcgaggtcaagaatgtctgggtgccttacggcgactga

SEQ ID NO: 35780 - DNA, 894 bp, Mesorhizobium loti
atgacggatatcgccgccaccgccgaaatgcaggccgccctgctgtcgcgcgctttgccctacatgcagcgttacgaacacaagaccgtcgtggtgaaatatggcggccacgccatgggcgacatcgagctcggcaaggcttttgcgcgcgacatcgcgctgctgaagcaatccggcgtcaacccgatcgtcgttcatggcggcgggccgcagatcggcgccatgctgaccaagatgggcatcgaatccaagttcgagggtgggctgcgcgtcaccgaccagaagacggtcgagatcgtcgagatggtgctggccggctcgatcaacaaggagatcgtcgcgctcatcaacgccgaaggcgaatgggcgattggcctctgcggcaaagacggcaacatggtgttcgccgaaaaggcgcgcaagaccatgatcgaccccgattccaacatcgagcgtgtgctcgatctcggcttcgtcggcgaaccggtcgaggtcgaccgcacgctgctcgacctcctggcccgctccgaaatgatcccggtgctggcgccggtggcgcccggccgcgacggccacacctacaacatcaatgccgacactttcgccggtgccatcgccggcgcctgcaaggcctcgcgccttttgttcctgaccgacgtgcccggcgtactcgacaagaacaagaagctgatcgacgaattgaccgtcgccgaggccaaggcgctgatcaaggacggcacggtctcgggcggcatgatccccaaggtcgaaacctgcatcgaggcgatcgagcgcggcgtcgagggcgtcgtcatcctcaacggcaagacgccgcatgcggtgctgctcgagctcttcaccgaacacggcgccggcacgctgatcgtgccctga

SEQ ID NO: 35781 - DNA, 837 bp, Mesorhizobium loti
atgaacgatgctcctcccttcgacctcgacgcctatctcgctcgcatcggttacaccggtccgcgcaacgcgtcgctggatacgctgaaggcgctgcatttcgcgcatccgcaggcgatccccttcgagaacatcgatccgtttcttggtcgcccggtccggctcgaccttgccgcgctgcaggacaagatcgtccttggcgggcgcggtggctactgcttcgaacataacctgctcttcatgcatgcgctgaaggcgcttggtttcgaggtcggcgggttggccgcgcgtgtgctctggggccagagcgaggacgccatcaccgcgcgcagccacatgcttttgcgcgtcgagctcgacggccggacctacatcgccgatgtcggcttcggcggcctgaccctgaccgcgccgctgctgctggaaccgggccgcgaacagaaaaccccgcacgagcctttccgcatcgtcgaggccgacgatcatttccgcctgcaggccgccatcggcggcgactggcgctcgctctaccgcttcgacctgcagccgcaatacgaagtcgattactccgtcaccaattacttcctgtcgaccagcccgacatcgcatttcctctcctccgtcatcgcggcacgcgccgcgccggaccggcgctacgcgctgcggggaaaccgcttgtcgatccatcaccttggcggccgcaccgagcagacagagatagccaccgccgccgaccttgccgacacgctgcaaggcctgctcggcatcatcattcccgaccgcacggctttcgaggccaaggtgcgtgagacgaagatcgtggagaccaacgcatga

SEQ ID NO: 35782 - DNA, 996 bp, Mesorhizobium loti
atgttcgacccgaaattccgcaaggtcgccgacaagatcttctccaagagcggcacaagactggcgccctattccggcatcccgaccttcctcgccgcgccctatcgcgaaatcgctgccgaaaatccgaatttcggcgacttgcaggtggccatcatcggcgtgccgatggatctgggcgtcaccaatcggcccggttcgcgcttcgggccgagggcgctgcgcgccatcgagcgcatcggcccctacaaccacgtgctggaatgcgcgccgacgcacgagcttcgcgtcgccgatattggcgatacgccgttccgcagccgctaccggctcgagaccagccatgaggacatcgagcgccgcaccaaccagatcgtcgatgccggcgtcattccgctttcggtcggcggcgaccattcgatcagccatccgatcctgaaggccgtcggcaagaaggcgccggtcggcctcatccacatcgacgcccattgcgacaccagtggcctgttcgacatgaccaagttccaccacggcggcccgttccgcaacgcggtgctcgacggcgtgctcgacccgacgcgcaccatccagatcggcatccgcggctcggccgaatacctctgggagttcacctacgagtccggcatgaccgtggtgcacgccgaggaggtgaccggtctcggcattcccgccatcatcgagaaggcgcgcaagatcgtcggagacggcccgacctacgtctccttcgacattgacagcgtcgatccggccttcgcgccgggcaccggcacgccggaagtcggcggcctgacgacgcgcgaagtgcttgagctgctgcgcggcctcaagggcctcaacatcgtcggcggcgacgtcgtcgaggtggcgccgcaatacgacgccaccaccaacaccgcgcatgccggcgcccaggtgttgttcgagatattgagcctgatggtgttcagcccggccatcacgggcaagggagcctga

SEQ ID NO: 35783 - DNA, 1587 bp, Mesorhizobium loti
ttgacgaaacagtttgtttgcgcggtcgatgtcggcaccgggagcgctcgcgctggcattctcgacgccagtggcaccttgcttggccgtgccgatcggccgatcgccatgaaccagccgaagcccgatcatgccgagcatgattcgcgcgatatctggtcggcggtctgcgccgccgtgcgtgccgcccgcgaaaaagccggcgtcgcggcgcaggatattgttggcatctcgtttgatgcgacctgctcgctggtggtgcgcgaccggcaaggcgatcagctcagcgtttcgaccacgggcgacaagcgctgggacaccatcgtctggctcgaccaccgcgccatttccgaagcagacgaatgcacggcgagcagccacgaggtgctcaactatataggcggcgtcatgtcgccggaaatggcgacgccgaagctgatgtggctgaagcgcaacctgccgcagacctggaatgaagccggctatctattcgacctggccgatttcctgacctggcaggcgagcggctcgctggcccgctcgcaatgcacactgacggcgaagtggacttatctcgcacatgaggagagcgcgtggcagcgcgatttcttcgagatcgtcggcctcgacgatctctttgagcacggcaatctgccggagcgggctagtccggtcggcgccgacatcggccctctgacggcgcaagcggcggcggaacttggtttgacggaaagctgccgggtcggcgccggggtcatcgatgcctatgccggcgcgcttggcgtgcttggcggctttgccggtgatgagcaggatattggccggcatctggcgttgattgccggcacgtcgagctgcgtcatggcgatgtcgcccgacccgcagcctttcgccggcgtctggggcccttactatggcgcggcgttgccaaagctgtggctgtcggaaggcggccagtcggctaccggcgcgctgctcgaccacatcatccgctggcacggcgccggcggcgagccggatgccgccatgcatgccaaaatcgccaggcgggtcgccgaactgcgcgccgccgagggcgacaacctcgccgcgcgcctgcatgtgctgccggattttcacggtaaccggtcgccgctcgccgacccgcatgctgtcggcgtcgtcagcgggctgacgctggattcctccttcgacagcctgtgcaagctctactggcgcaccgccgtcggcatcgcgctcggcgtgcgccatgtgctggaagcgctgaacgagaacggctacctgatcgacacgctgcatgtcaccggcggccacaccaagaacccactgctgatggagctctacgccgacgccaccggctgcacggtggtcgaaccgctggccgacgaggcggtgctgctcggcaccggcatggtcgccgccaccgccgccgggcttttccccgacctcaatgccgcctgccttgccatgcagcagggcggcaagaggcgtgccgccaacccggccgccggcgcccgcttcgaccgcgactaccggattttcctggaaatgcaccgccagcgccaggcgcttgacgacatccggtag

SEQ ID NO: 35784 - DNA, 771 bp, Mesorhizobium loti
gtgaggctgaaaggcaaatcggcgctgatcaccggatcggcgcgtggcatcggcaaggccttcgccgaagcctatgcgcgcgaaggcgctatcgttgccattgccgatatcaatctcgaggccgcgcaaaaaacggcggcagatatcggcgacaaggcctatgcggtcaaactcgatgtcacggatcaggcctctatcgacgccgcggtgaaagcggtggagacgaggaccggcggcctcgacatattgatcaacaacgccgctctgttcgacctggcgccgatcgtcgagatctcgcgggcgagctatgaaaaactgttctcggtcaatgtcgccggcacgctgttcatgctgcaggcggcggcccgctcgatgatcgcgcggggcaagggcggcaggatcatcaacatggcgagccaggccggacggcgcggcgagccgctggtcggcgtctactgcgcgaccaaggccgccgtcatttcgctgacccagtcggcggggctcgacctgatcaagcaccgcatcaacgtcaacggtatcgcgcccggagtcgtggacagcgacatgtgggaccaggtcgatgccctgttcgccaaatacgagaaccggccgaagggcgagaagaagcggcttgtcggcgaaggggtgccctacggccgcatgggcaagccggaggacctcgccggcatggccgtcttcctggccagcgatgaggccgaatacatcgtcgcccagacctacaatgtcgatggcggccagtggatgagttga

SEQ ID NO: 35785 - DNA, 1209 bp, Mesorhizobium loti
atgctgaaacgcgtcgtcattaccggcattggcgggctgtgcggactaggcgtcgatgcgcagtcgatctgggccgaaatgcgggccggccgttcagccataggcccgatcgacaatcccttcctgcatgatttgaaggtcaagaccggctgcgagatcaaggcgctgcccgatcatggcatcgagcgcaagcagctggtgtcgatggaccgtttcagcctgctggcggtgatcgctgctaaagaggccatgcggcagtccggcctggccccgcatgccgacaacacctatcgcatgggaaccatcgtcggcgtcggcgtctgcggcttcgagaccgtcgaggagaactatcgcgccattctggtcgagggcaagaatcgcgccggcatcttcaccgtgcccagggtcatgccgggcgccgccgccggtcaggtcagcatgcatcttggcctgcgcggaccggtcttcggcgtcacgtcggcctgctcgtcggccaaccacgccatcgcctcggcggccgaccagatcaggctcggccgcgccgacgtcatggttgccggcggcaccgaagcgccactggtctggggcgtgctcaagggctgggaggcattgcgcgtgctgtcacccgacacctgccggccgttctcggccgaccgccagggcctcgtgctcggcgaaggtgctggcatggcggttctggaaagctacgaccacgccgtggcgcgtggcgccaccatcctcgccgaaatcgccggcgccggcctttcggccgatgcctccgacatcgtcgccccgaccatcgagggaccggaagcggcgatgcgcttctgtctcgtcgatgccgggctcaatcccgaggacatcgattatctcaacgcgcatggtaccggcaccaaggccaacgaccagatcgagaccaacgcgatcaagcgcgtcttcggcgattacgcgcggtcgctgtccatctcctcgaccaagtcgatgcatgcccattgcctgggcgcgtcgggcgggctggagatgatcgcctgcgtcatggcgatccgcgaaggcgtcgtgccgccgaccgcgaattaccgcgaacccgatcccgattgcgatctcgacgtgacgcccaatgtcgcgcgcgagcgcaaggtgcgcgtcgcgatcagcaacggttttgctttcggcggcaccaacgcagtgctggcattcaaggccatctaa

SEQ ID NO: 35786 - DNA, 705 bp, Mesorhizobium loti
atggccgacctgtccgcctttccgatcacaacccgctggccggccaaatatcccgaccagatccagctctattcggcaacgacgcccaacggcgtgaagatatcgatcgcgctggaagaggtcggcctgccctatgagccgcatctggtcaacatcagcaaggacgaaagctggacgccggaattcctgtcgctcaatcccaatggcaagattccggcgatcatcgatcccaacggcccggacggcaagccgatcggccttttcgaatccggcgccatcctgctctatctcgccgacaagaccggcttgctcgtcccggcggacgcagcgcggcgctacgagacgatccagtgggtcttcttccagatggcttccgtcgggccgatgttcggccaggtcgggttcttccacaaattcgccggccgcgagatcgccgacaagcgcccgctggagcgctaccgcgacgaatcgcggcggctgatcggcgtgctcgacggccgattgaagggtcgcaaatggatcatgggcaacgactacaccatcgccgacatctcgctgctcggctgggtgcgcaatttgatcggcttctatgaagcgcgcgagctcgtcggtttcgatgatttcgccaatgtagcggcatggctggagcgcggcctggcgcgaccggcggtgcaaaagggcctgaccattccggccaagggctaa

SEQ ID NO: 35787 - DNA, 1092 bp, Mesorhizobium loti
gtgttgaccaccacagacgacctccgggtcaaggaaatccgagaactgagcacgccggaccaggtgatgcgggaaatcccgcgcacgctgacggcgacgcgcaccgtgagcgcctcacgcaatgcgatccacgctattctgaacggcaccgacgaccggctgcttgtcgtcgtcggtccctgttcgatccacgatccggtcgcggccgttgactatgccagccgtctggcggcgctgcgcgagaccctgtccgaccggcttgagatcgtgatgcgggtgtatttcgagaagccgcgcaccacggtcggctggaagggcctgatcaacgatcccgaccttgacggcagcttcaacatcgacaaggggctcaggatggcacgcaacgtgctttccgccgtcaacaatctcggcctgccggcggccaccgaattcctcgacatgaccacgccgcaatacattgccgacctcgtcgcctggggtgccatcggcgcgcgcaccaccgaaagccaaatccaccgtgagctggcctcgggcctgtcctgcccggtcggtttcaagaacggcaccgacggcaatctcaggatcgccggcgaggcggtgaaatcggccgcccagccgcatcatttcatggcggtgaccaagggcggacgcagcggcatcgccaccaccaccggcaatgaggactgccatgtcatcctgcgcggcggcgttcagcccaactacgacgcggcgagcgtcgaggcggcctcggtcgaactcgcccgcatcggtgtcgcgccgcggctgatgatcgatgtcagccacgccaactccgccaagaagcctgagaaccagccgaaggtggcggccgatgtggccggccaggtggcggcgggcgacgagcgcatcatcggcctgatgatcgagagcaatctcgtcgccggccggcaggacgtggtgcccggcaagccgctcgtctatggccagagcatcaccgatggctgcatcgactgggcgaccaccgagaccgtgctgcatggccttgccggtgccgtcgagtggcgccggtcggcacgccgcgccatgctggaaagccggcagggtgctgcctga

SEQ ID NO: 35788 - DNA, 795 bp, Mesorhizobium loti
atgagcgcatcttccgatcgcaatcatgagacacgcgccatcgtcaccggtggcgcgcaaggcatcggctttgccgtcgccgaggcgctggccgacgagggctgccgggcattggcgctcatcggccgttcgcaggagaagggcgacaaggccgtcgcccacttcaaaaaggccggcgtcgacgcgatcttcatcagcgccgacgtctcgaaggtggcggattgcaagcgcgcggtggcgaccgcgctcgcgcatttcggcacgctgaatgcgctggtcaacgccgccgccacctcggcacgcggctcattggtcgaaacctcggaagagcttttcgaccagatattcgcaaccaatgtgcgcggacctttcttcctgatgcagggactggttgcccatctgctggagcgcaaggcgccgggctcgatcgtcaacgtgctgtcgatgtcggcacattgtggccagtcgttcctgacgccctattcgaccagcaagggcgcgctgatgacgctgaccaagaacgtcgccaacgcctatcgcttcgaccgcatccgctgcaacgccgtgctgcccggctggatggataccgagggcgaggacatcgtgcaaaagaaatggcacgacgccccggacgattggctggcgaaggccgaagccgcgcaaccgatgggccaattggtcaaaccggaccagctcgcgcggctgatcagctacatggtcagcccgcaatcgggcgtcatgaccgggtcgttggtcgactacgaccagagtgttgcggggtcgtcgccggagtag

SEQ ID NO: 35789 - DNA, 600 bp, Mesorhizobium loti
atggcgccccgttccgccgaagccagccgcaagaccaaggaaaccgatatctcggtgtcggtccatgtcgacggctcgggcaaatccgatatcgcgacgggcgtcggcttcttcgaccatatgctcgaccagctgtcgcgccattcgctgatcgacatgacggtgagggccaagggcgacctgcacatagacgaccaccacacggtcgaggacaccggcatcgcgctcggccaggccttgacgaaggcgctgggtgagcggcgcggcatcatgcgatatgcctcgatcgaccttgccatggacgagacgctgacacgcgcggcgatcgacgtgtcgggccggccgttcctggtctggaacgtgtctttctcgtcgcccaagatcggcaccttcgacaccgagctggtgcgggaattcttccaggcgctggcccaaaatgccggcatcacgctgcatgtcaccaaccattatggcgccaacaaccaccatatcgccgagacctgcttcaaggcggtggcgcgcgcgttgcgtgccgcgctcgagcccgacccgcgccagccggacgcggttccctccaccaagggatcgttgaagggatag

SEQ ID NO: 35790 - DNA, 837 bp, Mesorhizobium loti
gtgaagatcaccatcatcctcgcctcctatgacagcggccactatcatggcggcatgggccagggcccggatgcgctgatcgcaggcggtctggtcgacgccctgaccattgccggccacgaggtcgcggtcgcggatatcggcagggttggtgacgaccaggagcgcgagatcgccaccggttttgccgtctgcaacgccgtctcgggcgaggttcgcattgccatcgacaggggacggttccccatcgtgctcgccggaaactgcctgacatcagccggcgcggtcgccggcgagggtgccgacgcgatcatctgggccgaccagcatggcgacctcaacacgcccgaaacctcggtttatggctttctcgacggcatggcgctggcgaccgtgcttggcctgtgctggcgtccgatggcaggggccattccaggcttcaagccgatcgacccgtcacgctgcgtgctcgtcaatgcccgcgatctcgatccggccgaggaagaactcctcaagaccttgccggtcatccgcaccgaatgtccaggcattggaccggcaaccgcaaagctgaaggccgtaggcgccaaaagcgtgcacatgcatctcgatctcgacgtgcacgaccccaaggaactgcaggccaatcgatacgtcacgtcaggcgggccaagccccggacaattgcgcgacgcggcctgcgccatggcgcttgcggtgccagtcgtcggcatcaccgtttccgcttacgatccggccttcgacgcgcggggtgacgtcccgccgttggtcggcgagctgctcaacgatctcatcgccacgatagagggccgctga

SEQ ID NO: 35791 - DNA, 792 bp, Mesorhizobium loti
atgctgaaagcccgtgtcatcccgtgcctcgacgtcaaggacggccgcgtcgtcaagggcgtcaacttcgtcgacctcatcgacgccggcgacccggtcgaagcggccaaggcctatgacgccgccggcgccgacgaactctgctttctcgacatcaccgcctcgtccgacaaccgtgaaaccatcttcgatgtcatcgcccgcaccgccgaacagtgcttcatgccgctgaccgtcggcggcggcgtgcgccaggtcgccgacatcaggaagctgcttctggccggcgccgacaaggtgtcgatcaacacggcggcggtgaagaatccggatttcgtcgccgaagccgccgacaagttcggcaatcaatgcatcgtcgtcgccatcgacgccaagaaggtctccggcgccggcgaggccgaccgctgggagatcttcacccatggcggacgcgagaagaccggcatcgacgccgtcgaattcgcccgcaaaatggtcgatcgcggcgccggcgagatcctgctgacatcgatggaccgcgacggcaccaaggccggctacgatatcgcgctgacgcgtgcgatcgccgatgcggtgcgcgcgccgatcatcgcttcgggcggcgtcggcacgctggatcacctggtcgaaggcattcgcgacggccacgccggcgcggtgctggctgcctccatcttccattttggcacctacaccatcgcgcaggccaaggcgcatatggccgccgcgggcctgccgatgcggctggactcctcgggcgatcggccctag

SEQ ID NO: 35792 - DNA, 324 bp, Mesorhizobium loti
atggctgaattttcgttctccgatctggaggcaatcatcagggaccgcgcccattccggcgacccggattcctggacggcgaaactgttcgcgcgcggcatcgacaaggcggcccagaaactcggcgaggaggcggtcgagacggcgattgccgccgtcaagggcgacagacagggcctcgtttccgaaagtgccgatcttatatatcattggctcgtcgttctcggcctctcgggtgttccgttgagcgacgtgctcaaggagctcgaaagccgcaccgggcgttcgggcatcgccgaaaaggcgtcacggcccaagggctga

SEQ ID NO: 35793 - DNA, 1455 bp, Mesorhizobium loti
atgtatctcggcctcgacctaggcacgtcgggcgtcaaggcgctgctgatcgatgccggacagaccgtcgtcggttccggccacggctcgcttgacgtttcgcggccgcatcccggctggtccgaacaggacccgtcccactggatacgcgcctgcgaagacgcgatcgcagaactgaaggcctctcatcccaggcagttcgcggcggtgaagggcatcggcctgtccggccagatgcacggcgccaccttgctcgatgcggctgatcatgtgctgcgcccctgcatcctgtggaacgacacgcgcagccatgtcgaggcagcagtgctcgacgccgatccacgcttccgcaagttgaccggcaacatcgtcttccccggcttcaccgcgcccaagctcgcctgggtgaagaacaacgaacccgccgtcttcgccaaagtggcgaaggtgctgctgccgaaggatttcctgcggctatggctcaccggcgagcacatttccgaaatgtccgactccgcgggcacgtcctggctcgacgtcggcaagcgccgctggtcggccgaattgctggcggctacgtcgctcgacgagaagcagatgccgtccctggtcgagggcactgagaaggctggcggtttgcgcgccgaactggcgtcgaaatggggcgtcgaggccggcatcccggttgccggcggcgccggcgacaatgctgcctcggcctgcggcatgggcacggtcggcgccggccatgcgtttgtctctctcggcacctctggcgtgctgtttgccgccaacgcgtcctatctgcccaacccggcgagtgctgtccacaccttctgtcatgcgctgcccgacacctggcaccagatgggtgtcatcctgtcggcaaccgattcgctcaactggctgtcggagatcactggaaagggcgcgggtgaactgaccgctgaactcggcgatacgctgaaggcgccgaccggcgtgtctttcctgccctacctctcgggcgagcgcacgccgcacaatgattcggccattcgcggctccttcaccggcctggcgcatgaatcgagccgcgcagtgctgacgcaggctgtgctcgagggcgtcgccttcgccttccgcgatagtctcgaagccctgaagaccgccggcaccacattgacacgggtgacggcgatcggcggcggctcacgctcgcgctactggctgaaatcgatcgccaccgcgctgcaagtgccggtggacattcccgccgacggtgatttcggcgccgccttcggcgctgccaggctcggtctgatcgcggcgacgggtgccgatccgctggccgtctgctccgcgccaaggacggatgccacgatcgaaccggatgccaagctcggcggcgcctatgcggacgcctatcatcgctaccgggcgctctatccggcaatcaggggtgccacggcgtga

SEQ ID NO: 35794 - DNA, 1164 bp, Mesorhizobium loti
atggattttggtctttcggaggaacaaaaactcatcgtcgagacgacgcgcgctttcgtggagaacgagctttacccgcatgagcgcgaggtcgagcgcaccggcgtgctgcgccgcgagctgatcgaagagctcaaggccaaggcgatcgaggcagggctctacgcagccaatatgccggcggatgtcggcggcgcgggcctcgatacggtgacctggctgctctacgaaaaggaactcggccgcgccaattacgcgctgcactggacctgcgtcgcacgcccctccaacatcctcttggctggcacgccggagcagcgcgaaaaatatctcttcccgtgcatccgtggcgagaaatgggactgcctggcgatgaccgagccgggcgccggctccgacctgcgcggcatgaaggcttcagccgtgcaggacggcgacgactgggtgctgaacggcaccaaacatttcatcagccacgccgatctcgccgatttcgccatcgtcttcatggcttcgggcgaagaggattcgccgcgcggcaagcgcaagaagatcaccgccttcttcgtcgacaaaggcaccaagggtttcacggttcgcgatggctatcgcaacgtctcgcatcgcggctacaccaacgccatcctcgaattcgacgattgccggctgccggcgagccaggtgctcggcgaagtgcacaagggcttcgacgtcgccaattcctggctcggcgccacccgtctgcaggtcggcgccacctgtctcggccgcgccgagcgggcgcttggccacgcggtcgagtacgccgcgcagcgccagcaattcggccagcagatcggcaagttccagggcgtgtcgttcaagctcgcagacatggcgaccgaattgaaggccgccgacctgatggtgttcgaagccggctggaagtacgatcagggcaccgtcaccgaccaggacatggccatggccaagctgaaagccaccgaaatgctggctttcgttgccgacgaagccatccagatccatggcggcatggggctgatggacgacctgccgctggagcgcatctggcgcgacgcccgcgtcgagcgcatctgggagggcacgtcggagattcagcgacatattatttcgcgggcgctgctgcgtccgttcggtgcttag

SEQ ID NO: 35795 - DNA, 939 bp, Mesorhizobium loti
atgaccgactacacaaaactcatcgatgccgagacctgggccttcatcgagcggaccaattcctattatccgcccgacacgatcgactacacgatcacccagcagcgcgagatctacgaccgcatgtgccgggagttctttgccggctatccccagggcgtgacggtcgaaacctcggccattgccacgcccacgcacgatatcccgatccgtatctaccgaagcgccccgcaaccggcggcgacggtgctctgcatccatggcggcggcttcatgcttggcgggctggacagccatgacgacgtctgcgccgagctttgcgcccgcaccggctacgaagttgtctcggtcgactatcggctggcgccggagcatttgcatcctgccgccttcgacgacgcgatgaccgccttcgcatgggttgcatccacccgcgatcgccccatcctgctctgcggcgacagcgccggcggcaatctctgcgccgccgtcagccacgccacgcgcggccacgtgaaacggccggtcggtcaggtgctgatctatcccggtctcggcggcgaccgctcgaaggactcctatgtcacgcatgccgaagcaccgatgctgaccatgcgcgatcttgaattctacaagcacattcgcaccggcgggcaggatcgcagcggcgatgccacactggcgccgctggccgacaccgacttcgccaacctgccgccgaccgtgctggtcaccgcgcagtgcgacccgctgtcttcagacggcgagacctatcgcgaccgcatcatcgcggcgggcgggagagccacctggttcgaggaaccgggcctggtgcatggctatctcagggcccggcacacggtcggccgcgcccgcgaaagtttcacacggatcgtcggcgcggcggccgcgcttgggcagggcgcctggctctggtaa

SEQ ID NO: 35796 - DNA, 660 bp, Mesorhizobium loti
atggcgctcgacatcaaaatctgcggcttgaagaccgaccaggcaatggccgcggcgctcggcggcggtgccagccatgtcggctttatcttcttcgcgaagagcccgcgttatgtcgagccggcggaagccgggcgtctgcgcgaagccgcgcgcggcaaggccgtggcggttgctgtgacggtcgatgcaaccgacgctttcctggacgagattgtctcggccatgcagcccgacatgctgcagttgcacggctcggaacaccccgaacgggtggctgaactgaaggctcgctatggcttgccggtgatgaaggcattgccgctcagcgaggccgccgacctcgaccggatcagaccgttcattggcattgccgaccggttcctgttcgatgccaagccaccgaaaggctccgaactgccgggtggcaatggcgtcgccttcgactggcgcatccttgccggccttgacgccggcgtcgattacatgctttccggtgggctcaacgccgccaatatcggcgatgcccttcggcttgcgaacccgcccggaatagacatttcgtcgggcgtggaaagcgcgccgggcgtcaaggatccggcgcttatcgaacagtttttccgggccgtccgagcagcacgcgacgaccgggccgcctaa

SEQ ID NO: 35797 - DNA, 1401 bp, Mesorhizobium loti
atgacgggtagcaaggattatgtggtcgccgacatctcgcttgccggctggggccgcaaggaactcgatatcgccgaaaccgaaatgccgggcctaatggcctgccgcgaggaattcggcgccaagaagccgctgaagggcgcgcgcatcaccggctcgctccatatgacaatccagaccgcggtgctgatcgagacgctgaaggcgctcggcgccgatatccgctgggcctcctgcaacatcttctcgacccaggaccacgccgccgcggccatcgccgaggccggcattccggtcttcgccgtcaagggcgagagcctcgaacaatattgggactataccgaccggatcttccagtgggcggacggcggcctctccaacatgatcctcgacgatggcggcgacgccaccatgtacatcctgatcggcgcccgcgccgaagccggcgaggacgtgctgtccaacccgcagagcgaggaagaggaatatttctacgctcaggtcaagaagcggctgaaggcttcgccgggcttcttcaccaagcagaaggctgcgatccgcggcgtcaccgaagagacgaccaccggcgtcaaccggctctaccagctgcagaagaagggcctgctgcccttccccgccatcaacgtcaacgattccgtcaccaagtcgaaattcgacaacaagtatggctgcaaggaatcgctggtcgacggcatccgtcgcggcaccgacacgatgatggccggcaaggtcgcggtcgtctgcggctatggcgacgtcggcaagggctcatcggcttcgctcaagggcgccggcgcccgcgtcaaggtcaccgaggtcgacccgatctgtgcgctgcaggcggcgatggacggctttgaagtggtgacgctggaagacgcggccccgaccgccgacatcgtcatcaccaccaccggcaacaaggacgtcgtcaccctcgaccatatgcggtcgatgaaggacatggtgatcgtcggcaatatcggccacttcgacaacgagatccaggtcgcctcgctgcgcaatctgaaatggaccaacgtcaagccgcaggtcgacatgatcaccttccctgacggcaagcggatgatcctcctgtcggaaggccgcctgctcaatctcggcaacgccaccggccatccgagcttcgtcatgtcggcgtccttcaccaaccaggtgctggcccagatcgagctgttcaccaagggcgaacagtaccagaaccaggtctatgtcctgcccaagcatctcgacgagaaggtcgcacgcctgcacctcgacaagctcggcgcacgcctgaccgaactgtcgggtgagcaggccgcctatatcggcgtcacgccgcagggtccgttcaagccggaacactaccgctattaa

SEQ ID NO: 35798 - DNA, 1611 bp, Mesorhizobium loti
atgtcggaagtcggcaaacgcaatcctgcttgcccgatcgatcgtatcggcctgaaaaccaccggtatggtgcgctataattttggcgcggccgccctttacgaggaggcgatccggcgtggcgaggcccggttgaccgcgcatggcgcgctggtcgccgagaccggccagcacacaggccgttcgcccaaggacaagttcgtcgtccgtgacgccgccacggagcctgaagtctggtgggacaacaacaaggcgatctcgccggcccagttcgaaacgctgttcgccgatttccttgcccacgccgcgaacaaggatctctatgttcaggacctcgtcggcggcgccgacgccgagctgaaactgccgacgcgcgtaatcaccgagtttgcctggcactcgctgttcatccgcaatctgctcatccgtccggacaaggccgaactcggacagttcgtgcctgagatgacgatcatcgacctgccgtccttccgcgccgaccccgcccgccacggcagccgcacggaaacggtgatcgctgtcgacctcacccgccagatcgtgctgatcggcggcacctcctatgccggcgagatgaagaagtcggtattcaccatgctcaactatatcctgccgcagaagggcgtgatgccgatgcactgttcggccaatgaggggccggccggcgatgcggccgtcttcttcgggctttccggaaccggcaagacgacgctgtcggccgatccgtcgcgcacgctgatcggcgacgatgagcatggctggggcccgcacggcatcttcaatttcgaaggcggctgctacgccaagacgatcaagctgtcggccgaagccgagccggagatattcgccaccacgcagcgctttggcacggtgctggaaaatgtcgtgctcgacgccgacggcgtgccggacttcaacgacggccgcctcaccgaaaacacacgctgcgcctacccgctcgacttcatccccaatgcctcgaagaccgggcgcgccagtcatcccaaaaacatcatcatgctgaccgccgatgccttcggcgtgatgccgccgatcgcgcggctgacccctgcgcaggcgatgtatcatttcctctccggctatacggccaaggtggccggaaccgaaaagggcgtcaccgaacccgaggcgacgttctcgacctgcttcggtgccccgttcatgccgcgccatccgtcggaatacggcaatctgctgcgcgagctcatcgccagccacggcgccgattgctggctggtcaacaccggctggaccggcggcgcctacggcaccggcaagcgcatgccgatcaaggcgacgcgcgctctgctgaccgccgcgctcgacggatcgctgaagacaggcgaattccgcaccgacgccaatttcggcttcgaggtgccggtggcggtgcctggcgtcgacagcgccattctcgacccgcgctcgacctgggccgacaagcctgcctatgaccgccaggcggcaagactggtcggcatgttcgccgtcaacttcgaaaaattcgagccgcatgtcgatgccaccgtcatgggcgcggcgccccggatgcaggaagcggcggagtag

SEQ ID NO: 35799 - DNA, 1665 bp, Mesorhizobium loti
atgcaatccgctttgaaagccagttcgaaccccgacctcgccatcgatcgcgactggtggcgaggtgctgtcatctaccagatctacccgcgcagctaccaggattcgaacggcgacggcatcggcgacctcaagggcatcatcgaacggctgccctacatcgcagcgctcggtgcggacgccatctggatctcgcccttcttcaaatcgccgatgaaggatttcggctacgacgtctcggactattgcgacgtcgacccgatgttcggcacgctggccgatttcgacgcgctgacggcggaggcgcaccggctgggtctcaaggtgatgatcgacgaagtgctgtcgcacacggccgacatccatccctggttcaaggaaagccggtcgagccgcagcaatcccaaggccgactggtatgtctgggcggacgcccggcccgacggcaccccgcccaacaactggctgtcgatcttcggcgggtccgcctggcagtgggacaccagccgccagcaatattacctgcacaatttcctggccgagcagcccgacctcaacttccacaaccgcgaagtccaggacgcgctgctcgacgtcacccgcttctggctggaacgcggcgtcgacggcttccgcctcgacacgatcaatttctactttcacagccagggcctggaaaacaatccgccgctgccgccggaagaacgcaacgaccagaccgcgccggcggtcaatccctacaactaccaggaccatctctacgacaagagccgtccggaaaacctcggcttcctcgaacgcttccgcgctttgctcgacgaatatccggcaaccgccgctgtcggcgaggtcggcgattcgcagcgtgggctggaagtcgtggcagcctacactgccggcggcaagcgcgtgcatatgtgttattccttcgacttcctggcgccggaaaagatcagcgccgccaaggtgcgttcggtgctggaggccttcggcaaggtcgccagcgacggctggtcgtgctgggcgttttccaatcatgacgtgatgcgtccggcctcgcgctgggccgccggcgaagccgaccctgtcgcctatctcaaggtcatctcggccttgctgatgtcgctgcgcggctcggtctgcatctaccagggcgaggaactcgggctgggcgaggccgaattgcgcttcgaggatctgcaggatccctatggcatccgcttctggccggaattcaagggccgcgacggctgccgcacgcccatggtgtgggatggcgacgccaagaatggcggcttctcccaggccaagccctggctgccggtgccggccaagcatctggcgcaagcggtcaatgtccagcagggtgaccaggcttcactgctcgagcactatcggcgcttcctcagcttccgccgcgcccatccggcgctggccaagggcgacatcaccttcatcgaaagcgagggcgacaccgtcgccttcacgcgccgcgccggcaacgagcaggttgtctgcgtcttcaacctcggcgccaagccggccaaggttgaccttggcagccgatccctgcaacctttgccgggacacgggttttccgggcaggcgaggcccggttcgatcgagcttggcggttacggcgcctggttcgggcgcatcgactga

SEQ ID NO: 35800 - DNA, 1383 bp, Mesorhizobium loti
atgcacaacagcgacagttcaaagacgcccatcggcggcatcagccgtgaccgcatcgcgcaattgcgcgagaccgaaggcgcggccttccgcaaggcgcggccgaaatcgcaggccaaggtcggcaacggcctgcccggcttcttcggcggcgtgccgatgcactggatgaacgactggccgacgccgtttccgatcctggtcgacagcgccaaaggcgctgcgatcaccgacatcgatggcaacaggctcgacgatttctgccttggcgacaccggctcgatgttcggccactcgccaccgccggtggcgcgcgcgatccgccgccaggccgggcgcggcctgacctatatgctgccttcggaagacgcgcttgccatcgggccgctgctgcagcagcgtttcggcctgccattctggcagatcgcgacgacggcgaccgacgccaaccgcttctcgctgcgcgtcgcccgcgccgtcaccgggcgcgaaaagatcctggtcttcaacggctgctaccacggttcggtcgacgagacgatggtgcggctgatcggcggcaagccggtcaaccggccgggactggcgggcgagttccgcgacctgacccgtacggcgaaagtcatcgaattcaacgatgttgcagcccttgaagcagccctcaaggacagggatgtggcctgcgtcatcgccgagccggtgctgaccaattcctgcatggtgctggccgacccaggcttccatgacgcgctgcgcagactgacccgcgagaccggcacgctgctcctgatcgacgagacgcacacgatctcgacaggtccgggcggctacaccaggaaatacgggctggagcccgacttcttcgtgctgggcaagccgatcgccggcggcgtgccggcaagtgtgtggggcatgagcgacgaggtcgcctcgcgctacgccgactacaacaggaccaaggagcctggctattccggcatgggcacgacgctgtcggccaacccgctgcagttcgcggcgatgcgcgccacgctggaagaggtgatgacggcggagaattatgaccgcatggaccatctggcggagcggctcgatgccgggctgaccggggtgatcgaccgctatcgcctgccctggcacgtcgcgcgcgtcggcgcccgcgtcgagttcatctgcgcacccggaccgttgcgcaatggcgccgaagccgagaccgcgcatgcgccggagctcgaggccgccatccacgtcgcgctggtcaatcgcggcgtgctgatcgcgcccttccacaacatgatgctgatctcgccggcgacgtcaggcgcccaggtcaaccggttgatcgccgccttcggcgcggttgcggcgaagcttgcggcgtga

SEQ ID NO: 35801 - DNA, 870 bp, Mesorhizobium loti
gtgacgcccggacatgaattttcgggcatcgtcgaggcaatcggcaaggccgtctccggctttgccgtcggcgatcgtgttaccggggatcccaacatcgcctgcggacggtgcccgcattgccatgccggccgggtcaatctctgccgcaatctcaacgccatcggcatccatcgcgacggcggctttgccgagtatgtcgtgctgccgcagaaacaggctttcatcctgccggccgatctgccgccgacgcatggcgccttctgcgaaccgctcggctgctgcctgcatggcgtggaccttgcgcagatcaagcctggcagttcggtggtcgtgctgggcggcggcgtgatcggcctgctgacggtgcaactggcgaaactggccggagccaccaccatcatcctgtcgacaaggcaggcttctcggcgggtgcttgccgaggaactcggcgcgacagcgacggtcgatcctaccgccggcgatgtcatcgatgccatcgcgggatccgagggcttgatgcccggcggcgccgacgtggtgttcgaatgcgctggcgtgcgcgacaccgtcgaacaatcgatgcggctggcaagggccggcggcaccgtcgtcatcgtcggcgtgacgccgcaaggcatgaaggcggaattcgagcccttcgacctgctgtttcgggaattgaaggtggtcggctcgttcctcaacccctacacgcaccgccgcgcggccgagctcatcgcttcgggtgcgatcgagatcgatcggctgatctccaggcaggtgccgctcgaagaggcggccgatgtgatcgccaatccgccagcgcccggcgaggtcaaggtgctggtggtgccgcgacagggttga

SEQ ID NO: 35802 - DNA, 1002 bp, Mesorhizobium loti
atgcaactcagtctcgaccaggcaagaggactgtgccggatggcggcactcggcgccggcgccaatgaggaggcggcgcagtcgctcaccgcgtcgatcatcgccgccgaggcggaagggctttcgactgtcggcctgtcgcatttcatcgactatctcgaagccctggaggccgggcgcatcgacggcaatgccgatccggtgatcaccaggccggcgctggccgtctacctttccgacgcacgcggcgggctggcgcataccggcttcgaccggacgatcgacgaccttgccaaggcggcaaaactgttcggcgtcgccatcttctcgcagaagaacgcctatacatgcggcgcgctcggctactttaccggaaggctggcggcacaggggctggtgtccttcgccgcgaccaacggcccggccgttcttgccggctcgggctcggtcaagccggtctattgcaccaatccgatgtcgtttgccgcgcccgccgccgacggcgcgccgctggtcatcgaccagtcatcgagcgccaccgccttcgtcaacattcgcaaggcggccgaagacggcaagaagatccccgaaggctgggcgctggacgccagtggcaacccgaccaccgacccggccgccgccatgaagggcgccatgcttgcctttggcggccagcgcggcgccaacatcgcgctgatggtcgaagtgttggctgcgggcatttccggggccaactggtcgctcgatgcgccctggttcaccggcgggcccgacagcccaggcaccggcctgttcgtgctggctatcgagcccaagctgctcgatccggatttcgaacagcgcatgaaggaccagctcgaccgcctgcgccgccgcttcggcgtgcatgtgccgggccgcgcccgggcggaagccgccgagaaggcgcaggcgcgcggcatcaccgcgcccaaggcggtggtgcagcgtatttccgaattcgccgagcgctattcgacctga

SEQ ID NO: 35803 - DNA, 1359 bp, Mesorhizobium loti
atgtctcacgccgccgctgccaagccggccaccgcccgcaaatctcaagccctttccggcaccgcgcgcgtgccgggcgacaagtcgatctcgcatcgctccttcatgttcggcggcctcgcctccggcgaaacccgcatcaccggcctgctcgagggcgaggacgtgatgcgcaccggcgcggccatgaaggcgatgggcgcgcatatcgaaaagcgcggcgccgaatgggtgatccgcggcaccggcaacggcgcgctcttacagccggaaggcccgctcgacttcggcaatgccggcaccggctcacggctgaccatgggcctcgtcggcacctacgacatggaaaccaccttcatcggcgatgcctcgctgtccggccggccgatgggccgcgtgctggagccgctgcgccagatgggcgtgcaggtgttgaaggcgacgcccggcgaccgcatgccgatcacgctgcatggtcccaagcacgccgccccgatcacctaccgcgtgccgatggcttcggcacaggtcaaatcggcggtgctgctcgccggcctcaatacgcccggcatcaccaccgtcatcgaaccggtgatgacgcgcgaccacaccgaaaagatgctgaaaggcttcggcgccaatctgtcggtcgagaccgacgagcgcggcgtgcgccatatcttcatcgaaggccagggcagactgaccggccagacgatcgccgtgcccggcgatccgtcctcggccggcttcccgctggtggcggcgctgatcgtgccgggttcggacatcacgatcgaaaacgtgctgatgaacccgacccgcaccggcttgctgctgaccctgcaggaaatgggcggccagatcgacattttgaacccgcgcaatgccggcggcgaggacgtcgccgatctgcgcgtgcgctattccgaactcaagggcgtcgcggtgccgccggagcgggcaccgtcgatgatcgacgagtacccggtgctcgctgtcgctgccagcttcgccgagggcgagacgctgatgcaagggctggaagaattgcgcgtcaaggaatccgaccggctgtcggccgtcgccaacgggctgaagctcaacggcgtcgactgcaccgagggcgaggcgtcgcttgccgtgcgcggcaggccgggcggcaaggggctcggcggccatcccaacggcctggatacgaccgtgcagacccatctcgaccaccgcatcgccatgagctttctggtgatgggactggcgacggaaaagccggtcaccatcgacgatcaggcgatgatcgcgacgagctttccggagttcatggggctgatgacggggctcggggcggagatcaggtga

SEQ ID NO: 35804 - DNA, 807 bp, Mesorhizobium loti
atgccggacaatgacgtcatccttgcagtggacacgatccatgccacctataaccacgccatcacggcgctgcatggcgtcagcttcgagatccggcgcggcgaaatcctggcgctgctcggcgccaacggcgccggcaagaccaccacgctgaaggcagtctccaacctgttgcccgccgagcgcggccaggtcaacgccggcaccatctgctatgacggcgccgatgtctcgcgccgcaagcccggcgacctcgtgcgcgccggcctggtgccggtgctggaaggccgccactgcttcaaaagcctcactgtcgaggaaaacctggtcgccggcggcatcggccgcagcggccgccgtgccgagatcaatcaggaccttgagcggatctacgcctatttcccccggctgaaagaaaagcgccggacattgtccggcctgacctcaggcggcgaacaacagatgacggcgatcggccgcgcgctgatgtcgcggccgcgcctgctggtcctcgacgaaccgtcgatggggctcgccccacttatcgtccaggacatcttccagacgctgagaaaactgaaccgcgaaaccggtctgtcgatcctggtcgccgagcagaactcggcggtcgcgctacgatacgccgaccacgccacggtgctcgaaaacggcgtctccgttctctccggcgccgctgccgatcttcgccagcgcgaggacgtgcgcgccttctatctcggtcaatcgaccaccggccaacagccctcgccggctgccaaaccagcccatctccatgccgtcgcttga

SEQ ID NO: 35805 - DNA, 1248 bp, Mesorhizobium loti
atgaccgtctcgaccgtcaagaccgaccatgcttccgccgccgtgccgccagtcgcaaggccagccgtaccggcgcacatcatcagggatgacgccgaggcgattgcgatcgcccatgcgctcgccgccgaattcgtcaaggagtcgtccaggcgcgaccgcgagcgggtctggccagtcgccgaactcgacgccttctcgcagagcggactgtggtcgatcaacgtgcccaaggcattcggcggcccggaagtatcctacgcgacgctggccaaggtgatcgagatcatctcggcggcggattcctcgatcggccaaatcgcgcagaaccatctcggcgtcgtcgccgcgatccgcaccgtttccgacgcggaccagcagaagctgctgttcgccgaggtgctgaacggcacgcggttcggcaacgccttttccgaattcggttccaagcgcgccgccgatttcgagacccgcttcaccgatgcgggcgaccacgtcgtcgtcaatggccgcaaattctattcctccggcgcgctgcttgcccatctggtgccgatcgtggcgctcgatgacgagggccgcgcctggtatgcgatcgccgaccgtggcgcgccgggactgaccgtcatcgacgactggtcgagctttggccagcgcacgactttgtccggcaccgtcatcatcgacaacgtcaaggtgccgaagacttttctcgtacccggctacaagggctacgaccgcccaaccgccgacggcgccatcttccagatcatccaggtggcggtcgacacgggtatcgcccaggcggccatcgacgaaacggttcatttcgtcaggaccagaagccgtgcctggatcgacagtggcgtcgacaatgcctgggacgatccctacacgatccaggcggtcggcgacctgacgctgcgcctgcacgccgcgcaggcgctgcttgaaaaggccggtctggcgatcgacaaggctgtggccgagccgacggccgagacggtggcgcatgcgcagatcgtcaccgcagaagcaaaaatcctgtcgaccgagatcgcgatcgccgccaccaacaagctgttcgaactggccggcacgcgctcgacgctggccgagcacaatctcgacaggcattggcgcaatgcccgcacccacacgctgcacgatccggtacgctggaagtactcgatcctcggcaaatatttcctcaatggcgaaaatccgccgcttcacgcctggagctga

SEQ ID NO: 35806 - DNA, 1440 bp, Mesorhizobium loti
atggcacaatttcgaaagaacctcatcgatggcgaatgggtcggcgacgccgggtcccacaacatcaacccttcggacacaggcgatgtcgtcggcgaatatgcctcggcgggggtcgaacaggccaagcaggccatcgcggcggccaaggcggcgtttccttcatggtcccgctccggtccattggcccgccatgcggtgctgaagaaggcctccgacgagatcatggcgcgcaaggacgagatcggccgcaatctggcgcgcgaggaaggcaagacgctggccgaaggcattggcgagaccatccgcgccgcccagatattcgatttctttgccggcgaaacattgcgcctgaccggagagatggttccgagcgtgcggccgggtgtcggcgtcgaaatcacccgcgaggctgtcggcgtggtcggcatcatcacgccgtggaatttccccatcgccatccctgcctggaagatcgcgccggcactcgcccatggcaacaccatcgtcttcaagccggccgagctggttccggagagcgcctggtccatcgtcgatatcctgcatcgcgccggcctgcccaagggtgtgctcaacctcgtgatgggcaagggctcggtggtcggccaggcaatgctcgacagccccgacatcaacgccatcaccttcacaggttcggtcggcacgggaaaacgcgtcgccgcggcaagtgtcgagcatatgcgcaagttccagctcgaaatgggcggcaagaacccgctggtcgtgctcgacgacgccgatcttgcggtcgccgtcgattgcgcgctcaacggcgccttcttctcgaccggccagcgctgcaccgcctcgtccaggctgatcgtgaccgaagatatccatgaccgtttcgtcgaggcgctgaaggagcggatgggcaaactggtgatcggcgatgcgctcgatgcgcagacccagatcggcccagtcgtcgacgcgacccagctgaagcaggacgaggactatatcgcgatcggcgtcagggaaggcgccacgctcgccttcggcggcgaacggctcgaccgcaagacgcccggcttctatctcagcccggccctgctgaccgaagccaccaatgccatgcgcagctcgcgcgaggagattttcggacctgtcgccagcgtcatccgcgtcaagaattatgacgaggcgctttccgtcgccaacgacacgcccttcgggcttacctcgggcatctgcaccacgagcctcaagcacgccacgcacttcaagcgcaattcggaggccggcatggtgatggtcaacctgccgacggcgggcgtcgatttccatgttcccttcgggggccgcaagggctcgagctacggcccgcgcgagcagggccgctatgccacggagttctacaccacggtgaagaccgcctatacattcgcaggctga

SEQ ID NO: 35807 - DNA, 1530 bp, Mesorhizobium loti
atggcgcgtgaacagacaaaggcggccaccttcccagtcgaccgcaatgacgtcgaactggtccgaggcgcgcatccgccgcgctggaagaaccctactcccgacggtccctacaatctcgtcgtcatcggcgccggaccggccggcctgaccgcggcacgcgacgccgcaagccttggcgcaaaggtcgcactgatcgagcgcgggctgatcggcggcgcctgcgtcaatgtcggcggcgtcccctcgaagtcgatcatccgcacggccaggctctatgccgatatgcgcgatgccgagaatttcggcggcgacacgccggcgcgtcttcccgtggacttcgaacgggccatgatgcggatgcggcagatccggcagcggctcagccgcgccgattcggccgcggccatcacagccgaaggcatcgacctctatttcggtgaagcgcgctttggcggaccggacacggttgaagtcgccggcaagacgctgcatttcaagaaggccctggtcgcgaccggcgcgcatccgagcgggccggcgataccgggacttgccgaggccggctatctcgacaatgagagcatgttcaacctcacgcggcgtcctgagcggctcctggtcatcggcggcgggccgcttggctgcgagacggcgcaggccttctgtcttctcggcgcgaaggtcatcctggcgcagagcgacccgatgttcctgcccggcgaggaacgcgacgccgcgcagatcctttcggacacactggcgcgcgagggggtggaggtgcgcctgaacaccgaggtggtggcggtacgcaaggaaggcggcaggaagctcgccgatcttttgcgggacggcgacacgacaacgatctccgttgacgagatcatcaccggcgtcggccgttcgcccaatgtcaggggtctcggactggaagaggccggggtggtgtatgacgccaacggcatcaaggtggacgatcatttgaggaccaccaatccgcacatctacgcggcgggcgatgtgtgcctggaatacaagttcactcataccgccgaggcagcggcacgcattgtcgtgcgcaatgccctgtttcgcgggcgcgaaaggctcagtgacctcgtcgttccctggtgcacctataccgatccggagatcgctcacgtcggtctttatccgatcgaggcgcggcagaacggcattccggtcaagacctatacggtgctgatgcatgatgtcgcccgcgccgtgatggacggcgaggaggaagggttcgtcaagatccatgtccgggagggatccgaccgcatcctgggggcgacggtcgtcgccagccatgccggcgagatgatcaatgcggtgacgcttgccatcaggtcgggcatgggattgcacgccctggccgacgtcatccatgccttcccgacgcaggcacaaggcatcaagatggcgggcgacgcctacaggcgaacccggttcacctccttgcgcaggcgtctggcggcgcgctggctggcctggtcgaggcgatga

SEQ ID NO: 35808 - DNA, 750 bp, Mesorhizobium loti
atgccgaacttcgcgggacgcttcgctggccggtcagccgtcatcaccggcggagcctccggcatcggactggcagtcgcgcaaaggatcgtcgaggaaggtggacgcatcagcgtctgggatcgtgatccggcccagatcgaacaggcgaaaactgtcatccctggcctgcatggtgttgccatcgacgtcgccgatgccgccggcgtcgaaggcgccgccgcacggacgatcgaagcccttggcggcgtcgacatccttgtgaccagcgcggccatcaccgggccgaacatgacgacctgggcctattcgaccgaggactggcagaaggtcatcgacatcaacatcaacggcgtcttctactgcaacagggcgctggtgccgcatatgctcgagcgcaattatggccgcatcgtcaacatcgcctcgattgccggcaaggaaggcaatcccaacgcttccgcctacagcacgtccaaggccgccgtgatcggcctgaccaagtcgctcggcaaggaactggccaagaccaaggtgacggtgaattgcgtgacgccggcggctgtgcgcacagcgatcttcaagcagatgagccaggagcacatcgacttcatgctgtcgaagattccgatggcgcgcttcggcgaggtcgaggaagtggcggcgctgatctgctggatcgcctcggaagaatgctcattcacgacggccgccgtcttcgacgtttccggcggccgcgccacttattga

SEQ ID NO: 35809 - DNA, 828 bp, Mesorhizobium loti
atgacaaaccttgcagggcgcggtgcaatcgtcaccggcggcttttcgggcatgggcttcgccattgcctcggccttggctgaagctggcgccaatgtcgccgtcgggtcctacatcgcgcctgccggcaccgacagatccgacgccgcctattatccgggcatcgacgaaatcgagcgcgtgcggtcggccttgtctgcccatggcaccagggtgcacgctgctcacctcgatgtccgcgacagcgaggtcaccaaccgtttcgtcgccgaagccgaggccgccatcggtcctgccgacatcctggtcaacgcggccggcaccaccaccgagcaaccggtttgcggacattccgacgcgctgtgggacaagatcgtcgacaccaacctgaccggcgccttccgcaccacccgtgccgtgcttcccggcatgatcgcgcgcggctggggccgcatcgtcaacatcggctcgaccgcggcttccgtcggctggaaggacaaccccgcctactgcgcctccaaggccggcctgctcggcctcacccgctgcgtggcgctggagggggcggcgcacggcgtcacctgcgtcatgatcagcccgacctgggtcgagaccgaattgatgcgccgcaacgtggcacaggtcgtcgagcgcgagggcaaggggcggacggcgcagcaagcgatggccgagatcgccaagggcaacccgcagcagcgcatgctgcagccgcaggaaatcgccgcactggccgtattcctgtgctcggacctggccaaaggcatcaccatggaaaacatacagatcaccggcggagcactctggtag

SEQ ID NO: 35810 - DNA, 1842 bp, Mesorhizobium loti
atgtcgaaatcctcgatccttcgcctgtcgctgtttcgcgatgtcgccgcgttcggcgccgtcatcgcccagatcggcgggcggcgaacctggacggcgctactgttcctgatcctcggcagcctgacggaaggcatttcgatcttgctgcttgtgccgctgctgcatctggtcggccgcgccgaccaggatttcgcggtgcggctgccgagcaatgatttcgtgcgctggctggtgccggacggaacgctgcagctgaccaccgtgctgtgcgcgctggtcgggctcgttgccgtgcaggcagcgttcaaccgcttcaagtcggtctacatggccaggcttctcttcgatttcatcaaccgtttgcgcatgaacctgttcgagagcatcggcaaggcgcgctggggcgtcttctcgcgcatgcgcagttccgatctcgaccatgccctgaccggcgacatcgatcgcgtccagggcgccgccttctcgcttttgatgctggtgcagatcgcggtgcttttggtgggctatctcgtgatctcgatgttcatctcgccggtcatgacggcgtttgcgatcgtcatcggcatcatgatgttcatagcgctgcagccgtttcgcgcgcgcgcgaccgctttcgggcgtgtcctgaccagcaaccgccaggatcagtaccgcacggtctcggagttcctcggcggcatcaaggtggccaagagcctgaatgtcgaggccagttatttcgcgcagttgcagtcgacgctggaaaagatgaaggccgacaacatcgactatgtccgcaacagttcgatcggcaccgccgtgttccaggtggcgagcgttgtgggcctcagcctgttcatctatgtggcgctggtccgcttcaacctgtcactggccgagattgtcgtgctgcttctcgtcttcatgcgcatcgcgccgcgcttcatggacatgcagacgcaggcccagcaggtgctgatcaacctgcccgcctatacggccatgcgcagcctgcaggcccgtttcgacgccgagcgcgagcccggccatgcccaatccgaggatatgcaaaagctgtcgctcgataccgggctgaacattcgcggcgtctccttcagctacgatgactcgggcaaggcggtggtgagcgacatcaccttcggcctgccggccggcaaggtcacggccctgatcggcccttcgggatcgggcaagagcacgatcgccgacatgctgctcgggctgctcgagccgaccgccggcaagatcctggtcgacggcgtcgagatcgatgccggcaatcgccggcgctggcgcgatcaggtggcctatgtgccgcaggacgtgttcctgctgcatgacacgatcgcggcgaacctgcgcctggccgcgccccaggccagcgacgacgatctgtggacagtactgcgcgccgcgcatgccggtgacttcgtcgaacggctcgaccagcggctcgagaccgtggtcggcgatcgcggcgtgcggctctccggcggcgagcgtcagcgcatcgcgctggcgcgtgcgttgctgcgcaagccgtcgctgctcatcctcgatgaggcgaccagcgcgctcgactggcagaaccagtcgctgatcgcccggtcgatcgacggattgcgcggcgcgatgaccatcctgaccatcgcgcaccggccatcgatgattgctttcgccgactgggtggtggcgatggaagacggccgcatcgtggaggtcggccagtatcagcgcctgaaggcgaagccggcgagccggctgtcgaggatgctgtcgggggaacagtcggaaaccgaacccgccaatgtggcctga

SEQ ID NO: 35811 - DNA, 1332 bp, Mesorhizobium loti
atgaacttgacggtgtttggaattggctatgtcggcctcgtgcaggcggcggtgcttgccgaggttggccaccaggttgtttgcgtcgatatcgacgaaaacaaggtggagcgcctcaaccagggcttcgtcccgatcttcgagccaggcctagaaagcctcgtccgggagaaccacgccgccggccgcatcaaattcaccaccgatgccgcagccgccgtccggcatggtgaaatccagatgatcgcggtcggcacgccgcccggcgaagacggttcggccgacctcaaatatgtgctggcggtcgccgagaccatcggccgtgaaatggacaccgccaagatcgtcgtcggaaagtcgaccgtgccggtcggcacctgcgaaaaggtgaaggccaagatcgccgagacgctgaagaagagagggcgtgaagacctgagcttcgacgtcgcctccaatcccgaattcctcaaggaaggctcggccgtggccgactgcatgaggcccgaccgtatcatcgtcggcacttcgagcgaggggaccgaggcggtgatgcgcgaactctacgcgcccttcaaccgcaaccatgaaaagatgatcgtgatggacgtgcgcagcgccgaattcacgaaatacgccgccaactgcatgctggccaccaagatcagcttcatgaacgagatggccaacctggccgagcagctcggcgccgacatcgaggaggtgcgcaagggcatcggcagcgatccgcgcatcggctaccactttatctatccgggtctcggctatggcggctcctgctttcccaaggacgtccgcgccctgatcaagaccgccgagggcgtcaagttcgacgccaagctgctgcgcgccgtcgaggagcgcaacaacgaccagaaatccgtgctgttcgacaaggtgaaccgctatttcaagggcagtctcaagggcaagacctttgcgctctggggtctggccttcaagcccaacaccgacgacatgcgcgaggcgccggcgcgtgtcctgatggaagcgctatggaaggccggagcaaccgtgcaggcctatgaccccgaggctatgcaggaatgccaggccatctacggcctgcgcgacgacctgcttttgtgcggcaccaaggaagcggcactgcgcggcgccgatgcactgctcatcgccaccgaatggaagagttttcgagccccgtcgttcgatgcgttgaaggacgcgctgaccacgccggtcatcttcgacggccgcaacctctatgaccccaaggtcgtggcgcgttacggcatcgaatatcactcgatcggcagaatggcggcatga

SEQ ID NO: 35812 - DNA, 897 bp, Mesorhizobium loti
atgaagaaaatcaggaaggccgtgataccggtggcggggcttggaacacggttcctgccggcgaccaagtcgatgccgaaggaaatgctcccggtggtcgacaggcccgtcgtgcaatatgcggtggacgaggccttcgaagccggcatcgagcacatcgtgttcgtgaccggccgcaacaaggcggtcatcgaggactatttcgacctgcatccggaattgatcggaaccttggagcagaccggcaagaagacccagctggaggcgctcgaaagcatgctgccggtggccggcgccacctccttcatccgccagcaatccccgcagggcctcggccacgccgtctggtgcgcccgcgaggtcatcggcaacgaacccttcgctttgcttttgccagacatggtctccttcggcgggcgcggctgtctggccgaaaccgtcgacctctatgagcgcaccggcggcaacgtcatcgccgtcgagcgttgtgatccgagcgagaccaacaaatacggcattgtcggccgcggcgccgacattggcggcggtttcgaggtcacggccatggtcgaaaagccggccccggccaacgcgccgtcaaatttctacatcaacggccgctacatcctgcagcctgagatcttcgcgctgctgggcaaccagcagcgtggcgccggcaacgagatccagctgacggacgccatggttcgcctgtcgaaggaccagccgttctttgcccagcctttcctgggccgcatgttcgactgcggatccaaggaaggcttcatccaggccaacatcgccttcgcgctggcgcgcaacgacatgaagggcccggttttcgagatgcttcaggagttcgtccggtcgcatgaacgtcaggaagaagccgcataa

SEQ ID NO: 35813 - DNA, 735 bp, Mesorhizobium loti
atgaccagactgaatggaaagaccgccgtcatcaccggcggcgctaccggcatcggccgcgccgcggcaacgcgcttcatcgaggagggcgccttcgtcttcatctatggccgccggcaggaagcgctcgacgccgctgtggccgacctcggggccaatgcccgcgcggtgaagggctcggtctccgatctggccgacctcgaccggctctacgcggcggtgaaggccgagcgcggaaccctcgatatcgtcttcgccaatgccggggccggaggcccgcttccgctcggccagatcaccgccgagcacattgatgaaacattcgacaccaatgtgaagggtacgatcttcacggtccagcaggcgttgccgctgatgggcccgggcggttcgatcatcctgaccggatcgagcgccggcaccacgggcgccccgggattcactgcctacagcgcgagcaaggcggccgtgcgcaacctcgcacggacctgggccgaggatcttaagggcaccggcattcgggtaaacgtgctgtcgcccggggcgacggcgactgaactcgcaaaggaagcgctgggcgaggagggccagaaggcctacggcgcgatgaccccgctccagcgcatggccgatccggcggagatcggggccgtggctgcctttctcgcgtcgtcggacagcagcttcatgaccgccagcgaagtcgccgtcgacggcggcctggcgcaactttga

SEQ ID NO: 35814 - DNA, 753 bp, Mesorhizobium loti
atgaaaaaactcgaaggtaagatcgcagtcatcacgggcggaagcagcgggattggattggccacagccaagcgcttcgtagaagaaggagcgcacgtcgtgatcaccgggcgaagagagaaagagttgaaggaggccgcagccttcatcatgagaaacgttacgacggtcgtgggtgacgtgtcgctcttggaagatctggatcgcctctatgccgtcgtgaaagagaaacatggtcacatcgacgttctcttcgcgaacgctggcgcggggacaatcgcaccgctcgcggcagccactgaggcccacttcgatcagaccttcgacgtgaacgtgaaggggctgttcttcacggtgcagaaggcccttcccctcttcaaagacggcggttcgattattctgaattcttcggtttcgaacgtgttgggattgccggggtttagcacatacgccgcgagtaaggcggcggtgcgcaacttctcgcgcgcttggacgctagagctgaaagaccgcaaaatccgagtgaatacgatgagccccggagcaatcgagacccctgcgttggagacaacaacgggccttacccctgagcaagccgagcaagcggtcgcccagtttgcgtcacagatcccaatgggtcgcaggggcaaaccggaggaaatcgcggctgccgtcacgttcctcgcctccgacgacagttcctacgtcaccggtgtggatctcgccgtcgacggaggcatggcgcaggtctaa

SEQ ID NO: 35815 - DNA, 1929 bp, Mesorhizobium loti
atggttcctgggaggttgccgatggcttcacgctatcacgaggtctatgacggctggaaacgcgacccggaaaaattctgggcggacgccgccggcgccatcgactggtattcgccctgggacaaggtgttcgacgctgacgccggcgtctatggccgctggtttaccggcgcgacatgcaacacctgttacaacgccatcgaccggcatgtcgcccgcgggcgcgccgaccagatcgcactgatccatgacagcgccatcaccggaacggtgaaaaaattcacctatgccgaactcaagcgcgaggtggtggcgctgacctcggtgctgaagaaccggggcatcggcaagggcgaccgcgtcatcatctacatgccgatggtggcggaggcggccatcgccatgcttgcctgcgcccgcatcggcgccgtgcattcggtcgtcttcggcggctttgcctcgcatgaactggccacccgtatcgacgacgccaagccgaagctgatcatctcggcctcctgcggcctggagccgggccggatcgttgcctacaagccgctgctcgacaaggcgatcgagatgtccggccacaagccggacgcctgcctgatcctgcagcgcgaccagctgcgctgcgagctgaaggagcatttcgacatcgactatgccgacgccgtcgcgcgcgaacgggcggccggcgccaatgtcgactgcgtgccggtgctggccaccgacccgctctacatcatctacacgtcaggcacgaccggccagccgaagggcatcgtgcgtgacaatggcggccacatggtcgcgctgaaatggacgatggaaaacgagttcggcgtcaagccgggcgaagtgttctgggcagcgtccgatgtcggctgggtcgtcggccattcctacatcgtctacggaccgctgctgcatggcagcaccagcgtcctgttcgaaggcaagccgatcggcacgcccgacgccggcacctactggcgggtcatctcggaccatggcgtggtcgcgctgttcaccgcgccgacggcgttccgggcgatcaagggccaggaccccaagggcgagttcgttcccagatacgatctgtcgaaattccgcacgctgttcctcgccggcgagcgcgccgatcccgagaccatcaaatgggcggagcagaagcttaacgtgccggtgatcgaccactggtggcagaccgagaccggttcgccgatgaccatcaatcccgcgggacttggcctgctgccggtgaaatacggttcgcccggcgtaccgatgccgggctacgacatccgcgtgctggacgatgccggccacgaagtgccgcgcggcacactcggcaatgtcgtggtcaagctgccactgccggccggctgcctgccgacgctgtggaacgccgacgcccgcttccgccaagcctatctcgacgagtttcccggcttctacaagacggcggacgccggcatgatcgacgaggacggctatctctacgtgatggcccgcaccgacgacatcatcaatgtcgccggccaccggctgtcgaccggcgccatggaagaggtgctggccgctcatcccgatgtcgccgaatgcgccgtcgtcggcatcgccgatgctatgaaggggcaaattccgctcggcttcgtggtgctgaacgccggtgtcgcgcgcggcggcgacgtcatcgagaaggaggtcgtggcactggtgcgcgagcgcatcgggccggtcgccgctttcaaaacggtggtgacgatcaaacgcctgcccaagacgcggtcgggaaagattctgcgcggcaccatgcagaagatcgccgacaaggaggcgtggacgatgccggcgacgatagacgacccggccatcctcgacgagatcaccgcagcgatgaaggcgcgcgggatcgggatttga

SEQ ID NO: 35816 - DNA, 1584 bp, Mesorhizobium loti
atgcgggccatgcggattgagggtgttccggcctcggccggctatgccgaggggccgctgttcgacctcgaccggccgccggccgtctacgcaggcaaagccacattagcggaagagaagacgtcgctgcaagccgcgatcggcacggcagtgagccggctttccgccatggcggaggcagccgacagcgacgccgccggcatactcgaattccacattgccatgctggaagacgacgccttgagagggccggccttcgcgtcgatcacgtccggacagaccgccgacgtggcatggcgagaggcgctcgatgccgagatcgccggttacgaggcctccgaccaggactatttccgtgcccgcgccacggacctgcgcgatatcagggaccaagtgctgcgtgccctgaccgaggacgtcgacagcgcggcgcctaccggtgccatcctctgtggcgaggacatcgcgccgacgcgctttctcgaaaccgactggagccatggcggcggcatcgcgctgaaggcgggcagcaccgccagccacgtcgccatgctggcgcgctcacgtggcgtgcctatggtcgtgggtctgcgcgaaatgtctgccagtcctgccggcatggcactgctcgacgccgagcatggcagcatcgtgctggcgccctcgccggcggagatcggcgcgttccggcagtcatccgcttccttcgcggcccgtcagggcaaggcgcagcgttttctggcgcggccggcggtgaccaaggccggcacggcggtgcgcgtgcaagtcaacatcgccgacccatccgatgtcgacggcattgacgtcgcgacctgcgacggggtcgggctgatgcgaacagagttcttgttcggcaagaatttgccggatgaggagacgcaataccgcgcctatcgcaaggtgctggaatgggccggggaaaaaccggtgacgatccgtactgtcgatgcgggcggcgacaagccggtgccgggcttcaccgtcgaggaaggcaatccattccttggcctgcgcgggatcaggctgtcgctggcgcggctcgacatttttcgcatacagatcagggcattgctgcgcgccgcgccacacggcaatctcagagtgatgtttccgatgatcgccatggccgacgagtatgagcgcgcagccgccctgttcgccgaagagcaggcagcccttgccgcgggcggtgtcgcgcaaaagatgccgccgctgggcatcatggtcgaggtgccgtcggtggccatcgcgcccgaggccttcgccggcgtggccttcttctcgatcggctccaacgatctgacgcaatatgtgatggcggccgcgcgggataacgctgctgtggcccatttcaattcggtccgccacccggcggtgctgcggctgatcggctcggtcgccgcctttggacgggaaaacggcattcccgtcagcctgtgcggcgatgccggcggcgatccggcagcgatcccgtcgctgctcgaagcgggcctgcgcgatctgtccgtcgcgccggcgcaactcgccatggccaaggcggccatcgcggatgtttcggtctag

SEQ ID NO: 35817 - DNA, 1644 bp, Mesorhizobium loti
atgaagcactttttcaaccgcagggaaacgatcgtcaccgaggcgctggacggcctgttgcgcaccatcggctcaggcgatctcgcgcgcctcgacggctatcccgagatcaaggtcgtgctgcgcgccgactgggacaagtcgagggtcagcgtcgtttccggcggcggcgccgggcatgagccttcgcatgccggctttgtcggcaagggcatgctgacggcggcggtctcgggcgagatcttcgcctcgccgagcgtcgaagcggtgctcgctgccatccgcgcggtcaccggcccggccggctgtctgcttatcgtcaagaactacaccggcgaccggctcaatttcggcctagcggcggaaaaggcgcgcgccgagggctttcgcgtcgagatggtgatcgttgccgacgacatcgcgctgcccgatatcgcccagccgcgcggcgtcgccggtaccctgttcgtgcacaagatttccggccatctgtcggaggccggccacaatctggctgatatcgcggcggcggcacgggcggcggcaaaggatatcgtttcgctcggcatgtcgctgtcctcctgttccatccccggccagccgcatgaagacaggtttggcgcggacgacggcgaacttggccttggcattcatggcgagccgggcgtcgagcggattgccttgcaaagcgtcgacaggctggtcgcgatcatggcggagcgcctcgcagcagggctcgacccgaaggcgagccatgccttgctgatcaacaatctcggcgcggtgccgcccctcgaaatgtcgctgattgccaatgcggtgctagcctcgccactggccaagactgtcaagctgacgatcggccccggcccgctgatgacggcgctcaacatgaacggcttctcgttgtcgctgatccggctcgatgcggcgcgcgaagcagccctgctggcgccggtcggcccgcatgcctggatgccggccaagccggtcgcggcacctgtcatcgtgccgatggcgaaggcagccggacaaagtgttgcgcacaaggccagccaggatgccagcagcaggcgcctgatcgtcacggtctgcgaaaaattgatctcgctcgaagcgtcattgaacgggctcgacgccaaggcgggcgacggcgacaccggctcgacggtggcgaccggcgcgcgcagcatcctggaacggctcgacgtcctgccgctggcgaaccctgcggcgacgcttggcgcaatcggcgacatattgagttcgtcgatgggcggctcgagcggggtgctgctgtcgatcttcttcacggcggcggcacaggtcctcggtggcggcgccagtctgtccaaggcactgcttgccgggctcgagcggatgactttctacggcggcgccaaaccgggtgatcgcaccatggtcgatgcgctggagcccgcgctaaaagcgctcgacgccgatggcctggaggaggcagcggccgccgcccagcgcggggccgaggcgacagccgccatggaaaaggcgaaggccggacggtcggcctatgtcggcaccaaattgcaaggcgtggtcgaccccggcgcccatgcggtggccgaggtgttttcggccgccgccacgctgctcgtcacggcctga

SEQ ID NO: 35818 - DNA, 2463 bp, Mesorhizobium loti
atgacgacaagatccctgccggagctcccggtatccgccgtgctgcaggcgctgggcgcggcgctggccgaacgcaacagcgccgtgctggtggcgccgcccggcgccggcaagacgacgctggtgccgctggcgctgctcgatgcgccgtggctcggagcgggcaagatcgttctgctcgagccgcgccggctcgccgcccgcgccgccgcacgtcgcatggcgcaattgctggatcaggagcccggtgcgaccatcggctatgccatgcgcatggaaaaccgtacctcggccaagacgaggatactggtcgtcaccgagggtgtgctggcacgcatgatcctcgacgatcccgaactgccggggatttcggccgttgtcttcgacgaattccacgagcgttcgctcgacggcgatttcggtctggcgctggcgctcgacgtgcaaggcgcgctgcggccggatctgcggctgctggtgatgtcggcgacactggatggcgcgcgcgtcgcaaaacttctgtcgggcgcgccggtgatcgaaagcgagggccgcgctttccccgtcgacataagctacgacgaacggcccgccggcgtcccgatcgaggatgccatggccaaggcgatccgtgccgcccttgccgatgagggcggcagcgtgctcgccttcctgcccggccagcgcgagatcgagcgcaccgccgaacggctggccggcaaggtcggcgccgacaccgacatcgtcccgctctatggccaactcgacggcaacgcgcaggacgcggcgatcaagccggcgccgccgggccgccgcaaggttgtgctggcgacgtcgatcgccgagacctccatcaccatcgacggcgtgcgtgtcgtcatcgattccggcctgtcgcggctgccgcgctatgagccggcgagcggcctgacgcggctggagacggtgcgcgtcagcaaggcatccgccgaccagcgcgccggtcgtgccgggcgcacgcaagccggcgtcgccatccggctctggcgcgccgaacagacggcggcactgcctgccttcacgccgccggaaatcctcgaagcggacctttcgggcctgctgcttgactgtgccgccttcggcgtcgccgacccgaccggtctcgccttcctcgatccgccgccggcgccggcgctcaacgaggcaagggtgctgctgcgcgcgctccatgccatcgacgaggcggggcgtttgacgcaagcgggcgcttcgatgcgcaagctcgctctgccggtgcggctggcgcacatggtcgccgaggccacgaagagcggtcatgccggcgaggcggccatgctggccgtactgctcaccgaacgcggccttggcggcgatggcgccgatctggagcggcggctgatgcgctttcgcggggaaagatcgccccgcgccaccgctgcgcggcaactcgcggagaggctggccaggcaggtgggcgggacgaaaaacagcgaagctgcacccgccggttctcttctcatcaacgcctggccggaccgcgtcgccaaggcgcgtggcgagcgcggccgcttcgtgctggccaatggctccggcgccatgctcgatgccgccgacccgctggcgggcgagccgtttctggtcgtcgccgacctgcagggcaaggcgcagaatgcccgcatcgcggctgccgcggcaataagcgaggacgacatccgcgccacgctggccgaccggatcgaaacacgccggcaaaccagtttcgatcgcgagcgtcgcgccgtgcgcgtgcgtgaaaccgtgcgccttggcgccatcacgctcgccgaacgcatgctgccggctccttcaggcgccgatgccgaccgcgccattctcgatgcgctgcgcgagcacggcctgtcgctgctgaactggagcaaggaggccgagacgctgcgccagcggctgtcctggctgcatcgtggccttgggtccccctggcccgatatgtcggacgaagcgctgatcgagcgcctcgacgactggctgctgcccttcctgtccggggcggcttccctggccgccatcaatcccggtgtcgtctcggccggtctggcctcgctcgtgccgcacgagctgcagcgcaagttcgatgcgctggcgccgacgcatttcgacacgccgtccggcagccatgtgccgatccgttatgacggcgaatggcccgtgcttgcggtgcgcgtgcaggaactgttcggcctcgaccgccacccctcgatcgccaacggcaccgtgccgctgacgctcgaactcttgtcgccggcgcaccggccgatccagacgacgcgcgatcttcccggcttctggcgcggctcctgggccgacgtgcgcgccgacatgcgcgggcgctatcccaaacatgtctggccggaaaatccgctgcttgccgccgccaccgcccgtgccaagccgcgcggcacctag

SEQ ID NO: 35819 - DNA, 846 bp, Mesorhizobium loti
atgccatccaccgtcagaaccaccacgctgccctctggcgaaaccgtccaggtgctcggccagggcacctggaagatgggtgaggattcgcgtcgccgtgccgatgaggtgaacgctctcaaactcggcctcgaccttggcctcacactgatcgacaccgccgaaatgtatgccagcggcggcgccgaagaggtcgtggctgaagccattgccgggcgccgcgccgaggtcttcgtggtctcgaaagttctgccatcgaacgcgtcgcacgcgggcgtgcagcgcgcctgcgagaacagcctcaagcgcctgcgcaccgaccgcatcgatctctacctcctgcattggccgggcagcgtgcctttggccgagacggtcgaggccttcgaggccgtgaagaaggccggcaagatccgccattggggcgtcagcaatttcgacaccgaggacatggacgatctggccggcttgcccgacggcagcaacgtccagaccaaccaggtgctttacaatctcgtccggcgcggccccgagttcgatctggcgccctggagccgcaagcgaggcattccactgatggcctattcgccggtcgagcagggcgcgctggcgcgcaatactgggcttgatgccgtcgccgcccgccacaatgcgactgccgcgcaaatcgcgctggcttgggtgatgcatcaggacggcatcatcgccattccaaaggccagcagccaggaacatgtccgccagaattttgcggcgctcgacatcaagcttacgccgcaggacatcaccgacctcgaccgtgcgttcccgccaccgacccgcaagcgtggcctggagatgatctga

SEQ ID NO: 35820 - DNA, 2730 bp, Mesorhizobium loti
atgaacatgcacagcccgaacgagcccgacgcccccgaggtgatgacgacgccgcagcccggcacggccgccgtcacgccgatgatggagcagttcatcgagatcaaggcggcgaacccggattcgctcttgttctaccgcatgggcgatttctacgagctgttcttcgacgacgccgaaaaggcgagccgggcgctgggcatcgtcctgaccaagcgcggcaagcaccagggccacgatatcccgatgtgcggcgtgccggtgcatgcggccgacgattatctgcagaagctgatcggccagggattccgcgtcgccgtctgcgagcagatcgaggatccggccgaagccaagaagcgcggctccaaatcggtggtgcgccgcgacgtggtgcggctggtgacgccgggcaccatcaccgaggacaaattgctggcgccgtcggaatcgagcttcctgatggcgctggggcgggtgaagggcggcagcgaccactcctttgcgattgcctggatcgacatctcgaccggcgccttccgcgtcgccgagaccaccgccgaccggctgctcgccgacatcttccgcgtcgatccgcgcgagctcatcgtcgccgagccggtgttccatgatcctgagctgaggccggtgttcgacgtgctcggccgcgtcgccaacccgcagccgccatcgctgttcgattcggcctcggccacgggccgcatcgcccgcttcttcgacgtggcgacgccggacagctttggtacgttttcgcgcgccgaactgtcggcgatctcgggcgccatcgcctatgtagagaagacgcagaaggccgagcgtccgccgctgtcgcggccggagcgcgaggagcagggttcgaccctgttcatcgatccggcgacgcgcggcaatctcgaactcttgcgcacgctctcgggaagccgcgagggctcgctgttcaaggcgatcgaccgcacggtgaccggcggcggcgcaaggctgctcgccgaccggctgatggcgccgctgaccgacccggcggcgatcggcgcgcgcctggattcggtgtcgttcttccgcaccgaaacccggctttgccaggcggtgcgggcgagcctgaagagcgtcgccgacatgccgcgcgcgctgtcgcggctggcgctcaaccgcggcggcccacgcgacctcggcgcgctgcgcgccggcttcgaggcggccggcgccatcgtcgaaatcttcgccgcaaccgccctgccccaggagttggcggaggcgatggccgccatccgggcgctgccgcaggcgcttgcccagcacctgattcaggcgctgggcgaggaattgccgcttttgaagcgcgacggtggtttcctgcgcggcggctatcacccggaactcgacgagatgcgggcgctgcgcgacgaatcgcggaaggtaatcgccgggctggagcgctcgctgatcgaggagaccggcatccgttccctgaagatccggcacaacaatgtgctgggttactacatcgaggtgaccgccaaccatcatgcgatcatgaccggcagcgatggcgccaaggcgcgctttatccaccgccagaccatggccaatgccatgcgtttcaccacgaccgagcttgccgaactcgagaccaagatcgccaacgccgccgaccgcgcgctcggcatcgaactggcggccttcgaggcgctgacggcgcaagcggtcggcgaggcggaaaagatccgtgccggcgccgatgcgctggcagcaatcgatgtctcggcggcacttgcgctgctttcggaaagcgaagcctggtgccggccggtggtggattcgagccttgccttcgaaatctccggcggccggcatccggtggtcgagcaggccttgcgccgttcgggcgagggaccgttcgtcgccaatgattgcgacctgtcgccggaggggaacgccaagaacggcgcgatctggctgctgaccggcccgaacatgggcggtaaatcgacgtttctcaggcaaaacgcgctgatcgccatcctggcccagaccggctcctttgtgccggcaacatcggcccatatcggcgtcgtcgaccggctgttctcgcgcgtcggggcttcggacgatctggcgcgcggccgttcgaccttcatggtcgagatggtcgagacggcggcgatcctcaaccaggccggcgaacgggcgctggtgatcctcgacgagatcggccgcggcaccgccaccttcgacggcctgtcgatcgcctgggcggcggtcgaatacctgcatgagaagaaccgctgccgggcgatcttcgccacccatttccacgaaatgacctcgctcgccggcaagctggcgcggctccacaacgtcaccatgcgggtcaaggaatgggaaggcgacgtcgtcttcctgcacgaggtcggcaagggtgccgccgaccgctcctatggcgtgcaggtggcgcggctcgccggcctgccggaagcggtggtcgaccgggccaagcaggtgctgcaccagctggaggaaggcgaggtttccggcaagaccaaccggctggtcgacgacctgccgctgttttccgtggccatgaagcgggaggcgccgaagccggtgaagagcgacgcgctcggcgccgccctcggcgacatcaatcccgacgagatgacgccacgggaagcgctggaggcgctctaccggctgaagggactggcggggaagtag

SEQ ID NO: 35821 - DNA, 1032 bp, Mesorhizobium loti
atggcaagaagccggctcgggtttttggcggagacattgatgccggattatgacgtgctttgcatcggcaatgccattgtcgacatcatcgcccagtgcgaggaggaattcctcgaaaccaacggcatcatcaagggcgcgatgaacctcatcgacacccaccgcgccgaattgctctacagccgcatgggtccggcgatcgaagcctccggcggcagcgccggcaacacggcggccggtgttgcctccttcggcggccgcgccgccttcttcggcaaggtctccaacgatgggctgggcgaaatctacacgcacgacatccgcgcacagggcgtcgccttcgacaccacgccgcttcagggtgagccgccgacggcacgctcgatgatcttcgtcacccccgatggcgaacgctcgatgaacacctatctcggcgcctgcgtcgagctcggaccggaggatgtcgaggccgacaaggcctctggggccaaggtcacctatttcgaaggctatctgtgggacccgccgcgcgccaaggaggcgatccggcagacggccaggctggcacatgccgcaggccgcgaagtctccatgacgctgtcggattcgttctgcgtcgaccgctaccgcgacgaattcctcgacctgatgcgctcgggcacggtcgacatcgtctttgccaacagccacgagatcaagtcgctctaccagacatcgtccttcgacgaggcgctggccaatatccgcaaggactgcagaatagccgccgtcacccgctcggaaaaaggctcggtcatcgtgcgcggcgacgagaccgtggtcatccaggcgacggcgattcgggagctggtcgacacgacgggcgccggcgacctctacgccgccggtttcctgcacggctatacgcaaggccgcgacctcaagacctgcggcgacctcggctcactggcagccggactggtgatccagcagatcggcccaaggccgcggcagaacctgcgccgcgaggcggaacaggctgggttgctgtag

SEQ ID NO: 35822 - DNA, 660 bp, Mesorhizobium loti
atgcaaatacccaagcttgtgatcttcgactgcgacgggattctcgtcgacacggagaatctcgccaatcgacgcctcgctgaatggttgacggctgccggctatccgacaagcttcgaatattgccgcaagaatttctccggccgcagcatggcctcggtccagaaagagatcgaggagacgaccgaggtccggctcggcgccgatttcgtcgagcgttggaatgccggcctgccggacctgttttcccatggcgtcgaggcaatcccttacgtccgcgagttcgtcgaagcggtgcgcgcggccggcattgcctattgcgtcgccacgtcggccaggatttcgaagatgcacatcacgcttggccagaccggactgttgccgctgttcgaacatgcgatgttttcgtcgaccatggtcgggcgcggcaagccgttccctgacctgttcctgcatgcggccaagaccatgggcttcgcgccggccgattgcatcgtcatcgaggacagcgtcgccggcacgcaggccgggatcaccgccggcatgcgggtgttctcctatcatggcgatccccattccgaccgcgatggcctgatcgaggccggcggcatcctgttcgacgacatgcgcgaactggccggactggtgccgatccactga

SEQ ID NO: 35823 - DNA, 1854 bp, Mesorhizobium loti
atgacgcagcggtttctttccagaagccgccaatggttccatccggcgacaactccctctataagccgccttcgtcagtccgctatcaaggatcagcctttgtttcgtttcttccgctcgacggaaaaccagcgactcgtcgcaaggttggtcagagaatcgttccgggagcacatgttcggatatggcgcggccattctttcgatgctggtggtggccggcatgaccgctgccagcgcctggatcctgcgcgaaatcaccaatgaattcgtgatcgacaagcgggtcgaccgcgtcaacatgattgccgcggccgtcgccgggatcttcgtcctcaaaggcctcgccaattttgtccaggcctatttcatgagccgggtcggcaatgccatcatcgccgaccggcagcgcaagatctacgaccgcatcctggcgcaaggcatcgaattctaccattcgacctcgtcgtcagacctgatcacccgtatgaccaacaatgcccaggcggcacgcaacgtgctcgacctgatcgtcacctcctatgtgcgcgacctggtgaccctgcttgccttgatcggtgtcatggtctggcagcagccggtgctgtcgctgatctgcttcgtcgccgggcccgtggccatctatggcgtcaaccgcatcctgaagcgcgtgcgcaacttcgccgccatggagttccgctcggttggccagatcgttcaggtgatgcaggaaaccgctatcggcgtgcgcgtggtcaagtccttcaacctcgaaagcttgatgcgcaagcgcatgtacaaggcggtggcggacgtcgaggatcgggccaacaacattgccgcgctggaagcagtgaccagcccggtgatggagacgctggccgggctggcgatcgccggcgccgtcatggtcagcggcttgctggttctgcagggcggccagatgcctggtaacatcatggcgttcatcgcggcgctgctgctcgcctatgaaccggcaaagcgcctggcgcgtgtgcgcatctcactggaaagcggcattgtcggcgtgcgcatgatgttccagctcgccgacgagccgctgacactggccgagaagcccgatgcaaagccgcttcgggccggaccgggcgagatccggttcgacgccatcagcttcgcctaccagaatgggccgccggtgctcgaccggttcgacctcacccttgaagcaggcaaaatgacggcgctggtcggcccctccggcggcggcaagtcgacgatcctgaacctgatcatgcgcatgtacgacccgaagagcggcaaggtcctgctcgacggccaggacatttcccatgccacgctcgcctcgctcagggaaaagatcgcctatgtcagccaggacacgttcctgtttgccggcaccatcatgcacaacatccggcttgggcggcaggacgcgaccgatgaagaggtgatcgccgccgccaaggccgccaacgcgcatgacttcatcatggcccaggcgaagggctacgagaccgatgtcggcgagaatggaggcctcttgtcaggcggccaacgccaacgcatctcgatcgcgcgcgccatgctgcgcaacgccgaaatcctgctgctcgacgaagcgaccagcgcgctcgacgccgaatccgaagcgctgttccgcgacgcgctgcagcagctgaccgacggacgcacgacaatcgtcatcgcgcaccgcctgtcaaccgtgcaccaggccgacacgatcgtggtgctggagggcggcaaggtggtggagagcgggccgcatcgtgctctgctcacgcagggcgggctttaccagaagctttatgaatatcagctgatgccgtag

SEQ ID NO: 35824 - DNA, 1428 bp, Mesorhizobium loti
atggacacccagatgctgatcggctcgaaattcgagaacggcgccgagaccgaggagtcgatcctcaatccgaagaccggggcaaccatcctcaatctgcccgaagccagccaggcgcagatcgaggccgcggtggcagccgccgaaaaagcgttcgtctcgtggtcgcgcacgacgccggcgcagcgctctggttatctcctcaagatcgccgaccgcatcgaggccgaggccaaggagttcgccgctctcgaggcgctgaactgcggcaagccgatcaattccgtgctcaatgacgagattccggccatcgtcgactgctaccgcttcttcgccggcgcggtccgttcgatgccgggcgtcgtcgccggcgaatatctgcccggccacacctcgatggtgcggcgcgacccgatcggcatcgtcgcctcgatcgcgccctggaactacccgctgatgatgatggcctggaagctggcgccggcgatcggcggcggcaacaccgtcgtcttcaagccgtcggagcagacgccgctgacggcgctgaggctggccaggatcctggccgaaatcctccccgaaggtgtggtcaatgtcgtgctcggccgcggcgacagcgtcggcaacgcgctgatcaaccatcccaaggtcaacatgatctcgatcaccggcgacgtcgccaccggcaagaaggtgctgcaggcggccgccaaatcggtcaagcgcacacatctcgaactcggcggcaaggccccggtcatcgtcttcgacgacgccgaccttggtgcggtggtcaacggcctgcgcgccttcggctattacaatgccggtcaggactgcaccgccgcctgccgcatctatgccggcaagaagatctacgacaagctcgtcgccgatctgtcctcggcggtctcgaccatcaagtacaaccagccggacgacaccgaaaacgagatcggcccgctgatctcgcgccgccagcgcgaccgcgtgtcgagcttcgtcgaacgcgcctctgaattgaagcacatcgagatcaccaccggcggcaggccgggcgagggcaccggcttctactaccagccgaccgtcgtcgccggcgcgctgcaggaggacgaaatcgtgcgccgcgaggtgttcggcccggtcgtctcgatcacccgtttcaccgaagtcgacgaagcggtgaactgggccaacgatagtgactacggcctggcgtcatcggtttggaccaaggacgtctcacgcgccatggcgacggcggcacgcctgcaatatggctgcacgtggatcaacacccatttcatgctgaccaacgagatgccgcatggcgggttgaaacagtccggctacggcaaggatatgtcgctctatgcgctggaagactataccgccgtgcggcatgtcatggtggcgcacgcatag

SEQ ID NO: 35825 - DNA, 2913 bp, Mesorhizobium loti
atgaacatcaaggccgacttcccatcgctcgtcgaagagatcgactacggaaccccggaatcgcgggcgcaaaagcaggtcacgctgaacgtcgacggccgcagcatcacggtgccggaaggcacctcgatcatgcgcgcggcgatggaaggcggggtcgagatcccgaagctctgcgccaccgacatgctggactccttcggctcctgccgcgtctgcctggtcgagatcgaaggccgcggcggcacgccggcctcctgcacgacgccggtcggtgaaggcatggtggtgcgcacgcagtccgaccggctcgacgccattcgccgcggcgtcatggagctttacgtctccgaccatccgaccggctggaacgagaaggccggcaccggcgccagcgaattcgacacggtggcgaagtcggtcggcctgaccgagaaccgctatggcgtcgagggccgcaaccacgtcaagcaggaagacggcgtggcgcccggccatggctcgctggcggtcgactacatcgcccgcgacgaatccaatccctatttcacctatgatccggcgcagtgcatcgtctgctcgcgctgcgtgcgggcttgcgaggaggtgcagggcaccttcgcgctgaccatcgagggccgcggtttcgaatcgcgcatggtcgccggcatgcatgaggatttcatcgcttccgaatgcgtgtcctgcggcgcctgcgtgcaggcctgcccgaccgacgcgctgcgcgagaagacggtgctcgagaagggcatgccggaacgctcggccgtcaccacttgcgcctattgcggcgtcggctgctcgttcaaggccgaggtgaaggacgacgaagtcatccgcatgatgccttacaaggacggcaaggcgaaccacggccatagctgcgtcaagggccgtttcgcctatggctacgctacccacaaggaccgcatcctgtcgccgatgatccgcgagaagatctccgatccgtggcgcgaagtgagctgggaagaggcgatcgcccatacggccaaggaattccgccggatccagtatcagtacggccgcacctcgatcggcggcatcacctcttcgcgctgcacgaatgaggagacctatctcgtccagaagctggtgcggcagggtttccgcaacaacaatgtcgacacctgcgcccgcgtctgccattcgccgaccggctacgggctcggccagacctacggcacctcggccggcacgcaggatttcgactcggtcgaattcaccgacgtcgccgtcgtcatcggcgccaatccggtttccgcccatccggtgttcgcctcgcggctaaagaagcggctgcgccagggcgccaagctgatcgtgctcgatccgcgccgcaccgagatggtcaagtcggcgcatatcgaggccgactatcacctgccgctgaagcccggcaccaacgtggcggtgctgacgtcgctggcgcatgtcatcgtcaccgaagggcttttcgacgaagccttcatccgcgaacgttgcgactggacggagttccaggactgggcctccttcgtcgccttgccggagaacagccccgagaccgtcggcaagctttccggcgtcgacccggatctgatccgaggcgccgcgcggctctacgccaagggcggcaatggcgcgatctattacggcctcggcgtcaccgagcacagccagggctcgaccacggtgatggcgatcgccaacctggcaatggccaccggcaatatcggccggccgggcgtcggcgtgaacccgctgcgtggccagaacaacgtccagggctcgtgcgacatgggttccttcccgcacgaactgcccggctatcgccacatctccggcgaagccgtgcgcgacatctatgagagcctgtggggcgtgaagctggacgacgaacccggcctgcgcatccccaacatgctggacgccgccgtcgacggctccttcaagggcatctacatccagggcgaggacattctgcagtccgatcctgacaccaagcatgtcgccggcggtctcgccgccatggaatgcgtcgtcgtgcacgatctcttcctcaacgagacggcgaactacgcgcatgtcttcctgcccggctcgaccttcctggaaaaggacggcaccttcaccaatgcggagcgccgcatcaacatggtgcgcaaggtgctggaaccgaaggcgcgctatgccgactgggaggcgacgcaggagcttgcccgtgcgatcgggctcgactggaactacacgcatccctcgcagatcatggacgagattgcccagacgacgccgagcttcgccaatgtctccttcgagctgctcgaccgcgtcggatcggtgcaatggccgtgcaacgagaaggcgccgctcggaacgccgatcatgcatatcgacggtttcgtgcgcggcaagggcaagttcatccgcaccgaatatgtggcgacggacgagaggaccgggccgcgcttcccgctgcttttgaccaccggccgcatcctcagccagtacaatgtcggcgcgcagacgcggcgcaccgacaacgtcatgtggcactcggaagaccggctggagatccacccgcacgatgccgaaaaccgtggcctgcgcgatggcgactgggtgcggctgaccagccgctcgggcgagacgacgctgcgggcgctgatcaccgaccgggtgtcgccgggtgtggtctacaccaccttccaccatccggacacgcaggccaacgtcatcaccaccgacttctcggactgggcgaccaactgtccggagtacaaggtgacggcagtgcaggtcggcgcctccaacggcccgtcggattggcagcgcgagtatgacgagcaggcgaggaacagccgccgcatcgcctcgctgcaggcggcggagtag

SEQ ID NO: 35826 - DNA, 1644 bp, Mesorhizobium loti
gtggataaatcagccttccagaaacagcttgccgccttgcgcgatcatcgctcggcggcacctgccagcatgcgccaggccttcgccgccgatccacagcgtttccaggcattcacagccaccgacggcgaccttttgctcgactggtcgaaatgcgccgtcgacgcaaccaccatggacttgctggaaaagctcgccgctgccgccgatctcgagggccgccgcgccgccatgttcgccggcaagaagatcaacatcaccgaagaccgcgccgtgctgcacacggcgctgcgcaatctcagcggcacgggcgtcacggtcgacggccaggacgtcaaggccgatgtcctttccgtgctcgacgcgatgggcgccttcgccgatgccatccgctccggcaaggcgctaggtgccaccggcaagaagatcaccgacatcgtcaacatcggcattggcggctccgacctcggcccggccatggcgacgctggcgctggcgccctatcatgacgggccgcgcgcgcactacgtctccaacatcgacggcgcccatatccatgacacgctgaaaggcctgtccgccgaaaccacgctgttcatcgtcgcctccaagaccttcaccacggtcgagacgatgaccaatgcgcagacggcgcgcgactgggtgcagaaggcgctcggcaagcaggcggtcggcaagcatttcgccgccgtctcgaccgcgctcgacctggtggccaagtttggcatcgaggcggaccgcgtcttcggtttctgggactgggtcggcggccgctattcggtctggggcgcgatcggcctgcccgtcatgatcgccgtcggtcccaggaattttcgcgccttcctcgatggcgcgcacgagatggaccagcatttccgcactgcgccgctcgccgggaacctgccggcgcttctcggcctggtcggctggtggcatcgtgtgatctgcggctatccggcccgcgcggtcatcccctatgaccagcggctgtcccggctgccggcctatctgcagcagctcgatatggaatcgaacggcaagggcgtcaccctcgacggcacgcccgtggcgacgccgaccgggccgctggtctggggcgagccgggcaccaatggccagcacgccttcttccagctgctgcaccagggcaccgacttcatcccggtcgagttccttgccgcggccgtcggccatgagccggagctcaagcatcagcatgatttgctgctcgccaattgcctggcgcaatcggaagccctgatgaagggccgcacgctggacgaggcgcgcgcgcagatgctggccaagggcatgaagccggccgatgtcgacaaaatagcgccgcatcgtgtcttctccggcaaccggccttcgctgaccatcctctatcgcaagctcgacccgcgcactttcgggcggctgatcgcgctctatgagcaccgcgtcttcgtcgagggcacgctgttcaacatcaattccttcgaccagtggggcgtcgagctcggcaaggagctggcgaccggcctgctgcctgtcgtggaaggcaaggaaagcgccgcaaaccgggacgcctcgaccaggggccttgtggaacgcatccaccaattgcgtggttcggagtga

SEQ ID NO: 35827 - DNA, 1704 bp, Mesorhizobium loti
ttgccgaaggcgctcacggaacttgccgccggcctgcccgaaaagccgtggctcaagagctatccgaaaaatgtccaggccgagatcggggtgttgccctacagttcgatcggcgatttcctggtcgccgcctgcaagcagttttccgcccagccggccttcacctgcatggacaaatccatcagctacgcagatgtcgagcagctgtcggcggccttcggtgcctatctgcaatcgaaggggctgcaaaagggtgcgcgcgtcgccgtgatgatgcctaacgttctgcaatatccggtggcgatgatgggcatcctgcgcgccggctatgtcgtggtgaacatcaatccgctctacacgccgcgcgagctggagcaccagctcaaggattccggcgcacaagccatcgtcatcctggagaacttcgccaacacgttgcaggcggtaatcgccaggaccgcggtcaagcatgtcgtggtggcggccatgggcgacatgctcggcggcctcaagggcacgatcgtcaacttcgtggtgcgccgcgtgaagaagatggtgccggcatggtcgctgcccgggcatgtcaagttcaacgcggcgatgaaggccggcgccggccttggcttcaagccggccaaggttgcggccgacgatgttgccttcctgcaatatacgggcggcaccacgggcgtgtcgaaaggcgccacgctgctgcaccgcaatgtgctctccaatgtcgtgcagaacgcacagtggatggaagacgcctatacgatcaagccgaaaccggcacacccgaacttcatctgcgcgctgccgctctatcatatcttcgcgctgacggtgaacgcactgatgggcatgcagcaaggcgcccgcaacgtgctcattcccaacccgcgcgatattccagccttcgtcaaggaactccagaagtatccggtccacatctttcccggcctcaacacgctgttcaacgcgctgctcaacaatgaggacttccgcaaactcgacttcaagccgctggtgctgacactgggcggcggcatggcggtgcagaagggcgtcgccgaacgttggaaggctttgaccggttgccctgtcactgaaggctacggcctctcggaaacctcgccggtggcgacggccaacaagttcagttccggcgacttcaccggcacgatcggcctgcccttgccgtcgacggaaatcgccatccgcgacgatgacggcaacaatttgccgctgggcgaggtcggcgagatctgcatccggggaccgcaggtgatggcgggttactggaaccggcctgacgagaccgccaaggtgatgaccaaggacggctacttcaagtcaggcgacatgggcttcatggacgagcgcggctacaccaagatcgtcgatcgcaagaaggacatgatcctggtctcgggcttcaacgtctatcccaacgagctcgaggaggtcgtggcgatgcatccaggcgtgctcgaagtcgcggcgatcggcgtgccagacgagcattcgggcgaagtgccgaagctgttcatcgtcaagaaggatccagccctgaccgtggaagccatcgccgctttttgccgcgaaaacctgaccggctacaaacggcccaaatatatcgagttcaggaccgaattgccgaagacgccggtcggcaagatcctgcggcgggcattgcgcgcctga

SEQ ID NO: 35828 - DNA, 1149 bp, Mesorhizobium loti
atggctgacaagagtttccttaactggccgttcttcgagaaccgtcatcgcgaactggccgaagtcctggaagcgtggtgctcgaagagcctccccgtcgatcatcacgacgtcgacgccgcatgccgcgagctggtgcaaaaacttggccgcgacgggtggctgaaaccgacagctgtcgacaccgtgaatcccggaccgctcgacgtgcggacactatgcatcacgcgcgagacgctctcccgccatgacgggctcgccgatttcgcctttgccatgcaggggctgggcacaggtgcgctcagcctgttcggcacgccggaccagcagcaatggctggcaaggacacgcgccggcaaggcgatctccgccttcgctttgtcggagccgcgctctggctcggatgtcgccaacaccgagatgacggcgacccgcgacggcgacagctatgtgctcaccggcgagaagacctggatctccaatggcggcatcgccgatctctacatcgtctttgcccgcaccggcgaagcgccgggcgccaaggggctttccgcctttatcgtaccgggtgacgtcaagggcctcggcattgccgaacgcctcgaagtgatcgcgccgcatccgctggcgcggctgtccttcgatcaggtccgcctgccgacctcggcgctgatcggcaagcccggcgatggctttcgcatcgccatgtcggtgctcgacgtgttccgctcgaccgtcggcgctgcggcgctcggctttgcccgccgggcgctcgatgaaagcatcaaacgagtggccgaacgcaaactgttcggcgctccgatggcggagttgcagatggtgcagggccacatcgccgacatggccctcgacatcgacgcggcggcacttctggtctatcgcgccgcctggaccaaggatatgggcgcggcgcgggtaacgcgcgaggcggcgatggccaaactgttcgccaccgacaaggcgcaggacgtgatcgacaaggcggtgcagctgcatggcggcgacggcgtccgcaaaggccacattgtcgaaagcctgtatcgcgaaatccgcgcgctgcgcatctatgagggtgcctccgacgtgcagaaagtggtcatcgcgcggcaagtgatgggcgcggcctaa

SEQ ID NO: 35829 - DNA, 774 bp, Mesorhizobium loti
atgacggcggtaccagcgatctccggcaagcatgcgctggtcactggcggtggctccggcgtcggccgggccatcgcacttgcgttggccggtgccggcatcgacgtgaccatctgcggccggcgcgacgccgagcttgccaaagtggccggcgaaagcgaccgtatcttcggcatcgccgccgatgtcaccgatgaggcgtccatggcctcgctctatcaggcggcggaagccgcgcgcggggccttcgacatcgtcattgccaatgccggcatggccggcagcacgccggcgcacaagaccacgctcgccgactggcagaagacgctcgacgtcaatttgaccggcgccttcctgacggtgaagccggcgctggccgggatggccgtgcgcaaggcaggccggatcgtattcgtcgcctccaccgccggattgaagggctacgcctatgtcgcgccctacgttgcggccaagcacggcgtcgtcgggttgatgcgagcgctggcggcggaaaccgcgaaatccggcgtcaccgtcaacgcggtgtgcccgggtttcgtcgagaccgacatgctggaagaatccatccagcgcatcatcgaaaagaccggccgctctgccggcgaggcgcgggcgagccttgtctcgaccaatccgcaaggccgcttcattcagccgcaggaagtcgccgccgccgtgctgtggctgtgtggcgatgcggcgtcatcgatcaccggacaggcaatttccatctcaggaggcgaaacatggtag

SEQ ID NO: 35830 - DNA, 837 bp, Mesorhizobium loti
atggttgagccgctgttttccgtgcgcgggctgaaggtcgcgctgcctgacatgacccgcaagccgctgatcggccgcgcgccgttggccgagatcctgaaagggctcgacttcgacctgccgagggggtcggtgaccggcattgtcggcgagtccgggtccggcaagtcgacgcttggccgcgcgctggttaggctgctggagccgagcgccggcagcatcagcttcgagggtcgcgacatcgcccatctgccggaggcggagttgcggccgttgcgccgtgacctgcagatgatcttccaggatcctatgtcgtcgctcaatccgcgccgcaccattgccagcatcatcgccgcgccgctcaggcagaacgggcttggcgacaatctgaagaccagagtcgccgaagcactgcagcgggtcgggctgccgcagagctttgccagccgctaccgccacgaactgtcgggtggccagcgccagcgcgtcggcattgcccgcgcgctcgcgctgtcgccgaaattcgtgctggccgacgagatcgtctctggcctcgacgtgtcgacgcaggcgcagatcctgaccctgctggagaagctggcagcggagatgggcctaaccgtcgccttcatcagccacgatctgtcggtcatccggcggctgtgccggcaagtcatcgtcatgcgcgaaggcgtaatcgtcgaggccagcgccaccgacgcgctgttcgaggccccgaaagagacctacacgcgcgacctcatcgcggccattccgctgcccgaaatcgacgccggctggctggacattccggccgccgccaaagccccgacatga

SEQ ID NO: 35831 - DNA, 1575 bp, Mesorhizobium loti
gtgagcgagttcgacgccatctttgtcggggcgggccacaacagtctggcatgcgccgcgcatctggcgctcaaaggctggaaaaccgggattttcgagcgcagttccacgatcggcggcgccgtccagacccgcgaattcacccttcccggcttccgccacgatttcggcgcgatgaatctgagcctctttgccggctctgcctttcaccggaaatatgcaaatgaattgaaaacgcagggcctggaattcgcgccggtcgccgactgtttcgccagcgcctttccggatggacgctggttcggcgtgagcaacgacctggaaaagacggcgagccgcatggccgctttctccgccgccgatgccgcgacatggcgaaagctggtagccgccttcccgggcgaggccgagcatctgttcaggctgctaggctcgccgatgagcgcccgtgcgctggccggcacggcgtggaacctgtggcgcaagaagggtgtcgccggcgcgctcgacacgggaaggctgttgctgtcctcaccccgcacgtggctggaggagactttcgagtcgccttatgtgcgggcgacgctcgccacctggggcatgcacctcgacttcgcccccgacatcgcgggaggtgcggtgttcccctatctggaatcgatggccaaccagagtttcggcatggtgctgggcaagggcggcgccgacaccatcatccgggcactggccggcatggtcacatctgccggcggcaagatcgtcaccggcgccgaagtgtcagagattacggtttccaacggcaaggcgaccggggtgcggctcacttccggtgaaacgcatacggcgaccaaagccgttatcgctggcgtcgcgcccaaggcgctgaccggcacgctgctgcccggcggttccggcaatgccggcttcgacacggcgatgaagaagtttcggtacgcgccgggcacgatgatgatccatctggcgctggacgagttgccgggctggcgcgccgggtctgagctgcggcagttcgcctatgtgcatctgtcaccctcgctcgacgccatgtcgcgcacctaccagcaggcaatggccggcatgctgccggacgaaccggttctggtcgtcggccaaccgaccgcgatcgatccgtcacgcgcgccgcagggcaagcatgtgctgtgggtgcaggtgcgcatgctgcctgccgagataacaggcgatgccggcggcaagatcgcgcccgcgcattgggatcaggtcaaggacgcctacgccgagcgcgtgctcgacatcatcgagacttatgcgcccggcctgcggagcaaaatcctcggccgatcggtgttctcgcccatcgatctcgagcgcgagaacccgaaccttgtcggtggcgatcaagtctgcggcagccatcatctggcgcagaactttctgttccgcccggcgcgcggctatgccggctggaacacgccggtcggcaatctgcatctgacgggagccgcgacatggccgggcgccggcaccggtgcggcctcgggtttcatgctcgcgcaacagctaggcgggaggtag

SEQ ID NO: 35832 - DNA, 1572 bp, Mesorhizobium loti
atgaaagcgcccgatcacatcatcgtcggcagcggcatcaatgcgctggtctgcgcggcggtgcttggcggcaagggtgccaaggtgctcgtcctcgaacgcaacgaccgcatcggcggctgtatgcgcaccgaggagatcactgcgcccggcttcatccatgatgtgatggcgacgaccttcgtgctgttcatcatctcgccggcctttgcggcattgggcggcgacctcgcccggcacgggctggagttctgccacaccggcacgccgacaggcgtgctcacccccgacggcagccatgcggtgctcgccaccgaccgcgccgccaatgtcgccgccctcaatgcgatcgcggcgggtgatggcgaccggcatgccgacgatgtcggcggcatcgagcgcaatgccggcctgctgttcggcctgctcggcggcagcctgtggtcctatccgacggccaagcttttggccggcgatgcctggcggcgcggcccgcgcggccttgccgcctttctcggcgaggcgctggcgccggcacgcggctggctggaaagcacctaccagtccgaaaccatccgcgcgctctgggcgccctgggtgttgcatgccgggcttgggccggaagacgccttctccggccagatcgccaaggtgatcgccttcgcgctggaggcggccggcgcccctatcgtcaagggcggggcgaagaacctgctgtcagccttcgaggcgctgatcaccgagcgtggcggtgtcatcgccactgaagcggatgttacctccatcatcctggctggtggtcgcgccaccggtgtgcggctggcctcgggtgaaacggtgcatgcgaggaagagcgtcatctgctcggtcacgccgacgcagctttatggccggctgctaggcagcgaggcgcccaaagccgatatcgaggcaacgcggaaataccgatacggcaaaggcaatttccagatccactacgccctcgacaagccgccggtgtggcgcggcggagggctggacaaggtggcgctgctgcatctgacgccgggcctggatggggtgtcgaaagcctgcaacgaggcagtgcgcggcttgctgccggaagtgccgaccatctgcgtcggccagccgcatgcgctcgacccgtcgcgctgtccggagggcaaggcgatcctctggctgcaactgcccgaggcgccgcgccacatcaagggcgatgccgccggcaagctgcaggccccggctgacgggcaatggaccgacgcattgcgcgaggcctatgccgaccgcgccgaagcgatcctcgccagccatattgacggcttcaaggacaatgtcattgcgcgccgcgcctattccccagccgacctcgaagcgatgaacatcaatctggtcggcggcgatccctatggcggttcctcgaccatcgaccagtccttcctgtggcggccgttcaagaccagccacaaccacaagaccggcatcaagaacctataccatatcggcgcctcgacccatccgggcgcgggtctcggcggcggttccggctttcttctggcggggaggctgtga

SEQ ID NO: 35833 - DNA, 1674 bp, Mesorhizobium loti
atgggtactgggaacaataaagtcgaggctgggaaccagatcacacagggctcgcttgtcagtcgccgcaacgtcctgcttggcggcacgacgcttgccgcggcatccgcgttggccgggagtaatccgatccggttggcgcaagccgccgcggccggtagcaagccgaacatcctcgtcatcttcggtgatgacatcggctattggaacaccagcgcttacaaccgcggcatgatgggttaccgcacgcccaatattgaccgtatcgccagggagggagcgatcttcaccgacctctacgcccagcaatcctgtaccgccggacgcgccgcgttcatcaccgggcagagttgcttccgcacaggcctgctcaaggtcggtctgccggccgccccggaagggttgtccgggaaggatccgacgctcgccgagctgttgaagcctcagggttacgccacaggccagttcggtaagaaccacgtcggcgaccgcaacgagtttctacctaccgttcacggcttcgacgagttcttcgggaatctctatcatctcaatgccgaggaagagcccgaaaatgtggactatccgaagaaccctgagttccacgcgaagttcggcccgcgcggcgtgctcaaatgcaccgcgaccgaaacggacgatcccaccgaagatccccgcttcggccgggtgggcaagcagaaaatcgaggacaccggcccgctcaccaaaaaacgcatggaaacggtcgatgaggaattcctgggcgcggccaaggacttcatcgatcggcagcacaaggccagcaagccgttcttctgttggttcaactcgacccgcatgcatatcaacactcatctcaaacccgcctcggaaggcaagaccggcttggggatggaggccgacggcatggtcgaactcgacggaatggtcggccagcttcttcagcagctggacgatctgggtattgccgacaacaccatcgtgctctggaccaccgacaacggcgccgaagttttctcatggcccgatggcggcacgacgccgttccatggcgagaaaaacaccagttgggaaggtggctaccgcgtccccggcatgatccgctggccgggggtcgtcaagccgggcaccgagatcaacgacatcgtctcacacgaggattgggttccgacgctggtggcggcagccggcgagccgaacgtcaaggagaaacttctgaccggttacgaggcggcgggcaagaccttcaaggtccacctcgacggttacgaccagcacgacctgctggccggtaccggccccgacccccgcaaggagttcttctactggaccgacgaaggaaatctcgccgcctttcgctatgaccgctggaagatccttttcttggagcagcgggctgagggcttcgacgtgtgggaggaaccgtttgtagccctgcgggtgcccaagatcttcgacgtgcgagccgatccgtttgaacgcgcccagcgtgaagcggctgaatacgtcaggtggagatttgatcggacgtatgtactaatgccggcgcaggccttcgtgggccagcaccttcaaagctttgtggcgttcccgccgcggcaaaagcctggcagcttttcgctcggtcaggtgctggaaaagctgcaggaggccgggaacagcggcaaggaatga

SEQ ID NO: 35834 - DNA, 1290 bp, Mesorhizobium loti
atgaaggatatcatgaagaattcagccatttccgaacgcaaaaaccagtcgatctcgcgcggcgtcggcatgaccacgcaaatctacgccgaccgggctgaaaattcggaaatctgggatgtcgaaggccgtcgttacatcgatttttcctcgggcatcgccgtcgtcaacaccggccaccgccatcccagggtgatcgaagcggtcaaggcgcagctcgaccgcttcacccacacctgccaccaggtcgtgccctatgagagctatgtgcggctggccgaacggctgaacgccatgctgcccggcaagttcgagaagaagacgatcttcgtcaccaccggcgccgaggcggtcgagaacgccatcaagatcgcccgcaatgccaccggccgcccggccgtcatcgccttcgccggcggcttccatggccgcaccttcatgggcatggcgctgaccggcaaggtcgtgccctacaaggtcggcttcggcgccatgccgggcgacgtctatcacgcgccgttcccggtgccgctgcacggcgtttcggttgccgattcgctcgcagcgctcgaccggctgttcaaggccgacgtcgatccggcccgcgtcgccgccattatcgtcgagccggttcagggcgagggcggtttctacgaggcaccgcgcgaattcctgaccgcgctgcgcaagctctgcgaccagcacggcatgctgctcatcgccgacgaggtgcagaccggctttgcccgcaccggcaagatgttcgcgatggatcaccacgaagtcgccgccgacatcaccaccatggccaagagcctggccggcggcttcccgctgtcggccgtcaccggccgcgccgagatcatggatgcgcctggccccggcggcctcggcggcacctatggcggcagcccgatcggcgttgccgccgcgcatgccgtgcttgacgtgatcgaggacgaaaagctgtgcgaccgcgccaacacgctgggcgcgcggctgaagcagcgcctgcagtcgatccgcgacgacgtgcccgaaatcgtcgatatcaggggcctgggcttcatgaacgcggtcgagttcaacgacgtcaagaagggcatgccatcggccgagatcgccaacgccatccggctgaaggcgctcgacaagggcctgatcctgctgacctgtggcgtctacggcaacgtcatccgcttcctcgcaccgatcaccatccaggacgaggtcatgaacgaggcgctcgacattctggaaagctcgatccgcgaagtctgcgctgcctga

SEQ ID NO: 35835 - DNA, 762 bp, Mesorhizobium loti
gtggcacaatcacggtttaaacaaagaacagtcctcatcactggcgcggggacgggcatgggccgtgccgcagcccttcgcttggccgaggaggaagcacatctcgtccttgtcgggcggcggccggagccgctcgaacgactggtttcggacattgaggccgcaagcggcaccgccatggcgattacctgcgatatttcgcgaggtgatgcggtcgctgcggccgtggaaaaaaccatcgctcgcttcggacgcttggacgcactgttcgccaacgcaggagtgctaggcgagttcaagccgctggcggataccgagacggacgacttcgatgggctcatcgccacgaacttgcgcggaacgtttctaaccatcaagcattgcctgccgttcctggaaggtggcgccgtcctgatcaacgcctcgtggaccgcgagcagcgtgatgccaggcgccggggcatatgcgagcacgaagggtgcactgctggccatgatgcgcacgctcgcggtggaacaaggccctcgaaacatacgggtcaacgccatcaatccggggatcatcctcacgccgatggccgacgatgtactcagtcctgatctggccgcccggcttgccgcgcacacggcattgcgccgaaacgggacaccggaagatgttgcgggtacggttgcctggcttctttcggacgatgcggccttcgtgactggccaggagatcatggtggacggcggctatacgatcggaggtctccggctgtga

SEQ ID NO: 35836 - DNA, 1266 bp, Mesorhizobium loti
gtgacgcggcagaactacttctttacctcggaatccgttgccgagggccatcccgacaaagtctgcgaccggatctccgacgagattgtcgatctggtctaccgcgaagccaagaagaccggcatggacccatggaaggtccgtgtcgcctgcgagaccttggcgaccaccaaccgcgtcgtcatcgccggcgaagtgcgcgtccccgagacgctgctgaaaaaggacaaggccggcaacatcctcaaggacgccgcgggccacccggtcgtgaacccggcaaaattcaaatccgtcgcccgcaaggcgatccgcgagatcggctacgagcaggccggcttccactggaagacggccaagatcgaggttctcctgcatggccagtcgccagacatcggccagggcgtcgacaatgccgccgaccgccagggcgaggaaggggccggcgaccagggcatcatgttcggctatgcctgccgcgagacgccggacctgatgccggcgccgatctactacagccacaagatcctcgaacttctggccgccgcccgccatcaaaacaacggcgaggccggcaagctcggcccggacgccaagagccaggtcaccgtccgctacgtcgacggcaaggccgccgaggcaacgcagatcgtgctgtcgacccagcatctcgacgcgacctgggactccaagaaggtccgcaaggtcgtcgaaccctatatccgcgaggcgcttggtgatctcaagatcgccgacgattgcatgtggtacatcaacccgaccggcaagttcgtcatcggcggcccggacggcgacgccggcctcaccggccgcaagatcatcgtcgacacctacggcggcgcggcaccgcatggcggaggcgccttctccggcaaggacaccaccaaggtggaccgttcggcagcctatgcggcgcgctatctggccaagaatgtcgtggcggcgaagcttgccgaccgctgcaccatccagctttcctacgccatcggcgtcgcccagcctctgtcggtgtatgtcgacctgcacggcaccggcaaggtcgacgaggcaaagctcgaggacgcgctgcgcacggtgatggacttgtcgccgtcgggcatccggcgccatctcgacctcaacaagccgatctacgctaagacgtcgtcctacggccatttcggccgcaaggccggccgtgacgggtctttctcctgggaaaagaccgatctcgccaaggcgctcaaggatgctgtcgcggcctga

SEQ ID NO: 35837 - DNA, 2583 bp, Mesorhizobium loti
atgagcgatacgaaatcgggcgacgacaagacgttgagtgttacaccgatgaagaccttgacgctgaagcgccccggcatggaacagggcaccgtgcgccagaacttctcgcatggccgtaccaagtcggtcgtggtcgagaccaagaagcgcaaattctccctgcccggcgacaagccggagccggctgctgctgcccctgtgcccgtcttcacgccgaagccgccggtcgccgcggcccctgtcgtgcaggaagcgccgaaggctgcgcctccacctcccccgcgggctccggtcgagcgcagcggcatggtgctgaacgaactgtcgcgcagcgaaatggaagcccgccgcagggcgctggaaggatccaaggtccgcgaggtcgaagaccgtcagcgcgccgccgaggaagccaagcgccgggccgaggacgaggagcggcgcaagcgtgagcgcgaggaatccgcgcgccgccaggccgaggaagaggcgcgtctgcaagccgaggccgaatcgcgccgccgcgccgaggaagaagcacgccgccgcgcaccgctggccgcggagctggcaacggcagacgaagaagaagaggtcaagccgaagcgggctggcgccggcgcgcctgtgcgtcgcctcgtcacgcccgaagtggcacgtccggccaagccgaccaagggcgaggaagatcgtcgccgtggcaagctgacgctgaattccgcgctttccgacgaggatgcgcgggcccgttcgctgtcgtcgatgcgtcgccgccaggagaagttcaagcgcgcgatgcacaatgagccgcgcgagaaagtcatgcgcgaagtgatcctgcccgagaccatcaccatccaggaactggcgcagcgcatgtccgaacgtgcggtcgatgtggtcaagttcttcatgaagcagggccagatcctgaagccgggcgacgtcatcgacgccgacacggcagagctggtcgccaccgaattcggccacacggtccgccgcgttgccgagtccgacatcgaggaaggcctgttcaacatcgccgacaatgccgaggacctggtgccgcgtccgccggtcgtgaccatcatgggccacgtcgaccacggcaagacctcgctgctcgatgccatccgcaatgccaatgtcgtttccggcgaagccggcggcatcacccagcatatcggtgcctatcaggtcgagaagaacggtcagaagatcaccttcatcgacacgcccggccacgccgccttcacggcgatgcgtgcccgcggcgcccaggccacggacatcgctatcctggtggtggcggccgacgacagcgtcatgccgcagacgatcgaatcgatcagccacgccaaggcggccggcgttccgatcatcgtggccatcaacaagatcgacaagcatgacgccgatccgcagaaggtgcgctccgaactgctgcgccacgaggtcttcgtcgaatcgatgggcggtgaagtgcttgacgtcgaagtgtcggcgaccaagggcaccaatctcgacaagctgctcgaggcgatcctgctgcaggccgaaatcctcgacctgaaggccaatccggaccgtaccgccgagggtgtcgtcatcgaagcgcagctcgacaagggccgtggcccggtcgccaccgtgctggtgcagaccggtaccttgatgccgggcgacatcctcgtcgccggcaacgagtggggccgcgtgcgcgccctggtcaacgatcgcggcgagcagatcaaggaagcgccgccggcgatgccggtcgaggtgctcggccttcagggaaccccgctggctggcgaccgcttcgcggtggtcaacaacgaggcccgcgcccgcgagatcaccgaatatcgccagcgtctggcgcgcgagaaggcggtggccaagcatgctggccagcgcggctcgctcgaacagatgatgtcgcagttgcagacgagcgggctgaaggaattcccgctggtcatcaagggcgacgtgcagggttcgatcgaggcgatcaacgcggcgttggacaagctcggcaccgacgaggtgcgtgcgcgcatcgtccatgccggcgccggcgccatcaccgaaagcgacgtctcgctggcggaaacgtctggtgcggcgatcatcggcttcaacgtccgtgccaacgtacaggcacgtgccgcggccgcggccgcgggcatcgaaatccgctactactcgatcatctacaacctcgtggatgatgtgaaggcggctttgtcgggactgctgtcgccggagcgtcgcgagaccttcatcggcaatgccgagatcctcgagatcttcgacatcaccaaggtcggcaagatcgccggctgccgtgtcaccgaaggcaaggtcgagcgtggcgcgggcgtgcgcctgatccgcgacaacgtcgtcatccatgaaggcacgctgaagacgctgaagcgcttcaaggacgaggtttcggaagtccccggcggccaggagtgcggcatggccttccagaactacgaggacatgcgcgtcggcgacatcatcgagtgcttccgcgtcgagatggtgacccgaacactctga

SEQ ID NO: 35838 - DNA, 804 bp, Mesorhizobium loti
atggacggattgatgaagggcaagcgcgggcttgtcatgggtgtcgccaacgatcattcgatcgcctggggcatcgccaagaaattgtccgaacatggggcggagctcgccttcacctaccagggcgacgccttcggccgccgggtcaagccgctcgccgacaagctcggcgcctcgctggtcgttccctgcgatgtcgaggacagcgcttcggtcgccgccacattcgagacgctcggcaaggaatggggcggactggacttcgtcgtccacgccatcggcttttccgacaagaatgagttgaagggcctctacgccgacaccagccgagacaatttcgtccgcaccatggtgatctcctgctattccttcaccgaagtggcgcgcaacgccgcggcactgatgacggaaggcggctcgatgatcacgctgacctatgccggttcggtccgcgtcatgccgaactacaatgtcatgggcgtagccaaggccggcctcgaggccagcgtgcgctaccttgccaacgactacggcccgcgcggcatccgggtgaacggcatctcggcaggcccggtgcgcacgctcgccggcgccggcatttcggacgcccgtcacatgttctcctaccagcagcgcaattcgccgttgcgccgcacggtgaccatcgacgaggtcggcggctccgcgctttatttgctgtccgaccttgcctccggcgtcaccggcgaaatccactatgtcgattccggctatcacatcgtctcgatgccgacgctcgacgagttgaagcaaacggatggctaa

SEQ ID NO: 35839 - DNA, 1221 bp, Mesorhizobium loti
atgagacgtgtcgtagtcacaggcctcggcatcgtgtcgtcgatcggcaacaatgccaacgaggtgcagacctcgctgcatgacgccagatccggcatcagcttttccgattccttcgccgagcacggcttccgttgccaggtctggggcgcgccgacgctcgacccctccgccatgatcgaccgccgcgcgatgcgcttcctgagccaaggtgccgcctggaaccacgtcgccatggaccaggcgatcgccgatgcgggcctcggcgaaagcgacatcaccaatgagcgcaccggcatcgtcatgggctcgggcggcccctccacccgcaccatcgtcgaggcggccgaaaccacgctgaagaacggcagccccaagcgcatcggccccttcgcggtaccgaaggcgatgtcgtcgaccgcgtcggcaacgctggccacctggttcaagatccacggcgtcaactattcgatctcgtcggcctgctcgacctcggcgcattgcatcggcaatggctacgagctgatccaatggggcaagcaggacatggtctttgccggcggccatgaggatctcgactggacgatgtcggacctgttcgacgccatgggcgccatgtcgtccaagttcaacgacagggcctcggctgcttcccgcgcctatgacgtcaatcgcgacggcttcgtcatcgccggcggcgccggcgtgctggtgctggaggagctcgagcatgccaaggcgcgcggcgccaagatctacgccgagatcgtcggctacggcgcaacctctgacggctacgacatggtggccccctccggcgaaggcgcggtccgctgcatgcgccaggcgctggcgacggtttccacgccggtcgactacatcaacacccatggcacctcgacgccggtcggggattccaaggaaatgggcgccatccgcgaggtgttcggcgagaagatgccgttcatcacctcgacgaaatcgctgaccggccattcgctgggcgcggccggcgttcaggagtcgatctattcgatcctgatgatgcaaggcggcttcatcggcgaaagcgcccatatcgaaaccctcgaccccgaattcgagggcatgccgatcgtgcgcaagcgtatcgacaacgccaagatcgacaccgtcctgtcaaattccttcggtttcggtggcaccaacgcaacgctcgttttccagcgctattccgcataa

SEQ ID NO: 35840 - DNA, 735 bp, Mesorhizobium loti
atgacctgcctgccaagccaaagcggcaagaaactcggcctggtcatcgacctcgatacctgcgtcggttgccaggcctgcgtcaccgcctgcaaggaatggaacaccggcggccacatggcgccgctgaccgacatcgacccctatggcggccatgtcgacggcgtctggttcaaccgcgtgcacagttatgagcacaccaccgagatgggcgggcgcacggtcaacttcccgcgctcctgcctgcattgcgagacgccggcctgcgtcaccgtctgcccgaccggcgcttcctacaagcgcgcctcggacggcatcgtgctgatcgacgaggacaaatgcatcggctgcaaattgtgcagttgggcctgcccctatggggctcgcgaattcgacaccgatgtcggcgtgatgaagaaatgcacgctctgcgtcgaccgcatctacaacgacaatctggccgaagaagaccgtgtgccggcctgcgtcgcggcctgcccgaccagcgcccggcacttcggtgatctcggcgatccccactccgccgtctcgcaactggtggcggagcgcggcggcgtcgacctgatggcggaactcggctatcacccgaccaacaaatatctgccgccgcgcgcccatacgcagcgtgccgcatcggtgccggcgaaggcgctggagccggtgcgggccgaaggcggcttcctcggctgggtcgatcgcatgctttcgaactga

SEQ ID NO: 35841 - DNA, 1227 bp, Mesorhizobium loti
gtgaaatgcgcccacctcaattctgacgatgcgctctgggaggagtaccatacccacatgaccaaccccgccgaaatacttggccttcccaagcccgcctgggccgcggacgaggtcggcatgctctacgacatggcaacccgcttcatgtcggaggagatcgcgccgcgctacgacgagttcgagaagaacgagatggtcgaccgcgaaagctggcgcaaggccggtgccgccggcctgctctgcgcctcgatgccggaggaatatggcggctccggcggcaccttcgcgcatgagagcgccatcatcgaggcgatcggccatgtcggcgtcgacggtttcggcatcggcctgcacaattcgatcgtcgcgccttacatccttcactacggttcggaagagcagaagaagaaatggctgccgaagctcgccaccggcgagctgatcggcgccatcgccatgaccgagccgggcgccggctccgatctgcagggcgtcaagacgcgggccgagaaggacggtaaccagtacaggatcaatggttccaagaccttcatcaccaacggccagctggccaacttcatcatcgtcgtcaccaagaccgatccggaaaagggcgccaagggcacctcgctgatcgtcgtcgagaccgacgaggtcgaaggtttcgagcgtggccgcaacctcgacaagatcggcctgaaggccaacgacacgtcggaactgttcttcaacgacgtgcgtgtgccgacctccaatctgctcggccacgaggaagggcagggctttatccagctgatgcagcagctgccgcaggagcgcttgcagatcggcaccggcgccatcgccatgatcgagcgcgcgctggcgctgaccatcgagtacgtcaaggagcgcaaggccttcggcaaggcgatcatcgatttccagaacacccagttcaagctggccgagctcaagaccgaggcgaccatcggccgcgtcttctacaatgattgcgtcacacgccacatcaatggcgggctcgatccggtgacggcctcgatggccaagtactggctgagcgacctgcagggcaaagtcgtcgacgaatgccttcaattgcatggcggctatggctacatgaatgaatacccgatcgcccgcatgttccgcgacgctcgcgtccagcgcatctacggcggcaccaacgagatcatgaaattgctgatcggccgctcgctctga

SEQ ID NO: 35842 - DNA, 1209 bp, Mesorhizobium loti
atggccgaagcttatgtctatgacgccgtgcgcacgccgcgcggcaagggcaagaaggacggatcgctgcacgaagtgccggcggtgcggctcgccgccaagacgctggaagcgctgcgcgaccgcaatgggctggacacaggtaccgtcgacgacatcatcttcggctgcgtcgatccggtcggcgaggcaggttcggtcattccgcgcgccgccgctttcgaggcaggctatgacaccaaggcgcccggcatgcagatctcgcgcttctgcgcctcgggtctcgacgccatcaatttcggcgccgccaagatcgcgcagggcgccgacgagatcgtcattgccggtggcgtcgaatccatgtcgcgcgtcggcatgggcgcctccggcggcgcctggttcatggatccttcggttggcctgcccggctggttcgtgccgcaaggcatctcggccgacctgatcgccaccaaatacggtttctcccgtgatgacgtcgacgcttatgcggtcgagagccagaagcgcgccgccaaatcctgggccgacggccgcttcaagaattcggtcattccgatcaaggaccagaacggcctgaccattctggaccatgacgagcacatgcggccttcgaccgacatgcagtctctggcttcgctcaacccgtccttcgtcatgcccggcgaaatgggcggcttcgatgcggtcgcggtgcagaagcatccggaggtggaagaggtcaaccacgtccaccacgccggcaactcgtccggcatcgtcgacggcgcggcggccgtgctgctcggctcgaagaaggcggggaaagccatggggctgaagccccgcgcgcgcatccgcaccttcgccaatatcggctccgagccggtgctgatgctgactggcccggtcgacgtcaccgagaagctgttgaagcgcgccaagatgaagctttcggacatcgacctgttcgagctcaacgaggccttcgcctcggtggtgctgcgctacatgcaggccttcgacatcccgcacgacaagatcaacgtcaatggcggcgccatcgccatgggccatccgctcggcgccacaggcgcgatgattttcggcacggtgctggacgaactcgagcgccgcgatctgaacaccgcgctggtcacgctgtgcatcggcgccggcatgggcaccgcaacgatcatcgaacgcgtctga

SEQ ID NO: 35843 - DNA, 1200 bp, Mesorhizobium loti
atgagcggttcggcgctttacgagacctttgctcgcgctcccctggctttcgaccacggggaaggcacctggctggttaccgacaagggcgagcgatatctcgatttcgccggcggcatcgcggtcaattcgctcggccacagccatccgcatctggtcgcggcgctgaccgagcaggcggcaaagctgtggcacgtctccaatctctatgagatccccggacagagccggctcggccagcgcctggtcgatgccaccttcgccgacaaggtgttcttcaccaattccggcgccgaggcgctggaatgcgcgatcaagacggcgcgacgctaccatttcgtcaagggccatcccgagcgcttccgcgtcatcaccttcgaaggcgccttccatggccgcacgctggcgaccatcgcggccggcggtcagtacaaatacctcgaaggcttcggccccaaggtcgaaggcttcgaccaggtcggcttcgacgacatcgatgccgccgagaaggcgattacgccggaaaccgccgcgatcctgatcgaaccggtgcagggcgagggcggcatccgcccggtcccgacgcagtcactgaagcggctgcggcagctttgcgaccagcacggcctgttgttgatctatgacgaggtccagtgcggcatcggccgcaccggaaagctgttcgcgcatgaatggtcaggcgtggcgcccgacatcatggcgatcgccaagggcattggcggcggcttcccgatgggcgcttgcctcgcaaccgatgaagcagctgtcggcatgacggctggcgtgcacggcaccaccttcggcggcaatccgctggcgatggcggtcggcaatgccgtgctcgacgtagtgctggaagacggcttcctcgaggacgtccagcgcaaggcattgctgatgaagcaaggcctggcggcgatcgccgacgagtttcccgatgtcgtcgaagacatccggggcaccggcctcatgcttggcctcaaatgcgccatgcccaacaccaaggtgaacatggcgctgcgcgaccagcatttgctggcggttccggccggcgacaacgtcattcgcctgctgccgccactcaccgtcaccgacgccgagatccacgaagcgctcaatcgcatccgtgccggtgccaaaggcctggcggatgccatcgccgtggccgccgcgaagtaa

SEQ ID NO: 35844 - DNA, 912 bp, Mesorhizobium loti
atgtcagttcgccatttcaccgatctttccactgtttccgagggcgacctgcgcttcatgctggacgacgcggtggtgcgaaaggcacgcctcaaggccggcgagcgcacgaggccgctcgaaggcaaggtgctggcgatgatcttcgacaagccgtcgacgcgcacgcgcgtctcgttcgacgtcggcatgcgccagcttggcggcgagacaatcatgctgaccggcaccgagatgcagctcggccgctccgaaaccattgccgacaccgccaaggttctgtcgcgctatgtcgacgcgatcatgatccgcaccacctcgcatgaccggctgctggagctgaccgagaacgccacggtgccggtgatcaacgggctgacggacgatacccatccgtgccagctgatggccgacatcatgaccttcgaggagcatcgcggtccggtggccggcaagaccatcgcctggactggcgacggcaacaatgtgctgcattcgctgctcgaagcctcggcgcggttccgcttcaacctcaacgtcgccgtgcccgagggcagcgagccggcgcagaagcacatcgactggtccaaggcgcatggcggcaagctgcatttcacccgttcgcccgaggaagccgtcgaccaggccgactgtgtcgtcaccgattgctgggtgtcgatgggtcaggagcaccgcgcccgcggccacaacgtgttctcaccctaccaggtcaatgccaagctgatggcgcatgccaagccggacgcgctgttcatgcactgcctgccggcgcatcgcggcgaggaagtgaccgacgaggttatcgacggaccccattcggtggtcttcgacgaggccgagaaccggctccacgcccagaaggcggtgcttgcctggtgtcttggggcttga

SEQ ID NO: 35845 - DNA, 1191 bp, Mesorhizobium loti
atgagcaacaagaagcgcaactggaagcctcagacagcactcgtgcatagcggaaccctgcgttcaggcttcggcgagacctccgaggcaatgtacctgacccagggctatgtctatcaaacggcgcaagccgccgaagcccgtttcaagggcgaggaacccggtttcatctattcgcgctacgccaatccgaccgtcgacatgttcgaaaagcgcatgtgcgcgctggaaggcgcggaggacgcgcgcgccacggcatcgggcatggcggccgtgacggcggcgcttctgtgcagcgtcaagaccggtgaccacatcgtagcggcgcgcgcgctgttcggctcctgccgctgggtggtcgagacgctggcgccgcgctacggcatcgaggcgacgctcgtcgacggcaccgatatcgccaactgggaaaaggtggtcaggcccaacaccaagctgttcttcctggaaagccctaccaacccgacattggaagtggtcgacatcgccgccgtggctgcgctcgccaactcgatcggcgcgcggcttgtcgtcgacaatgtcttcgccacgcccctgcagcagaagccgttgcagctcggcgcgcatatcgtcgtctattcggcaaccaagcacatcgacggccagggccgctgtctcggcggcgtgatcctgtcggacaagaagtggatcgacgagaatctgcatgactatttccgccacaccggccctagcctgtcgcccttcaacgcctggacgctgctgaagggcctggagacgctgccgctgcgcgtgcgccagcaaacggagagcgccggcaagatcgccgatttcctggccgagcagccgcagatcgcccgcgtcatctatcccggccgcgccgaccatccgcaggccgagatcgtcaagaagcagatgtcgggcggctcgacacttatctgcctcgacgtcaaaggcggcaagcaggcggccttcgccctgcagaacgcgctcgatattgtgctgatctccaacaatctcggcgacgccaagagcctgatcacccatccggcgacgaccacccacaagaatttgagcgacgaggcgcgcgccgaactcggcatcgggccgggcacgctcaggctgtcggtcggcctggaggataccgacgaccttctggaagatatcgcgcaggcgctgaaggccgccaaatag

SEQ ID NO: 35846 - DNA, 1080 bp, Mesorhizobium loti
atgagcgtgctcgaccgactcggccagaagctgctgtttgccttcgatccggaaaccgcgcacggcctgtcgatcgcggcgctgcgctgcggcctgccggccggcacgcgggcggtgcgcgacatcaggctgaaggtcagcctctgcggtctcgatttccccaacccgctcggcatggcggccggctatgacaaggacgccgaggtgcccgacgcactgctcggcctcggcttcggctttgccgaggtcggcacggtcacgccgctgccgcaggccggcaacccgaagccgcgcatcttccggctaacggcggatgaagcggtgatcaaccggctgggtttcaacaatgaaggccatgcggcggctgaaaaacgccttgccgcgcgcaaggggcgccccggcattgtcggcgtcaacatcggtgccaacaaggacagcgccgatcgcatcggcgactatgagcgcggtgtcggccgcttcgcgcgccacgccagctatttgaccgtcaacatctcctcgcccaacacgcctggcctgcgcaacatgcaggcgcgcgagcagctcggcgaacttttgtcgcgtgtcatggctgcgcgtgcgtcagccgcaacccagccgcccatcttcctcaagatcgcgccggatctggtcgaggccgagctggaggacatcgccgccgaggtcgttgaaaagcggatcgacggcatcatcgtctccaacaccaccatttcgcggccaccgctgcgcagcggcgacgtcggacgtgagaccggcgggctttcgggaaaaccgctgttcgaacgctcgaccatcgtgttggcgaagatgcgcaagctgcttggcccgggcatagccattatcggggtcggcggcgtcgactccgcggagaccgcgctggagaaaatccgcgccggggccgatctggtgcagctctacaccggcatgatctatgccgggcctgcgctgccgggccgtatcgtcgccggcatggcacgcttttgcgagacggagcgactgaagtccattggcgaattgcgcgacagccacctcgatcggtgggcgtccaagccactcagctga

SEQ ID NO: 35847 - DNA, 1278 bp, Mesorhizobium loti
atgaactaccagcggttcttcgaagaagcgatcgaccagctccacgcggagcgtcgctatcgtgtcttcgccgacctcgagcgcatcgcgggcaagtttccgcgcgccatctggcgctccaacggccgcgccgaggaaatcaccgtctggtgctccaacgactatctcggcatgggccagcaccccgatgtcatcgccgcgttccagaacgcagccggcaagatgggctcgggcgccggcggcactcgcaacatttccggcacgtccaacccgctggtcgagctcgaacatgagcttgccgacctgcacggcaaggacgcggccctggtcttcacctctggctttgtctccaacgaagcctcgatctcgaccatcgcccggctgttgcccaattgcctgatcatctcggacgaactgaaccacgcctcgatgatcgaaggcgtgcgccgctcgggcgccgagaagaagatcttccggcacaatgacgtcgcgcatctggaaagcctgctgcaggcggccgggcgcgaacgcgccaagctgatcgtcttcgaaagcgtctattcgatggacggcgatatcgcgccgatccgggagatcgtcgaactcgccgagcgctacaacgccatgacctatatcgacgaggtccatgcggtcggcatgtacggaccgcgcggcggcggcatcaccgagcgcgagggcctggccgaccgcatcgacatcattgagggcacgctggccaaggcattcggcacgctgggcggctacatcaccggcaccagcgcggtgatcgacgcggtgcgctcctatgcgccgggcttcatcttcaccacggcgctgccgccggcgattgccgccgcggcgaccacctcgatccgccatctcaagcgctcgcaggccgagcgcgatgcccagcagcagcaggcagcgcggaccaagcagatcctgtcggcggccggcctgccggtgatggagtcgccaacccatatcgtgccggtgctggtgggtgacccggagctttgcaagatggccagcgaccgcctgcttggcgtgcacggcatctacatccagccgatcaactacccgaccgtgccgcgcggcaccgagcgtctgcgcatcacgccgacgccgttccattccgatgcgctgatcgcgggactacaggatgcgctggtcgagacatgggacgccctcggcatcccctatggcgcggcaggacggcccgcagtggccaagagcgatcggatcgttccattgctggtgcccaagtcaggcggctga

SEQ ID NO: 35848 - DNA, 1542 bp, Mesorhizobium loti
atggacacgacagcccagcacggcacggtgaaggaggggcctcaggactccacgccacgcctgacgctgtccggcatctccaagagtttcccgggtgtgcgcgcgctgcacaatgtcagcctgtcgctctatcccggccaggtgacggcactgatcggcgagaacggcgccggcaagtcgacgctggtcaagatcatgaccggcatctaccagcccgacgccggcacgatcagcatcgacggccaggctgtcaccttgcccagcgcgcatgccgccttcggccatggcgttaccgccatccatcaggaaaccgtgctgttcgacgatctcacagtcgccgaaaatatctttctcggccatgcgccgcgcacacggctaggcaccatcgactggcgcacgatgcgcggaaatgcccgcgaagtgctcgacaccatgcatgccggccatatcgacgccgatgcgcggctgaaggacctcggcatcgccaacaagcatctcgtcgccgtcgcccgcgccatgtcgatcgacgcccagatcgtcatcatggacgagccgaccgccgcgctttcgatgaaggagatcgaggagcttttcctgctcatcgaattcctcaaggaggaaggcaaggcgatcctgttcatcagccacaagttcgacgagatctaccgcatcgccgaccgctacacggtgttccgcgacggcgaggtggttggcgaaggcctgatcaaggatgccggccagagccagatcgtgcgcatgatggtcggccgctcggtcgatcatatcttcccgcagcgcaaggccgagatcggcgcgccggtgctgtcggtcgccggcctgtcgcacccgaccgagttcaacgacatcggcttcgagctgcacaagggcgagatcctcggcttctacggccttgtcggcgccggccgcagcgaggtgatgcaagcgatatcgggcatcacccgaacctctggcggcacgatcacgctggaaggcaaggcgatagcgccgaaatcggcggcggattcgatcgaagccggcatcgtctacgtgccggaagagcgcggcaagcagggcgtggtgatcggcctgccgatcttccagaacgtctcgctgccctcgctcaagcgtacctccaagtctggcttgctgcggctggccgaagagttttcgctcgcccgctcctacaccgagcggcttgacctcagggcctcctcgctcagccaggatgtcggcacgctgtcgggcggcaaccagcagaagatcgttatcgccaagtggctggcgaccgcgcccaaggtgatcatcctggacgagccgaccaagggcatcgacatcggctcgaaagccgccgtgcacggcttcatggccgagctggtggcgcaaggcctgtcggtgatcatggtgtcgtcggaactgccggagatactcggcatgtccgaccgggtggtggttatgcgcgaaggccttgtcgcggcgacatatgacaataaggggctggacgccgagacgttggtgcggacggcagcggggatcgcggcatga

SEQ ID NO: 35849 - DNA, 1488 bp, Mesorhizobium loti
atgaaccttcctcccaatgcgttgtggatcgaccaggacgactatgatgttcgcggcttttcgcacggactctacatcgacggcagatggcgaccatcttccgatggtcgggtcatcgacgtcgtcgatccttcgtcgggatccgtgattgcagcggtccccgatgcgacgctcgaggatgccttggccgccgtcgatgcggcggccaaggcggcgacggcatggagagagacggcgccgcgcaagcgctcggaaatcctcaggcgctgtttcgaactcatggtcgagcggtcggaaacgctcgccatgctgatctcgctggagaacggcaaggctctacgcgacgcgcgcggcgaggttgcgtacgccgctgagttcttccgctggaacgcggaagaagcggttcgcatcaccggcgagttcggcaccgcgccgtccggcgccaaccgcatcgtggtcgactatgagccgatcgggatctgcgtgctgatcacgccctggaattttcctgccgcgatggcgacacgaaagatcgcgccggcattggcggccggttgcacggtgatcctgaagccggccagcgaaacgccgctgacggcctatgcgctggccgcgctctacagcgaagccggcgttccggccggcgtcgtcaatgtgctcaccacgaccagtcccggtccgctgacctcggccatgctggccgatccgcgcgtcaggaagctctctttcaccggctcgacgggcgtcggacgaaccttgcttggcgaagccgccaagcatgtggtctcctgctcgatggaactcggcggcaatgcaccgtttgtcgttttcgacgatgccgacctcgatgccgcgctcgacggtgccatgatcgcaaagatgcgcaatgccggcgaggcctgtacagccgccaaccgcatctatgtgcagtcaggcatccatgacgcgttcgccgacggccttcgcaagcgcatggcagctctcaaggtcggaccgggcatgagtgcggatacggagtgcgggccgatgatcaccagaaaggcggtcgacaagatcgaccgcctggtcaaggacgccgtgggccggggagccaaggtgctttgcggcggctcgatcccggaagaggagggcttcttttatccgccgacggtcctgtcgcaggttccgcccgatgctgacatggcgcatgaggagatcttcgggccggtagcgcccgtcacgcgattcgagaccgaggccgaagtcatcatgcacgccaacaacacggaatacggccttgccgcctatatctatacgcgcgatgtgggccgaggattgcgggtggcatcgaggatcgaggccggcatgatcggcctcaatcgggggctgatgtcggaccctgcggcgcccttcggtggcgtcaagcagagcggcctgggtcgcgagggcggccagcaccacggcatcgccgagttcatggaggcgaagtatatcgccgttaccttctga

SEQ ID NO: 35850 - DNA, 1227 bp, Mesorhizobium loti
atgagcctcttcgccgccctccggcttccgcgtgaaatccttttcgggaaaggccagcgccacgcactgtcgacagtcgccggcaggttcggccggcacgccctggtctgtaccgacgagcgtttcgccggcacggcggtgttcgcggaaattgtccaatcgctccaggccgcctcgatcgaggtgctggtgcatgaccgcgtgcttcccgacgtgccacgtgacagcgtcggcatttgcgtcgacgaggccgagaaattccagcccgagatggtgatcggcatcggcggcggcagctgcctcgatttcgccaaatgcgccgacttgctgctcagccatggcggcaagcttcaggactactatggggagttcaaggtgcccggcccgacgctgccgctgatcgccgtgcccacgacagcgggcaccggctccgaagtgacgcccgtcgcggtgatctccgatccggatcggacgctcaaggtcggcatatcgagcccctatctaatcgcggcagttgccttgtgcgaccccgaactgacgatgacctgcccccctgccctgactgcgatagccggcgccgacgccctgacccatgcgatcgaggccttcaccgcgaagcagcgcggcgaggaccccagcctggcgcaacagcatgtcttcatcggcaagaccgcgctgaccgaccatttcgccctcctggccataaagctgctgggccgcagcctggagaaagcctgcaccgacggcacggatgccgatgcgcgcgccgatgtgatgatgggcgcactggcggcgggctgcgcattcggcaccgccggcactgcggcggcgcatgccgtgcaatatcccgcgggcgccctcacccacaccgcgcacggattgggcgtggcgacgatgatgccttacgtcatgacctacaacagccgcgtggtcgccgccgaaatggccgagatcggcgacgcgcttggccttgaggccaaggggcggagcgccgaggagatggcggacgccaccatcaaggaaatccggcggctattcacggcgatcggcatcacgccgacgctggccgatctcggccttcccgccgacaagctcgactggaccgccgatcaggcgctcggcatcgaccgcctgatcaagaacaacccgcgccccttcgatctcaccgccatgcgacgcctggtccaggccgcccatgacggcgacctcgcagcctgcgccatgtaa

SEQ ID NO: 35851 - DNA, 1023 bp, Mesorhizobium loti
gtgaggcagtcaaaattcgcgccgcgccacgccgtcaacgcgggtgagcgcaagaccacctcggcgatgatcgcctcgatcgcgcccaatggcgttccgacgcgcagtgctccgttcggacacacgcttgcaaggctagcccatcagcggcccgggatcgtgggtttgacggctgatcttgcgaaatacaccgaccttcatgtgttcgcacaggaacatccggatcgcttctatcaaatgggcatggccgagcaggtgctgatgagtgccgccgccggcctggcgcgggagggtttcacgcccttcgccacgacctacgctgtctttgcctcccgacgggcctacgatttcatctgcatggcgattgccgaggagaagctcgacgtcaagatcgtctgcgccctgccggggctgaccaccggctacggccccagccaccaggcgacagaagacatcgcgatcttccgcggcatgccgaacctgacgatcatcgacccttgcgacgcgctcgacatcgaacaggccacggaggcaatcgcggactacaagggcccggtctacatgcggcttttgcgcggcaaagttcctgtcgtgctcgacgaatacgactacacgttcgagatcggcaaggcgcggctgttgcgcgatggggcggacgtgctgttcatttccagcggcctgatgaccatgcgagtgctggaggccgcgaaggcgcttgaagcagaccgcatcgactgcgcggtgctgcacgtgccgacgatcaaacctctggacacgcaggcgatacttgatggcgcgcgccgtccgggacggctggtggtggtggcggagaatcacaccatcattggtggcctaggcgaaggcgttgccgcgttgctgatgcgggagggcgtggccccagtctttcgccagattgccctgcccgacgagttcctcgatgctggcgcactgctgacgcttcatgatcgctacgggatctcatcgtccgagctcgtgcgtcgtgtccgcaaatggacagagtaa

SEQ ID NO: 35852 - DNA, 753 bp, Mesorhizobium loti
atgttgctgaagggcaaggccgtggtgatttcgggtgccgcgagcccccggggaattggccgctccacggcaacgctgatggcggagcaaggcgcgcgcatagctattcttgaccttgatgaggaacaagcccgtgacgccgccgcgtcgcttggacccgagcacatcggcctcgcctgcaatgtcgccgacctcgattcctgcaagagggctgcggcagaagtgaccgaagcgttcggaagggtcgaggtgttatgcaacattgccgggatcacgcagcccgtaaagacactggacatcggtccggccgactgggaccgcatcctcgatgtcaatctgcgcggcgtgctctatctcagccaggccttcatcccgcatatgcgtgaaaatggcggcggctcgatcatctgcatgtcgtcggtttcagcgcaacgcggcggcggcatcttcggtggcccgcattactcagccgccaaggcgggtgtgctcggcctcgccaaggccatggcacgcgaattcgggcctgacggcattcgcatcaactgcgtcacgcctggcctgatccagaccgacataaccggcggcaaactgaccgatgccatgcgcgctgacatcatcaagggtatcccgctcagtcgcctgggcgatgcgcgtgacgtggcgggcgcctacctcttcctcgcctccgatctggccagctacatcaccggtgccgtgatcgacgtcaatggggggatgctgatccatggctga

SEQ ID NO: 35853 - DNA, 1110 bp, Mesorhizobium loti
atgtccgatgcaaaacttcagagtgtgctgtcgtctctttcgcaagtggcgagacagttagatgctctgccatccgatacaccagcgccggattcaagttgggtaaaactaaacacgaatgagaaccccttcccgcttccggaaatcataatgcaaagtgcgattgcagctctcgaacggcagtatctatatccagaagacgataacatcagcttgagagaagcagccgcgaatgcctacagcgtctccatggatcaggtgatcgccggcaacggatcgtctgaactgcttggacttgtctacagagcattccttaccccgggggatagcgtggcgatgatgtcgccaggtttttcgttcaaccgcaaacttgcaacgttgcagggtgctcaatttgtcgaaatcgaatttagcaaagatcattccttgccgatggagcaattgctcttcggtcctgcaaaggacgccaagttcattctgctagccaatccgaacaatccgactggaacgttcgttccggtggccgatatcgaacgcctggtagcgaaatcggaccgcttgatcgtgctggatgaggcctacgtcgactttgcacccgagaatggtctacgcctcatcaatcgctattcgaaccttctggtcttaaggacattttcgaaaagctatgctgccgccggcgttcgcgtcggtttcggtttcggtcatcctgaaattatcggcaggctacgcaacatccagaacgtcttcaacatgaatgtgatcgggcaggcggttggtatcagcgtccttgcgcaccgcgccgcctatgcagacaaccacagacacatcaggcatgaacgacggcgagtgacgctcgcgctgtcgcaacttggattttccgtaatcccttcccacgcaaacttcttgcttgcccgcgtgccaacggcacaggacggctcatggtggcaatcagccttcgcaaggcaaaaaatacttgttgccgtctttccagataaaggtttggaaaattacatccgcgtcagcatcggtacaaaagagcaaatggatgcgtttcttcgtgccgctagtcgtattagcagaatattgaatatgtcaacacccccgcgttag

SEQ ID NO: 35854 - DNA, 360 bp, Mesorhizobium loti
gtgatgttccgcattaccaaagagttccacttctcggcctcgcatcagctcacctccttgccaccagatcatcagtgcgcacgtctgcacggccacaactacatcgtcgtagtggagctttcaggtggcgaactggacgaacacggctttgtgcgcgactaccaagatctggcggcgttcaagcactacatcgatgggacgttcgaccatcggcatcttaacgacgtgctggggcatgaccatgccacagcggaatgtctggccaggcacttctacgactggtgcaaggtgcggctacccgaaacctccgccgtgcgggtgagcgagacgccgaaaacctgggcggaataccgaccatga

SEQ ID NO: 35855 - DNA, 1434 bp, Mesorhizobium loti
atgaaattcgggtcaagcggcgttcgaggtttggcttcggaattggtcggcaaggccagcggactttataccgaagctttcgcttggcgtttgatttccagccgggttcagccgaatagttcagtcttcataggccgcgacctacgtgacagcagtcaggcgatagccaacaattgcatggcggcgttggccgcaaatggtttccagccgatcgattgcggcaccatacccacgcctgccctggcactatatgcatgcaaacacggcgcggcggctcttatggtcaccgggtcgcacattccagccgatcgcaatggcatcaaattctatggcccgaatggtgaaatcagcaaggcggatgaggccgcgattacgcgctttgtagccgaaagatcaattgcgtattgcttaccaacggcttgtctgggaacgacgtggcctatgcactgtgaagaagcgatcgcctcttatcgagagcgcgcccatgacatgctggagccgggctcactttccggcatgagacttggtgtctatcagcacagttcggtcgcggcggaactgttggtacaggttcttcgatcgctcggtgccagcgtggtcgccgtcgggaaaaccgcgactttcgtacctgtcgataccgaagccgtggacgcagcaacaatcgcaaaattgaagaagtgggtccgcgaattcggtctcgatgccatcgtgtcgaccgatgcggacgctgatcggccactcatcgctgatgaaaatggcgatcttcttcgcggcgacctggttgggcttgcaacggctcttttcctgaaggcagacacgatcgtgacgccagtgacctccaattcgggaatttcgaaggccttgggtttcgcggtccagaggacgaaagtcgggtctccatttgtcattgaagcaatggaagcattacacggcgccggcggcgtcatcgtcggctttgaggccaatggtggtgttctgctgggctcggattgtgtcgtgaatgggaagacattgactgcactgccgacgcgggactcattcctcccgattttggccgtgctcagtaccatggcgtcgacaaaaaagaagctgtcgcgactgcgcgggctttggaatcttcctgtgtgcgccagtgaccggcttcagaacttccccgcggaaagttcgcgcagattgatggatcatctcgcaagccggaacgcactgcagcactttcttgcctcgttcgggaccgtcgccgaaattgacgaaaccgatggcctcagggcgcggatgctttcaggtgagatcatacatctgcggccttccggcaatgccccggaactgcgctgctactcggaagcttcgaccgagagcagggccatggcgatcgtcgcctcgacgctgcaaggggcacatgcgttcgcgcttacagacgagatagaggacctttga

SEQ ID NO: 35856 - DNA, 1494 bp, Mesorhizobium loti
atgaagggggacgacggtttgaccgtgacacagtcgctgacgagacgtctcaaaaatcccgagctatttgacgatctggccggtgtgcctggtcggaaggcggagcaatccacgaggcgtttttcggtgttcaatccctcaacgggcgagctgttggctgagcttccagatatggatgtccgggacgtttccaaggcaatcgataaggctgaagctgcgcaggaacattgggcggcgctcaccgcgcgcgagcgctccgacatcttatgggaatggcaccaactgatcctcgaccacagcgaggatcttgcagccattttgacggctgaaatgggtaagccgcttgcagaggcgaagtctgaaatcgcccatgccgcagcctacctccaatggtatgccgaggaggccaatcgcatctatggcgagacgatttcgccgccttctaacgacaggcgtatgctggtaatcaaacagccgatcggtgttgtcggcgccattactccttggaattttcccgcctcgatggtggctcgcaagatttcgcctgcgcttgccgccggctgcgcgattgttctgaaacccgcggagcaaacaccgcttgtcgcgggtgctatgttcacgcttgcccggatggcaggttttcccgatggcgttctaaacttgatctacgcatcggaaggcgatgcggttgggcgtgaactttgctcgaacccgaaggtccgcaagatcagcttcactgggtcgaccgaggtcgggcggctactcatgagggagtgttcggatcagatcaaaagaaccagcttcgaacttggtggtaacgctcctttcattgtttttgatgatgcagacgtcgacgctgccgtcgatggtgcgctacaggcaaagtttcggaatgcaggccagacctgcgtttcagccaatcggctttacgtacagtccagcgtgtataatgaattctgcgacaaattcaccaagcgcgtcagtgcattgcgcgtcggtgacggtttcgagccagaagttgcgatcggtcccctgatcgataagtgcgcgcttgcaaagattgaagatcatattcgcgatgctgtgcggcagggtgggaagatccgttgcggtggcaaccgtatcggcgaatcgggaaccttcttcgagcccacggtgatcaccgacgtcgaaaggacaatgcgggtcgctcaggaagaaaccttcggaccgctggctcccataatccgcttcaacgatcccgaccaggtggtgcgcgaggcgaatgacacgatttacggtcttgcagcctacttctacgcttccaatctaaagcgcgtgtggcgcgtggctgaagccctcgaatacggaatggtcggcatcaatacgggacgcatgtcatccgaggccgcaccctttggcggaatgaagcaatcagggatcggtcgtgaggggtcgcgccacggcctcgaggattatctcgaaatgaagtacctgtgcatgggtgggctataa

SEQ ID NO: 35857 - DNA, 1659 bp, Mesorhizobium loti
atggctgccaaagacgtgaaattctctcgtgatgcccgcgagcgcatgctgcgcggtgtcaacatcctcgccgacgcggtgaaggtgacgctcggccccaagggccgcaacgtcgttatcgacaagtcgttcggcgccccgcgcatcaccaaggacggcgtcaccgtcgccaaggaaatcgagcttgaagacaagttcgaaaacatgggcgctcagatggtccgcgaagttgcttcgaagaccaacgacatcgccggtgacggcaccacgaccgcaaccgttctggcgcagtcgatcgtccaggaaggccacaaggcggttgctgccggcatgaacccgatggacctgaagcgcggcatcgacctcgcggttagcgacgtcgtctggacgctgatcaagaacgccacgaagatcaagacctcggaagaggttgcccaggtcggcacaatcgccggcaatggcgacgagtcggtcggcaagatgatcgcggaagcgatgcagaaggtcggcaacgaaggcgtcatcacggttgaggaagccaagaccgccgagacggaactcgaagtcgtcgaaggcatgcagttcgaccgcggctatctctcgccctacttcgtcaccaacgccgacaagatggttgccgatctcgaggacgcctacatcctgctgcacgagaagaagctctcgaacctgcaggcgatgctgccggttctcgaagccgtcgtgcagacctcgaagccgctgctcatcatctcggaagacgtcgaaggcgaggccctggccacgctggtcgtcaacaagctgcgtggcggtctgaagatcgccgccgtcaaggcgccgggcttcggtgatcgccgcaaggccatgctggaagacatcgccatcctcaccggtggccaggtcatctcggaagacctcggcatcaagctcgagaacgtcggccttgacatgctcggccgcgccaagaaggtgtcgatctccaaggagaacaccaccatcgtagacggtgccggcaagaaggaagagatccagggccgcgtcgcccagatcaagcagcagatcgaggagaccacctcggactacgacaaggagaagctgcaggagcgtctcgccaagctcgcgggcggcgttgcggtgatccgcgtcggcggtgcgacggaagtcgaagtcaaggaaaagaaggaccgcgttgacgatgcgctgaacgcgacacgcgcagccgtcgaagaaggcatcgttcccggcggcggcgttgccctgctgcgcgcttcgctgagcatcaacgctgtcggcgcaaactccgaccagaccgctggcatcagcatcgtgcgtcgtgcgctgcaggctccggcccgccagatcgcggccaacgccggtgcggaagcctcgatcgttgccggcaagatccttgagaacaagggcgcgaccttcggtttcaacgcccagaccggcgaatatggcgacatgatcgccatgggcatcgtcgatccggtcaaggtcgtgcgcacggctctccaggacgcggcctcggtcgccggcctgctggtcaccaccgaagccatgatcgcggaggctccgaagaaggagtcggctggcggcggcggcatgcctggcggcatgggcggcggcggcatgggcggcatgggcggcatggatttctaa

SEQ ID NO: 35858 - DNA, 813 bp, Mesorhizobium loti
atggcattcaatattgcgatctatctgaatcgtatcggccttgctcgagtgccgacaacggtcgacggtcttgttgcccttcagcaggctcaaatgcgcgcgattccctttgaaaacatcgatgtgctgttgggtgatatacccaatctgactgagaattcgatctgggccaaactgatcaatgcccggcgaggggggtattgcttcgaattgaacaagttgtttggcttggcgctcgaagcactcggtttcacgatccagcccatcctttgcagagtgcgtatgggtgctgcggagggtgggccacgcacacaccaggcattcatcttaaccatcgagggcgtcgactggctcgccgacgctggcttcggtggtccagcaccgattgcaccgctacggatcgatacagaggaactgcaaacagctggccgtgacgtgtttcgcctgcgagctgactccgccagcggagaactcgtcgttgaacgcaagaacgggaatgaatggttccctctttatggtttcgatcgagccaccgccttgccctcagattttgagggcgccaacttcatctgcgctcgctgggaccgttcgccgtttccatccagcctcatgatgagcgtgctgacagccgaagggcctgcgaacttgttcaacaaggatttcagcttgattcggaaccaaattgaggaaacagaaaccctcaaaacgaagagcgaactgcagcgagtcttgtccgatgtttttcggctgcaccttcctcggtccacgattgattcgttgtgggaaaagcttgggtcgcgtggacgggtatag

SEQ ID NO: 35859 - DNA, 1209 bp, Mesorhizobium loti
attggacaggcgagtcgtcattactgggataggggggctttgcggctaggcaacaacgccgcctctatctggaaagagatgcgcgaaggtcgctccgccatccgcctgatggtcacttccgcgcttcatgagatgaaggggactgtcggtaccgagatcaaggagctgccccagcacgacatcggccgcaaccagctcgtctccatggaccgccacagcttgctcgctgtgcttgcagcgcgtgaagccatgcagcacgccggactttcctgcgataagggaaatccgtatcgcttcggcgcgacagtgggcgtctgcggctggggctggggaacggtcgaagaaacctaccgtgacctccttttgggcggcgcgacgcgtgctggcatttacactgcaccaagggggttgccgagcgccgctgccagccaggtcagcatgagtctcggcctgcgcggcccggtctttgccatcgcctccgcatgcgcatcagccaaccatgcgatcgcttcggccgcggatcagatcaagctcggccgggccgacgtgatgcttgccggaggcgccgaagcgccgctcgtatgccttcagatgaaggcatgggaagcaatgcgcgcgctcgctccagatacgtgccggcccttctccgccgacaggaagggagtggtgataggcgagggtgcgggcatggccgtgctggaaagctatgagcatgccgccgtgcgcggtgccacaatccttgccgagatcgcaggcatcggcctttccggcgacgccttccacatcgtcgcgccgtctgtcgaggggccggaggccgcgatccgcgcttgccttgccgacgccgggctgaatgcggaggacgtggactacctaaacgcccacggcaccggcaccaaggccaacgatcagactgagacggcggcgatcaagcgcgtcttcggagactatgcctattcgatgtctgtctcgtccaccaagtccatgtacgcgcattgcctgggcgcagcgagcgcacttgaaatgatcgcctccgtgatggcgatccaggagggcattgtgccgccgaccgcgaactatcgcgagccagaccccgattgcgatctcgacgtcacgcccaatgtggcgcgcgagcgcaaggtgcgcgtggcactgagcaacgctttcgccatgggcggcatgaacgcagttctggcgttcaagcaagtgtag

SEQ ID NO: 35860 - DNA, 984 bp, Mesorhizobium loti
atgagcaagtcgtcgcgcattctcgggttcggtcatcatacgcctgggcgcaaggtggcgaatgccgagatcgagaacaatctcggcctcgagccgggctggatcgaaaggcgtaccggaatccgttcgcgcttctgggcaacggacggagacacgctgtctggtcttgccacgcaggctggcgacatcgcgctggcgaacgccggtattgaccgcagcgacatcgggctgctgttgcttgccacctcgacacccgaccaccttctgccgcccagtgcacccttggtcgcgcacaagctcggccttggccgcgcaggcgcggtcgatctgaccggcgcctgcgccggcttcgtctatgcgctgatgttcgcggacgggttcacccgcctgcacggcaaaccagcgctggtcatcgccgccaacatcctcagccgccgcatcaatccagccgagcgcgcgagctcagtccttttcgccgatgccgccggcgccctggtgatcggtccttgcgaggatccctatcagggtattctcggcgcttcggtggattccgacggctcgcgctacgggctgatccagatcccggcaggcggaagcaacaccccgttccatggcgagctcgatctcgagcagacccgcatgacgatcaccgacggccgcgaagtgttcgccaaggcggttgagatgatgactgcctgctcgcaggacgcactcgcggcggcccggatgcggccgcaggacatcgatcggttcgtaccgcaccaggccaatgcccgcattttcgatgcggtcgggcgaaacctcggcatcgccgatgaagcgatcgtcaagacgatcgccgagtatggcaactcttccgccgcgacgatcccgctctcgctgtcgctcgcccatcgggcggcgccgttccggccgggggagaaggttcttctggcggccgcgggtgcgggtcttagcggcggtgcgctcgtcgttggaatttag

SEQ ID NO: 35861 - DNA, 1269 bp, Mesorhizobium loti
atgatgccgcagtcccgtgtgtggcatcccttcacccagcacgcgctcgagcccgccatccctgaaatcgcccggacggaaggcgcctacctctacaaggccgacggcacgcgcatcctggatgccatttcctcctggtgggtcgtcacgcacggccaccgccatccccgcatcatcaaggctatcgagacgaccgcgtctagcctcgtccagatcatcttcgctggcttcacccacgagccggcagagcgcctggccaaggcacttgtcggcctcgctcccgccggactcgactgggtgttctattccgacagcggctcgacctccgtcgaggtcgcgctgaagatggcgctcggctatttccgcaacatcgacgcgccgcgctcgcgcatcgtcgtcatggagcacagctatcatggcgacaccatcgggacgatgagcgtcggtgcccgtggcgcgtttaacgccgcctacgaacctttgctgttcgaggtcgacaccatccccttcccggccgcgggacgcgaacaagagacgctggatcggttcgaggcagttgcccgcgaccggcgcacggccgcgctgatcgtcgaaccgctcgtgctaggcgccggcggcatgctgatgtatccggcctgggttctggccgaattgaagaagatcgcagaaacctccggcacgttgctgatcgccgatgaagtaatgaccggctgggggcggaccggaaccatgttcgcctgcgagcaggcgtccatttctccggacatcctatgcacgtcgaagggcttgaccggtggcgcgatccctttggcggccacgctcgccaccgatgccatcttccaggcccattattccgaagaccgtaagaaaaccttctttcattcgagctcatacaccgccaatccgattgcctgcgcggcagcactcgccaatgtcgagatctggcgcgacgagccggtggccgagcgggtcgcggctttgagcgcgaagcaggccgccgggctgcaacgcttccgggacaacccatatttcaccgactgccgagccactggcacgatcgctgccctcgacctgcgcaccggttccgccggctatctcgccgagattggtccgaaactgcgcgcgttcttcctcgagcgcggcctgcttgttcgtccgctcggcaatgtcctctatcttctcccgccctattgcatcaccggcggcgagttggacgcactctacgacgcgatcgaggaggccgccgaacgcttcgggtctaggccatga

SEQ ID NO: 35862 - DNA, 1140 bp, Mesorhizobium loti
atgaacgaggcacttcttgtccggtatgacgcgtccttgcgcggactggcgcgcaaggaccggctgcgcacacttgcaccgcgcgccgggctcgacttctcgtcgaacgactatctcgggcttgccgcctccaaaagacttggcgaagcggtggcggcggcgattgcgcgggggacgccggtcggcgcgaccggatcgcggttgttaaggggcaactcaccggagcacgaggctctggaggcagacgccgcggcgttcttcggcgccgaacgcgcgctgttcttcggcagcggctatatcgccaacttcgctctgctgacgacgctgccgcaaaagggcgacctcttgatcctcgacgaccttgctcatgccagtatgcatgagggggcccgcgctggccgcgccgagttcaagctcgccgcgcataacgacatcgatgctgtcgaggatgcgatcacccgctggcgcgccgaaggcggcatgggccgcatctggatcgcggtcgaaagcctctacagcatggatggcgaccgcgccccgatggcccgccttatcgcgcttgccgatcggcacgaggcattcctcgtcgtcgacgaggcgcatgccaccggcatctggggaccgaacggccgcgggctggccgccgctttcgagggccgcgacaacactgtcgcacttcacacatgcggcaaggcgctcggcgcgtccggcgcactcgtcaccgggccgggaacgctatgcgactatctcgtcaaccgctgccggccattcatctacgccaccgcgccgtcgcctctgatggcggtggcagtgcgcgaagcgctggccatgctgtccgacgagccccaacgccgtgtccagctgcaggagcgcgtagccttcgcgggccgccaattggccgagcgctgcggcgtgaagcccagcggctcgcagatccagtcctttgtcatcggcgacaacaggcgcaccatggcggtggcggcggcgctgcagacgcgcggcttcgacatacgcggcattcgtccgccgaccgtacccgagggcacatcgcgactgcgcatttcgctgacgctcaacgtcgacgaagccgacatttcggccatggtcggggcactcgtcgaggtgctggcctcggcatga

SEQ ID NO: 35863 - DNA, 1542 bp, Mesorhizobium loti
atgacggcggacatccatcacattggcggagcgccggtcattatcggcgctggtatcgccgggctcatgacggcgctacacttggcgccgcaaccagtcgtccttctgtcaaggacctcgctcggaaccgaagcctcgagcattctagcccagggcgggctcgcagcgagtctgggggaggacgacagccccgacctgcacctcgccgatacgcttgctgccggcgaagggctttgtgacgaacaaatggccaggcgggtggtagaggccgcacctcaagccgtcgagaatctcattcgtcttggtactcctttcgaccgctcgctagacgggaggctgcagctgggcctggaagctgcgcattcgcgtcgccgcatcgtgcacgccgccggcgacgcaaccggccgcgagttgtttcgggcgctactcggcgtggcgcggcgaacccgttcgatcacgatcatggaaggcatgacagcgcttcgcttggttgtcgcagagggcagcattgttggcttgctgactgtcctgcatggcgccgtgttcgcattgcccacacgccgcgtggtgctggcgaccggtggtataggcggcctgttttgcgatacaaccaatccgctctcctcattcgggcacggcctggcgcttgcagcctgtgctggagcggaactagccgatctcgaattcgtgcaattccacccgacggccctcgacattgcgcgccggccaatgccgcttgtcagcgaagcagtgcgtggcgaaggcgcggtgctgatcgatgagcacggccatcgcctcctggcagacacgcccggggcagaactcgcatcgcgcgatgtggtcgcgcgggcgatctccgatcagctcgcagccgggcatggcgtctatctcgatgcccgacattgtctcgggcagaaattcgcaagacgctttccggcaatcgacgctatttgcaagcatgccggcatcgatccggcggtggaacccattcccgtacggcccgctgctcactatcacatgggcggcgtggccgttgacgccgaggggcgaacttccgttagcggcctgtgggcctgtggcgaagtcgcatgcacaggactgcatggcgccaaccggcttgccagcaactcgctgaccgaagcggttgcaaccgccgcctgggtggctgaaagcgtcgcgggtacctctgcgggttggcagtggcctaggcttccggcaactgttcccatccggcccgacccttcacctattcgcacgattgtgtccaatgcgcttggcattgttcggaatgggaaatcattgtgcgacacggtcgcgacactgctgccgatctctgtttgcgagacggccgcggccgatccggccctggtggcattgttgatggcgatcgccgcccttcggcgcgaggagagccgcggctcccactttcgatccgatttccccgggcgcgatgccgccgccctcccctcacgattgacgctctgcacagcttttgagaatgccgtcacgctcagatggcaagcatccgaacggagccgttga

SEQ ID NO: 35864 - DNA, 1494 bp, Mesorhizobium loti
atgggagaagccgcggggaggaacagcccgccccaaaccggtcagggagagaaaacttacatgttgaccccactggctccaagcgtaaagcgcgcaccccgcaagaccctttttgccaagccttacgtgcaggtgcttgtcgcaatcctgctcggagttgcggttggccatttttatccgcaaatcggagaaaacctgaagccgctcggcgatgccttcatcaagctcgtcaagatgatcatcgcgcccgttatctttctgaccgtgtcgactggaattgccggcatgagcgatcttcagaaggtcggccgtgttgccggcaaggcgatggtctatttcgtcaccttctcgacgctcgcgcttatcgtcggcctcatcgtcggcaatgtcattcagcctggcgccggcctcaacatcgatctgacctcgctcgacgtccaagccgtcaatggctatgcctcaaaggcccatgagcagtccgtgaccggcttcctcatgaacatgatcccgaccacgattgtcggcgcctttgtggaaggcgacattctacaggtgttgttcttctccgtcctcttcggcatcgcgctggcgatggtcggagaatcgggcaaatcggttctttccttccttcaggacctcactgcacccgttttcaaattggtcggcatcctgatgaaagccgcgccgatcggtgctttcggagcaatggccttcacgattggcaaatatggcatcggttcggtagccaaccttgcgatgctggtcgggaccttctatctcacggccttcctcttcgtattcggggttctcggtgcagtctgtcgctacaatggcttctcgatcttttctcttatccgctacataaaggaagagctgctgctggtcctcggaacgtcctcctccgaggctgcgctgccctctctcatggagaaaatggaaaaggccggcgccaagcgctcggtcgtgggcctggttatcccgaccggatattccttcaatctggatggcaccaatatctacatgaccctcgcggcccttttcatcgcgcaggcgacgaatacggatttgtcagttggcgatcaggtcctgctgctgctcgtcgcgatgctttcctccaagggtgcagcaggtgtcacaggtgccggcttcgtcacgttggctgctacgctctccgtagtgccggcagttcccgttgctggaatggcgctgatccttggcgtcgatcgcttcatgtcggaatgcagggcactgacgaatttggtcggtaacgcggtggcatcgctcgtcgtcgcccgctgggaaggcgaactggatcaggcgcaattgaaagctgcattctgcggccaccagcctgccgagacatcagccggccagccactgataacgcccgcgccgagcaactcggcagcatcgctgccggttgaatcgcctggctggtcccaaacgccggacgatcgggccgcgggttccaaacaaactctcgcgggccgatga

SEQ ID NO: 35865 - DNA, 1101 bp, Mesorhizobium loti
ttgtcaaagagaaaagtagctttaatcaccggggttacgggacaagacggttcctacctcgcagaattgcttttagaaaagggctattctgtgcatgggataaagagacgatcgtctctttttaatactggccgtatagaccatctctatcatgaccctcatgaaagtggcgttgatcttacacttcaccacggggacttgacagactcgtcgagccttacgcgcgtcatccaactggttcagccggacgaaatttacaatttggcagctcagagccacgttgcagtctcctttgaagaaccagaatacaccgcgaactccgatgccttgggtgcgctgcgtatcctcgaggcaattcggatcctggggctcgtcaagcatacgcgctactaccaagcctcgacgtctgagctctacgggctggtgcgggaaacgccacagaccgagacgacaccgttctacccccggtccccctacgctgttgccaaattgtatgctcactggatcaccgtaaattatcgagaatcttacaatttgtatgcttgtaacggcattttatttaatcatgagtcacctgcgcgcggagaaacatttgtaactcgcaaaatcacgcgcgccttgactcggattaagcttggaatgcaacgcactctattcctcggcaaccttaatgcgcgtcgcgattgggggcacgctcgagactacgtccagatgcagtggttgatgctgcagcagcagcaacctgaagactttgtgatcgctagcggtgagcaacattcggtgcgcgaattcgtcaccgtcgcggccgctgaactcggcatcgatgttcgttgggtgggggaaggggtcgacgaagaggggtacgatgcaaagacgggagctctgatcgtaaaagtagatccccgctattttcgtcctgcagaagtcgagacacttctcggcgatgcccgcaaggcgaaagaaaagcttgggtgggagcccaaaatctccttcatcgaattggttagggagatggttcgggaagatttgcgcatggcggagcgtgaagcagtgctgatgaatcagggttattattcacacagtccacgagagttatgctga

SEQ ID NO: 35866 - DNA, 1896 bp, Mesorhizobium loti
atgttttcgtcctcacgcagaccttccatttcggctttcttgagaccgagcggcctgctgcgctcgtacaaagccacgcggcgttttcacatcgatctgcgcggcgccgcctttcgcgacgttttcgccttcaccatgcgccactggagcaagcagccggtccggctcgcgatcattatgatcgcgatgcttgtcgccacgctccttgacgtcctgactccgttttattccggacggctcgtggacgcggtcgcccaggcagcgacagccgacgccgtcgtgtgggatgcggcacttgcggccttttcaatgttgattgcgctcgcactcggcgccgtcgtcctgcgcaacatcgccttcgttgcctacaatgacttcattctgaagatgatgtcggacatcgccagcgacgcgttccatcgcgtccagcgcttttcgaccgattggcatgcgaaaaccttcgccggctctacggtgcgcaagatcacgcgcggcatgtgggcgctctgcctcctcaacgacacgatccttttcgcgttgttcccgtcgctcatcatgctcgtcgggtcgagcgttctgctcggctggtattggccgatgatggggctgatcatcgcctgcggctcggttggctatgtggcgctgatcattatcctgtcgctcggctatgtggcgccagcggcaagccttgccaacaactgggatacgaggcttggcggctcgcttgcggacgcgatcagctgtaacgctgtggtcaaaggcttcggcgccgaggcgcgggaagatcatcgcctggcgaaagttatctccaagtggcggcaccgcacccgccggacctgggtgcgcgggacggtcagtgctgcattccaggggatcatgcttcttgcgctgagagcggctttgatcggctatgccttatttttgtggtcgcgcggccaggctaccccaggtgacatcgccttggtgctcgggtctttcaccgtcctgtatgggtacttgcgtgatgtttccatacacgtgcgcaacatccagcgctctgcaaatgagatggaggaactggtcgaaacctacagccagccgcccgacgtggccgatgttccgggcgccaagccgatccggatcacgaagggtcacatcgattttgagagcgtccatttccactacggcaatcattggtcgcccttctacagcgacttgtcgatttcgattgaggccggcgcgcgggtcggtctggtcggcccctctggctccggcaagaccaccttcgtcaagctcatccagcggctttacgacctggatgctggacgaatcttgatcgatgggcaggacatttcgcgggtgacgcagggttcgctgcgctcgcagatcgcgatcgtacagcaggagcccctcctgttccaccgctcgctggccgagaacatagcctatgggcggccgggtgcttctcggtccgacattgagcaggcggcgcggctcgccagcgcgcatgacttcattgcacgcctgccgaacggctacggtacgctggtcggcgaacgcggcgtgaagctctcaggcggcgagcgccagcgtgtggcgatagcgcgcgccttcctcgccgatgccccgatcctgattctggacgaggcgacatcgagcctcgactcggaatcggaggtgctgatccagaaggcgatggagcggctcatggtcgggcgcaccacgctcgtcattgcgcaccggctctcgacggtgcgcgaactcgaccggctgcttgtcttcgaccgtggttgcatcaccgagcagggcgaccatgccgcgctgatccgtcgcgacggcatctaccgccgcctgttcgagcggcaggccttggaactgacaaaggggtgcgatgagaccaatgtgcaacacggttga

SEQ ID NO: 35867 - DNA, 1218 bp, Mesorhizobium loti
atgaagcaggcaggacgggtcgtcatcataacgggagcggcaggcggaatcggccgtgcgctggtcgagatcgttgccgccgatggagacatcgtcgttgcggtggaccttcctggcagcggcgttcttgaactggccggcggtctcggccatccgcatctgggcctcgaatgcgatgtctcacgagaagaggacattgtcgccctatacggccgcatcgaagcgcagttcgcgaaaatcgatgttctcgtcaacaacgcggcgataggacccgccatggctgcgactatcgacaccggtttcgaggccttccgacgcgtgctggcaacaaatctgatcgggcctttcatcatggccggcgaagcggcgaggcgcatgcagcccggcgctgccattgtcaacgtcgcttcgctggcgggcgtgctcggcaatcccaagcgcaacgcctatgccagctcgaaggcaggcttgatcgctctcacgagatcgcttgcatgcgagtgggcctcgcgcggcatccgcgtaacggcggtagcgccaggatacgtgcgcacgccgatggtggcggaactggaacgtgcgggcaagatggacctcgcggccgtgcgccgccgcgtgcccatggggcgaatggcgcgccccgacgagatcgctcgggccgtgcgttttttggccagcgcacagacgggctacatcacaggatcggtgctgacggtcgacggcggttggatgtcgttcaaccagccgggcgacgcgcacccgccggtcgacgagacgcctcgagccgaactcttccggccggccgaacgaactggcgcgcgcacagtggtcgtgacgggcggcgcgaacggtataggcgccgccgtcgttcgccgctttgccgcgaactccgacacagtcgtgattgctgataaagatggtgctggggcggcagaactcgctgatttgctgggcggcaggcacgtggcgaaatccgtcgacttggcggtcgagagcgacgtggtggcgctgttcgaggaaatacgggggcgcttcggtcgcatcgaggtcctcgtcaactgtgctgctattgccgatacgtttgtgcgagggatcgaaatcccgcaacagattgagcgggtgctggacgtcaatctcaccggcaccttcacctgcgcgcgaggcgatcaagtcgatggacgccggcggcgtaatcctcaatcttggatcgatcaatag

SEQ ID NO: 35868 - DNA, 579 bp, Mesorhizobium loti
gtgctgctattgccgatacgtttgtgcgagggatcgaaatcccgcaacagattgagcgggtgctggacgtcaatctcaccggcaccttcacctgcgcgcgaggcgatcaagtcgatggacgccggcggcgtaatcctcaatcttggatcgatcaatagtttcctgcccttcgtgccgcgccatgcctatggggcgtccacggcgggtatgaacattctgacccggtgcatggcggccgaactcgggtcggtcggcatccgaacggccaccgtcgctcttggctatatccgtacgcctgacattgctcagttggtcgagtccggctgcatcgattccgtagcgatcaaacggcgcatcccgatggggcggatgggagagcccgaagacgtcgccgaggcagtgttctttctggcctcgcctgatgcctcatacgtaaacggctcgaccctctacgtggacggcggcttgacctcgttggctgacgcgcgaaacgcccagccaaccgatcaagaaaatccaacggaatgttcgccggcgacgggttgcggttcgtcgaagccgacgaggttcgaggattga

SEQ ID NO: 35869 - DNA, 1191 bp, Mesorhizobium loti
atgcttgcgcatcggacaaacctgttcggtacatcgggtaccgccgcggcgcgcgctgccgcaaaagcggcggccgatgctggcaaggagatcatcgatctgaccgccggcgagatctggagcgagcttgctcccacgattcgcgacggcgcgatcgacgccatcaataagggcgtcaatcgctataccgatacggttggcatggtggagctgcgcgaggcactggcgcggaagatctccctcgataccggacagatctggaaggccgaggaagttgccgtgacgtccggagcgaagcaggccttgttcaatgccgcaatggtgctgctgaacccgggcgacgaggtcatcatcccggcgccttactggacaacgtttccggcccaggtgctaatcgccggcggcacaccggtcttcgtcgacaccagatccaacgggtacgtcccgcgccccgagcacatcaaggaggcggtcaccgaacgaacgcgggcgatcgtcgtcaacacgcccagcaatccggccggtgcggtctacgatgttgagaccctgatggccatcgctcaactggcggtcagccacaacctgtggatcattttcgacgagtgctatggcgacttcgtgcatgaggatcatacccaccatccgatcgtctcggtcgccccggaaattcgagcacgcgcgctgatcgtcagctccttcagcaaatcgctggcattgaccggctggcgcatcggctatctggcgggtccaaaagaggtgatcaatgccgtcaacgcgctgcaatcgcacaccacttcgaatccaaacgtaattgcccagcacgcggtgctcgcccatttgcaaaggggtggctcggactatgaaggcaagctgcgttcacgcctcacaagcgccagacggatcggtcttgacgtgcttgcttggttgacgcgtgtaccggtccccagggcgcaaggcggcttctatttctatctcgacctttcccatctgctgcgatcggcatcggaagacggcgcctcaacgacagccgacgatatcgtgacggcactgcttgccgaaactggcgtcgcagctgtgtcgggcgccgcgttcggtgaccccgccggcctgcgcctgtcctatggaattccatctgaaaaactcgcgaccggcctggcccggctcgtcgaattcctcaactcctggaaatga

SEQ ID NO: 35870 - DNA, 1542 bp, Mesorhizobium loti
atgccgcaatcggccgaaaaagttctcgaccatgctcccctgttccgcgagccggaatacagacaaatgcttgcggagaagaagctcaatttcgaatgtccgcaccctgatcagatcgtcaccgaccaacgcgaattgaccaagacttgggaataccgcgaaaagaacctcgctcgcgaggcgcttgtcataaatcccgccaaggcctgccagccgctcggcgcggtgttcgcggccgcgggcttcgagcgcaccatgtctttcgtccacggtagccagggctgcgtcgcctactaccgctcgcatctgtcgcgacatttcaaggagccttcgtcagcggtttcctcctcgatgaccgaggacgcggcagtgtttggcggcctgaagaacatggtcgacggactcgccaatacctacaagctctacgaccccaagatgatcgccgtctcgaccacctgcatggctgaagtcattggcgacgacctgcggagcttcatcgagaacgccaagaacgaaggctcggtcccgagcgacttcgacgtgcctttcgcgcatacgcctgccttcgtcggcagccatatcgatggctatgacggcatggtgaagggcgtgctggagcatttctggaagggcagcgagcgctcgcaagccgctgggaccatcaacatcattccaggcttcgacggattctgcgtcggaaacaaccgagaactcaagcgcctcctcgacctgatgggtgtcacttataccgtcattcaagacgcctcagaccagttcgacacgccgtctgacggcgaataccgcatgtatgacggtggcacgaagatcgaagacttgaaaggcgcactcaacgcggaggcgacactgtcgctgcagcattacaacacccgcaagacgctggaatattgcgacgaggtcgggcaagcgacggcatccttccactatccgctgggtgtccaggcgaccgacgaattcctgatgaaggtctcggcgatttccggccaggagatccccgaggcaatccggatggagcgcggccgactggttgacgccatggcggacagccagtcatggctgcacggcaagaagtacgcaatctatggggatccggacttcgtctacgccacggcccgcttcgtcatggagaccggtggcgagccgacacattgcctcgcgaccaacgggacatcggcctgggaggccgagatgaaggaattgcttgcatcctcgtccttcggccaggatgcccagatctgggcgggcaaggatctctgggcgatgcgttcgctgctgtttacagagccggtggacctgctgatcggcaattcctatggcaagtatctggagcgcgacaccggcacgccgctgatccggctgatgtttccaatcttcgaccggcaccatcaccatcgctttcccctcatgggctaccagggtggattacgcgtgctgacgacgatcctcgacaagatattcgacaagctcgatcgcgagacgagcgaaacaggcgtgacggactattcctatgacctcacccgctaa

SEQ ID NO: 35871 - DNA, 597 bp, Mesorhizobium loti
atggcggcactggcgaaattcagaccagttgattccggccaacacgacaaggacgaactccgcgagattgtccgtgagcgctcttttcgattcggacgctacacgctctcgtcgggcatagagagcgacatctatttcaatatgaagcctaccatgatggtggcgcgaggcgcgcaacttgccgctcttgaattcctaaaaatagttgagcaagtgaaagcagagtacgtcggcggtcttgaaatgggagcggtccccgtaatcggatcgatggcggctgtcagctcgatgatgaacaaacccataaacacgatcttcgttcgcaaagttccaaaggcccatggcacaagggacgtgattgaaggacttgggcctaaagaagatctcgagggaaaagtggtcctgatcgttgacgacgttgccacaagcggcaagtcgatattgaaggcgattgaagaggttcgccgcgtcggcggcattgtgggtgacgctgcttgcctcgtggaccgtgacgagggagctacggcgctgctagcccaacatggcgtcacgctgcactccgtactgcatgcgagcgaatttgtggaacgccactga

SEQ ID NO: 35872 - DNA, 1014 bp, Mesorhizobium loti
atgctggaaaaattcgagcgttacccgctcacctttggactcacacccatcgagaagctcgaccggctcggcaagcatctgggtggcaaggtcgaaatctacgccaaacgcgaggactgcaactccggtctggcgttcggcggcaacaagctgcgcaagctcgaatacgtcatccccgacgcgatcgcgtcagatgccgataccctggtcaccgtcggcggcgtgcagtccaaccacacgcgcatggtcgccgccgtcgccgccaagatcggcatgaagtgtctcctggttcacgagagctgggttccacatgaggatgtcgtctacgaccgggtcggcaacattctcttgagccgcatcttgggcgcagaggtgcgtctggtcgacgatggctttgacatcggtatccgccgcagctgggaaaaagcgctctatgaggtcaaggcaaggggcggcaggccctatgcgataccggccggggcgtctgttcacccgaatggaggcctcggctatgtggggttcgcggaggaagtgcgcgcccaggaggaacagcttgggtttgccttcgactacatggtcgtttgcacggtcaccggttcaacgcatgccggcatgctcgtcggattcgccaaggacggtcggcagcgcaacgtgatcggtatcgatgcctctgctaccccggccaagaccaaggcgcaggtgcttagcattgcccgacatacggcgaccctcgtcgagctcggatcggaacttgccgaggatgacgtggtgttgctcgaggactacgcgcacccgcggtacggcattccatccgaggaaaccaaggaggcgatccgtctgtgtgcgcggctcgagggtatgattaccgatcccgtctatgagggcaaatcgatgcaagggatgattgacctcgttcaaaaaggtttttttccagcgggctcgaggatactttacgcgcatctcggcggcgcgccggccatcaacggttatggctacacctttcgcaatggctga

SEQ ID NO: 35873 - DNA, 354 bp, Mesorhizobium loti
atgaagattacgcaagctttcaccttcgaggcggcgcactgtcttccgcgggtgccagcaacccaccgctgtcaccgcatacatggccattcctaccgtgtggaactgcgtctggaagggcccgtcgatccagatacgggctttgtcatcgatttcttcgatgtcgaggctgtgttcggaccgcttctgcaacgtctcgaccatcagtatctgaatgagattgaaggtctcgacaatccgaccgcggaaaacattgcggtctggatctggaaccaaaccaagccgcttcttggccaaatgtgctcggtaacagtctatgagacaccgctgtgctgggctgaatacgagggttga

SEQ ID NO: 35874 - DNA, 1260 bp, Mesorhizobium loti
atggatatcgacattttcgcagcctacgagtctaacgttcgtcgctatggacgatcgtttccaacagtctttaaaaagtcgcttggggcgacaatctgggacgagtccggaaagccatatattgatttccttgtagggtcaggcgcgctcaactacggtcataacaacccggatattattgaaccggcaattcaatatctcgccgatcaaaatatcgtcttgtcgcttgatatgtatacagctgcaaagcgtgatttcatcgaagtgtttgtcgagtcgatcctgaagccccggggcctttcttacaagatacagtttcctgggccgaccgggacgaacgctaacgaagcggcgttggcgctggcgcgaaaatataccggccgctcgagtgtcatggccttcacaaattcgtaccatggcatgtcgctcggctccttggcggtgtcgggttcagcgtcaaccagacagcttggcggcgttgctcgccacgatgtgatccgagtgccttacgagaactatccgaaccaaactttcgattccgcgagttacattgatcacgtgttgggcgacccaggcagcgggatcgaaaagccggccgcaatcatcctggagcccatccaggcagaaggcggcatgaacaccgcatccgcaccatggctctcagaaattcagcgcatttgccgtaagcacgacgttgttttcatcgtcgatgacattcaggcaggttcgggacgaacgggcgatttcttctcattcgagttcgcgaaaatcgagcccgacatcgtgtgtctttcgaaatcgctaagcggttcaggtaatccgttgtccatagttctgattcgccccgacatggacatatggaatccgggggaacatagcgggaccttcagaggcaataatctcgcctttgtgacttccgcggccatgtgcaaaatgtggtccgataggcagtttactaccgccgtcgagcggactgccgtcaaactgcaagaacaccttgatcgcctcgttgcgaaataccccaagtgcatcgaacaaaagcgcggccgtggtctgatggccggcctcaagtgccgttcacaggccgttgttggccgtgtgcacgatgtcgcgttcgaaaacggcctgctgatcgaatcctcggggccaaatcgcgacgtcatcaaagtccttccgccgataaccatctcagatgacgaactcgatcatggcattgccatcctcgatcaggcactacaggagaaaacaaatggcgattaa

SEQ ID NO: 35875 - DNA, 1377 bp, Mesorhizobium loti
atgaggcaccagatcctgtccaaccgttcgggcgaagatctgcgggccagcgacctcgcgcaccatctgcatccgttcacagaccataccgtgctggctgcagagggtggccctcgtgtcatcaaggatggcgacggtatctatgtttgggaaacggagggtcggcggttgctggacgggatggcgggattgtggtgcgtcaacgtcggctatggccgaaaggaactcggcgaggtcgcccgtcagcagatggaccggttggctttctacaacaccttcttcaagacctctcacgagccagtgatcaatctggcggagagactcgccgccgtgacgccagagggcattgacaacttctttttcggcaattccggttccgaagccaatgataccgcgatccggcttgtgcgcagctattgggccgctgtggaaaggcccgagcggcaggtcgtgatcagccgagaatatgcctaccacggctctaccctcgcaggagcaagcctttgcggcctgccgggcatgcatggcgttgcgggccttccgattcccggcatcgcgcacgctgccgccccgtatgcctgggccgctggaaaggaccaagatgacccggcctatggtcgagcatctgctgatgcgctcgaggcgaagatcttggagatcggtccgaagaacgtcgccgccttcatcggggagccggtgatgggagccggcggggtaattacgccgccgccgcgctattgggcgcgggtgcaggagatctgccgcaagtacgacatcctgttagtctgcgacgaggtgatctgcggcttcgggcgcactggggaatggttcggtgctcagagcttcggcatcgcgccagacattatgtgtatggcgaaggggcttagttctggttacataccaatctcggctgtcggtgtcggtactcgcgtggccgaaatcttgcgcacccgcccgggcgtcctctcgcacggcttcaccagttccggtcatccggtagctgccgccgttgcactgaagaacattgaactcatcgaggcagaagggttggtcaatcatgtacgcgacgtcgccggcccggctctcgcccgccgcctgggggcgttggcaatgcaccccctggttgggcaggtgcgcggcattggcgccatgtgggcgctggagctgacgtcagacaaggccacccgtgcgccctttgcgccgctcggctcggtcgcgacccgcgtgcgcaatctctgcttcgaacggggcctggccacgcgggccgttcgcgagggtctggtgttcgcaccgccgctgatcatcaccgaggcgcaggtggacgagatggcggacattttgacctcctgccttgacacggccgttgcggaactctga

SEQ ID NO: 35876 - DNA, 1323 bp, Mesorhizobium loti
atgagccacgtatttcatcgttccgccctctccgttcctccaatggccgtcgcggcagacgggcactacatcatcgacatcaacggccgccgctatctcgatgcgtcgggcggtgccgctgtaagctgtatcgggcatggcgacccacgcgtcgtcgccgcggtcgccgagcagatcgcacggctcgactatgcccacagcggcgccttcaccagcccatcggcggaggaactcgccgcccatatctgcgcggaggcgggtcaaggtatggcgcgggtctatttcgtcggatccggctccgaggcggttgaggctgcgatcaagatggcgaggcagtgccagattgaacggaggcagccgagccgccacgtcgtgatctcgcgccgcctgagctaccacggcaatacactcggcgccctaggccgatccggcagcgagacccggcgtgcgccatatgcgccgatgctgcagaaaagaacgcaaatcgcgccctgctttccctaccactatgccgagccgggagagacgccggaggcctacggacttcgtgcggcggaggcgctggaggcagagattttgcggcttggctcggagaacgtcgccgctttccttgcggaaactgtggtgggtgcgacgtccggcgcagtcgtcccggcgaccggctatttccggcacatccgcgagatctgcgaccggtacggcgtgctgctgatctgtgatgaggtgatgtgtggcgctcatcgcaccggccctttcctcgcctgctcggacgaaggcgtttcacctgatatcgtcacgctcgcaaaggggctcgggggcggctatttgcccatcggcgcggtcgtctgccgggctgacgtgcatgatagctttgcccaaggctctggcgcgttcacccatggccatacttacatggcccatcccgtggcttgcgccgccgcgctcgaggtccagagggtgatcgtcgacgacaggttggcggaacgggtggtgaggcagggagcactgctcgacgccgcgctgcgggatcgcctgtcacagcatacctatgtcggagacatccggggacgtggcctgctctatgccgtcgaactcgtcgccgaccgtgagacgcgagtttcgttcgatcctgaaatgcggctcgcagcccggattggcgctcaggcgaagggtcgagggctgcttgtctatccgggaagcggaactatcgacggcctacggggtgaccacgtgctgctcgctcctgcctattccatcgatgcgcagagagtgggcgagatcgcggacatcctcaccgaggccattgatgcggcgcttggctga

SEQ ID NO: 35877 - DNA, 1248 bp, Mesorhizobium loti
gtgtttctttgccggcgccaattcgatcttcgtcggcgacacgctgctgacggcggacaatcccggcgaggacaaggacattctgctgtttcggcgcctcggcatggagccaatgggcgcaatgaacggggcgcttcttgcccggtatggccggtccttgcgcggactggcgcgcaaggaccggctgcggacgctggcaccgcgcgccgggctcgacttctcgtcgaacgactatctcggacttgcctcctgcaaaagacttggcgaggcggttgcggcggcgattgcgcggggcacgccggtgggcgccaccggatcggcaacgcgccggaacacgaggcgctggagtcggacgctgcggcgtttttcggagccgatcgcgccctgttcttcggcagcggctacatcgccaacttcgctctgctgacggccctgccgcagaagggcgacctgctggtgctcgaccagctcgcccatgccagcatgcatgagggcgcgcaagccggacgcgccgagttcaagctcgccgcgcataacgacgtcgatgctgtcgaggatgcgatcacgcgctggcgcgccgaaggcggcatggggcgcgtctggatcgcggtcgaaagcctctacagcatggatggcgactacgcgccgctggagagcctggtcgcgcttgccgatcggcacgaggcattccttgtcgtcggcgaggcacatgccaccggcgtctggggaccggatggccgcggccttgccaccgcgttcgagggcagcgacaacatcgtcgcgctgcatacatgcggcaaggcgctcggcgcgtccggcgcgctcgtcaccgggccgggaacgctatgcgactttctcgtcaaccggtgccggccgttcatctacgccaccgcaccatcgccgctaatggcggtcgcggcgcgcgaagcgctcaccatgctgtccgacgagcccacgcgtcgcgttcagctgcgtgagcgtatcgctttcgcgggccggcaattggccgagcgctgcggcgtggtgcccagttgctcgcagatccagtcctttgtcatcggcgacaacaggcgcaccatggcggtggcggcggcgctccaggcgcgcggcttcgacatacgcggcattcgtccgccgaccgtacccgagggcacatcgcgactgcgcatttcgctgacgctcaacgtcgacgaagccgacatttcggccatgctcgaggcgctcgtcgaggtgctggcctcgacatga

SEQ ID NO: 35878 - DNA, 1962 bp, Mesorhizobium loti
atgggcaagctgttctcaaaaatcctcatcgccaatcgcggcgaaatcgcttgccgcgtcatccggacggcgcgcaggctcggtatggcgaccgtcggtgtctactccgatgccgacgcgaaatcgcttcatgtagcaatggccggcgaggcagtgcatatcggcgcctcccccgtcgccgaaagctacctgaaggctgaccgcatcatcgacgcggctctcaagaccggcgcgcaggcgatccacccgggctatggcttcctgtcggaggccccggatttcgtcgagcgggtggaagcggcaggactggtgttcatcggaccgtcggcttcgtcgatccgcgccatgggtctgaaggacgctgccaagcgcctgatggaaataaccggtgtgccggtcgtgccgggttatcatggcgaagcgcaggatcctgccttgctggcctccagggccatagagatcggctttcctgtcctgatcaaggcgcgtgcgggaggcggcggcaagggcatgcgccgtgtcgagactgccggagaattcgccgatgcgctcgcgtcggcgcagcgcgaagcgaaagcctccttcggcgacgacaaggtgttgatcgagaagtacgtagagaagccgcgccacatcgaggtgcaggtcttcggcgacaatcacggcaatggggtccatctcttcgagcgcgactgctccgcccagcgccgccaccagaaggtcattgaggaagcgcctgcccccggcatgacgccggagatgcgcgtggcgatgacccacgccgccgtgaaggccgcgaaggcgatcaattactccggtgccggtacgatcgagttcatcgtcgacgcgtcggagggccttcgcgcggaccgattctggttcatggagatgaatacgcgtcttcaggtcgaacaccctatgacggagatggtgaccggacaggatctcgttgaatggcagatacgcgtcgctgctggcgagctactgccgctcacgcaagatgacatccatctcgacgggcacgcctttgaagcgcggctctacgccgaagacgcatcgcgcggcttcttgccggcgaccggcacattgtatcatctgaggttcccgccggaagcctcgtcgattcgcatagaaaccggtgttcgacagggcgatacgatttcatctttctatgacccgatgatcgccaagatcgtcacgaaaggaagcgaccggaaagatgctctagaactgcttgtcagcgcgctggcagtcactgaggttgccggctcaaccgttaacaccgccttcctttcggcgcttgctcaggacgaagacttcgccaccggcgatgtcgatacgggcctcatcgcgcgcaagcagggggcgttgaccgccctggccgaagcatctgctcgttcgaaggcgctcgcagcgctcagggtcgcaagtgttgacgaggccacgtcgaatgacccctgggccagcctgactggctacgaccatttcggatcgactgccaaagcgatctcgctcggcgagtccggcgagatcagtgtttccctaactgcagagacaaatggcgcttggcgcgctgaggtcgatgaacagactatccgtttctctcccacgtcgctgcccgaagcactcgcatcggccgtcatctggcccggccacgtcaccgtcttcgacggcgcggtcagccacaccttcatcgcccgcgatcctctcgacgaagctgccgatgcttatggtggcgccggcagcctgcgcgcgccgatgcccggtctcgtcaagctcgtgcgcgccaagcccggcttcaaggtcagcaagggcgatccacttcttatcctcgaggcgatgaagatggagcatacgatcacggcacctcatgatggcacgatcgccaagatcgccgccgagggtgcgcaggtcgctgacggaaccgtgcttgtccgcttcgaagagtcgggaggaaactga

SEQ ID NO: 35879 - DNA, 1689 bp, Mesorhizobium loti
atgcttttcgagaaggatagctttgaggaggtccgccgatcgtttcagtggtctattcctgagcggttcaatatcggcgtcgacatctgcgacaagtgggctgaggcagacccaactcgtctcgcgatagttgacgtcgatccggctggttttacgcgcgaatacacattttccgacctgcgcacgatgtcgaacagattagcgaatgcactttttgggcatggcgttggccgacaggtgggtgaaacgggcgaccgagtgggtgtgttgcttcctcaacgtgtcgagactgcggtagcccatatcgccgtgaccaaactcggatgtgtgtcgataccacttttcaccctgttcggtccggaggcgctcgagcaccgacttcgcgactcaggcgcgagggtagtcattaccgaccgtgccggcgccgaacgtgtcgcaagcatccggtctcgcgtgccttcgatagaactcgtcgtctgcgtggacggccggggggagggcgacgaagtctcattccaagagatgtgttctgagcagtcggacacgtttatccccgtcgatactcactccgatgacccggcgatcctcatctatacgtctggaacaaccggcaatcccaagggtgcgctacatgctcatcgcgtcctgctgggacatctgccaggtgtggagataagtcatgactttctgccgaagcccgacgaccgcttctggacacctgccgattgggcgtggattggaggactgctcgacgtactgatgcctgcgcttcatcatggtattccggtcgtcgcctgccgcttttcgaagttcacgaccgaggcggcgatcaccctgatccgctcgcagaggatcagaaacgtattcctcccacctaccgccctgaagatgctgaaactcaagcctgctgaggaatgctcggggctcgacctccgttccgtcgccagcgggggagagacgttgggcgccgagctgatccagtggggcaaggacgcgttaggcgtgacgatcaacgaattctacggccagacagaatgcaacatgatcgtctcgtcttgtgcggccctggagccgcccgcactaggatctatgggacggccggtccctggacatgatgtcgacgtcattgatccggtatcgagactgagacagcctgcaggcgtggagggggctattgcggcactcgctcccgaccccgtcatgttcctagggtactggaacaacccggatgccactcgggagaagttcattcatggacccgagggccgatggctggttaccggagaccgaggtgtcagggacaatgatggacgtttgcgctttgtcggacgagacgacgatgtcatcggctccgcggggtatcggatcggtcccgctgagatcgaagattgcctgctcggtcacccgtcagtgcgtctggccggtgcggtcggcaagccggatgaaatcaggggttccgtcgtggcggcgtacgtcgtcctgcgcgaaggattcagtccttcgcaaaaccttgcagaggacatcgcggcacacgtgaaatcgcgcctcgccgcgcatgaatatccgcgggtcgtcaggttcatagacgagatgccgatgaccaccaccggcaagatcatccggggagcgctcaggaagattgcgcaggaagaagccgctctcgaagcacgatccaggcagaaagattaa

SEQ ID NO: 35880 - DNA, 1446 bp, Mesorhizobium loti
gtggagcacgcgatgttcgacgccaggacctacgagctcttcattaacggcaaatggcgagccggtggcagcaaagcaacattgccggtgattaacccggcgacggagaaggtatttgcctcggtggcctcggccacggtgtcggacttggatgaggctcttgcttcggcagaacgcagccgcaaggcgtggtcctcgcggccagccaaagatcggggcgagatcctcgtagcagccgcaaggattctagcagagaaggctgcagccgcagcccgggacctgtcggccgaacagggaaaaacgattgccgaagcgacaggtgagtacgcgcgcgctgtcgaaacgctggaatggaacggcagaaatgttgaagagctgtcggcctcgattccgttgggcccgaaccggatgatcgtcccggaggcgctcggtgtcgttgctgcctttacgccttggaactatccggccgttctcatcgcgcgcaagctcgcccccgcgctggcggcaggctgcccggtgatcctcaaaggggctgaagagacaccgagcgtggctgtccatatcgttgaatcgttgcgccaagcaggcatccccgacggcgtggtcaatctggtcttcggtattccggtgcatatatcgcggcatctcctgagttccccaaccgtgaaggtcttgactttcaccggttcaaccgcggttggaaaacagctggccatgctcgccgcgaataatttgcagcgctgcattcttgaactcggtgggcactctccggttattgtgtgcgaggatgccgacctggcaaaggccatacccgcgatctcggaatacaagttcgagtgcgcgggccagagttgcaatgcgcccagcaggattcttgtcgctcggtctctctatgagcaattcctgtcccggatgacggatgcggcccgcaagataaagatcggcgcaccggacgaccctgcaacggagatgggtccgatggcaaatgcgcggcgaatcgaggccatgcagcgtctgaccaaggatgcggtcgatcgtggcgcccgcatcgagaccggtggaacccgcctcgacggaccgggcttttactggccgccaaccatcctgacgggtgtgccaaaggatgccagagtgcttcatgaagagccgttcgggccgatcctcacggtggcgccgttcgacacgcttgaggaggccatcgaggaagccaacgccaccgagtacggcctggccgcctatttcttcaccggcgctgccgatgcgcaacagaagcttatcaacagtctttcagcaggcgctgtcagtgtgaattacctgaaaggggtttccgcggatgcgccctatgggggcgtcaaacagagcggctatggatatgaaggaggcgagcagggagtgcggagcttccagatcttgaaaatggtcaacggcctcagctcatttggatga

SEQ ID NO: 35881 - DNA, 1407 bp, Mesorhizobium loti
atgcggttgagcaatctgggaaccgagcaactcagagagaaggatcgaagcttcgtctttcatccgtccacgcatctggccaagcacagccgaggcgagaccccaaatcggatcatggccggtgcggaaggcgtgtacatctgggataccgaaggccgaaagagcctcgacggtttcggtgggctctactgcgtcaatatgggatatggctgcacggaaattgccgaggccattgccaggcaagcacacgaattgccgttcgcccatgtctatgcaagtcaaggaacagagccagtcgccctcttggcagaggccgtcgtcgaatattttggccagaacatgcgaagggtctttttcggcctttccggctccgacgccaacgaaaccaacatcaagctggtctggtactacaacaacattctgggccgccccgaaaagaagaagatcatctcgcgacatcgcggttatcatgggtctgggctggtcaccgggagcctgacaggccttgccttcttccataatttcttcgacctgccgctcgatttggtgcgccataccacgacgccgcaccactatcgccaggcgcatgacggcgaaagtgagcaagcgttctcgacacgctgcgcggatgaacttgaaggccttatcctcgctgaaggcccggagaccgtcgcagcttttatcggcgagccggtgcttgggacaggcggtatcgttccacccccaaaaggatactggaccgcgatccaaggcgtgctcgacaagtacgatatcctgctgatcgccgacgaggtggtctgcgggtttggacgaaccggtgagcaattcggttcccacctctatggcatgcggccggacttcgtgaccatcgccaagggtttgagttccgcctacctgcccatctccgggtcaatcattggcgaccgcgtctggtcggtcttggaacaaggaacagagaagcacggcgctctcggccacggctggacatattcaggtcacacgctttgcgctgcggccgcgctcgccaatattcgactcctaaaggaaagaaatatcctggagcatgtccgcgatgtcggaccgtattggcatgcccgtatgaatgccgaactggcgggacaccccatcgtcggagaggttcgtggtgtcggaatcctcgccgccgtagagctgatgcgagatccaaagcagagaataccgtttgaatccgatcttcaggtcggcgttcgcgccgccgctgctctgttcgagaatggtgtcatcggccgtgccatgccacacggcgatatcctcggctttgccccgcctttgatcatcacccgtaaggagatcgacataatcgtcgacgcaaccgcgaaatcagtcgagacgacctatcgcgcgctgaaggccgagggtgcgatatga

SEQ ID NO: 35882 - DNA, 1176 bp, Mesorhizobium loti
atgaccaggcagttcgtgttctcttccgaatccgtcggcgcgggacaccccgataagatggcagataacatctcggatgccatcctcgatgccatcctccgcaccgacccgaaggcgcgcgtcgcctgtgaaacgttggtgaagacagggatggtcgttctggctggagagatcaccagccacgcggtgatcgattatactcaagttgcccgcgatacgatcctcgatattggctacgacgacgatggcatcggctttgatggtcgacgttgcgccgtcgttctggctctcaccgagcagtcgcccgacataagccagggcgttgatgagggacgagggcaggatctcgagcagggggcgggggatcagggcctcatgtttggattcgcatgcaacgagacggatacattgatgcccttgccgatccaactcgctcatcatttgacgaaaagacaggctgaggtccggaaaacgggacagcttggctggctgcgtccggatgtgaaatctcaagtgtccgtacgctacgagggtttgcgcccggtggcgctggataccattgtcctgtcgacgcagcatgatgaggcggtctcacaagccacggtccgggaaggggtcattgaggagatcataaaaccggtcctgccgacccacctggatacgacagggatcagatttctggtcaacccaacagggcggttcgtggtcggtgggcctgccggcgactgcggcctcactggacgcaagatcatcgtcgattcctacggtggaacggggcgtcacggcggcggcgccttttcgggcaaggacccatccaaggttgaccgctcggccgcctatgccgcccggtatgtcgcgaagaatatcgttgccagcggccttgccgaggtctgcgaggttcaactcgcctacgcgatcggcgtggccagtccggtttctgtcatggtcaacaccttcggaactgcaaggatcgaggaaaaaaggatcgagtgccttgttcttgagcttttcgatctccgaccgaaaggcatcatcaagatgcttgatctcgtacgcccgatataccgcaacacggcgacatacggacacttcggccgtgaagagcctgagttcacctgggagaagacggacagagccgacgacttgctgcgtgaagcaggaccggcagctgcgtga

SEQ ID NO: 35883 - DNA, 2331 bp, Mesorhizobium loti
gtggcaacgctcggcgtgccgcgtatcggtcgacggcgggaactcaaattcgcgcttgaaagctactggtccggaaaatctcccgctgccgacctgctcgcgacggcgaaggcgctacgcgccgccagctggagggagcagcacgatcgcggcgtgtcgaaaatcccgtccaacgatttctcgctttatgaccatgtgctcgacaccgtcgccatggtcggcgccgtgccggcacgatacacttggactgacggcgaggtcccactcgatacctatttcgcaatggcgcgcggcaaccaagatcaggccgctgattgcggacatgccggtgacgagcatgcggccaacgggcatggccttgccgcgatggaaatgaccaaatggttcgacaccaactatcactacattgtgccggaacttaccgacgatcagagctttgccctctcgtcggcgaaaccggtcgatcatttcctcgaggccaaggcgctcggcatccacacgcgcccggtcctgcttggaccggttacctttctcaagttggcgaagtcacctgaggaaggtttcaaccctatcgcgctcctgccacggctgctgcccgtctacgaggagctcctgcggaggctgaagctcgcgggagccgattgggtgcagatcgatgagccggcgctcgtggtcgatctggttcccaacgaacgggatgcgctccaattcgcctactgccggctgtcaaaagcagcaccggagttgaagatcatggtcgctatctatttcggatcgctgggagacaatctcgagaccgcaatttctctgcccgtggcgggactgcacgtcgatctcgtgcgcgctccagagcagttggagaccgtcggccggcttgcgcagaaggaccttgtcctctcgctcgggctgatcgacggccgcaacgtctggcgcgcgaacctgcctgccatacttgaccgcatcaagccgatcgtcgccggctggccgctggaccgagtggagatcgccccgtcctgctcgatgctgcatgtgccgatcgacctggacatggagacggccctcgatgcggacgtgaaatcgtggctcgccttcgcggcgcaaaaaaccgacgagctggtcgtgctcgcccgtgccctggctgaaggccgggacgcggtcgccgccgaactggaggcgtcggctgaggctgccgccgctcgcgcgacatccgctaaggtgcatgatccgctcgtcgaaggtcgggtcgccagcatcaaggtcgccatgacgcgccggaagagcgcattcgacgtgcgctccaagcttcagggcgacacgtttggcttgccatccttccccaccacgacgatcggctccttcccgcaaacagccgaggttcgcaaggcgcgggcagcccatgccaagggcgagctgagttacgtcgactatgaggccttcctgaaaaaagagatagaagccgccgttcgctggcaagaagagatcggactcgacgtgctggtccacggcgaattcgagcgcaacgatatggtgcagtatttcgccgagcagctccgcggctttgccttcacgcagcatgggtgggtgcagagctatggctcgcgctttgtgcgacccccgatcatcattggcgatgtgtcgcgacaaaatccgatgacactacactggtggcgatacgcccagtcgctgacgccaaagccggtgaagggcatgcttaccggcccggtgacgatcctcaactggtccttcgtccgagacgaccttccgcgctcagccgtctgccgccaagtcgcgctcgccattcgcgatgaagtgagcgacctcgaaaaggccggcgccaagatgatccagatcgacgaagccgcactgcgcgagggcttgccgctgcgcgaggccgactggcaggcctatctcgactgggccgtcgaatgcttccggctggcttcaacggcggttggcgatgcgacccagattcacacccatatgtgctactccgagttcggcgacatcgtggacgcgattgctgcaatggatgccgatgtgatctccattgaaacctcgcgctcgcagttggaactgctcgatacgctgcgaaccttcaagtatccgaacgagatcggtcccggcgtctatgacattcactcgccgcgggtcccggaagtgggcgaaatttccaacctcatcatgcttgcgcgcaagcgattgtcggatggccaactgtgggtgaatcccgactgcggtctcaaaacgcgcaggtgggaggaggtccgccctgccctggtgaacatggtggctgcggcacgcgcaattcggcaaaaagcgcagacggcgtag

SEQ ID NO: 35884 - DNA, 1023 bp, Mesorhizobium loti
gtgttgaagcgtaagttgggcccagaggatttgcggcggctcgagactcctgcgatcgaacgggagtctcacgggcaaacaagcgcgaaaagctccgtgcctgactctgcgtcaaccgtggcagtcgattttgccggcgtaaccaagtcgtatgggaacaagatcgttgtcgacgaactgtcgttctccgttgcgtcgggagagtgtttcggcctcctcggaccaaacggggcgggcaaaagcacgattgcgcgtatgctcctcggcatgacatgccctgacgcgggcacgatcacggtgcttggcgtcccggtgccggcgcgcgctcggctggcacgcaggggcattggcgtggtcccgcaattcgacaatcttgaccaggaattcaccgtacgcgagaacctgctggtgttcggacgctacttcggcatgagcacacgtcagagcgaagcggtcatcccgtcgcttctcgagttcgctcgcctcgagcgcaaggcggatgcgcgcgtctcggaactgtccggcggcatgaagcgatgcctgacaatggcgcgggcgttgatcaacgacccccagctcattgtgatggacgagccgaccaccggcctcgatccgcacgcgcgccacctgatctgggagcggctgcgcgccctgttggcacgcggcaagacgattatcctgacgacgcatttcatggaagaggctgagcgattatgcgatcggctgtgcgtgctcgaaaagggccgcaacatcgccgaaggcggcccgcaggcgctgatcgacgagcatatcggatgccaggtcatggagatttatggcggcgatccgcacgagttgctttcgctggtcaagccacattcccagcgcatcgaggtcagcggcgaaaccctttattgctatgcgccagaccctgaccaggtgcgcacgcaactgcaggggcgagcaggtctgcgtcttcttctgcgtccagccaatctcgaggatgttttcttgcggctgaccgggcgcgagatggaggagtga

SEQ ID NO: 35885 - DNA, 909 bp, Mesorhizobium loti
atggcaaagtgggctggtgtattccccgcagtgacgacgaagctgacgagggatggcaaggttgaccttcgggcgaccaaggacagccttgaccgcctcgtcaaggcaggtgtttccggcgtcattgtgcttcccatgctaggcgagaacgcttcgatgtcgctgaaggatcgtgaagacatcatcggaggtgctgtcgaagtcgtagctggtcgtgttccggttctctccggcctcgccgaaatcacactcgacaatgcgaaggcaaacgccaagctctacgaatcgttcggcgcccaggggctcatggtattcccaagccttggctacaagaccgacgatcgcgaaacggtcgagtggtacaagggggtcgccagcgcttcctcgcttccgatcatgatctacaacaacccgatcgcctacggcgtcgactgcacggtcaatgttctcaagcaacttgtcgacaccccggaaatcgtctgcgttaaggaagaaactggcgacattcgtcgcgtcaccgacatgtttgtcgagctcggcgaccgcttcagcatcttctgcggcgtcgacgatctgattgtggaaagttgcgcgctgggtgttaccggctgggtctcgggcatgaccaacgtttggccgtcagaatgcgtcgagctcttcaacctctgcatccaaaacaggtacgaggaggcgcgcgcgctttaccacatcctgacgccgtccttccatctcgacacccacgtgaagctggttcagtacatcaagctcgccgagagcctggtctacggcgcaccggaatggacccgtgccccgcgcttgccactcgtcggcgaagagcgtgactttgtcacatcgacgattcagctagcaatcgagaccttggccaagcgggtgaagaaggccgcctga

SEQ ID NO: 35886 - DNA, 1224 bp, Mesorhizobium loti
atggccaaaagagcgcttatcctggttgaaggctcgaggactggtctgctgtacgtccaagcggcccagcggcttggcctttctccaattactctgtcggctgatccgacgcagtacgactacattgcggcggaagggattgaggcaattcatgtcgatacagccgatctcgatgctttgatcggcgaatgttcccggctgcgtgcgacctatgagattgccggaattacgtgcgccaaggagtcggtctatgcgacggttgccaagctttgccggcatttcgatctaccgggaccaaaccctacatcgattgaacgatgttgcgacaaattcacccaacgtcaactcctcgcggaggccggcgttccagtaccgtcgtatcgcttggcagcgaatgcggcggacatagaaagctatgccgctgaaatcgggctgccggtaattcttaagccagccgtgggtgtcggcagcagcggtgtccgattatgccgcaacggcgatgagttggccgaacacacgacctatctgttgggcgggaagcacatatggcgatcttcgccgcggatactggtcgaagaattcgcacaaggcccatactatagcaccgagataatgggagatgaggtcatcgggatttacgccggtgagttcggccccgaaccgtatttcgtgtttcgtgaattcaccctgccggccctactgactgacgaagagcaagagcgtatcgtcgacgtttcgctggggtgtttgcgcgctctcggccttggctgggggccaacctgcatagaattccgatggacgaagcgtggcccagtcgtcattgaagttaatccacgtcttggtggcgcgcccggtcctcaactggttcagctaacttacgggctcgaccttgtcaccgagcacatcaagcttgtcatcggcgagaaatgggatttgcgcagaaggcactcgcacacggccgccgcgcgaatcctagttcctgatcgcgatggcacccttgattggatcgacggcgacaatcgggcaactgctgtaccaggcgtcgccgaggtcgaattctacattggacccaatacgccgatcgtcaggaaaggcgatcaccgggactggatcggccatgttatcgtcgcctcacccagtcgtgcgctaaccgaagcgacacttcaccgggccgtcgatctgatcgattggtcgatcgcaccatttccgactcttggcgaatag

SEQ ID NO: 35887 - DNA, 1359 bp, Mesorhizobium loti
gtgacaacgcaggtatcagaacataatcacgacgatgcgatctgccctgtcgatccggcgatctcgtctttgagagctacggcaaaggggatcgacacgcgcgtcgtgcgcggcaggatcacgcgggctgtcggcacactggtccatgccgtcctgccagacactcgtattggagaactttgcctcctacaggacccacgaaccggactgtcgctggaagctgaggtgatcggcctgttggatgatggcgtattgctgacgccgatcggcgacctggtcggcctctccagccgcgcggaagtcgtggccactggacgaatgcgtgaagtacccgtcggcaacgatttacttggccgggtgattgacagtcgctgccgtccattggacggcaaaggccaaatcgagaccacagaaactcggccgctgcacggcagagctccaaatccaatgacaaggcgcatgattgaacggcccttgccccttggggtgcgtgttctggatggtctcctgacgtgcggcgagggccagcggatcggaatttacggcgagccaggtggtggcaagtcgaccttattgtcacagatcgtaaaaggtgccgccgctgacgttgtcatagtcgcattgataggcgaacgaggacgtgaagttcgtgaattcatcgagaggcatctcggggaagagggccttcgccgtgccgtcgttgttgttgaaacgtccgaccgctcggctgttcagcgggcgcaatgtgctccgatggcgacagcgctcgcggaatattttcgcgaacaagggctacgcgttgctctcatgctggactcgctgacacgcttctgccgcgccatgcgtgaaataggccttgctgcgggcgagccgccgacgcgacggggcttccctccttccgttttcagcatgctgccaggcctgcttgagcgcgccggcatgagtgagcgtggctcaatcacggcgttctataccgtgcttgtagaaggcgatggcacaggggatccaatcgctgaagagtcgcgcggcattctcgatggccatgtcgtgctctcgcgcgctattgcggcgcgatcgcatttccccgctatcgatgtactacagagtcgcagccgcgtgatggatgcggtcgtttcgcggacacatcgcaaggcggcatccttctttcgtgaactcctttcccggcatgccgagaccgagttcttgatcaacgtcggagaatacaagcaaggcggcgatcccctgacggaccgggctgtcgagtcaatagacgaactgagggagtttttgcgccagagcgaagacgagatctcagggtttgaggaaacggtcgcatggatgtcgcgtctgaccgcgtaa

SEQ ID NO: 35888 - DNA, 966 bp, Mesorhizobium loti
atgcagaccgattccacgctacacgacgacgcgcaggcgcgcggcgcatccggcaggctgccgtcggagatctggatgcaggacggcgtaaggcgggtcgaacaggcgctggcgcgtcttctctgcgccgaagacgacggtgagaccgagctgatggcggcgatgcgctacgccaccttgcatggcggaaagcgcacccgcgccttgctctgtctggctaccggcgcactggccgacacgccggcgcccatgctcgacgatgtcggcgccgccatcgagatgatgcacgcctgtaccctggtccacgacgacctgcccgcaatggacgatgacgtgcttcgccgcggccttccgaccgtgcacgtcaagttcggcgaagccactgcgatcctggtcggcgatgcgctgcaggcgcacgccttcctgaccctggcgagcctggatgcgccgagcgacaaccgtatcgcgctcgtgcgcgaactggcgcaggcggtgtccgccgagggtgccgcaggcgggcaggccatggatctgtcgctggtaggaaagcacgtcgagctggacaggatcgtggcgatgcaccggatgaagagcggagcactagtgcgcgcgtccgttcgcatgggcgcgctatgcgccatcgcggaggatgccgcccacgctgcgctgtactgtgcgctcgatcgctactccgcctgtttcggcctggcgttgcaggtggtcgacgacattctcgacgcgacagcggataccgcgacgttgggcaagacccccggcaaggacgcggcggcgcagaagccgacctgtgcgtcgatcatggggctgcaggcagcgcgccagttggcgctggatctgttgcgcgacgccggggaggccatccccccgctgggaacgcgtgcggaacggttggcgcagatgctgcaacgggccaacgcgtatctgttcaagcacgcgccatgcgcatga

SEQ ID NO: 35889 - DNA, 1551 bp, Mesorhizobium loti
gtgaacgcgctgtccgaacagatcctttccgaattgcgccacctgctgatcgagatgagcgacggcggcagcgtcggtccgtccgtctacgacacggcgcgagctctgcagttccacggcaacgtcaccgatcggcaggacgcatacgcgtggctcatcgcgcaacaacaggccgatggcggatggggaagcgcggacttcccgctgttccgccatgcgcccacctgggcgacgttgctgacattgcagcgtgccgatcctcttcccggcgcggccgacgcagtccaggctgcaacccggttcctcgagcgccagcccgatccctacgcgcattcggtgccggaggacgcgccgatcggcgcggagctgatcctgccgcagttgtgcggcgaggccgcatccttgctgggcggcgtggggtttccgcgccacccggcgctgttgccgttgcggcaggcgtgccttgtcaagttgggggcggtggcgacgttgccgagcggccatccgttgctgcactcctgggaagcctggggaacgtcgccgaccaccgcatgccccgacgacgacggcagcattggcatcagtccggcggccaccgccgcgtggcgtgcgcacgccgtaacacatgggagcacgccgcaggtcgggcgcaccgacgcgtatctgcaggcggcatcgcgggcgacgcgcagcggcatcgaaggtgtcgttcccaacgtctggccgatcaatgtgttcgagccatgctggtcgctgtacaccctgcatctggccgggctgttcgcgcatcccgcgttcgccgatgccgtgcgcgtgatcgtcgcgcagctcgacgcccgcatgggcgtgcgcggtctgggcccggccttgcacttcgcagccgatgccgacgacacctccgttgcgttgtgcgtcctgcgccttgcaggtcgcgacccgccggtcgatgcgctgcgcgatttcgaaatcggcgagctattcgtcaccttccccggcgagcgcaatgcctcggtgtcgaccaacatccatgccctgcatgcgttgcgactgttgggaaagcccgccgccggcaccagctactacgtcgaggccaatcgcaacccgcacggtctatgggacaacgaaaaatggcacgtttcgtggctgtatcccaccgcgcatgcggtcgctgcgctggcgcaaggcaagccccagtggcgcgacgagcgcgcgctggcggcgctgctgcaggcgcagcgcgatgacggcggctggggcgccggtcgcgcgtcctcatttgaggaaaccgcctatgcgctgttcgcgttgcacgtcatggacgggagcgaagagccgacagggcgccggcgcatcgcgcaggcggtggcgcgtgcgctggagtggatgctcgctcgccatgtggcgcatgcattgccgcagacggcgctgtggatcggcaaggaactgtattgccccacccgggtcgtgcgggtggccgaactcgccgggttgtggctggcgcttcgttgggggcggcgcgtcctggccgagggagcaggagcggcgccatga

SEQ ID NO: 35890 - DNA, 891 bp, Mesorhizobium loti
atgatgactttgtttcgcggcctgtcggcgttcccccttacgccaaccgatgcggaagggcatgtcgacaccgagggtctggctcgttttctcgagcgtattcaacgcgccggagcggactccatcggccttctggggagcacgggcggttatgcttacctcaccagggaagaacgcaagcgtgccgttcaggctgccgtggaatgcatcggcggcaaaacgcctcttgtcgtgggtgtgggtgcattgcgtaccaatgaagctcaggctctggcgcgcgatgccaaatccgctggcgctgacggcctgctcctggcaccgatgtcctacgttcccctgaacgaggacgaagtcttccagcacttcgtcgcggtggccgaggcgggggaattgcctttgtgcatatataacaatccaagcaccacgcgcttcacattcagcgacgcattgatcgcccggctgtcagaggtgtccaacatcgtcgcggtgaaaatgcctctggcggcgaatgacgattacgcgggggaactggcacgtttgcggtcgatgacgcctgacacgttcacaatcggatacagcggcgattggggcgcggcggatgccctgcttgccggatgtgacacctggtacagcgttgcggcaggtctgctgccggtcccggcgcttgcgctgacgcgtgcagcgcagtccggcgacgcggtggagtccactcggttgaaccgcgctttcgggccgctctggaccttgttcaaacactacggcagcttccgcgttatgttcgtcatcgccgactacctcggtctggcgcacgtccagccaccgcgccctattttgccgttgccggaggacgccggagatgacattaggcaggcattggagaagctcgaatag

SEQ ID NO: 35891 - DNA, 1824 bp, Mesorhizobium loti
atgtgcggaattgttggcatcgttgggcaacagccggtgtcggaacgcctggtcgacgcattgaagcgtctggaataccgcggctatgattcggccggcattgcgacgatcaccgatggcaccttgcaccgccggcgcgcggagggcaagctcgtcaatctcgagaggagactcaaggaagagccgctgggtggtaccatcggcatcgcccacacccgctgggcaacccatgggccaccgacggaacgcaatgcacacccgcacttcacggatggtgtggccgtcgtccataacggcatcatcgagaatttcgccgaactgaaggacgaattggcggcgacgggagccgagttccagaccgacaccgacactgaggtccttgcgcatctcttggcaaggcaccgccgggagggcatgaggcgtggtgaggcggtgcatgccatgctgaaaagcgtcaggggtgcctacgcgcttgccatcctctttgaggatgatccgtcgaccatcatcgcggcgcgcaatggaccaccgctggcgatcggtcacggcgacggcgagatgttcctgggctccgacgcgatcgcgcttgctccattcacgaatgaaatcacctatctcatcgacggtgactgggccgttgtcggcaggacgggcgctgatatatttgattacgacggccaccccgtcgcgcgtccgcgccagacctccgtggccgtggccactctggccaacaagggcagccatcgccacttcatggagaaggaaatcctcgagcagcccgaggtcatcgccgatgcgctcggtcattatatcaatttcatcgaaaatggtgccgatgcggtttctggcatcgacttcgccaagatcccgagcttggcgatctctgcctgcggcaccgcatatctcgccgggctgatcggaaaatactggttcgagcgctatgcgcgcctgccggtcgaaatagatgttgcatccgaattccgctatcgcgagattccattgtcgccgcagtctgcggctctgttcatttcacagtcgggcgaaaccgccgatacgctggcatcgctgaggtactgcaagcagcttgggctgaaaattggcgctgtcgtcaatgcgcgcgaatcgaccatcgctcgggaggccgatgtggtcttcccgatccttgccggcccagagatcggcgtcgcctccaccaaggccttcacctgccagctagccgctcttgccgcactcgccatccacgcagccaaggcccgcggaaccgtgaccgaagatgaggtgcaggcgctcgtcgagagcctcgccgaaatgccgcgcctcatgaggcaggtactggacagcatccagccggagattgagcttctgtcgcgcgaactgtcaaagtgtcatcatgtcctttatctcggccgtggcacaaatttcccgctggcgatggagggggcgctgaagctcaaggagatttcctacatccacgccgaaggctatgcggcgggtgaattgaagcacggtcctatcgcattgatagacgagaacatgccagtgatcgtcatcgcgccacatgatcgctttttcgacaagaccctctccaacatgcaggaagtggccgcccgcggagggcgcattatcctcatcaccgatggaaaaggggcagccgcatcgaaactcgatacgatgcacacgatcgtgctgccggccaccgacgagattatcgcgccgatgatcttctcgctgccgatacagcttcttgcgtaccacacggcgctcttcatgggcacagatctcgaccagccacgcaacctggcaaaatcagtcaccgtcgaatga

SEQ ID NO: 35892 - DNA, 2289 bp, Mesorhizobium loti
atgagctgttgtgcacccagcgcggaactggcgctggatctgaccagtaccacatcggtcctgccgtctagccaggagatcaggttggcgagccgatcgcttggcgacaatctttggcagaccgacctttcagtgccgacggttcactgcgcggcgtgcatccaggccatcgagacggctctcggaaggctcgatcgcgtcgaaggcgctcgtgtcaacctgtcgacgaaacgggtcgcgatccggtggcgtggggactctgtgcctccgtttgtcgccgcgctgggacggctgggctttcaggcgcacctgttcgaagccgaccctgataagaaggacaagacgcttgccgagctgatccgcgcggtcgcggtcgccgggttcgccgccggcaacatcatgcttctttcggtctcggtctggtccggcgccgaaggtgctacccgcgacctgtttcactgggtctctgcattgatcgccatcccggcgctcacctttgccggcggcatcttcttccgctcggcctggaatgcactgcgccacggccgcatgaacatggacgtgccgatcgcggttggggtgtcgctcgcttatgccatgagcctctacgagacgatcaatcatggcgatcacgcctatttcgacgcgtccgtatccctgctgtttttcctgttgatcggccgcaccctggatcacgtcatgcgcgaacgggcacggaccgccgtgaaaggcctgtcccagttggccgcacgtggcgccatggtgctgcgcggcgatggcgcgcgcgactacctgccggttggcgagatcgaaccgggcatgcaactgctggtcgccgccggcgaaagggtgcctgtcgacagcagggtcattcgcggcgcgtcggatctcgactgctcgctggtttccggcgagagcacaccgaaaaccgtggcgtccggggaacaggttcaggccggcacgctcaatcttaccggcccgctgaccatcgaagcgaccgctgccgcaaaggactccttcctggcggaaatggttcggctgatggaagcccccgaaggtggtcgtgcgcactatcggcggatcgccgaccgtgtctcggcgctctacgcgccggtggtccatctcaccgccttcgtgacgttccttggctggatggcggtaaccggcgactggcaccgggcagtgacgatcgcgatcgccgttctcatcatcacatgcccgtgcgcgctcggtctggccgtgccgatcgtgcaagtggtcgcggcgcgccgcttgttcgaagccggcgtgatggtcaaggacggatcggccattgagcgcctggcagcgatagacgtggcggtattcgacaagaccggcacgctaacgctcggtcagcccaggctggtcaacgcgtcgaccatcgatccggcgatgctggcgatcgcagccgacatggcggcgcactcccgtcacccgttctcgaaggccatcgccgcattcgcgggttttgccggccagccgaagctggaagccgtcagcgagcacccgggtctcggcatcgaagcgacgaccgcggacagcacctggcgtcttggccggcgcggctgggccggatggaaagcccggaccggtggcgaaggcaagtatggcggctatggcgggacggtgctttcgaagaatgggaggatcgtcgcctccttcacgttcgaggacgctacgcgcgccgacgccaaggcggcggtcgggcaattgaaggatgccggcgtgtcggtcgaaatgctgtccggggatatagtccatgcctgcggcgaggttgccgggacgttggatatcgagagtttcgttccggcgctgcttccctccggcaaggttgagcggatcgaggtgctggccagggcgggccacaaggttctgatggtgggcgacgggctcaacgacacgccggccctcgctgccgcgcatgtctcgatcgcgccggcaaccgccgccgatattggccgcaacgcggccgatttcgtgttcctgcgcgaaagcctgctggcggtgcccctggcgctggatgtctcgcggcaagcgggaaggctgatccggcagaatatcgccattgcgatcgtctacaacgctgtcgccgtgccgattgccattctcgggcacgtcacgccgttgatcgcggcgatcgcgatgtcggcctcatcgctgctggtcatcggaaacgggctgcggctgcagggctttaggctcgccgagctgacgagggcttcttcggcaacgcattccggcattcacccatcagcgcggtcatcatga

SEQ ID NO: 35893 - DNA, 1467 bp, Mesorhizobium loti
atgagtttcaaaatcgctatcatcggtgccggcagcgtcggattcaccaagaaactgttcaccgacatcctgtgcgtgcccgaattcagggatatcgaattcgcactgaccgacctcagcgaacacaatctcgggatgatcaaggcgattctcgacaaggtcgtcgaggcgaacgggttgccaaccagggtgacggcgacaaccgatcgccgcaaggcgctcgaaggcgcgcgctatatcatcagttgtgtgcgggtcggcggcctcgaggcctatgccgacgacattcgcattccgctgaaatatggcatcgaccagtgcgtcggcgacaccatctgcgcaggcggcatcctctatggccagcgcaacattcccgtgatcctcgacttctgcaaggacatacgcgaggtcgccgcgacgggcgccaaattcctcaactatgccaacccgatggccatgaacacttgggcggcgatcgaatacggcaaggtagacacggtcggcctctgccacggcgtccagcatggcgccgagcagatcgccgaggtgctgggagcgaagtccaggcacgagctcgactatgtctgttccggcatcaatcaccagacctggttcatcgatttgcggctgaatggccgcaagatcgccaaggacgaactggtcgaagcgttcgaggcgcatccgatctattcgcagcaggaaaagctgcgcatcgatgtcttgaagcgcttcggtgtctattcgaccgagagcaacggccatctctccgaatatctgccctggtaccgcaagcggcccgacgagatcacccgctggatcgatatgtcggactggatccatggcgagaccggcggctatctccgctactccaccgaaacccgcaactggttcgagacggagtatccgcaattcctcgaagcggcgtcgaagccgatcgatccggccaagcgctccaacgaacacgccagccacatattggaggcgctggagaccaatcgggtctatcgtggccacttcaacgtcaggaatgatggcctgatcaccaatctgccgcaggatgccatcgtcgagtcgcccggcttcgtcgaccgtttcggcatcaacatggccgccggcatcacattgccggaagcctgtgcggccacctgcatgtcttcgatcaacgtccagcgcatgtcggtgcatgccgcgatatcaggcgacatcgatctcctgaagctcgccgtgctgcacgacccgctggtcggcgcggtgtcgacgccggaggaagtctggcagatggtggacgaaatggtcgtcgcccaggctcaatggctgccgcaatatgcgcatgcggttccggccgccaaggagcggctgtcgaaatccgcggtcaagacccgcgaatgggcgggtgctgcgcggcgaaacgtgcgctcgatcgaggaattgcgcgccgaaaaggccgcgctcaaacaggccggctga

SEQ ID NO: 35894 - DNA, 1668 bp, Mesorhizobium loti
atgaccgtcgtactcgccgagtccttcgcgcccatcgttcgtcatgaccatgacgggcgccaggaccagcccatcatcgacgcccgcaacatcgaggtcgccttcaaggtcgagcacggcgttgtcgaagcggtcaaggacatctcgttccagctctatcgcggcgagacgatcgccatcgtcggcgaatccggttccggcaagtcggtgacggcgcgcgccgtcatggggctgctgtcgcgccgggccaccgtgtcgccgaaatcgagcatctgttacgacggccagaacatcctgaaattccccgagagcgagcggcgcaagctgcgcggcaaccgcatctcgatgatcttccaggagccgatgagctcgctcaacccgatctatacggtcggcagccagatcgtcgaggcaatccgggtgcatcgcaaggtgagccgcaggcaagcctgggcgcgggcgctcgagctgctgcggcatgtccagatccccgagccggaggcgcggctcaagcagtatccgcaccagctctcgggcggtcagcggcagcgcgtgatgattgccatggcactggccaatgatcccgacgtgttgatcgccgatgagccgaccaccgcgctcgacgtcaccgtccaggcgcagatcctgaacctgatccgcaatctgcagaaagagctgcggatggcggtgatcctgatcacccacgatctcaccgtggtgcgcaaattctccgactatgtctatgtcatgcagcatggcgcgatgtgcgagcacaacgtcaccgaacggctgtttgcggacccacagcacccctacacgcagcggctgctcgccgcggagccgcgcgggcgtccgcagccgcttcctgagggcagcggcgccatcctcgaggcgaatgatgtgcgcgtctgcttcatgctgcgccatggcggtttcctgaagcccgactggcgcgagctggtcgccgtcgacgatctcggcctcaggctttgccgccacgagacgctggggctggttggcgaatccggttccggcaagaccaccttcggccaggcgctgttgagattgatcgacgccaggcgcggcgagatccgtttcgacggtcaaccgatccaaggcctgtcgcgcaacgagatgcggccgctgcgctcgcgcatgcagatcgttttccaggatccgttctcctcgctcaacccgcgcatgacgatcggccagatcatcgaggaggggctgatcgtcaacagcctcggcgcgacgcgggcggagcgggtggaccgggtgcgtgaggcgctggtcagcgccggcatgccgggtgatatcctgtcgcggttcccgcatgaattctccggtggtcagcggcagcgcatcgcgatcgcccgcgccatcgcgctcgagcccgaactcatcttgctcgacgagccgacatcggcgctcgacctctccgtccaggcgcagatcatcgacctcttgcgcaagctgcaggacgagcgcggcctcagctacctcttcatttcgcacgacctcaaggtggtgcgcgcgctgtgccatcgcgtcatcgtcatgcagcatggcaagatcgtcgagcagggacccgtcgacgagatcctcacaaatcccaagaccgcctacaccgaacggctcgtccgagccgctttcgacgtggcttga

SEQ ID NO: 35895 - DNA, 1386 bp, Mesorhizobium loti
atgccggaggttagcatggcaagacatcccaggatcactttcatcggcgccggctcgaccgtgttcatgaagaacattgtcggcgacgtgctgcagcggccggccctctcgggcgcgacgatcgcgctgatggacatcaatccgcagcggctggaagagagcgccatcgtcgtcaacaagctgatcgcgacgctcggcgtgaaggcgaaggccgagacctattccgaccagcgcaaggcccttgccggggccgatttcgtcgtcgtcgccttccagatcggcggctacgagccctgcaccatcaccgacttcgaagtgccgaagaaatacggcctgcgccagacgatcgccgacacgctcggcgtcggcggcatcatgcgcggcctcagaaccgtgccgcatctgtggaagatctgcgaggacatgctcgccgtctgccccgaagcgatcatgctgcaatatgtcaacccgatggcgatcaacacctgggcgatctcggagaaataccccaccatcaagcaggtcgggctctgtcactcggtgcagggcacggcgatggaactcgctcacgacctctcgctgccgtatgacgagatccgctatcggtcggccggcatcaaccacatggccttctacctgaaattcgagcaccgccagcccgacggctcctaccgcgacctctatccggatctcgtgcgcgcctatcgcgaaggccgcgcgcccaagccgggctggaatccacgctgccccaacaaggtacgctacgagatgctgaccaggctcggctatttcgtcaccgaaagctcggagcatttcgccgagtacacgccctatttcatcaaggagggtcgccccgatctgatcgagaaatacggcattccgctcgacgaataccccaagcgctgcatcgagcagatcgagcgctggaaagaccaggcgcaggcctaccgctcggcccagcgcatcgaggtcgaggagtccagggagtatgcctcctcgatcatgaactcggtctggaccggcgaaccgtcggtgatctacggcaatgtccgcaacaatggctgcatcacctcgctgccccgcgactgcgccgccgaagtgccctgccttgtcgatgcctccggcattcagccgacctatataggcgatctgccgccgcagctgacggcgctgatccgcaccaacatcaatgtccaggaactgacggtgcgggctctgatgagcgagaaccgcgagcacatttaccatgcggcgatgatggatccgcacacggcggccgaactcgacctcgaccagatctgctcactggtcgatgatctcctggccgctcacggcgactggctaccggcctgggcgcgcgtgagccgcaagaccgaggccgcctga

SEQ ID NO: 35896 - DNA, 1293 bp, Mesorhizobium loti
atggccatcacgcttcgccagtccgatgccgatttcgagcagcgcttcgccgctttcctgacgaccaagagggaagtgtccgaggacgtcgacgcaggggttcgccagatcatcgcacgcgtgcgcgccgaaggtgacgcggcactgatcgactatacgcaacgattcgatcgggccgatttgaaaagcctcggcattgccgtgtcgaagcaagacattgcggccgcttacgagacggccgatccaaaggcgatcgaagcgctcgaattcgcgcgcgatcgcatccgctcccaccacgagcggcagcgaccgaaggacgatcgctacacagatgccaccggcgtcgagctcggctggcgctggacagccatcgaggcggtcgggctctatgtgccgggcggcacggcgagctatccaagctcggtgctgatgaacgccgtgccggcccgggtggccggcgtcgagcgcgtcgtcatggttgtgccggccccgggtggcatcatcaatccgctggtgctggtggcggccgacatatcaggcgtgaccgaaatctaccgcgtcggcggcgcacacgcgatcgctgcccttgcctatggcacagagaccataaagccggttgccaagattgtcgggccgggcaacgcctatgtcgcggcggccaaacgccaggtgttcggcacggtcggcatcgacatgatcgccggcccctcggaagtgctcgtggtggccgacggcagcaacaatgcggactggatcgccgccgatctgctcgcccaggccgaacacgatgtgtcggcgcaatcgatcctgatcaccgatgatccggcctttggcaaggcggtcgaacaggctgtcgaacggcaattgcagaccctgccacgcggtgaaacggcagcggcgagctggcgcgatttcggcgcggtgatcgaggtcgcgaccatcgaggcggcgctgccgctggtcgaccgcatcgccgccgaacatgtcgaactggccatcgacgatgccgaaggtttcctgtcgcggatgcgcaatgcgggcgcggtctttctcgggcgccacacgccggaagccatcggcgactatgtcggcggctccaaccatgtgctgcctacggcacgctcggcgcgcttctcgtcaggcctgtccgtgctcgatttcgtcaagcggacttcgatcttgaagctcgggccggagcaattgcgcgtgctggcgccggcggcgatcgcgctcgccaaggcggaagggctcgacgcgcatggccgctccgtcgctatccggctgaacatgtag

SEQ ID NO: 35897 - DNA, 1293 bp, Mesorhizobium loti
atggatcgcatcagaattgtcggcggcaacaagcttgccggaagcattccgatctcgggcgcgaaaaacgccgctttgccgctgatgatcgcctcgcttttgaccgacgacacgctgacgctggaaaacgtgccgcatctggccgatgtcgagcagctgatccgcatcctcggcaatcacggcgtcgattactcggtcaatggccgccgcgagaagcagaatgaaggctattcgcgcaccatcaacttctccgcccgcaacatcgtcgacacgacggcgccttacgagctggtgtcgaagatgcgggcgtcgttctgggtgatcggcccgctgctggcccgcatgggcgaggccaaggtgtcgctgcccggcggctgcgccatcggcacgcgcccggttgacctgttcctcgaaggcctgcaggcgcttggcgccgatctcgatgttgacaccggctatgtcatcgccaagaccaagaatggtcgcctggtcggcaaccgctatgtcttccccaaggtctcggtcggcgccacccatgtgcttatgatggcggcttcgctggccaagggcgagacagtgctggaaaacgccgcctgcgagcctgaaatcgtcaacctcgccgaatgcctcaacgccatgggcgccaggatttccggcgccggtacaccgaccatcaccatcgatggcgtcgaatcgctgtcgggcgcgcgcgtgcgcgtcattcccgaccgcatcgagaccggcacctatgccatggcggtcgccatgacgggcggcgacgtcgtgctcgaaggcgcgcggccggagctgctgcagaccgcgctggacgtgatttcgcagacgggtgccgagatcacccagaccaattccggtattcgcgtgaagcgcaacggcgccggcatttcgcccgtcgatgtgaccacggcgcccttcccggccttcccgaccgatctgcaggcgcagttcatgggcctgatgaccatggccaagggtaagtcgcgcatcaccgagacgatcttcgagaaccgcttcatgcacgtccaggaactggcccggctcggcgcccacatcacgctttcgggccagacggcgatcgtcgacggcgtggcgaagttgaaaggcgcgccggtcatggccaccgaccttcgcgcttccgtctcgctggtcatcgccggcctcgctgccgaaggcgagaccacggtcaaccgcgtctaccatctcgaccgcggcttcgagcggctggaggaaaaactgtccaactgcggcgcggtgatcgagcgcatttccgcctga

SEQ ID NO: 35898 - DNA, 816 bp, Mesorhizobium loti
atgacgaacaggcttgttctcgccggctgcggcaatatgggctacgccatgctttcgggctggctgaaatccggcaagctcgcgccctcggcggttttcgttatcgagcccaatgcggagctgcgccagcgcgctgcaacgcttggctgcgccacatcagcggacgccggtgagattccagccgatgcggtgcccgatctcgtcgtcatcgcggtaaaaccccaggtgatccgcgacgtcaccgccgcctacaagcgtttcggcgatggccgcaccaccttcgtcagcatcgccgccggcacgccggtcgccaccttcgaagacatcctcggcaaccgcgcgcctgttgtgcgctgcatgcccaacacgcccgcctccatcggcaaaggcatgatggtggtgttttccaacccgctggtctcggatgataccaagcgctttgtcgccgacctgctgtcggccagcggcgaagtggccaccattgacgacgaaggcctgatggatgcggtgaccgccgtgtcgggatccgggccggcctatatcttccacttcatcgaagcgctgaccgtggccgccgagaaggcggggctgcctagcgcaaccgccaggctgctcgcgatgcagaccgtctatggcgctgcctcgctcgctgccgaaagccaggaggaacccggcgtgctgcgccagcaggtgaccagccccaacggcacgacggctgcggcgcttgccgtgctgatgggcgaagaccggttgaccaatttgctgacgcaggcagtcgaggcggctcggctgcggtcgatcgagttgggaaagtaa

SEQ ID NO: 35899 - DNA, 900 bp, Mesorhizobium loti
atggccgaagtgattgacggaaagagcgttgccgaggatgtggtgcgaacggtcaaggcgttgaccgccgagctggtcgccaagggcaaagccaagcctggtctggccgtggtcatcgtcggcgaggatccggcgagccaggtctatgtcgcttccaagtcgcgcaccgccaaggaatgcggctttcattcgctccagcacactctgccggccgagacctccgaggaggcgctgctcaagatcatcgccgatctcaacgccgatccggccgtcaacggcatcctggtgcagctgccgctgcccgcccacatcgacgccggcaagatcatccaggcgatcgcgcctcagaaggatgtcgacggcttccatttcatcaatgtcggcaagctcggcacaggcgagctggatacggcctttgttccttgcacgccggccggctcgatgcttctgatccagcgcgtgcgcggcaaagacctgtccggcctcaacgccgtcgttgtcggccgctccaacatcgtcggcaagccgatggccaatctgctgcttgccgccaactgcaccgtcaccattgcccacagccgcaccaaggatctgccggcgctcgcccgcacggccgacatcctggtcgccgccgtcggccggccggaaatgatcaagggggattgggttaagccgggcgccaccgtcatcgatgtcggcatcaaccgcattcccgcacccgagaagggcgagggcaagtcgcgcctcgtcggcgatgtcgcctatgccgaggcggccaggcaggccggcgccatcacgccggtgcccggtggtgtcgggccgatgaccattgccatgctgatggccaatacgttagcttctgcctaccttgcggccggattgaagcggcccaccttctga

SEQ ID NO: 35900 - DNA, 1470 bp, Mesorhizobium loti
atgaccagccagatcattcccgtcgatcctttcgacttcatcattttcggcggcaccggcgacctgtcggaacgcaagcttctgccgtcgctctattatcgccagcgcgaccatcaattctccgagccgacgcgcatcatcggcacatcgcgctcgaaaatgagcgacgaggaattccgggccttcgccagccaggcgatctccgatcacgtcaagccggccgatatcgacgccaaggaattgaagaccttcctggcgcggctctcctatatctcggccgatgcgacgagcggcgctggcttcgacaagcttaagaaggcgatcggcgagagcgagagcatccgcgccttctatctggcggtggcgccggcgctgttcggcgatatctcgcacaagctgaaagagaacaagctgatcacgccgaactcgcgcatcgtgctggagaagccgatcggccgcgaccttgcctcggcgcgggcactcaacgatttggtcggcgacgacttccacgaaagccagattttccgcatcgaccactatctcggcaaggagacggtgcagaacctgatggcgctgcgctttgccaacgcgctctatgagccgctgtggaactccgcccatatcgaccacgtacagatcacggtggccgagaccgtcggcttggaagaccgcgtcacctactacgacaaggccggcgcgctgcgcgacatggtgcagaaccacatgctgcagttgctctgcctcgtggccatggaggcgccgtcgtcgatggacgccgacgccgtgcgcgacgagaagctcaaggtgctgcgggcgctgaagcgcatcaacggcaacgaggcgccgaagcacacggtgcgcggccagtatcgcgccggtgcatcggccggcgggccggtgaagggctatgtcgaggagctcggcaaggacagcaacaccgagaccttcgtcgccatcaaggccgagatcggcacctggcgctgggccggcgttccgttctacctcaggaccggcaagcgcttggcgacccgggtttcggaaatcgtcatcgagttcaagccgatcccgcattcgatcttcggcgacagcgccgggccgatcttcgccaaccagctggtcatccggctgcagccggacgagggcgtcaagcagttcatcatgatcaaggatccgggcccgggcggcatgcggctgcgccagatctcgctcgacatgagcttcgcgcaatccttcgacggccgcgcgcccgatgcctatgaacggctgatcatggacgtcatccgtggcaaccagacgctgttcatgcgccgtgacgaggtcgaggcggcgtggaaatggatcgacccgatccagaatgcctgggaaggcgccaagcaggaagcgcagggctatacggcaggcacatgggggccatctgcctcgatagcgctgatcgaacgtgacgggcggacatggcacgagagcaattga

SEQ ID NO: 35901 - DNA, 762 bp, Mesorhizobium loti
atgagcggacaaggcatgcgtctggaaaacaaggtcgccatcatcaccggcgcggcatcaggcttcggcgaaggcatggccaagcgcttcgcgcaggagggggccagggtcgttgtcgccgatctcaacgccaagggggcggagcgcgtcgccagcgagatcggcgaggcggcgatctggacgcagaccgatgtttcgctgcgctccgagttcgacgagatggtctatgccgccaaaagcgccttcggccgcatcgacatcatggtcaacaatgccggttacacccaccgcaacggcgacatgctgaaggtcgacgaagaaaccttcgacctgatcaccgctgtcaacatgaaggcgatctatcacgcggcccttgccgtggtgccgatcatggagcggcaaggtggcggcgtcatcctgaccacggcctccaccgctggcctcaggccacggcccggcctcacctggtacaatgcctcgaaaggttgggcgatcaccgccaccaaatcgatggcggtggaactcgcgccgaagaacatccgcgtcaactgcctctgcccggtggccggcgagaccggcatgctggagaaattcatgggcgccgacacgccgcagattcgcgagactttccgcgcctcgatcccactcggccggctttcgacgcccctcgatatcgccaatgccgcactctggctggcatcggatgaagccgccttcatcaccggcgtggcgctggaggtcgatggcggacgctgcatctga

SEQ ID NO: 35902 - DNA, 1959 bp, Mesorhizobium loti
atggctgccgaagtaccgctctggaccccgacgcaagaccggatcgacgcttcgccattgacggctttcctgaaggccgcggaggcgaaagccggcgccacattcgcctcttatgccgatcttcaccgctggtcggtcgaggatcgcgaggggttctggagcctggtctgggatttctgcggcatcgccggcgaaaagggcgagcgcctgctcgccgatggcgacaagatgccgggtgcctccttctttcccgacgcgacgttgaatttcgccgagaacctgttgaagaagaccggcgcgggcgaggcgatcgtcttccgcggcgaggacaaggtcgagcggcggctgtcctggaaccaactgcatggcctggtttcgcgcctgcagcagcttttcctgtcgctcaaggtcaagaagggcgaccgcattgccgcgatgatgcccaacatgcccgagacagtcgctgccatgctggccgccgcctccatcggcgcggtgtggtcatcctgctcgcccgacttcggcgagcagggcgtgctcgaccggttcggccagatcgagcccgtcatcttcatcgggcctgacggctattggtacaatggcaaggcgatcgaggtcgctgacaaggtcgccgcggtcgcggccaagctcggcagtgtccgcaaggtgctgcttgtcgattatctcggtacttcggccgatgtggcggcaaccatcgacaaggcggtggcgatggaagaggcgctgtcgcccttcgccgccaagccagtcagcttcgagcctctgccgttttcgcatccgctctacatcctgttttcatcaggaaccaccggcatccccaaatgcatcgtccattcggccggcgggacgctgatccagcatgtcaaggaacaccggctgcatgccggcctcgtcgacggcgaccgcttcttctacttcaccacgtgcggctggatgatgtggaactggctggtgtcgggcctggcttccggggcgacgctgctgctctacgacggctcgcccttctaccccgacggcaatgtgctgttcgacttcgtcgatgccgagaagatgaccttcttcggcacctcggccaagttcatcgattccgtgcgcaaggccggcctcaagccgatccgcagccatgacctgtcgaccgtgcgggcgatctcctccaccggttcgcccctgtcgcccgaggatttccgcttcgtctacgaaggcatcaagaaggatgtgcatctcgcctcggtttccggcggcaccgacatcgtctcctgcttcgtgctcggcgtgcccaaccagccggtgtggaccggcgagatccagggaccaggcctcggcctggccgtcgatgtctgggacgatgacggcaagccgatccggcaggaaaagggcgaactggtctgcaccaaggcgtttccgtcgatgccgatcggcttctggaacgatcccgaaggcaagaaataccaggcggcctatttcgagcgtttcgacaatgtctggtgccatggcgatttcgctgagtggacggcgcatggcggcatgatcatccatggccgctcggacgccaccctcaatccgggcggggtgcgcatcggcacggcggagatctacaaccaggtcgaacagatgccggaaatcctggaggcgctgtgcatcggccaggatttcgacaatgacgtgcgtgtcgtgctgttcgtgcggctggccgcgggcgtcgaactggacgaggatctggaaaaacgcatccgcgccaagatccgcagcggtgccagcccccgccatgtcccggccaggatcgtcgcggtcacggatattccgcgcaccaagtcgggcaagatcaccgaactcgccgtgcgcgacgtcgtgcatggccgcgccatcaagaacaaggaagcgctcgccaacccggaagcgctggagctgttcaggaacctgccgcagcttgccgaatga

SEQ ID NO: 35903 - DNA, 1278 bp, Mesorhizobium loti
atgaactaccagcggttcttcgaagaagcgatcgaccagctccacgcggagcgtcgctatcgtgtcttcgccgacctcgagcgcatcgcgggcaagtttccgcgcgccatctggcgctccaacggccgcgccgaggaaatcaccgtctggtgctccaacgactatctcggcatgggccagcaccccgatgtcatcgccgcgttccagaacgcagccggcaagatgggctcgggcgccggcggcactcgcaacatttccggcacgtccaacccgctggtcgagctcgaacatgagcttgccgacctgcacggcaaggacgcggccctggtcttcacctctggctttgtctccaacgaagcctcgatctcgaccatcgcccggctgttgcccaattgcctgatcatctcggacgaactgaaccacgcctcgatgatcgaaggcgtgcgccgctcgggcgccgagaagaagatcttccggcacaatgacgtcgcgcatctggaaagcctgctgcaggcggccgggcgcgaacgcgccaagctgatcgtcttcgaaagcgtctattcgatggacggcgatatcgcgccgatccgggagatcgtcgaactcgccgagcgctacaacgccatgacctatatcgacgaggtccatgcggtcggcatgtacggaccgcgcggcggcggcatcaccgagcgcgagggcctggccgaccgcatcgacatcattgagggcacgctggccaaggcattcggcacgctgggcggctacatcaccggcaccagcgcggtgatcgacgcggtgcgctcctatgcgccgggcttcatcttcaccacggcgctgccgccggcgattgccgccgcggcgaccacctcgatccgccatctcaagcgctcgcaggccgagcgcgatgcccagcagcagcaggcagcgcggaccaagcagatcctgtcggcggccggcctgccggtgatggagtcgccaacccatatcgtgccggtgctggtgggtgacccggagctttgcaagatggccagcgaccgcctgcttggcgtgcacggcatctacatccagccgatcaactacccgaccgtgccgcgcggcaccgaacgcctgcgcatcacgccgacaccgttccattccgatgcgttgatcgcgggactgcaggacgcgctggtcgagacatgggacgccctcggcatcccctatggcgcggcaggacggcccgcagtggccaagagcgatcggatcgttccgctgatcatggcgaaggccggaggctga

SEQ ID NO: 35904 - DNA, 2289 bp, Mesorhizobium loti
atgagctgttgtgcaccgggcgccgaaatggcgcgggatctggaaagcagcatgtccgtcctgccatcaagccaggagatcaggttggcgagccgatcgctcggcggtggtcttaaccaaactgacctttcagtcccaatggttcactgcgcagcctgcatccagacgatcgagacggcactgggaaagctcgacaatgtcgaaggcgcgcgtgtcaacctgtcgacgaaacgggtcgcgatccggtggcgtggcaatgaggtaccacccttcgtcgccgcgctgggacggctgggctatcaggcgcacctgttcgaagccgaaattgataacaaggacaagacgcttgccgaactgatccgcgctgtcgctgttgccggctttgcagcgggcaacatcatgctgctttcggtctcggtctggtccggcgccgaaggtgctacccgcgacctgttccattgggtctcggcgctgatcgccatccctgcacttgcattctccggcggaatcttcttccggtcggcctggaacgcgttgcgccacggccgcatgaacatggacgtaccgatcgcggtcggggtgtcgcttgcctatgccatgagcctctatgagacgatcaaccacggcgaccatgcctatttcgacgcgtcggtttcgttgctgttcttcctgttgatcggccgcacgctggatcacgtaatgcgggagcgtgcccggaccgcggtgaaaagcctgtcacagttggccgcgcgtggcgccatggtgctgcgcggcgacggcgcacgggattatctgccggttggcgagatcgaacccggcatgcaactgctgatagcagccggtgagagaatcccagtcgacggcaagatcattcaaggggcgtcggatctcgactgctcactggtctccggcgagagcacgcccagaaacgtggcgccgggcgagcccgtgcaggctggcgtgctcaaccttaccggctcgctgacgatcgaggcgacagccgcggcgaaggattccttcctggccgaaatggtccggctgatggaggccgcggagggcggccgctcgcagtatcgccgcatcgccgatcgcgtctcggcactctacgcgcccgtggttcatctcaccgccttcgtgacattcctgggttggatggcggcgaccggcgactggcaccgcgcgatgacgatcgccatcgctgttctgatcatcacatgcccgtgcgcgctcggtctcgcagtcccgatcgtacaggtggtcgccgcgcggcgcctgttcgagaacggcattatggtcaaggacggctcggccatggaacgcctggcaacaatcgatacggcggtgttcgacaagaccggaacgctcacgctcggccagccccgacttgtcaacgcgtcatcgatcgatccggccatgctgtcaatcgcagccgacatggccgcgcattcgcgtcatccattttcaaaggccatagccggttttgccgctcctggcgggcaacacaaattcgatgcggtcaccgagcacccgggatttggaatcgaagccactgacggcggaagcacttggcggctgggtcgacggggatgggctgggtggaaggctcgaaccggtggtgaaggcaaacatggctacggcggaacggtcctgacgaaaaacgggatgattgtcgcatgctttgttttcgaggatgcattgcgtgccgacgccggtgcagccatcgatcaattgaagcatgcagggatgtcggtggaaatgctgtcaggcgataccgcggcagcctgcgccgaggtggcaaaggtgctcggtgtcgatgacttcgttccctgcctgctgccatccggcaaagtcgaacggatcgagaccctggcggaagacgggcacaaggttctgatggtgggcgacgggctcaacgacacgccggcgctgcgcgcggcgcatgtctcgatcgcaccggccaccgccgccgacattggccgcaatgcggccgactttgtcttcctgcgcgaaagcctgctggctgtgccgctggcacttgacgtctcgcgcaaggcgggacaactgatccgccagaacatcgcgatcgccatcgtttacaatgccgtcgccgtgccggtcgccatcctggggcacgtgacgccattgatagcggcgatcgccatgtccgcctcgtcgctgcttgtcattggaaatgcgctgcgattgcaagcatcgatgccaaattcaccggcgaaggatgttcgccgaaacaggcaatccgacttcaacgaactggcccgatcgtcatga

SEQ ID NO: 35905 - DNA, 1518 bp, Mesorhizobium loti
atgaacaaggttgaattctcacgcccggtcaaggcgcccttcgacaagcgttacggcaatttcatcggcggcaaatggaccgaaccccgctccggccgctacttcgagaaccactcgccggtgaacggtcagttgctgtgcgaggtggcgcgctcggatgccgacgacatcgaggcggctctggacgcggcccatgccgccaaggacgcctggggacgcaccagcgtggcagagcggtcgcttattctcaaccgcatcgccgaccgcatggaggagaacctcgatctcctcgcctgcgctgaaacatgggacaacggcaagccgatccgcgaaacgaccgtcgccgacctgcctctggccatcgaccatttccgctatttcgccagtgccgtgcgcggccaggaggggagcctctcgcaaatcgacgacgataccgtcgcctatcacttccatgagccgctcggcgtggttggccagatcattccctggaacttcccgctgctgatggcatgctggaagctcgcgcccgcgcttgcggccggcaactgcgtggtgctgaagcccgccgagcagaccccggccgccatcctgctctgggccgatcttatcggcgatctgctgccgccaggcgtgctcaacatcgtcaacggcttcggcctcgaggccggcaagccactcgcgtcgtcgccgcgcatcgccaagatcgcctttaccggcgagaccacgacgggccggctgatcatgcaatatgccagccagaacctcatccccgtcacactggaattgggcggcaagtcgcccaacatcttcttcaaggacgtcgtcgccgaggacgacgatttcttcgacaaggccatcgaaggcttcgtcatgttcgcgctgaaccagggggaggtctgcacatgcccgagccgtgcgctcatccatgaatcgatctacgacaggttcatggaacgtgccctcaagcgcgtcgaagccatcgtccagggcgatccgctcgacccggcgacgatgatcggcgcccaggcctcgtcggagcagctggaaaagatcctgtcctacatcgacatcggccgccaggaaggcgccgaggtgctgaccggcggcgcccgcaatgttctgcccggcgacctggcgggcggctattacgtcaagccgaccgtgttcaggggccacaacaagatgcgcatcttccaggaagagattttcggaccggtggtttcggtcacgaccttcaaggacgacgacgaagcgctcagcattgccaacgacacgctctacggccttggcgccggcgtctggacacgtgacggcaaccgcgcctatcgcttcggccgcgcaatccaggccggccgcgtctggaccaactgttaccacgcctatccggcgcatgcggccttcggcggctacaagcagtccggcatcggccgcgagactcacaagatgatgctcgaccactatcagcagaccaagaacatgcttgtcagctatagcccgaagaagctcggcttcttctga

SEQ ID NO: 35906 - DNA, 1803 bp, Mesorhizobium loti
atgaagctgacgggcggtcaaatcgttgcaagggcactcaaggagtatggcgtcgagtacgtggctggcgttcccggccacggcatctggtcgctgtttgacgccttcctggaagaggggtcgacccttccattcatccaggtcatgcatgagcagagcgccgtgcatatggccgatggcttcttccgggccagcggtcggccgatggcctgctccacatcgatcggtcctggcgcgacgaacacgatcatcggacttgcgacctgctacgccgactccattcccgccttttttgtctccggcggcccggcgacccacatgaagggtcacggcgtgatgcaggagatcgagcggcagaacgagaacgctttccctcgcatcaccgaacaggtcaccaagcgcgcctacaaggctggccgcgtcgacgaactgcccttcatcatgcaccgcgccttcaacaccatgctgagcggccgtcccggacccgtccatgtcgaggtcccgatggacatccaggtcgaggcggccgatgtcgagattcatccactcgatcttcgcatggcgcgcggcgtttcctacccggatccgaaagcggtcgagcgggccgtgaagctgctgctgtcggccgaacggccggtcatcgtcgcaggcggcggtgcgatttccgccaatgcgtcgggagagctcacgaggctcgccgaaaagctgggtgccgcggtttccattacctggaacggcaagggcgccatttccgaagaccatgcgctgttcatcggcgctgtcggccagaccggcacgacctgcggcaacagcattactgcatcggccgatgtcatcatgtcggtcggctgccgcttcaccgactggtcggcttcctcctacgccaagggcgtcagcttttcgattccgccgggcaagctcatccacatcgatctcgaccaccacgagatcggcaagaactatccgacggaggttggcatcgtggccgatgccaaggcaacgctagaagcgatgctggccatgatttcggaggccgagtcgaagaaagcggtcatgcgccgcgacaggtttctggccgatgtccagaaagcgaaggcagactgggaagcgctgcttgcgccgcgccgcgatagccgcgagtcgcccttcacgtcgcagcggccgcttggtgcgttacgcacggtcatgagtcgcgacggcatcgtcgttgtcgggtcgggcaacacgcaaggcgcggtcaagcagacctttccgatctaccagccgcggacccacctcacctccggctcattctcgccgatgggctgggccgttcccgccgcaatgggcgccaagctggcaatgccggaccgtcaggtcgtatccatcaccggcgacggcgatttcatgatgtcgctgcccgaactcggtaccgccgtgatgaacaacattcctgtcgtgttcctggtccagaacaaccagggctacatgtcgatccgtggcggtcagcgcaagttcatgggacgacacatcgcctccgaattcaaccgccacaagggtaatggcgaaccctacagcgccgacattgcggcggtcgcgaggaacttcggcgtcgagagctggaaggtcacggccgacgaggatctggagaaatcgctgaaggccgctctcgattgtggcggcccggcgctggtcgaggtcataacctctcgcgatgcggccggtccgtttgccaccggctggtgggattttccatcgcccgcctactacgagaaagagcaggcggcttacaccgagaagcgcgtgctcgaacagcacatgtag

SEQ ID NO: 35907 - DNA, 1503 bp, Mesorhizobium loti
ttgccaccggctggtgggattttccatcgcccgcctactacgagaaagagcaggcggcttacaccgagaagcgcgtgctcgaacagcacatgtagccgtacctggggcgagcagccctggctgctcgcgcttcattccattgattcagaccgcaatgcggggcgtaggccctgcaaacgaagagccattgccatgatacgcaccatcaagtcggctcgaggcagcgttgtaaacggcggcaacggtgccatgacgagcgcggtccagacactcctcgaccaagtcgagcaggggggcgacagggcagtccgcgaactgtcgatccgtttcgacaagttcgaccgggactcctatcgcctgaccaaggccgagatcgacgcttgcatcaactcgctgaccgggcgtgaacgcgaagaccttgatttcgcgcaggaccagatccgcaacttcgccgaggcgcagcgcgcaacactgctcgatcttgagatcgagacgctgccgggcgtcgtccttgggcaccgcaacgtgccgatccagaatgtcggctgctacgtgccgggcggaaagtatccactgctggcctcggcgcatatgacggtgctcacggcaagggttgccggttgcgagcgcatcatcacgtgcgcaccgcccttccagggcaaggtcgccgaaaagatcgtggccgcccaggccctggccggggccgacgagatctactgtctcggcggcgtccaggcgatcgcggccatggcgtacgggaccgaaacgatcgccccggtcgacatggtggcggggccaggcaatgcctatgtggccgaagccaagcgccttctgttcggtaaggtcggcatcgatctctttgccggtccaaccgagactctggtgatcgccgacgacagcgtcgatggcgagctggttgcgaccgacctgctcggccaggccgagcatggcgtgaactcgccggcggtgctgatcaccaactccgaaaagctggcactggacacagtcgccgaaatcgggcgcctgctgacgatcctcccaacggcggccatcgcggcaaaggcctgggaggatttcggcgagatcatcctgtgcgagacgaccaaagagatggtggccgaggccgatcgtctcgcttccgaacatgtccaggtgatgacgcgcgaccccgaccacttcctcaactccatgaggaactatggcgcgctgttcctgggggctcgcacgaacgtttcgttcggcgacaaggtcataggcaccaaccacacgctgccgaccaacaaggccgcccgctataccggcgggctctgggtaggcaagttcctcaagacctgcacctatcagcgcatcctgacggacgaggcctccgcgctcatcggagagtacggctcgcgtctctccctcatggagggcttcgtcggccacgccgagcaatccaacatccgggtccgccgctacggggggcgaaacgtcggctatgccatgccggtcgatccacgctga

SEQ ID NO: 35908 - DNA, 1500 bp, Mesorhizobium loti
atgatggagcacaccgcagacattgtcatcatcggctccggcatcggcggcagctcgcttgcctatagcctcgccgacaccggaagacgcatcgtgatcctggaacgcggggagcacctcagggatacgccggaggcgcgcgacgatatcgccatcttccagaatggcttctacagatcgagcgaggaatggctggcgacggacggcgagagcttcctgccgggcaattactactatgtaggcggcaattcgaagttcttcggtgcagtgatgtaccgctaccggcaggaagatttcaatccgcgggatcacatgggcgggcgctcacccggctggccgatctcatacgccgaactcgagccatggtatgaacgcgcggagattttgttcggggtccgtggcgatgccaggcaagacccgaccgagccgccgcgcaatagaccatacaggtatcttcccgttcccgacgaacctgcaatcgcgactgtgcgccaacggttgctgcaggcaggcattcatccggcaagcctgccgctcgccatcgatatcgacgcgtggttgcggcgggcaaaaacaggctgggacgcctttccgaataccggcgcagggaagatcgatgcggaagtcggcccgctcaccaaggcgttggagcacccgaacgccaccctgatcaccggcgccaatgttcagcgcctggtaacggacgcgtctgggcggagggtgatggctgcggttttcatcaaggatggtgtcgagctcagcataggcgccgatgtcttcgccgtggctgccggcgctgtgcaaagtgcggcgctgctgcttcggtcgtcgacttcggtttatccgaacggtcttggaaacagctccgatcagctcggccgcaacttcatgaaccacaacacgacggcgatgctggccatcgacccttttcgtcgaaacaccgccgtctatcagaaaacgcttggattcaacgatttctacaacaaggacccgctgggcagctttccgttaggcaacgtacaattgctcggtcacatcaccggcaatattctcaaagccaacgcgccgttgctgccgcgctggctggccggcctcgttgcgcgaaactgctacggctggttcctgaccagtgaggatctgcccaatcccgaaagccgtgtgaccatccgcaacgggcgcatcgtcatgaactgggtccgcaacaatatgggtgcgcacgagacattaatcaggcggacgcgcgcagtgatgcgcgaagccggcttccctgttgttctcacccgaacgttcggccgcaagacaacatcgcatcagtgcggcacggccaggctcggcagtgacccgaacacatctgtcgtgtcgcctgattgtcggtcgcacgacatcgcgaacctctatgtcacagacgcatctgtgctgccgacgtcggcggcagtaaatcctgcgttgaccatagcggctctggctctgaaagccggagcggcgatcagggcgatgtga

SEQ ID NO: 35909 - DNA, 1647 bp, Mesorhizobium loti
atggctaattttggatccgctcgatggggaattctgccgcgatccgagacagtcgcagggaagtgcgactacatcgtcgtcggtggcggctcaaccggttgtgtcgttgcttcccgactgtccgaaaatgctgatgtctcggtcgtcctgctcgaagaggggccgaatgatatcaacccgtacatacatataccgggggcgtattacaaaactgcccaagggcctttgctgaagcgaatcccctgggagccgatggccgggcaatcgcccgatgcaacgcctacaatggtccaggcgagcgtcttgggtggcgggagctctgtcaatgccatgatctatatccgcggcgttccttcagactatgcgcgttgggaagaacttggcgccagcggctggaactatggcgatgtgctgccgtattttcttcgctcggaggacaacaacaggttctgcaacgaagcgcatgcggttggcggcccgctgggggtctccgacattgacaacattcatccgctaacacgcgcttggctccaggcatgccagcaggcgggtctcccttataaccacgatttcaattctggcgatcaggccggatctggcctttaccagatcacggccagaaacggtctgcgcagcagtgccgctactgctttcctgaagcctgttcgccgtcgtccgaacctgcaggttcggacacgcgcgcgcgtcagccggatcatcgtcgaacaaggcagggcgaccggcgtcgaatatttcgtgaacggtcgcaggtgggttctccacgcagagcgcgaggtcatcttgtcggcaggcgcaatctcttcgccgaaactgttgatgttgtcgggcatcggcccggcggacgcactgcgcagacatgggatccaggtggagatggatctaccaggcgtaggccagaatctgcaggaccatattgagatgtcgctggtctaccagctcaacggaccgcacagctacgacaaatacaagaagctgcattggaaggccgcggcagcactgaactaccttctgtttcgtggcgggccggcttcatcgaatctgatagaaggcggcgccttctggtggggaaacaagaatgaaaccgtgcccgacgtccagttcttcatggtggtaggtgccggtatcgaggaaggcgtcgatactgttccgggcggcaatggctgcaccgtcaaccttggtcagataagaccgcgctctcgcggcgaagtcacgctccagagtgcgaaccctgccgaaaatccgcgagtcgcgccccgatatttctccgatccttacgatcttgacgcggtgaccgaaggcaccatggctgcgctcgacatcatggagaagccggcgatcagccgctatatcgcggcgcggcaaacgcctgcgcccactatgaagacccgctcggacatcagaaatttctgccttgaaacggcccatgctgcgctacacccagccggcacctgccggatgggccaggacgaaatggcggttgtcggcccggatcttcgtgtccgcgggattgacggactacgcgtggcggatgcctcggtcatgccgacgctaatctcgggaaatcccaacgccgtctgcatcatgataggcgagagagcggcatcgtttctgtcagaggcggcttga

SEQ ID NO: 35910 - DNA, 762 bp, Mesorhizobium loti
atgatcctgaaggacaggaccgcgatcgtcaccggcgcgggatccggcatcggcagggcggcggcgctgatcattgcgcgcgagggtgcgatggtcggcgtggcggatcgtagcgccgacggcgccaacgccaccgtcgaccagattcttgccgcaggtggccgggcaaaggcgcttgtgttcgacctgaccgacgaccaggcgcttgaagccggttttcacgatttcatccacactcagggcaggatcgacatcctgcacaatcatgccggcgtacaggtcgaaggcgacgtgctcggagtgagcgtgaaaggcttcgatacctcctggacgctcaatgtgcgggctcacttcctcggtgcccgtatcgtcatgccattcatgaagaaggcaggccgcggcgtcatcctcaacacgtcgtcgagctccggcgtgctctacgaccgcgagatgatcgcctatacgacgaccaagcacgcggtgatcgcgatgaccaggcagatggccggcgactatggccgcttcggcattcgcgtcaacgcgctttgcccgggttgggtggacacgcccttcaatgcgcctttcatcgcccagatgggaggccgggaagccatcgaagcctacatccgcgaaagggtgccgcttggccgttgggcaaccgtcgaggagatcgcggaggcagtactgtttctggtgtctgaccggtcctcgtacatgacgggtcagatcctggttgtcgatggaggagaaacggtgatctag

SEQ ID NO: 35911 - DNA, 1284 bp, Mesorhizobium loti
atgtatgacttcggccccttcgagttcgagtcgaagcaggattttttcgacaaggcaatgcgtttctggaatcccgacaagaccaggttctggcagaaggccgggatcgatctggtgatcggcaagcgggagggttatttcctctacgacatgtcggggcgccgcctgatcgacctgcacctcaatggcggcacctacaatctcggtcaccgcaatccggagctggtcgagacgctgaagagcgcgctcgactatttcgacataggcaaccactggttcccttccgtggcgcgaacggcgctggccgaatccctcgtcaatgtctcgccaggaatgaaatacgcgatcttcgcgccgggcggcgcggaggcggtggacatcgccatcaagagcgcccgctatgccaccaagcggcgcaagatcgtgtcgatcatcaagggctatcacggacattcggggctcgccgtggcgaccggcgacgatcgcttcaccaagatctttctttccgaccagccggagacgttcatccaggttcccttcaacgatatcgacgccatggaacgggcgctcgagggcgaagacgtcgcggcgctgatcatggagacaatccccgccacttacggcttcccgatgccgaaggatggctatctcagcgcctgcaaggcgctgtgcgaaaagcatggcgcgatgtacatcgccgacgaggtccagaccggcctgatgcgcaccggcagcatgtggggctggcaggcctatggcgtccagccggacatcatggtgacggcaaagggcctgtccggcggcctctatccgatcagcgcggcgttggtgaacgagagagccggcggctggctcaacgaggatggggcggcccacatttcgaccaccggcggggccgaactcggctgtgtcgtcggccacaaggtcatcgagatgctgcagcggcccgaactggtggccaatgtcgggaccgtgaccgagttcatggcgcaggccatgcgcgagatgctggttcgtcacggcgatatcttcaccggggtgcgccagaagggcgtgatcctcgggctggaattcagcaatcacctcgaaggcgccgtcttcgtgtcgcgtgcactctacgagcagggcgtctgggcgatcttctcgtcgctcgacaagcgggtgctgcaatggaagcccggtgttcttctggatcacgaaacctgtcgggacatcatggatcgcttcgatgcggcaatgccgcgcgctcgggagttgctgcatcaggcaggcaaggcgagttga

SEQ ID NO: 35912 - DNA, 765 bp, Mesorhizobium loti
atgacccagtctttgaagggtcggtccgtcgtcgtcaccggcgggtcgaaaggcatcggcaagggcatagcgcgggtgttcgcgctgtcgggtgccaaggtcgccatcgttgcgcgccatcccgaccaggccgaagccgcggccgccgagatcggccacggcgcctttggcgtggttggcgatgtgacctcgctcgccagcatcgagagcgcgcttgcagtggtagccgcgagaaacggcagtatcgacgttttgtgcgccaatgccggcatcttcccgcaggcacggctcgaagacatgacgtcgcagcaatgggacgaggttgtcgacaccaacctcaagggcaccttccacgcggtcaaggcagcggttccctatctcaagacgtcgaaccagggccgcatcgtgctgacgtcgtcgatcaccggcccgatcactggttttcccggctggtctcactacggcgccaccaaggcgggacagctcggcttcatgcgaacggcctgcatcgaactggcgaaatacggcatcaccgtcaacgccgtcatgccgggcaacatcgtgaccgagggccttgtcggcctgggcgaggactaccagaagaccatggccgcctcgatcccgctcaagcggctcggaaccgtggaggacatcggctacgccgcgctctactttgcgtcgaaggaagccggctacgtgacgggacagacgatcatcgtcgatggcggccagatcctgccggagagcctggaggcactggcatag

SEQ ID NO: 35913 - DNA, 1239 bp, Mesorhizobium loti
atggaaacgaaattcggcgtgcattccgaagtcggccagcttcgcaaggtcatggtctgcgcgcccggccgcgcccatcagcgcctgacgcccagtaactgcgacgcacttctgtttgatgatgtgctctgggtcgacaacgcaaaacgcgaccatttcgatttcatgaccaagatgcgcgaccgcggtgtcgaggtggtggagatgcataacctccttgccgagaccgtcgccgtccccgaggggaagaaatggatcctcgacaatcaggtggtgccgaaccagattggcctcggcctcgtcgacgaggtgcgctcctatctggaagggctctccaaccgcgatctggcggagacgctgatcggtggcctctcgacacacgaattccccgaatccatcggcggcgaacagctcgagctgatccgcgacgcggccggggtgaacgagtatctgctgccaccgctaccgaacacgctctacacccgcgacaccacctgctggatctatggcggcgtcacgcagaatccgctctactggccggcgcggcatgaggagaccatcctcaccacctcgatctacaagttccaccccgacttcgccggcaaggtgaatgtgtggtggggcgacccgaccaaggattggggcctcgccacgctggaaggcggtgacgtcatgccgatcggcaagggcaatgtgctgatcggcatgagcgagcgcacctcgcgccaggcgatcagccagctcgcggcgacgctgttcgagaagggcgcggccgagcgcgtcatcgtcgcggcgatgccgaagctgcgagcggcgatgcatctcgacacggtgttcacctttgccgaccgcgactgcgtgctgctctaccccgatatcgtcaatggcatcgaggcgttctcctaccggccggacggcaagggcggcgtcgagttgcacaaggacaagggtacctttgtcgagacggtacgcgacgcgctcggcctcaagaagatgcgcgtcgtggagaccggcggcaacgcctatatgcgcgagcgcacccaatgggatagtggcgccaacctcgtgtgcgcctcaccgggcgtcgtgtacgcctatgaccgcaacacctatacaaacacgcttctgcgcaaggagggcatcgaggtcatcaccatcatcggcgcggaactgggtcgcggtcgtggtggcggccattgcatgacctgtccgataatccgtgatgcggtggactactga

SEQ ID NO: 35914 - DNA, 1434 bp, Mesorhizobium loti
gtgacaggtaagtccgagcagaagctgtccttgttcgccttgatcggaatggtcgtcggatcgatgatcggggccggcatcttcaatctgcccggcaggttcgccaccgcgacaggcccgttcggcgccatcatcgcctggtgtatcgccgggaccggcatgtacatgctggcccgagtgttccaggcgctggccgagaagagacccgatatcgattccggcgtcttcgcctacgcgaaggcgggattcggcgactatatgggcttcctctcggcgttcggctattggctcggaagctgcctcggaaacgtcttctactgggtgctgatcggatcgacgctcgggcgcttcttcccagggattttcggggatggcagcaccgcgatcgcgatcatcgtctcgctggtcggcatctgggccttccatttcatgatcctgcgcggcgtcgagcaggccaccttcatcaacagcgtggtgacggtcgccaagatcgtaccgatcatcgtggcgatcctcgccatggcgatcgcgttcaactacacgcaattctccgagaactttctcggcggcgtgggcatgccggaaaagaccctggtggcgcaggtgcgcgacaccatgctgatcaccgttttcgtcttcctcggtatcgagggggcgagcgtgtattcgcgcttcgcccagaagcgttcggacgtcggcaccgccaccattctgggttttgtcggcgtcaccggcctgatggtggccatcaccctgctgccctacgccacggctccccgtgccgccatcgccggggtccagcagccctcgcttgccggcgcgctcgaactggtcgtgggacattggggcgcggtgttcatttccgtcggcgtgctggtgtcagtgctcggcgcgtatctcgcctggtcgctgatctgcgccgaggtgctgttcgccgccgcaaagtcgcaggacatgccgaagcttttcgcggcgcagaacggcaaccgggttcccgccaacgcgctttggctgaccaacatcgtcgtctcgctattcatcatctcaacctactggtcacgcgacgccttcaacttcatgctcgacatgacaagcgtgacggcgctgctgccctacctgctggtcgcgggctatggcgtgctgatcgcccgtcgcggcgaggggtaccagaccacgcccggcgaacgcgggcgcgaccagctattcgcctggatcgccgtcgtctacaccctcatcatgtttgtggccgccggcttgaaatacgtgcttctggtggcggtgctcttcgtgccgggaaccatcctctacctgtgggcgcggcgcgaacagaaggcgcggttcttcacatcggtcgaactcatcatcttcgccgtcaccctggtcgccggccttgctggtttcgtcggcctgctgaccggcgccattacaccttga

SEQ ID NO: 35915 - DNA, 1536 bp, Mesorhizobium loti
ttgctgcatgactacctcgcccactccgcccgccggctcggcgacaaggtggcgctggtgtgcggcaaacaacgtgtcacctatggcgagcttgaggcgcgcgccaatgcaatcgccacagatttggccgcatcaggggtcgcgcgcggcgatcgcgtgatgatcttcgccgacaacaccgtcgagacggtggtgagcttctgggcggtgctcaaggcgaatgcggtggtgtgcatcgtcaacccgctgaccaagagcgacaaggtggattatctgcttaacgactgccgaccggcggcgctgatcacggacgcgcatctgcacgcgatcttccgcgagcctgcgcgcggctgccagtcgcttctgcggatgatcgtttcgggatcaatcgatgatcccgagctctcccgattgccgcgtgccgtgcgctgggacactgcggtcggcaacggcggcgatgcaccgccggcgcggcgttgcatcgatatcgatcttgccgccatcatctacacgtccggctcgacaggcgaacccaagggcgtgatgctgacgcacagaaacatgatgaccgcatgcacgtcgatcgcttcctacctcgagcttgccgaggacgaggtgatcctcaatgtcctgcccctcgccttcgactacggcctgtaccagatgatcatggcgtttcgcaccggcgcccggctggtgctcgaacgttcgttcgctttcccggcgcaggtccttgggctgatcaggcaagaggggattacgggctttcccggcgtgccgaccatcttcgcggcactctccgaactcaggtctctcaaggaccaggatttctcaagcattcgctacgtgacaaacaccgcggcagccctgcccctcaagcatattctcatgcttcgggagctgttttcgagtgcacgcatttattcgatgtacggcctcaccgaatgcaagcgttgcacctatttgccacccgaggatctcaagcgaaagccattgagcgtcgggatcgcaatcccgaatacggaaatgtggatcgttgacgaacatgacaggcgggtcggccccggcgtcgtcggccagctcgtcattcgcggcgcaacggtgatgaagggatactggggcaagcccgaagcgacggccaggaagctcaaacccggcccgctgcccggcgagcaggtcctatacaccggagactactgccggatggacgcggaaggttacctctacttcgtcggccgtggcgacgagatcataaagtcgcgaggcgagaaggtagcgccgaaggaagtggagaacgtgcttatggatattcccggcgtccgggaagcagcggtgatcggtgttcccgacgaactccttgggcaggcggtgaaggcgtttgtcgtgatggagaacggaagaaccatcggcgaaaaacagctgcagatggagtgccagaaacgactggaaaacttcatggttccgaagtccatcgtcgtcgtggccagcctgccgatgacggataccggtaaactcaagaaaacggccctgtcatga

SEQ ID NO: 35916 - DNA, 1005 bp, Mesorhizobium loti
atgagctatagtggcaagaaagttctggtgacgggcgcggatggatttatcggttcgcatctcaccgaagcgctcgtccgcaacggcgcggatgtcacggccctggcgctatacaattccttcgacagccatggatggctggacgatttgccggacaagatccgcagccagctgaagctcgtccgcggtgacgtccgcgacagcgcgttcctgaaccggatcgtgcgcggccaggccgtcgtgtttcacctggccgcgctcattgcgattccatattcctacgcggctgcccagtcctatgtggaaaccaacattctgggcactgtgaatgttcttgaagcggcgcgtcaatgggagacggagcgggtggtgcatacctccacgagcgaggtctatggaaccgcccagaccatgcccatccgcgaaacgcatccgttacagggacagtcaccctattcggcatccaagatcggcgccgacatgatggccgagtcctatgccaggtcgttcgatgtccccgtggtcatcatgcggcccttcaacacctatggtccgcgccagagtgaacgcgccatcgtgccgaccatcgtccggcaggcccttgatccgaagtgcccgtcgatcatggtcggcgatacgagcccgatccgcgacctgacctttgtcgaggacactgcggcagccttcctgaccgcgggcctggccgggcttgaattcggccacgcctacaatgccggcagccaacgcgccgcgaccatctccgacgtattggatcttgtcctcgaattgagcggttccaagaaaccggtccatcgtgacgaacgccgtttgcgaccgcaaaattcggaggttcgcgccttgctcgccgattcttcgcgttttgaaggcgagaccggatggcgggcgcagacaagcctgcgcgatggactggagcgaacgatcgcatggtggcgcgcgcgccttagtgaaggccgggtacggcgcgaaatgggttatatgacatga

SEQ ID NO: 35917 - DNA, 1824 bp, Mesorhizobium loti
atgtgcggcatcgtcggaatcgtcggccactcgcaggttacgtcgctcatcctcaccacgctgaagcggctcgaatatcgcggttatgactcggccggcgtcgccaccatcgagcatggcgagctcgcccgccgtcgcgccgaaggcaagctgatcaacctcgagcgccggctcaaggaggagccgctcgacggcacgatcggcatcggccacacacgctgggccacccatggcgtgcccaacgagaccaacgcgcatccgcatttttccgacggcgtcgccatcgtccacaacggcatcatcgagaactttgccgagctgcgcgacgagctggtccgcgacggctatgccttctcctcgcagaccgatacagaggtcgtggcgcatctggtggcgcgcgagttggccaaggggctgaagccggtcgaggccgcgcatcaggcgctgaagcggctggaaggcgcctttgcgctggccatcatgttcaagggcgacgaggacctgatcgtcggcgcccgcaacggcccgccactggccgtcggccatggcgatggcgagatgttcttgggctcggacgccatcgcgctggcgccattcaccaattcgatcacctatctcgaggacggcgactgggcggtggtgcgccgcgacagcgtcgccatcttcgacatcgacggcaaaaaggtcgagcgcaagcgccagcagtcgctgtcgacctccttcatggtcgacaagggcaaccgccgccatttcatggagaaggaaatccatgaacagcccgaggtgatctcgcacacgctggcgcattatgtcgatttcgtctccggcgtttcgaagccgctcgacctgccgttcgacttcgccaagatcggccggctggcgatttcggcttgcggcaccgcctatctcgccggcctgatcggcaaatactggttcgagcgctatgcgcggctgccggtcgacatcgatgtcgcctcggagttccgctaccgcgaaatgccgctgtcggccaatgatgccgccttcttcatctcgcagtcgggcgagaccgccgacacgctggcctcgctgcgttattgccgcaaggccggcatgaagatcggcgccgtcgtcaatgttcgggaatcgaccatggcgcgcgaatccgacgtcgtgctgccgacgctcgccggccccgagatcggcgttgcctcgaccaaggctttcacttgccagctgtcggtgctggcctcgcttgcggtgcgcgccggcgtggcgcgcggggtgatttcgcaggagcaggaaaagaccctggtgcgcgcgctttcggaagcgccgcgctatgccaaccaggtgctcaagctcgaagagcagatcgagcggatcgcgcgcgaactgtcgcgctacaaggacgtgctctatctcggccgcgacaccaatttcccgctggccatggaaggcgcgctgaaactcaaggaaatctcctatatccacgccgagggctatgcggcgggcgaattgaagcatgggccgatcgcactgatcgacgagaacatgccggtcatcgtcattgcgccgcatgaccgcattttcgagaagaccgtgtcgaacatgcaggaagtggcggcgcgtggcggcaagatcatcctgatcaccgacagcaaaggggcggcgcaggtgagcgtcaagacgatggagacgatcatcctgccggacgtgccggaaatcatctcgccgatcatctatgcgctgccgatccagatgttggcctatttcgccgccgtgttcatgggcaccgatgtcgaccagccgcgcaatctggcgaaatccgtgacggtggagtga

SEQ ID NO: 35918 - DNA, 933 bp, Mesorhizobium loti
atgcgttgcaaaatcgtcggggcaccggtgcaggacggcgccggcagaatgggctgcgaaatggggccgagtgcgctgaggacggcagggcttgccgaagtgctgtccggcctcggccacactgtcgaggatatgggcgccgtccagccaatgccggcgaggcgcgtcgtgcacggcaatctggcgctgaaggccttgcccgaaatatcggcctggacatccgccatcgcagcggcagcttacgcagcgagcgaggatgccatgccgattttccttggcggtgaccattcgatctcggcgggaaccgtgtcgggcctcgcccgccgcgccgccgaggccgggcgcccgctgttcgtgctgtggctcgatgcgcatccggacttccacacgctggacaccaccgccagcggcaatctgcacggtgttccgctcgcctatgccagcggccagccgggtttcagcggctattttcccgatctgccggcggcggtcgaccccaagcgtatctgcacaatgggcctgcgcagtgtcgacccggccgagcgcagcgcgctcaaccaggcgggcgtaaccgtgcacgacatgcgcgccattgatgaacatggtatcgcgccgctgctgcgcgccttcctggcgcgcgtgtctgatgaagacggactgctgcatgtcagtctcgacgtcgactttctcgacccgtcgattgcgccggctgtcggcaccacggttcccggcggcgcgacgttccgcgaagcgcatctggtgatggagatgctgtccgacagcggactcgtctccagtctcgacctggtcgagttgaatccatttctggacgagcgtggccggaccgcgacgctcatggtcgacctgacggcgagcctgatgggccgccgcatcatggatcgcccgacccgcagccattccgggagcttttga

SEQ ID NO: 35919 - DNA, 1563 bp, Mesorhizobium loti
gtggcagatggagtgaggatgaccagggccaaggttgagcacgcaccgaattgcgatatcgtcatcgtcggcggcgggtcggccgggtcgttgcttgccgcgcggctgagcgaagatccggacagccgcgttctgctgatcgaggcaggcgaggagccgacggatcccgatatctggaaccccgccgcatggccggcgctacagggccgcagctacgattgggactaccgcacggaggcgcaagccggcaccgcgggccgggcgcatcattgggcgcgcgggcggttgatcggcggctcgagttgcctgcacgcgatgggctacatgcgcggtcatccctccgacttccaggcctgggtcgatgcgtcaggggatcgccgatggggttgggatgaactgctgccggttttccaggccatcgaagaccatccacttggtggcgacggcattcacggcaagggcggaccgttgccgatccatttgccggcggacgaagtcagtccgcttgctcgtgccttcatcgaggcaggcgcatcgttgggtctgcctcgccttgaaggccacaacagcggagagatgatcggcgtcaccccgaattccttgaacattcgcgacgggcgaagggttacggcggcggacgcctggctcacaaaggcggttcgcggccgcaagaacctgaccatccttaccggctcccgggtgcggcgactcaagctggagggcaatcaggtccgcagcctcgaagtcgtggggcgacagggttcggccgaagtgtttgcggatcaaatcgtgctttgtgctggagcgctggaaagtccggccttgctgatgcgttcgggcatcggtccgcacgatgtgctcgatgcggcgggcgtcggctgcctgatcgacatgcctgacatcggtcgaaaccttcaggaccacctgcttggcgccggcaacctttacgcggcccgcaagccggtgccgccatcgcgcctccaacattcggaatcgatggcctatatgcgggctgacagcttcaccgccgccgggcagcctgaaattgtcgttggctgcggtgtcgcgccgatcgtgtcggaaagcttcccggcccccgccgccggctcggcctattcgctgctgttcgggatcacccatccgacgagccgcggcagcgtgcgcataagtgggcctgagctcggcgatcggctgatcatcgacccggcatacctgcaaaccggccgggaccgcgagcggtttcgcagagcactcgaggcatctcggaccatcgggcacagagatgaactcgccggctggcgagagcgcgaactcctgccaggcacgccgaacagtgcggccgagatggacgacttcatcgcgcgatcggtcatcacacaccatcatccctgcggtacttgccggatgggcaaggacccggacgccgtcgtcgatgcaaatctacggctcaaggcgctcgacaatctttttgtcgtggacgcgtcgatcatgcccaacctcaccgcgggaccgattcatgccgcggtcctcgcgatcgccgagactttcgcccgacagtactaa

SEQ ID NO: 35920 - DNA, 1632 bp, Mesorhizobium loti
atgccgcacgcggaaagttacgactatatcatcgttggggccggatcggccggttgcgtgctcgccaaccggctgagcgccgatccgagatgttcggtgctgctgctggaggccggcggctgggatcgcgatcccatgatccacattccgcttggatggggcaagatcctgaccgagcgccgccatgactggatgtatttctgcgagccggaagacaatgtcggcggacgccgggtcgagtgcgcgcgcggcaaggtcattggcggatcgtcgtcgaccaacgccatggcctatgtgcggggaaatcgcggcgactatgatcgttgggcagcgacagggctcagcgagtggtcatacgacaaggtcctaccgtacttccgcaagcaggagagctgggaagggggcgcgaaccagtatcgcggcggcaatggcccggtcagcacccagttctgccgctacaaggacacgctgatcgacgccttcgcgcaagccagcgtgcaggcaggctatgcgcagacgaaggactataatggcgagcggcaggaaggtttcggccgcctccagatgacgatttcaaaaggtcggcgcgcctcgaccgcgtcagcctatctgcggccggtgctgaagcggcccaacctgaccgttctgacggaagcgagcgcgaccaggatcgtgctggagggtgcgcgcgccaccggcgtcaccatcaaccatcgcggcggcgaacgtacggttctcgcccgcaaggaagtgctgcttgccggcggcgtgatcaacacgccgcaactgatgatgctgtcgggtatcggggcgcaggatgagcttgccgcgcacggtgtccagacgcgggtcaatctgccggcggtcggcaagaacctgcaagatcacgtctcggtcattctcatgtaccggcgccgggctccgggcggccccttcctgcgcaacatgcgtgccgatcgcatcggcttcgatttcgtcaagacctacctgacgggacgcggtttctctggcgatgtgcccggcggggttgtcgccttcctcaagagcggtccggcgcgacccttgccggatgtgcaactgctcttcacggcggcgccgctcgcggcatggccatacttcaagccgttcaaggcgccgtttgcggacggcttcgcgacacggatcgtagcgacacagcccgaaagccggggagcggtgaaactggcctcggccgatccttccgcggcgcccctgatccaccagaatttcctcgcgtcgcccaaggattgggagtcgctgcgggccggtttccgtgtggcaagggatctggccgcgcagccctccatgcaacccttcatcgaggcggagttctttcccggcccgaagtgccagagcgacgacgagatcgacgagcatatccgcaagacctccatcaccgtgcatcacccggccgggacctgcaggatgggggcggatgcggcctcggtcgtcgacccgcaattgcgggttcgcggcgtcgataggcttagagtggtggacgcttccgtcatgcccgacctggtctgcggaaacatcaacgcggcagtgatcatgattgccgaaaaggccgccgacctcatcgcgagctcaaaagaaggcagggcagtgcaatga

SEQ ID NO: 35921 - DNA, 930 bp, Mesorhizobium loti
atgatccgaaatatcgccatcatcggcctgggtacgatggggccgggcatggccgcccggctcgccagaggcggcctgcaggtggtcgcctacgatgttgccccggcagcgatagagcgcgcgcgatccatgctgagcgtggccgagaccgttctggacgccttgggcatcgcgctgccgtcagctggcgtcgggacggttcgcttcaccgacgatatcggcgatgcggtatccggtgccgacctcgtcatcgagaacgttcctgaaaacatctcgatcaaggccgatgtctatcgcaccatcgacggcctgataggccaggatacgatcgtcgcgtccgacacgtcgggtatcccgatcaccaagttgcaggcgcatatctcgtatcccgagcggatggtgggcatgcactggtcgaacccgccgcacatcatcccgatgatcgaggtgatcgccggcgagaagaccgcgccgcaaaccgtggcgacgatccgcgatctcatccgctcgatcggcctgttgccggtggtggtgaagaaggacgtccccggtttcgtcgaaaaccgcgtgctctatgcgctgctgcgcgaggcggtcgacctcgtcgagcgcggcgtcatcgatccggaagatctcgacacctgcgtgtcctggggcatcggctacaagatcgccgtgatcgggccgatggctctgctcgatatggcgggcctggatatctacaagtccgtctcctccttcctcaacgccgatctttccaatcgcgacgatgtcgcgcccatggtgctggaaaagaccagcgcgtcgaagttcggcatcaagtcaggcgagggcatgttttgctacacgcccgagcagaccaaggcgctgcaagccgaaagggcgcgcaaactcgtcgcggtacgacgcatcctggaaggccgggagtag

SEQ ID NO: 35922 - DNA, 1620 bp, Mesorhizobium loti
gtgatctgttcgcccctccggctgattaccattctttggtgcagggctttcatgagcggttcttcttcatcgtccgttgccgggcgcgacatcgtcgcgcttgaaggcgtgaccaagcggtttcccggcattgtcgccaatgacagtgtcgacctgtcgatccgtcccggcgaggtgcatgtgctgctcggcgagaacggcgcgggaaaatccaccttgatcggcatgctgtcaggcctgcagcagccggacgaagggcgcatactggtcgacggcaagccaacgccgatcacttcgccgcgccatgcgctggcgctgggtatcggcactgtcttccagcacatgatgttggtgccgacgctgacggtggcggaaaacctcttgcttggcggaccctggtggcaacgccccaggaccgaggagcttgaggcgcgcgtcgccgagatcacccgaagtctcggcatcacggtgaagctgcatgccaaggtgtcggagctttcgctcggcgagcagcagcaggttgaaatcctgcgcgccatggtgcgcaacagccggctgctgatccttgacgagtccacctccatgttgacgccgaaaggcatcgacgaactgggcgcgctgatgcgccgcctcgtcgagcagggtctggcgatcgtcttcatcacccacaagctcaaggaggcggcggccttcggcgaccgcatctcggtgctgaagctcggccgcaaggttggcgagattccgcccgagcggtttcgcgcgctggacgaacaggcgatcatctcggagatcgtggaactgatgttcggcaagcagaaggacgatccggaagctgtcgggcgcccggtccgtacagtccaggccgaagcggcgccgctgctccaggtcgtggatctggcggtcgcgccgacggacaatgcgcccggcctgtcgtcgatctccttcgacatccgcccgggcgagatcctgggcatcgccggcatcgacggcaacggacagaaacagctagccgaagcgctggccggccagcgcgcggcgaccagcggttcggtgcggctggagggcgtcgccatcgaggcgctgagcgtcggcgaacgccgtcggcgcggtctgcgctacctgaccgacgaccggctcggcgaaggcactgtcggcaccttcccggtttcgatcaacttcttcctcaagcaggtcggcgctgcgccgttctggcgccacggcgtcgagcagcgtggcgagatcgacaggcgcgccgtcgaactcgtacgcgaatacgacgtgcgcacgccaagcctgaagacgccggtcgcccggctgtccggcggcaacatccagaaggtgctgctggcgcgcgaactggccgaaggcgccaaggtggtgatcttcaacaagccgacctatgggctcgatctcgccaacacattggcgtcgcgccaacgcatccgcgatacggcggcgcgcggccttgccgtgctgctcatctccaccgacctcgaggagttgcttgttatgtgcgaccgcgtcgccgtcatcgccagcggagcgctcgtcggcaccgtcgagaacaccgacgatgcgcgcaccaggatcggccgcctgatgatcggacttgccgcatga

SEQ ID NO: 35923 - DNA, 963 bp, Mesorhizobium loti
atgactgctaatgttttttccggctgcatgccggcgttgatgaccccatgcacgcaggaccgtcagcccgacttcgacgcgctggtacgcaagggacgagagctgatagccgccggcatgtcggccgtcgtctattgcggctcgatgggcgactggccgctcctgaccgacgagcaacgcatggaaggcgtcgagcgcctggtgaaggccggcgtgccggtgatcgtcggcaccggcgcggtcaacaccgccaaggccgtggcgcacgcggcgcatgcccagaaggtcggcgcgcgaggcctgatggtgatcccgcgtgttttgtcgcgcgggccttcggtgacggcgcagcgccatcatttcaaggcaattcttgccgccgcgcccggcctgccggcggtcatctacaacagcccctattacggctttgccacgcgtgcggacctgttcttcgcgctacgcgccgaacatccgaacctggtcggcttcaaggagttcggcggcccgtcggacctgcgctacgcggcggaaaacatcaccagccgcgacgatgaggtcgcgctgatgatcggcgtcgacaccgccgtcttccacggtttcgtcaattgcggcgcgtccggcgccatcaccggcatcggcaacgtgctgccaaaggaggtgctgcaccttgtgggcttgagccaggcggcggccaagggcgacgtcgaagcccgccagcgcgcgctggagctcgacgctgcgctcgccgtgctgtcctccttcgacgaaggcccagacctggtgctctatttcaagcacatgatggtgctgaagggtaatcccgagtacaagctgcacttcaacgagaccgatgccttgaccgacagccagcgcggctacgccgaggcgcagctcaaattgttcgacagctggtatgcccaatggtcgaggcaacccggcgtgattgcaaggtctgcagcctga

SEQ ID NO: 35924 - DNA, 864 bp, Mesorhizobium loti
atgcaggccggcgcccgaaaatatccggagccaccctttcccgagcaacatcatcccaagccgggggatgaatgggcgatcgacccggcgccgctctacgatgcgcccttctatctcggatcgaaaaaactcgaagacaaagtcgctctcatcaccggcggcgattccggcatcggccgttcggtggcggttctgttcgcccgcgagggagctgacattgcgattgtctatctggccgaggacagggatgccaaggcgacaaaatccgccgtcgaagcggaaggacggcgctgtatcctggtgaaggcagacgtcagcgaacgcgaccaatgccgcaacgcggtggcgcaaacggtcaaggcattcggccgcatcgacgtgctggtcaacaatgcggcattccagattcattcaagcgagttcgccgaactgaccgaagagcatttcgacacgacgctgaagaccaacctctacggctatttccatatggcacaggaagccgtgccgcatatgaagccgggctcggccatcatcaacacaggttcggtcaccggcatagacgggtcgaaggcgctggtcgactactccatgaccaagggaggcatccatgccttcacccgcgccctctccggcaatcttctcggcaagggcatccgggtgaacgcggttgcaccgggtccggtatggaccccgctcaacccttcggacaaggaagccggtgacgtttcgaagttcggcgcggatacaccgatgaagcggccggcgcagccggaagaactcgcaccggcctatgtgtttctcgcctcgccgcattgctcgagctacatcaccggcgagatattgcccgtggtcggcggctactga

SEQ ID NO: 35925 - DNA, 786 bp, Mesorhizobium loti
atgtctgactttgaaaataaggtcgcgttgatcacaggcacgaccggcatcgcgctcgccaccgcaagacggctggcgcaaggaggtgccgcgatcatcgcctgcggcatcgaccgggcagccaatgccgccatgcaggagagcctcgccaaggccggagcggatgcgctggtgcaaacagtcgacgtgtcgatttccgatcaggtgcgcgacgcggtcgtggccggcgtcgcgaaattcggcggcatcgacgtcatcgtcaattccgccgcggtccatccctacggaaccgcgacgacgaccgattgggaaacctggaaccgggcgatgtcggtcaatgtcggatcgatctacctgaccgcccacttcggcattccggaaatgatcaagcgcggcggcggcgccatcgtcaacgtcgcctcggtacaaggcttcgcctgccagcagaacgtcgccgcctatgccacgaccaagggcgccatccatacgctgacacgctcgctggcgctcgactacgcggcagcaggcataagggtgaattcggtgagcccgggctcgatccgcacgccgatcctcgagaaggccgcgcgcggcgaccacggcagcgacgccgatgtcgaggaagcttacaagcgcttcggcgcggcccatccgcttggccgcatcggcgagccggaggaagtggctgagttcatcgctttcctgtgctcgtcaaaagccagcttctgcaccggcgccgactacaagatcgacggcggcctgaccgccggcatcggcgtgaggtag

SEQ ID NO: 35926 - DNA, 1101 bp, Mesorhizobium loti
gtgcctgcatgttcaatcggctgggtttttcggacggaaatttcaagcaacatccggaaagcactgggaaaggagcttgatatgcccagaatagtgcctgtgctcgatctgagccgtcttgaacagggcgcgtcggaacgccggacatttctagcggatcttcgttccgcctcgcgcgacatcggctttttctatcttgccggacatggcatctcctgggcggagatcagcgaggtgctcaccgcatcgcgccagttctttgccttgccggaggccgacaagctggcgatcgagatggtcaagtcctcgcagtttcgcggctatacgcgcgccggcggcgaactgactaagggcagagaggactggcgcgaacagcttgacatcggcgtcgagcgccaggcaatcgcgcaagggccgggaactcccgcctggacccggctgcaaggaccgaaccagtggcccgcggcgctgccggatctcaaacccgcgctgcttgcctggcagagcaaggtgacagccgtggcgatccggctgctgaaggccttcgcgcaatcgctcgatcagcccgaggatgcgttcgatccgatctacagcagcgagcccaaccatcgcatgaagatcgtgcgctaccccggccgtgacacaaccggcggcgaccagggtgtcggcgcgcacaaggatggtggtttcctcaccctgctgcttcaggatgacaataaggggctgcaggtcgactatgacggcagctgggtggatgtggaccccattcccggcacgctcgtcgtcaacatcggcgaattgctcgaactggcctccaacggctacttgcgcgcgaccgtgcatcgtgtcgtgacgccgcccgccggcgtcgagcgcatttcggtgccgttcttcttcagcgccaggctcgatgcgacgataccgctgcttgggctttccgaggaactggcggcgcaggcgcgcgggccggcaagcgatccggacaatccgctgtttcgcgatgtcggaaccaatgtgctcaaaagccgcctgcgctcgcatcccgacgtcgcgcggcgccattacgcggatctgctcaaaggggaaagccgggtcggttga

SEQ ID NO: 35927 - DNA, 1428 bp, Mesorhizobium loti
atgcgcatcatcgtgccgggcgagggcgtggtcgacgcggccaatgccatgcgcgccttcgagagcgacggcctgaccgcctatcggcaattgccgctggtcgtcgttctgcccgagaccgtggcgcaggtctcccgcgtgctgaaatactgcaacgaccgcaacatccgcgtcgtgccgcgcggttccggtacctcgctgtccggcggtgcgctgccgctcgaggacgcggtgcttctggtgatgagccgtttcaaccgcatcctggcgatcgattttcccaaccgcatcgtcgtcgcccagccgggcgtcaccaatctaggcatcaccaccgccgtcgagcaggagggcttttattacgcccccgatccatcctcccagatcgcctgctcgatcggcggcaatgtcgcggagaattccggcggcgtgcattgcctgaaatacggcctcaccgccaacaatgtgctcggcatcgagatggtgctgatgaatggcgaggtggtgcggctcggcggcagccatctcgatgccgaaggctacgatctgcttggcgtcatgaccggttcggaaggtctgctcggcgtcgtcaccgaggttacggtccgcatcttgaagaagccggagacggcacgcgccctgctgatcggctttccgaccagcgagcagggcggccagtgcgtcgccgacatcatcggcgccggcatcatccccggcggcatggaaatgatggaccggccggcgatccacgctgcggaggatttcgtccatgccggctatcccctcgatgtcgaggcgttgctgatcgtcgagctcgacgggccgggagtcgaggtcgatcacctcatcaccgcggtcgaggcgatcgccataagcaacggctcgaccacctgccgcatctcgcaatccgaggcggagcggctgagcttctgggccggccgcaaggcggcattcccggcggtcggccgcatttcgcccgactattactgcatggacggcaccatcccccgcaaggaactgccgcgcgtgctcgccggcatgcgcgaactgtcggagaaatacggtctcggcgtcgccaatgtctttcacgccggcgacggcaatctgcatccgctgatcctctacgatgccaatgttcccggcgaactcgacaaggccgaaagttttggcgccgacatattgcgcctttgtgtcaaggtcggcggcgtgctgacgggcgaacatggggttggggtcgagaagcgcgatctgatgccggaaatgttcaaccaggtcgatctcgaccagcagatgcgcatcaaatgcgccttcgaccccaaccacctgctcaacccgggaaaagtcttcccgcaactgcgccgctgcgccgagcttgggcgcatgcatgtgcaccggggtcaggtggcatttccggacattccgaggttttga

SEQ ID NO: 35928 - DNA, 921 bp, Mesorhizobium loti
atgtccctgcccgacgacagccgctatctcaagggcggcccggttgcccagcgcatcatcgccgccgtgcgcgaggacgcggcgattgccaaggccgagggttttccgcccaagctgatctcgatcaccgtcggcgataccgatgccgtggatgtctatgtgcgcaaccagcgcgccaaggcgcagcttgccggcatcgatttcgaggaacggcgttttcccgccaccatcacctcgggcgaattggaagcggccatccacgggctgaacgccgatccgcgtgtcaccggcatcatcatccagcggccggtgcccgcgcatatttcggtcaagacgctgcaggcggcagtgcatccgctcaaggatgtcgaaggcatgcacccggcctcgatcggcaacatcgtctacaaccagcttgatctggcgccctgcacggcggctgcctccgtcgaactgctcaaggagaccggcctcgacctcaaggggctggaagtggtcgtcgtcggccattcggaaatcgtcggcaagccgatcgctttcttgctgatgagcgaaggcgcgacggtcacggtctgccaccacttgacgcgatcggtcgccgcgcatgcgcgccgcgccgatgcgctgttcgtcgccgtgggcaagccgcggctgatcaaggccgacatggtcaagccaggggctgccgtcatcgatatcggcatcaattccgagatcgggcccgatgggacgagccgtatcgtcggcgacgtcgacaccgacagtgtgaaagacgtggcctcctggatcacgccggtgccgggcggcgtcggcccgatcacggtggcgatcctgctgcgtaacacgatggtggcgctcagccggcagcgcgcgctttacgaggcaacctacggcacggcggacaggctcgcggcggagtaa

SEQ ID NO: 35929 - DNA, 1773 bp, Mesorhizobium loti
atgccggtcaatctcgacgagctgaagaacgccaccaatctgcgcggccgcgctgcgcgcgccggcagcgtctttatcgcacccgtcgacggcagggcgcatgtctcgggcgaccgcaaggtgccgctgctcgacaagaccattccggcgcttttctccgacacggccagcaaatacgccacgcaggatgccgccgtcttcgtcggccaggataagcgcttcacctggagcgaactgtcggacacggtggatgcgctggccgccggcttcctggcgctgggcctcgaaaagggcgaccgcgtcggcatctggtcgcccaaccgctgggaatggctggtgacgcagttcgccaccgcccgcatcggcttgatcctggtcaacatcaacccggcctaccggctgaccgaactggaatatgcgctgaacaaggtcggctgcaaggcgctggtgacggccgccagtttcaagacctcggactatctcggcatgatcgagacgctggcgccggagatcgcgaaggccacgccgggcaagctgaaggcgcaaaaattgccggcgctgaagatcgtcatccgcatgggcgaggacaattcgccgggcatgttcaatttcgccgacgtgttggccatggccggccgcgacgagcatgacagcctcgaccgcatttccgaggggctgaagccaggcgatgccatcaacatccagttcacctcaggcacgacaggcgcgcccaagggcgcgacgctgacgcaccacaacatcgtaaacaacggcaatttcgtcacctcggcgatcaaactcaccgtcgacgaccggctctgcatccctgtaccgctctaccattgcttcggcatgtcgatgggcacgatgggctgcgtcaccaagggcgcgaccatggtgtttccgggcgagggcttcgaccccggcgcaacgctgaaggcggtggcgcaggaacgctgcaccggcctctacggcgtgccgaccatgttcgtcggcatgctcgaccatgcggatttcgcgaccttcgacctctccagcctgcgcaccggcatcatggccggctcgccatgcccgatcgaggtgatgaagaaggtggtgtcgctgatgcatatgtccgaggtcaccatcgcctacggcatgaccgagaccagcccggtgtccttccagagcggcgtcgacgatccgcttgaaaagcgcgtctcgacagtcgggcgcatccaccctcatgtcgaggtcaaggccatcgacgccgacggcgccaccgttgcggtcggcgcgccgggcgagctctgcacgcgcggctattccgtgatgaagggctattgggacgacgccgaaaagacccgcgaggcgatcgacagcgacggctggatgcataccggcgacctcgccaccatcgatgccgagggctattgcaacatcgtcggccgggtcaaggacatggtcatccgcggtggcgagaacgtctatccccgagaggtcgaggaattcctctatcgccatcccaaagtcagagaagtgcaggtcttcggtattcccgacgccaaatacggcgaggagctgtgcgcctggatcgtgctcaagcctggccagatcgccactgagcaggagatcaaaaccttctgcgccggccagatcgcccactacaaaatcccgcgccacatccgcttccgcaccgaattgccgatgacggtgaccggcaagccgcaaaaattcctgatgcgtcaggcgatggtcgaggaattggggcttgtggcgcagaagacggcgtga

SEQ ID NO: 35930 - DNA, 2271 bp, Mesorhizobium loti
gtgcggtcgccggtcggccccaaaatcttggcaaaaaatcaaatcaaacctcggcaaaatcggagcagtgatatggacgcgaaaaccgacgacaacagcgcgggcaaatgccctgtggcgcatggatccgccggtcggaccaaccgtgattggtggccgaaccagctgaacgtccagatcctgcatcagcagtcctctctgtccgacccgatgggtgaggcgttcgactatgccgaggaattcaagagcctcgacctcgacgccgtcatcaaggacctgcacgcgctgatgacggattcgcaggagtggtggccggccgatttcggccactacggcccgctgttcatccggatggcctggcacagcgcaggcacctaccgcattgccgacggccgcggcggcgccggggctggccagcagcgtttcgcgccgctcaacagctggccggacaatgtcaacctcgacaaggcccgccggcttttgtggccgatcaagcagaaatatggccgcaagatctcctgggccgaccttctgatcctcaccggcaacgtcgcgctggaatcgatgggcttcaagacctttggctttgccggcggccgcgccgacgtctgggagcctgagcaggacgtttactggggtcccgaaggcaagtggctggccgacgagcgctacagcggcgaccgtgacctgcagaacccgctcggcgccgtgcagatggggctgatctacgtcaatccggagggaccgaacggcaatccggatccgctggccgcggcgcgcgatatcagggacacattcgcgcgtatggcgatgaacgacgaggaaaccgtagcactcatcgccggcggccatacgttcggcaagacccatggtgcgggtgacgcgagcctggtgggtgtcgagccggaaggcgctgatatcgagcagcagggccttggctgggcgagcaaattcggcaccggcaagggcggtgacgccatcggcagcggtctggaagtcatttggacgacgacgccgaccaaatggagcaacaacttcttcgacaatctgttcggcttcgactgggaactgaccaagagcccggcaggcgcgcatcaatggacgccgaagggtggcgccggtgccggcacggtgccggacgcacacaactcggccaagcgtcacgcaccctccatgctgaccaccgacctcgcgctgcgtttcgatccgtcctacgcaacgatctcgaagcgcttccatgagaatccggatcagttcgccgacgccttcgcccgcgcctggtacaagctgacccaccgcgacatgggcccggtcgcccgttatctcggcccgttggttccgaaggaagagctgccctggcaggacgtcatcccggtggtcgatcatgtgctgatcgacgagcaggatgccgaagcgctcaaggctgagattctggcctccggcctgtccgtgtcgcagctggtttcgacggcgtgggcgtcggcctccaccttccgcggttctgacaagcgtggcggtgccaatggcgcgcgcatccgcctcagcccgcagaaggactgggccgtcaaccagccggccgagctcgccaaggtgctcgacaagctccaggcgatcgccaaggacttcaatgccgcacagaccggcagcaagaaggtctcgcttgccgatctgatcgttctcggcggcaacgccggcatcgagaaggccgcgaaggccgccggccacagcgtcgacgttccgttctggccggggcgcatggacgcctcgcaggagcagaccgacattcactccttcgcgccgctggagccgactgttgacggcttccgcaactatgtcagcggcaagcagcggctgaccgtcgaagaggcgctggtcgaccgggcgcagttgctgacgctgaccgcgcctgagctgacggttctcgtcggtggcctgcgcgttctcggcgccaatgccggacagtcgaagcatggcgtgttcaccaaacagccggaaacgctgagcaacgacttcttcgtcaacctgctcgacatgggcacggagtggaaggcgacatcggatgccaaggacgtgttcgaaggccgcgaccgcaagaccggtgaagtgaagtggacgggcacccgcgccgacctgatcttcggttcgcactcgcagttgcgcgcgcttgccgaagtctatgcgacggcggacgccaaggcgaagttcgccaaggacttcgtcgtggcctggaccaaggtgatgaacgccgaccgtttcgacatcgccggctga

SEQ ID NO: 35931 - DNA, 1401 bp, Mesorhizobium loti
atggttgaacctgctctctcgctaaatgaaaccggcgcccccaccaatgagcggtttcatctgattcaggccgcccctctggccggcagtatcggtgcggaagctcgcgaactcatcacatcctcggaagatattttcgtcaccgatcagagcggaagaaaactgatcgacggaccggcaggcatgtggtgcatcaacgtgggacatcgcaaccaagcgctggccgatacattgcgcgaccaggcaatgtcgatgacctattcaacgccgtggtatacaagcaatgctcccgcggagaagcttgcgcagatgctcgcggagcgcgcgccgggtgacctcaaccatgtcttcttgacgactggcggttcatccgcggtcgaaacagcaatacggctcgtgcaattctacaacaacgtccgcggactgccgcagaagaagttgttgatctcacgccaaggaagctaccacggctcgacatacctgaccgcgtcgctgaacggccgcccgcgtgatcacgactggatggatggcgcaggcgatctcgtcagaaagctgacttgccccaatcccttccaccgaccggcaaacttgtcgctggaggcgttcgaagatttcctcgtcaatgagtttcgcgcgctcatcgagcacgagggcgcccagcagatcgcggcttttatcgccgaaccgatccaggcgagcggcggggtgttgatgtcgccgccgaactatctcaagcgcatgcgagcgctctgcacggaaaatgacattctgtttatcactgacgaggtcgtcaccgctttcgggcggctcggccatatcttcgcatcgcaggacgtgttcggaattcagccggatatgatcactttcgctaaaggtgtcacgtcagggtattttccccttggtggcgtcatggtgtcggatcgcttgctcagcgaacttcgccgtctgaaccatcccaaagcaaacttcgtgcatggtctgacctattccagtcatcccatcggctgcgcggtggcaatccgcaatatcgaactgctggaagatggtctcctccatcacgcgcgtgaaataggtccctactttcaagagcagttacggacgctcgaggaactacccctcgtaggcgaggtgcgcggggccggactgatggcggggattgaatgtgttgccgatgccaagacggaggatcgtcttgatctcgacctgaccgtcggtaagcgcatcgattttcattgccaggagaatggattgcttgtccggcccctgatcaatatgtgcgtgatgtcgccgccgctgacaatcagccgttcgcaaatcgacatgatgaccgatgctcttcgcaaggggattgaagccaccgcggatgacctgatccgtgagggactttggaagccggcatga

SEQ ID NO: 35932 - DNA, 1491 bp, Mesorhizobium loti
atgccatccgccgctgagccaatggcaagaacgaacaacaatcttactggagcaagcatgcagtccgacaacgcgtcgaaattctatatcgatggacaatgggtcatgccaggcggtgctggccgaatggacgtggtcaatcccgcgaccgaacaatcgttcatgcagattgcgatcggcaccaccgaagatgcggatttggccgtgcaagctgctttcgaggctttcccgactttttcacaaacgagcaggaccgagcgagtggaactcctgcgcaatgtcctacgatgctacaatgatcgctacgacgatattgcgcgagccgtcagcacggaactcggtgcacccttgaaatttgcccgggaggcccaagcatgggcagggcagattcatttggaatcgacaatcgccgctctcgaagcattcagcttcgacgagctccacggaagctcgatgatcacctgggagcctatcggcgtttgcgcgctcatcacgccgtggaattggcccctgaaccagattgtctgcaaggtcgcgccggctcttgccgcgggctgtacagtcgttctgaagccgtccgagttggcgcccctcagtgcgatcatcttcgcggaagtgctcgaagaagccgcaatacccaagggtgtcttcaacctgatcaatgggacaggacctgaggtcggacagtatctcgcaggtcatcctcgcgtcgatatggtgtccttcacgggatccacgcgcgcgggcatcatggtcgccaaaactgccgctgaaactgtcaagcgcgtggctcaggagttgggcggaaaatcggccaatatcgtgctggccgacgctgacctggagaatgcggtcgtcaagggtgtcgaggcgtgtttcagcaattcgggccaatcttgcgacgcgccgacgcgccttttgatcccggccgatcgccatgccgaggcgctcgacatcgcgaggcgggtcgccgccgccacccgcgtcggagatccttcaagtgaagataccgatatgggacctgtgatcagccagcagcaattcgacaagatccagcggatgattggtcttggcatcgaggaaggcgccactttggttgcaggcggaccaggcaaacctgagggtctcgatgttggcttctacgtcaagccaacgatcttcggtggcgttacgccggagatgaccattgcccgcgaggaaatttttggtccggtcctttcgattattccctacgataccgaggcggacgccatacggatcgcgaacgactcgatctacggcctggccgcctacgtgcaaggcggcagtctggaaggagcaagagcggtcgcacgcaaactgcaagccggctcagtctacgtcaactatgcgccgtgggatacgcatgcaccgttcggcggttacaaacagtccgggaatggccgcgagtacagccattggggaatacgcgactttatggaggtcaaggggattgtaggttggggggcgtga

SEQ ID NO: 35933 - DNA, 1626 bp, Mesorhizobium loti
atgagacagcactacgaagccgccctgcgcgatgacgccaactgtgtggccctgtctccactgtcgttcctgaaaagggccgagttggtctacggcgcgcgctctgcggtgacgtatggcgacgtaaggcgcacatgggcacagacgggcgctcgctgccgttcggtcgcggcggggctggcggctttgggcgtggggccgggggacacggtttcggtgctgtcgccaaacattcccgagctcttcgaactgcactatgccgtgcccttgctgggggctgtgttgaacaccatcaacacccgcctggagccggaaaccgtcgcctatatcctggcgcattcggactcgacgctggtgattgccgatacggccttcgcacccttgctgcgagaagcctttcgattgaacggcaacacgctcccggttgtcgatgtcgtcgatgcgcaggcgcaggcttctgccgagttcggcgaacgcagctatgaggatctggcggctcatcctcccatggggtgggaactgcccaaggatgagtggcaggcgctggcgctgaactatacttccggcacttcggggcggccgaagggcgtgatttatcaccatcgcggcgcctatctgatggcgatggggacgattgccgcatgggccttgccgcagcacccgacttacctgtcggtcgtgcccatgttccactgcaacggctggacccatccctggtcgatggcgatcgtcggagccaacatggttttcacccgcgatgcgtcgccgggcaaactgctggaggccatggcggcgcaccgcgtcacccatatgggagctgcgccaatcgtgctgcaaatgctctgcgacggccgcggtgcttccgcgcaacccttcaatccccagatcagggtcatgaccgctggtgcgccgcccccgcccgcggttcttgaaaaggccgcgcaaatgggtctcgatgtgatgcaagtgtacggtctgaccgaaacctacggtcatatttcccaatgtctttggcaggacgaatgggaagccctgtctgtttctgcaagagctgaaaaacaggcgatgcagggcgtcgcctttccgatggtcgaggacatccgcgttgtcgaccgcgacaccggcacggatgtaccgcgcgatgggctgacacaaggtgagatcgccattcgcggcaatacggtgatgaagggatattacaaggacgcgacctccaccgcggcggccttcgagtctggctggttctggtccggtgatgccgcggtggtccatcctgacgggtatattcagatccgggaccggctgaaggatgtgatcatctcaggcggggaaaacatctcgtccgtcgaggtcgagtccgttctataccgacaccctgcgatcagcgttgcggccgtggtggcccgcccgcatccgaaatggggcgagagcccatgcgcctttgtcgaactgcgcgagggcgcgagcgcgaccgaagcggaaatcattgccttctgtcgcgccaatatcgcgcatttcaaagcgccgaaaacggtggtgttcggccctttgccaaaaaccgcgacaggcaagattcagaagttcattctgcgggcggcagcccgtgacctggggcctcaggcatga

SEQ ID NO: 35934 - DNA, 1527 bp, Mesorhizobium loti
gtgaccatgagcacgaattcaaaagacctttcccgccgtctcgccgccggcgcggacgacgctccggcgatcctggcgcccgacagggcgacgctgacccatggcgggctgcgccgcctgatcgcggccacggcggagcggctgcacgcgctcggcatcggccggggcgaccgggtggcgatcgtgctgcctaacgggccggagatggccaccgccttcgtcgcggtggcggccgccgcgtcgacggcgcctctcaatcccgcctatcgcgccgacgaactcgatttctacctcaccgatatcggcgccaaggcgatcctggtcgcggagaacgagaccggtccggcggtggcagtggccgaacggctcggtatcggcgtgctgcggcttgtcgtgcaaccggacacgcctgccggctccttcaccatcgagggcgtggcgatcggcccgcaggctgcgcccgacatggcaggggatggcgacatcgcgcttttgctgcacacgtcgggcacgacatcgcggccaaaactcgttccgctcagccatgccaatatcgccgcctcggcagcccatatcggcgccacgctcggcctgagcgccgacgaccgctgcctcaacatcatgccgctgttccacatccatgggttgatcgcggcggtgctgtcgtcgctggcggcgggcggcagcatctactgcacgccgggcttcaacgctttgcgcttcttccagtggctgggcgatgccaagccaagttggtacacggcggtgccgaccatgcaccaggcgatcctgccgcgggcggcgcgcaacgaagagattctagcggcggcacgcctgcgcttcatccgctcgtcctcggcatcgctgccggcgcaagtgatgggggaactggaagcgaccttcggatgcccggtgatcgaatcctacgggatgaccgaggccgcccaccagatggcgtcgaaccggctgccgccgggcctgcgtaagccgggcagcgtcggtgccggcgccggaccggaggtggcggtgatggcgcccgacgggcggctgctcacgaccggcgagaccggcgagatcgtcattcgcggacccaatgtcacggcgggttatgagaagaacccagacgccaacgccacggccttcgcgcatggctggttccacaccggcgaccagggcgtgcttgacgaggacggctatctgcgcgtcaccggccggctcaaggagatcatcaaccgcggtggcgaaaagatctcgccgctcgaggtcgacgacgtgctgatggaccatccggcggtggcgcaggtcgtcaccttcgcgatgccgcatgacaagctcggcgaggaggtggcggccgccgtggtgctgcgcgaaggcatgatcgccaccgaaagcgacatccgcagccatgccgcgacgcggctcgccgacttcaaggtgccgcgcaagatcctgatcctggacgagatccccaagggcgcgaccggcaagctgcagcgcatcgggctcgccgccaaactcgggctttga

SEQ ID NO: 35935 - DNA, 1488 bp, Mesorhizobium loti
atggctaccgtgattgtcgaggcgagggaggccaccagtgaatccggcatcccgcatatcgaaaacgccggccaatatcctcgaatgatggagttgctgaaccggcaaggccgcgcagaggcggtgcgccggcttcgccaggcatgccggtttccggtgtacggcgccttgagcaaggatggcgagcatctcacatatgactatgacgtgctcaggcacgagcgcgaagctcacctgggaccaatatggcatttctacgccaagccattgcacattacccgcgcccgcggagcctggatgtatgccgccgatggcactgcctatctggatgtctacaacaacgtcccccagatcggtcattgtcatccgcatgtggcgaaggcgatctaccgccaggccagcgcgctgaacaccaatacccggtatatgtgcgacgtagccgtcgagtacgcggcgcgcctgaccgccgacctgcctgatcacctcgacacctgcatcttcgtcaattcgggcagcgaagccaacgacctggcgatgcagatagccatgtcacttagcaggcaggatgggggtctgataattgaccaagcttaccatggatgcacggagctgacgacggccctgtccaatgaaagctggcgtcatcttcccgctgacgagcaccccaaacgcattgagaccctgacggccccggatatgtataggggccctttttcccgcgaccgccaagcagcagccaaatatgctgccgacgccgacagggcgatagccgccttgcgcgaaagaggccacaggccggcagcattcatggtcgacactgccctatgttcgagcggggtgctgcgggcgcctgaaaactacttcaatcttgtcgcggaaaaggtccgggcgacgggcggattcgtcatcgcggacgaggtgcaggcaggttgtggccgcatgggagctttttggggtttccgggcaaacgggctcaaggacgaaaacatcgatttcataacaatgggcaagccggttggaaacggccacccccttggcgtcgtcattctcagctcggaactgatgaagcggttcctcaatggcacctacccgctgttgttcagcacattcggcggcaacaccgtcgcgtgcgcggccgggatggctgtgctggacgtccttgagcgagaggacctgatcaagcggggcgccgccatcggggagtatctacgccaggagcttgggcgcctggccgaacagcaccccgcgatcggcgacgtacgcgggcttggaatgatggctggcgtggaattggtgacggatcgcctgacgaaggagccggccatcacactgaccgagcgactcattgccgacatgcttgcccgcaacatcctcatcgggaaaggcacgcccaacacgctcaagctacgccccccgctgatttggtcgcgcgacgaagtcgacatcttcgtcgacgctttcgatgacagcttgagaaagcaccaatga

SEQ ID NO: 35936 - DNA, 1251 bp, Mesorhizobium loti
atgatcaccctcacctatcgcatcgaaacgtctgaaagcatcgaggccctggcggccaagatcgccagcgaccagtcgactggcaccttcgtcgcgctgcctggcgaaaccgaggaactgaaggcccgggtggcggcgcgcgtcctggcgatccggcatctacccgacgccgtgcagccctccattccggaagccagtaatggcccgttcaagcgcgccgatgtcgacatcgcctttcccttcgacgctatcggcacagacctgtcagcgctgatgaccatcgccatcggcggcacctattcgatcaagggcctgtcgggcatccgcatcgtcgacatgaagcttcctgatgactatcgcggcgcccatcccggcccgcagttcggcgttgccggcagccgcaaactgaccggcgtcgagggccgcccgatcatcggcaccatcgtcaagccggcactggggctgcggccgtacgagacagccgagatggtcggcgaattgatcgccgccggagtcgatttcatcaaggacgacgagaagttgatgagcccggcctattcgccgctggccgagcgggtgaaggcgatcatgccgctggtccgcgaccacgagcagaagaccggcaagaaggtgatgtatgccttcggcatctcgcatgccgacccggacgagatgatgcgcaaccatgatctggtgctcaaggccggcggcaattgcgcggtcatcaacatcaactccatcggcttcggcggcatggcttaccttcggaagcgatcgggcctggtgctgcacgcccatcgcaacggctgggacatcctcacccgccaccccggcctcggcatggatttcaaggtctggcaacagttctggcgattgctcggcgtcgaccagttccagatcaacggcatcgcctcaaaatattgggagccggatgcatccttcatcgaatccttcaaggcagtgacgacgccgatcttttcgcctgacgattgcgcgctgccggtcgcaggttccggccagtggggcgggcaggcgcccgagacctaccaacgaaccggccgcacggtggatctgctttatctctgcggcggtggcatcgtcagccatccggacgggccaggcgccggcgtgcgcgccgtgcggcaagcctggcaagcggcggtcgatggcatcccgctggcgaaatatgcccgcagccatgccgagctcgcgcgctcgatcgaaaagttcggcgacggcaaggcggcgtga

SEQ ID NO: 35937 - DNA, 1374 bp, Mesorhizobium loti
atgctcgccaattccctgatcgaactcgaccgcgcccatctcattcatccggtctcctcatatcgcggccatgaggcgctcggcgtgcgtgtgctgaaatcggccaagggcgcgaccgtgaccgaagcgtccggccggcaactcgtcgacggcttcgcgggactgtggtgcgtcaacgccggttacggccacgacagcatcgtcgaggcggccgcccggcagatgcgcgagcttccctacgccaccgcctatttcgacctcggcgcggagccggccatccggctcgcttcggagctggccgagcgcgcgcccggggatctcaatcatgtctttttcacgcttggcggatccgacgcggtcgacagcacggtccgtttcgttcgctactactggaatgccaggggcgcgccgaaacgcgaccagttcatttccatcgaacagggctatcatgggtcgtcggtggtcggcgcgggcctgactgccctgcccgcctttcacgccggtttcggcattcctttcgaatggcagcacaagatcccgtccccctacccctatcgcaacccggtcggcgaggacgccaacgcgatcattgccgcatcgctcgccgcgctgaaggccaagatcgaagagctcggaccggagcgggtcgccgccttctatgccgagccgatccagggctcgggcggcgtcatcgtcccgccgaaaggctggatcaaggccatgcgcgaactctgccgggagtacggcatcctgttcatcgccgacgaggtgatcactggcttcggtcgcacggggccgctgttcgcctgcacggacgaggagatcgttcccgatttcatgacgaccgcgaaagggctgacctcgggctatgttcccatgggcgccgtgttcatggccgatcatgtctacgacgtcattgccgatggcgcgggcgcttcgtccgtcggccacggctacacctattccgcgcaccccgtcagcgctgccgtcgcgctcgaggtgttgaagctctacgaagacggcctgttggagaatggcatcaaggccggcgcccgcctgatggcagggttgtccggcctgagcgatcatccgctggtcggggacgtgcgcggccgcggcatgctagccgccatcgagctcgtggtcgacaaggagaagaagacgccgcttccggcgtcggcgatgccggcacggcgcatcttcgaccgggcgtgggacaacggcctgatcatccgcgcttttgccaatggggttcttggttatgctcccccgctctgctgcaccgacgccgacatcgatgcgatcatcgagcgcacacgccggacgctcgaccagacgctggcggatcccgatgtccgccaggctctggcatga

SEQ ID NO: 35938 - DNA, 1458 bp, Mesorhizobium loti
atgaaaaccctgaaagacaaaaatctcttccgcgaagccggcctgatcggcggtgagtgggtcgctgccggctccggcaagaccgtcgatgtcatcgatccggcgacgcaggctgccatcggcaccgtaccggacatggctggctccgacacccgcgcggccatagacgccgcggcgtccgcctatggcgactggaagaagaaaaccaacgccgagcgcgccgacctcctcgaagcctggcacggcctgatgctggcgcatctggacgatctcgcgctgatcctgacgactgaacagggcaagccgctggacgaagccaaaggcgagatccgctatggcgcgtccttcgtcaaatggttcgccgaggaagcacgccgcatcaacggccacaccatcccctcgccgacgcaagaccgccgcatcatcgtgctgaaagaaccggtaggcgtttgcggcatcatcacgccgtggaattttcccaatgcgatgatcacccgcaaggtcgcgccggcgttggccgccggctgcactgtggtgatcaagccgtccgaattcacgccctattcggcgctggcgctcggcgtgcttgccgaacgggcgggcatcccggccggcgtcatcaacatcgtcaccggcatgccggccgagatcggcaacgagatcatggcgaacgagaccgtccgcaagatttcctttaccggttcgacgcgcgtcggctcgctgctgatgcgcggtgcggccgacagcgtgaaacggctcagcctcgaactcggcggcaacgcgcccttcatcgtcttcgacgacgccgacctcgaccttgccgtcgagggcgcgctggtctcgaagttccgcaatggcggccagacctgcgtctgcgccaaccgcatcctcgtccaggcgggagtctacgaagccttcgctgcgaagctttcggcccgcgtcaacgccatgacggtggggccgggcacgcagcccggcgtcgccatcggtccgatgatcaacatggcggcggtcgagaagatcaaccgccatgtcgaggacgcgctggccaagggtgctgcaatcatcaccgagaagccggcgttgccggagggtcctcaatatgtcgcgccgctggtgctgagcggcgccaccaaggacatgcagctcgccggtgaagagacgttcggcccggtggcgccgcttttccggttcgagacggaagaggaggcgatcgcgctggccaatggcacgccctacgggcttgcttcctacttctacaccgagaatttgaaacgtgcctggcgcgtcggcgaggcattggagttcggcatggtgggtttgaacaccggctcggtctcgatggaagtggcccctttcggcggcatcaaacagtccggcctaggtcgcgagggcgcgcaggccggcatcgaggaatatctcgagatgaagagcttccatatcggtgggctgggctga

SEQ ID NO: 35939 - DNA, 1044 bp, Mesorhizobium loti
atgaagtcttattcgatcgctatgatccccggtgacggcattggccgggacgtgaccgccgccgcatggacggtgctggaggccgcggcaaaacacgcgggctttgccttgaccggaaccgagttcccctggtcctgcaaattctacaaggataccggccgcatgatgcccgaggacggcatagagaccttgcgcggcttcgacgccatccttctcggcgcagtcggctggccggcggaggtgccggattccgtttcgctgcacggcctgctgctgccgatccgcaaggcattcgtgcagtacgccaacatccggccgcaccgcctgctgccgggcgtgacagggccgctgcgggcggaaggtttcgacatattgtgcatccgcgagaacaccgaaggcgaatattcgggcgccggcggtcgcgtgcatcagggcacgctggacgaggttgcggttgagacctcgatcttcacccgtgccggcgtcgagcgcatcctgcgcttcggcttcgagcaggcgcggacacggaacggcaagctggcttccgtcaccaagtccaacgcgcagaaatactcgatggtgttctgggacgagatcacccgcaagctggccgcggagtattccgacgtcgctgtgaccagctatcatgtcgatgcgctcgccgcgcgcatgatcatggcgccggagagcctcgacgtggtcgtcgcctccaacctgttcggcgatatcctcaccgacatcggcgcggcaatccagggcgggctcggctacgctgcctcagccaacatcaatcccgaccactcggcgccgtccatgttcgagccggtgcacggctcggcacccgacatcgcacatctgggcatcgccaatccgatcgccaccatctggtccggcgccatgatgctcgatcatctcggcgaaaagcctgctgccgaccgcgtcatgaaggcggtcgaggtcgcaaccgccagaggcataggcaccattcccgccaaggatcgcacagaggccatcaccgccgccgtcgtcgcggcgctcacctaa

SEQ ID NO: 35940 - DNA, 1464 bp, Mesorhizobium loti
atgggcctgagcttcgacccggatactgtctcccttcccgtcggccatttcattggcggagagctcatcgcggccgagggtgcgatcgagatgcgccgaccgtcggatggcaaggcatacgccgccagcccggtggcggacgttgatatggtcgaccgcgccgtggcaagcgccaaggcggcgctgaaggccagcaactgggggggcgttcggccgcgcgagcgcaccaaggcactccaggcctgggccgacctgatcgaggcggaagccgaagcgctggcaaaaatcgaggcgctgtgctccacccggcccgttggccagctcgtagccggcgacatcgccataaccgcggagcaaatccgcttctttgccgaattcgccgacaaggaaggcagcgagctggtgccgaccgacgactccagtctcggcatgatcatgagcgagccttatggcgtggtcggtgcgatcacgccgtggaacttccctatctcgatggctggctggaagctcggaccggcactggccgcgggcaatgcggtcgtgctgaagccgtcggaaatgacccccttttccgcagtctacatggcacaactcgccttgagggcaggcttgccggcagggcttgtaaacgtggtcctgggagacggcccgacgactggaacggcgctgaccggccattccgagatcgccaaggtcagcttcaccggctcaacccgcgccggttcggccatcatggaaaacgtcgctcgcaccggcgtcaagccgatgacgctggaactcggcggcaagagcccgcagatcgtctttgccgatgccgacctggacaaggcagcgacggcgatcgccggtagcgtcaccttcaatgccggccaggcctgtgtggccggcacgcgcctgatcgccgagaagagcgtggccgacaggctgacggccacgatcctggagaagatgaaggcggcgcggcccggcccgacctgggacgacgcgacccaatattcgccaatcatctcggagcggcagcgggcgcgtgtcgacggcatcgtgcgggccgcggtcgaagccggcggcgaatgcctgaccggtggccacaccatggacggcccaggctatttctacgagccgacgctgatcaccgatgtcgaccaagccaatccggcgatcgtcgaagaaatcttcggcccggtcctgaccgtccagaccttcgagaccgaggaggaggcgctggcgttgtccacccatccaacctacggactggcttccggcctgttcaccgccgacctgtcccgcaccatccgcttcgcgcgcaagctcgaagcgggcaccgtctgggtcaaccgctacagccgctcgcgcgaccatatcctgccgaccggcggctacaagcgctccggcatcggcaaggacctcggccgcgaggcctatctcgccaaccgcaggagcaagagcgtcctgatcagcctctag

SEQ ID NO: 35941 - DNA, 747 bp, Mesorhizobium loti
atgagcactcccgttgttttgattaccggcgcgttgaccggcatcggccgcgagacagcaatcgccttcgcaaaagaaggctctcgcctcgtcatcgcgggtcgccacgaagaggctggacggaaactcgcaaccgagctgcaatcgtttggcgcggaggtggaattcatccgggctgatgtccggcacgacgacgaggtgcgcgatctcatcgatcgggcggttgcccgcttcgggcgcctcgacgtcgccgttaacaatgccggcactgaaggcaagccgggcccagtaaccgagcagacggccgaaacctacgcggcgaccttcgacaccaacgtgctggggacgctgcttagtctgaaacatgagcttcggatcatgctgacccagggcggcggcagcattgtcaacatctcctcgacctacggccatgagggcgcgaagggcgcttcgatctacgcggcaagcaagcatgccgtcgaaggcttaaccaagtccgctgcccttgaagcagcggcctcgggtgttcgcgtgaacgcagtcgcccccggaccaacgaacaccggcatgctcgatcgcttcaccggtacttccgaagtgaaggcctccctggccttgactgtgccaatgggacgcgttggccagccaagcgaacttgcccgcgcaatcgtctttctggcctctaaagaggcatcgttcatcactgggcacgttctgacggtggacggcggaaagactgcgggttga

SEQ ID NO: 35942 - DNA, 747 bp, Mesorhizobium loti
atgactaagctttcaggaaagaccgctctcgtcacaggtgcctcgcgtgggatggggcggtccgccgcgttggcgctggcacgaatgggcgcgcaggtattgattcactacagcaccgggttgaaagaggccgaagccgtcgtcgccgagattcgcgaggccggcggacgtgcagactcgcttgccgcagatctgtccgcgccggatggggcgcacaagctcgcgaagcaggttcgatctgtgatcggcgacagactggacatccttgtagccaacgccggaacctcgaagtcggcgaccattgagcaaactacggtcgaggatttcgacaggctcttcgcggtcaacgtccgcgctccgttcttcctcgtccagcagttgctgcctatcatgggcaaggacagcagcatcgtgctgatctcttcgctggcagcccatgcggcggtaggaacgctcccagcctatgcggcgaccaaaggtgcgatcgacacattggtgaagcacttcgctgcagtgctcggcgaacgcggcattcgtgtcaatgctgtggcgccgggtgtcgtcgggaccgacatgtcaagcttcaccaagacggacgcagggcgtgacttcacactcggcattcaggcgctgaaacgtcttgcccagccggacgatatcggcggtgtcgtcgccttcctcgccactgacgacgcgcgctggattagcggcgacatcgtccgggtcgacggcggctcgaagctctga

SEQ ID NO: 35943 - DNA, 1614 bp, Mesorhizobium loti
gtgagcgaaacttcccctttcggcgattacgactacgtcatcgtcggtgccggctccgccggctgcgtgctcgccaaccggctctcggccgatccgcgcaaccgggtgctgctcctcgaagccggcggcagcgaccgctatcactgggtcgatatcccgatcggctacctcttctgcatgggcaatccgcgcaccgactggatgatgaagaccgagccggaagccggtctcaacggacgcagcctcaactatccgcgtggcaaggtgcttggcggctgttcgtcggtcaacggcatgatctacatgcgcggccaggcagccgactatgacggctggcgacaggccggcaatgtcggctggagctgggacgatgtgctgccgtatttccgcaagtcggaagactatcacggtggcaagagcgccatgcacggcagcggcggcgagtggcgggtcgaacgccagcgcctgtcctggccgatcctcgacgcgttccgggacgccgccgaggaactcggcattccccgcacaggggatttcaacaccggcaccaatgaaggctcgggctatttcgaggtcaaccagcggctgggcgtgcgctggaacacatcgaaggcgtttttgcgcggcattgcggcgcgtcagaatctccgcgtggtgacgggggcagagacggaacggctcgaattcgacggccggcgcgtcaccggactcctctttcgccagggcgaccgcctgcacagggtcagcgccggacagacgatccttgcggccggtgccatcaactcgccgaagatcctcgaactgtcgggggtggggcgacccgacctgctttcgagcattggcgtggatgttcgacacgccttgcccggcgttggcgaaaacctgcaggaccatctgcagatacgcacggttttcaaggtcgccaatgccgcgacgctcaacgagcgctatcacaatctgatcagccgcgcggcgatgggtgtggaatacgcgctcaaacgcagcgggccgctgtcaatggcgccgagccagctcggcatcttcgccagaagcgatgctcggctggcaacacctgatctggaataccacgtgcaaccgctgagcaccgaccgtctgggcgagccgctgcatcgctttcccgcggtcaccgtgtcggtctgcaatctgcgcccggaaagtcggggcaccgtgcatatggcatcgtccgatccgcgcgaggcgacgaagatccggccgaactatctctccaccgcgggagaccgcagcgtcgcggtcgcatcgctgcgccatgtccgcagcctgatgaaggcgcgggccgtggcgcgctttgcgcccgaagagatgctgcccggcacgcagtatgacagcgacgaagacctcatccgcaaggccggcgatatcggcacgacgatcttccaccccgtcggcacctgcaagatgggttcggactcgatggcggtggtcgacgaccggctacgcgttcacgggcttgccggactgcgcgtggtcgatgcctcgatcatgccgacaatcgtctcgggcaacaccaactctccggtcgtcatgatcgccgagaaggcagcggagatgatcctgcttgatccgcgccgataa

SEQ ID NO: 35944 - DNA, 1104 bp, Mesorhizobium loti
gtgtcgaaagcttcagacatggtccgaaccgaagtcacgcgcccgtcgccttacaattccgggctgaccatcaccgaggtcatgcaacgatatgctccggccaggatcgccaagctgggctcgaatgaaaacccgctcggcccgagcccgacgctggccacgatgctgcaggccggcgccgagatgttccggctctatccggatccggccgggcgcgaactgcgccaggcgatcgccgccaaatatggattcggtgaggaccaaatcatcctcggcaatggctcggaggaccttctctccgtcatcagccgtgccgtgttaaggcccggcgattccgtcgtcacgctctatccatcattcccgctgcacgaggactacgcgacgctgatgggcgcgagcgtcaaacgagtgaccgtcaacgacgacctcaccatcaatgccgacgccctgatcgacgcggtgcgcgagcggccccgcatgctgctgttctccaacccgatgaacccggtcggcagctggctgtccgccggcgacctgtcgaaggttctggatgcggtcagcgacgagacgctgatcgtcgtcgacgaagcctatgccgaatatgcggaaggcgacgactatgcctcgtcgctgcctgacctctgcgaacgcgaccagccctggattgtgctgcggacattttccaaagcgttcgggcttgccgggttgcggatcggcttcggcattgtcggcgacccggaattgcgcgccctgctcgacagggtgcgcacaccgttcaacgccaatggcatggcgcaggcggccgcactggcggcactcgcggatgaggaacacctcgcgaaggtcgtcgcgctggccaaggcggaaagaacgcaggtcgagagtctcctcaggaacatgggcttcgacgtcgccccttcccgcggcaatttcctgtttttcaactgccggcaaaatgcctccgccttcgccgagggcctgctgcgcgaaggcgtcatcgtcaaaccctggaagcaggaaggttttgacagctatgtgcgtgtcagcatcggctcgccagcggagaacgaccacttcatggccgcgctgtcgcagctgttgtga

SEQ ID NO: 35945 - DNA, 774 bp, Mesorhizobium loti
atgcgcaatgcttctctgttcgatctcgccggcaggaaagcgcttgtcaccggcgccagccgcggaatcggccgcagcatcgccgaggcgttgagcgctgccggcgccgacgtcgcggtcaccgcgcgcagcctggcgtccctcgacgggaccacggcggcgatccgtgcggccggcggggttgcgcatgccgtcgctctcgacgtcaccgatgtcaaccgctgccggaccgccaccgccgaggctgcgggcctgctcggcggtctcgacatcctcgtcaacaatgccggaatggaagaggtcaggccttcgctcgacgtcgacgaggcgctgtgggaccggatcgtcgacaccaatctcaagggggcgttcttctgcgcccaggcggccgcgcggcagatgcgggatgccgggcatggcggcgccatcatcaatctctgctcgctgacgtcagaagtcggcattcctaccgcggtgccctatggctcttcgaagtcgggcctgctcggcatgaccagggcgctggcggcggagtgggcgggtctcggcattagggtcaacgccatcgccccgggttacttccggacggcgatgaccgatgtgttctacagcaacgaggcatggcagcagtctatgctcgccaagatcccgcagcaccgtttcggcgatctcggcgacctgcacggcgttgccgtcttccttgcctcggatgcggcggcctacataaccggccagtccattccggtggatggcggcttcctggcatcgatttga

SEQ ID NO: 35946 - DNA, 1323 bp, Mesorhizobium loti
atgtccgacgtcagcttccacgatctgtcatcgctcgacgccacccagcggtccagcctgctgaagcgcgccgaggccgatctgtcggtcttcgtcgaaaaggtccgcccgatcatccaggccgtcaaggacgagggtgacgccgcgctgatccgcttcgccagggagctcgacaaggccaatgtcgccgaaggcggactacaggtgtcggaagccgagttcgacgcggccttcgacaaggtcgagaaggatgtcgtggaaagcatcggcttcggcatagacaatatcaggcgtttccatgaggagcagaagccggaaacgatgtggctcaaggaagtccggccgggcgcctatgccggcgaccgctatacgccgatcgcgtccgtcgcgctctacgtgccgcgcggcaagggcgcctttccgtcggtgacgatgatgacctcggttccggcagtcattgccggcgtgccgcagatcgccatcgtgacgccgccgacatcggacggttcggtggatgcggcgacccttgtcgccgcccgcctcgctggcgtgcacaccgtttacaaatgcggtggcgcccaggccgtcgccgccgtcgcctacggcactgaaacggtgaagcccgcgctcaagatcgtcggccccggcagcccatgggtggttgcggcaaaaagcgagctgtcgtcgatcatcaacacgggtcttccggccggcccgtcggaagccatcatctttgccgatgacagcgtcgacggcggccttgccgcgctcgatctactgatcgaggccgagcacggaccggattcttcggcctatctggtgacgcacagccgcaaggtcgccgaggccgcacttgccgcactcccgcaacactggtcgcggatgaccgaacagcgtgtggagttctcgcgcgcggtgctgaccggcaagcgtggcggcatcgtgctgaccgcgtcgctggaagacagctatcgcttcatcaacgactatgcgcccgaacatctggaaatcctgtcgaaggagccgttcgcgcacctcgggcatatcaccgaggcagccgaaatcctcatgggcccgcacacgccggtgacccttgccaacttcgtccttgggcctaatgccgtgctgccgaccagccgctgggcgcgcacctatgggccgctctcggtgaccgatttcgtcaagcgctcatctgtcggctacgtcacctccgccgcttatccggaattggcgaagcatgcccgcaggcttgcccgctacgagggcttcagctcacacgaaaacgcggtctcggaaatccgcgaccgctacctcgccggctga

SEQ ID NO: 35947 - DNA, 1896 bp, Mesorhizobium loti
atgatgtcgacgcgggacgatgacgagaaggacgacaagagcgggcggccgaccaaggccgtcgtcggctcgcatcgcgacgaggaagaggttttcggcaaggcctatgatccgcgcatcatcaggcgcatctggagcttcgtgaggccctatcaaggccggatcttcatctctgtggcggcagtgctggtgttcacgctgacgcagttggcgatcccgctggtcatccgctacgccatcgaccacggcatggctccgggccggctcgaccgctcggtgatgatctccgcgattatcactttcaccgtgatcatcctgatcaactatgccgccagttatgtgcaggaaagcgtcgtcggcaaggtggccgagaacgtgttgtccgatctgcgccgcgccatgttcagccatctgcagcttgtgtcgctcagcttcatggacaagaccgaggtcggccggctgatgtcgcgcctgcagggcgacgtcaattcgatgcaggaattcctcgagacatcggtgatgtcggtgggcgacatcgtgctgctgttcggtatcgtcaccgtcctgctctggctcgatttccggctcggactgttgacattgtcgaccatgccaatgctgttcatcgtgcggctgttctggctgccgcgcgccaaggtcgccttcatggcggcgcacgaaaccaattccatcgccaacggggcgctcgccgaaggcatccatggcgtgcgcaccgtgcagagcctggagcgccagcacgtcaatttcgacctctatgacgagaaggtgctggccaacctcaatgcccatctgcggtcagctagatatgcccaggtgatggtgccgatcgtcgacacgcttaccggcatggccatggcgacggtcatcgtcgtcggcggttcgatggtgctctcgcacagcctcgatgtcggcgtcatggtggcgttcctgttctacatccagcgcttcttcgacccaatccgctcgctcaccatgcagtatagcgtcatgcagcgcgccatggcctccggccagcgcatctccgaagtgctcgacgtgccggtggatgtcagcgacaaggacaatgcggtggccttgtcgcgcgaaacggacggctcggtcgagttcaggaacgtcaccttcggctatcggccgaaccagccggtgctgaagaacatctctttccgcgtcaatccgggcgagaccgtcgcgcttgtcggtccgaccggatcgggcaagtcgagctcgatggcgctggtgcaccgcttctacgacgtctggtcgggtcaggtcctggtcggcggccatgatgtgcgtgacctgacgcaggattcgctcggcgaccaggtggccatggtgctgcaggaaccgttcctgttctccggcacggtgctggagaacatccgctaccacaaaaccggcgccagccgcgacgaagtggtgcgcgcggcgcaggccgtcggcgcgcacgacttcatcgaacaactgcccgatggctacgatacccagctagagcaacgcggcggcaacctctcgctcggccagcgccagctcatcagtttcgcgcgggcgctggtggccgacgccaagatcctcgtgctcgacgaggccacggccagcatcgattcctacaccgagatgctgatccagaaggcgctgatcaaactgttggaaggccgcaccgggctggtcattgcccatcggcttgccaccatccgcggcgccgaccgcatcatcgtgctgcagaacggtgagatcgtcgagagcggcaaccacgaacagctgatgcagaggaagggcctctacgcccgcctctacaacatgaactacgcttcgttcgacgacatttccgaggaagagatgggaatggacgcggcgctcggcaaagcgacgtga

SEQ ID NO: 35948 - DNA, 1884 bp, Mesorhizobium loti
atgtccggattggattggatattttccttgcctacggatgcagccagcggcgcggcgaagcgcggcaaatcgtttgcccatgtggcggaagcctcctggggcaagggcctcagcaccttgctgcgcatcgtgcgcatgacgctgcgccatccctggcaggtcgccatcaccctcgtctcgaccttcatcgccgcgacgctgcagcttttcatcccacgcctgctgggacgcgccatcgatcaggcgcaaggcgtgatcgccgccagtggcggtgccgtggcggaacaggcgctgtggcacacggcgctgacactgctcttcgtcagcatcctgcgcggtctcttcaccatggcgcagaactattatggcgaggccgtcggccatcaaaccggctatgaattgcgtctcgccttctacgagaagatccagcgcctgagcttctccttccacgacaaggtccataccggggacctgatcacgctcggtctgctcgatctcgacggcgtgcgcatgttcttttccaccggcatcctgcgcgtggtgctgctcggcgtgctgatcggcgtcggcgcctatctcctgatcagcaccgatttcgtgctcgggctgctcagcctcagcttcgtgcctttcgtcgcctggcgctcctccgtgacacagctcagattgcgcagcacctggctgacgctgcaggagcggctgtcggtgttgagcagagtgatggatgaaaatctcggcggcatccgcgtcgtgcgcgcctttgcggcgcagcgccatgagctcaagaaattcgaccgcgccaagcaggacgcgctggagttggccaatcagcgcgtcgacatccgcgtctccaacaccagtgccatgaacttttccttcctggccgccatggggctggtgctgtggttcggcggccagaaggtgatcgcgggccagatcagcgtcggtacgctcgcgcagttcctcaccttcatgaccatcctgcagatgccggtgcgccagctcggcctgatggtcaactcgttcgcgcgcgcctcgacctgcggcacgcggctgttcgaactgctcgacaccgaactcgacatcgaggatgcgcccgacgccagggagctcgtcatcaccgagggcgtgctgcgcttcgacaatgtcggcttccgctatgaaggcgcgggcgatcgtccgacgctgtccggcatctctttcgaggccaggtccggcgagacgatagggatcgtcggaccgcccggcagcggcaagtcgaccatcgcgcatctgatcccgcgcttctacgacgtgacctcgggcgcgatcaccatcgacggccaggacataagcaaggtcacgctgcaatcgctgcgcaaggtggtcggcgtggtgcagcaggacgcgttcctgttcaccacctcgatcgagaacaacatcgcctatggcaacccctgggcgcgtgaaacccgcatcggacaggccgccgaatatgcgcagttacacaactatatcatcggacttccggccggctacaccacggtcgtcggcgagcgcggcgcatcgctttccggcggccagcgccaacgcctgaccatcgcccgcagcctgatgttgcggccatcggttctggtcttcgacgattccaccgcggcaatcgatgccggcaccgagcagcgtatccgcgcggcaatgaagcgtttcgccaaggatcgcgtgacgctgatcatctcgcatcggctgagttcgctgatgcatgccgaccagatcctgttcgtcgagggcggccgcatcgtcgagcgcggcacgcatgaggaattgctggcgctgggcggtcgctatcgcgcgctttacgacttgcagctgcggccggatgacgaccggctcgagggagccgcatga

SEQ ID NO: 35949 - DNA, 1497 bp, Mesorhizobium loti
atgacagcccggatagtactgctcgacgccaagccgctcggcgtggctgacgtcgccgagatcgcacgccgcaacgcccggttgatgctgggcgaagaagcgatgcgccgaatccgggcgagccgcgccctcatcgaacatctgaccgggcttggcaaaccgatgtacggcgtcaccacaggcctcggcgcctgtgtcgacacgccgctcgcgcaggccgacctgatcgccttccagcacagcgtgccgctcagccacagcatgggcatcggaccggcgctcccgacagaggcggtgcgggcgctgatgaccgcgcgcatttcaggtatggccgccggtggcaccggcacctccgaacgcgtggtgatgggccttgtcgccgcgctcaatgccggcgtgcatccggtgatcccgacctggggctcgatcggcgcggccgatcttgctcatctcggccatatggcgaggtcgctgcgcggcgatggcgaggcggagttccagggccggatcatgccctccgccgaggcgcttgccttggcccggctcgagccgctcgacctgcgcgaaaaggacggccacgccatcatcgtcgccaacagcctgtcgaccggaacggcgtgcctgtaccttgaagacgtcgcccatctcatcgactgggcgctggccgccgtggcgctcaactacgaggcgttccgctcgtccctcaccgcgatcgacgaacaggcgcttgccgcgcggccggccttcggccagcgcgagatcggcgcgcggttgcgcgcggaactagccggaagcggcctttggcaggacaaggcggcacggcgcttgcaggatccgctcagctatcgctgcgtgccgcaggtctggggtggcctgctcaatgcgttcgaacaggcaaggctagcgaccgagatcgaactgacccattccggcgataatcccgtgatcctggccgagggcgaacgggtgatttccaacggcaatttcgacctgacggcgatgacgctggcctgggagcaactgggccaggcgctcgcgcattgcgccgtcggcaccgccaatcgctgcatgaagctgatgtcgccgacaacagccgaactgccgcgcttcctgtcggccaggggcggcagccgccagggctatgcggaactgcaaaaacccttgtccgcgctggaggccgaaattcggcatctggccaacccgatgtcactcagcccgctcgcggtgtcggacggcatcgaggatcagtcgtcgatggcgcccagggtggtggccaaaaccgctgagatcgtcgagcgcatgcgctatctcgtggcgatggagctgatcttcgcggcgacgggtgtggagttgcgcggtgtcgtcgacaccatgggtgaagggccgcagcgcaccttcgccgccgtgcgcgcgctcgtcagcccgctcgacgacgaccgcgagatgagcaccgacatgacgcgggtggcgcggatggtggcgggtccgcgctgctga

SEQ ID NO: 35950 - DNA, 1071 bp, Mesorhizobium loti
atggccgccgtgctgctcaccgggcacggcggaccggaaaaactcgtctaccgcaccgacgtgaaagtgccctcgcctgaccctggtgaagtgctggtcgaggtcagcgcctgcgggatgaacaacaccgacgtctgggtgcgccagggcgcctatggcacggaagaggacgcggccgccgtgtcgacctggcggcgtcagggcaacacgcttgttttcccgcgcatccagggcaccgacacggttggcaccatcgtttccgttggcgaaggcgtttcgccggagcggatcggtgagcgggtgatggtcgatttctccatctacaaccgcgatgacgattcactcgccgacatcgactatatgggtcatggccgcgacggtggttatgccgaataccagaccgtgcctgccgagaacgcccatgtcgtcgatactgatatgagcgatgtcgagctcgccaccttctgctgcgcctacctgaccggcgaacagatgctggaacgcgccggcttgaaggccggtgagcgtgtgctggtcaccggcgcttcgggcggcgtcggctccggcatcgtccagctggcgcgggcgcgcggcgccattccctatgccgtcgtcggcaagggcaaggaacaggcggtgctcgacatcggcgccgaggccgtcatcacccgcggcgtcgctgacctgccgcgggccgtggctgaagtgaccggcggccagccgatcgacgtggtcgccgatctcgtcggcggcgcgatcttcaacgacctgctgcgtattctcaggcccgaaggccgctacaccaccgccggtgcaatcgccgggccggtggtgcagctcgatctcaggaccatgtatctcaagcaattgcagctgcatggctcgagccagggcacgcgcgcggatttccgccgtatcgtcggctatatcgaggcgaaaaagatccggccgctggtcggaggtgtctacaggctctccgatttccaccgcgcacaggcggatttcgtcgccaaggattttgtcggcaagctggtggtcgtccccgatgccatcgcggagcggcaggcatag

SEQ ID NO: 35951 - DNA, 1380 bp, Mesorhizobium loti
atgctcaaccagtccaacgaactcaacgcctgggatcgcgaccacttcttccatccctcgacgcatatgggcacgcacgcacgcggtgagagcccgacccgcatcatggccggtggtgaaggcgtcaccgtctgggataacaatggcaggaagagcatcgacgccttcgctggcctctattgcgtcaatgtcggctatggccgccagaagatcgctgatgccatcgccacacaggcgaagaacctcgcctactatcatgcctatgtcggacacggcaccgaggcctcgatcacgttggccaagatgatcatcgaccgcgcgccgaaggggatgtcgagggtctatttcggcctctccggctcggacgccaacgaaaccaacatcaagctgatctggtactacaacaatgtgctgggccggccggagaagaagaagatcatctcgcgttggcgcggctatcacggctcgggcgtgatgaccggatcgctgaccgggctcgacctgttccataacgccttcgacctcccgcgcgcgccggtgctgcacaccgaggcgccgtactatttccgccgcaccgaccgctcgatgagcgaggaacagttctcgcagcactgcgccgacaagctcgaggagatgatcttggccgaaggtcccgaaaccatcgccgccttcattggcgagccgattctcggcaccggtggcatcgtgccgccgcctgccggttactgggaaaagatccaggcggtgctgaagaaatatgacgtgcttctggtcgccgacgaagtggttaccggcttcggccggctgggcaccatgttcggctccgatcattacggcatcaagccggatctgatcaccatcgccaagggcctgacctcggcctatgcgccgctgtcgggcgtcatcgtcgccgacagggtgtggcaggtgctggtgcagggttccgacaaactcggctcgctcggccatggctggacctattcggcgcatccgatctgcgttgccgccggagtcgccaatctcgaactgatcgacgagatggatctggtgacgaatgccggcgaaaccggcgcctatttccgtgccgaactcgccaaggccgtcggtggccataaaaatgtcggcgaggtgcgcggcgacggcatgctggcagcggtcgagttcgtcgccgacaaggacgaccgggtattcttcgacgcttcgcagaagatcgggccgcaagtggcgacagcgctggccgccagcggcgtcatcggccgcgccatgccgcagggcgacattctgggcttcgcaccgccgctctgcctgacccgcgagcaagccgacatcgtcgtctcgaagactgcggatgcggtgaagagtgtgtttgccaatctctga

SEQ ID NO: 35952 - DNA, 1494 bp, Mesorhizobium loti
atgtccgcgcatttcgcccgctcgcatcgccatgaggcgctcgaccgcctcgccgaccgccgtctgctgcgcgaactcgcctatgtcgacggccactggacggcgagcgaggccgccgaaagctttgaggtcacggatccggcgacgggaagcacggtcgccttcgtcgcggcgctggatgcacggcaaacgacacaagcaatcgacgccgccgcgctcgcttttccggcttggcggtcgctgctgccgcaggagcggtcaagaatcctgcgaaaatggttcgagctgatcatcaccgcgaaagacgacctcgcgttgctgatgaccctggaacagggcaagcccttgcaggaatcgctcggcgaaatcgactatgccgcctctttcgtcgagtggtatgcggaggaagccaagcgcctcaacgccgagagcgtcaccagccatctggcgaacgcagaaatgatggtgcggcgcgagccgctcggcgtcgtcggcatcgtcacgccgtggaatttcccctcggccatgctgacccgcaaggcggccgccgcccttgccgccggctgcaccattgtcgcgcatccgtcctcggaaacgccgctgtcggcgctggcattggccgagcttggcgagcgcgccggactgccggccggtgtcttcaacatcgtcaccggcaaggccgcgacgatcgtcgggcggatgtgcgaagacacacgcgtgcgcgccatgagttttacgggctcgaccgagatcggcaggctgattgccgcgcagagcgcgccgacgatgaagcggctggtgatggagcttggcggccacgctccgctcatcgtgtttgccgatgcggatctcgacaaggcggtgagcatcgccatcgacgccaaattcgccacatcgggccaggattgcctcgccgccaaccgcatctacgtccagcggccgatccacgatcgcttctgcgctgccttcgccaagcggatcgaggcgctgcggaccggcaatggccttgacgacatgaccgacatcgggccgctgctgcatgagcgcgccgtccagaaagtcgaggagcaggtcgccgatgcgctcgcccatggcgcgcgctgccttgccggcggcaagcgacaccaggccgggccgctgttctaccagccgacgctgctggccgacgtttccgacgcggcgctgatcatgcgcgaagagacttttgggccggtcgccgcggtgacgcctttcgacagcgaggacgaggtgatcgcgcgcgccaatgccacggaatatggcctggttgcctatgtcgtgacggataacggtgcccgccagcagcgcatgggccgcgcgctcgactacggcatggtcgccatcaaccgggtgaagatcaccggcgctccgatcccgttcggcggtgtcaagcagtccggcatcggccgcgagggctcgcgccacgggctcgaagcgttcaccgatctcaagtatctctgcctggacgtcgcataa

SEQ ID NO: 35953 - DNA, 1311 bp, Mesorhizobium loti
atgcacgtgtcccagtcttcgccatatcaagcaaatgccgactcgacggcatccgagcaggccctgctcgaacgccgcgcaaggctgcttgggccgacctatcgcgccttctaccgcaacccgatccatctggtgcgcggcagcggcgtctggctctacgatgcgacaggccgcaaatttctcgacgcctacaacaacgtcgcctcggtcgggcactgccatccgcgcgtcgtcgaggcgctgtcgggacaggccgctactctcaacacccatacccgctatttgagcgagatcatcctcgattatgcggaaaaactgctcggcacggttccctcccatctcggccatgccatgttcacctgcaccggcagcgaggccaacgacctcgccatccgcatcgcccagcactcgagcggcggtaccggcgtcatcatcaccgatttcgcctatcacggcgccacgatcgcgaccgcgcagctgtcgccagcggcggtcggcgcgaagggcgtgcccgtgcaccaccggaccgtggccgcgccggacacgttccgcgaccacggtcgcgccgcgaaggacttcgccaagaatgtcgccgccgccatcgaggacatgcgagcgcagaatatccgcccggcggcgctgctgctcgactcggccttttccagcgacggcattttcttccccgacgcggctgtcatgcgcgaggcgggggatcacgttaggaaggccggcggcatcgtcatcgccgatgaggtccagtccggcttcggccgccttggccagggcatgtggggttttgccaactatggcctcgagcccgacatcgtcaccatgggcaagccgatcggcgacggccatccgatgggtgcggtactggtgcggccgcggcttgtctcgtccttcggctccaacaccggttatttcaacaccttcggcggcaatccggtcgcggccgccgtcggcatcgcggtgctggacgtgatcgaaggcgaggggctgatcgagaacgcgcgcaatgtaggcgcctatacggctgacctgctgcgcgcgctgcagggccgtcatggcatggtcggtgacgtcaggcacaacggtctctatttcggcgtcgaactgacagcggacggcggcgaagcgctggcggccagcaagacgtcttccgtcgtcgaagcgatgcgcgaggacggcgtgctgatctcgtcctgcggtccgcgcggcaatgtgttgaagatcaggccgcctctgccctttgccagggacaatgccgagcaactggccgagacgctcgatcgtgctttgtcgaactggtga

SEQ ID NO: 35954 - DNA, 1404 bp, Mesorhizobium loti
atgtcgcctgaaacgcaacggcttctctccgcccttggcgatcggctgggcgcgggcggcgtgcttgccggttccgatgtcgaccagcgctatcgcgacgatcccgacggcaagcttggcgtactgcccgaagtggtgctgcgtccgcgcgatgccgttggtgtcgcggcagcgctcgccggctgccacgctgtcggccagccggtcgtcgtccagggcggacgcaccgggctggccggcggcacgcgggtccagcccggcgagatcgtgctgtcgctggagcgtatgagcggcctcgccgctccggacacccaagccgccagtattgtcgccgaagcgggtgcgacgctgcaggcggtgcaggaggcggccgacgacgccgggctgatgttcggtgtcgatatcggcgcgcgcggctcggctacggtcgggggcaacatcgccaccaatgccggcggcatccgcgtgctgcgttatggcatgtaccgcgcacaggtgcttgggctggaggccgtgctggccgacggcagcgtgctgtcctcgctgaagggcctgcccaaggacaattccggctacgacctcggccaactcttcatcggcgcggaagggacgctcggcgtcgtcacccgcgccgcgctccggctgcatccgaagccggcctccgaggtgaacgccttctgcgcgctcgcttcgctcgacgcggcgatcgccttgctcggactgctgcggcaaaggctcggtccgttattgtcggcctatgaggtgaatttcgcaccgctctatgacgtgatggctgccagcatggccatgcccgcgccgttgcctgtgggctcacccgtctatgtgctggccgaaatccagggcaacgagcccgagcgcgacggcgagcgcttcgccgaggttctcatgcaggcggtcgaggatggcgtggtcgacgatgtcgtcgtctcgcagtcgccgcgtgaattccgggcgctctgggacgtgcgggaggacgccaatcgcgttctgttttcgatcaaaggcctgatcggcgtcgacatcagcatcccgctggcgcgcatgggcgcgttcctgcaagaagccgacgccgccatccatgccgtcgatcccagcgccgacatctatgtcttcggccatctcggcgacggcaatctgcactatcaggtgctgacggcggatccggcggccgcctacggcatcgtctatcgcggcgtggcggcggccggaggcggcgtttcggccgagcatggcatcggcctcgataagaaacagtggctgcatctggtgcgcagcgacgccgagatcgccacgatgcggcggctgaagacggcgctcgacccgaagaacatccttaatccgggacgtgtcttcgacctcgatccagctgccgtcccccgatga

SEQ ID NO: 35955 - DNA, 777 bp, Mesorhizobium loti
atgacggatgaaatcggctacgccatctacccaagcctcaagggccgcagcgtcttcataaccggcggcggcagcggcatcggcgaaagcctggtgcgccatttttgcgcgcaaggcagccgcgtcgccttcgtcgatctgtcggaagagccttccaggcatctggtcgaggcgatcgcggccgaaggacacccagcgccgctgtttattccgtgcgatctgcgcgatgtcgagcagttgcaggcggcaaccgcgcaagcgatgcagcacaatggcccgatccaggtgctgtgcaacaatgccggcaacgatgaccgccatcaaaccaaggacgtgacggtcgcctactgggacgaccgcatggcggtcaatctgcgccaccagttcttcgccgcgcaggcggtgcgaccgcagatgagcgcgcagggtggtggctcgatcatcaatttcggctccatcacctggatggtcggcgatcccgattgtccggcctatgtcaccgcgaaggccgctgtctacggcatgacgcgggcgctggcccgcgaacttggccccgagcgcatccgagtcaactgcatggtgccgggctgggtgatgaccgagcgccagatgcggctgtggctcaatccggctggtgaacgccagatcgcggaaaggcagtgcctgcccgaccggctgcagcccgccgacatcgcgcgcatggcgctgttcctcgccgccgacgacagccgcatgtgcacgagccagcagttcatcgtcgatgcgggctgggtgtga

SEQ ID NO: 35956 - DNA, 1446 bp, Mesorhizobium loti
atggatatcggacttctgatcgacggcgacaaaagggatgcgtccggcgcggccgcctacgagcgtctggacccgttcaccggcaagctggcaacgcgcgccgcagccgccagcgttgccgacgccaacgctgccgtggaagccgccgccgccgcctttgcgacctggtcgaagaccgggcctggcgagcgccgcgccttgctttccagggcggccgacgtgatggcctccaaggtcggcgaattcaccaaattgatgatggaagagaccggcgccaccgctccctgggccggcttcaacgtcatgctggcggccaacatgctgcgcgaggcagcggcaatgacgacgcagatttcgggcgagatcattccttccgacaagccgggcacgctcgccatggcgatccgccagccggccggcgtgtgtctcggcatcgcgccgtggaacgcgccggtcattctcggcacccgtgccatcgccatgccgatcgccagcggcaacacggtggtgctgaaggcctcggaaatgtgcccgggcacgcatcggctgatcggccaggtgctggtcgaagccggcctgcccaagggcgtcatcaatgtcgtcaccaacgaccccaaggatgccgctgcaatcgtcgaggcgctggtcgcgcatccctcggtcaagcgcgtcaacttcaccggctcgaccaaggtcggccggatcatcgccgagctcgccggccggcatctgaagccagcgctcctcgaactcggcggcaaggcgccgctgctggttctggacgacgccgccatcgacgcggcggtcaatgcggcgaccttcggcgccttcatgcatcagggccagatctgcatgtcgaccgagcggctgatcgtcgacgagaggattgccgacgaattcgtttccaagctggccgcccgtgcctcgcagctgccggccggggatccgcgcggccatgtcgtgctgggctcgctgatcagcagccaggcggccgacaagatggaggaactcatcgccgacgctgtcgccaagggcgccaagcttgtcgctggcggtaagcggacggggaccgtggtggaagcaacgctgctcgaccatgtgacgccggccatgcgcgtctatgccgaagaatccttcggcccggtcaagccggtgatccgggtgaaggatgaggacgaagccgtgcgcgtcgccaacgatacggaatacggcctgtcgtcagcggtgttcagccgcgacatcaaacgcgccatggcggtcgccgcgcgcatcgaggccggcatctgccacattaacggcccgaccgtcggcgacgaggcgcagatgccgttcggcggcgtcaagggctcgggctatggccgcttcggcggcaaggcctcgatcgccgaattcaccgatttgcgctgggtgacgatcgaggatcccggccagcactatccgttctag

SEQ ID NO: 35957 - DNA, 954 bp, Mesorhizobium loti
atgaagaaactggtttgtgccggcgagatcctggtcgagatcatggccgagcggatcggccagagtttccttgcccccggcccgctggtcggcccttttccatcaggcgcgccggcgatcttcatcgaccaggcggcacggctcggccagccggctggcctgatcgcggccgtcggtgacgatgatttcggccatttgaacatcgagcgcctgcgcgccgacggggccgacatctcggccatcaaggttcaccggggtgccgccacgggcacagctttcgtgacctatgagaccgatggcagccggcatttcgtctacaacatcaaacacagtgccgccggcctgatcgagatcggcgccgaagcgcgcgcgctgctcgccggggccgaccattttcacgtcatgggcacttcgctgttctcgccagaggtgatcgaggtcgcgcgcaaagggatcgagacggtcaaggcgcgcggcggcacggtgtcctttgatcccaacatccgcaaggagatgctcgatcttccaggcctgcgcgacgcactgcatttcgtgctgtcgaagaccgacgttttcctgccgagcgggccggaactgttcatcttcgccagggcgaccgacgaggagagcgcggtgcgcgaaatgctggaccgcggcatctccgccgtggtcatcaagaaaggcgcgcagggcgctgttcattacgacaagaccggacgcaccgcgtcacctggcttcgtcgtcgaggaaatcgatccgaccggcgccggcgactgctttgcggcggccttcgtctccttctggctgcgcggggcagcacccgaaaaggcgctgcgcatcgccaatggctgcggcgcgctggcggtgaccaggaagggaccgatggagggcatcgcctcgcttgccgcggtcgaggcctacgtcgcgaccgccagaaccggagcgccggcatga

SEQ ID NO: 35958 - DNA, 951 bp, Mesorhizobium loti
atgcccgccgtcccctcgatcctcggcttcggcgctattgcgatcgacgacatcgtctatgtcgatcagccgttgtcggcaggcaaggggagggttcggcaaagtgcccgggctttcgggggaaatgtcgcgacggcccttgccgccgtcgcgcggctcggcggaagcgccgggttcgtcggatggctgggcactgccgcggacgacccggtgctgtgcgatctcattgagagcggtgttgaaaccgcattcgcgccgcgccacgccgacgcgcgcccggtgcgctcacgtatcacggtcggctcggacggggagcggttcatcgcatatgacgacgacgcgatgctgggcaccacgccggatttctcagacgacatcctcaacagagcggccgtcctgatcgtcgacagttacgcgatccggtcgatggatgtcgtgactcgggctcgcgatctcggccttgcgatcctcggcgatatcgaatggagcggtggcccagccacggagaggctgatcgggctctgcgaccacctcattcttccacttggttttgcgcggaccgctacgggctgccgattgcccgccgagatgctcgaagctttgtggtcgccgtcgcggtccgccgtggttctgaccgatggcggcaggggcgtatattatcgcgggcgtgaagagacacggctctggcaacttccgccgcaccgggttgccgtcgtcgactcgaccggcgccggtgactgctttcacggcgcctacgcacatgcattgacgcgcggcgccgacaccgcaggccgggtggcattcgctgccgcggcggcggccctttcgataacggggcgtggcgggcgcgaggcgcttccgaccgaagaccaggtaacggaactgctggcatcggcgaacgcgccgtcggcggtcgaactgaaatatgcgcaactcgataccggaacatag

SEQ ID NO: 35959 - DNA, 1329 bp, Mesorhizobium loti
atgcacatcgcagaccaatcaggcgcggctgccgcgcagcgcaagcccctttatgcccaactctacgtgcaggtgctggtggcgatcaccgtcggcatcctgctcggccactactatccatcgatcggcgagagcatgaagccgctcggcgacgccttcatcaagctggtcaaaatgatcatcgcccccgtcatcttcctgacggtggcgaccggcatcgccggcatgagcgacctgcagaaggtcggccgcgtcgccggcaaggcgatgctctacttcctcaccttctcgacgctggcgctgatcatcggcctcgtcgtcgccaatgtcgtacaacccggcgccggcttcaacatcgacccggcaacactcgacgcctcgaccgtcaacacctatgctgccaaggcgcatgaccaatcggtcaccggattcctgatgaacatcatccccggcacgatcgtcggcgccttcgccgatggcgacatcttgcaggtgctgttcttctcggtgctgttcggcatcgcgctggcgctggtcggcgacaagggtgcaccagtgctcaacttcctgcaggcgctgatggcgccgatgttcaagctggtcagcgtcttgatgaaggccgcccccatcggtgcgttcggcgccatggccttcaccatcggcaaatacggcatcggctcggtcatcaacctcgccatgctggtcggcaccttctacgcgacgtcgctgctgttcgtgttcgtcgtcctgggcgcagtctgccgctacaacggcttttccatcctgtcgctgctgcgctacatcaaggaagagctgctcttggtgctgggcacctcctcgtcggaagccgccctgccctcgctgatggaaaagatggagaaggccggcgccaagcgctcggtggtcggcctggtcatcccgaccggctattccttcaacctcgacggcaccaacatctacatgacgcttgccgcgctgttcatcgcgcaggcgacgaacatccatctgtcgatgggcgaccagatcctgttgctgctggtggcgatgctctcgtccaagggtgccgccggcatcactggagccggcttcatcacccttgccgcgacgctttcggtggtgccttcggtgccggtcgccggcatggcgctgatcctcggcgtcgaccgcttcatgtcggaatgccgggcgctgaccaacttcatcggcaatgccgtcgccacgctggtcgtcgcgcgctgggaaggcgagctcgatgaggccaagctcgccagggctttggccggcacggccgacgacagcctgccggcggatatcgttcccgccgagtaa

SEQ ID NO: 35960 - DNA, 1746 bp, Mesorhizobium loti
atgacgttgctgtccgttcgcgatctgtgcgtcggcttcggccgcgatccgcacgccaatgaggtggtgcgcggcgtcagtttcgaccttgccgatggcgaaacgctggccattgttggtgagagtggttcaggcaaatccgtcaccgcgctgtcgatcaaccggctcatcgatttcggtggcggccgcatcactggcggagcgatgaagctgaagcgggccgacggcagcctcttcgacctgataagtgcgaccgaaccgcagctgaccggtattcgcggcgccgagatcggcatgatcttccaggagccgatgacctcgctgaacccggtgctgaccatcggcacgcagatcgaggaatcgtttcggctgcatcgcggactgaccggccggcaagccacggccgcagctaaggatgcgctcgatcgcgtgcgcattcccgatgccgcgcggcggctgaaatacacgccaaaccagctgtcgggcggcatgctgcaaagggtgatgatcgccattgcgctcgcctgcaatccgcgcctgctgatcgccgacgagccgaccaccgcgctcgacgtcaccgtgcaggcacagatcatggcgctgctggccgagttgaagcgcgaaacaggcatgtctgtcatcttcatcacccacgatatcggcctggttgccggcatcgccgacaaggtgctggtgatgcagaatgggcaagctgtcgaacagggcgagctgaaccatatcctcgacagaccgcggcacccctacacgcagcacctgctgcaggacgtgccgcatttcgccaggggaagcgcgacgcgcgcggacggacaacgcgacaaggacgagcgcatggaacccgccttgaaggttgagggcctggtggtgcggttccctctcaagagcaatttcttcagccgcgccaccggcgccgtgcatgccgtcgatggcgtcgacttcgacctgatgccgggtgagacgctggccatcgtcggcgaaagcggttcgggcaaatcgaccaccgctaaggcggtcctcgggctggtgcgctcgacgcgcggcagcttctcggtcggcgcacgagcggcttccgcggagcgcagcgccaagcccgtgcagatggtgttccagaatccctatgcctcgctcaatccaaggctgaccatcgaaagcatcctggccgagccggtgatcgccaacggcggccgggtgaatgcagaaacacgcgccaggatggcgggcctgctggagcgcgtcggcctgcccaggaatagcctggagcgctatccgcatgaattctccggcggccaacggcagaggctgtgcattgcccgcgcgctgatgctcaacccgtccgtggtagttctcgatgaagcagtgtcggcgctcgatgtctcggtgcaggccaaggtgctggagctgctggtcgagctgcaacgcgagttcggactggcctatctcttcatctcgcacgacatggcggtggtcgagcggatcgcgcaccgcatcgccgtcatctttgccggccagatcgtcgagatcggcgatgcggcctcggtgctgtcggagccgaagcattcctatacgaagaaactgatcgcagcggttccgaccatcgagcgacggcgcgagcatttcgaactggacacacgccaggtgccgtcgcttgtgcgcccgcagggtttcgagccagcgccggcgcaatgggagcagttcggcagcgatcatatggcgagggttgaggcatga

SEQ ID NO: 35961 - DNA, 1554 bp, Mesorhizobium loti
atgcgcgacatactgatcggcatcgacgccggcacctccgtcatcaaatccatcgccttcgacacgttgggccggcagattgccgccgccgccttgcccaaccactatgaaacgctgccgggcggcggcgccgaacaggatctggcgcgcacatggagcgatgccgccacgaccttgcgccagctagccgacaaagtgcccaatctcgccaaccggacggtggcgatcgcggtgaccgggcaaggcgacggcacctggctgatcgacgccaagggcgagccggtggccaagggctggctctggctcgatgcacgtgccgcggccgtcgtcgaggaaatccgcgcgcggcccgaggatcggctccgcttcgagaagaccggcagcgggctcgccgcctgccagcagggttcgcaattcgtcttcatgaagcgcaccatgcccgcaatgctcggcaaggcggcaacggcattccactgcaaggactggctctatttcaagctgaccggcgagcgcgccaccgatccgtcggagggcaccttcaccttcggcgatttccacacccgcgactacagcgacgaggtgctcgacgtgctcggcgtcgccgatctcaggcatctgctgccgccgatcgtcgacggcacaaggcacagcaccgctctgtcgcaggcagcggccgacgccaccgggatgctggccggcacgccggtcgtgctcggctatgtcgacgtcgtctgcaccgcgctcggcgccgggctgctggatcgccagcgcaagcccggctgctcgatcatcggctccaccggcatgcatatgcggctggccgagacaccggatgacgtgcagctgaacgacgcggcgaccggctatacgatggcgatgccggcgcccggcgtgttcgcgcagatgcagtccaacatggcggcgacgctcaacatcgattgggtgcttgggctcgcctcgggcattctcgcctcgcaaggcatttcgcgcagcaatggcgagatgatcgcgctggtcgatgcctggatcgcggccgcgcagccggcctcgctgctctatcagccctatgtgtcggaagccggtgagcgggggccgttcgtcgacgccaacgcccgagcggggttcgtcggcatttcctcgcggcacggttatgctgacctcgtccgcgccgtcttcgaagggttggccttcgcggcacgcgactgctacaccgccatggggccgctgccgcgcgaagtccgcctcaccggcggcgcggccagaagcccggcgctgcgcaagatcctgggtgcggcgctgggtgccgacatccgcaccagcgcgcgcgaggaggcgggcgcggcgggcgcggcgatgatcgccgcggtctgcgtgggtctctacccgtccatggatgcgtgcgtcggcgaatgggtgacgccgctgcttggtgaagccgagccgagcgaccggaacctcgccgcgatctacgacaagatgaccccgtcctacacgttggcgcaccaggcgttgcggccggtctggcgcgcgatggcttcagtgcaggcaaattga

SEQ ID NO: 35962 - DNA, 1518 bp, Mesorhizobium loti
atgaacggcggtcctgaaatcgtcgacctcttcgtcatcggtggcggcgtcaatggcgccggcattgcgcgcgacgccgccggccgcggactttccgtcatcctgtgcgaaaaggacgacctcgccgaaggcaccagctcgcgctcgggcaagctcgtccatggcggcctgcgctacctcgaatattacgagttccgcctggtgcgcgaggcgctgatcgagcgcgaggtgctgctagaatcggcgccgcacatcatctggccgatgcgcttcgtgctaccgcacagcccggacgaccgaccggcctggctggtgcggctcggcctgttcctctacgaccatctcggcggccgcaagcggctgccggcgactcgaacgctgaacctgcgcacggcgcccgagggcgcgccgatcaaggatgccttcaggcgcggcttcgaatattccgactgctgggtcgacgatgcccgcctcgtcgtcatcaatgcgctcgacgcggccgagcgcggcgccagggttttcacccgcaccgcctgcaccgccgcccgccgtgagagcggcctttgggttgtcgagatgcgggatggcaggacgggcatcaggacggtggttcgcgcccgcgcgctgatcaatgccggcggcccctgggtcaacgacatcgtcaaccgcgttgccggccagaactccacgcgcaatgtgcgcctggtcaagggcagccacatcgtcgtgccgaaattctgggaagggcggcaggcctatctcatccagaacagcgacaagcgtgtgatcttcatcaacccttatcagaacgatctcgccctgatcggcaccaccgacatcccctatgacggccggcccgaggacgtggcggcggatgagagcgagatcgattacctgatcgcggtggtcaaccgctatttcaagcgcggccttgcgcgcggcgatgtcgtctattccttctccggcgtcaggccgctctatgacgacaatgccgacaacccaagtgcggtgacccgcgactatattttcgagctcgacgcgccggacgcgcaggcgccgctgctttccgtcttcggcggcaagatcaccacgttccgaaaactggccgagcatgcgctggacaggatcgcgccgttctttccccatatgggcaagccctggaccgcgaaggcgcatctgcccggcggcgacatcgccaatgccgatttcgaacagtttctcggcgacctcggaggcgaatatccctggatgccggcatcgctactgaagcactacggcaggctctacggcaccaggacgcgggccttggttggcccggcgcgttcgctcgatgaactcgggcgctgcttcggcaaggatttcttcgagcgcgaggccaattatctcttcgaccgggaatgggcggcgacatcagccgatattctcgagcggcgcaccaagcacggcctgcatctgtccgccgaggagagggcggccttcgagcattggtgcgcgaaccggctggcgagggcaggctga

SEQ ID NO: 35963 - DNA, 1065 bp, Mesorhizobium loti
ttggctcgcatcacactgagacaattgctcgatcacgccgccgaatacggctatggcgtgccggccttcaacatgaacaacatggaacaaggcctcgccatcatggaggcggcggaagagaccaaatcgcctgtcatcctgcaggcaagccgcggtgcgcgtgcctatgccaatgacgtggtgctggccaagctgatcgacgcgctggtcgaaatccaccccgacatcccggtctgcatgcatctcgaccatggcaacaacgaagccacctgcgtcaccgcgatccagtacggcttcacctcggtgatgatggacggctcgctcaaggaagacggcaagtcgccggccgactacgcctacaattcgggcatcaccaagcgcgtcgtcgacatggcgcattggggcggcgtgtctgtcgaaggcgagatcggtgtgctgggatcgctggagagcggcggcggcgagcaggaagacggtcacggcgtcgaaggcgcgatcagccacgaccagctcttgaccgatccggaacaggcggtggagttcgtcaaggacacgcatgtcgatgcgttggccgtggccatgggcaccagccatggcgcctacaaattctcgcgcaagccggacggcgcggtgctggcgatgaacgtcatcgaggagatccacaggcgcctgcccaacatgcatctggtcatgcacggctcgtcctcggtgccggaggatctgcaggagatcatcaacaaatatggtggccagatgaagccgacctggggcgtgccggtggaggagatccagcgcggcatcaagcatggcgtgcgcaagatcaacatcgacaccgacaaccgcatggcgctgaccggcgcgatccgcaaagtgctgaccgagaacccgagcgagttcgacccgcgcaaatatctgacgccggcaatggctgcgatgcgcaagctctgcaaggagcgcttcgagcaattcggcaccgccggcaacgcaccgaagatcaagccgctgccggtctcggaaatggccaagcgctacaagtcgggcagcctcgacccgaaattcggctga

SEQ ID NO: 35964 - DNA, 765 bp, Mesorhizobium loti
gtgcgcgtggtctactgggtcggtacaagctggaagatgaacaagacgctcgccgaggcactggatttcgcggagcgcctggcaggcttcattcccggtttcgatgaccgcatccagcccttcgtcatcccacctttcacggcggtgcgcgaggtcaagcgggcgctgtcgtcgacgcgcatcaaggtcggtgcgcagaacatgcattgggccgatgccggcgcctggaccggcgagatttcgccaccgatgctgagggattgcgggctcgatctggtcgaactcggccacagcgaacggcgcgagcattttggcgagaccgatcgcaccgtcggcctgaaaacggctgccgccgtgaagcacgggatgataccgctgatctgtgtcggcgagacgctggccgagcgcgaaagtgggcaggccgatgccgtgctgagcgcccaggtcgagggcgcgctgcagttcctcgaaggcgaggcgaagaccgcgaaaatcctgttcgcctacgagccggtctgggcgatcggcgacaagggcattccggccagcgccgactatgccgacaagcagcaggcattgatcaagacagtggccggcgccctgctgccgtcggtgccgccggtgctttatggcggcagcgtcaatcccggcaatgccgccgagctggtcggccagcccaatatagacggcctcttcatcggccgttccgcctggcaggcggacggctacatcgacattctcggccgcgcctcggcggcgatctga

SEQ ID NO: 35965 - DNA, 1014 bp, Mesorhizobium loti
atgccggtgcagaccaagaagatcatcaatgacggcaaccgcgccgtcgacgaaatgctcgaagggatcctcgccgcgcatcctcgccacctcaggagcgcggacggcagcccgcgctcgatcatcgcccgtgacgggccgcggcccggcaaggtcgggctggtgatcggcggcggctcaggtcatgagccgaccttcctcggctttgtcggcaagggactggcggatgcggcggccatcggcaacgtcttcgcctcgccgccgcccgatccgatcctcgaatgcgccaaggcagtcagcggcggcgccggcgtcttgttcatgtacggcaactatgccggcgacgtgatgaatttcgacatggcggccgagatggcagcgatggacgacatcgaggtgcgcaccgtcctgaccaccgacgacgtcgcctcggcgctgcgcgaccagcggcagaagcgccgcggcgtcgccggcaatttcttcatcttcaaggcggccggtgccgcctgcgaccggatgctctcgctggacgaggtcgagcgcatcgcccggaaggccaacgaccacaccttcaccatgggcgtggcgctgtcgccctgctcgctgccgcagacaaggcggccgaatttcgagatcggcgcgggcgagatggagatcggcatgggcatccatggcgaacccggcatcgcccgcggcaagctcgggagcgccgacgcgatcaccgacgagatgctggacaagatcctcgccgagatggcgccgacgcgcggcgacaaggtcgcggtgctggtcaactcgctcggctcgacgccgctgatggagctctacatcatgaaccggcgggtcaagcagcggctcgacgacatcggcgtcaccatccacgcgacctgggtcggcaattactgcacgtcgttggaaatggccggcgcctcggtgacgctgtttcatctcgacgaggaattgcagaccatgctcgaccatccctgcgactgcgccatgttccgtgccggctga

SEQ ID NO: 35966 - DNA, 1641 bp, Mesorhizobium loti
atggccaattcttacgaacaggatctcgacaggaacgcggccaaccaccagccgctgacgccgctcacctatctggagcgcgcggcaaagacctatcccgaccacatcgccatcatccacggccgccagcgcatcagctaccgcgatttctggcgccgctcgctgaaggtcgcatcggcactgcaaaagcgcggcatcggcaagggcgacacggtcaccgtgatgctgtccaacacgccgccgatgctggaggcgcatttcggtgtgccgatgaccaaggcggtgctgcattcgctcaacacccgcctcgacgccgcggtcatcgccttccagctcgaccatgccgagaccaaggtgctcatcgtcgaccgcgaattctccggcgtcgtccggcaggcgctcgatctggccaaggtcacgccgctggtcatcgactatgacgatcccgactacgccgccgacgccccctatccgaagggggaacggattggcgcgctcgactatgaggactttgtcgccggtggcgacgaggatttcgcctggtcgatgcccgacgatgaatgggacgccatctcgctcaactacacctcgggcacgacgggcaatccgaagggcgtggtctaccaccatcgcggtgccgccctgatggcctacaccaacaccatccatgccggcatggccaagcacgccgtctatctctggacgcttccgatgttccactgcaatggctggtgctttccgtggacgctggccgtccaggccggcacccatgtctgcctgcgctgggtgcggccgaagccgatctatgacgccatcgccgatcatggcgtcacacatctctgcggcgcgccggtcgtcatgtcggtgctgatcaacgcccgggatgaggacaagcgcacgttcgcgcagacggtgaccttcaacaccgcggccgcgccgccgccggaagccgtgctgtcggggatggccgatgccggctttgccgtcacccatctctatggcctgaccgagacctatggcccggccgtggtcaacgaatggcatggcgaatgggacgatctcgcaaagggcgagcgcagcgccaagaaggcaaggcagggcgtgcgctatgccgcgctcgaaggcctgaccgtcatggaccccgagacgatgcaggcgacgccggccgacggcgagaccatcggcgaggtcatgttccgcggcaacatcgtcatgaagggctacctcaagaaccgcaaggccagcgacgaagcgttcgccggcggctggttccattccggtgatctcggcgtcatgcatcccgatggctacatccagctcaaggaccgttccaaggacatcatcatttcgggcggcgagaacatttcctcgatcgaggtcgaggatgcgctctacaagcacccgtccgtcgcctcctgcggcgttgtggcgcgccatgacgacaaatggggggaggtgccggttgcctatgtcgagctgaagcccggcaagacggcgagcgaggccgagatcatcgagcactgccgtgcgctgcttgcccgcttcaaagtgccgaaagcggtgatttttgccgagatcccgaagacctcgaccggcaagatccagaaattccgactccgcgaaatggccaaactcgcctga

SEQ ID NO: 35967 - DNA, 807 bp, Mesorhizobium loti
atggcgcagcgcataccttccctgaaacggggagggctatcgatggatcttttcaagctggacggcgatgtcgcgctggtcaccggtgccggcagcggcattggccaggcaatcgcaatcggattggctgaggcaggagccgacgtcgcgtgtttcggtcatgcatcgaaaggtgggctggaagaaaccgcgcagcaagtcacgacactcgggcgcaaggctttggtgctgaccggcacggtcacctcgcagagcgatctggcggcggcaatcgatcgcgtcgaggccgaactcggtgcattgaccgtcgccgtcaacaatgccggcatcgccggttccgaaccggccgagaccttgtcgctcgagaaatggcagaaggtgcacgaggtcaacgtcgccggcgtgttcctgtcctgccaggccgaagcccgcaagatgctggcgcgccgcaagggctcgatcatcaacatcgcctcgatgtccggcaccatcgtcaatcgcggattgacgcaggcgcactacaactcctcgaaggccgccgtcatccacatgtcgaagagcctcgccatggaatgggccgatcgcggactgcgcgtcaatgtcgtcagccccggctacacgctgacgccgatgaacaagcggccggaggtggcggaggagatcaagatcttcaagcgcgacacgcctatgggacgcatggcagcgcctgaggaaatggtcgggccgacggtgttcctggccagccgtgcgtcgagcttcgtcaccggcctcgacctgatcgtcgatggcggctacgtctgctggtag

SEQ ID NO: 35968 - DNA, 759 bp, Mesorhizobium loti
gtgatgacgaacctttccggcaaagttgtgctcctgacgggcggtctgggttcgctcggccgcgcccaggctgccgcgcttgcccgggctggagcgcgcgtgcttctgcttgaccgaccggagaatgcggaagggcccggaatcgcagcggaattggccgcggcaaacaagggtacgatcgtctatgtcggttgcgacttgaaccagctggccgaagccgaggcagcggtcaaggcgctcgccgacaaagaaggcacgatcgacatcctgatcaacaacgcggcgctcatcatcaatcgtccgttcgaggaattctcacttggcgagtacgaggaccagatccgtgtgaattcgtcagccgccttcgcgctggcgcgcgcctgcgccccaggcatgaagaagaagggccagggcaggatcgtcaatttctgctctgtgacgctgaacggccgctgggacggctacgtgccctatgtggcttcgaagggagccatgctgggactcaccaagtcgctggcgcgggaattgggatcacacggcatcactgtgaatgcagtgtcgcccggcgccgtcgtttccgaggcagaggagcgcgtcttcggagaacgactcgaggaatacaatgactggatcctcgccaaccaatgcctgaagagacgcatcgagccgcagcatatcgccaatctcgtgctgttcctcgtctccccggcctcggacatgatcagcggtcagaacatcaacattgatggcggatggtag

SEQ ID NO: 35969 - DNA, 906 bp, Mesorhizobium loti
gtggacagaggagaaagacagccaggcttcgtgtttgatgcccaggatatcgtcggtgaaagcctgatttgggatgagaacaggaaggcactggtctgggtggacatcatcgggcaacgcatccaccagctcgatccggttactcgcgatcatcagagttggtcgacaccggacctcgcaacctcaattggcctgcgcagggacggtggcgcgatcgtcgggttgcgaaaggatgtggttctgtgggatttcgcagaagccttcaggacgatcgcgacgatcgaaccggacagccctgacacacggttgaatgagggcgtggtcgccccggacggctcattctgggtcggcaccatggaaaacaacatcggccccgacgatcgcccacgcgatatttcgcgagatgcggggcggatctatcgcgtcgacacagccggcattgtcgaggcgctcggtgccgatcgcttcggcatcaccaacacgatggtctggacggcggatgataccttcatcacggcggacacgatgaagaaccagatctttcgctatcactgggacagggtgcgatcgcgaataaccgacaggcgccctttcttctcggacttttcacgcggcctgccggacgggtcgtgcatggatgcggagggctatgtctggaactgtcgcgttgcggggggcggctgcctggtgcgcatttcacctgacggagttctggacaaagtggtggagctgccctgcagctggcccacgagctgtaccttcggcggcgagaatttcgatatcctcttcgtcacctcggcgcggtttaccatgagcgagagacatttgcgggcaaacccgcgggagggcgggttgttcgcggtgcgcgcaggcgttggaggcacaccgaccaaacggttcggatga

SEQ ID NO: 35970 - DNA, 888 bp, Mesorhizobium loti
gtggacaccgacatcggttcgcgcacctggcacgcgcatgccaagatcaatctggcgctgcacgtcaccggcaggcgtgctgacggctaccatctgatcgacagcctggcggtgttcacgcgcttcggcgacagggtcgagatcgccctcgccgacagcgacgatttcaccgtatccggccgttatgccccggcggttccgctcgacgccggcaatcttgtgctcaaggcgcgcgatgccttgcggcgggaggccggctccgggcgcaccccgccggtctcgataaagctggaaaagaacctgccgatcgcctccggcgttggcggcgggtcgagcgatgcagcggccgtgttgcgcggactggcacagacatgggccctggacatcgacgacgccgggctggcgcggatcggtctctcgcttggcgccgacgtgccgatgtgccttgcggcaaagccgctggtggcgcgcggcattggtgacgagctgtcgatggtaccggacttttcagcgctggggctggtcctggtcaatccaggcacgccggtctcgacggcggatgtcttcgcggccctgtcccgccgcgacaacgagcccctgccgccgctgccgcgcagcatcgatttccacagcctgcgcaactggctggaggtcacccgcaatgatctggagcctgcagcccttgcgctgcagcccgccataggcagggcgctatcatggctcaataaggccggatcgggattttcacgcatgtcgggatcgggcgcgacttgtttcggcctgttcgagaccggcaatgtcgccaagcgcgcggcggccgaaatccgcagccgccagcccgactggttcgtcgcggcgacgcgcagcatgtcatcagaggctgagtga

SEQ ID NO: 35971 - DNA, 1017 bp, Mesorhizobium loti
gtgggtgtcgttctcaacatcgaaaacgggaagcgggagcccgcctccatcaaggatctgatcgatctgacggcggccgatatgggacgcgtcaacgaattgatcctgtccaaggccggctccgacgtcgagatgattccggaggtcgccaaccatctgatctcgtccggcggcaagcggctcaggccgatgctgacgctcgccgccgcgcagatgttcggctatgccggcgaaggccacgtcaagctcgccacctcggtggaattcatgcacaccgcgacgctgctgcacgacgacgtcgtcgacgagagcggcatgcgccgcggcaagaagaccgcccgcatgatctggggcaaccaggcgagcgtgctggttggcgatttcctgcttggccaggccttccgtatgatggtcgatgtcggctcgctcgaagcgctcgacatcctgtcgagcgccgcctcgatcatcgccgagggcgaggtcatgcagctcgccgccgccaagaacctcgaaaccaccgaagacgagcacttcgccgtcatcaaggccaagaccgcagcacttttttcggcggccgccgaagttggaccggtcatcgcccaggcgacccgcaatgatcgcgcagcactgcgctcctacggcatgaatctcgggcttgccttccagctcatcgacgatgcgctggactatggcggcaccagcaaggatctgggcaagaatgtcggcgacgatttccgcgagggcaaggtgaccttgccggtcatcctcgcctatcggcgcggcaccaaggccgagcgcaccttctggaagcgcgccatcgaggacaatgtcgttgacgatgcgggcctggaaaaggcgatcggcctgatgacccggcacggcgccatcgccgacacgatcggccgtgcccggcatttcggcgagatcgcccgcgacgcgctcgcgccgctcgaagaaacgcgtcagaaatcggcgctgatcgacgtcatcgatttctgcatcagccgggtgaactga

SEQ ID NO: 35972 - DNA, 1431 bp, Mesorhizobium loti
atgaccgaaattttgcaaaaactcgatcccgctctcatcgaccgcttcgcggcgatcgtcggtgacaaatacgcgctgcgcgatgagcaggacatcgcgccctatctcatcgagcggcgcgggctctggcatggcgcaacatcgctggtgctgcggccgggcagtgtcgacgaggtcagccgcatcatgcggctggcgaccgagacgggaacgcccatcgtgccgcaaagcggcaacaccgggctggtcggtgcccaggtgcccgacaaatccggccgcgagatcatcctttcgctgtcgcggctgaaccgcatccgcgagatcgacatcctgtccaacaccgtgacggcggaggctggcgtcatcctgcagacgctgcaggaggcggccgacgccgccgaccggctgtttccgctgtcgctggcagcccagggctcctgccagatcggcggcaatctttcttccaacgccggcggcaccggtgtgctggcctacggcaatgcgcgtgaactctgtctcggcgtcgaggtggtactgccgacgggcgaggtcttcgacgatctgcgcaaattgaagaaggacaacaccggctacgatctgaaggacctgttcgtcggcgccgaaggcacgctgggaatcatcaccgccgctgtgctgaagctgttcccgaacccgaaggggcgtgaggtcgcattcgccggcctgtcgtcgcccgaggcggcgctatctttgttcagcctggcgatggaccgcgccggcgcttcgctcacggccttcgaactgatcggcaagagaccttacgatttcacgctcaagcatggtcaaggtgtcgtgcggccgctggccgatgattggccctggtatgtcttgatgcagatttcttccggccgctcggaagccgatggacgggcgctgatagaagaggtgctggcggatggtctccagcaaggcatcgttggcgatgcggtggtcgcggcaagcctcgcccagggcgacgctttctggaacttccgcgagacgctacccgaatgccagaagccggagggcgcctcgatcaagcacgatatttcggtgccgatcgcctcaatcccacgcttcatcgcagaggccgcaggcgcggtggcgtcagtcagtgccggcgcccgcgtggtctgcttcggccatatgggggatggcaatcttcattataacatctcgcggcccatcgatggcgacgatgaggcctttctcgccctctaccatcccatgaacaaagccgtgcacgatgtcgtgcgctccttccacggttcgatctcggccgagcacggcatcggccagttgaagcgcgacgaactgatcgccacggcgccgccgatggccattgatctgatgcgccgagtgaaggctgccttcgatccggccggcatcatgaatcccggtaaggttatctga

SEQ ID NO: 35973 - DNA, 1770 bp, Mesorhizobium loti
atgtatcgggcaccggtcgaggatatcgcgttcacgctgaagcatgttgcgggcatgaaatccgcccttgatgccggtaggttcggcgatctcggcgaggacctggtcgacgccgtccttggcgaggccggccgtttcgccaccgaggaggtggcaccgctctataagatcggcgacgaacacggtgcggtgctcagggatgccgccgtcaccatgccgcccggctggaaggagctttatcgccgctggatcgatggcggctggaacgcgctgtcggggcctgaagactatggcggccaggcgctgccgaccatgctgggcgtcgccgcgctcgaaatgtggaactcggccgccatggccttcggcatcggcccgacgctgaccatgggcgcggtcgaagcgctcgacaagcatgcctccgaagcgctcaaggcgaagtatctcgccaagctggtgtccggcgaatggatgggcacgatgaatctgaccgagccgcaggcgggctccgatctcgccgccttgcgcgcccgcgccgagcccgctggcgacggcacctaccgcatcttcggccagaagatcttcatcacctatggcgagcacgatttcaccgacaacatcatccatctggtgctggcgcggctgcccgacgcgccggccggcacgcgcggcatctcgctgttcctggtgccgaagtttttcgtcaacgacgatggctcgcttggcgcccgcaacgacgtcttctgttccggcctcgagcacaagctcggcatccatgcttcgccgacctgcactatgatttatggcgacggtttccggggcgccacgcccggcgccatcggctggctgatcggcgaggaaaacaagggcctcgcctgcatgttcaccatgatgaacaatgcccgcctcgccgtcggcatgcagggtgtcgcggtcgcggaagccgccacccagaaggcgatcgcctatgccaatgagcgccgccagggcaaggcggctgattacgccggcgccggcatggcgccgatcgtccatcaccctgacgtgcagcgcaatctcctgaccatgaaggcgctgacgcagacggcgcgggcgatcagctattcctgcgcccacgccatcgacatggcacgcgtctcggatggcgatcaggcggcgcattggcgcgaccgcgcgaacctgctcacgccgctggccaaggccttttcgaccgatgtcggcgtcgaagtcgcttcgctcggcgtgcaggtgcatggcggcatgggcttcatcgaggaaacgggtgccgcagccttctaccgcgatgcgcgcatcgcgccgatctacgagggcaccaacggcatccaggcgatcgatctggtcacccgcaagctgccgctcggcggcggcgagcatgtgcatggcttcatcggcgaactcgccggggccgccaatgccgtgcgcacctcgaacctgcaaggtttcggccgcaccgccgatgcgctcgacgcagcacttggcgacctgacgcaagcgacgcgcttcctgcagaaactgtcggccgacggccggatggaagaggcgctggcgggagcgacgccgtatctcaggctgatctcgcttgccgctggcggcgcctacctggcgcgcggcgctcttgccgatcaggatcgcatcgcgctgtgccgcttcttcgccgagaacttgctcggcgaggcacgcgccttgagggaacgcgtcatcgacggcgcggagagcctcgctgccgccggcaagacgttgatatcagcttga

SEQ ID NO: 35974 - DNA, 819 bp, Mesorhizobium loti
atggcgggtggacagggcctgatggccggcaagcgcggccttattcttggcatcgcgaacaacaggtcgattgcctacggcatcgccaaggcatgcgtcgaccatggcgccgagattgcgctgacctatcagggcgaggcgttcaagaagcgcgtcgagccgttggcggcggaactgggcgcctttgtcgccggccattgcgacgtcaccgattcggcgagcctcgacgaggttttcgccaatgtcgccaagcattggggcaagcttgatttcctcgtccatgccatcgccttctccgacaaggacgaactgaccggccgctatgtcgagacgacgcgcgacaacttcctgcgcaccatggacatttcggtgttttccttcaccaccatcgccaagcgtgccgaggcgctgatgaccgagggcggttcattgctcacgctgacctactacggcgccgagaaggtgatgccgcactacaacgtcatgggcgtcgccaaggccgcgctcgaagccagcgtgcgttatctcgccgtcgatctcggcggcaagaagatccgcgtcaacgccatatcggccggcccgatcaagacgctggcggcctcgggcatcggcgatttccgctacatactgaagtggaacgaatacaattcgccgctgaagcagacggtcacgcaggaggaggtcggcgattccggcgtctatttcctgtccgacctgtcgcgtggcgtcaccggtgaggtgcaccatgtcgattccggctatcacgtggtcggtatgaaggcggtcgacgcgcctgatatttcgacggtcaaggaataa

SEQ ID NO: 35975 - DNA, 588 bp, Mesorhizobium loti
atgtacccgctggtttatatcgtgcgccacggccagaccgcgtggaacgccgaggcccggcttcaggggcaggccgacaccgatctcaatgcccttggccgcgagcaggcgaccggaaacgggcgtcggctggccgaacttgtcggcgatcccggggatttcgatttcgtcgccagcccgatgcggcggacgcgcgaaacgatggaacgcatccgcgccgcgatgaagctcgatccgctcgcctatcgaaccgataccagactgattgaagtcaatttcggtgactggcagagctttacctttgccgagctggagacgcagtctcccggagccaagcggtcacgcgcacgggacaagtggaacttccagccgcccggcgacggtgcggagagctaccagatgctgctcgaacgggtgaaaccctgcttcgacgagatcgaccgcaagacggtctgcgtgacgcatggcggcgtcatgcgcaccctgttccgtttcgtgcttgatatggccgaggacgaggccgcgaacctggaaataccgcaggatcgcgtgctcaaacttgaaggccagagcctcgagtggctttag

SEQ ID NO: 35976 - DNA, 1116 bp, Mesorhizobium loti
atgtctcacaacacgttcggccaccttttccgcgtcaccacctggggcgaaagccatggcgcagcgcttggctgcgtggtcgacggctgcccgcccggcatccgcttcacgcgtgatgaaatccaggccgaactcgacaagcgccggccgggccagtcgcgcttcgtgacccagcgccgcgaacccgacgaggtgaaggtgctgtcgggtttcgtcctcgacgaggacggcgagacgatgatcaccaccggcacgccggtctcgatgctgatcgagaatgtcgaccagcgatcgaaggactatggcgagatcgcccgccagtaccggccgggccatgccgactacacctatgatgtcaaatacggcatccgcgactatcgcggcggcggccgctcctccgcccgcgagaccgcggccagggtcgccgccggcgcgctcgcccgtaaggtggtgcccggcatggtggtgcgcggagccctggtctcgatgggcgaaaaatcgatcgaccgcgccaattggaactggaatttcatcggcgacgcggagaatccgttcttcacgcccgatcccgcttcggttcccgtttttacgcagtatctcgacggtatccgcaaggcgggatcttcggtcggcgctgtgatcgagatcgtcgccgatggcgttccgccagggctcggcgcgccgatctatgccaagctcgaccaggacattgcgtcgggcctgatgtcgatcaacgccgtcaagggcgtcgagatcggcaatggtttcgaggccgcccgcatcaccggtgagcagaatgccgacgaaatgcgcatcggcaatgacggcaaaccggtgttcctctccaacaatgccggcggcatcctcggcggcatctcgaccggtcaggcgatcgtggcccgcttcgccgtcaagccgacctcgtcgatcctgacgccgcgaaagtcgatcgacaaggacggcaacgacgtcgaggtgatgaccaagggccgccatgatccctgtgtcggcatccgcgccgtgccgatcggcgaagcgatggttgcctgcgcgattgccgatcactatctgcggcataggggacagacggggaagggaataggcagtagggaatag

SEQ ID NO: 35977 - DNA, 1914 bp, Mesorhizobium loti
gtgaacgcaacgccgcatacgccgcttctcgacaaggtccgcatcccggcggatctgcgcgcgcttgacgagagcgagctgccgcaactggcgtccgagcttcgcctcgaactggtcgacgcggtgtcccgcaccggcggccatctcggcgccggcctcggcgtggtcgaactgacggtggcgctgcactacgtcttcaacacgccggacgaccggctgatctgggatgtcggccaccaggcctatccgcacaagatcctgaccggccgccgcgaccgcatccgcacattgcgccaggagggcggcctgtccggcttcacccgccgcgccgagagtgaatacgatcccttcggcgccgcccattcctcgacgtcgatatcggctggcctcggcatggccgccgctcgcgacctctccggcggccgcaacaatgtcatcgccgtcatcggcgacggcgccatgtcggccggcatggcctatgaggcgatgaacaatgccggtgcgctcgatgcccggctcatcgtcatcctcaacgataacgacatgtcgatcgcgccgcccaccggcgccatgagcgcctatctggcgcgcctcgcctcgggcaaggcctatgccggcctgcgcgatttcggcaagaagctgacatcctatctcggcaagcgcgccgatcgtgcgatcacaagagcggtcgagcatgcgcgcggctatgtcaccggcggcacgctgttcgaggagctcggtttctaccacatcggcccgatcgacggccacaatctcgagcatctgatcccggtgctgaagaatgtccgcgacaatggcgaaggcccggtgctgatccatgtcgtcacccagaagggcaagggctatgcgccggcggaggctgcggccgacaaataccacggcgtcaacaaattcgacgtcatcaccggcgcgcaggccaaggcgccggccaacgcaccggcctacaccaaggtgttcgccgaaagcctgattagagaagcccgcgaggacgaccggatcgtcgccgtcaccgccgccatgccgagtgggacggggctggatctgttcggcgaagtgttcccgtcacggaccttcgacgtcggcattgccgaacagcatgcggtgacctttgctgccggtctcgcgaccgaaggctacaagccgtttgcggcaatctattcgaccttcctgcagcgcgcctatgaccaggtcgtccatgatgtcgccatccagaaactgccggtgcgtttcccgatcgaccgcgccggcttcgtcggtgccgatggcgccacccattgcggtgctttcgacacaactttcctggcaagcctgccgggctttgtcgtgatggcggccgccgacgaagcggagttgcgccacatggtgcgcacggcggcagcctatgatgacggcccgatcgccttccgctatccgcgcggcaatggcgtcggcgtcgacatgccggagcgcggcgaggttctcgaactcggcaagggccgcgtcgttcgggaaggcagcaaggtggcgctgctgtccttcggcacgcgcttacaggattgcctgatcgctgctgaggaactcggcgcggcggggctttccaccaccgttgccgatgcccgctttgccaagccgctcgacgaggatctgatccggcggctcgcccgctcgcacgaggttctggtgacggtggaagagggcgccattggcggcttcgccagccatgtgctgcagttcctcgcccatgaaggactgctggaaagcggcttgaaggtgcgcccgctggtgctgcctgacgtgttcaccgatcacgccaagccggaaaaaatgtatgccgatgccgggctcgatgccgccggcatcgtgcgcaccgttttcaccgcgctcgatcatacggcccgcgcccagcgcgcctga

SEQ ID NO: 35978 - DNA, 1293 bp, Mesorhizobium loti
atgggtgttgaggtaagccgtctgtcgaacggcctgacagtcgccaccgaaacccttccaagtatcgaatcggttgccttgggtgcctgggtcaagtccggcgcccgcaatgagcgtgatgaagagcatggcatggcccacctgctcgagcacatggcgttcaagggcacgaagcggcggacggccttcgaaatcgcttcggaaatcgaggatgtcggtggcgagatcaatgccgccaccagtgtcgagaccacatcctactacgccagggtgctcagcgacgacgtgccgctggccgtcgacatcctcgccgacatcctgcaggagtccgaattcgacccgcaggagctcgagcgcgagcagcacgtcatcctgcaggagatcggcgccgcgcacgatacgccagacgatatcgtcttcgaccgtttcaccgagacggcctttcgccaccagaccatagggcgctcgatcctgggcacgccggacaccgtcaaatccttcacgtccaagcagctgcacgatttcatcgaacgccaatatggcgccgagcggatggtgatcgtggccgccggcgacatcaagcacgacaatttcgtgcgcgaggtggagaagcagctcggcggcttccgcagcaaggccgacagcaccatcccgcaatatgcgcagtatgtcggcggcgatttccgcgaggaccgcgacctgatggacgcgcagatcgtgctgggcttcgaaggccgcgcctaccacgtgcgcgacttctacgcctcgcaggtgctgtcgatgatcctcggcggcggcatgtcgtcgcgcctgttccaggaagtccgcgagaaacgcggcctgtgctactcggtctatgccttccactggggcttttccgacaccggcatcttcggcgtccacgccgcgaccggccagagcgacatcgccgaactcgtgcctgtcatcatcgacgagttgcagaaggccggcgagaacatcctgcaggaagagctcgaccgtgcgcgcgcccagtatcgcgccggactgatcatgtccgccgaaagcccggccagccgcgcctcgcagatcgcaaggcagctgcttttgttcggcaggccgatcgccaaggaggaattgatggagcgcctgtcggcgctgacggtggagcggctgaccgacctgtcgtcgcggatgttctcgaccaagccgacgcttaccgctgtcgggcccgtgggtacgctggcaccatatgaggcgatcctcgattcgcttccgggtacgcagaccacggcccgcaggctcgccgtctaa

SEQ ID NO: 35979 - DNA, 3459 bp, Mesorhizobium loti
atgaagttttcgcgccttcgcctcctcggtttcaagtccttcgtcgagcccggcgagttcgtcatcgaacgcggcctgacgggtattgtcgggccgaacggctgtggcaagtcgaaccttgtcgaggcgctgcgctgggtgatgggcgaaagctcctacaaaaacatgcgcgcgtccggcatggacgacgtcatcttttccggctcgggcacgcggcccgcccgcaacaccgccgaagtcacgcttttcctcgataacagtgatcgttcggcgcccgccgccttcaacgacgccgacgagttgcaggtgtcacgccgcatcgagcgcgaggccggctcgctctaccgcatcaacggcaaggaagcgcgcgccaaggatgtgcagcttctgttcgccgaccagtcgaccggcgcacgctcgccgtcgatggtcgggcagggccgcatcggcgaactgatccaggccaagccgcaggcgcgccgcgccctgctcgaagaggccgccggcatttccggcctgcacacccgtcgccacgaggcggaactgcggctgaaggcggccgaacagaatttggaacgcctggacgacgtcgtcggcgaactggaaagccagatcgaaagcctgaagcgccaagggcgccaggcctcgcgcttcaagaacctgtcggccgatatccgcaaggccgaagcgacattgctgcacctgcgctggacgctggccaagacgcaggaaggcgaggcgcgttctgcgctggctgttgccacggcgctggtcggcgaccgcgccgccgcgcagatgaacgcggccaaggagcagggcatcagcgctcatcgcctgcccgatctgcgcgacgcggaggctgccgctgccgccgccttccagcgcctgtcgatcgccaggtcgcagatcgaggaggaggccgggcgcatccgcaaccgccaggccgaaatcgagcgccgcttgcagcagttcgacggcgacatcgcccgcgaagagcggatggtgcgtgacaatgccgatgtcctcgaacgcctgcgcaccgaagaggccacgctgaattccgaaaacgctggtgcggctgagcgcgaggccaccacccgcgctgcgttcgaacaggcggcatcgacgctggcgcaaagcgaagccaggctcgcggcgctgaccgccgaacgggccgaggccgccgcttcgcgccaccagatcgaacggactttgcgcgaaaccgccgagcgccgcgaccgcttcgcccgtcagctcgccgaggtcgaccgcgaattgtcggatatcctctccaaggtcgccggcctgccggatccggccgaaaagcgcgttctggtcgaacaggccatggcgctcctggaagaatccgaggccgccgtggcgcaggccgagcagtcggtcatcgatgcccgcaccgctgaaagcggtgcccgcccaccgcttcaggacgccaaggccgagctggcgcggatcgagacggaagcgcgcacgttggccaagatcctcaatgccgccagtggcgatctcttcccttcggtactggagcagatcagcgtcgagcgcggcttcgagacggcgctgggcgccgcccttggcgaagacctcgatgtgccgcttgaccgcagcgcgcccgcgcattggggcgaaagccagatccagcccggcgacgcggccctgccggaaggcatcaagagcctggccagcgtggttcgcgctccggcgcagcttgcccgccgcctggcgcagatcggcattgtcgaggtcgcggacggccgccggctgcaggcgctgcttgcgcccggccagcgtctggtcagccgtgaaggcgcgctctggcgctgggacggcctgaccgccagcgccgacgctccgacggccgccgcacaaaggctggcgcagaagaaccggcttgccgaactcgatgccgaagcagtgcaggccacgctcgtcctacgccaggccgaggaggcgctggcacaggccgaacaagcgcttcgccaggcgagcgaggccgaacgcaacacacgccaggccggacgcgatgcccagcatcggctggacgccgcccgcactgcgctggccgaggccgaaaaggccggtggcgagctggcgagccggcgcgcggcactcgatgaggggcgcgcgcgcatcgtcgacagccatgaggaaacctcggctgctttcgtcgaggccgaaatgctactgcaggacgcgccggatctcggcgacctgcaattgcagcttgaacagtccacggccaatgtctcgcgtgaccgcgccgcgctcgccgatgcgcgggccgtccatgaagggctgcggcgcgaggcggaggcgcgtacgcgccggctcgatgccatcggcgccgagcgcagcaactggctggtccgcgccgaaaatgcctcgacgcagattgcctcgcttggcgaacgcaaggccgaggccgaggccgagcgcgagcggctggccgatgcgcccgatgaaatcgacgccaagcgtcgcgcgctactgtcgcagctcaccgaggccgagaccttgcgcaaggcggccgccgaccggctgcaggaagcggaaaacaggcaggccgaactggacaagctggccacatcagccatccagtcgctggccgaggcgcgcgagacccgtgtccgcgccgaggaaaggctgacggcggccgatgagcgccggctcgaggtcgaagcgcgcatccaggaaacgctgaacacgccgccgcatctggtcatccgccataccgggctggaagccgacgacccgatgccggagatggccgagatcgaacgccagctcgaccggctgaagatcgagcgcgaacggctcggcgccgtcaatctgcgcgccgaggaagaacagaaggagctttccgaccggctcgaagcgatcgttaccgagcgcgaggacatcatcgaggcgatccgcaagctccggcaggcgatccagagcctcaatcgcgaaggccgcgagcggcttctggccgcttttgacgtggtcaacagccacttccagcgtctgttctcgcatctgttcggcggcggtactgcggaattgcagctgatcgaatccgacgatccgctcgaggcaggcctcgaaatccttgcccgcccgcccggcaaaaagccgcagaccatgacgctgctgtccggcggcgagcaggcgctgacggcgatgtcgctgatcttcgccgtcttcctgaccaacccagcgccgatttgcgtgctcgacgaagtcgacgcgccgctcgacgatcacaatgtcgaacgtttctgcaatctcatggacgagatggccaagaccaccgagacgcgcttcgtcatcatcacccacaatccgatcaccatggcgcgcatggatcggttgttcggcgtcaccatggccgagcagggcgtcagtcagctcgtatcggtcgacctgcaggccgccgaggcgatgcgcgaggcgagctga

SEQ ID NO: 35980 - DNA, 2679 bp, Mesorhizobium loti
atgaccaaatgggttttcacctttggcgatggtgcggcggaaggccgtgccggcgacaagaatctgctgggcggcaagggcgccaacctggccgaaatgtgcagcctgggcctgccggtgccgccaggcttcaccatcaccaccgaggtctgcaatgcctactatgccaatggccgcgcctatccggcgggattggaagccgacgtcgcggtcgcgctcgatcacatcggccggctgactgaccgccggttcggcgatccgtcgaagctgctgctggtgtcggtgcgctccggagctcgcgcctcgatgccgggcatgatggacaccgtgctcaatcttggcctcaacgacgagacggtcgaggcgctggccaccgattccggtgatgcgcgctttgcctatgacagctaccgccgcttcatccagatgtattccgatgtcgtcatgggcctcgatcacgaggtgttcgaggaaatcctcgaagaccagaaggccagcctcggccatgagctcgacaccgaactgacggccatcgaatggcagggcgtgatcgcgctctacaaggccaaggtcgaggaagagctcggcaggccgttcccgcaggatccgcaggagcagctctggggcgctatcggcgcggtgttctcgagctggatgaacaaccgcgccatcacctaccggcgcctgcacgacatccccgaaagctggggcacggcggtcaacgtccaggccatggtgttcggcaatatgggcgagacctcggccaccggcgttgccttcacccgcaacccatcgaccggcgaaaagcagctctatggcgagttcctggtgaacgcacagggcgaggatgtcgtcgccggcatccgcacgccgcagaacatcaccgaggccgcccgcatcgccgccggctccgacaagccgtcgctgcagaagctgatgcccgatgccttccaatccttcgtcagcatctccgacagcctggaaaagcactatcgcgacatgcaggacctcgaattcaccatcgagcgcggcaagttgtggatgttgcagacccgctcgggcaagcgcaccgccaaggcggcgctcaagattgccgtggaaatggcaagggacggcctgatcacgaaggaggaagccgtcgctcgcatcgacccggcctcgctcgaccaattgctgcacccgaccatcgacccgaaggccgcgcgcgacgtcatcggcgtcggcctgccggcatcgcctggcgctgccactggcgagatcgtcttttcctccggcgatgccgaggatctcaaggcccagggccgcaaggcgatcctggtgcgcatcgagaccagcccggaggatatccacggcatgcatgcggccgagggcatcctgaccacgcgcggcgggatgaccagccatgccgccgtcgtcgcgcgcggcatgggcaagccttgcgtgtccggcgccggctcactgcgcgtcgactacaaggccggcacgctgctctcgatggggcagaccttccgcaagggcgacatcatcaccatcgacggcggcaacggccaggtgctgaagggcgccgtggcgatgctgcagcctgaactttccggcgattttgccgctatcatggaatgggcggacgcggtgcggcgcatgaaggtgcgcacaaacgccgaaaccccgctcgatgcccgcatggcacgctctttcggcgccgagggcatcggtctttgccgcaccgagcacatgttcttcgacggcgcccgcatcgtcgccatgcgcgagatgatcctggccgataccgaaaaggatcggcgcatcgcccttgccaagcttctgcccatgcagcgctcggatttcctggaattgttcgagatcatggcaggcctgccggtgacgatccgcctgctcgatccgccgttgcatgaattcctgcccaagaccgaggccgaaatcgccgaggtcgcggccgtcatggatgtatcgcccgacaagctcaggcagcgcaccgaggccttgcacgaattcaatccgatgcttggccatcgcggctgccggctggccgtctcctatcccgaaatcgccgagatgcaggcacgcgccattttcgaggccgccgtcgaggcaggccagaaggctggcgcgctggtcgtccccgaaatcatggtgccgctggtcggcctggtgaaggagctcgactatgtgaaggcgcgcatcgatgcggtcgccaagagcgtcatggaagagagcggcgtcaagatcgattatctcaccggtacgatgatcgaactgccgcgcgcggcgatccgtgcccatgtcatcgccgcaacagccgagttcttctccttcggtaccaacgacctcacccagaccacgttcggcatctcgcgcgacgatgcggcctcgttcctggagacctaccgccagaaaggcatcatcgagcaggatccattcgtctcgctcgacgtcgatggcgtcggcgaactggtgcgcatggccgcgcaaaagggcagggcgacacgccccgacatcaagctcggcatctgcggcgaacatggcggcgacccggcatcgatccgcttctgcgaggaggtcgggctcgactatgtctcgtgctcaccctatcgcgtgccgatcgccaggctggcggccgcgcaggccgcggtacaagtgtcaaaagcggggcgcgggtag

SEQ ID NO: 35981 - DNA, 1629 bp, Mesorhizobium loti
atgctggggctgatgcaggaatggccgctgctgtgccacaagcttatcgacaacgccgaacggcagcatggggtgcgcgagatcgtgtcgcgctcgatcgaggggccgatcgtgcggaccacctatgccgacatccatcgtcgttctctcaaggtcgcccagcggctggagcgggacggctatgggttgggcgaccgcatcgccacgctggcctggaacacggcgcgccacctcgaggcctggtacggcatcatgggcgtcggcgccatctatcacacgctcaatccgcgcctgtttcccgagcagatcgtctggatcatgaaccatgccgaggacaaggcggtcttcgtcgacctcacgttcattccgctgctggagaagatcgccggtgccgtcaaatcgctgaaaaaggtgatcgtgctgaccgacaaggcgcacatgccgcagacgaccttgcccaatgccgtcgcctatgaggagtggcttgacgaggtcgatggcgacttcgcctggaagactttcgacgaaggcaccgcagccggcatgtgctatacatcgggcaccacgggcgatcccaagggcgtcgtctacagccaccgctcgaacgtgctgcacgccatgatcgccgccatgcccgacgcgatgggcctgtcgtcgcgcgacacggtcctgccggttgtgccgatgttccatgccaatgcctggggcctcggccagagcggtccgatggtcggcgccaacctggtcatgcccggctgcaagatggacggcgcctcgatctatgaattgctcgacaccgagaaggtaaccttcagcgccgccgtgccgaccgtctggatgatgctgctgcaatatctggaggagaccggcaagaagcttccctatctcaacaaggtcgtcatcggcggctcgtcctgcccgcgcgcgatcatgacgaaattccaggacaattacgacgtccaggtcatccatgcctggggcatgaccgaaatgtcgccgctcggcacgttgtgcaccctgaagccggaatatgccggtctccagggcgaggcccggctcgatgtcaagcagaagcagggctacccgcccttcggcgttgaaatgaaggtgaccgatgacgagaacaatgcgcaaccctgggatggcaagacctttggccgcctgaaagtgcgtggtccggccgtcgcacgcgcttattacggcggcgccggggcggagcaattcgatgcggacggctggttcgataccggcgatgtcgctcacatcgacgccggcggctacatgcagatcacagatcgggccaaggacgtcatcaagtccggcggcgaatggatttcgaccatcgacctcgagaatctggccgtcggccacccggacgtggcggaagcggcggccatcggcgtccatcattcgaaatggggcgagcggcccttgctggttgtcgttgccaagccaggtaaggagccgaccaaggcggatattctcggtttcatggatggcaaggtggccaagtggtggatgcccgacgatgtcgctttcgtcggcgaaataccgcacaccgccaccggcaagatccagaagacaaccttgcgccagcagttcagggactaccgcttgccgacggattga

SEQ ID NO: 35982 - DNA, 882 bp, Mesorhizobium loti
ttgaaaggaattatccttgctggaggcagtggaacgcgtctttatccactgacattagcggtctctaagcaaatccttccgatatacgacaagccgatgatttattatccgctgagcgtactgatgctcgcgggaatccgcgagattctgattgtctcgacaccgcgtgatctgccggcttttcgtgatttactcggcgacggatcggagttcgggctggcgttctcctacgccgagcaaccgcatcccaatggtcttgcggaagctttcattatcggccgggatttcatcggcaaagatagcgtctcgatgatccttggcgacaacatctatttcggtgatggcctgtcgcagctttgccgcgccgccgctgcgcgcgacgcgggtgcttcggtgttcgcctatcatgtcgaggatcccgagcgctatggcgtcgtgtccttcgacaaggcaaccgggaccgcgctgacgattgaggaaaaaccgcagaaaccgaagtcgaactgggctgtcaccggtctctatttctacgacaatgaggtggtcgacatcgccccgacgatccgcccctcggcgcgtggcgagctcgagatcacggcggtcaacaatgtctatctcgagcgcggcaagctgcatgtgcaccgtttgggccgtggctatgcctggctcgacaccggcacgcatgacagtttgcacgaagcctcttctttcgtgcgcacgatcgaacatcgccagggtatcaaggttgcctgccctgaggagatcgccttcgagcagggctggctgacggcggagcaagtgctgcaacgcgcaacccggttgggcaaaaatgaatatgccgcctatctgcggcggcgcgtcgccgatctgttggagggctaa

SEQ ID NO: 35983 - DNA, 1938 bp, Mesorhizobium loti
atgcgtcacatcatggcaaaaagcctcgcccccaccgacagcgtccgcgactacctggccgcgcaggagaagaagtcgctgctgcgcttcctgacctgcggttcggtcgatgacggcaagtcgaccttgatcggccgcctcttgtccgacaccaagcagattttcgaggatcagcttgccgcgctcgaacgcgattcgcgcaagcatggcaccaccggcgatgacatcgatttcgcgttgctggtcgatggtctcgaggccgagcgcgagcaaggtatcaccatcgacgtcgcctaccgcttcttcgccacgccgaagcgcaagtttatcgtcgccgacacgcccggccacgagcaatacacccgcaacatggcgacaggcgcctcgaccgccgatctggcgatcgtgctgatcgacgcaaggcaaggggtgctgcgccagacaaggcgccattcgatcatcgcctcgctgctcggcatccggcacatcgtgctggccgtcaacaagatcgatctcgtcgatttcgaccaggcggtcttcgaccggatcgtcgaagactacggccaattctcgcgcgatctcggcttccagaccatcgtgccgatcccgatgtcggcccgttacggcgacaatgtcagcggccgctccgacaacatgcaatggtattccggcccgacgctgatcgagcacctcgagaccgtttcggttgaagaggctgccgtcgagcagccgttccgttttccggtgcagtacgtcaatcgccccaatctcgatttccgcggctttgccggtacgatcgcgtcgggcgccatcgcgcaaggcgacgaggtcgttgtcgccaaatccggcaagtcgtcgcatgtcaaacgcatcgtcgctcatggcggcgatctcaaacaggcggtggccggccaggccataacgctcgttcttgacgacgaggtcgaggtctccagaggcaatatgctggtgtcgccggccgctcgaccgcaagtcgccgatcaattcgccgccaacatcgtctggtttgacgagcatgcgctgctgccgggccgctcctatatcctgcgcaccgaaaccgaccagaccagcgccaccgtcaccgacctgaaataccgcatcaacgtcaacgacttcgcccatgaggcggccaagtcgcttgaaatgaatgaagtcggcatctgcaacgtctcgacgcgggcgccgatcgctttcgatcccttcgccgagaaccgcaccaccggcgccttcatcctgatcgaccgcatctcgaacgccaccgtcggcgcgggcatgatcgtgcactcgctgcgtcgtgccgagaacatccactggcaatcgctcgatgtcggcaagcgcgtgcgcgccgacatgaagaaccagcggcccgccgtgttctggttcaccgggctttcaggctccggcaagtcgaccatcgccaacttgttcgagaagaagctgttcgccaccggccgccacacctatattctggacggcgacaatgtccgtcacggtctcaaccgcgatctcggcttcaccgatgctgaccgcgtcgagaacatccgccgggtcgccgaagtggcaaagctgatggccgatgccgggttgatcgtcattgtctcgttcatttcgccgttcagcgccgaacggcgcatggcgcgcgaattgatggccgatggcgagttcatcgaggtgtttgtcgacacgcccttcgaggagtgcgccaggcgtgatccaaaaggtctctacgcgcgcgcgctgaatggcgagatcaagaacttcaccggtgtcgattcgccttaccaagcgccggaacacccggagatccatctgaagacgctcggcaaatcggcggaagagatggtagatgccctggaacattggctgaatgagcgcgacattgccgaagaccaatatgaaagcggcggcggcatctga

SEQ ID NO: 35984 - DNA, 924 bp, Mesorhizobium loti
atgatcctctgctgcggcgaagccctgatcgacatgctgccgcgcatcacgacgcagggtgagccggcctttgccccctatgtcggcggcgcggtgttcaacacggcgatcgcgctgggccgattgggcgcgccggccggcttcttttcgggcctgtcgtcggatctcttcggcggccagttcagggacgcgctcggagcgagcaaggtcagctccacctatgcgcacacctcgcccaggccgaccacgctcgccttcgtacggctcaccaacggccaggcgacctacaccttctacgacgagaataccgcgggacgcatgctgaccatcgacgacctgccgtcgctcggcaatgagatcgaggccatgctgttcggcgccatcagcctgatctcggagccggccggcggcgcctatgaagagttcatgcggcgtgagcacgcaagccgcgtcatgatgctcgaccccaacatcaggccgaacttcatcccggacaaggccaagcacctcaggcgcatccgcgagatgatggcgatggccgacatcgtgaaactgtcggacgaagacctccattggttcggcgaagccggctcgcatgaggatgtcatccgcaactggctcgaccgcggccccaagctgatcgtggtcacccatggcagcgaaggcgccgtcggctacaccaaggaccacaccgtcaccgtgatgccggaaaaggtcgaggtggtcgacacggtcggcgcaggcgatacattcaacgccggcatcctcgcctcgctgcatgaacagggcctgttgacgaaggcggccatcggcggccttccgcaagacgccattcgcaaggcattggcgcttggtgccaaggcagcggcggtgaccgtgtcgcgcgcgggcgccaatccgccgtggcggcatgaaatcgcctga

SEQ ID NO: 35985 - DNA, 2517 bp, Mesorhizobium loti
atgaatggtgaaagccggtatgatcgtggcaaccgcacgagaggcagcatgacgcgagcgatgacatccgaaacccttccgcccctgctcgaaaatcctgatccgaagacgctcgcaagggaagtcttggtggtcctcaaataccgggtcggcaaggacaccaccgttgcgacccagtacgactggctgacggcctcgatcaaggtcgtgcgtgaccgcatcgtcgatcgctggatgcaggcaaccaaagaggcttatgatcagcaggaaaagcgcgtctactatctgtcgctggagttcctcatcggccgcctgatgcgcgacgccttctccaatcttggcctgatggacaatatgcgcgaggcgctgtcgtcgctcggcgtcgacctcgatctcatcgcggcgctggaacccgacgccgcgcttggcaatggcggccttggccggcttgccgcctgcttcatggaaagcatggcgaccgtcgacatccccgcgcatggctatggcatccgctacgctaacggcatgttccgccaggaaatccacgacggctggcaggtcgaactgcccgagacctggctcgatcacggcaacccctgggagtttgaacggcgcgaacgctccttcgaagtcggcttcggcggttcggtggagtccatcacgtcaaaggacggccggctcgagcgccacgtctggaagccgaccgaacacgtcctggctgtcgcctacgacacgcctgtcgtcggctggcggggcaaccgcgtcaacacgctgcggctgtggtcgggcatgccggtcgacccgatcctgctcgacaagttcaatgccggcgaccacatcggcgcgctcgccgaaagcaacaaggcggacgcgctgtcacgcgtgctttaccccgccgattcccacatggccgggcaggaactcaggctgcgacaggaatatttcttctcaaccgcctcgctgcaggacatcgtgcagcgccatctcagccagtatggcgacctgaagtcgctgcccgacaaggcggcgatccacttgaacgacacccacccggcgatcgccgtgccggagctgatgcggctgttgatggatgtccacggcatggacttcgacctcgcctgggacatcaccaagcgcaccttcggctacaccaaccacacgcttcttcccgaagcgctggaaagctggccggtgccgctgttcgagcggcttttgccgcgccatatgcagatcgtctacgccatcaacgcgcaggtgcttctggaggcacgcgccaccgaccagttctcgggcgagcagatcagccatatttcgctgatccaggaaaatggcgaccgccgcgtgcgcatgggcaatctggcctttgtcggctcgcactcgatcaatggtgtgtcggcgctgcataccgagctgatgaaggaaacggtgttcgccgacctgcacaagctctatcccgatcgcatcaacaacaagaccaacggcatcacgccgcggcgctggctgatccagtgcaaccccggcctgacctcgctcgcccgcgaggcgatcggtgaccgttttctcgatgacatcgacgccatcaaagggctcgacagctttgccgacgacagcgcgttccgggagaagttcgcgggcgtcaagcgccagaacaaggcgcggctggccaatctcgtcgccgaccggcttggcatcaaggtcgacccgtcggcgctgttcgacatccaggtcaagcgcatccacgaatacaagcgccagcttctgaacatcctcgaggcgatcgcgctctacgaccagatccgctcgcatcccgagcgcgactggatgccgcgcgtgaaattctttggcggcaaggcggcgcccagctaccacaacgccaagctgatcatcaaactcgccaatgatgtcgccagggtcatcaaccgtgacccggcggtgcgcggcttgctgaaggtggtgttcgtgccgaactacaatgtcagcctggctgaggtcatgatgccggccgccgacctgtcggagcagatatcgaccgccggcatggaagcgtcgggcaccggcaacatgaagttcgcgctcaacggcgcgctgaccatcggcacgctcgacggcgccaatgtcgagatcaaggagtgcgtcggcgacgacaacatcttcatcttcggcctgaccacggccgaggtcgccgaacggcgcaacaatggctacaacccgcgcgccgtgatcgagggctcgcccgaactgtcgcaggcggtcgcggccgtttcctcgggcgtcttttcgccagacgacccggaccgttaccgcgacctcatcaacggcctctacgacagcgactggttcatggtcgccgctgatttcgatgactactccgccgcccagcgtgatgtcgacgctgtctggcgcaacagcccggactggtatgccagggcaatccgcaatgtcgcgcgcgtcggctggttctcgtccgatcgcaccatccgccaatacgcgaaagaaatctggaacgtgcctgcctga

SEQ ID NO: 35986 - DNA, 2214 bp, Mesorhizobium loti
atgaggaagccgcgcgtgaccgctgcgacaagcgggccggacggactggcgccagccagcgatgttgcggcgattgtcgccggtacgcacggagatccgttcgcggtcctcggtgtccatgaggtcggcaaaggcctgtttgcccgttgtttcgttccgcatgccgagactgtcactgcctatacgctgacgggcatcgaggccggtgcgttgtccaggcgagacgatgctggcttcttcgaaggcaagctgtcgatcaagaagcggcagccgctgcgctatcacgcgcacaatgccggcggcgactggtggctgaccgatccttattcgttcggcccggtgctcgggccgatggacgattactatatcgccgaaggttcgcatctcaggctgttcgacaagcttggcgcgcatgtcatcgagcacgaaggcgccaccggcgtgcatttcgccgtctgggctcccaacgcaaaacgcgtctcggtggttggcgatttcaacgactgggatggccgccgccacacgatgcgcgatcgccgcgacaccggcatctgggaggtgttcatccccgacatcggtgccgggcgaccctacaaatacgagatcatcggacccgatggcgtcaggctgccgctgaaggccgatccgtttgcgttcaaatccgaattgcgtcctgccacggcttcagtggtcgccgtgccgccggcgcatgactggggcgacgaggcgcatcgcaactactggcgcaatgccgatccccggcgcgaagccgtctcgatctacgaagtccatgccgggtcatggcaacttcacgacgacggcacgttcctgtcatgggacgagctggccgaccggctgatcccctatgtcgtcgagaccggcttcacccacatcgagttcatgccgatctccgagcatccctatgatccgtcctggggctatcagaccaccggcctctatgcgccgtcggcccgcttcggcgatcctgacggctttgcccgtttcgttgatggcgcgcaccgcgccggcgtcggcgtcatcctcgattgggtgccggcgcatttcccggtcgatgcgcacggcctggcccatttcgacggcaccgcgctctacgaacatgccgatccgcgcaagggttttcaccccgactggaacaccgcgatctacaatttcgggcgccgcgaggtggtctcgttcctggtcaacaatgcgctgttctgggccgaaaaatatcatgtcgacggtttgcgcgtcgatgcggtcgcctcgatgctctacctcgactattcgcgcaaggccggcgagtggatccccaacgagaagggcggccgcgagaacctcgaggcggtctctttcctgcagaagatgaacaaggaggtctacggccaccatccaggcgtcatgaccatcgccgaggaatcgacctcctggccgaaggtttcggcgccggtgcacgaaggcgggctgggcttcggcttcaagtggaacatgggcttcatgcatgacacgctggagtatttctccaaggagccgattttccgcaagcaccaccacaacgacctgaccttcggcctgacctacgccttctcggagaatttcgtgctgccgctctcgcatgacgaggtcgtgcacggcaaaggcacgctgctgagcaagatggccggcgacgactggcagaaattcgcaaccttgcgcgcctattacggcttcatgtggggctatcccggcaagaagctcttgttcatgggacaggaattcgcgcagcgccgtgaatggagcgaggcgcgtgctcttgactggaacctgctcgatttccgcccgcatcgcggcgtctggcagacggtgcgcgatctcaactatctctaccgctcgcgcccggcgctgcacggccgcgactgcgagccggaaggattttcctggctgatcgtcgatgacagccagaattcagttttcgcctgggtgcgcaacgcgccgggcggcagcccggtggccgttatctccaacttcacgccggtgccacgcgacaattatcgcgtgccgctgccgaaggctggcaagtggcgcgagatcatcaacaccgacgcatccgaatatggcggctccggcatgggcaatggcggcatggtcgaggcaagggcggaaggcaagaacatctctgcaacgatgcttctgccgccgctgtcgacaatcatgctcgaactcgttgccgactga

SEQ ID NO: 35987 - DNA, 1266 bp, Mesorhizobium loti
atggcagacttgaaacggacccagccgctggcgcgcgatgccatggcctatgtactggccggcggccgcggcagccgcctcaaggaactgaccgaccgtcgcgccaagccggcggtctatttcggcggcaagacgcgcatcatcgacttcgcgctctccaatgcgctcaactccggcattcgccgcctcggcgtcgccacgcagtacaaggcgcattcgctgatccgccacctgcagcgcggctggaacttcctgcggcccgaacgaaacgaaagcttcgacatcctgccggccagccagcgcgtctctgaaacgcaatggtatgaaggcactgccgacgccgtctaccagaacatcgacatcatcgaggcctacggccccgaatacatggtcatcctcgccggcgaccacatctacaagatggactacgagatgatgctgcgtcagcatgtcgacgccaatgccgacgtgaccgtcggctgcctcgaagtgccgcgcatggaagcgacaggcttcggcgtcatgcatgtcgatgccaaggacaacatcatcgccttcgtcgaaaagcccgccgatccgccgggcattccgggcaatccggacttcgccctggcgtcgatgggcatctacgtcttcaagaccaagttcctgatggagcagttgcgccgcgacgccgccgagccgggctcaagccgcgatttcggcaaggacatcatcccctacatcgtccagcacggtaaggcgattgcgcaccgtttcaccaaatcctgcgtgcgctcgaccgccgagaacgaagcctactggcgcgatgtcggaacggtcgacgcctattgggaagccaatatcgacctgactgatatcacgcccgagctcgacctctacgaccgcgactggccgatctggacctatgccgagttgaagccgccggcaaaattcgtccatgacgaggatggccggcgcggctcggccgtttcctcgctggtctcaggggattgcatcgtctcgggcgcgacactgaagaagagcctgatcttcactggcgcgcgcatcaattcctattcgacgctggaagaggtggtcatgctgcccgacgttcatgtcggccggaacgcaaagttgaagcgcgtcgtcatcgaccatggtgttaggataccggaggggctggtggtcggcgaggatcccgcgctcgacgcaaagcgcttccgcgtttcggagaagggcatctgcctgatcacacaggacatgatcaacaaactcgggctctag

SEQ ID NO: 35988 - DNA, 1446 bp, Mesorhizobium loti
atgcaggttctgtcggtcacgcccgagatcttcccgctgatcaagaccggcgggcttgccgacgtgaccggtgcgctgcccgtcgcgctggcagccaagggcgtgaccatgcgcacgctcattccaggctttcccgcggtgatggaaggcttcaagaaaaggaaggctgtttaccaatacccgctgctccagggtggcaaggcttcgatccatgctgtccagatcgcagggctcgatcttttcgtgctcgacgcgccgcatctcttcgaccgtcccggcggtccctacggcaatgcttcgggcgccgactggccggacaattggcggcgttttgcggcactgagccaggccggcgccgatatcgccggcggcgccatctcgggctacttgcccgagatcgtccatgcccatgactggcagtcggcgatgacgctggcctatatgcgctacggcaaggcggtcggcacgccgtcgatgatgacggtccacaatctcgccttccagggccagttcggcgcaggcatcttcggcgagctcggcctgccggcggtggcgatggcgcttgacggtgtcgaatattatggcggagtcggcttcctcaaggccggcctgcaggccgcctgggcgatcaccacggtcagcccgacctatgcgcaggaaatccgctcgccggaattcggcatgggcctcgacggcctgatcaacatgcgctccagcgatctctacggcatcgtcaacggcatcgacaccgccatctgggatccggagacggacaagcatctggtatcgaactatacggccaccacgctcaaggcgcgggcgccgaacagggcggccgtggaggaacgcttcggcctcgaccgcgacgacagcccgattgtctgcgtcatcagccggctgacctggcagaagggcatggacatattggcgacggtgatcgacggcatcgtcgcgaccggcgcgcggctggccatattgggctcgggcgacgccggcctcgaaggcgcgctgcttgccgcagccgcacgccaccgtggccgcatcggcgtggtcatcggctatgacgaagggttgtcgcacaccatgcagggcggctgcgacgccatcatcatcccgtcgcgcttcgaaccctgcggattgacgcagctctacggcctccgctacggctgcgtgccggtggtcgcccggaccggcggcctagccgacaccatcatcgacgccaacgaagcggcgatggcggccggcgtggccacagggctccagttcgctcccaacaatggcggcgcgatgctgcacgccatccgccgcctggtcgatgcctacgccgaccccgcggccttcgagaccatccagcgccagggcatgaaggccgatgtgtcatgggacaagagcgcggaaaaatatcttgaactctatcgcctgctgctttcgaaaagggttgcctga

SEQ ID NO: 35989 - DNA, 1629 bp, Mesorhizobium loti
atgatacgaaccgtccccaccaagccctattcagaccagaagcccggcacgtcgggcctgcgcaagaaggtgcccgtgttccagcaggagcactatgccgagaacttcatccagtcgatcttcgatgcactggacggtttccagggcaagacgctggtgatcggcggcgacggccgcttctacaaccgcgaggtcatccagaaggcgatcgccatggcggccgccaacggcttcggcaaggtgatggtcgggcagggcggcatattgtcgacgccggccgcctcgcatgtcatccgcaaatacaagaccttcggcggcatcatcctgtcggccagccacaatcccggcggcccgcatgaggatttcggcatcaagtacaatgccggcaatggcggcccggccccggaaaagctgaccgacgcgatcttcgccaagaccaaggcgatatcgagcttcaagacatcagacatcgatacgatcgacatcgatacgatcggcaccgtcaaggccgccggcatgacggtcgagatcatcgatccggtcgccgattatgccgagctgatggaaagcctgttcgatttcgacgcgctgcgcagactgttcaaatcgggcttccgcatgcgcttcgacgccatgcatgcggtgaccggtccctatgccaaggaaattctcgagaaccggcttggcgcgcccagcggcacctgccgcaacttcaagccgctgccggatttcggcggccatcatccggacccgaacctggtgcacgccaagcatctctatgacgagatgatggggccggacgcgccggattttggtgccgcctccgacggtgacggcgaccgcaatttgatcatcggcaagggcattttcgtcaccccctcggattcggtggcgatgcttgccgccaatgcccgcctggcgcccggctacaaggacgggctgaagggcatcgcccgttcgatgccgaccagtggcgccgccgaccgcgtcgccgaaaagctcggcatcggcatctacgagacgccgaccggctggaagttcttcggcaatctgctcgatgccggcatggcgacgatctgcggcgaggagagcgccggcaccggctccaaccatgtgcgcgaaaaggacggcctgtgggcggtgctgttgtggctcaacatcctcgccgcgcgcggcgagagctgcaagcaggtcgtcaccgagcactgggcggcctacgggcgcaactactattcgcgccacgactatgaggaggtcgagagcgaccgcgccaacgcgctggtcgacgaactcagggccaagctcggttcgctgcccggcaccagcgtgcgcggcttgaagatcgccaaggccgacgatttcgcctatcacgacccggtcgatggctcgaccagcgagcaccagggcatcaggatcctgttcgaaggcggctcgcgcgtcgtcttccggctttccggaaccggcacgtccggcgcgacgctgcgcgtctacatcgagcgctacgagccggacaaggccaggcacgatctcgacacgcaggcagcccttgccgacctcatcgctgccgctgacgacatcgccgggatcaaaagccacaccggccgcaacaagccgagcgtgattacttga

SEQ ID NO: 35990 - DNA, 2019 bp, Mesorhizobium loti
atgaccccgctcggcgcaaccgtcacccccgaaggcatccgctttgccgtgtggtcctcatcggcccgccgcctctgggtctcgctcttcgatgggcagggaaaccgcgaactcgaccggttggagttgcagtcggaaggcgaggggatgcatgcgctcttcgttccccgccttgccgcgggcacgcggtatggctttcgcgccgatggcgactacgcgcccgaccgcgggttgtggttcgacccggacaagctgctcaccgatccctacgccgtcgaaatcgaccgcccgtatgcctatcactggcggctcgccgcgcggcgcaatgagggggccgacaccgcgccgctgatgcccaagacggtggcgaaaaccttgcccaaaacggtgcctgcgctgccgccgctgtttcgtccgggcggcctgatctacgaggtaccggtgcgtgccttcaccaagttgcatcccgacattcccgaagcgcagcgcggtacgatcgcggcgcttgctcatcctgtcatcatcgaacatctgcaaaggctcggcgtgtcggccgtcgaactgatgccggtgacggcgtcgatcgacgaacggcacctgccgccgctgggcctcagcaacgcctggtgctacaatcccgtcaccttcatggcgctcgacccgcgtctcgcgcccggcggcctcgaggaattgcgcgacaccgtggcggcgctgcgcaaggccagcatcggcaccatcctcgacctcgtcttcaaccacacgggcgaaagcgaccggctggggccgacgctgtcgctgcgcgggctcgacaaccaggcctactaccggcaccagcctgatggcaggctggtcaatgacaccggcaccggcaacacagtcgcctgcgatcatccggtggtgcgggacatggtgctcgacacgctccgtcacttcgtccgccataccggcgtcgatggcttccgcttcgatctggcgccggttctgggccgcgtcgatggcgcattcgatcccacggcgcccttgctcgaggcgatcaccggcgatcctgtgcttgccgatcgcgtgctgatcgcggagccgtgggatatcggccctgacggctatcagctcggcaacttcccgccgcgcttcctcgaatggaacgatcgctatcgcgacgatgccaggcgcttctggcgcggcgatgccggtgcggtgggagcactggcgacgcggcttgccggttcgtccgatatttttggcaaggccggccaggcggccagccgcacggtcaatttcatcgctgcccatgacggcatgactttggccgacatcgtcgcctatgagcgcaagcacaacgaggccaatggcgagcagaaccgcgacggtcacaacgacaatctgtcctggaacaatggcgccgagggcgagacggatagcgcggcgatcgccaatgcgcgcttcgacgaccagtgcgcgctgctcgccacgctttttgcctcgcgcggcaccatcatgctgacggcgggcgacgagttcggccgctcccagaagggcaacaacaacgcctatgcgcaggacaatgccatcacctggctcgactgggccggccgcgaccatgcgctggagcgctacgcatcggtgctcggcatgctgcgccgtgccgtcccggccctgtcggctacagatttcctcacaggacaatcggccgatgcgacaggcacccccgacgtcgcctggttgaccgagaccggcatgccgcttgccgagacggactggaacgaccccgcccggcaccgcctcgtcatgctgcttggcgatgcaggcggcgatcgccttgccgtcatgatcaacggcgatcgtcgccaatgcgtcttcaccttgcccgaacgggaaggcttccgatggcagccggcgatcgagacgcaggcgattgagcttgcgcggccgctgccgggccgaagcgtccatttcatggcagagcatcggaccgaaaagtggcagtcggttttcgggcaatccgatgcgagcaaaaaatag

SEQ ID NO: 35991 - DNA, 1635 bp, Mesorhizobium loti
gtgatggccgacgacaatgcggggcagggggccgactggtggcgcggctgcgtcatctaccaagtctatccgcgttccttccaggacacgaccggcgacggcagcggcgatcttaggggtatcaccacgcggcttggccacatcgcttcgctcggcgtcgatgccgtctggctgtcgcccttcttcaagtcgccaatggccgacatgggctatgacgtttcggattatcgcgacgtcgatccgatgttcggttcacttgaggatttcgacgctctggtcaccgaggcgcaccggttgggcctgaaggtcgtcatcgaccaggtcttgtcgcactcatccgacaagcacgaatggttcgtccaaagccgcgccagccgcgacaatcccaaggctgactggtacgtctgggccgatacgaaacccgacggcaacgcgcccaacaactggctgtccgtcttcggcggcccggcctgggagtgggattcgacccgccggcaatattacatgcacaatttcctcgcctcgcagcccgatctgaatttccacaatccagaggtccaggatgcgctgctggacacggtgcgcttctggctggagcgtggcgtcgacggttttcggctcgatacggtcaactactatgtccacgaccgctggctgcgcagcaatccgccgctggcgtcgagcgtcgccggcaccaatggcgagaccaacacctacctctaccaggagcatctgttcgacaagacgcagccggaaaacctggctttcctcaggcgtttccgggggttgctagacgaatatcccgaccgcgccgccgtcggcgaaatcggcgatgagggccgctcgctgcagacgctggctgcctacacctccggcggcgacaagctgcagatgtgctacaccttcgacctgctcggcccgcagttttcggcggcgcatgtgcgcggctgcgtcgaggccttcgaacaagcggttaccgacggctgggtctgctgggcgttttccaaccatgacgtggtgcgccatgtcagccgctggactgggccggacggcgatgccgatgcggtagccagattctcgatcatgctgctcgcctgcctgcgcggctcgatatgcctctatcagggcgaggagctcggcctggaggaggcggagcttgcctatgaggatctgcgcgatcccgtcggcatccgcttctggcccggcatgaagggcagggatggctgccgcacgccgatggtctgggaagccggcgccgacaatgcgggtttctcgacggccaggccctggctgccggtcccggccagccatcgcgcccgcgccaccgacgtgcagaacggcagcgagcaatcggtgctgtccgcctaccgctcgacgcttgccttgcgcaggcggcatccggcgctggtcagcggctcgatccgctttctcgacgccgaaggcgatgtgctggccttcatccgcgaaggcgacgggcagaggctgctctgcgtcttcaatttcgccggggagccggggaattggcccttgccaccggatattggcgtcgctgctgtcctggctggcgccgctgttgtcgaggaagaagcgctctcgctgccggctctcggttgcttccttggccggctcgactga

SEQ ID NO: 35992 - DNA, 1464 bp, Mesorhizobium loti
atgcgcgcccagcccacggcatcgcactatgtcaacggacgctacatcgacgacgagcaaggggcgccattgccggtcatctatccggcaaccggcgagaccatcgccatgctgcgctcggcgacgccgaatgtgctggagctcgccatcgaggccgcacgcgccgcgcaaccggcatgggcgcggctgaagccggtcgagcgcggccgcatcctgcgccgcgcagccgacattctgcgcgcccgcaacgccgacctcgcccgcatcgagacgctcgacaccggcaaggccatccaggaaacgctggtggcggacgcaccgtcggccgcggactgcctggaatacttcgggggcgcggtcgccgcctataatggcgaggccgtcgatctcggcggtcccttcgcctacacacggcgcgaggcgctcggcgtctgtgtcggcatcggcgcctggaactacccgatccagatcgccggctggaaatccgcccctgcgctggccatgggcaacgccatggtattcaagccgtcggaaaacacgccgttgtcagcgctggcgctggccgaaatctacagcgaggccggcctgcccgacgggctgttcaatgtcgtgcagggctatggcgatgttggcgcgggcctcgtcggccacgatgtcgtggcaaaagtttcggtgaccggttcggtgccgaccgggcgcaaggttctgtcgcttgcgggttcgaagatgaagcacgcgacgatggagctcggcggcaagtcgccgctgatcgtcttcgacgatgccgacatcgaaaacgccattggcggcgccatgctcggcaatttttactccacaggccagatctgctccaacggcacgcgtgtcttcgtgcaaagcggcatccacgaccgcttcgtcgagcggctggtcgagcggacgaagaaaatccgcatcggcaatccgcttgatcccgagacgcagatgggaccactggtctccaaggcacagcacgagaaggtcgtcggctatattgggattggcaagcaggacggcgctgttctcgcctgcggtggcaatgtgccgtcgctgcagggttttgacggcggcttcttcgtcgagccgacggtgttcaccggggtcaccgacacgatgcgcatcgcccgcgaggagattttcggacctgtcatgagcgtgctgaaattcgacggcgaggacgaggtgatcgaccgcgccaacgacaccgaattcggcctcgccgcgggcgtcttcacccgcgacctgccgcgcgcccaccgcgtgatcgccgaattgcaggccggcacctgctggatcaacgcctacaatctgacgccggtggaaatccccttcggcggcttcaagcagtccggcatcggccgcgagaattcgctggcggcattggcgctctattcgcagctgaagtcgatctatgtcgagactggggacgtggcgagcccgtattga

SEQ ID NO: 35993 - DNA, 1653 bp, Mesorhizobium loti
atgcttgaagcggatttcgttatcatcggctccggctccgccggctcggccatggcctatcgcctgtcggaagacggcaagcattcggtcattgtcatcgaattcggcggcagcgatatcgggccgctgatccagatgccgtcggcgctgtcgatcccgctcaatatgagcctttacgactggggctttgccagcgaaccggagccgcatctcggcggccgcgtgctggcgacgccgcgcggcaaggtgatcggcggttcgtcctcgatcaacggcatggtctatgtgcgcggccatgcccgcgactttgaccattgggccgaagaaggtgcaacgggttggggcttcgccgacgtactcccctacttcaagcgcatggaggacaatgacggcggcgaggacggctggcgcggccatggcgggccgctgcatgtgcagcgtggctcgcgtaaaaatccactctacggcgccttcgtcgaagcgggccgccaggctgggttcgaactgaccgacgactacaacggctccaagcaggaaggttttgggccgatggaacagaccataagcggcggccgccgctggtcggcggcatcagcctatctgaagccggcgctcaagcggaaaaacgtgagtctggtcaagggctttgcccgtcgggtgatcatcgagaatcaacgcgctatcggcgtcgagatcgaagctcacaaacagattcaagttgttaaggcgcgacgtgaggtgatcgtcgccgcgtcgtcgatcaattcgcccaagatcctgatgctgtccggcatcggcccggccgagcatttgcgcgaaaacggtatcgccgtggtggccgaccggcccggcgtcggccgcaatctgcaggatcacatggagctttatatccagcaggaatccaccaagccgatcacgctgaattcggtgctcaacccgttctcgaaagcgttgatcggagcacagtggctgttcttcaagtccggcctcggcgccaccaaccatttcgaggccgccgccttcgtgcgctcgcgcgccggcgtcgattatccagacattcagtaccacttcatcccggcggcggtgcgctatgacggcaaggcggcggcgaagtcgcacggcttccaggcgcatgtcgggccgatgcggtcaaagtcgcgcggctcggtgacgctgcgttcgcccgatccgaaagcgaagccggtgatccgcttcaactacatgtcgcatccggacgactggaccgagttccgccactgcatccggctgacccgcgaaatcttcggccagtcggccttcgacgcttttcgcggccaggaaatctcgccgggcagccatgtgcagtcggacgatgatctcgacgtcttcatccgcgaccatgccgagagcgcctaccacccctgcggcacctgcaagatgggccgcgccgacgatgtgacgagcgttgtcgatccggaatgccgggtcatcggcgtcgacgggctgcgggtcgccgattcctcgattttcccgcgtgtcaccaacggcaatctcaatgcgccatcgatcatgaccggcgagaaggcgtccgaccatattcttggccgcacgccgctggcgccgtccaaccaggagccatggatcaatccgcgctggcaggtgtcggacagatag

SEQ ID NO: 35994 - DNA, 1530 bp, Mesorhizobium loti
gtgacagcgaagcgacccaatttcctgatcgtcatggtcgatcagctcaacgggactttttttcccgatgggcctgccgcgtttctgcacgcgccgcatctgaaggcactcgcggcgcgttcggcccgattcaggaacaactacaccgcctcgccgctctgcgcgccgggccgcgcctcgttcatgagcggccagttgccgtcgcgcaccgaggtctatgacaacgccgccgaattcgcctcgtcgatcccgacctttgcccatcatctgcgcgccgacggctatcacaccgtactgtcgggcaagatgcatttcgtcgggccggaccagttgcacggcttcgaggagcggctgaccacggacatctatcccgccgatttcggctggacaccggactaccgcaagcccggcgagcgcatcgactggtggtatcacaatctgggctcggtaagcggcgccggcgtcgccgagatctcaaaccagatggagtatgacgacgaggtcgccttccacgcggtgcaaaaactctacgacttcgcccgcgtctccgacgatgcggcgcaccggccctggtgcctgacggtttccttcacccatccgcacgacccctatgtggcgcggcggcagtactgggatctttatgaggattgcccagcgctagaacccgaagtgggcttcatcccctgcgacagccaggacccgcattcgcagcggctctacaaggcttccgactacaacagtttcgacatcacggcagagcaaatccgccgctcgcggcgcggctatttcgccaacatctcctatctcgacgacaaggtcggcgagttgctgtcggtgcttgagcgcacgcgcatgctcgacgacacgatcatcctgttctgctcggaccatggcgacatgctcggcgagcgcggcctgtggttcaagatgtgcttcttcgagggctcggcacgggtgccgctgatgatcgccggcaaggacattcccgctggcctgatcaaggcgccggtctctaatctcgacgtgacgccgacgctgtgcgacctcgccggcatcgacatgagcgcgatcgcgccatggaccgacggccagtcgctgctgccgctgctggagggcaagcagcgctacgcgcccgtattgatggagtatgcggccgaaggctccaacgcgccgttggtggcgatccgcgacggccgctacaaattcgtccattgcgagatcgatccgccgcaactctatgatatcgaagccgacccgcatgagctgagcaatcttgccaccgatccggcgcatgccgatctggtggcggctttcctggaaaaggtgcgcgcacgctgggacatggcggccttcgataccgccgtgcgcgccaaccaggcgcggcgctgggtggtctacccggcgctgcgcaacggcacgcattacccctgggagttccagccgctgcagaaggcctcggaacgctacatgcgcaaccacatggatctcaacgtgctcgaagagcaaaaacgctttccgcgaggcgaatga

SEQ ID NO: 35995 - DNA, 1179 bp, Mesorhizobium loti
atggagaccgccatgaccgcatgcatcgttggctgggcgcattcgcgcttcggcaagctcgagggcgagacgctcgaaaacctcatcgtcaaggtcgcgacggatgcgctcgaccatgccggcatcggtccggacgaggtcgacgagatcgtgcttggccatttcaacgccggcttctcggcgcaggatttcaccgcgagcctggtgctgcaggccgacgaccggctgcgcttcaagccggcaacgcgcgtcgagaacgcctgcgcgacgggatcggcggcggtccggcaaggcatccgcgccatcgacgccaacgcggcccgcatcgtgctggtggttggcgccgaacagatgacgacgacgccgggacccgagatcggcaagaaccttctgaaagcgtcctatctgccggaggacggcgagacacccgcgggcttcgccggcgtcttcggcaagatcgcgcaggcctatttccagcgttatggcgaccagtccgatgcgctcgccatgatcgccgccaagaaccacaagaacggcgtcgacaatccctatgcgcagatgcgcaaggatttcggctatgatttctgccggcaggagagcgagaagaaccccttcgtcgccggtcctctcaagcgcaccgactgctcgctggtctccgacggcgccgccgctcttatcctcgccgatacggccactgcgctgaagatgcgccgcgcagttgccttcagggccaatgaacatgtgcaggatttcctgccgatgtcgaagcgcgatattctggccttcgaaggctgcgagcaggcttggacccgcgcgctgaagaatgccggcgtgacgctcgacgatctgtcctttgtcgagacgcatgactgcttcaccattgccgaactgatcgaatatgaggccatgggcctggccaggcccggcgagggcgcgaagctggcgctggatggcacgacggccaaggacggccgccttccggtcaacccctccggcgggctcaaggccaagggccacccgatcggcgccaccggtgtctccatgcatgtcctgaccgccatgcagcttgtcggcgaagccggcggcattcaggtgccgggcgcgaagcttggcggcatcttcaacatgggtggcgcggcggtcgccaactacgtttccattctcgaccggatcaggtaa

SEQ ID NO: 35996 - DNA, 720 bp, Mesorhizobium loti
atgtcggtgacgtatgattttacgggccgaacagcaatcgtcacaggaggtgcccgtggtatcggccgagcgatagcccacaagctctctttgagtggagcggacgtctggatctgggatattgagcccgtcgagcttgaaggcacacgatctctttcagtggacgtgacgaaacgcgataacgtcatgcaagcgctgaccatcatgggtgaagtcggggtcgacattctcgtcaacaatgcgggttggctgggtggctataagccgttcgaggaattcgaaccggcggaatggcagagaatcctgcaggtcaaccttcttggcacgttcgaagtaacgcatcgcgtgctcccgcttatgcgacgagcgggaaagggtcgtatcgtcaacatgggatcccttgccgggaaagagggactgccgagccttgcggcctattccgcggccagcgccggtgtcatcgcttttaccaaagcactgtcgcgtgaggtcagcgataccgacattcgcgtgaactgcatcgccccgggtccgatcgatacgcgccttatccgggacctcggcaatgagaccgtcgatgcgatgatatcggcaagtccgttgaagcggctgggcgatccgaacgaggtagcggcgctcgtggtgtggctttgctcggatgccagtgcgttcaacaccggcgctgttttcgatatgtcgggcggccgagcccgatactga

SEQ ID NO: 35997 - DNA, 2085 bp, Mesorhizobium loti
gtgccgaactgcaaggcagcatccggcgaagcgaaagcctatccatataggcttgcgagacagagggggcgcgaaggaacgcctgcgtcgctttcagcaagccctcgctacggaggctccatgttcagcaaaatcctgatcgccaatcgcggcgagatcgcttgccgtgtcatccgcacggcccgcaagatgggtgtgcgcaccgtcgctgtctattcggacgccgacgcgaaatccctgcatgtcgagatggccgacgaggccgttcatatcggccccccgtcggttggcgaaagctatctgcgcggtgaccggattgtcgcggctgcgctttcgacgggggcgcaggccatccatcccggttacggcttcctgtcggaaaatcctgatttcgtcgaccaggtggtggcggcggggcttaccttcatcggcccgtcggcggcctcgatccgcgccatggggctgaaggacgccgccaagcggctgatggagaaagccggcgttcccgtcgttccgggctatcatggcgaagcgcaggagatcgtgctgcttgcctccaaggcacgcgagattggctatcccgtgctgatcaaggcgcgcgccggcggcggcggcaagggcatgcggcgcgtcgagcatcccgatgatttctccgaggcgctgtccagcgcccggcgcgaggcaaaggctgctttcggcgacgaccgcgttctcgtcgaaaaatatgtcgacaagccgcggcacatcgaagtgcaggtgttcggcgacaatttcggcaatgccgtgcatctctacgaacgcgactgctcggcgcagcgccgccaccagaaagtgatcgaggaagcccccgcccccggcatgacgccggcgctgcgcaaggcgatgacggaagcggctgtgaaggccgccaaggcgatcggctactcaggcgccggcaccatcgaattcatcgtcgatgcctcgcaaggcctcaagcccgaccgcttctggttcatggagatgaacacccgcctgcaggtcgagcatccggtcaccgagatggtcaccggcaccgacctcgtcgagtggcagttgcgcgttgccagcggcgaaaagctgccgaatacgcagagcgagatcgcgctgaccggccatgccctggaggcgcgaatctatgccgaggatgcgtcaaagggcttcctgcccgcaacgggcacgctccatcatctgaagttccctgaggcggcacccgagggcgccacgatgcgcgtcgagaccggcgtgcggaccggtgatgccatctcaccctattatgatccgatgatcgccaagctggtggtccatgcaaaggacaggctagcagcgctggaagctctcggcgcggcgctggcgcggaccgaaatcgcgggttccaccgtcaacaccggctttcttgccgcccttgccgccgatcccgacttttgtgctggtgatgtcgacaccggcctgatcggcagacatcaggcggcactgaccggggtcgcgccgccgaccggcgaaatcgtctcggcagcagcccttgccgcctccggtgccgcagccttgccgctatcgaacgacccatggtcgtcactttccggctacgcgcatttccacggcgtggcgcggcgcacgcggctgaagttcggggagaccgatatactggcaaaggtttcggtgcggccggacgggcgcttccaggtggcgttcgatgcgccctatgacagcaccaattcgcatgattttcgcgccgctccccgcctcgcccgctggcctggccacatcacggtgttcgaaggcgccgtcggctacacattcgcggtaccggacccgttggcacggagcgatgaagcggccgccgcctccggcagcctgcgcgcgccgatgccgggcctggtcaagctggtgcgcgtggcgaagggcgatgcggtgatcaaggggcaaccgttgctgatcctcgaggcaatgaagatggagcacactatcgccgccccgcatgacggggtggttgccgagatcgccacggaaggcgcgcaggtcacggacgggacagtgctggtgcggttcgtagaggagcagaacgcgtag

SEQ ID NO: 35998 - DNA, 1164 bp, Mesorhizobium loti
atgtacacgaacacgctcagcttcgggcatgacgaggacatcgaggcgctgcgcgacatggtgcggcgcttcgcccaggacaggatcgcgccgatcgccggcgatatcgaccgccagaacgaatttccggcgcatctgtggcgcgagctcggcgcgctcggcctgctcggcatcaccgccgatcccgatttcggcggcagcggcatgggttatctcgcccatgtgattgcggtggaagaaatttcccgcgcctcggcttcggtcggtctctcctatggcgcccattccaacctctgcgtcaaccagatcaaccgctgggcgacgccggcgcagaaggaaaaattcctgccgccgctgtgttcgggcgagcgtgtcggcgcgctggcgatgtctgaatccggcgccggctccgacgtcgtctcacttaagctgcgtgctgaaaagcgcaatgaccgctatgtgctcaacggcaccaagatgtggatcaccaacggcccggacgccgatacgctggtcgtctatgccaagaccgatccggagcggaaatcgcgcggcatcaccgccttcatcgtcgagaaggcgatgacggggttttccgtggcgcagaaactcgacaagctcggcatgcgcggctccagcaccggggagctggtgttcgagaatgtcgaggtgccattcgacaatgtgctgcacgaagaaggacgcggcgtcgaggtgctgatgtcgggcctcgactatgaacgcaccgtgcttgccggcggcccgatcggcctgatggcagcctgtctcgatgtggcgatcccttatgtgcacgaacgcaagcagttcggccagccgatcggcgagttccagctggtgcaaggcaagctggccgacatgtatacggtgatgaacgccgcgcgcgcttacgtctatgccgtcgcggccggctgcgatcgcggccagaccacccgcaaagacgccgccggctgcgttttgttcgcagcagagaaggcgacgcagatggcgctggacgccatccaacttctgggcggcaacggctatatcaacgactatccgaccggtcggctgctgcgcgacgccaaactctacgagatcggcgccggcaccagcgaaatccggcgctggctgatcggccgcgagatcatggcggagggggtgtga

SEQ ID NO: 35999 - DNA, 285 bp, Mesorhizobium loti
atgaacgatcggaaaagagcagttcaggcccgcgtatacggcagagtgcaaggcgtcggctacaggatctggacgagaagcgaagcggcagggcttgggctggtgggctgggtgcgcaacgaaagagacggctcggtaacggcatggcttgccggcgccgacgcggcggtttcggccatgatcgaacggcttcggcaaggtcctgcgggcgcctcagtctcgcgggtcgaggtggaggagatcgagacctggaccgcgcctggagatttcaggatcgtcgcatag

SEQ ID NO: 36000 - DNA, 1113 bp, Mesorhizobium loti
atgcgtcagcgccctgccctctcgccgatcattgaagcacttccctcgaccgtgccttttgtcggcccggaagcgcaggagcgtgagcgcgggcgggcttttcgtgcccgtatcggcgccaatgagagcagttttggtccgtcgccgcgcgtcatcgcccgcatgtccgggattgcccgcgacatgtggatgtactgcgatcccgacaatttcgatctgaaggtcgcggctgccgcgcatcacgacgtggcggtcgagaatgtcgttgtcggcgaaggcatagacgggctgctcagcttggtggcgcgcatgtatgtggcgcctggcgatgccgtggtcacctcgctcggcgcctatccgaccttcaacttccatgttgccggcgtcggcgggcggctggtcacagtcccctacgagaacgaccgcgaaagcctggatgatttgcttaaggcggtcgtcaaggagaaggcaccgctggtctatctgtccaatccggacaatccgatgggcagctggtgggatgcggacgaggtgatccgcttcatcgaagcgctgccggagaccaccatgctggtgctcgacgaggcctatggcgaattggggccggcctcggccctgccgccgatcgatatctcgcgaccgaatgtcatccgcatgcgaaccttttcaaaggcttacgggctcgctgggatacgctgcggctatgcgattgccgaggcccaggtgattcgcgacttcgagaagatccgcaaccactatggcgtcagccgcatggcgcagatcgccggcgtcgcggcgctcgccgaccagccctatctcgagacggtggtggcgcgggtggcagcagggcgccggcgcatcgcggcgatcgccgagcagaacgggttgaagccgctggcctcggcgaccaatttcgtcactatcgattgcggccatgacggcgccttcgcgctgaaagtgctgcaagggctgctgtcgcgcgacgtcttcatccgcaagccgatggcgccaaagctcgaccgctgcattcgcgtcagcgtcggcctcgaccacgaactggatatttttgccgaggaattgccgggtgcgctggcggcggcgcgggggaactag

SEQ ID NO: 36001 - DNA, 918 bp, Mesorhizobium loti
atgcataaacaaacaagtcccaaggagttggacgacatgctgagaggctcgcttactgcgctcgtgacaccgttcgaaaagagcgggcgtttcgacgagaaagcctttcgcgcctttgtcgaatggcagctcggggaaggcacgacgggtctggtcccggtgggcacgaccggcgagtcgccgacgctgtcgcatgacgagcaccgccatgtcgtcaaggtctgcatcgaggtggccaatgggcgcgctccggtcgtcgccggcgccggctccaacaacaccgcggaagcggtcgggcttgtgcaatatgccgaaaaggccggcgccgatgccgccctggtcgtcacgccctattacaacaagccgacacagcgcggcctctacgagcatttcgccgccgtcgccagggcgaccaagctgccgatcatcatctacaacatcccgccgcgctcggtgatcgacatgatgccggagacgatgggccggctggcgcacgacttcaagaacatcgtcggcgtcaaggatgcgaccggcaaggtcgagcgtgtgtccgagcagcgcatgacctgcggcaaggatttcatccagctttccggcgaggatgcctcggcgctcggcttcaacgcccatggcggtgtcggctgcatctcggtgacctcgaacgtcgccccgcggctgtgcgccgaattccaggaagccacgctgtccggcgacagtgtgaaggcgctggaattgcaggaccgtctcttgccgctgcataaggcgatcttcctggagcccggcgtgtccggcgccaaatacgcgctgtcgaagctgggcaaggtcgagaacgtgctacggtcgccgttggtcacggtcgaggagtcgaccgcggcgaagatcgatgcggccatgaagcacgccggcttgatcaattag

SEQ ID NO: 36002 - DNA, 1884 bp, Mesorhizobium loti
gtggccgaaaaaaccgtctccgccgacacctcaacgctcacgacattgcgcaatttgtggccctatatgtggccagccgaccgcgccgatctcagggcacgcgtcacctgggcgacgctgctgctggtcgttgccaagttaacgctggtcgccggtccctatttcttcaaatgggcaaccgatgcgctggcgggcggcttcaagacgccgccgccgctgccgtctttcatgctcgccccggtgatgctggtcgtcgcctacaatgtgctgaggctggttcaactcggcttcaaccagttgcgcgacgcgctgtttgcccgcgtcggccagcatgcggtgcgccagcttgcgttccgcaccttcgttcacatgcaccagctgtcgctgcgcttccatctggagcgccgcaccggcggcctgtcgcgtattatcgagcgcggcaccaagggtatcgagacgatcgtgcgcttcatcatgctcaacaccgcgccgaccattctcgaattcgcgctgaccgccggcatattcggtttcacctatggctggaaatatgtggccgtagtggcaatcaccgtctgggtctatgtctggttcacggtcaaggccagcgactggcgcatttcgatccgccgcgacatgaacgacagcgacaccgacgccaacaccaaggcgatcgactcgctgctcaatttcgagacggtcaagtacttcaccaatgagcgcatggaggccgaccgcttcgaccgttcgatggcgcgctacgagatcgccgccaccaagacctggacctcgctcggttggctgaattttggccagggcgtcatcttcggcctcggcacggttgtcgtcatgtgcatgtcggcgctggaagtgcaggcccacacccagaccgtcggcgatttcgtcttcatcaacgccatgctggtgcagctttccgtgccgctcaacttcatcggcttcatctaccgcgaaatccggcaggggttgaccgatatcgagcatatgttcgatctgctcgacgtgccgcaggagattgtcgacagaccggacgccaagccgctcagcgtcagcgcgggcaaggtcgagttccgcgacgtgcatttctcctatgatccgaaccgcaagatcctgaagggtgtttccttcgaggtgccggccggcaagacggtcgccattgtcgggccgtcgggcgccggcaagtcgaccatctcgcggctgctgttccgcttctacgacgtgcaggccggccaggtgctgatcgacggccaggatatccgggatgtcacccaggacagcctgcgctccatgctcggcatggtgccgcaggacacggtgctgttcaacgacaccatcgcctacaacatccgctacggccgcgtcggcgcgagcgaggaggaagtccgcaaggctgccgaactcgcccagatcgggccgttcatcgaaaagctgccggacggctacaagtcgatggtcggcgaacgcgggctgaagctttccggcggcgaaaagcagcgcgtggcgattgcccgcaccatcctgaaagcgccgccgatcctgatgctcgacgaagcgacttcggcgctggacagccacaccgagcaggagatccaggccgcgctcgatctcgtcagcaaaggccgcaccaccattgtgattgcccaccgtctgtcgacggtgatttcggccgatgagatcatcgtgctcaaggacggccagatcgccgaacgcggcacccatgtcgagctgatgcgcaagcacggcctctatgcctcgatgtgggaccgccagcgcgaggcgaccgaagccgaggagcgcttgcgccttgcccgcgagggcgacgagctcggtgtcatcgttcgccggcggacgtcggaggtaaattga

SEQ ID NO: 36003 - DNA, 891 bp, Mesorhizobium loti
atgatgacgcgcaacaaggagttccccatgcagatgcaatcggtcaccccggcgcgtctcgtcaccactggccttgccttcggggaatcgccccgctggcatggcggacgcctgtgggtctgcaactggggcaccagcgagatcatcgcgaccgatgcgcatggcaaccgcgaaatcatgctcatagtgcctgccgtcctgccctattccatcgactggctgcaggacggtcgtctgctggtcgtttcaggccgtgaaggcttgctgctgcgacaggaagttgatggcaagctcgtcacccatgccgatctgcgcggcctgtcgaaaagcccttggaacgagatcgtcgtcgacgggcgcggcaacatctatgtcaatggcggcgggccggcgccggctgccggtgagtatttcggcccgggcaccgtcgtgctgatcacggcggacggcgcggtccggcaagtggctgacgacatcgccttcgccaacggcatggcggtgaccccggacaacaagacgctgatccttgccgaatcccatggcaatcggctgaccgccttcgatatcgccgccgacggcagcctgtccaaccggcgcgcctgggccgacctcgacggctatcccgacggcatctgcctcgatgcagaaggcgcggtctggtatgcggatgttcccaacaagcactgcgtacgggtgcgtgaaggcggcgaggtgctgcagaccgtcaccgtcgatcgcggctgcttcgcgtgcatgctgggcggcgcggacaggaggacgctgttcatcgtcgccgccgagtggcgcggcttcgaacacatggtcggcgacgcccgcaccggccaggtgctcagcgtggatgcgccggcacccggcgtcggctggccttaa

SEQ ID NO: 36004 - DNA, 2223 bp, Mesorhizobium loti
atgatcctgacactggctctgcttgcgggtcttgccctggcctggctgctgatcggcgtggtggaaaaattccgcctcggcctgcgtttcggccaggcgctgctctatgtgccgttcaagctcgcctaccggatcgacgacagccacatcaggatcgcgcgcaaggcgcaggctcccgtcatctatgtcatctcgcaccagtcgcgcttcgaaccggcgctgatgctgtcgctgctgccggatgacacgctgcacattctggacgaggtctcggcgcgctcgccgtggctggaaccctggcgtgagcttggccgcacgattgccttcaatgccgaacatcttttcgtcagccgccggctggtgcgtgtgctgaagggcaagggccggctcgccgtctatctgccggatgcggtcgagcctgacgtcaagacgtttcggctgtttcgcgccgtcacccgcatcgccatgcaggccgatgcccgcatcgtgccgatctttgtcgccggcgcgcgcagcctgcctgtttccctgacgccggcggccagggccccgcggcactggtttccgcagctctcgatgagcgtactggagccgatgaccatcgccgagctggtggcgcgcaatccggaccaggcctccaataccaatgcgctgttcgaccgcgtcgccgaggcccggcttttcggcaacgacctcgaccgcggcctgttcctggccatgcgcgatgccgcggccagggtcggcgcctcgcatccgatcatcgaggacgtgatctcgggtgcgctgagctaccgcaagatgttcatcggcgcccgcgtgctgggcaggcgtttcgaggcggtgaccgcgccaggcgaagcggtgggaataatgctgcccaacgccaatggcgtcgtgctgtcattcgtcggccttctgtcagcgggacgagtggcggcgatgatcaactacacttctgggccggcgagcgtcaccgccgccgtgcgcacggccgtcatccgcaccgtcatctcctcgcgcgccttcgtcgagaaggccgatcttggcgacatcgtcgccgcggtcgagatgggcggcgccaggctgctgtggctggaagatgttcggaccagcgtcaccgcgctggacaagcttgccgccgcgttgctgtggcgtttgccgctgcagcgccaggatgcggccaagccgggtgtgatcctgttcacgtcaggctcggagggcacgccgaaggcggttgtcctgtcgcaaaagaaccttctcgccaatgccatgcaggccgaggcgcgcatcaccatctcgccggccgatatcctgctcaacgtgctgccggtgttccattccttcggcctgacgggcggcaccgtcctgccgctggtcaccggagtgaagcttttcctctacccctcgccgctccactacaagatcatccccgagatcgcccgcaaggtgcagccgacgatcatgttcggcaccgacaccttcctcgccaactatgcgcgcaccgccaaggacggcgacttctccagcctgcgcttcgtcgtcgccggcgccgaggcggtgaagccggaaacccgccgcatctatcgcgagcgcttccaggccgagatcatcgaagggtttgggctgaccgaggccgcacccgtggtcgccgtcaacaccgccatccatgggcgcgatggtacggtcggccggctgttgccggccatgcgcatgaagctggaaccggtcgaaggtatttcggacgccggccagttgtggctcgacggacccaatttgatgatgggctacatgactgcggaccgccccggtgagctgcagccgctgagcggctggcatgacaccggcgacatcgtcgccgtcgaccgcgatggcttcatcaccattcgcggccgcgccaagcgcttcgccaagatcgccggcgagatggtgtcgctgggtgcggtcgagatgctggtgcagtcgctgtggccggaagaacgccatgcggcggtggcggtgcccgacaagaggcgcggcgagcgcatcgtactggtcaccaccgccgacgacgccaatcccgaagaattgcgccagttcggcaagaaagccggggccgccgagctgatggtgcccaacgacatcgtcaaggtggaggaaatcccggtgctcggttccggcaagaccgattatgtctcgaccaggaagctggcgatcgacaggctgggactgggcgtcgcggcctga

SEQ ID NO: 36005 - DNA, 741 bp, Mesorhizobium loti
atgaccctcgaccttaccggccgcgtcgcggtcgtcaccggcgcctcgcgcggcatcggctatttcatcgccagggaattggccgccgccggggcgcatgtcatcgccgttgcgcgcacggtcggcgggctggaggaactcgacgaccagatcaaggcggccggcggtcaggcgacgctggtgccgctcgacctcgccgacatggccggcatcgaccggctgggcggcgccatccatgagcgctggggcaagcttgacatcctcgtcgccaatgccggcgtgctcggcgtcatctcgccgatcgggcatgtcgaggccaaaaccttcgagaaggtgatgaccatcaatgtcacctcgacctggcggctaatccgctcggtcgacccgctgctcaggctttcggatgccggccgggccattatcctgtcgtccaacgcggcccattcggcgcgcgccttctgggcgccttacgccgcctcgaaggcggcagtcgagaccatgatgcgctcgtgggcgcatgagacgcaaagcttgccgctgcgcgtcaatgccgccgacccgggcgccacccgcaccgccatgcgagcccaggccgtgccaggcgaggatccggagacgctgccgcatccttccgagatcgccaagcgcatcgtgccgttggccagcccggagctgaaggagaccgggctgatcttccaggccaagcacaaccgcttcgtcgcctacaggcaacccgaataa

SEQ ID NO: 36006 - DNA, 948 bp, Mesorhizobium loti
atggccgtcgcattcacctttccgggacaaggcagccaggctgtcggcatgggcaaggacctcgccgatgcctttcccgaggcgcgcagggtcttccaggaagtcgacgacgcgctcggcgagaacctgtcgaagctgatctgggaaggtccggaggagaccttgacgctgacggccaatgcgcagccggcgctgatggcggtttcgttggcggcgatcagggcgctggaagcgcgcggtttttcgctgaaggacaaggtcgcctatgtcgccggccattcgctgggcgaatattcggcccttgccgcagccggcttcgtttccgtcgccgatgcggcccggctgctgcgcattcgtggcaacgccatgcaggcggcggtgccggccggcgagggcgccatggcggcgatcatcggactggagcagccagatgtcgaagccgcttgcatcgaggccgcgcaaggggccagcaaggtctgccagatcgccaatgacaatggcggcggccagctggtcatctccggcgccaaggccgcggtcgagctggctgccaaattgtgcaccgaaaagggcgccaagcgggctctgatgctgcaggtctcggcgcccttccattcggcgctgatggcaccggctgccaatgtcatgcgcgaggcgctcgccggtgtgacgaagcatgcgccgggggtgccagtggtgtccaacgtcacggtgaccccgaccagcgatcccgacgagatcgcccggcgcctggtcgagcagatcaccggccgcgtgcgctggcgcgaaacagtcgaatggttcggcgccaacggcgtcaccacgctttacgagatcggcgccggcaaggtgctgtcgggcctggctcggcgcatcaaccgcgacatcgcgacatcggccgtcggcacgccggccgatgtcgaggccgcgctggccacattcgcataa

SEQ ID NO: 36007 - DNA, 738 bp, Mesorhizobium loti
atgttcgaactgaccggccgcaaggcgctcgtcaccggcgcatcgggaggcatcggcgaggcgatcgcccgcgtgctgcatgcgcaaggcgccattgtcggcctgcacggcacccgcatcgagaaactggaggccttggcggccgaactcggcgatcgggtcaaactgttcccggccaatctgtcgaaccgcgacgaggtcaaggcgctcggccagaaggcggaggccgatctcgaaggcgtcgacatcctggtcaacaatgccggcatcaccaaggacggcctgttcgtgcgcatgtcggacgccgattgggactccgtgatcgaggtcaatttgaccgccgttttccggctgacccgcgaactcacccatccgatgatgcgccgccgtcatggccgcatcatcaacatcacctcggtggtcggcgtgactggcaatcccggccagaccaactactgcgcctcaaaggccggcatgatcggcttctccaaatcgctggcgcaggagatcgccacccgcaacatcaccgtcaactgcgtcgctccgggcttcatcgaatcggcgatgaccgacaagctcaacgacaagcagaaagaggcgatcatggcggcgattccaacgcgccgcatgggaacgggtgccgaggtggcgtccgccgtcgcctaccttgcctccaacgaagccgcctacgtcactggccagaccgtccatgtcaatggcggcatggccatgatttga

SEQ ID NO: 36008 - DNA, 237 bp, Mesorhizobium loti
atgagtgacaccgcagagcgcgtcaaaaagatcgtcatcgagcaccttggcgtcgatgccgacaaagtgacggagcaggcgagcttcatcgatgatctgggcgctgacagcctcgacacggtcgaactcgtcatggcgttcgaagaagagttcggcgtggaaattcccgacgacgcggccgagaccatcctgaccgtcggcgacgcggtgaagtacatcgacaaggcttcggcctga

SEQ ID NO: 36009 - DNA, 1263 bp, Mesorhizobium loti
atgaggcgtgtcgtcgtcacgggccttgggttgttgtcgccattcggcatgggcttcgagcacagctggaaggaacttctgaccggccgcagcgcggccaagcgcatcaccgagttcgaggtggaggatcttgcctgcaagatcgcccacgtcgttccgcgtggtgacggcagcaatgccaccttcaatcctgaatccgtgctcgagccgaaggaattgcgcaagatcggtgacttcatcctgtacgggattgccgccgccgacgaagcgctgaaggattccggctgggagcccaagacccacgaggagcaatgcgccaccggcgtgctcatcggttccggcattggcggcatcgagggcatcgccgagaacgcgatgatcctcaaggaacgcggtccgcgccgcatcagccccttcttcatcccgggccagatcatcaatctcgtctccggccaggtttcgatccggcacgggctgaaaggtccgaaccatgccgtcgtcacggcctgctcgaccggcgcgcatgccattggcgatgcggcccggctgatcatgtggggcgatgccgacgtcatggtcgccggtggcgcggaggcgccggtgaccagactttcgatcgccggcttcgccgcctgccgggcgctgtcgaccgagcgcaatgacacgccgcagacggcgtcgcgtccctatgaccgtgaccgcgacggcttcgtcatgggcgagggcgccggtgttgtggtgctggaagaactcgagcacgccaaggcgcgcggcgccaagatttatgccgaggtgaccggctacggcctcaccggcgatgcctatcacatcaccgcaccggccgaagacggcgatggcgctttccgttgcatgaccgcggcgttgaaccgggccaagcttacgcccgccgatgtcgactacatcaacgcgcatggcacctcgaccatggccgacacgatcgaactcggcgctgtcgagcggcttgtcggcaacgccgcgtcgaagatttcgatgtcgtcgaccaagtcgtcgatcggccatctccttggtgcagcgggagccgccgaagcgatcttttcgatccttgcgatcagggacaatgtcgcgccggcgaccatcaacctcgacaatccagagcgcgaaaccgcgatcgacctggtgccgaacaagcctcgctcccgccagatcgacgttgcgctctccaattccttcggcttcggcggcacaaacgcatcgcttgtgttccagcgctacaatggctga

SEQ ID NO: 36010 - DNA, 765 bp, Mesorhizobium loti
atgagcaaagccactgccgcggccctggtgacgggcggggcgaaacggatcggcaaggcaattgtcgaagacctcgccggccatggttttgccgtcgccatccacgccaatcgctcgcagggcgaggcggatgccttggcggcggggatcaaccagtctggcggccgcgccaccgtggttggggcggacttgaccgacacgaatgctgtcgccggcctcgttggtcaggcggaggccgcgttggggccgatctcgctgctggtcaacaatgcttcgcttttcgtcgatgattcgatcgaggatttcgattggcaggcctgggaccgccactttgccatccacgtgaaaacgccggcgctgttggcgcggaatttcgcccgcgccttgcccgaagggcgcgaggggctgatcgtcaacatcatcgatcagcgcgtctggcgcccgacgccacgctacttctcctacgcgctgtcgaagtcggctttgtggacccagacgcagatgctggcgcaggcgctcggcccgcgcattcgtgtcaacgcgatcggtcctggcccgacactgaagaatgtgcgccaggacgattccgattttgacgcacagctcgctggcctgatcctgaagcgcggcccggaattgccggaattcggcgccaccatccgctatctctgggatgcgcgctcggtcaccggtcagatgatcgcgctcgatggcggccagcatcttgcatggcagacgcccgatgtgacaggcatgacggaatga

SEQ ID NO: 36011 - DNA, 423 bp, Mesorhizobium loti
atggcgctcgaacgcaccttttccatgatcaagccggacgctacccggcgcaacctcaccggcgccatcaccaagatgctggaagacgccggcctgcgcgtcatcgcttcgcgccgcgtctggatgagccgccgtgaggcggaaggtttctacgccgtccacaaggaccgccctttcttcggcgaactggtcgagttcatgtcgtcggctccgacgatcgtccaggtgctggaaggcgagaacgccattgccaggaaccgcgaagtgatgggcgccaccaacccggccaacgccgccgaaggcaccatccgcaaagtgcacgcgctgtcgatcggcgagaattcggtgcacggctccgacgcgccggaaaccgcggcgcaggagatcaagtactggttctcggacaccgagatcgtcggctga

SEQ ID NO: 36012 - DNA, 2094 bp, Mesorhizobium loti
atgaacctcgccgcccatgattcgacctttttggaatcggccgtcgcgcccgcctatctcgcgcggctgaacgacgcccagcgccaggccgtcgagcatggcgacggcaagatcgcagggccgttgctggtcattgccggcgccggctcgggcaagaccaacacgctggcgcatcgcgtcgcccatctgatcgtcaagggggccgacccgcgccgcatcctgctgatgaccttttcgcggcgcgccgcatccgaaatggcgaaacgtgtcgagcgcatcgccggcgaggtgctcggccgcgacgccgcggtcatcaccgatgcgctgacctgggccggcacttttcacggcatcggcgcccggctgttgcgcgactatgcgctggagatcggcctcgacccggccttcaccattcacgaccgcgaagattccgccgatctgatgaacctggcgcgccacgagctgggtttctcgaagaccgaagcgcgctttccgaccaagggcacttgccttgccatctattcgcgcgccgtcaacgcgcaggcgccgctcaatgaagtgcttggttccgcctttccctggtgtgccggctgggccgagcagttgaagcaattgttcgccggatatgtcgaagccaagcaggcgcagaacgtgctcgattacgacgacctgctgctctactgggcgcagatgacggccgagccggagatcgcggagcatctgggttcgcgtttcgaccatgtgctggtcgacgagtatcaggacaccaatcgcctgcaggcctcgatcctgatggcgctgaaacccgatggcgccgggctgacggtggtcggcgacgatgcgcagtcgatctattccttccgcgccgccgaggtgcgcaacattctcgattttccccggcagttcgcgcaggcagccgatgtggtgatgctggagcgcaattaccgctcgacggaaaccattctggccgctgccaatgcagtgatcggcgaggcctcggagcgcttcaccaagaacctttggtcggagcgcaaatccaccgacaagccaaggctggtgagcgtccgcgacgaggtcgagcaggcaaactttgtctgcgataccatcctcgccgagcgcgaggccggtacggcactgaaatcgcaggcagtgctgtttcgcgcctcgcaccacagcgggccgctggagatcgaactgacgcggcgcaacattcccttcgtcaaattcggcggcctgaaattcctcgatgccgcccatgtcaaggatgtgctggcggtgctgcgtttcgccgaaaacccgcgcgaccgcgtcgccggctttcgcgtcctgcaactgatgccgggcattggcccttccgccgccgcgcagatcgtcgagacgatgacgacggcgcttgacgaggcgatggggctggccggctggcggccgccgcaacgcgcggcggacgactggccgggcttcgtctcgctctattcgggcctgcgggccggcgccaaatggccggccgatctcgaacaggtcaggctctggtacgagccgcatctggaacgcatccatgaggatgccatcacacgccgcgccgacttgttgcagctggagcagatcggctcgggctacgcctcgcgcgaacgcttcctgaccgaactcacgctcgatccgccggatgcgaccagcgaccaggctggaccgccgcatcgcgatgaggactatctgattctctcgaccatccactcggccaagggccaggagtggaagaacgtcttcgtgctcaacaccgtcgatggctgcattccggccgatctcggcgtcggcaccaaggaggacatcgaggaggagcgccggctgctctatgtggcaatgacgcgggccaaggacagcctcaacctggtcatgccgcagcgcttctttccgcatggccaggccgcgcgcggcgaccgtcacctctacgcctcgcgcacccgcttcatccccgcctcgatcctctccgcgttccagcagatgtcgtggccgggcgcacaggcggcacagggcagggcgcctcggccggacgtgcgcgtcgacatcggcgcgcgcatgcgcggcatgtggaaatag

SEQ ID NO: 36013 - DNA, 795 bp, Mesorhizobium loti
gtggaaatagctgaaatcatggcgcaaccgccgatcaggatcgccatcgccggggcgctgggccgcatgggccgccagatggtggaggctgtgcaggcagatccgcggctggcacttgccgcccgctttcaccgcccagatagtgtcggcgacgggctggtgagccgcgacgaggcgcttgccatggccgatgtggtgatcgatttcaccacgccggcggcctcggccgatctggcgagggttagcgcaaaccggggcggtcccgctttggtgatcggctctaccggtttcgatgccgccgaactggctgatatagcggatgccgcgaaaacagttcccatcgtccgctccggcagtttttcgctcgggctcaacatgctggtcggactggtcgagcaggcggcgagagcgttcgcgcccgaagattgggacgctgagattttcgaggcgcatcatcgccacaagatcgacgcgccgtcgggcaccgcattgatgctgggacaggccgtcgccggtggacgcggcgccgaactggacgcggtcgcaaggcgcgtccgcgacggcgtcaccggcgcgcggccgcccggcgagatcggctttgcggtggttcgcgggggcagcatcgtcggcgaacacagcgtcagcttctgtgccgaaggcgagcttgttaccttgtcgcacgctgccggcgatcgcatcatgttcgcccgtggcgccatcgccgcggcactctgggtgtcgggacgcccgcccggcgaatacgatatgcgcgacgtgcttgggtttgaccgctga

SEQ ID NO: 36014 - DNA, 1398 bp, Mesorhizobium loti
gtgaccgttgcaaagaccagaaccgaaaccgatacgttcggccccatcgaggttgccgccgaccgttattggggcgcgcaggcgcagcgttccctgggcaatttcaagatcggctgggaaaaacagccggcgtcgatcgtgcgggcgctgggggtcgtcaaacgggcggcggcggaagtgaacatggagatgaagcggctcgatccggtcgtcggcaaggcgatcgtcgacgccgcccaggaagtgatcgacggcaagctcaacgaccatttcccgctggtggtctggcagaccggctcgggcacgcagtccaacatgaacgccaatgaagtgatctccaaccgggcgatcgagatgctgggcggcgtcatgggctcgaagaagccggtgcatcccaacgaccacgtcaatatgagccagtcttcgaacgacacctatccgacggccatgcatatcgcctgtgccgaacaggttgtccatcatctcatcccggcgctgcaccatctgcacaaggcgttggacgccaaggccagggccttcaaccacatcatcaagatcggccgcacccacacgcaggatgccacgccgctgacgctgggccaggaattttccggctatgcggcgcaggtcgcctcctcgatcaagcgcatcgaaatgacgctgcccgggctgcaggagctggcgcaaggcggcaccgccgtcggcaccggcctcaacgcgccagttggttttgctgaaaaggtggccgaccgcatcgccgccatcaccggcatcgccttcgtcaccgcgccgaacaagttcgaggcgctcgcggcccacgattccatggtgttctcgcacggcgccatcaacgccgcggcggcagcactcttcaagatcgccaacgacatccgcttcctcggttcgggcccgcgctcgggcctcggcgaattgtcgctgccggaaaacgaacccggctcgtcgatcatgccgggcaaggtcaacccgacgcagtgcgaagcgatgacgcaggtctgcgtgcaggtgttcggcaacaatgcggccctgaccttcgccggcagccagggccatttcgagctcaacgtctacaaccctttgatggcctacaatttcctgcagtcggtgcagctgctctccgacgcctcggtctccttcaccgacaattgcgtcgtcggcatcgaggcccgcgaagacaacatcaaggccgcactcgaccgctcgctgatgctggtgacggcgctggcgcccaccatcggctacgacaacgccgccaagatcgccaagacggcgcacaagaacggcaccacgctgcgcgaggaagcgctggccaccgggctggtcagcgaggtcgattatgaccggctggtgcggcctgaggacatgacgcatccggggtaa

SEQ ID NO: 36015 - DNA, 774 bp, Mesorhizobium loti
atgagacttctgcacaagcgcacgctggtgaccggcggctcggacggtatcggcctggcaatcgccgaggcgttcctgagcgagggcgccgatgtcctgatcgtcggccgtgacgccgccaagctcgaagccgcgcgccagaagctggcggctcttggccaggccggcgcggtggagacgtcgtccgccgatcttgccaccagcctcggtgtcgcaaccgtcgtcgagcaggtgaaagagaccggccggccgctcgacattcctatcaacaatgccggtgtcgccgacctcgtgccgttcgagagcgtcagcgaggcgcagttccagcactccttcgcgctcaatgtggcggcggcgttcttcctcacccaggggctgctgccgcatttcggcgccggtgcatcgatcatcaacatctcttcctatttcgcccgcaagatgatcccgaagcggccatccagcgtctactccctgtccaagggcgcgttgaactcgttgaccagatcgctggccttcgagctcggcccgcgcggcatccgcgtcaacgccatcgcgcccggcacggtcgacaccgccatgcggcgcaagaccgtcgacaacctgccggccgaggccaaggccgaactgaaggcctatgtcgaacgcagctatccgctgggccgcatcggccgtccggacgacctcgccggcatggcggtttatctagccagcgacgaggcggcctggacgagcggtgggatctttgccgtggatggtggctacacggccggatga

SEQ ID NO: 36016 - DNA, 1011 bp, Mesorhizobium loti
atgcgcagctatcgtcttgacgggtcgagcgggaccgaatgcctggtgatgcgcgacgagccagaaccacagccgaagccgcatgaaatcgtggttcgcatccgcgccgcctcgctcaaccgccgcgacacgatgatcctcaacggcacctatccgctgcagccgcgccagagcgtcgttccattgagcgacggagctggtgacgttgtcgccatcggcgatgccgtcacccgcttcgccgtcggtgaccgtgtcaccggcagctatttcgcccgctggatcgacggccgcatcaacgccgggctcatcgaccagctcggctgcacgctggacggcatgctggcggaatatgcggttctcgacgaacaatgggcggctcgcctgcccgatcatctcgactggcatgaggcggcgacgctgagctgcgccggcgtgaccgcctggaacgcggtgacgggtgccggaattccaaagcccggccaatgggttctggtcatcggttcaggcggcgtctcgctctttgcactgcagttcgccaagctgctcggctgccgcgtcgccgccgtcacctcgcgcggagagaaggccgacaggctacggacgctgggcgccgaccttgtgatctcgacgtcggatatgcccgaatggggtgcggccgtccgcgaccagaccggcggtgtcgatctcgtcgtggagaccggcggcccggcgaccttcgcgcagtcgctgatcgccagcacgctttacggacacatcgtgctgctcacgctgcaggatgcgaaaggcggatcgatccagatcccggcggcactgtaccagcgcagcctcgccaccatcagccgcctcttcgtcggcagccggagcaacctcgaagccatgctgcgcgctgtttcgcagcaccgcctgcggcccgtcatcgacaaggtctttgccttcacccaggcccgcgatgcctatcgctacttccagcagggcgacgtcttcgggaaggtggtcgtcgacggcgcctga

SEQ ID NO: 36017 - DNA, 1656 bp, Mesorhizobium loti
atggctgctaaagacgtaaaattctctcgtgatgcccgtgagcgcatgctgcgcggcgtcaacatcctcgccgacgcggtgaaggttacgctcggccccaagggccgcaacgtcgtcatcgacaagtcgttcggcgccccgcgcatcaccaaggacggcgtcaccgtcgccaaggaaatcgagcttgaggacaagttcgagaacatgggcgcgcagatggtccgcgaagttgcttcgaagaccaacgacatcgccggcgacggcaccacgaccgcgaccgttctggcgcagtcgatcgtccaggaaggccacaaggcggttgccgccggcatgaacccgatggacctgaagcgcggcatcgacctcgccgtcagcgaagtcgtcgcggcgcttggcaaggctgccaagaagatcaagacctccgaggaagttgcccaggtcggcacgatctcggccaatggcgacgagtcggtcggcaagatgatcgcggaagcgatgcagaaggtcggcaacgaaggcgtcatcacagtcgaggaagccaagaccgccgaaaccgaactcgaagttgtcgaaggcatgcagttcgaccgcggctatctctcgccctacttcgtcaccaacgccgacaagatggttgccgatctcgaggacgcctacatcctgctccacgagaagaagctctccaacctgcaggccatgctgccggttctcgaagccgtcgtgcagacctcgaagccgctgctcatcatctcggaagacgtcgaaggcgaggctctggccacgctggtcgtcaacaagctgcgtggcggcctgaagatcgccgccgtcaaggctccgggcttcggtgatcgccgcaaggccatgctggaagacatcgccatcctcaccggtggccaggtcatctcggaagacctcggcatcaagctcgagaatgtcggcctcaacatgcttggccgcgccaagaaggtgtcgatctccaaggagaacaccaccatcgtcgacggcgccggcaagaaggcagagatccaggggcgcgttgcccagatcaagcagcagatcgaagagaccacttcggactacgacaaggagaagctgcaggaacgtctcgccaagctcgcgggcggcgttgcggtgatccgcgtcggcggtgcgacggaagtcgaagtcaaggaaaagaaggatcgcgttgacgatgcgctgaacgcgacccgcgcggccgtggaagaaggcatcgttgccggcggtggcgtggccctgctgcgcgcttcggccaacatcaaggctgccggcgccaatgccgaccaggccgctggcatcaacatcgtgcgtcgcgctctgcaggctccggcccgccagatcgcctcgaacgccggtgcggaagcatcgatcgttgccggcaagatccttgagaacaagggcgcgaccttcggctacaacgcccagaccggcgaatatggcgacatgatcgccatgggtatcgtcgatccggtcaaggttgtgcgcacggctctccaggatgcggcctcggtcgccggcctgctcgtcaccaccgaagccatgatcgcggaggctccgaagaaggagtcggctggcggcggcatgcctggcggcatgggcggcggcggcatgggcggcatgggtggcatggacttctaa

SEQ ID NO: 36018 - DNA, 297 bp, Mesorhizobium loti
atggcaaagtcgaagttccgcccgcttcatgaccgcgtggtcgttcgccgggtcgaatccgaatccaagaccgccggcgggatcatcatcccggatacggcgaaggaaaagccgcaggaaggcgagatcatcgccgtcggctccggcgcgcgcgacgaaagcggcaagctggtccccctggacgtcaaggctggcgaccgcatcctgttcggcaagtggtcgggcaccgaagtcaagctcaatggcgaagaccttctgatcatgaaggaatccgacatcatgggcatcatcggctga

SEQ ID NO: 36019 - DNA, 1389 bp, Mesorhizobium loti
atgatatccagggctgaatggctgcggacaacactgctggcaacctcgctggccttcacgttcaccggccccgtgctggccgacagtaccgcgttgcccgacaagacgccggccgagttcaaggtgacggattttctgctcgacaacggcatggaagttgtcgtcattcccgaccatcgcgcgccgatcgtcacccatatggtctggtacaagataggcagcgccgacgagccgcccggcaaatccggcatcgcccatttcttcgagcatctgatgttcaaggcaacgaccaatcacgccgccggcgagttcgaccgcgccgtctccgacattggcggctccaacaacgctttcacctcctacgactacaccgctttccacgagacggtggcgccgtcggcgctcgagcagatgatgggtttcgaggccgaccgcatgcgtaacctcatccttaccgacgacgtcatcaagaccgagcgcgatgtcatcctggaagagcgccgctcgcgcattgacaacaatccgcaggcggtgctcgacgaggaagtcgatgccacgctgtggcagaaccagccctaccgcattccggtcatcggctggatgcaggaaatggagcagctcaaccgcaccgacgccgtcgccttctatgacaaatactaccggcccaacaacgccgtgctgatcgtggccggtgatgtcgagccggagacggtcaaggcgctggccgaaaagacctatggcaaggtggcgcgcggaccggacctgccgccgcgcatccgcccggtcgagccggagcagaacaccaagcgcaccgtcacgctcgccgacgcccgcgtcagcgtgccgagcttctcgacgcaatgggtggtgccgtcctatcacaccgccaagccgggcgaggccgaggcgctcgacctcttggccgagatcctcggcggcggcaaccgcagccggctctaccaggcgctggtggtcaagcaaggcatcgcttcgaacgccggcgcgtatttccagggcaccatgctcgacgacaccaatttcaccgtctatggcgcgccgcgcggcgacgccaagctcgccgacgtcgaggccgccgtcgatgccgaggtggcgcgcatcgccagcggcggcgtcacaccggatgagctcgaaaaggccaaggaccgctatatcaggtcgatggtttttgcccgcgataagcaggattccatggccgaaatctatggctcgacgctggccaccggcggcaacgtgcaggatgtccagcaatggccggaccgcatccgcaaggtcacggcggacgaggtcaaggccgtcgccgcgcgctatctggtgctggcccgctcgacatcaggctatctcttgccgcagcaacaggcggggaattga

SEQ ID NO: 36020 - DNA, 1377 bp, Mesorhizobium loti
atgacgaaccagcaccgcgcctctttcccttctcccacaaggggagaaggaagaacgcgcaccgccctcgcaaccctcttcctctccatcctgttcctgatcctgccggcacttgccgcccgcgcgatggacatccagcaggtcacctcgccaaaaggcatcaccgcctggctggtcgaggactattccgtaccgatcgtcgccgtccgtttcgtcttcggcggcggctcgacgcaggatccggtgggcaaggaaggactgaccaatctgatgaccggcctgttcgacgagggcgccgggcctcttgattcggaagccttccaggtcaggctcgacgatgccggcgcagagatgagcttcgaagagacccgcgacggcgtctatggctccatgcgcatgctggccgagcagcgcgacgaggccttcgacctgttgcggctggcggtcaacgagccacgcttcgaccaggcgccgatcgaccgcatccgcgcccagatcctgtccggcatcatcgccaacgagaacgatcccgacacggtggcgcagcacagatgggcgcgcgccgtctatggcgaccatccctattcgcgctccgaccagggcaccaggcagagcatcgccgccatcaccaaggacgatctgaaggccctgcacaaggcggtgttcgctcgcggcggcctgcacgtcgccgtggtcggcgccatcgacgccgagacgctgaagaagaagctggacatggtgttcggtgacctgccgcagaaccaggcgctcaccccggtcgccgatgtcgagccgaagctggcgcagcgcgtcgaggtcaattacgacctgccgcagacctcgctgcagctcgcctggccgggcgtgaagcgcaagtcggcggatttctttcccgccgtgctgatgaacgagatccttggcggcggtaccttcacctcgcgcctgttcgcggaggtgcgcgaaaagcgcgggctggcctacagcgtcaattcctcgctggtcaaccaggaccatgccgacgcgctgatcgtcaccacgggcacgcgttcggaccgcgcggccgagacgctcggcatcgtgcgcgatgtcgccaggcagttggctgaggaaggcccgaccgaggctgaactggcggcaaccaagaaatacctcatcggcgcctatgccatcaccaatctggactcttcgagttccatcgccgcgacgctggtcgaattgcagctcgacgatctcggcatcgactacatgcagcgccgcgccggctacatcaacgcggtgacgctcgaccaggtcaaggcggctgcgaaaaagctgctgacagccgagccgaccatcatggtggtcgggccgccgctggccggagccggcaagggatga

SEQ ID NO: 36021 - DNA, 1884 bp, Mesorhizobium loti
atgcccattcgccagctttccgaaacgatgatcaaccagatcgccgccggcgaagtcatcgagcgtccggcgagcgtggtcaaggagctggtcgagaatgctctcgatgccggtgcgtcccgggtcgaggttgtcacggcaggcggtgggctgaacctgatccgcgtcaccgatgacggttccggcatccccgaaccggagctggcgctggcgattgcgcgccactgcacctccaagctcgccgaggatatcaacgacatccgctcgctcggctttcgcggcgaggcgctgccgtcgatcggctcggtgtcgcggctgtcgatccgctcgcgcaccgctttgggcgacagcgccgccgagatcggcatcgagggcggccgcgtactccccgtcaggcccgcggcggccaatcgcggcaccacggtcgaggtgcgcgacctgttcttcgccacgccggcgcggctgaaattcatgaagggcgagcgcgccgaaagctcggccaccagcgatgtggtcaagcgcatcgccattgccttcccggccgtgcggttcactctggccggttcggaccgctcgacgctggaattgccggcgaccgacgacagtccggaaggcagcctgcgccgcgtcgcccaggtgatgggggccgagtttcccgacaattccatcgccatcgacgcgatgcgcgaaggcgtgcatctgaccggccatgtctcgatcccgtccttcagccgcgccaacgcgctgcagcaatacgcctatgtcaatggcaggccggtgcgagacaagctgatcgccggcgccatccgcggcgccttcgccgacgtgctgccgcgcgaccgccacgcagtgacggtgctgttcctgacgctcgatccggccatcgtcgacgtcaacgtccatcccgccaaggccgatgtgcgcttccgcgatccgggcctggtgcgcgggctgatcgtcggcgccatccgccaagcattggccgatgccggcatccgctcggccaccacgggagccgccggcatgatggcggcattccggccgggagcggcatcctataaccacggcggcccggccaatggccatcgcagctacgaagcagcttatcgcgcgtccggctccgccggcttcgaccccgcgcgctcgccgcagcggccgctcgacatgcaattcggagacttcgaacgcgccggcgcaaggcatggcgggtttagcgaacccggtcaggcggctttcgacaccggcccgcttgtcagcgccgatgcgcgcgtcgggcagaacgagacgacggagacgctgctcggcacggtgctcggtgcggcacgcgcgcaggtgcatgagaactatatcgttgcgcaaaccagggattcgctcgtcatcgtcgaccagcacgcggcgcatgaacggctggtctatgaggcgctgaagaacgcgctgcattcgcgccccgtgccctcgcagatgctgcttctgcctgagatcatcgacctgccggaagaggatgccgagcggctggccatgcattccgaaacgctcgcccgcttcggcctcggcatagagcgtttcggcccgggcgccgttgccgtgcgcgagacgccgtcgatgctgggcgaaaccaatgtccagcaattggtgcgcgacctcgccgacgaaatcgccgacaacgacacggtcgagacgctcaaagagcggctggacaagatcgccgccaccatggcctgccacggctcggtgcgttccggccggctgctcaaggccgaggagatgaacgcgctgctgcgccagatggaggcgacaccgggatccggcacctgcaaccatggccgcccgacctatatcgagctcaagctcgccgatatcgagcggctgttcgggcggcggtga

SEQ ID NO: 36022 - DNA, 1188 bp, Mesorhizobium loti
atgaccgcagcttttctctcccatatcgacagcgaacttgccgggctcaaatcggccggcctctacaagtccgagcgggtgatttcctcgatgcagtcggcacagatcgaggtcggcggcgagaaggtgctgaacttctgcgccaacaactatctcggcctcgccgataacgccgacctgcgaaaggcggcctcgcaggctctggaccgctatggctacggcatggcctcggtacgcttcatctgcggcacgcaggaggaacacaaggagctcgaggcgacgatctcgtccttccttggcctggaagacaccatcctctatggctcctgcttcgacgccaatggcggcttgttcgagacgctgcttggcgaggaagacgcgatcatctcggatgcgctgaaccatgcctcgatcatcgatggtgtcagactgtcgaaggccaagcgcttccgctacgccaacaacgacatggccgatctcgaggcgcggctgaaggaagccagggattgccgcttccggctgatcgccaccgacggcgtgttttcgatggacggcatcatcgccaacctgaagggcgtctgcgaccttgccgacaaatacgatgccatggtcatggtcgacgacagccatgcggtcggcttcgtcggcaggcaaggccgtggctcggccgagcattgcggcgtcgagggcagggtcgacatcgtcaccggcacgctcggcaaggcgctcggcggcgcttccggcggctacacatcgggcaagaggcaagtggtcgactggctgcgccagcgctcgcgaccctatctgttctccaacacgcttatgccggcgatcgccggcgcctcgatcaaggtgttcgagctgatccgcaatggcgacgccttgcgcgaacgcctctatgccaatgcggcgcgattcaggtctgagatgggcaagctcggcttcacgctggccggcgcggaccacccgatcatccctgtgatgctgggcgaggcgacgctggcgcaggagatggcggcgcgcatgctgaagcgcggcatctatgtcatcggcttttccttcccggtggtgccgaaaggccaggcgcgcatccgcacgcaaatgtcggcggcgcataccagcgccgatatcgacagggcggtcgaggccttcggcgcggtcggcagggaactgggcgtgattgcctga

SEQ ID NO: 36023 - DNA, 1035 bp, Mesorhizobium loti
atgtcgaacatgatgaaggcgctggtgaaggccaaggccgaaccgggcatctggatggaagaggtgccggtgccggagatcggccccaacgacgtgctgatcaagatcaggaagacggcgatctgcggcaccgacgtgcacatctacaattgggaccagtgggcgcagaagaccgtgccggtgccgatggtgaccggccatgaatttgtcggcacggtggccgattttggcgccgcggtcaccgaatacaaggtcggccagcgcgtctcgggcgagggccacatcgtctgcggccactgccgcaactgccgcgccgggcgagggcatctctgccgcaacacgctcggcgtcggcgtcaaccgccccggcgccttcggcgagtatctggcgatcccgcaacacaatgtcgtgccgatccccgacgatgtgccggacgagatcgccgcgatcttcgatcccctgggcaatgcggtgcatacggcattatccttcgatcttgtcggcgaggacgtgctggtcaccggcgccgggccgatcggcatcatgggcgcgctcgttgcccaatgcgtgggcgcgcgaaaagtcgtcatcaccgatatcaacccggtgcggctggcgctggcgaagaaactcggtgtccagcatgtcgtcgacgcctcgaaggaaaagctgcgcgatgtcatgccagtgctcggcatgaccgagggttttgacgtcggcctcgaaatgtcgggcgccgcccccgccttccgcgacatgatcgacaccatgaacaatggcggcaagatcgccattctgggcatcgcgcccaccggcttcgagatcgactggaacaaggtcatcttcaagatgctgcatctcaaaggcatctacggccgcgaaatgttcgagacctggtacaagatgatcgcgctggtccagggtcctctggatgtttcgggcctgatcacgcaccgcatcggcatcgacgatttccaggaggggttcgatgcgatgcggagcggcagttccggcaaggtggtgatggattggtag

SEQ ID NO: 36024 - DNA, 1374 bp, Mesorhizobium loti
ttggtcaataccggcagacttggctttgtgaagcttggagccgggatcaaggaggatcggatggccttttcctacatgccgggtttcggcaacgattttgagaccgagacactgcccggctcactgccgcagggccggaactcgccgcagcggccggcctacggcctctatgccgagcagctttccggctcgcccttcaccgcaccgcgcggcaccaatgagcgctcatggctctatcgcatccggccaagcgtcaagcacaccggccggttcaaggcagcgagctatcccctgtggaagaccgcgcccaatgtcggcgaccacgaactggcgcttggccagtatcgctggaatccggtgccgatgccgaaggagccgaccgatttcatccagggcatgcgcagcataaccacggccggcgacgtgctcgggcagaccggcatggcagcccatgtctatgttgccaaccgctccatggtcgacgatcatttcttcaatgcggacggcgagttgctggtcgtcccgcaggtcggcgccttgcgcttcgtcaccgaaatgggtgtcatcgagcttcggcctggcgagatcgccgtgctgccgcgcggccttgtcttcaaggccgagctggtcgacaaggacgtgcgcggctatgtctgcgaaaactacggcgccaagctgaccttgcccgatcgcggcccgatcggcgccaattgcctggccaatccgcgcgacttcaagacgccttgcgcctggttcgaggagaaggagacgccgtgccggctgatcgtgaaatggtgcggcaatttccacgtcaccgagatcggccattcgccgctcgacgtcgtcgcctggcatggcaactacgcgccctacaaatatgatctggcgaccttttcgccggtcggcgccatcctgttcgatcaccccgatccatcgatcttcaccgtgctgacggcgccgagcggcgaggaaggcacggccaacatcgacttcgtcatcttcccgccgcgctggctggttgcggaagatacgttccgaccgccctggtatcaccgcaacatcatgagcgagttcatggggctgatccacggccagtacgatgccaaggaagaaggcttcgttcccggcggcatcagcctgcacaatctgatgctggcccatggcccggatgcgcccggcttcgaaaaggcctcgcgcgcggacctgaaaccggtcaagctcgacaacaccatggccttcatgttcgagacccgtttcccgcagatgctgacccgctacggcgccgagctggaaacccggcaggacaattacatcgactgctgggccgacctgaagaagcgttttaacggcacgcccgagggcgactggtcttga

SEQ ID NO: 36025 - DNA, 1116 bp, Mesorhizobium loti
atgggtcccttcccgcacgacgccccgcccgccaaaatcagcaaggacaacccggccggcaccgatggtttcgagttcgtcgaattcgcgcatccggagccgcagaagctcgccgagttgttcacccgcatgggctatgcagcggtcgccaagcaccgtaccaaggacatcaccgtctggcgccagggcgacatcaactatgtcgtcaatgccgagccgggctcgcatgccatgaaattcgccgacaagcacggcccgtgtgccgcctcgatggcctggcgcgtggtcgatgccaagcatgcgttcgaccatgccgtctcgaagggcgccacgccttacgaaggcgaagacaaggcgcttgacgtgccgaccattgttggtatcggcggttcgctgctctatttcatcgatgcttacggcaaaaagggctcggcctacgacgccgaattcgaatggcttggtgcgcgcgacccgcggccgcaaggcgtcggtttctattatctcgaccacctcacccacaatgtctatcgcggccagatggacaagtggtgggatttctaccgcgaactgttcggcttcaagcagatccatttcttcgatattgacggcaagatcaccggcctggtcagccgcgccatcacctcgccctgcggcaagatccgcatcccgctcaacgaatccaaggacgagaccagccagatcgccgagtatttgaagaagtacaatggcgagggcatccagcacatcgcggtcggcaccgacgagatctatgccgccaccgacaagctggccgccaacgggctgaaattcatgcccggcccgcctgagacctattacgacatgtcgtacgaccgggtgaacggccatgacgagccgatcgagcggatgaagaagcacggcatcctgatcgacggcgaaggcgtggtcgacggcggcatgacgaagatccttttgcagatcttctcgaaaaccgtgatcggcccgatcttcttcgagttcatccagaggaagggcgacgaaggcttcggcgaaggcaatttccgcgcgctgttcgaatcgatcgagcaggaccagatcaagcgcggcgtgatcaaggtggatggcaaggcggcataa

SEQ ID NO: 36026 - DNA, 1542 bp, Mesorhizobium loti
atgaccgaactgaccctgaagcccggcaacgcgacgctagccgactggcgcgccatctaccgtggcgccgtgccgaagctggatgaggcttgccgtccaaaaatcaaggcgagcgccgaggctgtcgccaggatcgtcgccaagggcgagccggtctatggcatcaacaccggcttcggcaaactggccagcgtgcgcatcccggccggcgatctcgagaccttgcagcgcaacatcgtgctgtcgcacgccgccggcgtcggcgagccgatgccggtcgcaattgcccgcctgatgatggcgctgaagcttgccagcctggcgcagggcgcctcgggcgtgcgccccgaaaccatcgatttgctgcaagcgatgctcgccaacgacgtcatcccggtggtgccggcgcaaggctcggtcggcgcgtccggcgatctcgcaccgctgtcgcacatgacggcggtgatgatcggcgtcggcgaatgctttaccccgcatggccggttcccggccaaggtcgctttcgtctcgcacggcctcgagccggtgacgcttggcgccaaggaaggcctggcgttgctcaacggcacgcagttctcgaccgcctatgcgctcgccgctttgttcgaagccgaagtgctctaccaatcggcgctggtagccggtgcgctgtcgaccgatgccgccaaggggtccgacgcgcctttcgacccgcgcattcatctcttgagaaagcaccgtggccagatcgagacggcggaggcgctgcgcaatctgatggccggcagtgccatcagggaatcgcaccgtgtcggtgacgagcgcgtgcaggacccctattgcctgcgctgccagccgcaggtcatgggcgccgcgctcgacgtgttgcgcaaggctgccgatacgctcggcaccgaggccaatggcgtcaccgacaatccgctgatcttcgccgaggacgatacggcgctctccggcggtaatttccacgccgagccggtggcttttgccgccgacatgatcgctcttgccgtctgcgagatcggctcgttgtcggaacgccgcatcgccatgctggtcgatcccgcactgtccggtatgccggccttcctgacgcccaagcccggcctcaactccggcttcatgatcccgcaggtgacggcggccgcactcgtttcggaaaacaagcagaaggcctatccggccagcgtcgattccattccgacctcggctaaccaggaagatcacgtctcgatggccgcgcatggcgcgcgccggctgatcggcatggtcgagaacgccacagcggtgatcggcatcgaattgctggcggccgcgcaaggctgtgatttccaccagccgctggcgtcgagcgatgcgctggaggccgtgcgcaagctggtccgagccgaagtgccgcatctcgacaatgaccgccacttccaccccgacatggaaaaggcaatcgccatggtgcgcagcggcgcgaccgtcagggctgccggcgcggtggcattgccgtccatcgcgggagcggcatga

SEQ ID NO: 36027 - DNA, 1773 bp, Mesorhizobium loti
gtgtcacttctgcagatctattggagagcgctgggctatctggccgccgacaagaggcgcgtcgcgctgatttgcggcgccaatgtcgcactggccgctatcgccatcctggagccgatcatgtttggccgggtgatcgatgccatctccgagcatggttcggtattctccacgcttgccgtgtgggccggtttgggcgccttcaacgtcatcgctttcgtcctggtggcgcgcggcgccgaccgctttgctcacgcccggcgcagcgaagtgctgtgccagtccttcgagcgcgtcatcaccatgccgctcgcctggcatcatcagcgcggcacgtccaatgccctgcacaccttgctgcgtgccgttgagacgctgttcagcctgtggctcgaattcatgcgccagcatctgtccacggctgtcgcgctcgtgctgctcgtgccgacggcactcagcatggatgtgcgtatgtcgatggtgctgctggggctcggcgtgctctatgtcggcatcggccgtctggtgatgaagcgcaccaaggcgggccaggcagccgtcgagcgccattaccacaaggtgttcgcgcatgtgacggactccgtcagcaacgtcgccgttctccagagctacaaccgccttggccatgaggccgagacgctgcgtcgctacgtcaagaacctgctcgacgcgcagaacccggtgctcgactggtgggccattgccaatgcgctcaatcgcctgtcgtcgaccatctcgatgatggtggtgcttctgatcggcgcctatctggtgacccatggccagctgcgcgtcggtgacgtcatcgccttcaccggtttcgccacgctgctgatctcgcggctggaccagatgtcggctttcgccaaccagatttcggaggctcgcgccaagctcgaggagttctacaagcttgaggactcggccgccgatgccgccgagccggatggcctgcgcgacctcaccaacgtcaccggccatgtccgctttgaggatgtcggcttcgaattcgccaattcagggcagggcgtcagcggcgtgtccttcgaggttcaggccggccagaccgtcgccattgtcggaccgacgggtgctggcaagaccacgctcatcaatctgctgcagcgcgtcttctcgccgtccactggccgcatcctgatcgacggcatcgatacccgcaccgtaacccgcaagtcgctgcgccattcgatcgccacggtgttccaggatgccggactgctcaaccgctcgatcgaggacaatatccgcgtcggccgcgccgatgcgagcaatgtcgagatccatgccgcggccgtcgcggctgccgcgcaggacttcattctggccaagagcggcggctacgacacggtggtcggcgaacgtggcggccagctgtcaggcggcgagcgccagcgcatcgccattgcgcgtgccgtgctcaaggatgccccgatactggtgctcgacgaggcgaccagcgcgctcgacgtcgagaccgaggaccgcgtcaaggaagcgatcgacgagttgcggcgcgaccgcaccaccttcattatcgcccaccgcctgaccaccgttcgcgacgccgatctggtcgtgttcatggacaagggcagggtggtcgaaatgggtggctttgccgaactgtcgctacgcaacggccgctttgccagcctgctgcgcgccggcggcctgctcaacgatgaggaagtccgccgcctcagccgctccgtgcagggcgaggccgcgtaa

SEQ ID NO: 36028 - DNA, 1446 bp, Mesorhizobium loti
atggcattagcttgctgcggcgcaacaaagcgctcaggggcagagggacggggcactatggactatgacatgctggtcatcggcagcggcccctccggccgccgcgcagcggtgcagtcggccaagctcggcaaatcggtgctggtggtcgatcgcggccggcgtcttggcggcgtctccgtgcacaccggcaccatcccctcgaagacgctgcgcgaaaccgtcctcaatctctccggctggcgcgagcgtggcttttacgggcgcggctaccgggtcaagcaggacatttccgtaggcgacctgatcgagcgcctgcacaagacactcgaccacgaagtcgaggtgctgcagcaccagttcatgcgcaatacggtcaagagcgcgcgcgcggcggtaaaatttctcggccccaacaaggtcagcctgacatcggacaatggcgactacagcgaagtcggcttcgccaacgcgctgatcgcggtcggcaccaggccgcaccggccacgcgatgtgcccttcgacaagacccgcatcttcgacagcgacgagatgctggagatcgaccgcctgccgcgcacgctcacggtcatcggaggcggtgtcatcggcgtcgaatacgctacgatcttttcggcgctcgacgtgccggtgacgctggtcgagccgcgcaactccatcctcgatttcgtcgaccgcgagattgtcgacgacttcatccaccagatgcgcgatcgcggcatgacgataaggcttggcagcgcggtcaaggaaatccgctccaagcccgaagcggccgaagtggaactggccgatggccgcaccattcggtcggaagtcgtgctctacgccgccggccgcaccggcaatgttggcagccttggcctcgacgtggtcggcatcgacgccgactcccgcggccgcatcaaggtcgatccgcagacgtttcagaccaacgtccccaacatctacgccgccggcgacgtcattggctttccgagccttgcctcgacctcgatggagcagggcagggtggccgcctgccacgctttcggcgtgacgttgccgccgccgccggaaacgtttccctatggcatctatgcggtgccggagatctcgaccgtcggccagtccgaggaacaggtgcgtgaaagtggggccgcctatgaggtcggcgtggcgcgtttccgcgagacctcgcgcggccacatcatgggcgtcaacaccggcttcctcaagctgttgttctcgatcgaaacgcgccgcctgctcggcgcgcacatcgtcggcgagggcgcgaccgagctcatacacatcggccaggccgtcatcaatctcggcggcaccgtcgacttcttcgtcaacaacaccttcaactacccgacactggcggaagcctacaagatcgccgggctcgatgcctggaacaggatggggcgaggctga

SEQ ID NO: 36029 - DNA, 1032 bp, Mesorhizobium loti
atgaacaaattcaccccgacaaagccggccggcgcgcgcagcgtcgacgacgtcaccggcagccgccgcctgcgccgcatgcgcaaggccgactggtcgcgccgcctggtgcaggagaaccggcttacggtcgacgacctgatctggccgattttcgttgtcgagggcaggaacgtacgcgagccgatcgccgccatgcccggcgtcttccgcctgtcggtcgatcttgccgtcaaggaggctgaacgcgcggccaagctcggcattccggcgctcgccaccttccccaatgtcgaactggccttacgcgaccagaccggctcgcacatcctcgacccggaaaacatcatcaaccgcgccacgcgcgcgatcaaggacgcggtgcccgggatcggcatcatcaccgacgccgcgctcgacccgttcaccagccacggccatgacggcatcctgcgcgacggcatcatcgtcaacgacgaaacggtcgaacaggtcgcggcggcggccgtcatccaggcagcggccggcgccgacatcatcgcgccttccgacatgatggacggccgcatcggcgccatccgcgacgcgctcgacgccaatggttttcaggacgtggcgatcatgtcctatgcgaccaagttcgcctcggccttctacggcccctatcgcgaggccgtcggcaccgccggcctgctcaagggcgacaagaagacctactacatcgaccatgccaattcggacgaggcggtgcgcgaggccgagcaggacatcgccgagggcgccgacatgctgatggtcaagcccggcctgccctatctcgacatcatccgccggctgaaggacgaattccagatgccgaccttcgcctaccaggtgtcgggcgaatattcgatgatcaaggcggcgggcgccaatggctggatcgacggcgagaaggcgatgctggaatcgctgctcgccttcaagcgcgccggctgcgacggcatcttgacctatttcgcgcccgaagtggccgaaatgctgaaggggtag

SEQ ID NO: 36030 - DNA, 972 bp, Mesorhizobium loti
ttgatcagatcagtcgtgcgcggcatgggcgccgcgctgccccgccgcatcatgaagaatgccgatttcgagggcatggttgaaacatcggatgagtggatcgtccagcgtaccggcattcgccagcgtcatatcgcggctgacgacgagacgactgcttccctgggagaagccgcggcccgcgctgcccttgccaatgccgggctgacgccgggcgatatcgacctgatcgtgctggcgacatcgacgcccaacaacacgttcccggcgaccgctgtcgagatccagaaccgcctcggcatgcatcacggctttgccttcgacatgcaggcggtgtgttcgggcttcgtctatgcggtgacgacagccgacctctacatccgtggcgggctcgccaagcgagttctggtgatcggctcggaaacgttctcgcgcatcctcgactggaacgaccgctcgacctgtgtgctgttcggcgacggtgccggggcactcatcctggaggcgggcgagggggccggcacgattgccgaccgtggtgtcctggcggccagcctgcgctccgacggcgtgcacaaggacaagcttttcgtcgacggcggaccgtcgaccacgggaacggtcggtcacctcaggatggaaggccgcgaagtcttcaagcatgcggtcggcatgatcaccgacgtcatcgaagcgaccttctcggccgccggcatatcggccgacgatctcgactggttcgtgccgcaccaggccaataaacgaattattgacgcatccgccaagaagctcgggatagcagagcaaaaggtggtggttacggtcgatttgcacggtaacacctcggctgcttccgtgccgctggcgctgtcggtggccgttgccgatggtcgcatcaagaagggcgacctcgtcctcctggaagcgatgggcggcggctttacctggggcgccgttctggttcgctggtaa

SEQ ID NO: 36031 - DNA, 1089 bp, Mesorhizobium loti
atgtccaaagccgccgagatcgacatcgtgtccgtttcgaaagtctatggaacgacgaccgccgtcgaggatatcagcctgaagataccggcgggcacctattgctgtctgctcggcccctccggctgcggcaagacctcgacgctgcgcatgatcgccggccacgaaagcatctcgtcgggtgacgtccggctcggcaacaccgtcgtcaccgacctaccgccggccaagcgcggcacggcgatgatgttccagtcctatgcgctgttcccgcatctcgacctcatcgacaatgtcgccttcagcctgaagatgaagggtgtcgacaaggagaagcgccgcgccaaggcgctcgacatgctgaagctgatgcagatggaggcctatgcgaagcgccgcccggcgcagctttccggcggccagcagcagcgcgtcgcgctcgcccgcgccctgatcaccgatcccgaggcgctgctgctcgacgagccgctttcggcgctcgatccgttcctgaagatccgcatgcgtgcagagctgaagaaattgcagacatcgctcggcatcaccttcgtccacgtcacccacagccaggaggaagcgatggcgcttgccgacctgatcgtggtgatgaatgacggccgcatcgaacaggcggcgccgccccgcgaggtgttcgagcggccggccacggccttcgtcgcgcgcttcatgggcgaccacaatgtcatctccggccgggtcaccagcagccgagacgcgatggtcgtcttcgaggtcaacggcggcggttcgctcgccgccagcggcaagccgcagcaggcgggcgcgccgatcgacatcgccatccgcaccgaccatgtgcgcatcggcgaggcacccgcgcccgggctgggcttcaccggcatcgtcgccaacatcgaatatcgcggcgccactgtgaaactctccgtcactggtgccggcatcgacgactttaccgtcattgtcgacgattccgacttcttcgccaaacccgtcgccattggcgacgccgtaccgctcgcctgggatgccgaggatgcgatcgtcctcggccgccttcattcatga

SEQ ID NO: 36032 - DNA, 927 bp, Mesorhizobium loti
atgaaaccgaaaatcttcatcgacggcgagcacggcaccaccggcctgcagatccgggcgctgcttgccgagcgtggcgacctggagatcatttccattcccaccgagcgccgcaaggagacggcggcgcgcgccgaattcctcaatgccgccgatatcgcgatcctgtgcctgccggacgatgcggcgaaggaaagcgtctcgctgatcaccaacgacaccaccaaggtcatcgatgcgtcgaccgcgcatcgcgtcgccgaaggctgggcctatggcttcgccgagatggacaaggaacaagccaaggcgatcgccacggccaaacgcgtcgccaatcccggctgctggccgcagggaccgatcgcaacgctcaggccactggtcacatcaggcctgcttccggccgatttcccgatcaccgtcaacggcatttccggctattcgggcggcggacgcccgatgatcgaggactatgtcgccaaaggcgaggacgcctcggagttcctgccctatggcctgaccctgcagcacaagcatgtgccggaactgcgggcctatgcaaaactatcgcatgacccaatcatgcagccggcggtcggcaatttcgctcagggcatgatcaccgtggtgccgctgcagctcggcggcctcgacagtgtaccgacgggcgcggagcttcatgcggccattgccgaccattttgccgccatcaagggcggtgtggtcgaggtggcgccctatgcgcatctggagcgcatgccggagatcgatcccgagatctacaacggcaccaaccgcatgaaggtctatgtctttgccaacgacaaacgcgcgcaggcgctgctgctggcggtctacgacaatctcggcaagggtgcttcgggcgccgccgtccagaacatggacctgatgctcgggctttga

SEQ ID NO: 36033 - DNA, 1008 bp, Mesorhizobium loti
atggcgaccaagaacatcgaccatgccttcaccgcccgctccaaaacgggtggcgcccttgagccgacctattccggcgcgctgtcattcatgcggcgcaaatacaccaaggacgtgaaaggcgcggacgcggtggtgtggggcatccccttcgacgccgccgtcaccaaccggcccggcgcccgtttcgggccgcaagcgattcgccgcgcctcggcgatcctcgacaatgacccgcaatatccgttctcgcgcgatctgttcgaacatctcgcggtagtcgactatggcgattgcctgctcgactcgggtaaccaccagaagacgccaggcacgatcgagcgcgaagcggccaagatcctgaaatcaggcgccttccttttgacgctgggcggcgaccatttcgtcacctggccgctgctcaaggcacatgccgccatccatggaccgctcgctttggtgcagttcgacgcgcaccaggacacgtgggaagatgacggcaagcgcatcgaccacggatccttcgtcggccgcgcggtcaaggaaggcatcatcgatcccgaccggtcgatccagatcggcatccgcacgcacgcgcccgacacgttcggcatcaagatcctctacggtcacgaaatcgaggagatgcgggcctccgacatcgcctacgccatcgtcgaccgcaccggcggcaagaagacctacctgaccttcgacatcgactgcctcgacccggcctatgcgcccggaaccggcacgccggtggccggcggcccgtcctctgcgaagatcctgtcgacgctgcgccagctcaaccaggtcgatattgtcggcgccgatgtcgtggaggttgcaccggcctatgatcacgccgatataacggcgatcgccggctcgatggtcgccatgcagtatctcggcctgttggctgaacgaaaggcacggcaggaagagatgaacaacggcaatcacaacggtgccgcggtgaatcacggcaacggcatatag

SEQ ID NO: 36034 - DNA, 1281 bp, Mesorhizobium loti
gtgacccgtacgcccggtttcaacacgctcgccgtccatgccggcgccaagcccgatccggccaccggcgcgcgcgccacgccgatctaccagacgacctccttcgtcttcgatgatgccgaccacgccgcgtcgctgttcggcctgaaggcgttcggcaacatctacacccgcatcatgaacccgacgcaggccgtgcttgaagagcgcgtcgcggcactcgagggcggcacggctgcgcttgcggtcgcgtccggccacgccgcgcaggtcatcgtgttccacaatctgatgcagccgggtgacaatttcgtcgctgcgacaaggctttatggcggctcgatcaaccagttcggccacgccttcaagaattatggctgggaggtgcgctgggccgacacaaacgacctctcgaccttcgagagccagatcgacgacaggaccaaggcgatcttcatcgagagcctggccaatccgggcggcactttcgtcgacatcgagaagatcggcgacatcgcccgcaagcatggcctgccgctgatcgtcgacaacacgctggcctcgccctacctgatccggccgatcgagcacggcgccgatatcgtcgtgcattcgctgaccaagttcatcggcggccatggcaattcgatcggcggcgtcatcgtcgacggcggcaccttcgactggtcgaaatcgggcaaatatccgatgctgtcggaaccgcgccccgaatatggcggcctcgtcctgcacgaaaccttcggcaatttcgctttcgccattgccgcgcgcgtgctcggcctgcgcgatctcggcccggcgatttcgcccttcaacgccttcctcatcctgaccggcctcgaaaccttgccgctgcgcatgcagcgccattgtgacaatgcggttacggttgccggctggctgtccaaccaccccaaggtcgcctgggtgaattaccccggcctacccagcgacaagaacaatgcgctgcagaagaagtactcgccgctcggcgccggcgccgtgttcaccttcggcctcaagggcggctacgaggccggcgtcaaattcgtcgaggcgctggaactgttctcgcatctggccaatgtcggcgacaccaagtcgctggtcatccatccggcgtcaaccacgcaccgccagctttccgacgagcagaaggtcaaggccggtgccggtccggacaccgtgcggctttcgataggcatcgaggacgtcaccgatatcgtcgccgacctcgaacaggcactcgccaaggtctga

SEQ ID NO: 36035 - DNA, 1275 bp, Mesorhizobium loti
atgagcaaggtcggcaacaacagcggtgactcgaagaacacgctttattgctcgttttgcggcaaaagccagcatgaggtgcgcaagctgatcgccggtccgacggtcttcatctgcgacgaatgcgtcgagctctgcatggatatcatccgcgaggagaacaagacctcgatggtgaagtcgcgcgagggcgtgccgacaccgcaggagatcctcaaggttctcgacgactacgtcatcggccagccctacgccaagcgcgtgctgtcggtggctgtccacaaccactacaagcgcctggcacatgccggcaagaacaacgatgtcgagctggccaagtccaatatccttttgatcggcccgaccggttgcggcaagacgctgctcgcgcagacgctggcccgcatcatcgacgtgcccttcaccatggctgacgccacgacgctgaccgaagccggttatgtcggcgaggatgtcgagaacatcatcctgaagctgctgcagtcggccgactacaatgtcgagcgggcacagcgcggcatcgtctatatcgacgagatcgacaagatttctcgcaagtccgacaatccctcgatcacccgcgacgtgtcgggcgagggcgtgcagcaggcgttgctgaagatcatggaaggcaccgtcgcctccgtgccgccgcagggcggccgcaagcatccgcagcaggaattcctgcaggtcgacaccgccaacatcctgttcatctgcggtggcgcttttgccggcctggacaagatcatctcggatcgcggcagaaaaacctcgatcggtttcggcgccacggtcgcttcgccggaggaccgacgcaccggcgacatcttccgccaggtcgagcccgaggatctcctgaagttcggcctcattccggaattcgtcggccgtctgcccgtcctggcgacgctggaggatctcgacgagccggcgctgatccagatcctgaccgagccgaaaaacgcgctggtcaagcagtaccagcggctgttcgagatggaaaatgtcgacctgaccttccacgagaacgccctgtcggcgatcgccaagcgcgccatcgagcgcaagaccggcgcccgcggcctgcgctcgatcatggaggcgatcctgctcgacaccatgttcgaactgcccgcgctcgaaggcgtgcgcgaagtggtgatttcggaagaagtggtgaccggcagcgcccggccgctctacatttattccgaacaaaaggaaaagaagggcaacgtcagcgcctga

SEQ ID NO: 36036 - DNA, 2427 bp, Mesorhizobium loti
atgaaaggttggacaatggccaaaatatccaaggctcccagcgacggcgtcttcgcagttctcccactgcgcgacatcgtggtgttcccgcacatgatcgttccgctctttgtcgggcgcgaaaagtcgatcaaggcgctggaagaggtgatgggtcaggaaaagcagatcctgcttgccacccagatgaatgctgccgatgacgatcccgagcccgatgccatcttcgacataggcacgctcgccaatgtgctgcaattgttgaagctgcccgacggcaccgtcaaggtcctggtcgagggcgcttcgcgtgccaagatcgtttcgttcaccgaccgtcccgatttccacgaggcccgcgccaccgcgttggtcgagccggaagaggaagaggtcgaggttgaggcgctggcccgctcggtcgtcaccgacttcgagaactacgtcaagctgaacaagaagatctcgcccgaagtggtgggtgccgccagccagatcgacgactattccaagctcgccgatacggttgcctcgcatctggccatcaagatccctgaaaagcaggaaatgctggccacgctctcggtaaaggagcggctggaaaaggcgatgggcttcatggaagccgaaatctccgtcctgcaggtggagaagcgcatccgctcgcgcgtcaagcgccagatggagaagacgcagcgcgaatactacctcaacgagcagatgaaggcgatccagaaggagctcggcgagggcgaggacggccgcgacgaggcggccgagatcgaggcgcgcatcaagaagaccaagctctccaaggaggcccgcgaaaaggcggaagccgagttgaagaagctgaggacgatgtcgccgatgtcggcggaatcgaccgtcgtgcgcaactacctcgattggctgctgtcgatcccgtggggcaagaactccaaggtcaagcaggacctggcctacgcccagaacgtgctcgacaccgatcacttcggcctcgacaaggtcaaggaccgcatcgtcgagtaccttgccgtgcagagccgccagaagaagctgaaggggccgatcctgtgcctcgtcggccctcccggcgtcggcaagacctcgctcggcaagtcgatcgccaaggcgaccggccgcgagtttatccgcatggcgctcggcggcgtgcgtgacgaagccgagatccgtggccatcggcgcacctatatcggctcgatgcccggcaaggtcatccagtcgatgaagaaggcgaagaagtccaatccgcttttcctgctcgacgagatcgacaagatgggccaggacttccgtggcgatccgtcgtcggcgctgctcgaggtgctcgatcccgagcagaactcgacgttcatggaccattacctcgaggtcgaatacgacctgtcgagcgtgatgttcgtgacgacggccaatacgctgaacatccctgcgcccttgatggaccgcatggagatcatccgtatcgccggctacaccgaggacgagaagatcgaaatcgccaagcggcacctgatgccgaaggtgatccgcgatcacgcgctgcagccgaaggagttctccgtcggcgaggacgcgatccgtgccatcatccagacctacacccgtgaagcgggtgtcagaagcctggagcgcgagctgatgaagctcgggcgcaaggccgtgaccgagatcctgaagacgaagaagaagacggtgagcatcacggcggcgaacctcgccgattacctcggtgtccagcgctatcgcttcggtcaggtcgaggctgacgatcaggtcggtgtcgtcaccggtcttgcctggacggaagtcggcggcgagttgctgacggtcgaaggcgtcatgatgcccggcaagggccgcatgacggtcacaggcaatctgcgcgacgtgatgaaggaatcgatctcggcggcggcctcctatgtccgctcaagagccctcgatttcggcatcgagccgccgctgttcgacaagcgcgacatccacgtgcacttgccggaaggcgcgacgccgaaggatggcccgtccgcgggtgctgccatggcgacagccattgtgtcggtgctgacgggcattccggtccgggccgacgtggcgatgactggcgagataacgcttcgcggccgcatcttgccgatcggcggcctcaaggagaagctgctcgccgcgctgcgcggcggcatcaagaaggtgctgatcccggaagacaacgccaaggatctggcggagattccggacaatgtgaagaacggcatggagatcattccggtctcgcgcgtcggtgaggtgttgcgccacgcgctggtgcggatgccggagccgatcgaatgggtcgaaccggtcaatccgccggccacgaccgacagtgccgatgacgctggaaagtcgcttgcacattag

SEQ ID NO: 36037 - DNA, 930 bp, Mesorhizobium loti
atggcagccggaaagcctgtcgtcatattgggcgtcttcgtcgccgataccgcctatcgcgccgatcgccagccgcgcatgggcgagacgatcctcggcaattcgttcaagctgggcccgggtggcaaggggtcgaaccaggccgtggccgccggcaagctcggcgccgacaccactttcctgacccgccttggagtcgatgcgttcgccgacatggccaagcggacatggcaggatgccggcgtgaaaagcgccgtcatcgacacgccggacagctatacgggcgccgcctacatcttcgtcgaggagggcagcggcaacaacgccatcatcgtcagcccgggtgcggccatgctgatctcgccgaccgatatcgaggccaatgccgccctgattcgtggtgccggcgtcttcgtaacccagctcgaacagccgatcgatgctgcgatgcgggcgctggagatcgcgcgcggggcaggggtgacgaccatcctcaaccctgcccccgcggcaaagctgcccgaccgcgtctacacgctctgcgactatctcacgccaaacgagaccgagacggaggaattgaccggactgaaggtctcttcggtcgatgaggcgcgcaccgcctccggcaagctgctcgaaaagggcgtcggcaccgtcatcgtcacactcggcgacaagggcgcgctgctgcactcgaagggacgctccgagcatgtccccgctatcagcgcggggccggtggttgaaaccactggcgcgggcgacgccttcaacggcggcttcgcggcagccctatcgcgaggcgtggagccgctgcaggcggtgcgcttcgcatgcgccgtcgccggcatttcggtgacgcgacccggcaccgcgccgtcgatgccgacgctgcaagaggtcgaggcactgctggcgaagggttga

SEQ ID NO: 36038 - DNA, 771 bp, Mesorhizobium loti
atgaccggacgattgaaagacaaggtggcgctgatcatcggcagcgcgcgcggcatcggcaagggcatcgcattgcgctttgccgaagaaggcgcacggctggttctggccgacagcgaggccgaggccgggcaagcgaccgcggatgagctcggtgtccctttcatcggcaccgacatctcgcaaatgcgcgacgccgaggcctcggtggcactggcgctgaagcgtcacggccggctcgacatcatcgtgcagaatgccggcatctatccctggcaattgatcgagaacaccagcaccgacgactgggatcgcgtcatggccgtcaatctgcgcggcaccttcaatgccacccgcgcagccctggtgccgatgaaggcgcagcgctccggacgcatgctctacacctcctccatcaccggaccgcatgtcacgagccccggccacggccattattcggcgacaaaggcaggcatcaacggcttcatccgggcagcggcgctggagttctccggctacggcatcaccgtcaacggtgtcgaacccggcaacatcctgaccgaagccatccagcagcatcgcggtgccgcctacatcaagaacatggaggattccatcccgctcggccggctcggcagcccgcgcgacgtcgccaatgccttccttttcctggcctcggacgacgccggctatatcaccgggacgaccattgtcgtcgacggcgggcaattgctgcccgagggcaatgattttcggatggtgccgccttga

SEQ ID NO: 36039 - DNA, 1440 bp, Mesorhizobium loti
atgaccatccacggcatctcgcctgacgttctcgccgcccttgagcatgtgctggggcagagcggcgtggctgccgatacggccgacatggcgaaatacctcgtggactggtctggcgatcatcatggcggcgcgcttgccgtgctgaagcccgcgtcggtcgccgaggttcaggccgcggtccggctgtgcggcacgctagggctggcgatgatcccgcaaggcggcaacaccggacttgtggcaggtgcgatcgacatcggcacagccggaggcgcggtggtgatcagcctggagcggctgaacaggatccgctccgtcgacgccgacaatttcatcctgcaggccgatgccggctgcatcctgcagcacatcaaggatgccgctgacgagcgggactgcctgtttccgctggcgctcggcgcgcaaggcagctgccagatcggcggcaacgccgccagcaatgccggcggcgtcaacgtgctgcgctacggcatggcccgcgacctcatcgtcggcctggaagcggtgctgccggacggcgaattgtggaacggcttttccggcctgcgcaaagacaatcgcggctatgatctgaagcagctcttcatcggcgccgagggcacgctgggcatcatcaccggtgtcgagatgaagctctttccgaaacccggccgcgtcgagaccgcctatctggggctgccctcattcgaagcggctatatcgctgttcaggcgcgcccgacgtcaatgctgcgacctgatatccgccttcgagatcatcggcgcggaatgcatggagcttgcgcgcctcgccgacccgaacatcgtcacgccggtcaccgggccagtccatgtgctgatcgaattgtcatcgagtgccgagatcgatttgcgcgccctgctgatgaatttccttgctgatacaatggaagaagaaatcgtcaccgacgccgtcctggccgagagcggcgcgcaggccagggcattctggggcattcgcgaggggctggtcgagggccaggccaagcgcggctaccatgtgcgcaccgacctttcggtgcgcatctccgacatccccacgctcatcgcccaggcccgccagtttatcgaactgcagcatccgggctggatctcccaggcctacggccacgccggcgacggcaacatccatttcaacgtcctgccgccgcttgaccttgccgatcccgacgcccgcgccagaggcgccaccatcaccaccggcctgtatgacatcaccaacgccctcggcggctcgatcagcgccgagcatggcatcggacgcacccgccagcgtgtctattgggcgggaatgtcggcagtccagcgccggctcgtcagcacgctcaaagatgcgctcgatccgggcgggctgatgaaccctggctgcctctttcccgcgacggagactttttcatga

SEQ ID NO: 36040 - DNA, 1214 bp, Aspergillus nidulans
cttttgcagtgggtgatgatcatccctgctgaaatcacaacggccgtctcagtactccagttctggccggcgacggacgccatccatctggcagcgtacatcacaatcttcctggctgatggctctggccaacgtcttccacttcaaggtgtatgggtacttcgagtattacatgggcttcatcaaatgcgccgtggtgattctcatgatctgcttcctgtttatcatggcatctggcgggatccccgcagcgcatggcccgctggtcttcagctactggaagaacccaggtgcattcaataacggaatcaaaggtatcgcgaaaagctttgtccaggccgcgttcagcttcggcgggggcgagcatatcgcagtcattgccggcgaagtggcgcccccgcgcagcacgatccgcaagacggtgcggccggtattctggcgcatgttcactttcttcggtgtcgatatctggctcgtcggcatgtgcgttccctacgatgactcggacctcatcaatgggtcagggacgctgggtccccattcgtgatcgcactgaaacgcgcagacgtctggggtttggcgcatgcgatcaacgggttcatcttcctgtctgtgatcagctgcggcgtgacgagcgtctatgtcgcaagccggagcctcacggctctggccgatctgggccttgtccataggaccctggggaagaaggacgctactggacggccgtgggtcgcgatcgccgtcagcctggccatcggcgttggtcttcgctatttgaacgtcgacggcactggcagtatcgtctatgatggctctcatctttggtagcccttcctctcaccaggtctctttcatgtttccctttcccgttttcctcgtttcctggttaccgtgcgaacacgatgtaggtcgcgattgtaaccctctttcaatgggcgtctatctacatcgcacacctccggttccggactggtctgcttgcccaaggaaggaacctcgctgatctccccttgaagggcttgcttacgccctacgcgcagtgcttcagtctgctgattgtgctgttcatcttcggatgcgagttctacctcgcctgtttcccgtttggggagaaggggtccgccaagagcttcttctcgacgtacctagcggcgccgctgttcttcttcgactatggtgtctacaaggtgagagagtctacctatccccataag

SEQ ID NO: 36041 - DNA, 3863 bp, Aspergillus nidulans
ctcggaaaaaggggtaagcctggcctaagtcgcgaccaggcgccactacccaagcgcgttgttcacctctctgcaagtgctattaaaggaatgtctgttgaagaagaaactgcccgcgccgacctgactgtcctgcctgttatcctgacccagcaagagaagagcctgtccagctacgcaatgctagatactggagctgacgggaagaggtttattgaccaagaatgggcagaagacaaccaccttgagctgctgcccctgaaaaacccaatccacttggaaagctttgacgggagagaatccgaaggagggccgataacccactatgttagaataaacctgacaatccatgaccatcatgaaaagaaggcttgtttcttggctacacaactagcccattacccaataatccttggaatgccatggttagagactcatgacccccgctgggggtttgcagagcacaccttaatatttgacagtgcctattgtcgacagaattgcaatatacctgcccaaccagccaagatcaaggccctgcgtgacgtgcctgcccgaagctgccagaagaacctgacttcctgtcccaaaggattggagaaacaagatattgccctagtctccctccgcgcctgctcagcttacgcccgtaggtccatgccctgtttacagccactattgggaatattgacgaggtattggctaagaggtcaggggatggtaaccctgaagacctactactaccagaatacaaagactatgcagatatcttctcccctaaggaagctgataagctgcccccacatcagccatatgactatttaataactctaatagatggaaagaccccaccatttggcccattatatggaatgtcccgggatgaactagttgcactacaggagtggattatggagaatctgaggaaaggctttattcgcccaagctcgtcgccaacagcctcacctgtcctatttgttaaaaaacccggcggaggtctatgcttctgcgtggactaccaagctctgaacgtgattttggttaaggaccaataccctctgccacttgtcaaggagaccctgaataatctaaaagggatgaggtactttactaagattgacattatttccgcatttaataacatacggatcaagaagggacaggaatatctgaccgcgttccgcacctgcctggggctgtatgaatccttagttatgccctttggccttaccggcgctccagcaacattccagcactatataaatgacaccctgcgagactatctggacatcttctgtactgcttaccttgacaacatcctgatctacagtcaaaccaggtctgaacatattcagcatgtccgaaaagtcctccaaaagcttagagaagctggcttgtttgcaaagctagtgaagtatgaatttactgttcatgagaccaagttcctgggcctgatagtggctagagatagaatcaagatagaccctgagaaggttcaaaccattgcagcctgggccacgccaacctgcattacagatatacaggcatttattaggttcgccaacttctaccggagattcattaaggatttctcaaagatcattgccccgctagttaacctgactaagaaggatgtcgagtttcaatggaccccaacctgccagctggccatggacgccctgaagaaggcctttaccagcgcccctgttttgaagccattcgactggacccaagatatcattcttgaaactgatgcttctgactttgtctctgctggtgtcctgtcccagtatgatgataatggcgtcttacaccctgtggccttcttctctaagaagcactctgccacagaatgcaactatgaaatctatgacaaggaacttctagcaattatccgctgctttgaggaatagcgccccgagctagaagggaccccgaaccccattaaagtcattactgaccaccggaacctggagtatttcatgtccaccaagctgttgaaccgtcaacaagcccgctggtctgagttcttatcctgttttaatttccggattgtgtaccgtcctgggaagcaaggagccaaacctgacactctgaccaggaggtcagaggacctccctaaagagggggatgaacacctactgcaccaaagccaaactgtactgaagcatgaaaatgttgaccctgcatgcctacctgaacctgctgaacctgctgaacctgctgaacctgctgaacctgctgaacctgctgaacctgctgaacctgctgaacctgctgaacctgctgaacctgctgagcatgcagaacctgctaagcatgcagaacctatgggaacaagacaatcagtatcctttagagatgaggtagaactacagctgccacctgaaattcaggacctaatatgcatagcatatgagactgaccctgttgtacggtcaatcttaaaagcactagctaccagacaggctcaacacccagatattaccctagctgactgcgagagaaaagggagcctcctgttctaccggaatcgcctgtatatcccagacaataatgatttaaaggcaaaactaacctgcttagcccatgataaaccaacatctggacatcctgggagagcatgcacatacaaactcctagcccgagaatattattggccgaacatgtattaatatgtgagtcaatggataaaaaactgtcatacctgtcagagaatcacaccctcttataaggcgcggcaagggatattgcggcccctgcctgtccctgaacatgcctggcaagatatctccatggactttattacccatctgcctaccagccaaggctttgattccatcctggttgttgtggaccgtctaaccaaaatgaggcacctaattgcctgtcaagccacaataaatgctgaaggagttgctcacctctatacacaacatgtgtggagacttcatggcctcccccggacaatcacttctgaccgtgggccccagtttgtcgctgagttctggaaacacctaaataaacacctggatatccagagcctattatcaaccgcctttcacccagagactaatggtcaaactgaatgggtaaatgcaatgctggaacaatacctgcaagcttatattacctacctgcaagataactggtctacctggttaccactagccgagtttgctctcaatgctacctattccgaagctatcagaacatccctgttctttgccaactacaggtttcacccacgtatgggcttcgaacctgtccctgttcctgactgtccagctagccaagatgctgagaacttcgcccagaagatgcaagctatatctgactatgtccgatcccagatgacctccgctcaagcccgttatgaagaacaatcaaacaagacccgtcaacctgcccgacaatataaggccggtcagcgtgtgtggttggatgcccgcaacatccgtacgctccgcccaagcaagaagcttgattggaagttcctgggaccgtttactataaaaaggatgatcaatgcacacgcttacgagctcgacctaccagccagtatgcggatacacccggtattcaatgtgagcctacttcgcccagccgccgacaatcctgtgccccgtcaaagagctgatcccccaccacccatcgaagtggaaggtcttgaacattgggaggttgagagcatcttagattcgcgctgggagcggcgaggccgaggaggccctcgtctgaagtatactgttaaatgggttggatatgacgatcctacagaggagcctgccgagtacttgacccacgccaaacagctcgtacagaacttccaccgccgatatccgcataagccccggccaagc

SEQ ID NO: 36042 - DNA, 2754 bp, Aspergillus nidulans
ccagccggtgctgccgtccagttcttcgaccctgggctactgcgaggcaatctggatgggacagccaggaatgaccgctatccattgcacctgatccatgagacactgaaccaaattggacaagccagatggtttactaagctggatgtgtctgctgccttccataagatccgcatagccaaaggacaggaatggatgactgccttccgtacgagatacgggctctttgaatggctagtcaccccttttgggttggctaatgcaccgagcaccttccaaaaatacatcaactggaccctccgggaatatctagatgaattctgctcagcctatatcgacgatgtgcttgtctataccaatggggacctccgccagcaccggaagcacgtacgaatggtcttgaagaaactggaagaagcaggcctatatttggatattaagaagtgcgaatttgagtgcaaggagacaaagtacttgggctttataatacaggcagggaagggaatcaaaatggacccggagaaggtgaaagcaataaaggaatgggaaacccctactactataaagggcgtccgaggattcctgggctttgccaacttctaccgaaggttcatccctaacttctcagggatcgtacgcccactgaacaacttgacaaagaaagggacacccttcttgtggactaaggagtgccaggatagctttgatctgcttaaggaaaagtttattactggacctgtcctagcaaccttcaacccttcctaccgtacggtagtagagaccgactcctcaggttataatacaggaggagttctctctcaatataatgaaaaaggggaattgcacccatgtgcctacttctctaaaaggaattctccagctgaatgcaactatgagatctatgacaaggagctactcgcaattgtacgatgtcttgaagcctgggatgctgaactgcgctcatgtggagaattccaagttattacagaccacaaaaacctggagtacttcttctccccaaggaagctgacagaacgacacgtacgatggtccttatttctcagccggttcaacttcaagctagtatataggaaagggtcagccaatcagagagctgatgcactttcacggagagaccaagacatgcctgatgatgaagatgacagggtcaagtctcgtacgatgcaactttttacagaaaaacacttggggaagacggtagttgccaccctccgaccggctgaagagcaaccatgggagccgtacgaaaaaagtgatatgtggaaggaggcactcaaacaggatgaaagatatagtgaagcagtactgtgcctgaaagatggagcaaggagatttcctccacacctacaattgaaagtcggaatctcagaatgccagctggacgcccaagaccatatcctcttccgtgggaggaggtgggtgcctgatagtgaacagctccgtacgagtataattcaggctgcacatgactctatattgacaggacatcctggccgagagcaaacatatttgctggttagccgtgaatacttctggcctaacatgtcccgggatatcagaagattcgtccggaactgtgatatatgtgggaggaccaagtcttggagagaccagagaagggggctattaaagcccctccctgtgcctgatcgtccctggcaggaggtttcaatggatttcattacagacctaccagagagcgaaggttgtacaaacatcatggttatcacagaccgattaaccaaaggtgtgatactagaaggaatgtcagaaactgactctgagagtgtggcctgggcactcgtacgagtacttataagcaaacacgggatcccgaaggctatcacctcggacaggggaagccagtttacaagtgatacatgggcccgcatatgtaccctgacagggatcaaccgccggctatctacagcctatcatcctcagactgatggatcaacagagagaatgaacagcacagtggaaacctacctccgcatgtatacctgctatgaccagaaggactggaacaggctacttccacttgcagagctggcaattaatggccgtacatcaacagcaacaggggtcagccccttctatctaagccatggctacaacctcagcccatttacccctaccgaggaggtagagcatctagctgaagaaccaaccaagagtcctatccagaaaggggaagccatcgtacggaaagttaaggaagccctagactgggctcaagcctccatggcctattcccaacagaatacagagaatcaggctaataaacacaggagcccggccacaaactaccaagtgggagataaggtctggctaagtctgaagaacatccgtacggaccgacccagtaagaaacttgactggaagaacgccaagtatgaggttataggcctggtgggcagtcatgctgtacggctgaatacgcccccagggatccatccagtcttccatgtggacctgcttcggctggcttcatcagatccacttccttcccagaagaatgatgatagccagccccctagcatcatggtgaacggtgaggaagaatacatggtagagaaaatcctggacgaacgtcgcaggagatacgggagaggtcaccggctggaatacctagtgaaatggtcaggctatgctcagccaacctgggaagctgccacagctttggaggaagtacaagctctggatgagtggctggatcgtacgaaacaatat

SEQ ID NO: 36043 - DNA, 822 bp, Aspergillus nidulans
atcctcgaccatgcttcgaaaaacaactatgccgtccctgcaatgtgcgtctacaacgtcgaaggcatccttgcgacggtccgcgcagccaacaagaagcgctcgcccgccatgatccagctcttcccgtgggccctgcactacgccgacggccttctcgtacatgccgccgccgaggccgcgaagagcgctgaggtgcctgtcaccgtgtccatggaccatgcgcagacaccagagatcatccggcgcgccgcggatattggtggtttcgacagtatcatggttgacatgagccactacgagaaggaggaaaatctgcggctaacgcgcgaactggtcgcgtactgccacgagcgcgggatcgccaccgaggccgagcctggccggatcgaaggcggcgaggatggagtcgctgatacggcggagctcgaggggctgctgacgacgccagaggagagcgaggagtttgtcgacacggggatcgactggctcgcgcccgcgtttggcaacgtccatggcgagtatggcccgcgaggtatccagctggagtatgagcggctgaagagcatcaatgagaaagtgggcgaccgcgtcagacttgtgctgcacggggcggatccgttcaccgaggagatcttccggaaatgtatcgagtgcggcgtgtccaaggtcaacatcaacaaggtcttgaacaatgagtatgtgaaggtacaaagagagaaggccgggagggtgccgcttacgcagctgctggaggaggcaacggacgagatgcaaaaggccgtggagaagtgtatggatatgctggggagcacggggagg

SEQ ID NO: 36044 - DNA, 1077 bp, Aspergillus nidulans
caaaccaccgatgccgttaactccttatgctaatccttaccagacaactgttgttcccttcagggatttttggtcttccactctttcggcggaggtactggctctggtttcggcgctcttctcctcgaacgtctgtccacagaatacggcaagaagtccaagctggagttcgcagtgtatccttctccccgtgtttccaccgctgtcgttgagccttacaacgctgttctgtccacacacagcacaattgagaactccgactgcacgttcctcgttgataacgaggctgtttatgatatctgccgccggaacttggatattcctcgccccagctttgagcaccttaaccgtctgattgcccaagttgtcagctctatcacctccagtcttaggtttgatggtgctctcaatgtggatctgaatgaattccagaccaaccttgtgccgttcccacgtattcactaccccttgatctcgtacgcgcccgttatttcaagcaaccgcagctctcacgagagcttcaaggtccaggatctcactctccagtgtatgttttcactttggctgctaacgtattccgtcgcctacatcacagaaatataataactgatcttgcatctaggtgccgagcctaacaaccagatggtcgtttgtgatccccgtaacggcaagtacatggccgtagccctcctgtatcgtggagactgcgtgccccgtgactgcacccaagccatcgcgtcgctcaaggccaaggcttccttcaacctagttgaatggtgtcctactggtttcaaggtgggaattaactaccagaaacccgcgcgtgtccccggaagcgaactcgcccctgtcgaccgctcagtcagcatgctttccaacacaaccgccatttccgaggcatggagtcgtctcgaccacaagttcgaccttatgtactccaagcgggcgttcgtgcattggtacgtgggtgagggtatggaagaaggtgaattctccgaagcccgtgaagacttggctgcccttgagaaggattacgaggaggttgctggggacagccttgatatggagggcgaagaa

SEQ ID NO: 36045 - DNA, 882 bp, Aspergillus nidulans
gctaacggtgtcgtcttacacaacttcagattctgcatcgccccactagacgtcgtgaaaatccgcctgcaactacaaatccattctctctccgacccaacctcgcacgcccacatcacggggccagtctacaagggcaccctttctacaatcaagaccatccttcgcgaagagggcctcacaggactatggaagggcaacatacccgcagaactactgtacgtctgttacggcggtatccagtttacgacataccgcacaacaacacagcttctcgcgcagctcgatccgcaccgactcccgcagccgattgagtcgttcatatccggcgccttgggcggcgggatcgctacggcggccacgtaccctcttgatctattgagaacgcggtttgcggcacagggatctggcgacaatcgcgtctacgagtcgctttttgcgtctcttagggatattgcgaagactgaggggactgtggggttctttcgggggtgcagtgccgccgtcggacaaattgtgccgtatatgggattattctttgcgacctatgaggcgctgagaccggttatggcgactgcgcctgaactatcgccgattcccttaccgcctgggtctggggacgcggcggccggcattgtcgccagtgttctcgcgaagacgggtgtgttcccgcttgatttggtgcggaaacggttacaggttcagggtccgacgcgcgcgttatacgtacatcgcaatatacccgagtatcgcggggtcttcaacaccatgggcttaatattcaggacgcaaggcctacgtggcctgtaccgcggtttgactgtgagcttggtcaaagctgccccggcaagcgcggtcaccatgtggacgtacgaaagagct

SEQ ID NO: 36046 - DNA, 779 bp, Aspergillus nidulans
tttttacccccaagcattgacaaaccccggctcctggcaggcgaatcctacgcacacttctcgcccgctccaccagcgatttcgacacagacaatagccacaaatccagaacatgactatctaattctaggcattgatgaagccggtcgcggccccgtccttgggccaatggtttacagtgccttttaccttcccagctctctgcaccactcgctgctgtcggaagagtacagcttcaacgacagtaaagttctcactgcgggagtacgagcaaatctcatgcgcatcctttgtacacaaggctcaccgctgcacgagtcgtgcggatgggcgacaaagcttctttccgcacgggatatatcatcgggcatgatgcgacctgcagcgggagtgtacaacctgaatgcgcaagcaatggatgcaacgattgagctgattaggggtgttgtggaagagagaaaactgaacgtgcgcgaggtctatatcgatacgataggaaatccagcaagttaccagaagaaactggagatggtgttcccatcgctgaggatcaccgtcgcaaagaaggcggactcgctttatccttgcgttagcgcagcaagtgtggtggcgaaggttacaagagatgttgcgcttgatgtttgttatgaagttctcaaggaaaatggaggagtgggcgatggttgggggagcggatatccttctgatccaaagtgcgtcgggtggattcgaactaacatgagattctgtctttggtgtgggggattcaatgccttgtc

SEQ ID NO: 36047 - DNA, 1977 bp, Aspergillus nidulans
gtcatcgttcaagctgcctacgcgattggtggtcttgaaagtggtttccctgataacttgaatgaactaaaagacctgtgtgccaaggctttcgcagccagtccccaagtcctgatcgaaaggagtatgaaggtctggaaggaaatcgaatacgaggtcgtccgtgatgccagggacaactgtatcactgtctgtaacatggagaattttgacccgctcggtattcataccggtgactccatcgttgtcgccccatctcagactctatctgacgaggactacaatatgctgcgcacaacggccgttaacgtcatccgtcatcttggtgttgtcggagaatgcaatattcaatacgccctcaacccctactcgaaggaatactgcattatcgaggtcaatgctcgtctctctcgatcttctgcgctcgcttccaaggctaccggataccctcttgccttcattgctgctaagcttggattgaacatcccgctcaatgaaatcaagaactctgtcaccaaggttacctgtgcctgcttcgaaccctccctcgattactgtgttgtgaagatccctcgctgggatttgaagaagtttacccgcgtctccacacagctcggttcctccatgaagagtgttggtgaggttatggccattggcagaactttcgaagaagcaattcagaaagccattcggtctgtggacttccacaaccttgggttcaacgagaccaacgccctcatgtctatcaagactgagttgcaaactccttccgaccagcgtcttttcgccatcgcaaacgctatggccgctggctacagcgtcgatgacatctggaagctcaccaacattgacaagtggttcctcactagactcaagggtcttagtgactttggcaagctcatgaccaattacaatgctagcaccgtaacggcacctcttcttcgtcaggctaagcagcttggtttctctgaccgccaacttgcaaagttcttgagctccaacgagttggctatcagacggttgcgtgtggaggctggcatcattccaattgtcaagcagatcgatacagtcgctgccgagttcccttcggtgaccaattatctgtatctcacttacaacgcttccgaacatgatgttaggtttgacgacaatggtattatggtactgggttctggtgtctaccgtatcggatcttcagtcgagttcgattggtgctctgtgaggacaattcgaactctccgtgagcagggacacaagactgtcatggttaactacaaccctgagactgttagtaccgactacgacgaggctgatcgcttgtatttcgagaatatcaatctggaaacggtgctcgatatttaccagctggagtcctccagcggtgtgatcatgtccatgggtggtcagactcctaacaatatcgctcttccgttgcaccgcctcaatgttcgtattcttggtacttcgcctgaaatgattgacggagccgagaaccgttacaagttctcccgcatgcttgaccgtattggcgtcgaccaacctgcttggaaggagctcaccagcatcgaagaggcccgtgagttctgtgacaaggtcggctaccccgtgcttgttcggccttcatatgtgttgtcaggtgcggccatgaacactgtctactctgaacatgatcttgccagctatctcaaccaagctgcggacgtctcccgtgaacatcctgttgtcatcaccaagtatattgaaaatgccaaggagatcgagatggatgcagtcgctcgtaatggtgtcatggttggccatttcatctccgagcacgtggaaaacgctggtgtccactctggtgacgcgactctgatcctgccaccccaggacttggaccctgagaccgttcgacgaattgaagaagccacccgcaagattgggaacgctctgaacgtgactggacccttcaacattcaattcattgccaaggacaat

SEQ ID NO: 36048 - DNA, 849 bp, Aspergillus nidulans
tacaaaacggagtaattcccttactccactcgatgtctcctcacgcccgtgcaattggggctgtaaacaccttaataccgatccggaacctggaaggcagcaccgacaacgccctagacttggaaaagaaccgagcaggaccaataaaaggcttgcatggagacaacacggactggattgggatcggtatatgcatacggcgaggcctgtcgccagcgaacgccatacgtccatccacaaccggccttatcattggagcgggcggaatggcgcgcgcggggatatacgcaatgattcatctaggtgtacaaaatatcttcatctggaaccgcaccgttgcaaatgctgagaagcttgcccagcattatatgcgcttgaacctctgcactctcggtggaagcggatcagcctcgtatacaatccatgtcttgaagtccctccaagaaagctggccggccaactacaaacagccgactatcgtcgtctcgggtattccagcacataggatcggtgaccagccggcgccgaacttccagctccctcctcagtggatcgagagcccaacaggtggggtggttgtagacctcgcctacaaaccattgaacactccgctcatgcgtcagatccgctcgctctcgcaccagcggctgggcggctcttgatgggcttgacgttcttcccgagcaggggtttgctcagtttgagctttttaccggatgtcgtgctcctcgacggcttatgaggacggtcattttacaagaatacaaagaggaggaacaaggggaggagtatgaccagagcgctatgcggactcgacttgagaatttggatgggcagccgatgtgagta

SEQ ID NO: 36049 - DNA, 1050 bp, Aspergillus nidulans
tacagcatcttccacttctacgtctgcttcagtgaggtcattttcggcgcgcaggccgcaggcagcgtcttctcgtatgcgcccggcatgtccaaggcaaaacacgccgcgggcgagctgaaagcactgtacagccgcaagcccaagatccacggccacaacgtgatgcgcgggcgctggtctggcgttgcggccagcgctgcgatgcgcaacgtcctccccctacctccccgatcgctgcaggggtcgatcgagttccgcaatgtgtacttccggtatcccacgcggatgacggtccccgtgctatcggggctcagcttctcgatccggccaggccagtttgtcgcgtttgtgggcgcaagcgggtgcggcaaatcgacgacgatcgccctcctggagcgcttctacaacccgctgccaggcagcggcgggatctacgtcgacggacgggatatcagcagtctggacctgcagagctaccggcggcagctggcgtttgtcgggcaggagccggcgctgttccaggggacgatcaaggagaatatcctgctggggatggaggagggggaggtcgatgacggccagatcatcgctgcgtgcaaagacgcgaacatctacgacttcatcatttcactcccgtgcgttcagtccctgcttctctccactctcctatactcacattgtgacaccggctgacatgcgagcaggcagggcttcaacaccgaagtcggcagcaagggcgggatgttgtctgggggccaaaaacagcgcatcgccattgcgcgcgcgctgctgcgcgagccccggatcctgctgctggacgaggcgacctcggcgctggacagcgagagcgagcaagtggtgcaggcggcgctggacacggccgcgaggggccgcacgacggtggcggtggcccaccgtctgagcacgatccagcgcgcagacgtgatctacgtgctggcgaacgggcgcattgctgaggaggggacgcacgccgagctgctgcggaggagggggcactactacgacctggtgaacctgcagagtctg

SEQ ID NO: 36050 - DNA, 1446 bp, Aspergillus nidulans
atgccccgttccgccattgtacaagagtacaaccccactcccacgctctcggtcgaccgcaaatccgcccagcatcaacatgaaggcatcatcgcgcggccatcgggctaccgggtatcatggcacgcaaaccctgcggtagaactgcatcacttcggccagtcgcacccaatgaagccatggcgcctcacactcaccaaacaacttgtgctcgcctacggcatgcatcatgcgatggacctataccactgtcgtgccgcaactgttgaagagctcagcgacttccacacatccgattacctggactttttgcagacagtggtgccaggtgacatgaatgacgcgcaagcgtccaaggatttcagcgaaaacatcgtccgcttcaattttggcgacgattgccccatcttcgacggcctattccaatactgctcgctgtacgcgggagcctcgctcgacgccgcccgcaagctctgcaacaatcaggcagatatcgcaatcaactggtctggcgggctgcatcacgccaaaaaggccgaggccagcggcttctgctacgtaaatgatattgtgcttgcgatcctgcagctcctccgcatacacccgcgcgttatgtacatcgatattgacgtccatcacggcgacggtgttgagcaagccttctggtctaccgaccgcgtcctcacagtttcgtttcataaatatgacaaggagaactttttcccgggcacagggcccttagatagtacagggccaacacacccgctcaacccaggcgctcatcacgcagtcaatgtacccctccacgacggcatcgacgacgaatcttatgtccagctcttcaaggacgttgtaggtgcctgtgtcagcaagttccgaccggccgctattgtcctccagtgcggcgccgactcgttgggctgcgacagacttggctgcttcaacttgaatgtggccgcacacggcgcctgcgtcgcgtacacaaagacattcggactacctatgctcgtcgtcggcggcggcggctacaccccgcgcaacgtctcacgagcctgggcgcacgaaacctccatactaatcgacgcccaagacaaaatcaaccccgttattccgtccaatgttgcatttcggaaccatttcggcccggacttctcgctgtttccgccgctgtcggagatgcgcaagctcgaaaacaagaactcgcgcgcttacttggcgacaattgtgcagacgatcacggagcagctgaggtatttgcaggcggcgccgagcgtgcagatgtctgtgattccgccggatctattagggctcagggaggaaacggagaaagaaatcgaggaggagattgcgaagttggaagagaaaagggaggaggccgaaggtgggaagaattctcggaggagagatgcggagaagggtgctggactgcggggagagttgtattct

SEQ ID NO: 36051 - DNA, 1276 bp, Aspergillus nidulans
  unsure (1)..(1276): unsure at all n locations
gactatatcataatcggcggtggccttgccgggtgcacgcttgccggtaggctcgccgaaaagaatcgctccctccaaatcctcatcatcgaggctggtccaaacgtcgccggacacactctgactgagtatccgctcgcatgcttcggtgcgcatttctcgccgcttgactgggcgtataccaccgtccctcaaacccacctcgacaaccgaatgtgctataacagtgcggcaaaagcgctgggcggcggttctgcaatcaactacgggacttggactcgcggaaatgcggcggattatgaccggtgggcggcaatggttgatgatgagagttggggctatgaagcattgctgccttatttcaagagaatggagaattgcctggattgcaagggcactgagaccggtgcacatggggtttccgggccaattcataatgtctctgtgtcgggaggcagtgcggaccgaatctacccactgagagagcctttgagacgcgcgtgggagaggctgggtgtgaaggaggtattagatgcgaatgcgggttcgccacttgggctgggagagctggttgagaattggcgtgaaggccggcggcagattacagctgatgtttttaacatcttagagaggccgggcatcacaaccttgacagagacgatggtgcagaaaatccttatcgaaaaagaccaacagggaaagaaagtcgcaaagggagtgcaggtggttcaaggccctgtattccttgctgatggggaggtcatcgtatctgcaggggcatatcgtaccccacaaatcttgatgctctctgggatcggcccaaaggatgagctcgcgaagctgggtatcgccgccgtcgcggatgcaccaggggttgggcagaacctgcacgatcattttgccttcgtgcagtggtggaggctgcgacacccagaaaaggggttatcaatcgngtacaccattgtgggacagtttagcatacggcatgggactgccctgtgattggattgccacgctacaggctcctcgcaacgagctcgtccaggcccttcatcaggacggagcaaccgatgtagggagccatccatatcttgctcctgatgcttgtcatgtagagacgctcatcgtatatgcacccgcaggggcggccgtctcgcgcatagagatcccgatggacggcacgcatatcgcctcggccgtcctaggtatggcgacgacatcacgaggccggatcactctcgcgtcagcggacgcaacgactgcgccagtattacag

SEQ ID NO: 36052 - DNA, 444 bp, Aspergillus nidulans
gacgttgcgttatatctcaaacttgagagactcgttcttcatctgctagagaggtctgatctccgaaaccaggataacatatgggaaacaatggctcatgaggcagcagttaatggctatgagttactgcttgacaagctagtcaaacagcccaattgggatctagttgtaaacaagaggagtaaaggaaagccgacgccactttatgaagcagcaaaaaatggtcacaggagaatcgtctcgacgttacttgagaaaggcgctaaagtcaacgagaaagataaatcagagagagtaccacttcacgaagcagccgccaatgggcatgacgatgttgtgcattttttactcgagaatggtgccaaagtcgacgaaggggacaaggcagggagagtccctctccatgaagcagcagcccatggacgcaacgcggtcattaaattc

SEQ ID NO: 36053 - DNA, 1550 bp, Aspergillus nidulans
atggcccccgctgttggtattgatcttggaaccacctactcctgtgtgggtgtcttccgtgatgaccgcattgatatcattgccaacgaccagggtaaccgcactacaccctctttcgttgccttcaccgacaccgagcgtctcatcggtgatgccgccaaaaaccaggtcgccatgaacccccacaacactgtcttcgatgctaagcgtctgatcggtcgtcgtttcggcgatgctgaggtccaggctgatatgaagcactggcccttcaaggtcgttgacaagagtggcaagcccatcatcgaagtggagttcaagggcgagaccaagcagttcactcctgaggagatttcctccatggtcctgactaagatgcgcgaaactgctgaggccttcctcggcggtaccgtgaacaacgcagtcatcactgtccctgcttacttcaacgactcccagcgtcaggccacaaaggatgctggtctcattgccggtctgaacgttctccgtatcatcaacgagcctactgctgccgccattgcttatggtcttgataagaaggttgagggtgagcgcaatgtgctcatcttcgatcttgggggtggtaccttcgatgtctccctgctcaccattgaagagggtatcttcgaggtgaaggccaccgcaggagacactcacctgggaggagaggactttgacaaccgtctggtgaaccacttcgtcactgaatttaagagaaagcacaagaaggatctttccacaaatcgcccgtgctctccgccgtctccgcaccgcttgcgagcgtgccaagcgcaccctgtcctctgctgcccagacttccattgagatcgattctcttttcgagggcatcgacttctacacctccatcacccgtgcccgttttgaagaactctgccaggacctcttccgtggtaccatggagcctgtcgaacgtgtcctccgcgatgccaagatcgacaagtcttccgtccatgagatcgtgctcgtcggtggttccacccgtatccccaagatccagcgcctcgtctccgactacttcaacaaggaggccaacaagtccattaaccctgatgaggctgttgcctacggtgctgccgttcaggctgccattttgtctggtgacacttcctccaagtccaccaacgagattctgcttctcgacgtcgcccctctgtccgtcggtattgagaccgctggtggtgtcatgactccccttgtcaagcgaaacaccaccatccccaccaagaagtccgaaaccttctccacttactccgacaaccagcctggtgtcctgatccaggtctacgagggtgagcgtgcccgcaccaaggacaacaacttgctcggcaagttcgagctcaccggtatcccccctgctccccgtggtgttcctcagatcgaggtcaccttcgatcttgacgccaacggtatcatgaacgtctccgctgtcgagaagggtaccggtaagaccaacaagatcaccattaccaacgacaagggccgtctctccaaggaggacattgagcgcatgc

SEQ ID NO: 36054 - DNA, 1328 bp, Aspergillus nidulans
gacgtccctagtatcgtgcgcagtgtgatcgaagacatccggcagaatggcgataaagcactgcgctcgtattcagaaaagttcgacaaatggagccccgatagcttcaaactgtccaaggagcagattgacgagatcgtcagcactgtccccgcacaggtcattgaggatatcaagaccgtgcagcagaacgtgcggacctttgccgaagagcagcgcaagtccatcagggactttgagtatcagattcagccgggggtgtttctggggcagaagaatatccccatctctgcggtcggcgcgtatgtacttacccctgccagacctaataacgttcttgtatggactcgtcttgtgctctcaggtacattcccggcgggcgctaccccctcctcgcctcagcccacatgacaattgtgactgccaaagccgccggtgtttcgcgtgtcattgcctgtacgccccctattcaaggcaaaatcccggcatcgacggtggcggcgatccacctagctggtgcagatgaaatatatatcctcggcggcgtgcaagcgattgcggcaatggcattgggaaccgaatctatcaacaagaccgacttcatcgcaggcccggggaatccgttcgttgcagaggccaagcggcaactcttcggcgagatcgggatcgacctgcccgccggtccgacggaggtgcttattgtagcggacgccaaagccgatccctttgtcgttgcaacagacctgctgtcgcaagcggagcatgggcccgatacgcccgccattctgatcacggattcgagggatgttgcggagaagacgatcaaagaggttgaaagactgctaccgatccttccgactagggcgctggcggcggtttcatgggagaggttcggagaggtacaacttgttgaggatctgaatgaggcgtacaaacttgcagatgagtatgcgagtgagcacgttcagattttgacggagaaccctagggaggcgctggtcaagatgaagaactacggggcgctcttccttggcgagaagacgtgcgtttcgtatggagataaggtatgtctactctcgccgtctaggacgataccaaagttttattcagactgtatggataactgacgaacgccgtagtgtattggaactaaccatgttctgcccactaaaagcgcagcgcgcttcactggcggcctctgggtcggcaaatatctgaagaccgttacctaccaagaggtaacagacgcgaaagccagtggcgaactcggtcgtctgtgtggccgtgctgctcgggcagaggggtttgaaggccatgctcggtctgga

SEQ ID NO: 36055 - DNA, 1614 bp, Aspergillus nidulans
aacatctacgtgatcacgaccattgcggtcattggtggtgccctgtttggtttcgacattgcgtctatgtctgccatgtatgtccctctgcctcctcccgcccgatcgtcccctctgtggggtgagaactgacccaacacttgcttacctctattctcagtctgggcactcaacagtacaaatgtttcttcaaccagggcggcatcggtgaagacgggaagtgtgccggaccgacctccagcaaccagggaggcatctctgcctcgatgcccggaggatcctttgccggagctctgtgttctggtatcctcaccgactggcttggccgtcgacgagcaatccaggtgggcgctgtgatctggtgcatcggcagtgcgattacctgctcctcgttcagtatcgggcagcttgttgtcggccggttcatcaacggggtatccgtcggcatctgcagcgcgcaggtgcctgtgtacgtctccgaactggcgcagcctagcaagcgtggaactgttgtcggtgcccaacagtgggccattacttggggggtcagtctgatcaaccgctgaaacagaaggaagatgctgactattcgcagatcatgatcatgttctacatcttctacggcagcagctacatggaggggcccgccgcatggagactgccatggggcctgcagatgattcccgccgtcttcctcttcttcgctctgttcttcatgccccgagagccccagatggttgggcaagaaggaccggtgggaggagtgccacgagacccttgcgctcgttcacgccaaggggaatcacaacgacccttttgtcggacggagctgcgcgagatccccgagatgtgtgagtttgaacgcgccaatgcagatgccagctacctggatctgtttaagcccaatatgatcaaccgcacacatatcgggatgtttacccagatctggtctcaactgacgggcatgaacgtaatgatgctgtacatcacgtacgtctttggtatggccgcctttccggcaacgccaaccttgttgcctcgtcgattcagtacgtgattaacgtggtaatgaccatttttgccctggtcttcatcgaccgctggggtcgccgcatcccgctgctgatcggatccaccctgatgatgaccttcatgttcgcaaacgccggcatcatggcttcatacggcaagccagcgcccccgggcggagtcgacaacgtccctgaagagtcctgggacatgtcagaggccaagtccgcagccaagggggtcattgcatgcacctacctcttcgtcgcatcgttcgcgcctacgtggggtcctgtcagctggatctatccccccgagctgttccccttgcgccttcgcggtaaagccgtagccgtgacgaccgcctcaaactggatcttcaattttgcgctttcttactttgtgcctcctgcattcgagaacattaaatggaaagtgtacattgtattcggtgtcttctgcgccgctatgacactgcacgtcttcttcctctttcctgagacggccggcaagacccttgaggatgttgatgcgatgttccatacgaatgtcaagccatggcagaccagggtgcagtatcgcgat

SEQ ID NO: 36056 - DNA, 1065 bp, Aspergillus nidulans
gatgtcgtgcgccggaaagcagagagctgcgattgtctgcagggcttccaggtgacgcactcgctcggtggcggaaccggctctggaatgggcacgctgctcatttcgaagatcagggaggagtttcccgatcggatgatggccactttttcggtcatgccgtcgccgaaagtgtcggatacggtggtggagccgtataatgcgacgttatcggtgcatcaacttgtcgaacattcggacgagacattctgcttggataacgatgctttgtatgacatttgcatacggacattgaagctgtcttcgccttcttatggtgatctcaaccatctggtgtctgctgtcatgtcgggcatcaccgtcagtctgcgtttcccagggcagctgaactctgacctgcggaaactggccgtcaatatggttcccttcccgcggttgcatttcttcatggtcgggtttgcccctttgactagccggagctcttcatctttccgtacaatatctgtgcctgaactcactcaacaaatgttcgattcacggaacatgatgacagctgccaactaccagaacggccgctttttaacctgctcaaccctgttgtaagtttccctctcagcccccctgccctttatattgttctgttccagatcaaattcgtgctttcaagacactaacggcacctccagccgcggcaaagtcgccatgaaagaagttgaagatcaaatgcgcaacatgcaaaacaagtactcttcctactttgttgaatggatccccaacaacgtccaaactgctctgtgctctatgccacccaagggcctgaaaatggcagctactttcgtcggcaattccacctctgtccaggaactcttcaaccgcgtctccaaccagttcacagccatgttccgacgcaaggccttcttgcactggtatactggcgaagggatggatgagatggagttcactgaggctgagagcaacatgaacgatctcatgagcgagtaccagcagtaccaggaggcgacggtttcggatggagaaggagcgtatgacgctgaagagggggag

SEQ ID NO: 36057 - DNA, 1088 bp, Aspergillus nidulans
tggattagcatgctgacaaatgatgcggacgtggatcttgtcctggatcatatcgcctcatcagggcataaaatcctgcgcatctggggcttcaatgatgtgaatactgagccatcgactggccaggtatggttccagaagcaccaagggggcgtttcgaccatcaatacagggcaatacgggttgcagcgcttggatgcagtagtcagctcggctgagaagcgaggcatcaagcttattatcaatttcgtcaacaactgggatgattacggcggaatgagtgcttacctgaatgcctacggtggcagtactaagaccgactggtataccagcgccaccatccaggctgcctatcgtacatacatcaaggcagtcatagacagattcatcgactcgccagctatctttgcctgggaattggcgaatgagccccgctgcaatggctgtgatacgtccattctatacgactggatcgctgacaccagtgcctacattaaatcacttgatccgctgcacatggtctgcattggcgacggtgagtaagacaagtctactgcgaataaagcaacaactgaccgaaccttgcagagggctttggactagacgagggctccgatggtagttacccgttcagctataatgaagggctcgatttcgccgcgaacctcgccattgataccatagactttggcacctttcatctctacccgggcagctgttcgtatcctgaattttccttcctgaaataccgtttggcaaactgaaagctaacatcgacgatagggggcgtatcgtatgattggggtaatctctgggccatcacgcatggcgcagcatgtgcaacagcgggaaagccatgcctatttgaagaatacggagcaccgtccgaccactgtgcaattgaggtcccctggcaaacgactgctgtaagctcgactgggatagctggcgaccttttctggcagtggggagataccttgagcactgggcagacccataatgacggaaacacgatctactatggctctgatgagtatacatgcatggtgacagagcatatggagcggattgcggcaaggtagcaagga

SEQ ID NO: 36058 - DNA, 1174 bp, Aspergillus nidulans
ctgggccagtggctcaaggagcaaggtgtcccggccattcacggggttgacacccgtgccctcaccaagcggatccgccagaagggtagcatgcttggtcgcttgctgctccacaaggccgatgttgctgaaaccgatgcagctctggcccaggatacctggaaatcatcctttgaacagattgactgggtcgaccccaacaccaagaacctcgtcagcgagggtgagctgccttctatacctgcttgctgatgatttctaacatgttcttgctagtctctatccgggagccgaaactcttttcccctcctgagaacgttgctttgaagcacccctctagccgccctattcgtgttctttgcctggacgtcggcctgaagttcaaccagctgcgttgcttggtcgctcgcggcgtcgaggttctcgtcgttccctgggactatgatttccccacacttgctggcaaggactacgatggtcttttcgtttcgaacggtcccggtgaccctgccaccatgactacaacagtcaacaacttggcgaagactatgcaggaggcgaggactcctatctttggtatttgtcttggacaccaattgattgctcgctctgttggcgctcagacgttgaagatgaagttcggtaaccgtggtcacaacatcccttgcacgagcttggtgactggaaagtgtcacattacctctcagaaccacggttatgccgtcgattcttccactcttccaagtgactggcaagagctcttcgtcaacgcgaacgatggtagcaatgagggtatcaggcacgtcagccgaccttacttcagtgtccaattccaccctgaaagcacacccggtcccagggatactgagtacctctttgacgtttttatcaacgctatcaaagacaccatcgcctcgccagaggcccttcagaagcctgtcaacttcccaggcggcgctgtggccgaaaatatcaaggcctctccccgggtctcagtcaagaaggttcttattctgggaagtggtggcttgagcattggtcaagccggtgaattcgattactctggaagtcaggccatcaaggccctgaaggaggaaggtatcaacacaattctgatcaaccctaacatcgctaccatccagacctccgagggtttgcggataaggtgtattgc

SEQ ID NO: 36059 - DNA, 1134 bp, Aspergillus nidulans
tccattgtcggtcgtccccgtcaccatgggtaaatatcccttaactgtatctccatcaacagagatgtggccgctgacgtccgaattagtatcatgatcggtatgggtcagaaggactcctacgtcggtgatgaggcacagtccaagcgtggtatcctcacactcagataccccattgagcacggtgttgtcacgaactgggatgacatggagaagatttggcaccacacattctacaacgagcttcgtgtcgctcctgaggagcaccccgttctcttgaccgaagcccccatcaatcccaagtccaaccgtgagaagatgactcagatcgtcttcgagactttcaacgctcccgccttctacgtctctattcaggccgttctctccctgtatgcttccggtcgtaccaccggtatcgtccttgactctggtgatggtgttacccacgtcgtccccatctacgagggtttcgctcttccccacgccatctcccgtgtcgacatggctggtcgtgacctgacggactacctgatgaagatcttggccgagcgcggatacaccttctccactaccgctgagcgtgaaattgtccgtgacatcaaggagaagctctgctacgtcgcccttgacttcgagcaggagatccagaccgcttctcagagctccagcctcgagaagtcctacgaactgcctgatggtcaggttatcaccatcggcaacgagcgcttccgtgctcctgaggctctcttccagcccagcgttcttggtctggaaagcggtggtatccacgtcaccactttcaactctatcatgaagtgtgatgtcgacgtccgtaaggatctgtacggcaacatcgttatggtatgtatcactcttagcctcgctctactgcactgggcggcactaacgaatcgatagtctggtggtaccaccatgtaccctggtatctccgaccgtatgcagaaggaaatcaccgcccttgcgccctcatccatgaaggtcaagatcattgctcctcctgagcgcaaatactccgtctggatcggtggttccatcttggcttctctgtccaccttccaacagatgtggatctccaagcaggagtacgatgagagcggtccttcgatcgtccac

SEQ ID NO: 36060 - DNA, 1371 bp, Aspergillus nidulans
gtggcctctctcgtctggatcattggcgcagttatccaatgttccgcccagaatgtagcccatctcgtggccggccgagtcattagcggtctctctggtgcgtcagtttctcgtgtgaatgtcgtctaaaactctaaccgcagattagtcggtgtgacttcttcccaagtatgtgtttacctggcggaactggccccagcccgtatccgcggacggattgtgggaatccagcaatgggcgatcggtaagactgctagccttctcccctacttctcttctcgtgtactcgactgatgggtccagaatggggtatccttataatgtacctgatctcgtggggctgcggcaaaggcatcgctggaccctccgccttccgagtcgcctggggtgtccaagccgtccctggtctcgtcttgttcctcgcgttatttttcttccccgagtctccgcggtggctggccagtcgtgaacgctgggaagaagcacttgatgttcttgccgccctccacggaaagggcaaccgcaacgatccagtcgtccaggtcgagtttgaggaagtaaaagagcgtgcgcgtctcgcagctgaagccaaggacgtctctttctttgctctttttggcccgcgcatctggaagcgaaccctgtgtggcgtcagttgccaggtctggcagcagttgcttggcgggaatgtggccatgtactacgttgtttggatcttccagatggctggaatggtaagtcgcccacgcacgccgacccgcctctgctggggaccgttctaacacgacctagagcggcgacacctccctctactcctccatcattcagtacgtgatcttcgtcgccacaaccggcgtcatcctcccctacatcgatcgcatcggacgccgtctccttctcgtctcgggcgccattatctgcatgatcatccactacgccattgcggccgtgatggctacacgcggcaacccggtcgatgaaatcaatggcaacgcctcgctcaagtgggaaatcaccggcgcgagcggcaaagccgtcatcgccatgtcgtacatcttcgtcggcgtctacggtctaacctgggcccctgcagcctggatctacgcgtccgaagtgttcccactaaagtaccgagccaagggtgtcggattgagtgccgccggcaactggatcttcaactttgcgctggcgtactttgttgcacctgcgttcacgaatatccagtggaagacatacattatcttcggtgtcttctgcacggtcatgaccttccatgttttcttcatgtatcccgagacagcgcagcgaagtcttgaagagatcgatcttatgttcgacacccatgtgaaaccgtggcagacggcgaaactt

SEQ ID NO: 36061 - DNA, 1251 bp, Aspergillus nidulans
cagcgccacctcaactaccggcaggtgcagatcatggccatgggaggatccatcggcaccgccttgttcgtcaacattggcggcggtctcgcaaagggcggtcccttgtccctactcctaggcttcaccatatactccctgatcctctcctgcgtcaacaactgcatcgccgagatgaccgttctccatcccgcgccgggcggttttattcgcatggccgggatatgggtcgacgacgcctttggcttcatggcgggctggaacttcttcctctacgaagcgctaacgataccgttcgagatcaccgcattgtccatgacgctctcgttctggagagacgatattcccgccggagcagtggcggctgtctgcattgtatcttattcgtatggttctttgcctttcagtgggcgtttccaattcccattattcctcaactgtccattcgcaagggtcagaactaagtgatgtctgtctagttgcttaagcgtcttcgccgtcaaagtctacggtgaagcagagttctggggctccggcggcaagatgctgctcatatcgattctgttcgcattcacatttgtggccatggtaggcgggaatccgcagcacgacgcctttggattccggcattggagagaccccgggcctatggctgagtacctgagcgcaggcaatctcggccgctttgaggggttcctgggatcattatggatggccagcttcacgactgttgggccggagtacgtcaccctgatcgcagcggagacaaagcacccgcgcacatacgtgaagaaagcatttcagaccgtcttctggcgtttcctgctcttcttcatcatggccgccgtcagtgtgggcattctcgtgccatacgacgatcctgctctgatcgcaaactttgtcaccaacaccgccgatggcagcaaatccggctcctccccgttcataatcgccatggggaatctacagatctcgggattgccgcatgtgatgaacgcgctactcgtcacgaccatcttctctgcgggaaatacgtacatgtactgcgccagccgcagcccctacgccttgtcattagaaggccgcgcgccccggatcctctcgaaatgcaccggacaaggcgtgcccatctattgcgtcctggtgacgatctgcttcccgctcctctccctcctgcaactcggcgacgcctcgagccaggtccttacctggctcacgaacatccttaccgctggaggcctgatcaattac

SEQ ID NO: 36062 - DNA, 1209 bp, Aspergillus nidulans
gcttttgcgacagttcagcaggatatcttcaagccaacgaagtatggtggcaaatacactgtgactcttatcccaggtacggccactaaatccacaccatatccgcgacgttgcgcgacgcgtacttgattcaccgaccaactaacgtcttactctgcccatcaggtgacggtatcggtgccgaagttgcggagtcagttaagactatcttcaaagccgacaatgtacccattgagtgggagcaggttgatgtcagtggcgtagacaccggcaacaagcactctgaggaactcttcaaggaatcaattgcttctcttcgacgaaacaagcttggcctgaagggtattctctttaccccagttgagcggtctggccaccagtccttcaacgtcgctcttcgacaggaactcgatatcttcgcttctgtcgtgctcatcaagaacatccccggctataagactcgccatgacaatgttgacctctgcatcatccgtgagaacacagagggtgaatactctggtcttgagcaccagtctgtgcaaggagtcgtcgagtcacttaagattatcactcgcgccaagtccgagcgtatcgctaagtttgcattcagctttgcgcttgccaacaacaggaagaaggtcacttgcatccacaaagctaatatcatgaagcttgcggacggtttgttccgcagcactttccacaagactgccgaaaactacccaaccctggaggttaacgatatgattgtcgacaacgcttctatgcaggctgtctctcgtcctcagcagtttgatgtgatggttatgcccaacctgtacggtggtattctttccaacattggcgctgccctcgttggtggacccggtgttgttcccgggtgcaacatgggacgagatgttgctgtcttcgagcctggctgccgtcacgttggtctcgatatcaaaggcaaggatcaggccaaccccagcgctatgattttgtctggttcgatgcttctccgccatctcggactcgacgaccatgcaaaccgtatttccaaggctgtctatgacgtgattggtgaagggtgagtatactgtgcgcaatcacattgtttggctcgctgacaagtttagtaaaacgcggactcgtgacatgggcggacaagccaccactcatgagttcactcgtgccgttcttgacaagatggaggctgctctgtaaacc

SEQ ID NO: 36063 - DNA, 1647 bp, Aspergillus nidulans
atggcggtcattcatcctgggtatcgttgtgtccatgggtggtttcatcttcggttactctactggttagcatcttcatcatgattgtgttagtgctcccgctgactgggcaggtcaaatttccggcttcacaacaatggcagatttcaagaagcgcttcgccgagcgccaagcaaacggcgagtacgtcttcagcaacgtccgcaacggtctaatcgtcggtcttctctgcattggaaccatgatcggagccctcgtcgccgcccccatcgccgaccgcattggccgcaaactctccatgtccttctggtcgatcatccacatcgtcggtatcattatccagatcgccactgactccaactgggtccagattgccatgggccgttgggttgccggtctcggtgtcggtgccctctccagcgtcgtccccatgtaccaatccgaagctgcaccccgccaggtccgtggtgccatgatctcggccttccagcttttcgtcgcctttggtatcttcatctcttatatcatcaactacggtaccgagtcgatccaatccactgcctcgtggagaatcaccatgggcatcggtttcgcttggccactgatcttaggtctcggagctcttttcctgcccgagtccccccgttacgcttaccgtcttggccgtattgacgaggcccgcaaggtcatggccaagctctatggtgttgaggttaaccaccgcgttgtcgtccaagaaatgaaggacatgaaggataagctcgaggaggagcgcgctgctggtgttgctccctggcacgaggttgtgactggcccccgtatgctctatcgtactcttcttggtattgctctgcagtccctgcagcagctctctggcgcaaacttcatcttctactacggtaactccattttcacctccaccggtctcaacaacagttacgtcacccagatcattcttggtgccgttaacttcggtatgaccctgcctggtctgtacattgtcgagcactttggtcgccgtgctagtctgatggtcggtggtgcctggatggccatctgcttctacatctgggcttctggtaagaataaatccatcctgccactcaaacgaaagacatcggctaacaagtctcatagtgggcaactccgttcttgatcttgacaacccgcagaacacccccaaggccggagccgccatgatcgtgttcacctgcttcttcatcgccggtttcgccaccacatggtcagtcacctcgtacatccgctacaaatctaacatactaacatgaccacctaggggtcccatcgtctggtccatctgctctgagatgtaccccaaccgcagccgcgccacaagcattggcattgccacttgtgccaactggacatggaacttcctgatctccttcttcaccccatttatctcaggctccatccactttgcctacggctacgtgtttgcctcctgctgtgttgttggtgtccttatcgtcttcttcttcgtcaacgagacccagggccgtaccctcgaggaagtcgacaccatgtatgtcttgcatgttgtcccctggaagagtgcttcctgggttcccgatgagagcatcgtccgtgatctccaccctggttccgatgctaacaagactgagg

SEQ ID NO: 36064 - DNA, 1179 bp, Aspergillus nidulans
gaaactacattggagattgaatatgttcgcgcattaataccgcctttgcatatcgcttcctttgagcatgacgactgggtaagctctatcgatgtactctccacatcttcgcccgcttcggcaggttcagatgctatagcccgtggccaggagcggattctctctggtagttatgacgggtttcttcgagtttggaacatgtcttcccaggtgatcgcaacttcgccgtcaccgaccgatggtgggcatatttcctctatcaaagccgccaaattcatctctccgagctcaattgcgtcggcaggtctcgaccggacagtgcgcttatggaagtatactgaggccgaagatggcttctctgggaagattgtcccgcaagtcgagctgtatggacataagtcaggaatcaactcgttagccgtacatgcatccacaaatcgcatactttcggcttcggcggaccacaacgttggtttctggtcgaccaagaaatcagacgctccagccgctcctgaaagtctacttccatcagctgcctcgagaacctcaaaaaggaggaagttaaatgcttccgtgagcgtctcacaacgcgggcccctggccctcctatctggccatactgcacctgtgtccgatgcaatattcgacgccagagactcgacagtcggatattcagtgtcttgggatcactcgctgcgtacttgggatcttgttaccgccgctttagtagatacgcgcacaacgtcccactcgcttctttcgctccagcacctgcccgatcacaacctcctcgccactggaacatctgcccgtcacatcactctcatagatccccgtgcgtcagcagcaacaatttcggccatgactctccggggtcatacaaatgccgtggtttcgttagctcgggacccgcacagcatatatggccttattagtggtagtcacgatggtacatgtcgaatctgggatttgcgtgctacgaaaacagataaaggcggtgccgtgggtgaaagcgtatattctatctcacggaagagcttggaggaagagggcaaggcgaacagcaagcgcgtgggaggtgagggtgtcaaagtctttagcgtgtgctgggatcgtgaggtgggcattgtgagcgccggtgaagacaagcgaattcaaatcaaccgcggcgagggcgta

SEQ ID NO: 36065 - DNA, 1374 bp, Aspergillus nidulans
aatccgggtgatctagtagatatcgctggtatcttccttcctacaccttacaccggcttcagagcgattcgcgctggattgctcacagacacctatctcgaagcccagcacatcacccaccacaagaagtcttacaacgacatcggcatagacagccgaaccctacgcaagatcgaacaacaccaaaagtccggcaacatgtatgagtacctcgcccggtccattgcgcctgaaatctacggccacttggatgtcaagaaagcgctgcttctgctcctcattggcggtgtcactaaagagatgggcgacggcatgcacattcgtggtgacatcaacatctgcctgatgggtgatcccggtgttgccaaatcgcaactgttaaaatacattgccaaggtcgccccgcgaggtgtttacacgacaggtcgtggtagcagtggtgttggtctcacagctgctgttatgcgtgaccctgttacggacgaaatgattcttgagggtggtgccctggtactcgcagataatggtatctgttgcatcgatgaattcgacaagatggaagacggggaccgaacagccattcacgaagtcatggaacaacagactatctccatttccaaagccggcatcaccaccacccttaatgctcgtacttctatccttgctgcagccaacccgctgtacggtcgctacaacccccgagtttctccagtcgagaacatcaatcttccagcagctctactttctcgcttcgacgtgatgttcctcatcctcgacactccgtcccgcgatgcagacgaggagctggccagtcacgtcgcttacgtccacatgcacaacaagcaccccgaaaacgaagatgcaggcgtcatgttcacaccacacgaggtccgccaatatattgccaaggcacgaacataccgtcccgttgttccctcacgggtctctgactacatggtcggcgcctatgtgcaaatgagaaagcgccagaagcgcgacgaagcgaacaaaaagcagttctcccacgtcaccccgcgtaccctgctcggtgttgtccgtatctcccaggctcttgcgcgccttcggttcagtgaagaggtcgttacagaggacgtcgacgaggccctgcgcctgattgaggtcagccgagcgtccctgtccaacgatggccaatcgcaccttgaccaaagccctacatctaagatctacaacctcatccgtggtatgctcgagagcggtgcagctgccgtcggagacggcgaagacggcgagctcagcatgaggagaatccgagagagggttctggcaaagggctttacagaggatcaactcacaatgacgatcgacgagtatgaaaactctcacgtacgtctc

SEQ ID NO: 36066 - DNA, 1271 bp, Aspergillus nidulans
ggcaaggaccccaaggtcgactacagcggacacttcgagtttggaggctctccaggagtcctcgccatgatgatcggctttccgctcctgatgtattacatgtggatcggcgccacttactacgacggcaagttccctagtccgtcagaaggacagagcatgtcagaatttttcgcgcacatgggacacctcgtatatgacggcgcgttcccgacgcttaaggcatggaccatgtactgggtgttcttcatctttgaaggccttctgtacctgctcgcccctggaatcaccgtcatgggccgtcccttgccgcaccttgggggaaagcagctgccatactactgctcggctctctggtctttctggactaccctcgccgtcgcttgcacacttcacttcaccggtgttttcaagctctacacaattattgatgagttcggttcgctcatgagcgtggctattctgtctggctttttggtctcttttgtcgcctacttttcggcattggctcgtggcgcgcagcaccgcatgactggttaccctatctacgacttcttcatgggggctgagctcaacccgcgcatgtttggcatcttggatttcaagatgttcttcgaagtccgcctgccttggtacatccttctccttgtcactatgggcaccgctgcacgccagtatgaggtgtatggatacgtgtctggagaggttggattcctgttcatggcgcacttcctctacgcaaatgcctgctccaaaggcgaggaatgcattgtgtctacatggtgagtttgccctgaagtttgaagaactctgctaattgattagggatatgtactatgaaaaatggggcttcatgctgattttctggaatctggctggtgtacccttgagttactgccactgcaccatttacctcgccaaccacgacccggccacttaccattggaatcgctatttcttggttttcctctacgtcgcctatttgtttgtgtactgggtctgggacacgaccaacagccagaagaaccgctaccgccagatggagcgtggcacgcgagtgttccgcaaggccttcccccaattaccctggcagacactccacaaccctaagactattacggccgctgacggctccaagatccttgttgacggatggtgtatgttttcccctagaaatcttatgaagtatactaacttcaacaaacggcaaggctcgcaagattcactacacttgtgatctctactttgcgctgaactggggtctaacaccg

SEQ ID NO: 36067 - DNA, 1431 bp, Aspergillus nidulans
ttcaccaatgatgtaaagggtatgggcatgaacctatagacaggccaaattggatgttaatttgatgagtacaaacagtctaatcaaagaggacaagactgttaagcgtaccggcgagatagtatgtcatacccgttgtaatcatcaattatgcttatcaagcattacttacaaaccatacaggttgatgtccctgttggccccgagcttcttggccgtgtcgttgatgctcttggtaaccccatcgatggcaagggccccatcaacgcttctaccaagagccgtgcccagctcaaggctcctggtatccttcctcgtcgctccgtcaaccagcccgtccagactggtctgaagtgtgttgactccatggtgcccattggtcgtggtcagcgtgagttgatcatcggtgaccgtcagactggtaagaccgctgtcgctctcgatgccatgctcaaccagaagcgctggaacaacaccagcgacgagtctaagaagctctactgtatctacgttgccgtcggtcagaagcgttccaccgtggctcagctcgtcaagaccctcgaggagaacgacgccatgaagtactctattgtcgttgctgctaccgcttccgaggctgctcccctccagtacctcgctcccttcactggctgtgctatgggtgaatggttccgtgacaacggccgccacgctgtcattgtctacgatgacctttccaagcaggccgtcgcctaccgtcagatgtctctgctgctccgtcgtccccctggtcgtgaggcttaccccggtgatgtcttctacctccactctcgtctcctcgagcgtgctgccaagatgaacgacaagcacggtggtggctctctcactgcccttcccgtcattgagacccagggtggtgatgtctccgcttacattcccaccaacgtcatttccatcaccgacggtcagatcttcttggaggctgagctcttctacaagggtatccgccccgccattaacgtcggtctttccgtgtcccgtgtcggttccgctgcccaggtcaaggccatgaagcaggttgctggttccctgaagctcttcttggctcagtaccgtgaggttgctgccttcgcccagttcggttccgatctcgatgcctccaccaagcagaccctcaaccgtggtcagcgtctgaccgagctcctcaagcagaagcagtactcccccatggccgtctctgacatggttccccttatcttcgctggtgtcaacggttacctcgacaacattcctgtcgctaagatcctccagtgggagtctgacttccttgcttacctcaagagcaaccaccccgaggtccaggagaccattgagaaggagggccaggtcagcaaggagcttgaggctaagctgaaggacatcatccccagcttcaacaagtccttcaacgca

SEQ ID NO: 36068 - DNA, 2366 bp, Aspergillus nidulans
cagcccttatcccggccggcacatactctctcgcccgatgaaatcttgcgcgaactcaaagtgaactcggaggagggtctcactgccgctgaagcgaagaagcggctggagctgtttggacccaatgaactcgaaggtggtgaaggtgtttcgcttgcgaaaattattattagacagattgccaatgcgatgatgctggttagttgtttccctctcctaagcctagctccgcttcgttttagttgattaacgtcctggtaggtccttatcatcgcaatggccgtcagtttcgggattgagtcctggattgagggtggtgttattggcgccgttatcggactcaacattgttgtaggcgtgtatcaggactatgccgctgagaagaccatggactcccttcggaacctgagttcacccaccggtgtagccacgcgcgatggcaaaacgaacactatccctgctaccgaaatcgtccctggagacatgattgaacttaaagtcggagacactgtcccggctgatgttaggtatgtctttcacgtactcgacgcagggttggactaatatcaaacagacttgtggacgccatgaacttcgaaacagacgaggcgctgttaaccggcgaatcgctgcccgtgcagaaagaggtcgatgtgacttttgctgaagacaccggccccggtgaccgcctgaatatcgcatatagctcttcaacagttactcgtggacgagcacgcggagtcgtcatcggcacaggaatgaaaactgaaattggtgctattgctgctgctctacacgcaaacgactccaaaagacgcccagttaagcgtggccccggaggtgagaccaagaagcgttggtacgtgcaggcttggaccctgactgccacggatgctgttggtcggttcctgggcatcaacgtcggaacacctcttcaacgtaaactttccaagctggctttgcttctctttggaatcgccgttgtcttcgcaatcgttgtcatgggcgccaacgaaatgcgcaatgacaaggaagtcattatctatgcagtcgctactggccttgcgatgattccggcttgcttggtggtggttttgacaatcacaatggcggtgggaacaaagcaaatggttgagagacatgtcattgtccggagacttgattccctagaggctcttggtgctgtgactaacatctgctcagacaaaactggaactcttacccagggaaagatggtcgccaaaagggcgtggataccatctctgggaacgtattcagtgggatcttccaataacccgttggatcctaccgagggtgaactaagcctcttgcctgatcctcctgttaagcttgacgcgatgcgcgaggagaccctgcagatccggctgaactgatcaaggataataagatcctggaggactatctcaatgtggcttccatggccaatcttgccgttgtccacaggtctgaaggaaatgaatggcaggctcgtggtgagccaaccgacatagcgatccaggtcttcgcacaccgcttcaactggggacgtgaacgctggacgaagggcgagaagccaatctggcgtcagaaggctgagtacccctttgactcgaccgtcaagaagatgtccgtaattttcgcccgggaagatgactctgaaaagggtcgtcaaatggtttttacgaaaggtgccgtggagcgagtcatcgattcttgcacgaccattctctggacccgtaacgaagatcccatccccatgagcgaagatatcaagagccaaattctgcaaaatatggaagccctggcgaaggaaggtcttcgagtcttgtgcttggctagtcgtgaatttgatactcctatcgccaacagcgaagaagtaccccctcgcgaggaagtcgaaaaggatctcgttttctgcggcttggtcggcctctacgatccgcctaggcctgagacagctggcgccatcgaagagtgctaccgagctggaatatctgttcacatggttactggcgatcaccctggcaccgcacgagccatcgccgctcaagtcggtatcatccccgccaacatggatgggattgctaaagacgtcgcagacgcgatggtcatgacagccagtcaatttgacaaattgacggatgaagagatcgacgacttgcccacattgcccctggttatcgctagatgcgcacctacaaccaaggtccgtatgattgacgctttgcatcgtcgtggccgctacgctgccatgactggtgacggtgtcaacgactccccatccttgaagcgggccaatgttggtattgcaatgggagaggcgggctctgatgtagcacaggatgcttcagagttggtcctgacag

SEQ ID NO: 36069 - DNA, 656 bp, Aspergillus nidulans
ctcttcgctttcgcgactgaggtgatggccacccctgtggcctatccaatgaccaccgcgtctccaactctggccaagcgggactcttgcaccttctcaggctcggacggtgctgcttctgctagcaggtcgcagaccgactgcgcgactatcactctgtccgacatcaccgttccatcgggcactaccctcgacctgagcgacctcgaggacgataccactgtaggttgatgttcctccagtcagctgtttggatagggctaactccagtccaggtcatcttcgagggcaccacctcctgggagtacgaggagtgggatggaccgctgctccagatcaagggcaacggcatcactatcaagggcgccgatggagccaagctgaaccccgacggatcccgctggtgggatggtgagggctccaacggcggcgttaccaagcccaagtttttctacgcccacgatctgaccgactcgaccatccagaacctctacattgagaacacccccgtccaggccgtcagcatcaacggttgcgatgggctgaccatcaccgacatgacaattgacaactccgccggtgacgatgcgggtggtcacaacacagacggcttcgatatcggcgagagctccaacgtggtcattaccggcgccaag

SEQ ID NO: 36070 - DNA, 1026 bp, Aspergillus nidulans
ggagccggcgttctaggaagacggttcgccgtcgtcctgatcgtatgcgggcacaccgtgcacatccgggaccccttgactcaagccctcagcgacgcggcctcattcatcgacgcccatcttcacgaattcactgccatcacaccaacgccgcatcccgtccccggcacatacaaagcgttcgccgagatctcctctgcagttgcaggcgcctggcttgtcattgaggcggtgccggaaaagctgtcgctgaaaattgacacgtttgcggaggtcgatcgccatgcaccggctgattgcgttattgcgtcgaacagtagcagtttcaagtccagtttgatggtagagaaggtgggcgagcaacggaaggaacgggtgctaaatgtccatttcaccatgccgccgcaaattcggacagtcgagctaatgacgaacggtcaaacgaggcccgaactttttgagagcttgagtaagatgttgaagggatgcggaatgatccctgttacggccagaaaggaatcgactgggtaggtgtcggctatatcattcttctgggttggaccattgctaacgttcttcatctgcagcttcatcttcaaccgtctgtgggcggcaatcaagcgtgagattatgctcatcttagcagaagacgtgagcacgcccgaggaaatagacctcttgtggacgaacatgtttcagctgccaaccagctctccgccgtgccagttgatggacaagatcggcttagacacagttgcgttcattgaagacaactatatccaggaaagggggcttgacggaagcatgactgtggactggctacgaaagagctatatcgatcaaggtcgactaggtctgaagagtgaaaaaggtggattgtacggaccgtcagccgccgctgcacctgctgccgctaccaaggcggcacagagtctgtacattctagatgtcggtttgggatcgaataacaaggttgaccagatccccacagccgggaaaatcctctactttgatcagtctaccgga

SEQ ID NO: 36071 - DNA, 1361 bp, Aspergillus nidulans
gtggctgctggcaattcctctgcctatatttttgagacgattctgccaacgtcggaaaggtgcccatgatgcccgagtatggtctgggattttggcaatgcaagctccggtaccagacacaggaagaattgcttcaggtggctcgcgagtacaagcgccgcgagctgccgattgacctgattgtcatcgatttcttccactggccgctccagggagattggcggttcgatccaacctactggccaaatccagctgcgatggtcaaggagctgaggggaatggggattgagctaatggtcagtatatggcccacggtggataagcggagcgagaactaccgcaaaatgttggagaaagggtttctcatccgcaccgatcgaggagtccgtacggcgatggactttcaaggagataccatacactttgacgcaactcacccaggtgcgcgagcatacgtctgggagaaatgcaaaacaaattattacgattatggcgtccgtgccttctggcttgatgaagcagagccagagtacaaggcctatgactttgataattatcgatactaccaaggaccaaacacagcaattggaaacatctatccactagaatatgcacgggcattctacgaggggatggaacaggctgggcaaaagaacatcgtgaacctggtccggtgcgcttgggtgggcagccaaaaatacggagcccttgtgtggagtggcgatattgcttcatcttgggaaagctttcagcaccaacttgttgcaggcctccacatgggattatgtggcattccgtggtggacaacagatattggaggtttccatgggggcaacccttcagatagcaagttcagagaactttttgtccgatggttccagtgggctacgttctgcccagtcatgcggctgcatggagatcgggagcccaggcagcctgttcagggcactaccgggggcgcttcctgtgctagtggcgccgataatgaagtctggtcatacgggctcgaggtatatgagatttgcaagaagtatatgttgctgcgggaggctctacgggattatactcgcggtcttatgcggtctgcgcatctcaaagggtctcctgttatgcgtacgcttttttatgaattcccggaagacccagaatgctggaggattggtacccagtacatgtacggtgatagatatctttgctgtccggtactccaggatggtcagcgtcagctcaaatcctacttgcctgcactgaggagcggaaagtgggtgccattccagaacgacgatgctgtgaaagaggcatatcctggtggacaatggattgagatctgcgcaccattgcattggatgccagtgttcgag

SEQ ID NO: 36072 - DNA, 1020 bp, Aspergillus nidulans
aaatgcccatccggtgaaatatcctcactgcttgagcagaggatacgtgggctcaaagggtcacctaaccttgccgagtctggccatgtcttgtctgtctgtgatggaattgttcgcgcgcgtggtttgacgaacgttcaagctgaagaacttgttgaatttgaatctggagtaaaggggatgtgtatgaacctggagtccaatcatgttggtattgtgctttttggttccgatcgtcttgttaaacagagtgagcctgtctggcggactggcgaaattgtggatgttcctgttggtcctaagatgttaggacgtgtggttgatgcactgggtaaccctattgacggcaagggacccatcgagactaccgaaagaagtcgtgcccaaatcaaggctcctggtattttgcctcgccgttccgtcaaccaacctgtccaaactggcctaaaggctatcgatgccatggtgcctattggcagaggccaacgtgaactgatcattggcgatcgacagactggaaagactgctatcgccctggacacaattttgaatcaaaaaatatggaacaagtcggatgacgaatcaaagaagttgtactgtgtttacgtggccgttggacagaagcggtccacagtagctcagttagtcaagaccctggaagagaacgatgctatgaaatattccattgtcgtggctgctacggcatctgaagctgctcctctgcaatacattgctccttttgccggttgtgcaatgggggagtggttccgagaccatggtcggcacgccattattatctatgatgatctgtcaaagcatgcagttgcctatcgtcagatgtcgctgttacttcgtcgcccccctggacgtgaagcttaccccggggatgttttttacctccattctcgcctcttagaacgtgcagcaaagctgaatgataaacatggtggcggctcactcactgctcttcctattatcgagacacagggcggcgatgtgtcggcttatattcccacgaac

SEQ ID NO: 36073 - DNA, 651 bp, Aspergillus nidulans
ggattttttctgaactctcactgcgccgtcatcggaatcgttattccatttgctgccctccaggctaagttcggcccagtcgaagaggtagaggttttcacagaacaagccgtgtctggagctggctacccgggcgttcccagtatggatatcatggacaacgttatccccttcatcagcggcgaggaggataaacttgagaatgaagcccagaagatccttggttcactgacagcggatgccaccgctttcgacgagcagcaaggacttaggatcggagccacctgcacaagagttggtgtcaccgacggccacatggcgttcgtttctctgcgtttcaagaaccgcccagctcccagcgctgaacaagtggtgcaagccatgagagaataccagtcagaagctcagaagcttggatgtccatctgccccggccgaggccatcaaagtgttcgatgagcccgacaggccgcagccaagactagaccgagacatcaacaggggttacacagtcagcgtgggacgagtgcgcgagggtaaccagggtggttatttcgatatacgattcgcagctctctcacacaacactgtcatcggggctgctggatcttcaatcctcaacgccgaagtggcagttatcaagggatacatc

SEQ ID NO: 36074 - DNA, 832 bp, Aspergillus nidulans
tcccagattggcggcgaacttaccgttgacgagcgtaaccttctctctgtcgcctacaagaacgtcgtcggtactcgacgtgcctcgtggcgtatcatctcctccattgaacagaaggaggaatctaagggctctgagcagcacgtcagcattatccgcgagtaccgtcaaaagatcgagaccgagcttgagaaggtctgccaagacgttctcgatgtactggacgagtccctcatccctaaggctgagacaggcgagtctaaggtgttctactacaagatgtgtgttcagtcatattcagcaattgaatgaagtgtctgatgtgataaataggaagggtgactaccaccgctaccttgctgaattcgcgtctggcaacaagcgcaagcttgccgccaccgctgcccacgaggcttacaaggtatgattagactctaactctgcacctgttattagagcatgagctaaataaacataatagaacgcaaccgacgttgctcagactgagcttacccccacgcaccccatccgcctgggacttgccctgaacttctccgtgttttactacgagatcctgaactcccctgaccgtgcctgccaccttgccaagcaggctttcgatgacgctattgcggagctggactcactttccgaggaaagctaccgtgatagcactctcatcatgcagttgctgcgtgataaccttactctgtggacttcgtccgacggcaacgaacccgagaacgtgtctgcccccaaggaggagaagcctgaggaggacgctgctgctcccgaggagaagcccgaggaagccaaggctcccgagtcgtaa

SEQ ID NO: 36075 - DNA, 1230 bp, Aspergillus nidulans
ccaatgaacgtgacatgggtcccctcgtttccaacaggccatgaaacaggccggtaccttgccattgacatgggcggcacaaatctgcgaatctgcgatgtgaccctgaccgaggaaaagggcgcgtatacgatcgagcaggacaaataccggcttccaatccatctgaggaagggcaaaggggttgaattatgggagttcattgcagcaaaactcgaggactttctcgctaaacacaagctggccagagaggatggggaaaaactgccgctggcctttaccttttcgtacccagtcacacaggaccacatccggcatggggtcctgcaacggtggacaaagggttttgatatatccggtgttgagggggaggatgtcgtcgcacatctggaggaggtgtttgagaagaggaatgtgcccgttaggcttgtggcactggtgaatgatacagtcggcactctcatcgcgtctgcctacaagaacccagctatcaagatcggcagcatctttgcgacggggtgcaatgccgcctatatggagaaggtgtcgcgaatccccaagattgcagatcacggctccgagttcgagagcgacgccctcgtctctatcaactgcgaatacggcgcttttgataacgcacacaaggtcctccccatgacgcggtttgacgaagagattgatcagacctctgcaaggcccgggcaacaggcctacgagaagatggtagccgggatgtacatgggcgaactactgcggctcctcctcctccacttgcacgagtccagtgggtttttcaccgatgccgagattgaccggctacgaggctatggcacgatggattctgcgtctctgtcgcgaatggaagcgggaggatccgaggcagagcggatgagtgacgccaagtgtatattgaaggacttgtatgggattgaggcgaccgacgaagaggcaagggtttgctgcctcttgggggagattgtgtgcactcgtgcagcgaggttatatgcatgcggtattgcagcattgtgccggaaacagggcatcagcgagtgtgccgtcggagtcgacgggtcgacttttgagaagtactcgcagttccgcgaacgtgcggtcgatgccctgggcgagattctggactggcctgaagggcaacagcttgtgaagctggtcacggcagaggacgggtctggagtagggtctgctctgattggggccatcacactgaatcaa

SEQ ID NO: 36076 - DNA, 2445 bp, Aspergillus nidulans
caggacagggtctgctcgacagttggggcggtgcctgggtcggatgttgttcagggtgctgattttgttcgatcatcatatggctacgaatatagccatcgttggcgcaacttcgggatcattgttgctctcaccgttttcttgacgatgtgccatttggtcacatccgagctggtctcttctcagcgctccaagggagaggtgctcgttttccgtagaggcaaggcgcaaaagatgcgggaaaagcgacaccacaccgatgaggagcagatagcagcacccgcagcgcagaacgaaaaggttatccaagaggagcctggcctggtttcaggtgtggagcagcagtcttcaatttttcactgggaagatgtgacctatgacatcaagatcaagggcgagacaaggcggatcctcgatcgtgtagacggctggattcggccggggactttgacagcgctgatggtaagcagccttgctcttcacaaggattgagactgatcttcatagggcgtttccggtgctggcaagacgactcttctggatgtattggcgagtcgcaccacgatcggcgttgttggagggaatatgctggttgacggccgatctcgagatgaatccttccaacgtaaaaccggctatgttcagcagcaagacctgcatttgcatacgtcgaccgtacgagaagcattgaagttcagtgctcttctccggcagccgcctcagtacagcagggctgagaggttagcctatgttgagaccgtcattgatctgctcaacatgagagagtacgctgacgcaattgtcggagttccgggtgagggcctgaatgtcgagcaacgaaaacgcctcacaattggtgtcgagctggctgcccgtccgaagttgctactcttcttggatgaacctacctctgggctggatagtcaaacctcatggtcgatctgcaacctcatggagaccttgacaaagaatggccaggcaattctgtgtactatccatcaaccttcggcaatgttatttcagaggtttgaccgactcctactgctagcgaaagggggcaagactgtgtattttggcgaagttggccaaggagcaagaacccttatggactactttgtccgcaatggtggttcggcttgtcctccaggggccaatccagctgagcatatgcttgaggtgattggggctgcgccaggggcacagacagatatcgactggcctgaagtgtggaggagcagtcctgagtaccagcaagtacgaagtgaacttgcaagactaagagagttggccaatcgtccatcgccagtctcagacccgaatgacaagtctagctatgctgagtttgcagcaccgttctctgagcagctccttcaagtcggccgccgagtgtttcagcagtactggcgcagcccgtcctacatttattcgaaagctttgttgactgttggctgtgtaagtcgtctcccagtctctagagcttgcttttccctaactagatcagtccctctttattggattctcgttcttcaaagcggacaacaccagacaaggccttcagaatcagatgttcggtgtctttgtatttctttttgtagtcgttcagctcgtcatgcaagtcatcccctccttcgtcacacagcgaactctctatgagtcgcgggaacgacagtcgaaaacttatgcatggcaagcatttgttctttccaacatcatcgtcgagtttgtgtggaatacagtacgctcctcacttcgtcttttatgacttccaccttctatggctcccactaacgtcatgcctagatcatggccatcttctgctacctcgtctggttctatcctgtcggcttgtaccagaacgcgcgatatacggacaccattcactcccgaagcactctcacattgcttatcatctgggcggtcttccttttcgccagttcattcgcgcacatgctgattgccggcgtggatagtgcggagatggcatccgccctctccaatatcttcttcatcatgatgtacgcattctgcggtattcttgccggtccaaatgcgcttcccggcttctggattttcatgtaccgtgtcaatccgcttacatacctcgtgtcctccttgctatcagccactcttggagatgcacccatgcactgcgccaataatgaggtcttgacattcttcgcgccaccggggctaacctgtcgcgagtatatggaagattaccggtctgtcaatgggggttacttgctcaacccggatgcgcaaggcagtgatcaatgtcagttctgcagcttggagtacaccaaccagtacctgagcagtcttagtattgacttcaataaccggtggcgggatttcggcctcctctgggtctacgttattgtcaacaccgtcggagcaatcgtcttctacaagctgttccgggtgcctagggcaaaaaaggattaa

SEQ ID NO: 36077 - DNA, 2439 bp, Aspergillus nidulans
tcttcgcctgagatcttgcttaataaggacaagcaagaggccaccataaagttctctgaaaccatctctgccggttcgtcagctcagctcaagctgaccttcaccggcacgctcaatgacaatatggccggtttctaccgctcgtcttacaagacaccgcaaggagagacaaagtacatcgcctcgacgcagatggaaccgaccgatgcccgccgagctttcccttgcttcgacgagcccgcgctcaaggccaagtttactgttagtctgattgcggataagagcatgacctgcctcggtaacatggatgttgcttcagagcaggagcttgagggtggaaaaaagattgtcaagtttaacacatccccggttatgtcaacatatctggtggctttcattgttggccatctcaactacattgagactaagaacttccgcgtccccatccgggtatatgctacaccggaccaggacattgaacacggtcggttctctctagaacttgcggcgaagacactggcgttctacgaaaaggccttcgatagcgagttcccgctcccgaagatggatatggttgcggtgcccgattttagtgccggagccatggagaactggggcttgatcacgtaccgtattgtggatgtgcttttggatgagaagaccagcagtgcctcgcggaaggagcgcattgctgagaccgttcagcacgagcttgcccaccagtggtttggaaacctggttaccatggatttctgggacggcctctggctcaacgaaggttttgccacctggatgtcctggtattcttgcaacagcttctatcccgaatggaaggtctggcagacgtacgttatcgacaacctgcaaagtgctctttctcttgattcgcttcgcagcagtcaccccattgaagtacctgtgaaacgtgcggatgaaatcaatcagatttttgatgccatctcttactccaagggatcctccgtcctgcgcatgatttccaagtatctgggtgaagatatcttcctccagggcgttcgtaactacatcaagaagcatgcttatggcaatacacaaactggcgatctttggtccgctcttgccaatgccagtggcaagcctgttgaagaagttatggatatctggacaaagaatgttggattccctgtagtcaccgtctcggagaaccctacctcttcgtccatcaaggtcaagcagaatcgattccttcgcacaggcgacgtccgtcctgaggaggataccaccatcttcccagtcatgcttggcttgcgcacgaagcagggtgtcgacgaggacactctactgtctgagcgggagggcgagttcaagcttccagaccttgatttctacaagctcaacgctgaccattccgctatctaccgcacgtcgtacaccccagagcgtcttaccaagctcggtgaggctgccaaggcgggcttgcttaccgttgaggatcgcgcaggtatgatcgctgacgccggtgccttggctgcctcgggataccagagcacttccggactcctctcactgctggctggattcgacagcgaacctgagttcgttgtctggaatgagattttgacccgtgtaggtgctcttcgcgctgcttgggttttcgaagatgcccagaccaaagacgcattggaggggttccagcgcgctctggtcagcgacaaggcgcacacactgggctggcagttttctgagaacgacggccacatcatccaacagttcaaggctctgctgttcagcgccgccggaaatgccggagacaaaactgtggtccaggccgcccaggacatgttccagcgcttcgctgctggtgatattagcgccattcacccgaacattcgcggtagcgtcttctccattgttctgaagaacggcggtaagaaggaatacgatgtcgtgtatgatcgcttccgcaacgcccccacctctgatgaaaagactaccgctctccgctgccttggcgccgccgaagaccctgagctcatccaacgcactcttggcctggctcttggtgatgaggtcaagaaccaggacatttacatgccacttggtggccttcgcaatcacgccgccggtatcgacgcacgttgggcttggatgaaggacaactgggacaccctctaccaacgcctaccccccggactaggcatgctcggaactgttgttcagatttgcactgctagcttctgtacggaagagcaactcaagggtgtgcaaaacttcttcgcaaacaaggataccaaggtgagttcatacgtcttttttttttttttttggtgcatttgactgacaaaattatagggctacgatcgtgctattgagcaaagtctcgacgcaattcgcgccaagatcagctgggtccagcgcgaccgtgctgatgttggatcatggttgaagtcgaagggatac

SEQ ID NO: 36078 - DNA, 1590 bp, Aspergillus nidulans
cggcgtatccttgatcatattgatggttgggtgaagccggggactctgacagccttgatgggagtcactggagctggtaagacctctttattggatgttctagcggatcgcgtgacgatgggtgtgattaccggagagatgctggtggacggacgcttacgggatgactcgttccagcgcaagacgggctacgtccagcaacaagacctgcatctggagaccagcactgtccgtgaggcgctaatcttcagcgcgatgctccgtcagccagccagcattccacgaaaggaaaaactggcttatgtggaagaagtcatcaagatgctaggcatggaagagtatgcagaggctgtggttggtatcctaggggaaggcttgaacgtagagcaaaggaagcgccttactattggagtggaactcgcagccaaacctgatcttcttcttttctttgatgagccaacgtctggtctggacagtcagacagcatggtctatttgctcgctaatgaggaagctcgccgatcatggtcaggcaatcttatgcacaattcaccagccgtccgctatcctgatgcagcaattcgatcggctcctattcctggccaaaggtggaaagaccatatactttggtgagctaggtgagaacatggggactctgatcgagtattttgagaagaaaggttccactccttgcccaaagaatgccaatcccgccgaatggatgttggaggttattggtgcggcgccaggctctcatgcagacagggactggtctgaagtgtggaaccaaagccctgaacgcgagcaagtgcgcgcagaactagcacggatgaaggccgagctcttacaaaagccagagcctccgagaactcctgagtatggagagttcgcaatgccgctctggtcacagtttctcatttgcctaaagcgaatgtttcagcagtactggcgcagtccatcctatatttattcgaaggccaccatgtgtgtgattccggtatgttcccttctatgctttgaacgtgaaaggaaactaatgatgtagcctattttcattggatttacattttggagagagccgctaagtctccagggaatgcagaaccaaatgtttgccatcttcatgttacttgttatctttcccaacctcgttcaacagatgatgccgtactttgtcacacagcgtgcgttgtatgaggtgcgggagagaccatccaaggcgtattcgtggaaagctttcatgatggccagtatctgtgtagagcttccttggaacatcttgatggcagtaccagcatacttctgctggtactatcccattgggctctatcgcaacgccggtcctggcgaaacggtcgagagaggaggcacgatgtttctgctaattttaattttcatgatgttcacgtcaaccttcagctccatggtcattgctgggatcgagcatccggatacgggtagcaacatcgcccagttgctgttctcgttatgtctcattttcaacgggtaagagatctttcttgatgccatcgctcattgcaaacagctcagtgtacttgcaactccccaacaaatgcctagattctggatc

SEQ ID NO: 36079 - DNA, 1093 bp, Aspergillus nidulans
gaattcgagcttgcgcgaacgtgggaaaccctggttgaaggagcagatggcacgatcagctcaacagtgggagggttattggaagccagtaagagaaagaggtgagttagcaagtgttcgtctcaagcatcgcccgcgtcacaagtatgggcattatggcgctttgctgatggttgggtgaaggcttctaaaggacacaacaccactgcagcgcggaattatacgccatataatattgatcctggatctatcacagtcgatgatggagaaagacctacgaccaacgcggtatcttctgacactacgatatgcccaagagtttgtaagggaattcttcgaacagaatcctatctctcaggttggtgttatcgggctgagagatggccttgcgctacggatcagtgatatgagcggaaatccgaccgaacatatcagcgcgatacaggatttaaggagtcaggatccgaagggccttcctagtctgcaaaatgggcttgaaatggccagaggtgcactcttgtagggttctttcacatcaagagacacccttccctccatgacgcgtactaacgactgtgccattccagccatacccccagccatggaacgcgagaaatattcattgccttcggctcactgctttcctccgaccctggtgacattcatcagactatcaccacacttatcgatgataaaattcgtgttggaatcgtgggccttgctgcccaggtagcaatctgccgtgagttgtgctctaggacaaatggcgccgatgatacctactacggtgctgcccctaacgagcacttttttcacgagtttatgctgcctgtaacaactcctcccgccacctttctcagaaacactcccacagcttactacttatgaaggcgtttccatcctgaatcatcaagctttctcctatttccttgcacgctattttaatcccactctgggtggtactttttatttactctaccttttaatcctttgctttatgctcatttctttccccttattttccctaccccattatctcctcttatcctttcctatactcttcatctcccattccctcttttccccttccaca

SEQ ID NO: 36080 - DNA, 1048 bp, Aspergillus nidulans
atggccgacagatattctttctccctgaccaccttttctccaaggtaagcggacgtctaatgatgaggcaccacggcttgctaacaaccttctagcgggaaactcgttcagattggtatgagtcttaactgccaatcttaagcgaccgtgctaattgatatagaatatgcattgaacgcagtcaaccaaggagtaaccgctcttggaattaaaggtgcagttggctgacctccgactagacgtgacagctactgatctctcgctgcagctacaaatggaatcgttttggccactgagaagaagtcttcctcgcccttgattgatcctccctcgctctccaagatctccctcatcacacccgacatcggcatggtctacgccggtatgagccccgactatcgagtgcttgtcgacaaggcccgcaaggtctcacacaccggctataagcgcatctacaacgaatacccccccacccggatattagtgcaggatgttgcccgcgtcgttcaagaggcaacacagtccggtggtgttcggccatatggtgtcagcttgctgattgcgggttgggacgagggtgtcgagcctgagaccgcccaggctcagaagggagaggaggaagagcccaagaaggctactggaaagacaggcggcattctgaagggaggtcccagcttataccaggtcgaccccagcggcagctattacccctggaaggctccggccatcggaaagcacgccacgagtgcaaagacgttccttgagaagcgttacacggaggggctcgagcttgaagatgccatccacattgctctactgactttgaaggaaacaatcgaaggcgagatgaatggtgacacgatagaaattggtgagtgtttggaagagtattcgcaactcggggcgcgaaaagctaattgtcgctataggcatcgttggccctcccgccgatcatttgcttggctacgagggcgttgaaggagcccgtggtccccgattcaggaagcttacgaaagaggagatcgaagactatctgaccagtctataa

SEQ ID NO: 36081 - DNA, 956 bp, Aspergillus nidulans
ctttcccgccctttcggcgttcagctctggccgcacttcagcagggcattcactgcactgtcaggcaaatcccccgctgatttccagctcgtccctggcgagacgccgatgacgacgctgcagggcacgcttctgtctctggcgacttactacgtcgttgtcctgggcggccggcagctcatgaagagtcaggccccgtttaaactacgaatcccgttcatcatccataatttcatcttaaccgtgataagtggtgtgttgttggcacttttcctggagcagattctcccaacgctctcaaatgatggcgttctccatgcaatttgcgatgcgcgcggtgggtggacggacgagttggtgcttctttactacgtacgttttacaccagctaagaaaaccaacgaaattgaaagctggcctatgctaaagagactcgcagctgaactacctgaccaagtatctcgaactggcagatacagtcttcctcgttctgaagaagaaaccactgacattcctgcacacctaccaccacggtgccacagcgctgctatgctacgttgagctcgtcggccgtacttctgtctcatgggttcctatcacgctgaacctgatggttcacgtcgtgatgtactggtactatttccagagcgcgcgcggcatccgcatctggtggaagcggtacatcacgctgctgcaaattgcgcagtttgtcattgatatcggtattgcaccagtctccaactcacagttataccctttgctgattgtggttgacagggtttatctacttcgcctcctatacgtactttgcctcaacgtatttcccctgggtaccgaatgcgggctactgcatgggtgaggagtatgcggctggcttcggcgtgttcattatcagctcttatctgttgctcttcatctcattctatcttacaacgtacagggaaaaggcgccgcgg

SEQ ID NO: 36082 - DNA, 1373 bp, Aspergillus nidulans
aacccttccaccggcgagcccttatatgaggtgccctgggctacagaggaagatgtcgaccgcgccgtagagcacgcccgtactgccttcaagtcgtggtcccggcttccgttccaggagcgttcgcggcttctggtcgcgtatgcggatgccgtggaggcagagcgtgcgccattggcgaaactgctggtcctggaacagggtaagcctctgagcctggcccagacggagctcgacatgagcgtgcagtggttgcgcacatttgtgacaatggaggtcaaggacgagctcctggacgataacgaggagcgctctatcacccagacctttccgccgctgggcgtgtgctgcggcatcgttccctgaaactggccggtcctgctcgccctgggcaaggtcggcccagccctcatcaccgggaatactatgatcatcaagccgtccccgtacacgccttactgcgatctgaagctcggcgaaattggcatgcgcatcttcccgccgggtgtcctccaggtgctcagcggcggcgacgagctgggtccgatacttacgcagcatcctggcattgataagattacatttacagggtcgagcgctacggggaagctggtcatgcagagctgcgccaaaacactgaaacgcgtgactctggagctcgggggcaacgacccggctatcatctgtgaggatgttgatatcgatgctattgtgcccaagatcaccagtctcgcgttcctcaactccggccagatctgtatgctcattaaacgggtatacatccacgagagtatctacgatgcctttcgtgacgctatggtcgcgtttgcaaagtcgatcaagaccgcagacgggtttgagccagacgcgttcgtcagcacgatccagaacagcatgcagtaagtttttgtcgtatatttattccctgatcttgaattttttggagacttcacgctaatcggaataagaggtacgaaaaagtcaaagacatgtactctgagatcggaaagcgcaactggaaacaggctctcgagggcaaggtattcgagaactccaagggctattacatcagccctgccatcattgacaaccctcctgaagattcgcgtatcgtcctcgaggagcccttcggccccatcgttcctcttctcaaatggtctgacgaggaggatgtgattgcacgcgccaacagcctgaaagacgggctaggtgcctccgtctggagcaaggatctcgatcgggcggagcgaatcggcaggcaactgtctgccggcagcgtttggctcaactcgcactttgatgtcgctccgaacgttccattcggcgggcataaatggagcggcctcggcagtgaatggggcatgaccggcttg

SEQ ID NO: 36083 - DNA, 664 bp, Aspergillus nidulans
ccttcgcagtgcccccaacatatctgggtcgtcactggccccgccggaagcggcaaaagcaccgtcggccgctacctccagcaggaattgggcgtgcccttcttagaaggtgatgatgtaagttcaagccttcccgactatacctgcacttttcggcaagagctaaacgaagaatgaatatcaatagtttcaccccgccgccaacaaagccaagatgtccgccgggacgcctctcaccgatgcagaccgctgggactggctcatctccctgcgcagcgcggccacaaccctgctcagcaccccagcacccacatccacgaatcccacgtcgacatcaacgcgagcgcaagctccaaccggtgtcgtcgttgcctgctccgctctgaaaaagaagtaccgcgacgtgatgcgcgtcgctgcctacgggtcccccaatgtgcgcatccacttcgtctacctgaagctcgagcctgcgacgctatatgcgcgcgtctcggccggccaggcgcattatatgaagcagggcatggtggagagtcagcttagagatttggaagagccggggcagggagaatgggatgttattactgtgcctgtgcaggtgggcatgggaatgggagaggtgcagagggaggttatgaatgctgtagagaaggttatacgt

SEQ ID NO: 36084 - DNA, 1833 bp, Aspergillus nidulans
catgagtggaggaacctcggcattttgatagcattctggatcttcttcatcgtcgtatatctggtggctacggagctgaactcagcgacgtcttctaaagccgagttcctcgtcttccgacgtcgtcacgtaccgccgcagatgcgcattcttggcaagtcccaaggagacgcttcgcctgaaaatgtcgctctagctgagaagcctactgaagtggcgccaaatacgtccgcaattccagaacagcacagcattttcacctggcgaaatgtgtgttatgatattcctgtcaaaggcggccagcgccgcctgcttgacaatgtcaatggctgggtcaagccgggaactctgacagccttgatgggcgtgtcaggagccggtaaaactacccttctagacgtactcgcgaagcgtgtctctatcggcgtcgtgacaggggatatgtttgttgacggcagaccactggataccagcttccagaggaaaacaggttatgttcaacaacaggatctgcaccttccaaccactactgtgcgagaggcactacaattcagtgcagtactccgtcagccaaagacagttcctagggctgagaagtatgcgtatgttgaagaggttattgacatgcttaatatgcaggatttcgcggacgcgattgttggtaccccgggcgaaggtctgaacgttgaacagcggaagctgttgacaattggtgttgaacttgctgcaaaacctgcactgcttatcttccttgatgagcctactagtggtctggattcgcagagctcctggtccatttgttcgttcttacgcaagcttgcggatcgcggtcaggcagtcctatctacaattcatcagcctagcgccttgctcttccaacagtttgatcgtctattatttctggcaaaggggggtcgaacagtctactttggggatattggcgaggactcccgtacattgctcgattactttgaagcaaatggagcaagagcatgtggttcatctgagaatgttcgtccttcttgcaagaattgttacaaatactgacttcagcagcctgcagagtatatactcgaagttattggggccggtgcatctggaaaatcagacttggactggccatcaatttggaaagaaagcacagaagctcgagaagtcctgcaggaaatcgacagaatccataaagacagggcttctgcatcatcagtggaagacaaaaacacgcatcgagaatatgccatgcctttcactgaccaactgtggcaggtaactagtcgagtatttcagcagtactggcgcgaacccatctacgtctgggcaaagctaatcctagcaatcgcctctggtctcttcatcggcttcacttttttcaaaccagatagctcacaacaaggctttcaagatgttctgttcagcgcgttcatgctcacatccattttttccaccctagtccaacagtgagtacatccctaccgaacactcccatccaactcctattaacaaaagccaagaattatgcctaaattcgtcatccagcgctccctttacgaagtccgcgagcgcccctcaaaggcttactcctgggccgctttcataattgccaacgtccttgtcgaaatcccctggcagattctagccgccatcgtctcttgggctagctattactttcccgtgtacggggcctcgcagcccccgcaccgacaaggcctcatactcctcttcgtgatccaattcttcatcttcacatcaacatttgccacattaatcatttcttctctgccggatgctgaaacaggcggaaccatcgcaaccctcatgttcatgatgacgctt

SEQ ID NO: 36085 - DNA, 1170 bp, Aspergillus nidulans
ttacaccatattaagcacttttcccgctcatcatgtaagagcgactatgcggatacgctcccaaacctcaagattggcgcgcataccagagttctgttccagggatttacaggtaaatcaacccatgggtatatcactatctcgctaacaagcattgcaggcagacaggtaggctcgagtcgaagttacaacaatggagactgaccagctaggctacggcgaacgtgaaagagtcattggaatggggaacgaagatcgtcggtggtgtaaagcctggtgtggaaggggaacacctgggactgccagtcttcccatctgtcaaggcggtacgaatccattgctttgttcccgagtccattactgatactgtgataggcccaagcgcaagcaaagccggatgcctccgcaatttatgtgccaggaagtcagacggcaaaggcgattgaggaagcaattgaagccgagatccctcttgttgttgcagtggcagagcacgtcccgctccatgatattcttagggtacgtacggtttctccatgaaataggttgggtatgtgcttacagttgacaggtccactccatactcaaaacccagtccaaaaccagactcgtcggggctaattgtcccgggataatctctgcgattgggaaatgccgcatcggattccaaccgctgccctgctttgccccaggtaagataggtatagtcgcgaagtcaggtactttgagttacgagactgttgcctctactactcgtgcggggctgggtcagagcctctgtatcagtatgggtggggacccgctcgcggggacgaactttgtcgatgctttaaagatctttgaaaacgaccctgatacagaaggaattatcttggttggtgagattgggggaacggccgaaatggatgcggcggagtggattagagattaccgtcgcaggactacgagccccaagtatgtgcttcgctctgctacactccacaggactgacaggaaagaccgattatggctctagttggcggccgacaagcccctccgggacgaataatgggccacgcaggagcctggacggcacctggtgagcccgggccagaggagaagtatagagcccttgagcgcgctggcgcggtcatggtcaaccatccagagaaatttgggaaggggatgaag

SEQ ID NO: 36086 - DNA, 1525 bp, Aspergillus nidulans
gttctctacaccaaaatcgacacacgccccccagaggttatccacagccggggaaactacctgcacaccagcgatggtcgtacaatatttgatgccagcggtggcgccgcagtcgcctgtctgggccataatgaaccccaggtgaagcaggcaatcatggcgcagctagacaaggtagcctacatctactcgccgttcttcactgtgcctgctgcggaagagatagccaccttcctgaccgagtcgacggggggtgcgatgagcaaggtgtttattgtcagctctggtgggttcctttttcgtccttgccctcttgaatgttcttgattgagactataggtgctcgataattgaccgggacaggcaccgaggcaatcgaagccgcactcaaaatgacacggcagtattttacagagctctcgaagcctcaactacaacggacaaagttcattgcgcggaggcagtcgtaccatgggaatacgttaggatcgttggcggccggtgggcacaaggcgcggcgggcgatattcgagcctatactggcggcaagcacatcgcacgtctcgccatgctacccataccgggagatgaagaaaggtgaaagcaatgaggagtatgtctctcgcctggctgaggagctggagaatgagtttcagcgggtcgggcccgatactgtctgtgcattcatcgcggaaaccatgtcaggaacggtaggtcaacaactcggaccaattcgcgcttgcaagtaaactaattgaaaaaagacactgggctgtattcctgcagtgccgggatacctgaaggcaatgaaacaagtatgcgaccgccacggggcattgttcgttttggacgaggtgatgtctgggatggggcggacgggtactctgcacgcctggcagcaggagggcgttgtcccagaccttcagactgttgcaaagggactaggggcaggatatgcccctgtgggagcgctgctcgtcggcaaccgggtggcagacgttctcagcaaaggaactggcagtttcacccacagtcagacgtaccagggacaccccatcgcatgcgctgcagcatgcgctgtccaaaagattatccagaaagaaaacctgttagataatgttcgccggcaaggcgagtatctaggccggcttctcaatgagcgcctaggtgggcataggaatgtcggcgatgttcgcggacgaggactgttctgggctgtaagtatatttcatatctttacctccggcgagtattggactgacaaatcactgcatagctcgagttcgtcagagacaaagagaccaaagagcctttcccagcggaagcgggcatagcgcaaaaggtgcacttgacaggcttgcaaaaagagcactccatctccgttatccctggcgctggggttgcagatggtcgtaatggggatatcatacaaattgcgccggcgtacaatgtgtcaaaggaggatattgaattgattgttgagcgcgtggagggcgtcgtccatgctgcctttggagcatagcgt

SEQ ID NO: 36087 - DNA, 3082 bp, Aspergillus nidulans
agcgaaaaagtcttgatcgcccaggagcgcagtgctggaaatacagttcaggttttcaagaaggcgccgcccagtcccacaccctacgtcgcggaaatccgcagtgcggtggaaaagggctcaaggctgctctcccagttatctcttaagctatttggtaagggtgacagtgccaaagggggttttggccctactatcagatccactctgccgtacatcaaggccgatatcccgatcgttattgttttccgtgcgcttggggtcgtttccgacgaggatattcttaaccacatctgttacgaccggaacgatacacctatgctggagatgctgaagccctgtattgaagagggttttgttatccaggaccgtgaggtggcgttggatttcattgccaagcgtggttcgtctcagtctagcatgaaccacgaacgtcgtgttagatatgctcgagagattatgcagaaggagctgctgcctcatatctcccagagcgaaggcagtgaaactagaaaggctttcttccttggttacatggtgcacagacttctccagtgcgctcttggacgtcgcgatgttgacgatcgtgatcatttcggaaagaagcgtctcgatcttgctggtccgttgctagcaaaccttttccgcgtcctctttaccagagttacccgcgatctgcagcgttatgtgcagaggtgtgtggagtccgaccgagagatttaccttaatgttggtctcaaggcaagcaccgttactcaaggtctgcgctatgccctcgctactggtaactggggagagcagaagaaggcagctagcgccaaggcgggtgtgtcgcaagtgctcagtcgctacacctacgcttcaacattatctcatcttcggcgaacaaacacgcctattggtcgtgacggcaagattgctaaacctcgtcagctacacaacacgcattggggtctggtatgtcctgcggaaacccctgaaggccaagcttgcggtctggtcaagaacttggctcttatgtgctacattactgttggtactcctagcgaacccatcatcgatttcatgattcagcgtaacatggaagtgcttgaggagtttgagcctcaggtaacaccgaacgccactaaggtctttgtcaatggcgtctgggttggtgtccaccgtcagccttctcaccttgttgagaccatgcaagcccttcgtcggcgaaacatgatttctcacgaagtcagtcttattcgagacatccgtgaacgagaattcaagatcttcaccgacgccggtcgtgtatgccggccactcttcgtcgttgacaacgatcccaagagtgagaactgcggcaacctagtcctcaacaaggagcacattcgcaagttggaagaagacaaggaacttccaccggatatggacccagaagaccgacgggagcgctactttggatgggacggtctcgtcaaatccggtgtcgttgagtacgtagatgccgaagaggaggagacgatcatgatcgttatgacgcccgaggacttggagatttcaaagcagctgcaggctggttacgcacttccggaagagcaagatccaaacaagcgtgtgcggtcgattctcagccagagggcgcacacctggacacactgcgagattcaccccagtatgattcttggtgtctgcgccagtattatccccttcccagatcacaaccagtctcctcgtaacacctaccagtcagctatgggtaaacaagctatgggtgtgttcttgaccaacttcgatcagcgcatggagaccatggcgaacatcctgtactacccgcagaagccgctggcgaccacgcggtctatggagttcttgagattccgagaacttcctgctggtcagaatgcgatcgtcgccattgcttgttactcaggttataaccaagaagattcagtcatcatgaatcaaagcagtatcgatcgtggtctattccgcagtcttttctaccgtacatactcagacagcgagaagatggtcggattgacagtggtcgagcggtttgagaagcccatgcgttccgacacgattggcatgcgcaaaggtacttatgacaaacttgatgaagatggtatcgtcaatcctggcgtgcgtgtttctggtgaggatatcatcatcggcaagaccgctccgctcgcgccggatgcagaagagttgggccaacggaccaagaaccacaccaagttggatgtgtcgacaccgctccgcagcacggaaaatggtatcgtcgaccaggtcttggttacgaccactccagacagcttgaggtcggtcaaggttcggatgcgaatgaccaaggttcctcagattggagacaagttcgcgtctcgtcacggtcagaagggtacgattggtatcacctaccgacaggaagacatgccatttacccgcgagggtgtgacgccggatctcatcatcaacccgcacgccattccctctcgtatgaccattgcccacttgatcgagtgtcaactcagcaaagtgtctgctttgcgtggtttcgaaggtgatgctactccgttcacagatgtcaccgtcgactcgatctctcgtcttctccgcgaacacggctaccagtcgcgtggattcgaggtcatgtacaacggccacactggacgcaagcttgtagcccaagtcttcctgggaccaacgtactatcagcgtctgcgccacatggtggacgacaagatccacgcgcgtgcgcggggtccgacgcagattctgacgcggcagccagtggaaggtcgtgctcgcgacggtggtcttcgcttcggagagatggagcgtgactgtatgattgcgcatggagctagtgccttcttgaaggagcgattattagacgtctcggacccgttcagagtccacatctgcgacgactgcgggctgatgaccccgatagcgtaagtccccctccgttcctgaattgttccgtgcattgctaaccgagcgcaggaaattgaagaaggggttgttcgagtgccggctctgcaacaataagcaccggatttcgcaggtgcatattccgtatgcagccaaacttctgttc

SEQ ID NO: 36088 - DNA, 1149 bp, Aspergillus nidulans
atgcctgctaccacggcggacacgctttccctcgtcacgcggaccgtcactgttgctccgttggtacttctctccgtcgcagatcactatggacgctctgcaaagggcactcggaagcgagtggttggcgtactgctaggagaacacattggagggaatgtgcgggtgtcaaacacgttcgccggtacgatctagcgtctccgctggcctgtcaattgactaacatgcttcagtcccgttcgaggaagacgaaaaggatccatcagtgtggttcttagatcacaactttgtcgagtcgatgcgagacatgttcaagaagattaacgcccgcgagaagctgatcggatggtatcactccggcccgaaactgcgcgcttcggatctcgagatcaacgagctattcaaacgatacacaccaaaccccctgctagttattgtagatgtacaaccgaaggaggttggcgtcccaaccgatgcttactttgcggtggatgaaatcaaggacgtaggtactacggctccacaaccaaggcatacgctaacccttgtcaggacggtaccactacatccaggacgttcgtgcataccccatctacaatcgaagcagaggaagcagaggaaatcggtgtggaacaccttctccgagacatcagagacgtcgctgtgggaactctctccacccgcatcacatcgcaactgcagtccttgcaaggcttacacctccgcctccgtgatattggccaatatcttcagaaggttcttgaccacgaactacccgtgaaccacgccatcctcggtaatctccaagatgtcttcaacctccttcccaatctgtctacaccgagtaccacggcgcgggttggcggtgagccagaacaatcaacagataacgccgagttggctcgcgctatgagcatcaagacgaacgaccaattgatggccatctacctaagcagcttggtccgtgccgttacagcgtatcacgaccttattgagaacaagattcagaaccgacaacagcaggaagaagtcgagcagaagagggagcaggaggccaacagcgcgaagaatgagaaggagggcgcaaagaaggtcacaaacacatctgagccgaaggaggagtccaaggagaagaccaagcggtagaca

SEQ ID NO: 36089 - DNA, 1333 bp, Aspergillus nidulans
gctggcgaccttgatatttggctccccagtgaggccaacattgctcgcactgcacttcttgacttgatcggcgacaagggcagatgggccgagggagccgctgcgggcgtgctagttgcaagcccaagtcggtcggaccctgactgtaagttgacccaggtttcatgagcatatagaccagtttctaattgttgattcacgaagatttctacacatggacgcgagattcgagtctagtattcaaaacactggtggaaatgttcagggcgggtgactctgatcttttacctattatccaagactggatatcatctcaggctcgcatacaaggggtggagaatccgagcggaggactggcggatggacgaggcctgggcgaggcaaattcacggccgaggagacggcatttgcgggctcatggggtcgaccccaacgggacggacctgctttgcgagcaactacaatgattgagttcgggtggtggctattggtacgcacggtgctcttcagggtgccaatgtgactgacgcctggcagagccagggatatcaccagctggctgcaaataccgtgtggcccgtggtgcacaatgatatctcgtacttgactgaatactggaatcagtctggattcggtgagttccgctctgactgattaattaagtaatattcttacctgggtagacttgtgggaagatctttacggacgctcgttctttaccctagcagtcacttatcgtgccctgacagaggcaagtttgtttgctcggagtatagggtcttcgtgtgcagagtgcgagtctcaggcaccacaagtcttgtgcttgttgcaatcgttttggacagggaggtttattcgcagcaacttagataccggaagaaccggaaaggacgctagcaccttgttgggggttattcacacattcagtcctcgctcggaatgtgacgatgtcactttccagccatgctctgcccgggctttggctaatcattacagagtggttgatgcgtttcgcgatctatatgatatcaacgcagaccgtagccaggatcaggctattgccattggtcgctatcctgaagaccagtattttggaggaaatccttggtttctttgcacgatagctgcagctgaacagctctacagtgcgatataccagtggactcatcttggttctataacaatcacagcggtatctcttccattttttcagacattgcacccgactgccgtaccagggacttattcgtcgtcaaccgagatatatcaccaactgattgatgccgttcggacgtacgccgacggtttcatgcgaattgtggtaggtcttcta

SEQ ID NO: 36090 - DNA, 1975 bp, Aspergillus nidulans
aggtaaagaagaatgagcctcgcccgcttcaagcacctcccgcgcgccacccagggacctatcaaatgcccctacaagggcgctgccctgctcggcaacgccaactacaacaagggctctgcccattccgagcgtgagcggcgcgaattcaacttgcacggactactgccacccaatatccagacattggacgaacaggtggagcgggcataccagcagtacaaaagccgtcccgatgacctggcgaaaaacaccttcatggcgagcatgaagtcgcaaaaccaggtgctttactaccggctgctgcagactcatctcaaggagatgttcagcgtcatctacacgccgacggaggcggatgcgatccagaactactcacggctgttccggaagcctgaagggtgctatctgagtatccgtgaccatggtgagaaagagatcgatgagtgtttcgctaacttcagcggtggggatgacgtggattatatagttgttagcgacggggagcaggtatgccctaggcaaggcttttgttaacactcagggaaagggtgacggtgctgacagtggcagatcctcgggataggcgatcagggcgtcggggcgatcctgatatctgtcgcgaagctggtcatcaccactgcctgtgctggcatccatccatcaagacagctccctgtagtgttggattgtgggacgaataatgaggagctactcaacgataagctctacttgggtctgcggcaacggcgcgcacaaggggaggaatacgataagtttgtggataaatttgtgaggatggccaggaagaggtttcccaatgcctatatccacttgtatgccactttaacccgccgtggaagataagactgacagatgcagtgaggactttggtctccaaaacgccaaacgtatccttgacagataccgctcacaattaccttgcttcaacgacgatattcagggcaccggttgtgtcacgctggctgccctcatggccggactccatgttagcaatgtcaagctaaaagatgtcagagtcgtgtgctatggctctggatctgcaggcactggcatcgcagatcagattagcgatgccattgccaccgaggcaggtttctctaaaagtgatgccttgaagcagatttggtatgtcgcagttcgctagttctacccgtgtatagcacaacccggttactgacatcttcaggtgcattgataaacaaggcctactgctgaaatctcaaggcgacgcactcacagccagccagaaatatttcgcaaaagaagacaatgaatggcctgagggtcaagatattgatctttattccgtcatcaagcacgtcaagccccatgttctgatcgggacatccaccaaacctgggtcttttacagaggagaccatccgcgagatggcaaaacatgtcgaccgcccaataatcttccccctcagtaacccgacgagattgcatgaggctcagccgcaggatatcaccaagtggacggacgggaaagccctgattgcgactggcagtcctttcccgcctgtagagtacaacggcaccaagacggaaatcggtatgccttctgaatatctcctatcctcattatcagattcatgtacttgaggctaatagtatcagccgaatgcaataactcaaccgccttccccggtattgggctcggagctgtcctctcacgagccagccgcctatctgagaagatggtcgtcgcagcttcaaaggcactagcagcaaaggctccagcgctggaagatccaaacaagccacttcttccagacgttgagaatgtcagagagttgagtttgaatgtcgccaaggcagttattcagacggcagtgaaggaaggattggcccaggaagagggcattccagaggacgagaaggatttggaagactggatacgggctcagatgtgggaggcaacctatcgggatttggagaaggctgattaa

SEQ ID NO: 36091 - DNA, 1233 bp, Aspergillus nidulans
atgtccgccaagtcgattttcgaggccgatggcaaggccatcctcaactaccacctcactcgcgcccccgtcatcaagccgactcctctccccccttccaacactcacaaccctcctcccaagctcgcctccctctacttccccgacgacctttccgtgaaggacgttctcgaccaggcggaggttacatacccatggctgctgacccccggatccaagttcgtggctaagccagaccaattgatcaagcgacgaggcaagagcggtctgctcgcgctgaacaagacttgggctgaagccagagaatggatcgaggctcgtgctacgaaggaacaacaggttgagaccgttgttggtgttctccgccatttcctcgttgagcccttcgttcctcacccccaggagaccgagtactacatcaacattcactccgtgcgtgaggtaaggaacattcttccgcactttctgaaactacgttcatagtctaacttttcttagggtgactggatcctcttcacccacgagggtggtgtcgatgttggtgacgttgatgctaaagcagagaagcttttgatccccgtcaaccttaagaactacccctccaacgaggaaatcgcttccgcacttctcagcaaagttcccaagggcattcacaacgtcttggttgactttatttctcgtctctacgctgtctacgttgactgccagttcacctaccttgagatcaaccctctcgttgtcatccccaacgccgatgctacttctgccgacgtccacttccttgacttggctgccaagcttgaccagactgctgagttcgagtgcggtaccaagtgggctgttgctcgtagcccggctaaccttggcctggccgctcttcccacatccgacaaggtcaacattgatgccggtcctcccatggagttccccgctcctttcggacgtgaattgagcaaggaggagaagttcatctcagacatggatgccaagactggtgcctctcttaagctcactgtcctgaaccccaacggccgtgtctggactctcgtcgctggtggtggtgcctccgtcgtctacgcggacgccattgcttccgctggtttcgttagcgagctcgccaactacggtgaatactccggtgctcccactgagactcagactttcaactacgcccgcaccattctcgacctgatgctgcgctctcccatccaccccgacggcaaggtcctgttt

SEQ ID NO: 36092 - DNA, 1044 bp, Aspergillus nidulans
ccgcacgcaataccacccaggattagctccaaccgaatgtcaggtgcatctactcgagacaaggcagcactaatgggaaacttcgagaaggactggctgtcaaaaggtgacaagcttcagacaaacaccgatttgtctaaaagacacacgcgaaatcagtcaagtctcgacgggacaaaatacaaagatgggaaatggtcccaagagaatgaggaggtgatcatgggtccgtacgactacatgctgcaacacccggggaaggacctgcgacggcagatgatcaacgcttttaacgtatggttgaaggtgccatctgagagcctggccatcatcaccaaagtagtggctatgctccataccgcttcattattgatcgacgacgtcgaagacaactctcttctccggcgaggaattccggtcgcacatagcatctatggcaccgcgcagacgatcaattcggcaaactacgtttacttcctcgccctccaggaggtgcaaaaactgaagagtccggcagctatcgacatatacgtccaggagctgctgaatttacacagagggcaaggcatggatctgttctggcgagacacgctcacttgtccaagcgaagatgaatacttggagatggtgggcaacaagactggaggtttgttccggctagctgtgaaattgatgcaagctgaaagcagcactggaaaggactgtgtggcccttgtgaatgttttgggactggtctttcagatatgcgacgactatctcaatttatccgacacgacgtatacccagaacaaagggctctgtgaagacctcacagagggcaaattttcattccccattatccacagcattcgatcgaacccggggaaccatcagctcatcaatatcctccggcagagaacaaaggatgaagaagtcaaacgctacgcgctccagtatatggaaagcacgggcagtttcaagcatacgcaggatgttgttcggcagctacgtgccagagctctgcagctcattgaagagattgagaacagcgaaaatggcgagcaa

SEQ ID NO: 36093 - DNA, 390 bp, Aspergillus nidulans
gagcacgtcctgcgatccacttggattatctggtaccgtcctcctacccccaaatattccgactatgagaagtccaccgcaccgctcgcctcaatccattcggttgagagcttttggtcggtatactcgcacctcaaaaggccttcgctccttcctaccgtttccgactatcatatctttaagaaggggattcggccggtatgggaagacgaggccaataagaagggcggaaaatggattgtcagactgaagaagggagtggcggaccgatattgggaggatcttctcctggccatgattggtgatcagtttgcggaggccagtgacgaaatctgcggcgctgttctcagtgtgcgaagtggtgaagatgttttggccgtttggacccgg

SEQ ID NO: 36094 - DNA, 1437 bp, Aspergillus nidulans
tatgccagcggcaaagtcctaggaggcagcacggggcgaaacctgatgacctaccacctcccaacaaagggcagtctagatagatgggccgaagacgtaagtgacgagagctggaatttcgacaacatgctcccgtacatcatgaagtcgcaaaggttcacaccaccaaacaacaacctccgcttccgcaatgcaaccccgacgtatgaccccgctgtcctggggcgaagaggacgactagacgtgacttaccctaactacgccaatggtcttgcctcgtggctcgtccgtggctttcgggacatcggtcttgcggccatccgtggcttgaacggcggccagcttattggatccgcctataccctaagcaccatccagcctggcaaccagcaccgcgcgtcatcgaagacagcataccttgatccccttatcggacggaatttgaatctgatcatctatcagtcgacgcatgcgaagcggattctcttcagcaatgatactgtggccaccggcgtgcgggtcagctctgagggacaggaatatacgctctccgccagaaacgaggtgatcgtctcggcgggagcattcaaaacgcctcagctcttgatggtctccgggataggccctgcggccaatcttgagcgttatggtatcccgcttgtggcggaccgaccaggcgtcggacagaacctgcaagaccacactctcgctggcccctcatacagagtaaacgccattaccggctcctcgaatagcatccctgagttcataaccgaggcgcaaagacaatacaacagcaacccaccacgcggcgtgctcacgaatactggcgtagacattctgggctgggagaaagtgccagagcaactgcgaggcaacttcagcactgagaccgaagacgccctcgccagcctcccagaggactggccggaactcgagtacctacctgtctacggctactttggggatcaaaacaactacatggtcacgccgaatgatgggttcaactacctgaccatcgccgccgcagtggtttcgcccctgtccagaggcacagtggatatcgcttcgaacgacaccgaggtaaatcctatcatcgacccgcgctggttcgcgcacccgggcgatatccaagtcgccgtcgccggatttcggcgctcgagggcgctaatggcgtcccccgcgatggctggcattacgcttggaggcgaatcgtatcccgggacagacgtgcagaccgacgatgagatcgtcgagtggctgcgcgaagcatccaacaccgttcaccatgcctgctgcacggcgggcatgggcccacgggataaccctgactcggtggtcgacacgcagggaagagtcattggggtttctggcctcaggattgtggacgcctcgatcatgcctttccttcccccaggtcaccctatttcaatcatc

SEQ ID NO: 36095 - DNA, 1349 bp, Aspergillus nidulans
ccccctccgcagggtcctccacaaggtggatattaccccggacctcagtataacgggcctcctcaacatggttacggtcctcatcctggctcatttcagcctcctcctggccctcctggccctcctggtcctcatggtcctcattcatacagcccacatcctccgccccaacctggatacgctccttctggacctcctgggccttcccctggagggtatcagcctcagcagtatggatataacgcccaaggtcaatatccaccgccgccacactccccccagcccccaccgcaacaccctcagcacttccaaccccctccggggcctccggggcctccggggcctccgcacggatatgggcaaggatttggcgctcctcccatgcctgccccttcgatgccttccctaggttacgctcccggtcaggttgcacctggcgattttcgccgggaagctgacgccctccgcaaagcaatgaagggtttcggtacagacgagaaggcgctcatccaagtccttagcaagctcgatccgctccaggtcgccgctgtccgcgcaacatactcatctcacatccgccgcgacctttatagcgatatcaagtccgaaacaagtagctactttcgacagggtctgctggctatcgtcgatggcccacttatgcacgataccgcgtcagcacgtgaagctgttcaaggtattggtactaaggagtggcttctcacgatgttcttctcggtcgctcaaatgcggaccttaatgcaatcaagctttcctatgagcgcacataccgccgctctctcgaacgcgatgttgaaggcgatctctcctttaagacgaagagcctcttcgcgcacgtcctccgcgccgcacgccatgaagaaaacgcccctattgactaccgcaccatcgaatccgaagcccagaacatacacggcgccacagcggcacgcatggttaacaatgcagacgaagtatgctctatcttcgcacgcagctcgaacaacgaacttcgagcccttagccaagctttctcagcgcgctaccatacttcacttgaagcacatattgagaaggaattctcaggccacatgaaggatgcactgctgcatatgctccggacggcgttggaccctgctatgcgtgatgctgtgaatctggaagaatgcatgaggggcatggggacgaaggatgagagacttgttgtgagggttgtgcgtgttcattgggaccgccaacatttggagaacgtgaagagagcttatcaacataagtataagcaggatcttgtgaaaagggtgagaggtgaaacaagtggagattatcaaaggttattggtggcgatgttg

SEQ ID NO: 36096 - DNA, 629 bp, Aspergillus nidulans
ccattctttggctcccttggctgcacttcagccattgttttcacttgctttggagctgcttatggaaccgctaaagcgggtgtcggtgtctgctccatgggtgtcctccgccccgacctgattgttaaaagtacgttagaacccggcgttccagcgaagcataacgctgaatgagcttattagacatcgttcctgtcgtcatggctggtattatcggtatctacgggctggtcgtgtccgtccttatcgcaaacaacctcggccagaaggttcccctctacacagcgcttgtccagctgggagctggtcttgcggtcggtcttgctggtttggctgctgggtgtgtatacatgctaccagattcgcattcatgaagctaaccctccgaattaagtttcgccattggtattgtcggagacgccggtgtccgcggaacggctcaacagccaagactctacgtcggaatgattcttattctcattttcgctgaagttctgggtgagtaacagacctgggtagtgtctcataatgaatcatattaatcttggttctcttctgttgcaggtctttacggtctcatcgttgcccttctcatgaactcccgtgccaccctcgaggccagctgctag

SEQ ID NO: 36097 - DNA, 1945 bp, Aspergillus nidulans
cgcacccgtcaaatctacgaaaccatcgaccgccagtccttccagtggattgttgtcctcgtcgccggcgtcggcttcttcctcgatgggtataccgtacgctcgttccattcatccaccggcgattctatcgacccgatttctgacgcggtgatagttattcgcaagcaatatcgcccttccaatgatttcctacgtctattggcgtgaagacacctcttccttccgactgacgtgcatcaacatcgccacgctgagcggcaccctcctcggccaagtcctgttcggctatctggcggaccgcaacgggcggaagaagatgtacggcgttgaactggcgctgctgattgcgtcgacgctgggcgtcgcgatgtcctcggaggggacacacgggagcatgagcgtctttgcgtggctgatctggtggaggatcatcgtggggatcggcgtcggtgcagattacccgttgagtgccgtaattacgtctgagtatgttcaacgcctattccaaatctcgaagctatggtggttaggagacagttattaacaacggctgccaaccaggttcgcacccacccgccatcgcgcgcgcatgatcgcctccgtcttcttcatgcagccgctcggtcagatcgctggcaatatcgtctcactgatcgtcgccgtcctgagcaagaagcagggacatgacgatgtcacacgcgcagttgatatcatgtggcgatgggtggtcggaatcggcgtcgtgcccggcgtcatcgcgacattctttcgcttctttatccccgagagtccgcgctttctgctggaaatcgaagacgatccggtgcaggccgagttcgatgccacgacactgttcagcgacccggcgcctctgtcgagcctcgggtcgccagagattgccgttgaggagggatatcggtatcccggttcggcgtcgactgctctcactagtatgactactgccacggcgaaccaattcaacgatatcaacctcattgccccatggaatgaaatcatacttgctgctcctgcgctccccgcaacagccacaacgatgggcacgggcaagggcacgagtacagctgccggtcccgacacatccggcaccggtgctggagccctaacgattcgctccatgtccattgacgacttcacagaccggaccccttcccagtaccacgatagcctccctgaaggcacgttcctcaccccggcaacgctcaacagccactggcgcctcaccaaggtcgacataacgcaatacttctggcatgagggcaactggcgcaccctgctcgccacgtcgctctcctggctgctcctcgattttggcttctacggtataggtctctcctcgccccagtttctcgcgaagacctgggacagtctcaaactctccggtcccgccccgccctggatgacagacgacaccggcgcaactgatatatacgacatgttccgcgacacgagcatccactgcctgatcatcctcaatattggcagtttcgtcggcggggtcctgatgctgctgactatccacaaactcgaacgcgtctcgctgcagaaatacggctttctagcgctagcagcccactttatcgcgcttggaaccatgttcatcaccgtgcacaaggagggccccgtcgcggtgacgctctacattatcgggcagatcttgttcaatttcgggcccaacacgacaacttacatgatccctgctgagatcttcccaacacgataccgcgcaacgtgccacgggatcagcgcgggcgcgggaaagctcggctcgatattgattcagctgctctcggcgtattataaattcggcacggggcccggcaatgagcagacggtccgccatgggtatatgttgatcgtgtttagtgcgtgtatggttattggggcggcggtgacgcatttctggatcccgccgacgcagaga

SEQ ID NO: 36098 - DNA, 1224 bp, Aspergillus nidulans
gtctccaaatcgcacgatcaatttgcgcagattgccgttgacgcagtgctttccgttgctgatctcgaacgtaaagatgtggattttgaattgatcaaggtagacggaaaggtcggtggggctcttgaagactcactccttgtcaagggtgtcatcgtggacaaggatttctctcacccgcagatgccagatgaggttacagacgctaagctggccattctgacctgcccattcgaaccccccaagccgaagacaaagcacaagctggatatcacatctgtggaggagtttaagcgcctgcaagaatacgaaaaagagaagtttacagagatgatccagcatctgaaagactccggggccaacctggtgatttgccaatggggtttcgatgacgaggcgaaccatcttcttctgcagaacaagctacctgctgttcgctgggtgggtgggcctgaaattgagctgatcgccattgcaacaaacggtcgaattgtgcctcgctttgaggatctcagcgcagacaaacttggtacagccggtcgtgtgcgcgagatgacctttggtactacgcgagagaagatgcttgttatcgaagagtgcgccaacagccgtgctgtgacggtatttgtgcgaggaagcaataagatggtaagatcgcccatctatactagaccgtgcattactgatttattactagattatcgatgaggcaaagcgatcactgcacgatgctatttgtgttgttcgtaacctagtcagggataaccgcgtcgtatatggtggaggtgcagcggaaattgcctgctcaatcgctgtggaggatgctgctgtcaaggttcgtggcgttccagtttcctatagtcatttactgacattgccctcagagccctggaatcgagcagtatgccatgcgcgcgtttgcagatgcgcttgatgcagtgccgttggcccttgctgagaactccggtttgagcccgattgaaacactcgcggccatcaagtcgcgccaggtcaaggagaacaactcccggctgggtgttgactgcatgctgactggaaacaatggtaaatactcttgatgaagacagtagaattgatattgattaggctacagatatgagagaacactttgtcattgatccgctcatcggaaagcgacagcagttgttgcttgcaactcagctctgccgcatggttctgaaggtgagttagatacctatgttt

SEQ ID NO: 36099 - DNA, 1689 bp, Aspergillus nidulans
actgttggcatcataggcggtggaatcactggcctcacagccgcataccgattatccagggacccaaaatgctccaaggttaccgtctatgagaaaggccctcgcgtgggcggctggattcaatccgagaaaattaacgtggacggagagcatattgtcttcgaatatggacagcgtacactgcgagctagcaccattactgcatttccacttttggacttggtatagctggcgcccttgggtatttacttgcttaattggagtttgagagctaacaactggaaattttggtagtcgaccgagctggggctagaagacgaaatgcttatcacgaaaacgtcatccgccgtgagccagaaccgttatatctattaccccgatcgcctcgttcgtatgccggggccgcagaaaggggccagtcttttatctcagctcataacgacgttgaaaagtctactacaagaaccagtcttcgagagtgtgcttcctagccttttgaaggagcccttcgttaagcgtccattgaacttgccttcagacgaatccgccatggagtttgtatcacgacggtggtctaccaaaatagctgacaatttggcttccagtgtatttcaaggcatatatgcagggaatattgacaagctgagtgcggaaacgctcctgggcccgcttcgggcgcatgagttgtctggtagtgtagccaagggtataacggagatgaaagggaaacagtactggatttcggacgatttcatttccatgctcctcataagtgaagcaaagaaagcgtctcacttagactacctcagaagcctggcaaaggacagcagtacattgactttcaagaacggcgtcggtcagctggcagacgctctggttgcagagttgaaacgatcaccaaaagttgaagtcctcacgcatgcaaatgtcacaagcattctccaagatcatgagagctccaacctcactgtatgttgatttcaaagttcgagtatctcgaagcgagcatttatgcggaaaaactgacctgtctatctaacaggtaaaagtagaagatggtcagagtcgtgttcacaaccgtctcattgctaccaacccgccttgcgacctcgcaagacaacttcagtgttcactggagcccgagaagcagcccacaggaacaataaatgccctacagagacacaactacgcaacaactactatggttgtgaatttgtattactcaaatcctgatctgatccctgtcgaggtttcggctacctgattcccaggtcgataccttttgcgcagaatcctgagcgagcactgggtgtgatatttgcttcagaatctagtgtaggtcaagacacagccaccggcacaaagctcacagtcatgatggggggccattattgggacgggtggaaagaatcagactatccggaccacgatactgcggtctcgatgtctcaagccttactgaaaaggcatctgggcatcctggattctcccaaagtagcccacacccgattgcagcgcgatgctattcctcagcccaccgttgggcatcttgaacgtatgcaagacatttcaacgtctattaagtctgagctcaaaaaccgtgtcactctggctggggcgtggtattcaatgcatggtaccggcgtggtggacagcattcgtcaggcttatctagctgcgaaatatggc

SEQ ID NO: 36100 - DNA, 1118 bp, Aspergillus nidulans
agagcacatggtgataagcttgggctgcctggccgcaacctcctcagccccccttactcaattaagaatgcggctggagctcttagccagaacactattcaaaccaacattggccacgcaggaggttacgttgaatacgacacccataatctctatggaaccagtaagtcagcttactatgcaattgttagtttgtctgacttgttgtttagtgatgagctcggcctctcgcatagcaatgcagcaacgccgtcccgacgtcagacccttaatcatcactcgcagcacgtacgcaggtgccggagcacatgttgggcattggttcgagacatctttactatggactcgacctagcactaacgctatataggctcggtgacaatctcagcacttggaagttgtaccgcgcctcgatcgcccaggtcctggccttcgcctcgatgttccagattcccatggtaggagctgatgtctgcggcttcggttcaaacaccacagaagagctctgtgcgcgctgggcatcacttggagccttctacaccttctaccgtaaccataacgagattggcaacatcccccaggagtactactactgggaatcggtaactgaatccgcgaccaaggccatcaacatccggtaccagctcctcgactacgtttacactgccttccaccgccagagcaaaaccggtgagcccttcctgcagcccttattctacctgtacccagaggacaaaaataccttcgcaatcgacctgcagtttttctacggcgacgccattcttatctcccccgtcaccgagaaaaactcgacatccgtcaatgcatattttcccaaggatatcttctacgattggtacaccggcgccgtaatccagggtcagggcgcgaatatcattctgtccaatatcaacatcacccatatccccattcacatccgtggcggcaatatcgtccccatccgctcctctggtgcgatgacaaccaccgagctccgcaaaaagggcttccagcttatcattgcttctggcatcgatgggacagcttctggaagcctgtatttagacgatggagactcgctcgagcagactgacactgccaacattgagttcgagtac

SEQ ID NO: 36101 - DNA, 1413 bp, Aspergillus nidulans
gctgtggccgcggcccaaacatataccgactgcaatccgctggaacaaagtgagacctctgcccgttaatggggcctaaaatgctaatattttgaaggttgtcccgcagatcctgcactgggcggctccgccaattacgacttcacccagggcgcatctgatgactttaccgaagtcatgtcgccgtcttatggcagcgacggagcgagtttcaccgtggcaaaacaaggcgatgctccgctgatacagtcggactggtacatcatgttcggacacgtcgaatttgtgattaaggccgcacctggagtcggcatcgtcagtagtgccgtcttgcaatcagatgatctggacgaaatcgactgggagtggcttgggggcaataatgaatatgtccaaacaaattactttggaaagggcaacaccgccacctataaccgtgcagctacccatgccaattcaggaaatcacgattcctttcatacgtataccattgactggacttcatcccatgtcgtatggcagattgacggcaacactgttcgtgtacttactcccgactctgcagagagcaaccaatatcctcaaacacctatgatggtgaaagttggagtctgggccggtggtgaccccaacaataatgagggcacgatccgtgagtttatctctctctgcgtccctgttagggcaatatatataacggaatttgctaatatacttgtagaatgggcggggggagaaactgattataccgctggacccttcacgatgtacctgaagtccattaaggtgaccgactattcgaccggcaactcttatacatacagtgacaacagcgggtcatggcagtcaataatatcagatggtggcaagatcaatggcaatagtgcggctcagtcaatgactgatatcgggacggtgccctcaataaccgcgactgccgacagcgggccgattccctttgagggaacgcatcgcgaaaccacaagtttctccacgcccagtatctatccttgggtcccccggccaagtagcgacgacgattcggactcatctccgtccacaaacttgccaggagattggcattttgctggcagcggaaaacctcagccacccagccggtcctctatgagtgagcattgcccacaattccgttttataccctcgtcaaatttcatgctaaagcgatgcctcttcacaacccagtatatgcgcccgtctatgtctgcctcgtatcacttctggtcgggtttatactccccctccgaccttgaacctacggacgaatctcctcgttgggtgtttcctgaaacagacccagcagagctatccgacgccactaccgacgaatttagaagagtgtcagccacgtcaggacaggatcgcaatggcctcaccataagtgccgcgaaccgc

SEQ ID NO: 36102 - DNA, 2514 bp, Aspergillus nidulans
gagaaaaattggaaggatttatcgacgtctctaaagatatatacatacgaaagacgcctcagagttgtcgttcgagcaactatatcggaacgcctatagcatcgtaaaaattcagcgtgccgaagacttgtacgagcggacaaaggaacttgagaaagaatggctatgtggtgaagttcaaaagcgagtcgttgccgcaatcacgcctaggctgttgctcgccaaagaggccgtggatatgcaagaccaatttacggaggctacggagaggcgggagaccggggagagattcctttcggccctaagtgaggtgtgggaggaccatcagatctgtatgaagatgattacggacgttttaatgtacatggtaagtcaattggtgtgtgctgattggatccccctaacgcaggaatcgacgcataggatcgagtcgttgcgcttaggaaagtttccatatacgccgccgccatggcattatttcgcgatcacgttttgcggtcacctgtgtcgtcgagtaataatgccgtcgtcgctgatgtgctcaagtctacggtgttattcatgatccagttggaaagatcagggcacatgatagaccgagctttaatccacagctgcattaagatgctggagggcctgtacgaaacggaggcggaagaggagtcttctaagctttatttgacgtcttttgaaccggactacttagaggcaagcgcagcgttctatcgcgccgagggcaagcgactgctagaaacggtcgacgctgctacgttctgcgctgttgtctctgctcgcatagcggaagaaaaggaacgctgtcagtatacgatctctctccttagcgaatcaaaaatcaaggagatagtggataacgagttgatccgcaataatttggccgaagttgtcaattttgaggggaccggggttcgagtcatgctggaccacgacaggatagacaatctaagcaagatttatgctctcagcgcacgggtggatcctaaaaagacccatctgactgccgctgtacagaagcgtatagtcgaaatgggtaacgaaatcaacaatgcttcatttgctttagcacaggcacctgcacagcctaagtcaactgggacagacgcaggtcagaaaaaagagaaggaaaaagagaagcccgtgaatcaagtcacatcatctgccatcaaatgggtggatgacattcttgccctcaagaagaagtttgatggtatctggaaagatgcctttgggtctgaccaggtgctacaaagcgcgattacggcaagtttttcgagcttcctcaattccaccccccgcagctcagagtttctttcgctcttttttgacgagaacctcaagaagggcgttaagggtaaaacggacaacgaggttgatgctcttctagagaacggaatcaccctgctgcgttatatcaaagacaaagaccgctttgaggcctactacaaaaaacacctttctcgacgactactcatgaagcgttcgatgagcatggacgcagagagacagatgatctccaaaatgaagatggaagtcggcaatcaattcacccagcgattagaggccatgtttagagacatgaccatatcggaggatctgactgcaagctataaacagtttgtacgggaacagggtgaccccgataaaaagcgattcgagctggacatcaatgtccttaccagcactatgtggccaatggaaataatgtcgagctcaagggatggtcaggttgagcttccgtgcatcatccctaaggaggttgagactgtcaagcagagctttgagaagttctatctggacaaacatagcggccgcaaactttcgtggcagccaagtatgggtacagctgacattaaagcaacttttcatcggtcaaatggcaaagtgcagcgtcacgaactcaacgtgtccacttacgctatgtttattcttttacttttcaatgacattcccataggcgagtccctcacattcgaggagatccaggcgcgcacacggattccagataacgatctcattcgaaacttacagtcacttgccgttgcacccaagactcgagtcctcaagaaggtcccgatgagtagggacgtcaaaccgacggataagttctatttcaacaatgatttccaaagtccattcatgaaagtacgaatcggtgtggtcagcggcggagccaacaaggtcgagagccaggaccagagaaaggagacagaggagaagatgaacaacgagcgcggcggcagtattgaggccgctattgtgcgcatcatgaagtatgttgcttctgctcttttgacgtccggtgctgacataactttgtatagacaacgcaaaacattaatccattcaaaccttattagcgaagtgcttagccagttatctgcccgtttcgtacccgacgttaacatggtcaagcggcgaatcgaaagtctaattgatcgcgagtacctcgagcgtgtttccgaggaccccccgacatacggttatgttgcgtgaact

SEQ ID NO: 36103 - DNA, 831 bp, Aspergillus nidulans
aagcagttgttcatcgggtctgagggtacgatcggtatcatcactggtgtttcgattctgtgccctccccgcccgaaagccgttaatgttgcctacttcggtctcgagagctacgataaggtccgccaggcctttggcgaggctaagaagcaactgtctgaaattctttccgcatttgagcttatggacggccgcagtcagaagctcgtgcacgccagcacaggcaataaattcccattagaagaggaataccctttctactgcttgatagagactagtggatcgaatgccgagcacgatatggaaaaactggagaccttcctggagagtgtcatgggtgagggtatcgtcgcggatggtgttctggcccaagatgagactcaattccagagcatctggcgctggcgagaagggatcacggaggccctgagccaccttggcggaacctacaagtacgacgtctcgatcccccttcccgagctgtaccagctggtcgatgactgccgagagcgcttgacgaagatgggctttgttggtgatgatgactcgttccccgtccgcgcggttgtcggttatggccacatgggtgactcaaatttgcatctcaacatcgcagtccgccagtacaacaaggacgtcgagaaggcgattgaaccttgggtctatgagtggattcaaaaacgaaatggcagcatcagcgctgaacacggtcttggccttgcgaagaaggagttcattggatacagtcagaatgacaccaatcttaaactcatgaaacagctgaaggaattgtatgatccggtgagtgctcccataccaacctcccatatt

SEQ ID NO: 36104 - DNA, 1251 bp, Aspergillus nidulans
gacacatctcttgcccgccttgcggctcaacaagaacatcatttgggcttctgggaggcggtgcggtgctatccaaatgccgtcctgtggtcggtactcctctcgacttcgattattatggagggatatgatatcgttctgatccagtccttcttcgcccaaccgtcattccgagagaaatatggccaatacgacgctggcaccagtagtcatcagattaccgctccctggcagaatgggctcagcaacgctgtcagcgttggtaccattattggagcttttgccaatgggtattttgtccataaatttggctaccgtaaagtcctcctggcgtctcttgtcacgatctgcggctttatcttgatttccttctttacgcccaacttgcctgttcttttagttggccagtttctttgcggtataccgtggggtgtatttgctactatggcacctgcctatgcctcagaggtctgcccccttgcgctccgaggttatcttactgtctatgtcaacctgtgttgggcatttggccagctcatctctgcgggcgtgcaatcgggcttttctgagaaaactggtcaatggtcctaccgcatcccgttcgctatacagtgggcctggccctgcctactcttcccgatcctctggtttgcccccgagtcgccttggtactatgtccgcgtcggtaaccacgatctggctgaagcctctattaatcggctgggatcagcctcacaaagggcgcacagcaaggaaaccctcgcaatgatgatccatacagacgagattgagcgatcaattgatgaaggaacctcatatctcgactgctttcgtggcgtggacctccgccggaccgagattgcatgtatggcattcgcggcacagcccttctgcgggagtgcaatgggcggaacgccaacatatttcttcgtccaggctggccttccggagtctatatcctttcgcatgtcggttggtggcttaggtatcgcttcagtgggcacgatctttgcatggttcttgatgcgcgggtgtggacggcgcacgttgtatctatgggggctgggcttacttacgctggttctcctcgctgttggcttttgcagtgttgggagcaattcgaacgcgagcaattatgcccaggccgggctgatgctctgctggctaggcgtgtattactcgactgttgggcccatatgctatgctgttattacagaggtttcgaccacgccgctgaagaacaagagtgta

SEQ ID NO: 36105 - DNA, 2455 bp, Aspergillus nidulans
atggccccaacagtcgctactcaacctccccctcccaagctgcgccgcattggtgtcctcacctctggaggagatgcccccggtatgaacggtgcagtacgagcggtggtcccatggccattcactccgactgcgagcttacgccgtttacgagggatacgaaggtctggtggaaggcggggacatgatccgacagctacactgggaatatgttcgtggatggctctcccaggggggtacattgatcggatccgctcgctgcatgtcttttcgtgagagatctggccgtctccgcgccgctaaaaacatggtcctgcgcggaatcgacgcattggttgtctgcggtggtgacggtagtttgactggtgccgatgttttccgctctgaatggcctggtttattggacgagctggtgaagaatggagaattgacggcagagcaggtcgagccgtacagagtcttgaacattgtcggtctcgtgggctcaattgacaacgacatgtccggtacggatgccactattggctgctactcctcgttgactcggatctgcgatgctgttgatgacgtcttcgacactgcgttctcccaccagcgaggcttcgttatcgaagttatgggccggcattgcggttggcttgctctgatggctgccattagcacaggcgccgactggcttttcattcctgagatgccccctaaggatggctgggaggatatcatgtgcgcgaacatcacaaaggtgagaacttttggatcctgactaggctcagtcaactgacgatctcgcagaaccgtcgggaacgtggcaagcgcagaaccattgtcatcgtcgccgaaggagcgcaagatcgaaacctcaacaagatcacaagtgatcgcgttaaagatattctcaccgagcgcctcggacttgacactcgtacaacaattctcggacacacccaaagaggaggagccgcctgcgcctacgatcgatcgctatcgaccctgcaaggtgttgaggccgttcgtgctgttttggacatgacgccggactctccttccccagtgatcacgatccgcgagaacaagatcatgcgcaccccgttgatggacgctgtcaaggccacgcaggaggttacagctcacatcaaaaacagagaatttgagaaggcgatgttgttgcgcgactcagaattcaaagagtaccactttgcttatctgaaaactgccacacctgatcaccccaaactctccttgacccaagaaaaggtacgtagtctcttaccgttaagcatagcctctctctaatgcgtagcagagaatgcgcattgccattgtccacgtcggtgccccggctggaggcatgaaccaagctacacgagctgccgtgacatactgtctcacccgtggccacactccgattgccatccacaacggtttccccggcttgatccgccaccacgcagatcaacccatcagctcagtgcgcgaagtcaaatggcaagaaacagacgcgtgggtaaacgagggtggttccgacatcggcacaaaccgcggtctcccgtctgaagactacgacgaggttgccaggtgcttcaaagagcacaagttcgacgccttatttgtcgttggtggctttgaagccttcacggcagtgagccagctccgccaagctcgcgacaaatacgacgccttcaagatccccatggttgtcctgcccgccacaatctccaacaacgtcccgggcactgagtactccctcggcagcgacacctgcctcaacgccctgatcgacttctgcgacgcaattcgccagtcagcctcctcctcccgtcgccgcgtcttcgtcatcgaaacccagggcggtaaatcaggctacatcgctacaacagcagggttggccgtcggcgcagtcgccgtatacatccctgaagaaggaatcgacatcaagatgctcgcccgagacatcgattttctccgcgagaactttgcccgcgacaagggtgccaaccgcgccggaaagatcatcatgcgcaatgagactgcctcatccacatacaccacacaggtcattgctgatatgatcaaggaggaagcaaagggccgcttcgagtcccgtgccgcagttcccggccacttccagcagggaggcaagccctcgcccatggaccgcattcgcgcgctgcgcatggcaatcaagtgtatgatgcacctggagggctacgcgggtaaatcaaaagacgaaatcgcgaacgatgagatgtctgcaaccgtcattggcatcaagggctcccaagtcctcttctccgtcatgggtggtgaacatggactcgagaaggtcgagacggactgggcgagacggcgtcccaaggccgaattctggttgcagttgcaggatacagttaacatcttgtcgggacgggcgggggccaaagcaatgtggaccggttatgaggatgagagccggacg

SEQ ID NO: 36106 - DNA, 1123 bp, Aspergillus nidulans
ggaaaatacgcgtctgattctgagtgggcgtcaatcgatcccattccgctcaatgatggctccgagtcaggcgcgatgccgctggccaccatcgcctacagcgaggaatatctcgaagcaacttcatatcttcgtgcggttatggccgccaatgaaatgtctgacagagccctgaaactcacagaagacattatctccatgaatccagcccactatacagtctggtaagtgatccttgaagatatctggacgcagctaaacccgacaggatatatcgtgccaagatcgtctttgctttgaacaaagatctcctcgaggagctggagtggctgaacggcgtctccttgaggtatttgaagaattatcaaatctggtaggcagctctccagccgggtgaggtactgtgaccactaaccccgccaggcatcatcgccaggttatcatgtcctcacgagagcacttccctagtctcccaccaaaagagatggactttctcatggaaatgttcgctcaagactcaaaaaactatcatgtatggacctaccgccactggctggtgcggcattttgaattatgggattcccctcgcgagctcgcggacgtgaactccctactcaactcggatgtcaggaacaattccgcctggaatcaccgttatatgctacgcttcggccctcgtagtaatgagcccgatgctggcatggtcaacaccggcgggtcgcctgccgaaaagggccgacttgccgtcgtggacgaagatctggtcgacgaggagctgaggtacgctcaggaccagatccttcgagcgccagagaaccgaagcccatggtcgtacgctcggggtatcctacgagctgctagtcggccactctccgaatggaccgagtttgcgcagaaattcgtcgtcgacaagcgggacgaccagggtcagattgtggacgtctcggtgaagagtagccacgctgtggagtggctagctgacgtgtatgctgacgctgaagagaatggccgcgctgaggctgtccgtatgctcaacctcctgaaggacaagtacgatcccattcggaagaactactggaactatcgcattcggacaatcgaggcggaagaagtcccagcttct

SEQ ID NO: 36107 - DNA, 2716 bp, Aspergillus nidulans
acccgattgagtttgcagcgaaccaagtcgacaaccaaagacgctcatcgattgcggtcccgcgccagccagcaccaggatcccgaaaaggcgctccaggaggaggatctcgagaaggagggcgaaagcgagtatggtggttttgacttgacggatttcctcatgggcggtcatcttgaacggcgtaccaccgcaggagacccggcgaagaaagtgggcgttgtcttcaagaaccttacggtcaagggcgttcagaccggcgcttcttttgttcgaacgcttcctgatgccgtcattggaacctttggaccggatctatacaacatcatctgccgctttgtgcctcagctgcggtttgggaagaagccgcctgtgcgtgacctgatccatgactttaccggcactgtccgtgaaggagagatgatgctggtgcttggtcgcccaggagccggttgttcaactttcctcaaggccattgctaacgaccgcggtgcttttgctgctgttgaaggtgatgtcagctacggtggtctcagcgctgctgagcaggataggcactaccgtggagaggtcaactacaaccaggaagacgaccagcactttccaaacctgactgtctggcagacgctcaagttctctttgattaacaagaccaagaagaacgacaaggaaagcattccgattatcattgatgccctgctgaaaatgttcggtatcacccacacgaagaacacccttgtcgggaacgagtacgtccgcggtgtctctggtggagagaggaagcgtgtcagtatcgctgaaaccctagctaccaagtcgtccgtcgtctgctgggacaactccactcgcggtctcgatgctagcactgccctggactacgccaagtctctccgtatcatgaccgacgtcagcaaacgcactaccttggtgactttgtaccaggctggtgagagtatttacgagctgatggataaggtgctcgtcatcgactctggccgcatgctattccaaggccctgcacactacgcccgacaatacttcgtcaaccttggcttctactgccctgagcagtcgacaacggccgacttcctgacatcgctttgcgaccctaacgcccgtcagtttcaggaaggccgcgaggcatcgacaccgaagactcccgaggaacttgaggctgctttccggcagagcgagtactacaagcttattcagaacgaagttcaggcctacgaggatcagctccacgacacgaactgtgccgatacccaacgctttcagaagactgtccaatcgtctaagagtaagactgtctcgaagaagtccccttatactgtctctatcgcccgccaggtggctgcttgcgtgcgtcgcgagttctggcttctctggggtgacaagacttctctctacaccaagtactttataatcatctcgaacgccttcattgtctcttccctattctatggcgaggcgatgaacaccaatggtgccttccctcgtggtggcgctcttttcttctcgattctcttccttggttggctgcagttgactgaactgatgcctgcggtttccggacgtgctattgtcgcgcgacacaaagactatgctttctatcgaccgtccgccgttgcaattgcccgcgtggttgtcgacttcccggctatcctctgcatgtgtataccgtttaccatcgtcgtctatttccttgctggtctcgatgctacggcttccaagttctggatttacttcctgttcgtgtataccacaaccttctgcatcacgtctatgtatcgcatgttcgccgcgctgtccccgactattgacgatgccgtccggttttctggtattgctttgaacgttctggtcttgttcgtcggttatgtcattccgaagcaaggtctcattgatggctcgatttggttcggatggctgttctatgtcaacccgctatcgtacagttatgagtctgtcttgtccaatgagttctctgaccgagtcatggcctgcgatccttctatgctggtcccgcaaggtcctggcgttagccccgagtaccagggttgcgctctcaccggatccaagctcggctcaaccgacgttgcaggaagcgattacttgagtacaacattccagttcacgcgtcaccacctctggcgcaactttggtgttgtcatcgcttttactgttttgtacctgctggtcactgtcatcgccacggagactctgtcttttgtcggtggcggtgacggtgccctggttttcaagcgttccagtaatgctaaacaaatcaaagctgccacggaaaagcccaacgacgaagaaaacggccagggcgatgcagtgacgcagtctggaggcaacaatgaagccgctttcaatcgtatttcttctagtgagcgcgtcttcacctgggacaacgtcgaattcacggttccttatggaaatgggactcgaaagctgctcaacggtgtcagtggttatgcgaagcccggactaatgattgcgttgatgggcgcctcgggagctggaaaaacgactcttcttaacaccttggctcagcgccagactactggcgtaatttcaggcgatatgttcgtggacggccgccctctcagcactgattttcagcggggcactggtttttgtgaacagaaaagacttgcacgacgcaactgctacgatccgcgaggctcttgaactctcggctctgcttgac

SEQ ID NO: 36108 - DNA, 999 bp, Aspergillus nidulans
cccaatctccccggcaagcccttcgtgccagaatggaatccgcctccggttaccaagcagactgagagctttgctaccctaaagtcaatcgatctgtccctcctcgactctgaagacccggtcgtggtcaaccgtctcattcaacaggtcaagattgccatccgcgacgacggattcctatttctcgagaattacggtgtctcgcttgagcagctgcaccgccagtttgcgctcgcgcagtacctctacaataacatgagcgaagaagataaggagcgccttctgtttgaccccgagacagggaggtggtcagggtataagcatccgtacgggttcaaggtaatcctatatcccgtctccactctttataactcgaacatccacttaactgggcttcgtcttatgatatagcgccaccgcggccccccagacggaatcgaacagtttaacttctacacgcgcgagtggaacgaccccagccgcatcccgacgtgcttacaccctttcatggacgaaatcaccgcgttctgcaactaccttacgcaatcggtaaaccgccgactgctgaccctcttctcacgcgtgctagaacttcctgacgactacctctgggaaaatgtgcagtcgcacggattccccacgggggaaggctacttccgccacgcgctgtttcggcctgtgcagaaggagacgcaggaagcgtccaaagggctgcgtatgcacggacacacagattttggacttacaacgctcctcttctcagtaccggtcagctgccttcagatctggggaagggacgaaaagtggtattatgtcccgtacaagcctggtgctctagttatcaacatcggcgacacgctggagattgtctccggtggacacttcaaagcgaccaggcatcgagtgtataagccgcctgccgatcagctaaatgaggagcgcctgagtcttgtgctgttcaatagctcggtcggggagttgcggatgcagcctgcatat

SEQ ID NO: 36109 - DNA, 1352 bp, Aspergillus nidulans
gcttccttgctcacagcttctgtgctgctgggctatgcctccgccgaggttcacaagctcaagctcaacaaggttccccttacagagcagttcgtgagtatatgagctcaatcatcttacgatatgatgtttgtttatggctgtgactgattcattcagatcacgcgcaacattgccgaccatgcaaatgccctaggccagaagtacatgggccagttccagcagcatgtacttgaggacgagccagtcaacgccatgcgcggtcacgatgtgctggtcgacaatttcatgaacgcccagtgtatgttcttaggactctgcgtggctgagtgatactgattcttgctagacttctccgaaatccagctcggtaccccccctcagaccttcaaagttgtccttgacacaggtagctccaacctatgggtgccatcgtcagagtgtggctctatcgcttgttacctgcaccagaagttcgactcttctgcctcgtccacatacaagaagaatggtagtgaatttgccatcaagtacggatccggcagcttgagcggattcgtgtccagggacaacctgcagattggcgacttgaaggttaagggacaagacttcgccgaggctaccagtgagcccgggttggcttttgcatttggccgttttgacggtatccttggcctcggatttgacaccatctccgtcaacaggatcgtccctccgttttataacatgatccaccagggtctgctcgatgagccggtctttgctttctaccttggtgatgccaacaaggatggcgacagctccgttgccacctttggtggtattgacaaggatcattacgagggcgagctgatcaagattccccttcgccgcaaggcctactgggaggttgaccttgacgccattgctcttggcgatgaggttgctgagctcgagaacactggtgtcatcctcgacaccggtacctctctaattgctcttccttccaacctcgctgagatgatgtgagtaatatcattgccgtttcacgcgatctctagatactgacattgacatctaaaagtaacaccgagatcggtgccacaaagggtttcactggccagtataccattgactgcgccaagcgcgactctcttcctgacctcacttttactctgaccggccacaacttcaccattggtccttatgactacaccctcgaggtccagggttcctgcatcagtgccttcatgggcatggacttccccgagccagttggccctcttgctatcctcggtgacgcctttctacgcaagtggtacagcgtatatgaccttggcaacggtgccgttggtctcgccaaggccaagtaa

SEQ ID NO: 36110 - DNA, 1053 bp, Aspergillus nidulans
atcctcctccttgatggtggcctggggacaacactcgagtcttaccctttcaatatcaccttcacctccgagacccctctctggtcgtcgcacctcctgatctcctccccatccaccctccaatccgcccaccgcgccttctacgacgctggagcagacatcctgctgacagcaacctaccagtccagcattgaaggtttcgcaaggacagacgcaagccacacgattaatgatgcgggagactacatgcgatctgccattccgctcgtccgaggcgccattccctcctctgcgaggcaacgtccacagcagtgtcgcgttgcgctgtcattaggcccctatggtgcaacgatgtccccagttgcggcggagtacacgggggcttatccgcctgagatggatggggaggatgcgttgagacaatggcatgcgggacggctgaatgtgtttgttgacgatcgtgaatcgtgggaccaggtcgactttgtcgcatttgaaacactcatcagggcggacgaggtttgtgctgtacgtggagcgatgaaggacgtttgcgtaggacctgaaatacacagaaggcgaaaaccctggtggatatgtggtgtctttcccgcggaggaagtggacagaacccaggttagacagtgggtggatgcggcggttggacagcgcccggggctgccgcgaccatggggcattgggctgaactgtacgcggattgaaaacgtcgcaaaaattgttgcgatcatgcgcgacgagttgcattgcttgctgagcaggggcaaggaagatggcttcgtggatgagtgggacgcagcgtcgggtaaaccatggctggtgttgtatccggatggcacgaagggcgagaagtacgaccctgtcaccaagacatgggtggcgcgggaaacggttgtgcgatgcccgtgggatgagagcctttgggatgtggtacaagggcagtcagaaggggactgggagggcatcattgtcggagggtgctgtcgcgccgggccagctgacattgcggcattgcgtcggagaattgattcatcc

SEQ ID NO: 36111 - DNA, 942 bp, Aspergillus nidulans
tccgacgtgcacttttggcatgcaggatgcattggtcccatgatcgtcacgggggaccatattctaggtcacgagtcggctggagacgttatcgcggtcgcgccggatgttacttcactcaaagttggagatcgagttgcgatcgaacccaacgttatttgcaatgcatgcgagccatgcctgactggtcgctacaacggctgtgagaaagtcgccttcctgtcgacaccaccagtggatggcctgctgcgacgttacgtcaatcaccccgcagtttggtgccacaagattggcgatatgagctatgaggatggtgctttgttggaacctctcagtgtgtcactagctgccgtcgagcgcagcggtctccgtctaggcgacccttgtctgatcactggcgccggtcctatcggtctcatcaccctgctcagcgcgcgcgctgcgggtgcaactccactggtcatcactgatatcgatgaaggtcgcttgaagttcgctaaagaactcgtgcctgaggtccgcacctacaaggtggagatcggtttctccgccgaagagactgcagagggtatcatcaatgcgttcaacgacggtcagggagccggccccgatgctttgaggccccgtatcgcccttgagtgcactggagttgaaagcagtgttgcatctgccatctggagcgtcaaattcggcggcaaggtgttcgtgattggagtcggcaagaatgagatgaagattccatttatgcgcctgagcactcaggagattgatctccagtaccaataccggtactgcaacacctggccccgagccatccgtctcgtaaagaatggtgtgatcaaccttcagaagctagttacccaccgctacgcactggaagacgcgctcaaggcttttgagacggcggcaaaccccaagacaggagccattaaggtccagatt

SEQ ID NO: 36112 - DNA, 1554 bp, Aspergillus nidulans
aagcattaatccattatagccatcggttcggcgataaattctggcttgttgataggactgggggatgctctctcacggtcagtcttctggttatgcaaagatactttcctgacctagacctcttagatcaggagtaatactgtcgcccaagctacaattcaaagtgctaattccagcagccagcctcgatcctgatctcctatacctttgtcggtttcatagtcttcctcgtcctctccgcactaggagaagtggcttccttctcacgagagccaatcaccctacatactcaagcaaaacgattctgcggtccgtcgttgggcttcacactgggatggatgtaagtcgcttcaatttggccttgacggcctggagctcacctggggcagatactggctcaagtatatgatggtcattatcaaccaaatcactgcaggtgtcttggtactgtccttttggactaatctcgggattgggcagaaggcggcgtatattacggtttttcttgctgtgatccttagcatgaattactggagtggccgcttcctcggtcgctatgaagtccttctctcgtcctttaagattctggtagttttgggtcttatgatgctgtcacttgttatcgcactcggaggtggtccgaaccataaaaagggctttcattactggagaatgcctggtgcgtttgccaacgaggaggatagatccgcgttaggagtgtttcgtgccattttcagaacgttccctccaaccacgctatcttacctgggaaccgaacttataggaatggccgtactgcacacgcaagattccaaaaaggctgcagctcgagcaattcagcagacattctatcgcatcttggcctttaaccttgtcgttgtcacgttgttgggaatggcgatcccttacgacgaagacatactagagttgtctatctacacctccaagcgcagagctatggcttttgttgtggctgttcaggtggcccatgttactgtgctaccggatatcctgaatgcttgtatccttatatttgtggtgtcgtcggcaagcagggccctttgtatggctaccaggattattcgcgagctctcccttgaggaaaatgcacctcatttccttcgtcgcgtcaacaaacgaggagtgcccgtctacgctctaggagtaagtttcgccccggttttgtcgggatttttgaatctcttcagtacttccgggcgcctctggacttatcttgtgaaccttgtgaccatgtttagcatactgacatgggtatcgattctcgtcgttcatatatcatttgtacattttcggagagtcaatcaaatacctcctgaaggtgtcccattcaaagcccccttgggtatcttagggtcctgggtcgcccttgtgctttgtatatccatacccatcatgcgagcaatcgaactgtctgatcataatttctacagccaaggtctggatgttggggctttcgtcacatcgttcctcggaattcccctatatcttggtctagtggtcggttataaggctgtatacaaacgcaagaggcac

SEQ ID NO: 36113 - DNA, 1616 bp, Aspergillus nidulans
gaccgtcagatcccttctatcctctcatacatcggtggcgagcaatatcacggtacccaagcgaaagctcagctcatccgtaacccctcgaacaccgttgcatacttcagagactaccttggcaaggagtaagttgcggcactcaaaactagaactggaagcgaatgcacctgctaaaggactactgcagcttcaagtcaatagaccccaccccatgccataactccgcccaccccattcagagcgactcgactgttgctttctcaatccgtgacactgagagcgagacacccaacactgtcactgtctctgagatcaccacccgccatcttctccgtctgaagcaatctgcctctgatttcctcggcagggaggtcaacgcagccgttgtcaccgtccctaccgacttcaacgatgctcagcgtgaggccctgaccgctgccgccaaggctgctggtcttgacattctgcagctcattcacgaacccgttgccgctgctcttgcctacgacgctcggccagaggctgttgtcactgataagctcatcgtcgtcgccgacctcggtggcacccgatctgatgttgccgtcattgcttgccgtggtggaatgtacaccatccttgccactgctcacgactacgaattgggaggctctaccctggaccagatcatcattgaccactttgccaaggaattcatcaagaagcacaagaccgacccccgtgagaacgctcgtggactggccaagctgaagatggaaggtgaagctacaaggaaggccctgagcctgggtaccaatgccaccttgagcattgagtctcttacagacggaattgactatggttctaccatcaatcgcactcgttacgaactcctgtctagcaaggttttcgctcagttcaccggcctgatcgagcaggttatcaagaaggctgaactcgatgttctggacattgacgaggttatcttctccggtggtgtttcccacactcctaagatcgcccagcttgctcgcaatctgttccccgagaagacccgaattttggccccgtccactctggcgtccgccatcaacccatctgagctgtcagcccgcggtgctgccattcaggcttctctgatccaggagtttgaaaccgaagatatcgagcagtccatccatcctatggtgactgccacacctcacctcagcaaggcaattggtgtcgagttcacttccggtgatgctgtcgagtttctgcctctccttaacacagagaccgcccttcccgcccgccgtgtggcccagtacagtgttcccgccgagggcggcgacgtcctcatccgtgtctgcgaaggttcccgtgagatcaaggttactaagcccgagcccaagcccaaggaggagaagtccaaagccgaggacgatgaagacgactccgacttcgactccgatgaagaagaagaagacatccgcgagattgtgtggaaaaccgagcagcccattgctgagctcgccgtcaagggcgttaaggccaagggtaaagttgagctgatgatccacattaacgccgacctcggtctgcagatcacagctcgagaagttggcggccaaagcgccgtccggggcgctgtt

SEQ ID NO: 36114 - DNA, 1290 bp, Aspergillus nidulans
ggctttgacgagtatcatccggtcaccaaaaagggcaaacagatgatcgagggtggaatgggctggcagattgtggatgcactggacacgttgatgatcatgaacttgacatctcgtgtacaacatgcgcgcacatggattcataactcgctacaatatgaccaggatcacgatgtgagcacttttgaaacgacaatacgcatgctcggtggtctgctctctgctcattatctctctacggagtattccaaccttgcccccattcccgacgacgacgttggttccccaggggaggatctctatattgaaaaggcaaccgaccttgcggaaagactacttggggctttcgaatcggaaacaggtattccgtatgccagtgtgaacctcaatacatcgactggtatcccgtcgcattcagaccgcggcgcctcatctacggctgaggccacctccgtacaactggaattcaagtacctagccaaactgacgggcgaggctgagtactggcgcgttgtggagaaggtaatgcaagtggttgacgccaatcaagcccctgatggccttctcccgatctatatctatccagatacgggaacgttcaggggagcgaacattcgcctcggtagcagaggcgactcttattatggtacgtgatgtcaaagcagtgaagtagatcggtgctaataacattcagagtatcttgttaagcaataccttcagacgtcagaagaaatatacaaggacatgtgggacgaggccctcgtcggaattcgcaaacacctcatcacattttccaagaatgccaagttgactgtcctgggcgagcgacaggccggtcttgacggccctctaaccccgaaaatggaccacctcgcctgcttccttcctggaacaattgctctcggggctacagaaggaatccctctctctgaagccaaaaagtccgccgcatggactcgccgtaaggacgaagaaatcctcctcgccaaagaactcatgaaaacttgctgggcaacctatctagccacccgcaccggcctagcccccgaaattacctacttcgacatcgacaccccgcacgtctccgagctagaccggtatcccgactccacgctcgccgcaggcaacgcggacaagaagcccgcggacaaagatctaccgctgaaatcccaagcgctgtaccctctcgcagactcaaattcagaccctaactcctggcgtcgcgacattatcatccagcctcaggatagacataatctccagcgcccggaaaccatcgaatccctcgtc

SEQ ID NO: 36115 - DNA, 1058 bp, Aspergillus nidulans
cgcctttgacgaagcagtggcggattccgagttggttggcagcttgtgccaagtgggctgatgttcatcggcctgtggttcctgaaggagtcgccccgctggttgatgaagcagggtcgccgcgaggaggcaacggcgtcgctcgctttcacgcggcgcgctgatccaaacagcgacgaggtgcagcaggaactggctgagatccgggcgtctatcgaagaggagctccgctccaccgagggcgtcacctggcgcgaggtcctgctgccggggaacaggttgcgattcctcaatgcattcttgatcatgttctggcagcagttctccggcacgaacagtatcgggtactacgcgccgcagctgttccagactatcggagtggcttccaccgacaccagtcttttcaccacgggtatctatggagtcgtcaaggtcgtttccacaggtcttttccttcttatcggaattgaccggttcggtcgtaagtggtctttggtcggtggaggttgggccatggccgtctttatgttcattctgggtgcagtcctggtttcatacccccctgtgaacactgacacaatctccaatgcaagcattgcaatgatcgtaatgatctacctttacgttatcaggtatgtgattatccttttccccctgaatcgtgatcagccctaagctaactatgacatagctactccgcctcctggggtcccatcccgtgggtatacatttcggaaatcttcccaacgcgcctgcgggcctatggtgtcggcatgggctcggccacccagtggctgttcaactttgttgtaacaaagttcaccccctctgccattagcaacattggctggcgcacgttcattatgtttggtgtcttctgctttgctatgggcttgtgggtgtgcatctttatcaaagagaccaagggaaagaggcttgaggatatggacgacatctttgggggaaagaccgtcgagcagatgcagaaagatatcgagcaggcagatgttgaggagcagacagaggtggaaaagacccagacaagacatgaagagcag

SEQ ID NO: 36116 - DNA, 1142 bp, Aspergillus nidulans
gatctacacgaatacctctctggcccaatcgccatcccgacaacaccccaccccctcacaggagcacagctccccgttacgctgggccacgaattcagcggcaccatcgaggaagtagggcaaggtgttacagggttcaaagttggagatcgagtggctgtccggccaaacttatcggatggaacctgcgcctcttgtgtatacgggaggcccaactgctgtcgcagccttgggtttattgggttcaagcagtgagtgagcctgagaggttgtgctacaggggctggagtcgataactaacttatcctgcctgagtaggtaattccggaggtctatcagattatgttactgttccagccaagcatgcgattctgttgcctgagagcgtccccctggatcttggtggtgagtccgccaagtgcacttttcactgacctagctaaagcagagcccagcgctcgtcgagcctctaacagtagcctggcatgccgtagcccgcagcccccacgaaactgcgcgtactgcgctcgtcgtcggcggcggccccataggcctcgcagtcgtgcaggtcctcaaagcccggggcgtgcaaaccgtcgtcgtcgccgaggtctccacccagcgacgcgaatatgcgctcaccctcggcgccacacacgttttcaaccctctcacggacgatgtcgttgcgcgtgtccgcagcttaacggataatgcaggcgcagacatcagctttgaatgctcaggagtacaggcagggttcgatacagccatgaatggaatccgggtccgggggacgacgacgattgtgtcgctctgggagaaaaagcccatgatcgatgcgtttgatgtggtttcttatgagaagcatgttattggggcggcaatttgcgacgacggggactttgaggctgtgatcggggccatcaaagacggtgtgttactcatcctttctcgtcttgcttattactcagttccgttgagaaggcaacatgctgactggtctcctacacgctctaggcaaactcaatccccgtcccatgatcactagcaagatccggatggaggacgtcgaagaaaagggcttcaaggcgcttgtcgacgagaaagataagcatgtaaagatcctgattgacattgcc

SEQ ID NO: 36117 - DNA, 1385 bp, Aspergillus nidulans
atgaggataatcccatccgcgttgatcgctctggggttcggctatggagtggtcgcagctcccactctaaagcaagccgaacgccgatccttcaaggttgagactgtccgccggagcaacactatctacggtccagctgctctacgaaaggcctatgtcaagtacggcattgttgctgcggacatcggactcgacctagatgactttgaacccagcgttaaggttgctgctgcggccgatactgacgcggaagtcgctgagcccgacttgaccggtgctgtcagtgccaaatctgtcgagggagatgcgtcttttgtttcgcctattaccattggtggccaggaactcaccatcacctttgacacgggttcgtctgatgtgtatgtgctacggttctttccccacgctcgatagtgctaatcaagtttccagatgggtggtgaacacactgctccccaaagactctattgaagggcaaacggcctttgacccatcaaagtccactacgtacaagaaaatgacagggtcgacctttaacatcacttacggagacgactcgtatgcgtacggtcccgttggaactgatacaatcaatgtgggaggggtcacagtgacaggtcaagcaattggccttcctactgcagttgcctcatctatcctcgaagacacccacagcaacggcctggtgggactgggtttcagctcactcaacaccgtcaagcccacacagcaaaagtccttttttgaaacaatcgccggcgtcctggacgagcctgtcctcagcgcatctcttgtgagtgatggagtcggcgagtacgagtttggcactgtcgacaagtccaagtacaaaggcaacctcgtcaatgcaaccgttgattcttcgggtggattctggaaattcgagtcttcatactaccgtgttggagacggcacgttgaagaagcacgacgacgcaacttggacaatcgccgatacgggaacctcgctcatgctcctcgagcagaccgtcgtagatgagtactatgcacaggtgcgaggcgcgcagtacgcaaccagcgcctcaggctacatctacccctgcagcgccgagttgcccaacctctccatcgccatcggccctcagcatctggcgacagtacctggtaatttgattaatttctcggaagttggcaccaacaccaccaccggggaagctggtatgtgacaatcttttttctagagattaatatatcgctaatatttccgcagtctgctacggaggtgtccagtccaactcgggtcttgacatgcaaattctaggcgatgctttcctgaaagccttctatgttgtctttgacctgcgtggcccgtcgatcggcgttgcgtctcctgtctgatcgaattat

SEQ ID NO: 36118 - DNA, 1629 bp, Aspergillus nidulans
cctgatgttgcattcttgccgccggcagaagatcagaaggctttgtgggagcacctcagcacgatcgatatcttctcaattggcagcattccttaccagcttgctggcgagaagggatctccggccgccggtatcgctgaggctctgcctctgctgttcactgctgtctccgaaggccgcctgactgttgaggacatcattgctcgtctgtacgagaaccccaagaagatttttgagctgcacgaccagtcggacagctcggttgaggtcgagatcgatcgtccttatctgttccagagcgcgcaggcctggtcgccgttcagtggcaagagcgtcaagggccttgttcagcgtgtcatcttccaagggaagacgtcttgtcttgacagcgaaatcactcctgatgctcctaaaggctcggatatgtctggtcacaggattgtgcctgcatctccatccctcaaggcgatgtctccacgggttgatggtgctctagaccgtaggcagtccatctccattgccggcactcctgcacggttgggacgcaagcctgtggatcacttccctgccgccactggagccgaacttggtccgcccctgtacacccctgtgcctcgggcctcttcgccgttgctacagatgctttctcggtccccctttaaacaaaagcacgtgctctctgtcaaccaattcaacagagctgaccttcacctgcttttcaccgtggcacaagaaatgcgactcggcgttcagcgcgagggcgtcctggacatcctgaagggccgtctcctgtgcactctcttctacgagccttccaccaggacttccgcctcgtttgacgctgcgatgcagagacttggaggacgaacgatcgccatctcaactgagcactcatctaccaagaagggcgagactctgcaggacaccctccgtacactcggctgctacggagatgccgttgtcttgcgccacccagagcccagcagcaccgaggttgctgccaagttctctcccgttcccgtcattaacggtggaaacggcagtgttgagcaccccactcaggcgttccttgaccttttcaccatccgtgaggaacttggaactgttggcggtctgaccatcaccttcaccggcgacttgaagtacggccgtcctgtccactcgctcatcaagttgctccaattctacgatgtccgcgttcaactcgttgcgcccaaggatctgtccttgcctgcggacatccgccagcaactgctcgcaaccggtcagctgctcacggagtctgaggagctgactcctgaaatcgtcgcccgctctgacgttctgtactccactcgtgtgcagaaggagcgcttcgccgaccttgagcagtatgaacgcctcaagaacagtttcatcatcgacaacgctctcctcaagcacgccaagagccatatggtcgtgatgcaccctctgcctaggaatgccgaagtttctgaagaggttgacttcgaccagcgggcagcctacttccgacaggtgagtctccaatcccgtggccctagtagtgagttcgacatgctaatgtggatgcagatgagatacggtctttactgccggatggccttgcttgcactgatcatggcgcct

SEQ ID NO: 36119 - DNA, 2163 bp, Aspergillus nidulans
cggttagaggacctcctccgacacccggaggacctcgacaagatcaatggactgaaagccgaatacacacgcaagaaagctgcggtcgatgcgcagctccgtgagggtcttcgggatcagttagcatccgtacaacgaagcctcagcgccctcacggaaggccagcgccaggtatcaaagacgagggatgagctacagggtatcgacagactatgcgccgagtcgcagaacagcgttgatgacttctcgcgaattgaccagctcgctaaaatccagcgcaactttgaagctactctgatgatgaagaaaggactggagaactttagctctgatttagcggagattgaggagcttctgagggaggatgacgaggatcttgagaaccagcctaatctgctgcggacccatatgcggatatctcgattgcgggactttcgagatgaggccatggatcaagttcgcagggcgcaggacgcgagtaacgaggccaccctagaagaatatttccaagggctggatgccgtaatcgattggtttgatgaccatcttgggacgctgtgtatgaacctcattccgctcgtgcagagtgataaccccagcatggtggttcgacttgcggttgtggtggcgaacgaggagaagaatgatgagaccgttaaggccttgcaggaggcgcagaaggatcaccaggatttagctgggcggtttaagtcaatgaatgttggaccgaagaccgtaaggggatacaaggaaaaatttatacaagcgatcgagttctacgctcaaaatcagttcgaagacaccaaggagaaattcttggatgacccggaaggtctggagaagagtttccgatggttctttaacgacctcttcgtcgtgcagcagggcatgcagtcgttgatgccgaagaagtggaaaatcttcaagacctacactgatatctatcaccgcatgatgcacgatttcctgattgagatggtcaacgaccccgcattaccagctgacaacctgcttgcgatcctccactggagggaaaaatactacaagaagatgaagaagcttggctggcaggcgtctgaccttgagctagatattctggataaccgcgaacctgatctcattcggcggtggcagaatgtcattattaacgcggtagaagattggatggataagatcacggagacggacaggaaggcacttacggagaggatacctgactcacttgatactacagcagacggctacttccgcactcaaactcttccagatatgtggcgaatgctgcacgagcaggtcaccgtgtccagctcctcctcacgccccgacctcttggaaggtattatggatgcaatgttccgagtgctgaaggctcgccaaaatgcctggcagacccttctcgaggaagaatgcgctaaatacaaagcacccggcggtgaacaactagacgggttgcaactgctgcaagactggcttatagcagtagcgaatgaccagattgcctgcattgacgacaatgacgaaacgggacaatatgggcacttgacgcggttccgacgtgatatcgagcagtacgtcgacccgaaatacatggcgtcccgcgcaattcccgagattgatgctttacgagatggctacgtcgatttgagtacctactgtatttcgcaattcgtgaacgtaattttcgcagtcgacctgcagggcacgattcgcgatttttttacccagagatggtatggagatttcgccgtgaagcgaatcacttctacgttcgacgattacatggccgattactcgcctgtcctccacccctccctcacagacatcctcgtcgaagaactctccgacgaactcctagtccgctacctctcatcggtccgcaacaagggtgtaaaatttcgccgacaaactgacccctacaccgacaaattcaaggacgacgtcctcacagtctttgcatttttccagaaatacccggactcttttgcaggcaccatcaagcagaaatggcggcttgtcgactggttggtccggcttcttgaggcagagaaaggtcctgctgtggttaatgtctatgaagacttcaagaatgagtactgggacctgcagctctcgtgggttgaaacagtccttagggcacgggatgactttgagcggagtatgatt

SEQ ID NO: 36120 - DNA, 943 bp, Aspergillus nidulans
ggaacgtggcaatccgcgcccggtgaagtcagtgcagccgtctaccacgccctcaaagtaggctatcgtcatatcgacgcagcccaatgttacggcaacgagaccgaggtcggcgagggcatcaaacgcgccctctctgaaggcatcgtgaagcgctccgagattttcgtgaccacgaaactctggtgcacataccacacgcgtatacagcaagcactagatctctctctatcaaagctcggtctcgattacgtagacttgtacctagtccactggcctcttgccatgaaccccaacggcaaccacgacctcttccctaagcttccagacggcagccgcgatctggttcgcgaacacagccacgtaacgacgtggaagggaatggaagagctaatcacgaacaaccccgataaggtaaaggcgatcggagtctccaactactcgaagcggtatctcgagcagttgctcccgcaagccaagatcgtgccggccgtcaaccagatcgagaaccaccctgcactaccgcagcaggagatcgtggatctgtgtaaggagaaggggatcttgattacggcgtatagtcctcttggaagcacaggaagtccgctgttcaaggccgaagccattgtggccgttgcagagaggaggggcgttacgcccgcgtcggttctgttgagctggcattgtacgtatccctatcccataccgtactaacttcggacctgaacatatttgatgcgagtgagaaatgctaatgtgtgcttgtacagtggcccgcggctcctccgtcctcgccaaatcggttacaccttcgcgcattgaggagaacaggaagttggtgaagctggagcccgaggatgtcgagttaattggcaagtactcggcggaactggctgcgacaaacgggttccagcgatatgtgtacccgccgtttggggttgac

SEQ ID NO: 36121 - DNA, 1623 bp, Aspergillus nidulans
gaccttgtcatggggttcttgaggaaccttgtttctggaaagagggagggaaggggaggtgtgccgctcaaggctgtggttatgagtgctacggctgatatggagagtctacaagaattttttgtggagggatacaaagctcgggaattgcagaaggaagagaagtcagagaaagatggtatcgcagtgtgtcatatcaagggccgtcagtttccggtcaagacgatatattcgccggaacccgtgcatgactttgttgatgctgccctaaaggtcattttccagatccactataaagaaccgattccaggcgacattctggtcttcctcacgggacaggagacggttgaagcgttggaaaatctggtcaacgagtatgccacagggatggacccttcattaccgaagatacaagttctcccactttttgcagcgcttccccaagcagctcagcagcgagtctttgtccctgcgccgccacgcacccgcaagatcattttggctacgaatattgctgaaacttctgtgactgtatctggtgtgcgctatgtcgtggattgtggaaaggcaaagatcaagcagttccggacccggcttggattggactcgctgcttgttaagcctatctcgaaatccgctgctatccagcgcaagggtcgtgctggaagagaagcgcctggccagtgctaccgactatatacagaaaaagactacctggcactagatgaggtcaatacgccggagattctacggtgtgacctcagccaggcgatactcaacatgaaggctcgaggggtcgacaatgtcattgagttcccattcctgacacggcctccacgagaagctctagagaaggcgctcctccaattactgagtatcgaggccctcgatgaaaccggcaagatcagtgagaccgggtcgcacatcgccaaacttccgctcaccccgacgttaggccgggtgttacttgccgcgtccgactttggaccggattgtctgactgacgttattgatattatatcgtgtctgagtgtggagaacatatttctaaacaccacgtcagaagagaagaaagaagcggccgaggcagctcgccgcgatctatacagacgagaaggcgaccatcttacgatgctagcgacagtacgggcctacgcatcggagaacactgaccggaaggcatgggctgagcgacatctggtctcgcatcgggcgatgcagtccgtcatggtaagtttgctgccctacctagataccatgtctctaagcaaccctcacggctaatattcgggtccttaggacgtccgcaagcaactgacggctcaatgccgacaggccaaactgcttccgagtcccaccgagtcacgggactcagactcctcgtccatccgagaaccgtctcctgtgttcatattgaagagcttcctgcgagggttcgctacaaacaccgctcgccttgtccccgacggtagctaccgcacggtggtggggaaccagacagtggcaatccacccatctagtgttctcttcgggaagaaggtcgaggcgatcctgtacaacgaatttgtgtttaccaaccgcagctacgcgcgaggggtgagtgcggtgcagatggattgggtg

SEQ ID NO: 36122 - DNA, 1198 bp, Aspergillus nidulans
gtaaggcagcacaacgtggtccctgaaccatccctcgtctcagatgtgacgcacgttgccctcgctttcatgcaatcgtcaatcttcaataggaactcaacctcgagctggcctctcttcaccacagttgatgctgtccgtaccgaattctcgaacggaacatcaatcctcatctccatcggtggatggggcgacacgcagggattttccacggctgctcggacggacgagagccggaagctctttgcggagaacattaggcggatggtggacgataccggggcggatggtaagagtagtttcatcaccggtgtattcgcctactgacgatcagcaggagtagatattgactgggagtatcctgggtatgtttttcctgcctatcgcccgttatagagcggcttgatatttaacgctaaaattatacagaggcaacggcgaagactacaaacgaatccccaactcggagaaattttgggaaaccgcagcatacccccaacttctggcagagatacgagcagccatcccggacaaactgataaccgccgccgttccaggccttccacgagacatgttggctttcacaaaagagactataccctctatcagcgcctcagttgatttcctcaacgtgatgacatacgacctcatgaacagacgagacactgtaacgaaacatcacactggcgtacagctgtccctggagtcaatagatgcatatatagaggccggcatgccgcctgaaaagctcaacctcggcctcgcgtactatgttaaatggttcaagaccgtgccaggcgaacagtgcgcaaaacagccaattggatgtccgactgttttaatggaggacccggatacgggtgcggatcttggacaagcaggcgcattttcatggaatgatcgagttccccaagagctggctgcgagttttgaaaaggccaaaataagtggtgaatatgatccttttggcggcggctattacttctgggactcgaatgaaaacatcttctggtcgtgggacacagcaaatgctattaaaagaaagtttcctgctattttggagaagagaaagctcggtggcgtgtttgcttggggcttgggtgaggatgctcctgagtttgcgcacctcaaggcaacgactgctggcctcggggactcttcggcagcgcccggcggcaagctaagtacaagtaggaaa

SEQ ID NO: 36123 - DNA, 1710 bp, Aspergillus nidulans
tattagctctactggtgtatcggcgtggcgatgctcaactcgtgtataaatggctacaacggttcgctcatggggtcgataaacagctacagacagtaccgcgagtactttggtttcgatctggaagagggaacctcgacgacaggcatcgtgtatgccatctacacaatcgggaatatcgttggttcgttctttgccggcccgtttacggattttcgaggtacgtgacctcatccctcaaccctccccatcctgccggagcctggcttgttgagtactgactgagcaggtcgccgcatgggcatggctatcggcgccctctggatcatagccggcaccatcgtgcaagcaacatgccacaacctcggcggattcatggccggccggttcctgctcggttttggcgtcgcaacctctgccacagcagggcccgcatatgtatcggaaatggcgcacccggcgtaccgcggcgcaatgacgggcttgtacaatgtgctgtggtttggcggcgggatcccagggacgttcatcccctggcgcaccagcacgattgacgggacacagagttggcgcatcccggtctggttgcagatggtgttttccgggctcgtcttgctgctctgttttacgatacccgaggtatattgtcccttcctttaccctgggtctgtcgagttagaatgaagagcatctaatcactggactcgaatgccatagagcccccgctggcttatctcctgcgacagacacgaggctgcgatccgcgtgctcgccgaatatcatggtgagggtgaccgaaactcgcccctcgtgcagcttgagtaccgcgagatgctcgaggatatctccaacgtcggtgctgacaagcggtggtgggactaccgggagctttttgatagtcgagagacgcggtaccggtctatgctcgttgtgttcatgggtacttctcccaatccttcgcttcagacatataccgaggaagtggtatgctaatgagtgatcttcagccttcttcggccaatggtctggcaatggcccggtctcctactactacccgcaaatgctcgcgggcgcaggcatatcctcaaaccacacacggctcctgctgcaaggtctgcagaatatcgtacaattcaccggcgcaatctttggcgccctgatcaccgaccgcgtcgggcgtcgtccacagctcctcgtatcaacatcgatcattgtcttcctcttcgtgatcatcaccgcgctgaacgcgacaaacgtccaagttgccggagacggcggcggagtcgtcgcaaagagcagcgtcacgcggcgcgcgcagatcgcgatgattttcatctttgggttcgtgtattcggccgggtggacgccgaatcaggcgatgtaccctgtggagtgtctgcggtatgagagccgggcaaagggtatgggaatgaataacgtacgcaccctttctctttatccggttctgttttcatccacgtcaagtatttgtgccatgatggccatggctaacaaaggaggtagtttttcatcaacatcgcctccttctataacacctttgtgacaggaatcgccttcacgcggattgggtggaagtattatttcctctttatattctggtgcacgtttgaagtgttgataatctatttcctatttgtggagacaagtaagcgtacactggaggagttgacggtgatctttcaacaaaaa

SEQ ID NO: 36124 - DNA, 2280 bp, Aspergillus nidulans
gatgccccatccgattccgaacaagatgtgttcggctctcaggaagatgagagcacctggtgggaagagacctttgggtggaaactcagattcgaagcccaggggtccgaaaagtgtggggtggacattagcttcccaggctacactcatgtgttcggtatccccgagcatgcagactctctgtccctgagggagacgcggtaagctgctcggcttctatttcataagctacccaaactaatcataagtagtggaggcccgggtaaccacgaagaaccctatcgcctgtataactctgatgtgttcgaatacgagcttaacagtcctatgactctatacggtgcaattccgttaatgcaagcccaccgtaaggactccactgttggtgtcttctggctcaacgctgccgaaacctggattgacattgtgaaatcaaaaaccgacacgcacagccattggttttccgaagctggacagctcgacgtatttgtctttctagggcctacccctggcgagataagcaagaagtatggcgagttgactggttacactcaactaccccagcagtttgctattgcttatcaccaatgccgctggaactatgtcactgatgaagatgtgaaggaagtcgaccgcaattttgacaagtaccaaatcccctatgatatcatttggctcgatatcgagtatctcgacgaccgaaagtacttcacttgggatcctctaaccttccctgatcccatcagtatggagaaacagcttgacgagtcggagcgcaagcttgtagtgatcattgatccacatatcaagaagcaagacaagttcgaaatatccaaagagctgaacagcaaaggtttagctaccctgaacaaggacggtaatgtctacgaaggatggtgctggccaggggcttccaactggatcgattgcttcaaccctgcagctatcaaatggtgggtcggcctcttcaagtatgataggttcaagggaacccttcctaatgtgttcatctggaacgatatgaacgagccctctgtgttcaatggtccagaaaccacgatgccgaaggacaacttgcaccacggtaattgggagcaccgtgatgttcacaatgtcaatggtataacctttgtcaacgccacataccaggctatgctggagcgcaagaaaggcgaaatccgacggcctttcatcttgacccgatcgttctacgcgggcgcccagcgcatgtccgctatgtggaccggagataaccaagccacctgggagcacttagcaatctccctaccgatggttctcaataatggaatctacggattcccgttcgctggggccgacgttgggggattctttcacaacccaagcaaggagcttctgactcggtggtatcagaccggcatctggtatccgtttttccgcgctcatgcccacattgacactcgccgtcgtgagccgtacctgatccaggagccattccggtcgatcattacgcaggctatccggctgcgctaccagcttcttcccgcctggtacactgctttccatgaagcttcggttaacggaacaccgatcgtgagaccgcaattttacgttcatccaacagatgaggcgggtttcaccattgacgaccaaatctacctcggctccaccggtattctcgcaaagccagtggtcactgagggcgccacgagtgtggacatatacatcgcggacgacgagaagtactacgactacttcgattacactgtgtaccagggagctggaaagagacattcagttccggcgcctatggaaaaggtacctgtgctaatgcaaggaggtcatattattccacgcaaagaccgaccacgtcgtagcagcggactcatgaagtacgatccttatacgctcgtggtggttctcgacaagaacggacaggcggaaggcacattgtacgttgacgatggtgagacctttgactaccagcgtgggggacacattcaccgccgcttccacttccaagactcctcactcgtttcggaggatatcgcaactcacgggcctcagacggctgcgtacctcaagaccatggccagcgtcagtgttgagaggattgtggtgattgaccctcccaaggaattgcaggataggagcacggtcactgtgattgaagatggagcaaagacatcctcttcagcacaactggagtatcatgctcaggaaggcggcaaagctccgtatgcggtagtgaagaaccccagagtgggtattagcaagacctggcggatcgaattttaagct

SEQ ID NO: 36125 - DNA, 1424 bp, Aspergillus nidulans
  unsure (1)..(1424): unsure at all n locations
gccagcatgcttattatctctaaccggctccccctctcacttcaaaaggtggacggcaagtacgagtcaacgctctccagtggcggcctcgtcaccgcactctcaggcgttagcaagtctaccaacgtgcactggttcgactggccgggctcgaacatcgaggatcccgaggagcgcaagaccgccaacgaggcattggccgagaacaacgcggttgggatctttttagatgaagcgctggcacacagccattataatgtgttttcaagtgtgttttctccctcacactcctccagttctggggaaatgagcagaaatgttaacctgtctagacgggatcgcctggccgatcctccactaccaatccggtgtcgacttcaacgaggacgcatggaaatcatacaagaaagtcaacgaaatcttcgccgactctgtcgccgagtcggcgtccgatggcgatttgatctggatacatgattatcacctccttttgcttccagcgtacttgcgcgaccggctcgagaagcagggcaaaaagtgccccatcggattcacgctgcacacgccgttcccagcagaggacttctggcgcgcgctgccagtgcagaaggagttgctagctggtgtgctagcctgcgacctcatcggcttccacacggacgagtataagcggaattttatcgagtgctgttcgcgcgggttggacgtcagcgtcaaggatgacagtattgtttaccagggccacacagcgcgtacgggcacgttcgtcgtcggcgtcgacccggccaagttcacggatgggctgcagactaccgaggtgaagaaccgcatcaaggaacttgaggatgagtacaagcataagaccgtgatcctgggcgtggatcgactcgattacacgaaaggccttgtgcagaagctgcagggatacgactacttcctacggcagcacccagagctcaagaacaaggtgaggctcatccaggtggccattccgagccgcgaggatgtaaaagaataccaggagttggagagggagctgagtatgcttgtgggcaagattaatggagaacactgtacgtaccgaacctttcctttccctcagaccgtccttcgctgcttgccggagatggtgtactgacagtgatagcgacgcccgacggcaccccaattatctacctgcaccactccgtccccttcactgacctgacggcactctaccgcatcgcggacatctgcctcatcacctctcgacgcgacgggatgaacctggtcgcagcggaatacgttgcctgccagaaagaccggtttggcgtcctcgtgctgtcggaacttgcaggcgcggcctccttcatgagcaagggaagcatcaccttcaacncgtctagtgcgcagcagcttgcagacgcggttacaaggagcgacat

SEQ ID NO: 36126 - DNA, 1800 bp, Aspergillus nidulans
aacccttctgtcgctgccctctatgaagacgctcttgtctacgagactggtactgctatcacatcaagcggtgctctcacagcctactctggcgccaaaactggtcgctctccttcagataagcgaatcgtgaaggaggagtcttcagagaaggaggtctggtggggacccgtcaacaagcctatgaccccggatgtaagtcaagctttctgttttatcccttgcctagccctttcttcgtccatcatgcacaagctgccgtcgactttccctccgagtggttacatttgttgataaatgcctcatgctctattgggttgaggcattttgaaattgtgctacctgaccaactagcctggtttgggtttgtcgttgtcgtgggtcgtctgtcgatctgcatgcaggtgccttgcagggctagtgtgacgtcactatacataggtcccgttactgacagggtttctccaggtctggcgtatcaaccgtgagcgtgctgtcgactacctcaacacccgaaaccgtatctacgtgattgatggtttcgctggctgggatgagcgctaccgtatcagcgtccgtgtcgtctgcgcgcgcgcctaccatgctctcttcatgcgcaacatgcttatccgaccttctgccgaagaacttaagcacttccaccctgactacgtgatctacaacgctggttccttccctgccaaccgcttcactgagggtatgacatctgccacctccgtcgctatcaactttgccgagaaggagatggttatcctcggtactgagtacgccggagagatgaagaagggtgtcttcaccatcctcttctacgagatgcccgtcaagcacaatgtcctgaccttgcactcttctgccaacgagggccagaacggcgacgttactgtcttcttcggtctgtccggaactggcaaaaccaccctctccgccgaccccaagcgtgctttgatcggtgacgacgagcactgctggactgaccgtggtgtcttcaacatcgagggtggctgctacgccaagtgcattggcctctccgccgagaaggagcctgatatcttcaacgccatccgctttggttccgtcctcgagaacgtcgtcttcgaccccatcagccgcgttgttgactacgacgactccaccctcaccgaaaacacccgctgtgcctaccccatcgagtatattgagaacgccaaggttccctgcctctccgacagccacccctcaaacatcatcctcctcacatgcgatgctcgtggtgtactcccccctatctccaagcttaccaccgagcagaccatgttccacttcatctccggttacacctccaagatggccggtaccgaggacggtgtcacagagccccaggctaccttctcttcctgctttgcccagcccttccttgccctgcaccccatgcgctacgcccgcatgctcgcggacaagatctctcagcacaaggccaacgcctggcttctcaacaccggatgggttggcgctggcgccaccaccggcggcaagcgttgcccgctcaagtacactcgtgccatcctcgatgccatccacagcggcgagctcgccaaggctgagtacgagacttacgacgtcttcaaccttcacgtgcccaagagctgccccggtgtgcctgatgagcttctgaaccccaagaacagctggaccgctaccaccagcttctcggacgaggtcaacaagctcgctaagctgtttaacgagaatttccaaaagtacgctgaccaagccaccaaggaagtcatcgcggccggtccc

SEQ ID NO: 36127 - DNA, 1156 bp, Aspergillus nidulans
aactttcgcgcattagactcgattttaattgccaacaggggagaaatcgctctgtatgtgcacgatccacatctctgacctcactaacgacatatagacgagttggtaggactgcggcccagcatggaattcgagtcactacgctctatacggatccagattcccaagcgcagcatgctttgagtacaccatatgcattcaatctcggctccgtgtccgcgtacctcgatggagaccgtatcattgaaatcgcaaaggcccaaggatgccagggaatacaccccggctacggcttcgtatgtataatctgcagtgaagtgagcatgatgctaatggattgttcattgatagcttagtgagaactcagagttcgcacgaaaatgtacagaagcagggctggtctttattggaccgccgtggaaagctatcgaggatatgggagataagaggtgcgtctacttccttgaggcttctctacgatatactaacattgtacttctgcagtcagtctaagcatatcatgactgccgctggagtgccctgtgtccccggctaccacggtgaaaaccaagaccctaatttcctcgaagcggaggccgataaaatcaaatacccagtgctcatcaaagcaatcaagggcggtgggggcaaaggaatgagaatcgctcgttcaaaggaagagtttcaagcgcagcttcagtcggcgaagtcggaggctatgaactcttttggggatgaccatgtcctagtcgagaaatatatcacaacaccgcgacacattgaggtccaagtctttgctgacaaacacggaaattgtgtagcgctgggagagcgagattgcagcatccaacggcgacaccaaaaaatcctggaagagtcaccggctcctcacctgcctgatgccacaagaaaagacatatgggcaaaggctcggtcggccgcgttagccggttcgctacgaaggcgccggtacagttgagtttatcttcgacaacgatacgggagagttcttcttcatggaaatgaatactagacttcaggtggagcatcccgtaaccgagatggtcactgggcaagatttggtgcaatgacagctgaaggtcgcggagggcgccgagcttccattaacgcaggaagaagtggaaaacaatatagc

SEQ ID NO: 36128 - DNA, 1573 bp, Aspergillus nidulans
tcccgtcccatgtatatcgatgccctcagcggagaacagtacacgtacggggatgtcatccaacgcacgcggtccctggcgaacgggctgcaacagctattcggtctcagggaacacgatgtcgtcgctctgttcagccctaatacgatcgactatcccattgcctgccacgctatcatcgggtccctggccgttgtggcccctactagcgcggcacttacggctcaggaactacacgctcagctgaagaccagtcgggcacgattcatcatcgcccactcgtcgcttctttctactgcaagagcagcagcaaagggcacctcgattgagaaagtcatcgtcctcgacggccaatcatctgcacccggccacctcacctgccagcaattagcgagcacctatgcccccaccgcactccgccaaatccctgctcacgaagccgggtcgcgaatcgcattcatctgcttctcctcgggcacatccgggccagcgaaaggcgtgatcaccacccaccgaaatattacatcgaaccttcaacaatggcgcgcccaactcctcgactcaggctccgcagctcagcgggtcgaccgcaccgccgcgattgccttcctccccttcagtcacatttatgggctgaatttatacatgtgccagtgtctaacgtggggcacgcctgtggtgatcctcccgcgtttcgatcttgacacgtacctctcgtgcgttgagaaatacaagccgcaggagctggcgctcgtgcctccaatcgcactcatgctggtcaaggatgatcgaatccgcaattacaatctgcgcagcgtacggcggattctctccgccgccgcaccgctgacaatcgagctctcgtcggcgcttgagacccgatttaaggatatctttggaacggaggtcttctgcacgcagtcgtggggacttaccgagacctcgccaatcgcaactggaatcccgaatgatcgaatggacaagagaggtgccggcgtaggttgtattgtgccaaatatggagtttcgtttcgttgatccggagacgatgctcgacgcggacgtgggcaaggatggagccagccaacccggcgagatctggtgtcgtggaccgaatgttacaccgggatactataataacttggaggcaacgaggggtgcgttccacgtggatgacgatggagtttcgtggtttcgtacgggcgatattggcgttattgacgctgagggatatattaccatacaggatcggatcaaggagatgatcaagtacaagggcttacaggtcatcccgagcgagctggagggtaagcttgttgatcatccggatgtggtagacgtcgctgttattggagtctgggtggacgcaagggcgacagagttgccgactgcgtttgttacgctgcggcagggtattgacgatgaggggagtaggaaaggtcattgaagatattcatctctggttcaacgctagggttgcgaaccataagcggttgcgaggaggcatatatgtggtagagaatatcccaaagagtccgagcgggaaaattctgaggcgggtgttgaagcagcag

SEQ ID NO: 36129 - DNA, 1283 bp, Aspergillus nidulans
ttgggtgattgcttgggtcgtggtgcctttgggtcagtgtatagggcactgaactggaataccggggaaactgtagcggtcaaacagatcaagctcgctgatctccccaagagtgaattgcgggtcatcatggtatgtttgcctacaacttcgcttgctttacgtgctaacaatacatgctacagctggagattgacctcctgaagaatttggatgtatgacactgcctgcttgggaccagtggcccctatagctgcgacatctactgactcaattgacaatagcacccgaatatcgtgaagtaccaggggttcgtgaagtcggccgaaacgttaaacatcattctcgagtacgtcctggatgggataggataggaaattgtacagcagctgacgattcagatattgcgaaaatggttctctacactcaattgccaaaaacttcggccgctttccggaaactttagtgggggtatatatgtcccaagttctccatggtcttctttaccttcacgatcagggcgtcatacacagagatattaagggtgcaaatattcttacaacgaaagagggccttgtcaagcttgcagacttcggtgtggccagtcgtaccaccggactaagcgaatcgagcgttgtcgggactccatactggatggcccctgaagtgattgaattatcaggtgcaactacagcgtctgatatatggagtctgggatgtactgtcattgagctgcttgaaggaaaaccgccgtactataaccttcagccgatgccggctcttttccggattgtcaatgacgatcaccctcccctccctcaaggcgcctcaccagtgagtttgcctcatggccctgcttctgtacgggatggctaatgaatgatcaggcagtcaaagatttcttgatgcagtgttttcagaaagatcccaaccttcgtgtgtccgctcgcaaacttctgaaacacccatggatcgtcaacgctcgaagatctgactccgtagtccctaaaaaatcaaccgaatatgaagaggcggtgaaaagtgtccaggagtggaatgaggctttgcgttcgccggaatcgaatgccctaagaagaggaaccagaaatgaaaatcaaaacccaccgtctttacggcttgacacgcggcatacgccaactaaagttacacttccaagcccagtctccagaattgtcgcggacaaatttagttctcctagctccggagaagaggataactgggacgatgattttgctacggccatctcgccaagtgcactgcag

SEQ ID NO: 36130 - DNA, 1559 bp, Aspergillus nidulans
tatgctcgcccatcaacggcgcgctcctccagtgcgtcggatctaaagggaagcgacaagcgtgccggtatcttcggggggaagaaagatgtgcgacagccagatacagagagcaagccgcatggccatatggcggaactcaagcgattcttcaagatgggccacaagcataagcgcggggaatcacctacgtcgaagaaatccagccgctcatccggaaagaacacgccttatcaaatggcaaccgataacgtcccatttgcggatgatcatggtctcaactccaagtatggtaagcttgggaaggttctgggctcgggcgccggtggctctgttcggctgctaaagcgtaatagcgacggtgtaacatttgccgttaagcagttcagggagcgccattcctgggaaacaatgaaggaatactccaagaaggtgactgctgaattttgcattgggtccactcttcatcacggaaatataatcgaaacactcgatatcattcaagagggaagccactggtacgaggttatggaatatgcgccgtacgacttgtttgcaattgtcatgacgggcaagatgtcgaaagaagaagtcgcctgctctttcaagcagatcctaagtggtgttgcttacctccacggaatgggtttagctcatcgggacttgaaattggacaacgtagtagtcaatgagcatggaatcatgaagctcattgattttggaagtgcagtggttttccgatatccatttgagaacgacatagtgcctgcatcaggtaagtcagtccaacaattccagatgcttgtggaaagcagtactgacttctttcaggaatcgttggctcggatccatatttggcaccagaggtttatgacgagaaaaaatatgatcctcgcccaacagatatctggtctctggctattattttctgctgcatgagcctacgcagattcccatggaagcaaccccgagttagcgataactcttatagactgtttgtttcaacgccaacaccgggcactccggtaccagacgctgatccaagacggcaccgccccgtcaaatctgcgccggatttacatagtgccgccattgaggacaagcctccgcagtacgcggcaaacataagcgaagagccttcgaaaatcatggctacgcccccgcggtcccctgttaagcccacgacaggcaaccaagaggaaaacctccccccggagaccacacaggagaagccaccaacaaaggacaccaactgtgataaggctaatacacagaacaaacccactcggaccaccagcaaagaggcacctccgcttccgcccgggtcggcgcaagcggctggtcaacgtcaggaagtcataaaagggccttggaggctacttcggctccttccccgggaaagccgctacatcattggtcgcatgctcaaagtgagcgtgaaagaccgggcaacgcttgacgacgtgctcacggacgagtgggtccgcaatatcagagcatgtcagcaggaggtgactggagaagtgatcaaagctcctggccatacgcacgtccttgag

SEQ ID NO: 36131 - DNA, 1613 bp, Aspergillus nidulans
cttcacatcggccaggctggcacgcagatgggtaatgcggcctgggaactgtaagtctttattactttgtgatccttctggcagcggctaatcgctcgattactatctagttatctcctcgagcacggcctaacggccgatggtcatgtcaatcccgatatcactacggacatccaccggaacgactcctatgtgacaattttcaccgaacttggcaatggcaaattcgttcctcgctccatctttgtcgacctcgacccttcggtgtgtaacgggcgagtagggagctggaatttgagctgacaggcttatggtggtatagcctatcgacgagatacgcactggtacctaccgccacctgttccaccctgagcagctaataagcgggaaggaggatgccgccaacaactgtctgacctccgaatatttgagagccgcgtggtaagccaagctaatgcgttctagatgctcgtggtcactacaccgtcggcaagacgcttgttcgaggcgttgttgaccgcattcgccgtgtggctggcgtgcattggaacccttccctgagtcctggattatatactaatttccttggagatagctgctcttcacttcaaggttttatgatcttccacgcctttggcggcggtaccggctccggtttcggcgcacttttacttgagcatctctcttcagaatatggcaagatgtccaagctagagtttgccgtctacccatctcctcgcacgtcgactgccgtggtggaaccttacaatgccgtcctatccacgcatagtaccattgagaactcggagtgcactttccttatggacaatgaagctgtttacgatatctgtaagcgcaagcttgacatcccccgccctggttataataacctcaaccgtctcaacgcccgggtcgttagctctcttaccaccagcctgcgtttcaatggtgaccttaacattgacttgaatgagttccagactaatcttgtgccattcccgcgtattcactaccctctaatcttgtatgctcctgttatctctagtagctgcagtacttacaagagcttcaaggtcaaggatcttaccttgcagtgtatgtgtcctgtcttttcttctaaaatatcccttcagtctaactgtctggcaggctttgaacctaggaaccagatagtcatctgcaatcctcaaactagaaagtatatagcagtagctctcttgtaccagggtgatgtaatgcctcataattgcgcccgggctattactgatatcaaggccaaggcctcttttaacctggtcaagtggtgtccaactggttttaaacttggcattaacaaccagaagcctatgtttgttcctaacagcaagcttgcttctattaactgtttagtcaccatgctctctaatttgaccgccattgctgaggcctggagtcgccttggccacaaattcaaccttatatactctaaacatgctttcatttattagtacgtgggtgagggtatggaagagggcgaattctcggaggcccgcaagaacctagcagttctagagaaggactacgaggagatcaccggcgatactgtgggcttggatggctatgtagaacatgag

SEQ ID NO: 36132 - DNA, 1506 bp, Aspergillus nidulans
cgcggtctttcgtcgcgccatgtgcagttgatggctattggtggctcccattgggaccggcttgtttgtgggaatcggcgcgtatcttcgcgatgcaggtcccctctcgctgttgctaggatatctgatctgggggatcgcgttcatccttcccatcaacctcagcgtcggcgagatgtgcgcctacctgcccatccgagggtcgatctttgagctggcggcgcgatacgtcgacccggcgtttggattcgccatgtaaggtccctctgctttccgggtccaaggaacacgctctgataacatccgtctaggggatgggtttacttctacgccgggctgatgcttgtctgcaccgaatactccgccgtcgccttcatcatggactactggcagatcgacgttaacccagcggcctgggttgccatggccatggtcatctgcctagcgctcaacctcgtcgccgtcaaatactacggcgaagctgaattcattatggcctcgaccaaaatcctgctcctcctcggcctcatcttcctcaccttcatcaccatggtcggcggcaaccctaaacgcgacgtctacggcttccgccactggactgacggcgtcatgtacgaatactacacagacggcgccaccgggcgcttccttggctttttctcggtcatggtctacgcggccttcaccatcgctgggccagacttacccgcgctcgccgctggagagatccagcacccacgccgcaccatcccgcgcgtcgtgaaaatgaccttctggcgcatcgtcggcttctatgtcgtcggcgtgctcggtgtcggcattatctgcgactcccacgattcgcgactcatgtctgcgatcgactcgggcgcgtccgggtctgccgcttcgccgtgggtgatcggtatcgagaacctgggcatcaccggcttgcccgatcttatcaacgtgctgatcctgttctcgggctggtcctgcggaaacgcctacctgtacagctccagccgcacgctgtattcgctcgcgcgcgacggccaggcgcccaagttcctgaccaaatgcaccaaggacggcgtccccgtttactgtgtgatcgtcgtcacgctgctgtcgtgcgtcactttcctggtagccgacaatgcctccatcagcgtcttctactggtttgtcgccttgaccactatcgggctggtcctcacctacaccagcatggcctgtaccttccttggctggtaccgcgccctgcgtgcccagggtatcgatcgcaaaagctacttgccctggatctcgccgttccagccatacatggctatcttggcggtgattctcggtttcagcacggcgctgtttaacgggtatgccgtgttcaagccatttaatgctcagggtttcgtcacctcgtactttggactggcgttttttgtcgtcatgtttgtgttctggaaggtgttgaaacgcaccaagtgggttgatcctacaacgaaagatctctacacgggtaaggca

SEQ ID NO: 36133 - DNA, 1359 bp, Aspergillus nidulans
atctcaatccaaacgaaaatgactgactctagcaacgtgtcgaatctaccaaccacggacatggctgaatcggctcagaccgagggggagaagagggaagagaattctgtgcccaagcaagaggagtcgcgccccaactttccagagggtggtctcagagcttggagtgtggcgttgggcaatgctggcgtcatgttctgcactttaggctatatcaactcctgggggtacgtgaagcgttgtccatagctgctcaaaactaatgtctgcagtgtctaccaggcctattatgaagcaaaccagctccgcagcgaaaccccatcggccatttcctggattggctctctccagacgttctctatcctcagcgcctctctcgttggggggcctatgtttgaccgatacggcgcaaaagtcatctaccccccagccgttgcattcgtgttcaccatattcatgacgagtctgtgcaaggaatactaccagtttatgctagcccagggcgtacttggcggtgtcactcaaggcctcactatgacgccggccatggcagcaacgccgcagtatttcttcaaaaagcgcggtgtggcaatgggcttaggagtcgccggcgcttctgttggcggcgttatacaccctattgtattgaatcaattgcttactcgaactgaccttggctttggatggtccgttcgcatagaagcctttttgatttctgtggttctgttgatttcgtgccctgcgattcgggcccgcttgccaccgcgcaagagcaagtttcttcttccaaaggcgttcaaggaagcagggtacacatcgcttatcatcggctctgtctccacgttcatggggatgttcactccgcttttctaccttccgtcttacggtatctcgaaggggatgtcaccaacactggcattctatctcagcgccattctcaacgccgcctctttcccaggccgtatcgtgcccgcaattctctctgatcggttcggcaagctcaacgcctttgccgcagccggagtagccacaggtatactcacactatgttggcagcgtgtggagggcaatgccggggttatcgtcttcaccgcgctctttggctttgtttcgggggcgatcatatcaggtggtacagtcgccctggccatgtgtgccaaggatccgaaagatatagggacctacatgggaatgggaatggcatggacctcgcttgtaagtttgatagggccacctgtcagtggtcgcttggtggacactgatatggggtacacggcagtggcaatattcgctggtacggcgtctctagttggaggcttgttcgtgctgcttattgtgaagccgttgagtgggttcaag

SEQ ID NO: 36134 - DNA, 1547 bp, Aspergillus nidulans
ctccctccccttcctatcccagaactcagagccatcattaatagacatctctcctatctgcgagcctttgcaacggaccaagagttccaggaaacagttcgattcgcgtcagacttccagacgccaggtagtattggaagacgtctatacgaccgcttgcaagttatgaaggcagccaatccagatacatggtatcacgatttatacctccaaaaccaatacctcgttcgcaatggtcccctcgccccctatatgaccttcttcttcacgcacccggttaatatcggaagacactcgcaagcggaacgggcagccctcattgcgtcaacggttatccggtataagttttgcctggaaaacggccagatccaaccccgacttgtcaacgagcagccgcagtgcatggacctatacaagtatatgtttaatacggtccgtgagcccacgctgggtgtagatcttatgagtcggtatcccggaaacgattactttgtggtcttgcggcgtgggcatgtctacaaggtcgagtttgattcgtcagcacaacatgcccaatatgagaggctggagagaatcttccagaccatcctcgacacgcggatagacgaggtcgactggcttggagtcctaactacagcggatcgtatttcatgggcaaaggtatactttcttctcgcaccgattatttgtaaatgcaagacagctgataacgaaggcagactcggcatgaatttatgcaccttagtgaggagaacgcatcgtatattcgaaccatcgagcaatccgcgtttgttgtctgtttggacgatggctctcccgagacaccagaagagcgaggtcgccatttccatttcttagacggctccaatcgctggcatgacaaaccgattgagttcatcatcgcggccaacggggcctctggtgttctaggcgaccatactgggcttgatgcaggcactgtccatgagctgaacaccgagattgcggaggcaatccgtcgccaccaggacagacgaacgctgtctaacggaacttcttgcgaagttacggtacacccggttcgatattcagcaatctctcccggaatcgaggctcgtatacacgagacgcgctctatatatacggccgccatctccagccgagagcatcgatacacgacgtggaccgggtacggctcgtcgctgatgaaggcatataagatcccagccaacagtgcattccagcttgtggtccaactggcagggcgatactacttcggacagacctctccgtgctgggagacagtgctccagtccaacttccacacgggccgggtagaaattaaccaagtagtcacggcgcaggttgcggcgttcgtggacgccgctgcagaggccgttccactgtcggattgcagacagctactccttgaggcggctcgagcccattcgagcgctgtgctggcttgcacgcgagcgggcggatcggatcgatttctctccatgatgcgagaaattgttgaggccgacgagcaggagccggagccgtatcatgacccagtctataag

SEQ ID NO: 36135 - DNA, 1063 bp, Aspergillus nidulans
gcccacggccacacctgccttggacaaaagtctatagcctggcggttccctctagcgttgcagattctcttcgcgtggatcctcttcttcggcatgttcctatttcccttctctccacgctggcttatgtccaagcaccgcgaggaagaggctgttgttgcgctatcgaaactacgaagacttgaccccaatgatcccctcatcaaagcagaggtgctggaaattaaagccgctgtcatgttcgatgaagagagtgatcgtgaagctgttcagaggggtggtaaactggcgccatggaaggcgctttttgcgccgaatatgttcaagaggctggtgttgggctgcggtatgtcctctgccttctctttatttctgacggacgctgacgctggccgtgaagggatgatgatctgccagcaattcaccggtatcaacgccgttctgtactacgcccctcagatattcgcctcctttggcttttcctcgtcgaagcagacccttctcgctactggagttaccggtatcctacaaatcgtcttcaccatgccggccgttctcttccttgacaagttcggccggaagaccttcctgatcgtcggtgctgctgggatgttctgctgccacatcgtggtcgctaccgtcgagggcctgtatgaggatgactgggctctgaatgagggtctatacaaggcgcagggatgggtggccattgcgttcatctggctgtttgctgtcaactttgcgtactcttggggtatgcatcctctcacctcactccttcctcccttcattatgcattagtgctaacgttgccgtaacgcccgtcgcttgggttctcgcgcaagagatcttccccaacagcgctcgttcccgaggtgtctcgatcgtcgcatccaccaactggatgttcaactttgtgattggcctgacaacgaaggacatgctaaacagcatgaagtatggcacgtacattttcttcgcgatcttcagtgctcttggcggcgcgtttatttggtggtttgcgccggagacgaaggacaagacgctcgaggagctggatatt

SEQ ID NO: 36136 - DNA, 2174 bp, Aspergillus nidulans
ttccttttgaattcaaacgggatggacatcaagattgacaaaaactctgataatatccagttcctggaatataatatcctggggggcgttctagacttttatttctttgctgggccaagtccgaaagacgtgagcgtgcagtatgcggaggttgcaggcttaccagccatggttccatactggggtcttggagtatgtctaccggccaggaaactatacatggtgtcaatcactgacttttcagtttcatcaatgccgttacggttacagagatatcttcgaagtcgctgcggtagtacataactatagcgacgttgaattcccctcgaaacaatgtggaccgatatcgactacatggatcaccgcaaagtttttacactcgatcgagagcgattcccattggatactgtccgagctttggtgcaatatcttcaccagcgagaccaacattatattgttatggttgatcccgcggtagctcactctgagaacggcgctttcacacgagggctagagaaggatgtgttcatgcggaagcaagatggaacgctatatcaaggtactttctcagcctaggcttaacaattagctacgtatctaaacctaatggtataaaggcgctgtctggcccggtgcgacagtttttcccgactggttccatccaaacacttcagactattggatcaacgaattcgcgttgttcttcaatgcagaatcaggagttgacatcgatgccctgtggatcgacatgaacgaggccgctaacttttgtgactggccctgtacagaccctgtcgcctatgcggaggagaataacctccctccggagccgccagctgtcaggccaaatccgagcagccttccagggtttccggctgagtttcagcctgtaaacagcaataacaataacagtagcagaaaacgcgagacgcaagttgttattgcagccaggcaaggatttgtcaaagtcggaaacgacaatggcaatggcaggaggctgggtctgcagggccgcgaactgatcgatccgccctacaagatcgccaacgcagctgggtcgctgagcaataagactatgaatacagacattttccatgccaatgggcttgctgagtatgatactcacaatctatacgggacaagtatgcctttttgtcctctcatttccggagtatatgttaatcaggcacagtgatgagttcgctttcacgagacgccatgctctacagacgcccagagaaacggcccctagtgataacgcgcagcacctttgccggtgcaggctcctacgtcggtcactggtaggaggcattccaatccaactgtcctgaaccagactattgactgcgcgcaggctcggcgacaacgctagcacctggaccaaataccgcatctccatcgcccaaatgctcgccttcgcatccatattccagatccccatggtcggttctgacgcatgtggttttacaggcaatacgactgaggagctgtgctcgcgctgggcaaccctggccgcttttaaccccttctttcgcaatcacaatgagtacgggatggtctcacaagagttttacaggtggaactctgttgccgaggcagcaaggaaggcaataagcatccgatacagtttgcttgactatctttacacggagttccatgaacagacggtcacgggcgagccgtttttgctcccacttttctttgtctatccaaatgaccccaatgtggtgggtattgactcacagttcttctatggggatgcgattcttgtcagtcctgttattgaagaaggtaagacggaggttcatgcttatttcccgggtgatttgttctatgattggtacacaggtcttcctcttcgtggaaatggtgaggtgataacattgacggacattgggtacactgacatcccgttacatgtacgtggtgggaaaattgtgcctgtacggaccgggtctgcggggatgaatacgacgactgaggtgaggaagagcgggtttcggttggtcattgccccaggactcgatggtagggctgcaggccgcctgtacattgatgatggggaatcgttggagcagactgccatggtggatgtggtctttacctatgaggacggtagggtgagcgttgatggcgtgtttacgctacagactgatctacgtgttgaggctgtg

SEQ ID NO: 36137 - DNA, 1602 bp, Aspergillus nidulans
gacctcgagcaagcccgcatcgcaacggcccaagaacacagcctgagcttcacagagggcctgcgcacgtaccgaaaggccgtgatgtggtcgatgctcttctcattagcaataataatggaagggtatgacacgacccttctacagtccttttttgcgtttcccgagttcgtgcgcaagtacgggtcccccatctatacctccacctccaacgcatcctcaagtccagggccgggagaagaggtggaaacccacgaactctccgccgcctggcaaagtgccctcacaaacggtgcgtatattggtgaaatactcggtctgttcatcacgggccttgttatcgaaaagacggggtatagacggctcatgttcgcatcggccctctcccttggagggtttattttcatcctggtcttcgcacccgatctcccaacattgctggtcggtgaaattctttgcggcattccctggggtgtatttcaaactgtgacaacagcgtatgcggcagatgtatgtcccgtacttttgagggggtacctgacaacgtacgtcaatctgtgttgggtgcttgggcagtttgtggcgacgggggtgttgcgggcttgcctgcatataggtccagtccaggatgcgggacaaggtgacgaatggagttatcgcatcccgttcatgatacaatgggtatggctgccgtttattttggtcattgtgtgggttgggccggagagtccgtggtggctagtgaggaagggaaagttgagtgaggctaaaagcgttctcgaaaggctttctgcctccaccctttcttcatcctgcacacccggcaggctttggaacgaggccaaacagaaaccacccttgccctgatgctatacaccatccagatggaaaacgaatatgtttctcaatctcatgagtcctacctttcctgcttccactctacgaaccgccgccgcacggaaatcacctgtctgacctgggcaatccaggccctctgtggctcctcgttcatgggctattcgacttacttctaccagcaggcaggtctatccgtatcgcagtccttcaatatgtcgctaggccagtacgcgtttgggatcgtcggaacactcgtctcgtggttgttaatgactcggtttggacggcgcaccctctacgtcgtcggtcttctccttctggtcatcatacttttctctgtgggttttacctctttgtctgatacgaagacagcgagctgggctattggctctttattactactgtttacatttacgtacgattgcactatcgggcccggtatgttatagtattgtctccgagatcccttcgacgcagctccgaggaaagacaatcgtactggcaagaaatgtatataacatgttcatgatcgtgaatgggattattgtcccgaggatgttgaaccctacggcctgggactggagaggactcgccgggttcttctggggtgggattacactggtattgctttgttggtcttatttcagactgcctgagagtaagggaaggacgtttgcggagatggatattctgttcgaaaggagagtgaatgcgagacggttcagaaaggagaaggtttgtttc

SEQ ID NO: 36138 - DNA, 667 bp, Aspergillus nidulans
atggccggcttcgacttctccaactacaaccgcaacgcggctcttcacgccaagggagcaccgcttccaaaagctacgagcacaggtacaacaattgttggctgtatattcgacaatggtgttgtggtgagtttgtttgggtaatggtggcatcatagttgatggggttgaccatcagcacagatcgccgcagataccagagcgacctctggccccatagtagcagacaaggtaagctagcgggctcatattttagtatagaagggattaattcaatattttcctttctacagaattgcgagaagttacactacatcgcacccaagatctggtgcgctggtgctggtacagctgctgataccgagttcaccaccgccctgatcagctccaacatcgaactacactctctgtcgaccggccggcccccacgagtgatcacttgcatgaccatgctaaagcaacaccttttccgctaccaggggtacattggtgcctacttggtcgttgctggtgtcgacccaaccgggtatcggcctctacactgttcacgcgcacggatcgacagacaagctcccctacgtgacaatgggatcaggatcgctagccgcaatgtctgtcttcgagtcgacgtggaagccgaatctgaacaaagaggaagccatcgcct

SEQ ID NO: 36139 - DNA, 884 bp, Aspergillus nidulans
gtcgtccgcgagaaagtccaagatggactaacaggggaaacgaaagaaatacaatattcgcaatgtaaaattgtcggtaatgggtcgttcggagttgtcttccagacaaaaatgatgcccagcggcgaggatgctgccatcaagcgggttctccaggacaagcgtttcaaggtatgtgcccattgttggagctcaccgtcgtgctcgcccggccactccccgctgacgctgagcagaatcgtgaattgcaaatcatgaggattgtgcgccatcctaacattgtcgagctgaaggctttctactattcgaatggcgaaagggtatgctccccaattaacagtgtttagctgcatgtcagtgctaacccgtgtatggtatcgccgcaaaaggaccaaagtgtacctgaatcttgtcttagaatatgtaccggaaactgtttatcgggcgtctcgctacttcaacaagttgaagacaaccatgccgatgttggaagtcaagctttacatctaccagctattccgttcgctggcatatatccattcacaaggaatctgtcaccgcgacatcaagccccagaaccttcttctcgaccccgctactggtatcctgaaactttgcgatttcggatccgccaagattttggtcgagaatgagcctaacgtatcatacatttgctcgcgttactaccgagccccagaattgatatttggtgctacgaattacacaaccaagatcggtaaacatccacggcaccttggattttcatggacaagctgacatttatagacgtatggtctactggctgtgtgatggccgagctgatgctcgggcaacctctcttccctggagagtctggaattgatccctttagtgagggttaattc

SEQ ID NO: 36140 - DNA, 1286 bp, Aspergillus nidulans
agacagcgtcgccctttcttctatctttccggatgcctgcttccggactcgtccctagtctacaatattgattctgaccaattaaccctattcattcctccaatcaacccagatgacgtgatttggtctggtctgccgttgtcagcagctgaagctctcgagcgatatgacgtcgataacgtcctggagacgacagaagtcaatgctaccttagcgaacattgctgcgtcgcatgcaaacaatagcactgcttttgctatcgcagagcaagtgtccgaaggtacaaaattcgagggcttctccgaaacgaacttcaacgtcctgaaaggagtgattgagaggactcgcgtcgtcaaagacagctacgagatcgctcttctcaggaaggcgaatgatatctctgcaaagggccacatcgcagctatcaaggcatcaaagtctgccaccaacgagcgcgaaattgaagccgcgttcattgcaacctgtatcgctaatggagctcgcgagcaatcctatcatccaattgttgcgtgcggccagaatggggccactcttcactatgggaagaacgacgaggacttaatcgatccggtgaccaaccggagaaaggacaacgtcctgatcgatgccggtgcagagtaccgcacttactgtgcagatattacccgtgcatttcctctcaatggcaaattcctaccagaaacccgccagatctatgaaatagttctgcggatgcaactggagtgcattgatatgctcaaggagggtgttcagtgggaggatgtccatgcgcacgcacaccgcgtggccattaggggcctgctcgaactgggcattctgcgcggctccgaggacgagttattcgacaagcgaatcagcgtggcttttttcccgcacggcctgggccattaccttggaatggacacacatgataccggcggcaacccgaactacgaagacacagatactatgttcaggtatcttcgggtacggggacggctgccggctgggtcagtcatcactgtcgagcctggtgtaagattccatacccgtcgtttttttatctctgttgctgattatctcccgtgcagatctacttctgccgtttcattattgaaccattcctcaagaaccctgatctgcagaagtatattgacgtgggtactctgaatcggtactggcgtgtcggtggagttcgtatcgaggacaatgttcatatcaccaaggatggccatgataatttaaccacagcacccaagactattgaggaggtagagagcctagct

SEQ ID NO: 36141 - DNA, 1645 bp, Aspergillus nidulans
ggatccttcctgttcgcgtacgatacgggcattattggcggaatccttactctggactcgttcaagcagtcgtttcgatactcagaggcagagcgggcagatatcgcttcaaactctaccagtcttctgcaggccggaggcatgtccttgtctcgactcccaggcagttctggcagcttgctgaccttgtgtcctcgatctagctttcttttcctgctttttcgcctggccgttcaccaaaaagtttggtcgccgatggtcgatcgcgctcgcctctttgatcttctgtatcggcgggatcatccaggtggctccaacgcactcgattggcgcgttttatgctgctcgtgtgatcagcggtgtcggtgtcggcatggccaccgtgatggtgcccatgtacaggtaatcctctgctgccttatattgatcttgaactaagctgacatcccgtcgtggacagcgcggaaatgagccctaaagagatccgaggacagttgggcagtctgttccagttcttcttcacgctcggcgtcatgacctcgtactggatcgactacgccgtcgaaaaatacgtcgcatcctctgatcgccagtggcagatccctatcggactgcaactcgtgccggcggggatcctgggcctcggcatgctgtttctcaaggagagtgtgcgatggctcgccagtgtcggtcgacatgatgaggcgctgcaatccctgatctgggtccgtggaggagaagacacagaggaagtccgcactgaaatggcagagatcctagacggcatcagcgccgaagtggctgcaactgagggcgtcacctggaaagagctgaatcttccagccaaccggttcaggattttcatcgcgataagcatccagatcggtacgtctccttgttagatagcgactctcaattgggtctatgctgacaactgcagccgcgcaatgcactggaaacacctcgctggcatactgtacgcttgctcatctaaaacatgtctgcgtcctggactgaccgtagcagatgcgcctcagatcttcggtgccgttggaacgagcgagaacgacacgctcctgatcacagggttcttcggtgttgtcaaagttgtagcatgcgggaccttcgtccttttcctagttgaacggattggccgtaaatggtctctagcccttggcgccttcatgatgggagcactcatgcttatcgtcgcgatcctcgcgaaggtgttcacgccagattcaaccgctactgaaatatcgtctcctaccgctgcatcgattgcgatgatctatctggaggcggcctcgtataacatgtcctgggtatgctaacagccagagccagtccgtactggaccgccagcacagcaagctaacaattcgactagggccccgtaccatggctttacatgagcgagatcttcccaacgcgaattcgggagatcggtattgccgttggaacagctacgcagtggttgttcaactttgtgttctcgcaggcgacaccgcatgccgtgaataacatgggctggcggacgttcctgatgttctgtatcttcaactgggcaatcgtggtctacgtctttctgttcatcagggagacgactggcaagtccttggaggagatggaagatggtacgtat

SEQ ID NO: 36142 - DNA, 1363 bp, Aspergillus nidulans
atgccgggatcaaaatatgccattaaagatcctttctcctaccataccggcctcaattcataccatgagtacgcccccccagctcaacaacctatggcttttctaacatgggcgaccagatcaacagccatcgaagacgccctaccccgcccgcaaagtctcccccaacggcacggcttaggcctctaccctgaacgtatcagcggcacatccttcaccgcaaagcgcgccgtgaacaaacagacattcctctaccgcatcctcccatcgactgcacagtcctcgtggaacaggctctcggaccatccgctgaaccatcgctcgcattcagcagagctcaactttgtaccagaccaactcatatggcctcctgcccaagtacaggaggacaagacattccttgatggactacagatgataggaggtgcaggggacccaacggtcaaaaatggcgtggcgtattatgtctacacctgtggtctcagcatggacgagaaacaggccttctactccgcagatggggacatgcttatcgttgcccagacggggatccttgatatccagaccgaaatgggtgatatacgagtgcgcccccgtgagatctgtgttgttcccaggggtatcagattccgagtttctttgcccaaggggccgtctaggggtcatgttattgaggcgtactccgggcatttcgacctccctgagctagggcctatcgggtctctgggcctggcaaatgtgagggatttcgagattccacgcgcgagatacgtagatacggaagagattacagaggtcatcgcaaagtttggaggtggggtctacagcgcagagatgaaggggagtgcgtttaatgctgttgcatggcatgggacgtattatccattcaaatatgacctaggtaagtcctcccagcgtcccaataacaagttcgagagactcaatagctgcgtctaccaggaaaattcatgcctatgggctcaacgctctacgaccaccaggtccgtcttccctttagcagttctttgtccagcccaaataaccgccgcaggacccatcaatctacgtagtcctcacctgcccctccgacaagcccgatcatgcagccgtcgacttccttgtcctcgggccccgctggatggttatggaagacacattccaaatcccgtatttccatcgcaacaccatgtccgaattttcctccgtaatcagcgggggatttgacctctcgcgcgtgccgacgccgatgtacggaatgagcgggctgcacaacgtcctcagtccgcatgggctgtcggcgccggagacagaaaatgcaataaagaaggtgctgaggccggagcgagtgccggatgatacgatg

SEQ ID NO: 36143 - DNA, 1644 bp, Aspergillus nidulans
gccgaaaacttgacaaaaaagcatgcagaatttggcccactgggtgatccatcccatctttataccagtgtggtctttggaggtgaaataccagacccggtggtcgatgagcctccatacttcatcatcttgacaacctatatcagtttccttgttcttatatttcttggccacttccaggactttgtctccagatggttccagccgcatacatacctgcgccttaggtcccaaaatggatatgcttctttgtacaacggtttcgagagcttcttttctcggcgtatgaagcaacgcatcaatgattgcttcgaacgacctaccactggagttcccggcaggcatgttgttctacttgaccggatctcaaaagacaatattcattttgaacttaccggtaaagcaacagacacgcttaatctgagctcatacaactatctggggtttgcgcaatcggaaggaccctgtgccgacacagtggaagagaccatttaccgagatggaataagtatggcggggccatatccaggaactacaaaactacttgtcgaggtggaggatcagatctcccggttggttggcaaggacgcggcaatcgtgttctcgattggctttgtgacgaattcgactgtttttcaagcgcttgtccagcgtgaatgtttgatcctgtcagacgaattcaatcatgcctctattcgattcggtgctaggctttcaggagcagccatagaggtctttgcacacaataatatgacgagtctcgatgagaagctgaggcaggccatttcccaaggccagccgcgaacacatcgaccgtggaagaagatcatggtcaccgttgaaggactatactcgatggaaggaacgatgtgcaaccttccacaaattctggagctcaagaaaaaatataaattttatctcttcattgacgaggcgcattcgattggagcaatcggcagtcgaggacgtggagtatgtgattacttcaaagttgaccctgctgatgttgacattttaatgggcacgttcaccaagtcattcggtgccaccggtggctatgtcgctgcgaaccagccgatcattgacaagctacgctgcaccaatgccggccaagcgtacagcgaagctccaacactcccagtacttgcccaaatttcttcttcacttcgattgatcgcagacgaggaccctctttacccgggtcagggtcttgagcgaatgcaacgcctgacattcaactcgaggtatctcaggctaggtttgaaaagacttggattcattgtttacggccatgatgactctccaatcgtgcccctaatgctgtatcatccggctaagatgccagccttctcaagagaaatgctgcgacgcaaaatctcggtggtcgttgttacctatcccgctacgccgttggaactttcccgtgcacgattgtgtgtatctgcagcgcataccaaggacgatctcgaccgcgtcttggaagcctgcgacgaagttggagaagcactacaactaaagttctcctctgggaaagctggtggattgaaacagccaagaccatgcgtgacgatatcaccagataaaattactgagcctccacgctggacattgacagagatcataaaatggggagttcgagatgcg

SEQ ID NO: 36144 - DNA, 948 bp, Aspergillus nidulans
cttataactggaacatcctccggcttcggccacgaatttgtaacccagctgctatcccgcggcgataaggttatcgccacagcgcggattctgtctagaatctctgacctgaagcagctgggacctgatgtggtgaccttagagctggacgttacagcgtcgcagcgagagttgaatgacaaggctgcggaggcgattcaggtctttggcaaagtcgatgtgctcgtcaataacgcgggatttgttaagtttgggttcttagaggatctgaggttcgtctatgcgtcctatccttccttatatatgagagatgctaagcccagacagtgaagatgattatataaagcaattcaaaccaaacgtcttcggccccatcaacgtagcccgggcatttctgcctcactttcggtcccagaggagcggaactatcgtgaatatcggatcgatgtccgcgtgggagacgtatcccggagtggggccttactctgcctctaaggcagctttgcgttgtatgttttcatctctccagttcgtcattttttgtaatcattattaaggttagatacagatgccaccgaggccttgtcgcaagaacttggtccaaccgggataaaaaccctccttgtcgaaccaggccagtttcgcactgagctcttgggtccatcgaacagtgtgtttgttgagacgaagatccccgagtatcaagacgcagcgaatgcgtcgttcggggcgtttcggagtgcccatagtagacagaggggggatccggtgaagggggtggcaaggattattgatgtggtgaaaggggagggagaagctgctggaagagaatggccaggggagttggtcctaggacaggatgcaattagggttatcaaaaagaagtgtgacgggatgttgagattgttgagtgattgggaaggcttttctagttctactgatgtctga

SEQ ID NO: 36145 - DNA, 950 bp, Aspergillus nidulans
cagattactatcatcactgctgcgcttaacacagagtccaaattcgccaagttctatcgagaagggcatcaacaaggcagactagggggagcctacctttgacgacgccatctcgcttctcgcaaagattccccgtgtcgcggcgctcgtcttccgccccaacgagatcgatgtcgttggccgccagaaactcgacccggcccaggactggtcctacaacttcgccgagctcctcggtaagggcggtgcgaacaacgccgacttccacgacctcctccgtctttacctcgctctccacggcgaccacgagggcggcaacgtttccgcccacgcaacccatcttgtcagttctgctctttccgacccgttcctcagttactccgccggtctgctcggtctagccgggcccctgcacggtctcgcagcccaggaagtgcttcgctggatcctagcgatgcaggagaaaattggcaccaaattcaccgacgaggacgtccgcgcgtacctctgggacacgcttaagtctggccgtgttgttcctggatacggtcacggtgtgctccgcaagccggatccccgcttccaggccctcatggacttcgccgccacgaggaaggatgtcctcgccaacccggtcttccagctcgtcaagaagaactcagagattgcccctggagtgctcactgagcatggaaaggtaccgtatcgtccctatcacaagacgcttcagctaatattgtgcttagaccaagaacccccaccccaacgtcgacgccgcctcaggcgtgctcttctaccactacggattccagcagccgctctactatactgtgacattcggtgtgtcgcgtgctctgggtcccctcgtgcagctgatctgggaccgcgcgcttggcctccccattgagcggccgaagagcatcaacctgctcggcctgaaaaagtaactg

SEQ ID NO: 36146 - DNA, 1396 bp, Aspergillus nidulans
aagcgggctggtcttgccagtgagcgggtcttggtgttgggcgcaacgaacccgggcggcgcggcgacgacaactgtccagtttatgagctctgtaccctcggagcctgttgggcctgttcatatcgagcctgatgatattgcattcttggtttactcgtctggaactacggggcttcctaaaggtggagacatcctattagatacagttcctgaggctgtcctggtgatcgactactgaccgttgccatccaggtgtcatggtttcgcaccggaacgttgtcgcagctgtcgtgctccaggcggcgatagagagcccccatgtccactggaagaaggaccggacattggccgtcctcccgacgtatcacatatacggtacgagcccatctggaccaagtcgcacaagtactgatcccctaggcctgatctgcctcgtacacctgccggtctggctcggcacaacaacggtcttcatggacaagtttgacctgcagagattctgcaagctcatccgggaacactccatcgcgcacgcctatgtagccccgccaattgtcctccatctagcaaagaatccctctatcgataaacgagatctatcttcgctacgtatgctcacttccggcggagcacctctcggcgaagccctcattcgagaaacctacgaccgctggaaggttcccatccgacaggcgtacgggctctctgagacaacctccgtctcacacatccaggttagcccgtccatccgagccccctgcctcgcccagtctgaatctattatatactgactccaccagcgctgggacagttggaacacggccatcggctccaacggcgccgtcctcccgggccttgaagccaggatcgttctcaacaacgacccgtccaagaaggccgccgtcaaagaagaagaaggcgagctctggatccgcggtccgacagttttcaccggatacatgaacgaccgcgcctccacagacgcctgcttgactgcaagcaagtggttcaagaccggcgatattgggtacgaagacgcgatggggaatctgcacatcaccgaccgcgccaaggacatgatcaaatttaagggattccagattgcaccgacggagctggaggatatcctaattgagcatccggctgttcgagacgttgctgtgattggggtctggaatggggagatgcactcagaagtaccgttggcttacctggtagcaaaggagagtatggcggagcgggagcgcgagactgcggcgctgtcggttatggcgtacctgagagggaaggtggtgcattataagcacctgcgagggggcgtgatctggatcgaccagatcccaaagagcgcgtccgggaaaatactcaagagggcattgagagatcgtgttggg

SEQ ID NO: 36147 - DNA, 1497 bp, Aspergillus nidulans
ccggggccgaaaccggccctgttgattgggaatattcaccagctccctaagagcctccagtggctgcatctataccacttgagcaaggaatatggaccaatcatgcacttcagcatggccggtcagcccctcattatcctgtcgacgcatcaagtcgcgcacgatctgctcaaccggcggagtggacgctactctgatcggccgcgcatggtcatggccggtgagctggtgacgaagaatatgcacatgctgcttcggccctatgacgagcgatacaagctacaccagcgcatggaagcccctctcctggtgctccgctcggcgagcaactaccgccctctccaggatctcgagtcgcagcagctgctattcgatgtgctgggagagtgggataagtttggcgagaagggtgtcgacttccaccaccatttcgagcgagccatggcgagtaccatctactgcctcaactacgggtaccgattacagacaggctatgagaaagagctcatggacggcaagaaggtgcaggccgagttcgcccggacgggccaggtcggcgcgtaccttgtcgactcgtttccttcactgaactacctgccgaaattcctcgcgccctggaagaaggagggcgaggggctgtacgagctggagcgacagttgcacgtcgggaacctcaagaaagggttgagtaaccgcggctggaacttcaccaagtatatgaaggactctcccgaagctgtcactatgcccgaggaagagctcgcgttcgacctgggcattctcgcggatgcaggtttggatacttcgaccgttgcgctagactggtttattgtcgcttggatcacctcgggctcgacgtgggtgaagaaggcacagcagcttctcgacgaggtcgtcggcaaggatcgaatgcctacctttgaggatcgtccgaagctagcatatatcgatgccattggtatgcttcctttgtcatttccatggaaccaacagtatcttactgacaatacagcgagcgaaaccctccgctggcgccccgttgttgtatccggcgtcccccacttcacaaaggtccaagatgaatatatgggctaccatatcccagcgaactccaccgtcctccccaacgcctttgccatctcccatgacgagtcaatctttggcgaagacgtagattcctttatccctgagcgctggctcgccgaggatccaccgtccgaaccctcgatcgacgcctgcggcttcaacacttccgcccttaaggatctcccgcacatcggcttcggttggggacgtcgcatctgcacaggtcgcttcattgcgcgcaatcagctatttatccagatggcgcgtatgctctgggcgtttgacgtcgacgccggggttgtcgatgagaagacggggaggaggcacaatgttgacgatatggattgtaccgaagggttcgttacgcttccgaagccgtttagggctgttatgcggcccagaggggagtgg

SEQ ID NO: 36148 - DNA, 1691 bp, Aspergillus nidulans
tggaacgagaacctgattatgagctattgccccgcggacggacgagtacttggttccggaatcaagcctgcgacagcggatgatgttgatcgcgcgatacaagcggcgagcagagcgcaggaacaatgggctaccactacctttgcggaaaggcggcgggtgctgaagactctactcaagtgcgttccaactttcctatcatgaacttacggattgggagaattgaccttgataggtacgtgctggaacatcaagatgagatcgtgatcgcctgctgcttggattcagggaaaaccaaggtcgatgcaacatttggggagacgctcgtcactgcagagaaactgaaatggacgatcgatcacggtgaaagggcgctgagcccggagtcgcgacccacgaatttccttatgatgtacaagaagaaccaagtcatctacgagcccctgggtgttgtgtcggcttgtgtctcttggaattatccgtttcataactttatttcgccggtgatcagcgccatcttcgccggtaacggaattgttgtaaagccatctgagcagactgcctggtcttctgtatacttcctcaacatcatcaggggcgctctagaaaactgtggccatccccgtgatctcgttcagagcgttgtctgtctgcctaaggtcgccgaccatttaacctcgcaccctggaattgcccagatcacattcatcggctcgcgtccggtggcgcacaaagtatgcgagtctgcagcaaaggcattgacaccagtaacagtcgaactcggtgggaaagatccctctgtcatcctcgatgacagcagaactatcagcgaagtaacctctgtcgcatctgtcctcatgcgcggcgttttccaatccgccggtcaaaactgcatccgcgttgagcgcgtcattgccctccctggcgtatacgacaaactccttgacaccgtcacctcccgcattaaagccctccgcctcggttcagtcttactagacacaaagcccaacaacccaaacaacaagtcaggtgccccagacgtgggggccatgatctccccggcctctttctcccgcttggagtttctcattcagcgcgccgtcagccaaggtgctcgcctcgtcgctggtgggaaacaattcgaacacccaacctatccgctcggtcactatttcacaccgaccctccttgcagacgtcacgccctccatggaaattgcccaaacagagctcttcgcccccgtcttcctcatgatgcgtgcatcttccgtctccgacgcaatcaccatcgcaaattctacccaatacgcgctaggtgcctcggtatttggctacaacacgcgcgacgtgaatgcttgtgtctcaggaataaaggcaggcatggtctctgttaacgattttggcagctactacacagtacagctgccattcggcggcgtcaagggatctgggtatggccggtttgcgggcgaagaaggtctgcggggcgtaagtaatatcaaagcgatttgcgttgacaggttcccgcgccttatggcgacgaggattccgccgcgcgtggattatccgattatgaagggagaagcggagaaagagaatggggatggtgcatttgagatgtgcaagggggttgttgagacggggtatcagatcacgctggctgggagggtcagaggtattctgaggttgatt

SEQ ID NO: 36149 - DNA, 834 bp, Aspergillus nidulans
tcttctagtaccattgagaactcggagtgcactttccttatggacaatgaggctgtttacgatatctgtaagcgcaagcttgacatcccccgccctggttataataacctcaaccgtctcaacgcctgggtcggtagctctcttaccaccagcctgcatttcaatagtgaccttaacattgacttgaatgagttccagactaatcttgtgccattcccgtgtatttactaccctctaatcttgtatactcctgtcatctctagtagctgcagtacttacaagagcttcaaggtcaaggatctcaccttgcagtgtatgtatcctgtcttttcttccaaaatatcccttcagtctaaccatctggcaggctttgaacctaggaaccagatggttgtctataatcctcaaactggaaagtatatagcagtggctctcttgtaccagggtgacatgatgcctcacaattatgcccgggctgttactgatatcaaggccaaggcctcttttaacctggtcaagtggtgtccaactggttttaaacttggcattaacaaccagaagcctatatttgttcctaacagcaagcttacttctatcaactgttcagtcaccatactctccaattcaactgccattgccgaggcctggagttgccttggccacaaattcgacctcatgtactctaaacatgctttcatttattagtacatgggtgagggtatggaagagggcaaattctcagaggcccgcgagaacctagcagttctagagaaggactacgaggagattgccggcgatactatgggcttggatagctatatagaacacgagtat

SEQ ID NO: 36150 - DNA, 727 bp, Aspergillus nidulans
atggcgtctagaaaaaccgtcctgatcaccggttgcagcgatgacggcattggctctggtcttgctttgacctttcagcagcgagactaccatgtctttgcaacggctcgcaatatccagaagatgagcaagctccacggccttcctaacgttaccctgctcactctggatgtctgcaacaaggaccatatcactgcagcagtggaagctgttaccaaacatactggcggcaagcttgactacctggtcaacaatgccgacgcaatcacttcatgccgatcctcgatgaggatatcgaggttaccaagaagctctacgaaactaacgtctgggggccggtcgccttgacccaggcttttgccccattactgatcgcagctcgcggcacaatcgcctttattacatcaatagcgggctacctcaatgttccctacatgggtacgtcgtcgcttatctatattgcttgaaaattattggaagggaccatgtctctcaccgtgggtaagggttggaagctgactctcgcatgatatcaggcacgtacgccggctccaaacgctccatcgaactcatcgctgaaaccctccgtctcgaactggcgcctttccacgttcgcgtcctatcggtcgtcaccggcgcggtcaagacaatgggacagacgtacttcggtgactttaagctccctgaggattcgctttacaaacctatcgaacagacaatcgctagc

SEQ ID NO: 36151 - DNA, 2743 bp, Aspergillus nidulans
cgaaatccctatgttgctggagcaccgccggtggtcgacttggctggtgaaaaggtacagcaggctttcgaagaacttctggaaaactatcaggaggaagctccaccaaagtcatcacacaccccgcagtcatcagcgccaatgaccaacaaatactacatcgcgcaaatccacggcatggcgaaatgggaactgtcgacattgtatgtggactttacacacctcacctcgctagacaaccctattcttgcggatcaatcgcgaatcagtactatcgatttcagccattcctcgtgaaggctctccataacctgatcgcgaagtacgagcccgaatactttgtctcgcaccgtcaagccactagcagagttatcgtcacaagctggcacgtctttaatggcgggcaactctagcgtggccgacgaccctaagctagatcggacgatccgtgagaagacacggcaccagcagacagataagctgtttgccctggcgttttacaacctgcctctggtctctagacttcgacagcttcgaacatcgcaaattggaaaactgctgtctgtgtctggcacagttacccgcacgtccgaaattcgacctgagctttccctcggaactttcatttgtgaggcttgcagaaccgtcatcacgaacgtagagcagacattccgttacaccgagcccacgagatgcccgaataccctctgtggaaccagagtcgggtggcgtctggacattggcaaaagtacgtttgtagattggcagaaggtgaaactgcaggagtcctcacatgaaattccaaccggcagcatgccccggactatggatgtgatattgcgcggtgagatggtcgaccgtgtcaaggctggtgaacggtgcatcttcaccggtacgcttattgttattcccgacgtcagtcagctaggactgccgggtgttcgccccgaggccgttcgtgacaatagcggtttccgcagcaatgatgttggaggtggaggagtcagtggcctcaaggcgcttggtgtgcgggatctcacctaccgcctggctttcctgacttgtatggttactcctgatacaacgacccccggccagcaatccaaccagcaactgagcggccagtccaatcgaatcctcggctcgctaaaccaaaaccccgatcctgagcccgacgacgacaaggcacaggaggcatttcttcagagtctgagtccggcagaagtcgaggacctaaagaccatggttcactccgaatacatttattctcgtctagtagactctatggcgccgatgatttacggccaccgacagattaagaagggtttgcttctgcagctcgtaggaggagtggctaagtcgacagaacaagaaagcctgcagctccgtggtgacatcaatatttgcatcgttggtgatccatcaactagcaagagtcaattcctcaagtaagttacttgcttattaaaatgttccttgctgactagtcagatacatttgctctcttcacccccgcgccgtctacacaagcggcaaagcttcatccgctgccggtttaaccgcatcggttgtcaaagacgcggagacgggcgagttcaccatcgaggccggagctctcatgctggcgaacggtggtggtatttgcgccattgacgaattcgacaaaatggacatcagcgaccaagtggccatccacgaagcaatggaacagcaaacgatctccatcgctaaagcaggcattcacacaaccctcaatgcccgtgcctctattctcgccgccgcgaaccccatcggcggccgctacaaccctaagaccaccctccgtggcaacctgaacttcagcgcacctatcatgtcccgattcgatttgttcttcgtcatacgcgacgagcctaacgaggacgtcgaccgcaatctggcggatcatattgtcaacgtgcacatgaaccgcgacgcgccagtcgagccggaattcagcactgagcagctgcaacggtatatccgttttgcgcggacattccgccccgtcttccgggaggaagccaaggctgtgcttgttgagaagtacaaagagcttcgcgcgaacgatgcacaaggggggatgggacggtcatcataccgtatcacagtccgtcaattggagtctttgatacgtctctctgaggccatcgcaaaggtcaactgcgttgaggagattgtccccaagtttgtgcgagaagcctacgatctcctccgccagagtatcgtcacggtcgagaaggacgatgtcgaagtggaggacgatgaaggcgccgccaacgcagatgaggacatgcccgaccgcgaccgagacggcgacagcccgatgcgcgaggagccccagtcggccgccgcagctgagcccgttgaaccacgcgccaagacaaagattacctatgacaaatacatgaagattctgaacctggttgtgcgccggattcgcgaagacgaggcccaagcgggcgagggtgtcgagcaggaagacttacttgtctggtacctcgagcagattgaggccgagctgaacaatgaggaggatctgcagcgggagcgcagccttgctgttaaagtcctcaagcgcatggttaaagataacattctcatgccgattcgtggggagggccttgttgatgaggcttctgaggtgcagactgacaggacgatctatgtgctgcatcctaattgtgcgattgatgaggaatagtcgtcgtatgatgaaatggca

SEQ ID NO: 36152 - DNA, 1748 bp, Aspergillus nidulans
cgtttgcagttggtggtgctcgtttgctttttgctaattatccttcaacgcgtcgtcaatgtcctcgttcctcttcaagttgggataatcaccaacaaattatctaaacagggtgacgaattccgcgtgccatggtttgagatctgcttatacattctgtttcggtggcttcagggcaaccaggggctcattgggtctctccgttccaccctctggatccctgttagccagtattcgtacatggagctttcaaccgctgcttttgagcatgtccatggtctcagcttggacttccatcttgggaagaagacaggtgaagttctctcggcccttagtaagggtagctccatcaacacctttttggagcaagttaccttccaggttgttccaatgctagtcgatttatgtgtcgccattgtctatttccttgttgcgctagacgcgtattatgctcttgtcgtcaccattgtgactttctgttatctttacgtgactattcgtatggctcagtggagagcggagattcggcgacagatggttaattcatctcgtcaagaagatgcggtgaagtgagttaaacagcctaattctcttcatctttttggatttactcatataacgcttttaggaatgactcgatggtctcttatgagacggtgaaatatttcaacgcggaagagtatgagtttggacgatatcgaggcgcagtatccgacttccaaagggccgaataccacgttcttttctcgctgaacctgatgaacacttcgcagaacaccatttttatgctcggccttctgatcgcctgctttattgccgcttatcaagtctcgctcggacaacgggatgtaggtcagtttgtttcgcttctcacgtatatggcccaattgcagggcccgctcaactttttcggaacattctatcgttccattcagtcagccctgatcaattcggagcgcttgctggaattgttcagggaacagcctacggttgtcgaccgacccaacgcccgaccattggcggtttgcaagggagacatcaaatttgacaatgttgaattctcctacgacgcccgtaagccggcgttgaacggccttacattccactgcgagcccggcaccacaactgctctggtcggtgaatccggtggaggaaagtcgactgttttccgtctgctcttccgattctacaattctgaaagaggccgaattctggtcgacgggcatgatgtggaaagtatcaccattgactccctccgaagacatattggagtggtgccgcaggacacagttctctttaatgagactctgatgtataacctgaaatatgccaacccaagtgctacagacgaagacgtctatgaggcatgtcgggcatctagtatccatgataaaatcatgtcattcccggatggctacaacaccaaagttggtgagcgtggtctgcgactcagtggtggggagaaacagcgagtggcaattgctcggacgatccttaagaacccgcgaattattctcctggacgaagccactgcggcacttgacactgagaccgaagagcacatccagggtgctctgtctacgctatcccgtggccgcacgatgctcgtcattgcacaccgactgagtaccatcacgacggcggaccgcatcctggtcctgagcgagggcaaggttacagaaagcggaacacatgatcaactgcttgcaatgaagggtcggtatgcaagcatgtggcgcaaacaaata

SEQ ID NO: 36153 - DNA, 1436 bp, Aspergillus nidulans
gccttgaaaaagcgcaagatcacggagaagcagccagagactaatagcgattctgaagccgagtccgtcagctctcgcggatctgccaaggatgaaacgcaaacctccggcgaagagccagctccagcaaagtccttcaaagagttaggaatcattgaccaactatgcgaggcttgcgagaacatgggctacaaggcaccgactccgattcaatcacaggcgattccgcttgcccttgagggccgtgatgtgattggcctcgcggaaacaggaagtggaaagacagccgctttcgccctcccaatgcttcaaggtatgttcgttatgatccatacaatgactttggctgacaagttgtagctcttatggaggcgcctcaaacactctttggtctcgttctagcccccacccgagaactcgcataccagatatctcaagcttttgaaacgctcgggtcaacaatcggagttcgctgcgccgtcatcgtcggcggcatggacatggtagcgcaatccatcgcccttggcaaaaaacctcatattatagtcgcaaccccaggtcgattactagatcatctagagaacacaaagggcttctccctccgaaatctcaagtatctcgccatcgacgaagccgacagacttttggacatggactttggtgaatccctcgacaagatcattcgaatcctcccccgcacccgccacacctaccttttctccgcgacaatgagcaccaaagtcgaatccctccagcgtgcctctctttccaaccccgtccgcgtctctgtttccagcaaataccaaaccgtctcaacccttcaatcatcctatatctgtattccccacaagcacaagaatctctacctcgtctacctcctcaacgaatttgcgggtcagtccgcaatcatcttcacgacaactgttcacgaaactcagcgtgtcgcgtttatgctccgcgccttgggctttggcgccatccccctccacggccaattgtcccaatctgctcgtcttggtgccctaggcaagttccgctctcgcagtcgcgatattctcgttgccactgatgtcgctgctcgaggtcttgatatcccgtccgttgacgtcgtctttaactttgacctccccatggacagcaagacatatattcatcgtgttggacgtactgcacgtgcagggaagagtggagtagcaattagcttcgtcacacagtatgacgttgaagtttggcttcgtatcgagcatgcgctgtccaaaaaactgccggagtatcaggttgagaaggacgaggtcatggtcatgtcagagcgggttgcggaggcttcacggcaggctactattgagatgaagagctttgacgaaaagaagggggctagagggaagaagtttggcaaggggaagcgctcaagagatgatatggatcaggaagagggt

SEQ ID NO: 36154 - DNA, 875 bp, Aspergillus nidulans
cgctccctcgccggcaaatgtgccatcgtcaccggcgccggctgtgctggtgatggaattggaaacgggcgcgcaattgccatttttctagccagtgatggatgcaatgttctctgcgttgataagaatctagaatgggctgagaagacagtttcgataattcaagagcactctcgatcgtcgtcgcaatatggccaagcagtatcgttccaagcagacgtcacctgcgagaccgattgctcctccatcatttcccaagcaatatcgacgttcaaacgggtagatatattgatcaacaacgtcggtatcgccggggcaccgggaacagcagtcactgttgacatggaatcatggagcaaaagcctcgaggtcaatgtcaactcgatggtgctgatggcgaaacacgccatcccagccatgcaaaagaacagcggcgaaataaaagggagtattgtgaacatggggtccgttgccggactaaaaggagggacaccccatctcctgtatccgacgagtaagggcgccgttgtgaatatgactcgtgccatggcggcgcatcatgcagaagatggaatacgggttaattgtgtttgcccgggagtatgtcccctcttcctgttatcatcttgcgctttacatagggttagggctgatttaatcgggtatagatgctttacacgcccatgatgtacgcgtccggtaacgggatgagcgaagaagcacgtgaagcccgtcggagacgcagtctgctaggaacagagggcaatggatgggattgcgcaacagcggtggtcttcctcgctggacctcatgcgcggtggattaccggtgcgattcttcctgtgtacgcagggacgacgcggtccgttgggatt

SEQ ID NO: 36155 - DNA, 681 bp, Aspergillus nidulans
gagctagagaatgctgttaccctgattgatccccaacgagactccctctacagatacgacgaggaaacccacaaataccttagtgatacccgtccatggaccaaagaccctcactattttaaatcagttcggatctccgccgtcgctctcctgaaaatggtcatgcacgcccgctccggcggttcgctcgaagtcatgggtctgatgcaaggctatatcctccccaacacattcgtcgtaacagacgccttccgcctccccgtggagggcacagagactcgagttaacgcgcaagacgaagcaaacgagtatatggtctcatatctccagtcgtgtcgggaagcagggaggatggaaaacgcagtggggtggtaccacagtcaccctggctacgggtgctggctttcgggcattgacgtttctacgcaggatatgcagcaaatgagcgggccatttgttgctgttgtcattgatcccgaacgtacgatctctgcgggaaaggtagacatcggtgcgttcaggacgttccctaaggactataccccccccaaggaggagcaagaagaagacgaataccagaccgtaccgcttaacaaagccgaggactttggagcacacgcttcccattactactcacttgaggtgtcactttttaaaagcgcccttgatactgagattctc

SEQ ID NO: 36156 - DNA, 1502 bp, Aspergillus nidulans
tcagtgctcgcagcacgtacagacgcctggaagacaagatccgtctatcaaaccatgactgacagattcgcccgcacggatggatcaaccactcattcctgcaatctcacagaagggctttattgtggtggaacatggagagggacgatagatcacctcgactatatccaaggcatgggcttcgatgctgttctgatctccccaatcatcaagaacgttgaaaagaaagccaaatatggggaagcataccacggctactgggcccaggacatgtactctctcaacccacattttggcacacatgaagatcttctggacttgagccaagcacttcataacagtggaatgttcattatgatggatactgtcataaataacatggcttataccatgaacggcggcaacccagcaccagacgttaactacacttctcttaatccctttaatgagaaaagcttctaccatccttactgcaagatcgacgactggaacgactacccgcaatcgcagtactgctggacaggggataacatcgttgcgctcccggatctaaacacggaggacgaacgggtccagaccatactggagatgtggattcaggagatgatagcaacctactccatcgatgggctccgtatagatgcagcaaagcatgtcacaccagattttattgggaaatttgaaaaggcagctgatgtctttatgttcggagaggtctatgagcgatctgtcgacataatctgcgggtatcaaagcaatatcatgcccagcgtcactaactacccgatctacttcgctcttctcgacgccttcaccataggcgacacagaatcccttcccaatcaagtcgaaagcatgaagagcaaatgcccgagcgtgacgagtttaaccattttttctgaaaaccatgatctgccccgattcgcaagcttgaaggatgacataaatgtaagtcgccttaaaccttctgcgtcgcccattagactcaataatttcagctcgcgaaaaatatcctaacattcaccctcctcttcgacggccttcccattatttaccaagggcaagagcagcacttctccggctcaacagaccctcacaatcgcgaagccctttggccctctgcgtacgacacctcctccccactttacaacacgattcacacgctgaacacaatccgcaaacacgccatccagatcgaccctgactactacataaattacaacacataccctgtctaccgcggatcctctgaaatggccttccgcaagggccgtgagggcaggcagattatcatggttctctcaacgcaggggagcaatagcggggcttacacgatccgcatgatgaatggattccagccaagtgttgtcgcgagggatgtatttagttgtcggacttggacagtgaatgatatgggggaactgaggcttgatatggataaaggggagccgagagtgttgtttccggaggcgttaatgagagggagtgggctttgtgggtat

SEQ ID NO: 36157 - DNA, 510 bp, Aspergillus nidulans
ccgcctttaatggcactgtttgaccccgaggatcacaacagacgcttcgtgggtacaccggattatctggcaccagagacaatcaacggtgttggtcaggacgaaatgagtgattggtggtctttggggtgtatcatgttcgaatttcttttcggctatccttcttttcaatgcggccaccccggacgaagttttcgagaacatacttcatcgaagaatcaactggcccggcgaagttgaggaactggcatcacctgaagccattgacctcatgaacaagctcatggctattaacccccgggagcggataggcgcgaacctggaagagaaatatcccaatggtggagcagaaattcggagtcatccttggtttgctgacatccattgggataccctcttagaagataaggctcaattcgtccccaacctggaaaaccccgaagatacggaatactttgatgcccggggtgcacactccaggcttttactgaagaagacgagagttctctc

SEQ ID NO: 36158 - DNA, 1422 bp, Aspergillus nidulans
tttcaggaaatgtctgacttccttgaacgttacggtgaactccagtccgatggttcatattccttcagccacgtccggtccggtctgattgtcagtcttctgtctatcggaacgcttattggtgctctctgtggtgctcctctcgctgataagctgggccggaaatggtccatcactgtctggtgtattatcctcatggtcggaatcattgttcagatttccgccccttccggtaactgggtccaaatcgtcatgggccgctggaccactggtcttggtgtcggcggatgctcccctggttgttcccatgtaccaaggagagagtgcccccaagcacgtccgtggtgccatgatcagttcctaccagctgttcgtcacgcttggtatcttcctagcatactgtatcaaccttggaacggagagcttggatggtagtgcccaatggcgtatcactctaggtctgaccttcctgttcgcactcatccttggtctcggcatggccatgtttcctgaaagccctcgcttcaactaccgtcacggcaagattgacactgcccgtacgactatggcccgtctttatggtgtcccagagaaccacgtcgtcatcgtccgcgagctggctgaaatccaatcgcagctcgacgctgaaaaggagcagtcccagaaatggaacgaattcatcaccgccccacgcatgctgtaccgtattcttctgggtattgttctccaagctctgcagcagctcactggcgccaactacttcttctactatggtaccaccatcttccagggtgccggtatctccaactctttcatcactcaggtcattctcggagctatcaattttggaaccacctttggtggtctctacgttgttgagaactttggtcgccgcaagtccctcattgctggtgcttccttgatgttcatctgcttcatgatcttcgcctccatcggacactttatgctcgacgttgagcaccctgagaacacccccggacccggcaagggcatggttgtcgtcgcctctttcttcgttctcttctacgctacgacctggggtcccatcgtctggtccatcgttgctgagctcttcccctccaaataccgtgccaagggtatggctctcgccactgcttccaactggctttggaacttcctcattgggtatgtctataaatatcttcttatacgtaccgtactaacagttgccttagtttcttcactcccttcatcaccggagccatcgatttcgcgtacggctacgtcttcgcgggctgtctcctcgtcgctgtcttcgtggtctacttcttcgttattgagggtaaagaccgaactctcgaggagctcgactggatgtacgtcaaccacgtcaaaccctgggagagcagcaagtacgagatcccgcggatcacctaccac

SEQ ID NO: 36159 - DNA, 1312 bp, Aspergillus nidulans
gcaagcactcctggttcttacgctgagactgtcaacaaccttcgcatcaatgccgataccaaggttcttttccagggcttcactggaaaacaaggaacgtacgtagctcctccccggactcttgattgataaatggatctgatgctgatatgcgccaatagttttcacgctgagcaggcgatcgcctacggtacatattgccatttcccttgcagctgtttcgcgcactgcgtcgttttggatcggacactcacgcattctaggtactaaggttgttggcggtaccaaccccaagaaggccggctctacacatctagacctcccagttttcgccaatgtcagcgaggctgtcaaggagactggtgccactgcttcggccatttttgtcccgtatgctatgataagctccaaacttctgccagaaagtcggcgctgatgcttggaatttagtcctcctctcgctgctaagggtattgaggaggccattgaggctgaggtgcctttggttgtctggtaagcttcgcctgacttgagaaactaatttacatgttactgaatgttccggtatcttacagtatcactgagggtattccccagcacggtatgagagagcaaccacgattcgcacgtattgctcacatttatactaactgagccagacatggtccgtatcaccgatatcctgaaaacccagaacaagactcgtcttgttgggcctaactgtcctggtatcattgctcccgtaagtatctcttagtgctcgtccagtgctgacggcagcttctaacgtggcattaacatatagggtcaatgcaaaattggtatcatgcctggtttcattcacaagcggggccgtgttggtattgtttctcgttccggtactctcacatacgaggccgtgaaccagaccactcaggctggactcggtcagtccctcgttgtcggtattggtggtgaccccttctctggcaccaacttcatcgattgcctgcgtatcttcctcgaggatgaggagactgatggtatcatcatgatcggtgaaatcggtggtagtgccgaagaggatgctgccgagttcttcaaggccaacaacaagcacaacaagcctgctgttggtttcattgctggtatcagtgctccaccgggccgccgtatgggccacgccggtgccatcgtcagcggcggcaagggaggtgctgactctaagatctctgctctggagagcgctggtgttgttgttgagcgcagcccggcttcccttggcaagtctctgcttgccgaattcgtgaagagagaccttgtctaattctga

SEQ ID NO: 36160 - DNA, 1239 bp, Aspergillus nidulans
tacttcaaccagacccatgccgcgctccgtgcggaggtgcgggaatgggttgagaaggagatcgaaccatatgtgacggagtgggatgaggccaaggaggttcctgccaagatctacaagcaaatgggcgagcgcgggtatctcgcaggtctactcggtgtcaagtaccccacgcaatacaccccgcaccgggtgcagtcggttgcgcctgagaactgggatctcttccacgagatgcttctaacagatgagctttcccgtgctggcagtggtggtctggtttggaacctgatcggcggctatggcattggatgtcccccgctggtgaagtatggtaagaaggcacttgtggaccgcatcctgcctggtattctcgcaggtgacaagcgcatctgtcttgctattactgagcccgatgctggtagcgatgttgccaaccttacctgcgaacggaacgtctctgaagatggcaagcattatatcgtcaatggcgagaagaagtggattacgaacggtgtctggtctgattacttcacgactgcggttcgtactggcggccctggaatgaacggaatttcagtacttttgattgagagagaagctggtggtgtcagcactcggcgcatggactgccagggtgtctggagcagcggtaccacgtacgtcacgttcgaggacgttaaggttcccgtggagaacctcattggcaaggagaaccagggatttaagggtaagtcaagtcagccctatttcgtcgtcgcatcagtattgacggaatatctagttatcatgaccaacttcaaccacgagcgaattggtatcattatccagtgtctccgcttctcccgcgtctgctacgaggaatccatgaaatacgcccacaagcgcaggacattcggccagaagctcgtcaaccaccctgtcatccgtatgaagctggcccacatggcccgccagattgaagccagctacaactggctcgagaacatcatattccagtgccagtcgatggaagagaccgaggcgatgctcaagcttggcggtgccattgccggtctcaaggcccagtcgacgacgactttcgagtactgcgcgcgcgaagccagtcagatctttggaggcttgagttatagccgtggtggacaaggtggtaagatcgagagattgtaccgtgatgtgcgtgcgtatgctatccctggtggaagtgaggaaatcatgttggatctgagcatgcggcag

SEQ ID NO: 36161 - DNA, 1195 bp, Aspergillus nidulans
atggtgcagcagatgccgcctcagggaggctcaaggaagatttcctttaacgtctcagatcaatatgagattcaagacgtcattggtgaaggcgcctatggtgttgtttggtgagaataacggtgtaaaccatgccggttatttactgatttttcccagctctgctatccacaagccctctggccagaaggtagccatcaagaagatcaccccctttgaccattcgatgttttgcctgcgaaccctacgagagatgaagctgctccgctacttcaaccatgagaatatcatctccattttggacatccagaggccgcgaaactatgagagtttcaacgaagtctacctcattcaggtaaattgcactagtgcggcgcacatctgagagccggctgattgattggtactgaaggaattgatggaaacagatatgcaccgggttatccgcacgcaagacctgtcagatgaccactgccagtactttatttaccaaactttgcgtgcgctgaaggccatgcactccgctaacgtcctccaccgtgatctcaaaccatcgaaccttctcctcaatgcaaattgtgacctgaaggtctgcgactttggtctagctcgatctgcggcttcgactgacgataattctggtttcatgacggaatacgtggcgacgcgctggtaccgtgcacctgaaatcatgttgacgttcaaggaatacacaaaggcaattgatgtgtggagtgtgggctgcattcttgcagagatgctgagcgggaagcccttgttccctggaaaggactgtaggtactctattggtggttggtggagaaatgcgggctaacgcatggcagatcaccatcaattgactctaattctggatgttcttggaacacctaccatggaagactactacggaatcaagtcccgacgggctcgggagtacatccgttctctcaaaatcaagaagaagattccgttcaaggcactgttccctaagagcaacgacctagctctggatctgctagagaagcttttggccttcaacccgacgaagcgaatcaccgtggaggaggctctgcgtcacccgtacctggaaccatatcatgatccagatgacgagccaacagcgcccccaatcccggaaggcttctttgacttcgacaagaataaggatgctctcagcaaagagcagttgaaaagt

SEQ ID NO: 36162 - DNA, 943 bp, Aspergillus nidulans
ctcttgttaaaaaccaaatccaccccgcatgacggctacgacgaattcttctccgctgctcacaccaaaccaaccttcatcccagtcctgagccataatttccacactcagaacctctccagcataaagcacttattcgagaacggtagtctcgcaccaggccgagaccgacaatatggcgggttgatattcacctctcagcgcgcggtcgaggcgtttggggagacgctgagtggtgttgagggtatgtttcctacagcacactaccgctcacttgaatacttggtgtagagctgacggcaatatagaatcatacttgatttcatcttcgcgaaacctccccctctacaccgtcggccccgcaacggcacgctccttaacgacattgagagacagatatctcccgcacgcaacgattcacggcgcggagacgggaaatggggagaatcttgcgcagttcatgctcgagcactataacgctttgttcttccaacaagaggggcagcaagcacagaagaagccgttactcttcctcgttggcgagacaagacgcgatatcattccaaaaacgctaatgggtgctagtgtgaatccagagaggaggattggtgttgaggaggttgttgtgtatgagacgggcgtagtggagggatttgagggggatttcgaacgggtattgcaggattgttataatgatattgaggatgggatgatatgggttgttgttttttcccctacagggtgtgacgctatggtcagggttttgagacagaaagaggcgaggattgcaggagagaatgggaaaggagcccggaaattgttcgtggcgacaatcgggccaacgacgagagaccatttggtgaaagaatatgggtttgagccggatgtgtgtgcggcgaagccttcgcctgaaggggtgggggcagggatagaagagtttatg

SEQ ID NO: 36163 - DNA, 1100 bp, Aspergillus nidulans
atgtcgaagccagtaatcctacaccttggcgaccccataaaatataacccagccctatactccaccttcagctcccacttcaccatcgttcgcccatcactctctgaactacgccgtgatgaattcaagacggcgctacgcgagaaccgcttcggctcattccacgccctctttcgccctttctggaacacgggtggcgaaatgggccgctgggacaaagagctcatcgacctgctcccgaaatcagtgaagattttcgcctctgccggggccgggttcgactgggttgatacacagtatttggctgaaaagggtacgtccccagttccctaccctgtactttgctcgttcgtgagacggagaggagatgtgttagagtatctgatattgacgaagataggtatcctgtattgcaacggcgccgcgcgtcctccgagtccgtagccgatatggccctcttccttattctggcctcgtttcgaaaccttgcttggagtcatagtgcagcagtatcgcaaaatccgcgggcgttcttggacgcacatcagaattctccactgacagcgcggaaccctagaggccacagtttaggtatcattgggatgggtcagatcgggttcatgattgcgaagaaggtgtacgcggcatttgggatgcagatcctctatcacgatattgtgcgcaagtcccaggacatagagaggagcgtgaatgcgacgttcttcgagagtctggatgatatgctggctgagtcagactgtgttattgttgcgacgccgtttgccgggaagacgctgctgacggctgaactgttcgacaagttcaagcggggttcgcggtttgtgaatattgcgcggggctctctagttgatgagggggccctggtaggggcgttggagagtggcattctgatgggcgtaggtatggatgtgcatgcggacgagccgaatgtgcatccaaggcttgcgagccatccgaaagtcatgatgatgagccataatgctggtggtacagtggacacgcacattgggtttgaaaggctggcgatggagaatatactggctttttttaaggaagggagggctatgacgccggtgaat

SEQ ID NO: 36164 - DNA, 1655 bp, Aspergillus nidulans
atggcttcccggcgcctagcgtacaacttcaaccagggctctcgcagtcgcgccgccctgaagtccatccagcccgtcaagcgtggctttgcttctcccgtcgctctcccgtccaccactcagtccaccaccctctccaacggtttcacggtacgacgacgcattggctcttgagattgtgtcctggctttgctaacgactatagatcgccactgaatactcgccgtgggcccagacatcgaccgtcggcgtctggatcgatgccggtagccgagcagagactgacaagaccaacggaaccgcgcacttcctggagcaccttgccttcaaggtgtgtttcctaaaaacccacaattaaatgatggctaacaggtcatagggcactagcaagcgctcgcagcatcagctggagctcgagattgagaacatgggtgctcacctcaacgcctacacatcggtacgctcggattgatggaacgatcgatggttttgcgtcattgcaaactaacaatgcttttagagggaaaatactgtctactacgccaagtctttcaacaacgatgtccccaaggccgtcgatatcctcgccgatattctgcagaactccaagctcgagtccgctgccattgagcgtgagagggacgtgatcctccgtgagcaggaggaggttgacaagcagctcgaggaagttgtcttcgaccaccttcacgctaccgcttaccagcaccagccccttggccgcaccatcctcggccccaaggagaacattcagaccatcacccgcgacaacctgaccgactacatcaagaccaactacactgctgaccgcatggtcctcgttggtgctggtggtatcccccacgagcagctcgtcaagctcgctgagcagcactttggctcgctcccaagcaagcccccaacctccgcccttgccgccctcaccgctgagcagaagcgccagcctgagttcattggatccgagatccgtatccgtgatgatactcttcccactgctcacatcgctcttgccgtcgagggtgtcagctggaaggacgacgactacttcactgcccttgttgcccaggccatcgtcggcaactgggaccgtgccatgggcaactctccctaccttggcagcaagctcagctccttcgttgagcgcaacaaccttgccaacagcttcatgagcttctccaccagctacagcgacactgggtaagcaccttgtcccgctttattggctctttcactaattttgcagtctctggggtatctacctcgtctccgagaacatgaccggtcttgacgaccttatccactttgccctccgcgagtggtctcgtctgtcctttaacgtcaccgcggccgaggttgagcgcgccaaggcccagctcaaggcttccatcctcctctccctcgacggtaccaccgccattgctgaagacattggtcgccagatcatcaccaccggacgccgtctctcccctgaggacatcgagcgcacgattggccagatcaccgagaaggacgtgatggactttgccaaccgcaagctgtgggatcaggatatcgccatgagcgccgtcggcagcatcgagggtatcctcgattataaccgtatccgatcggacatgagccgaaacgcctactaaacg

SEQ ID NO: 36165 - DNA, 1053 bp, Aspergillus nidulans
gtgattggatactgggagggctggagtactcagcgcagctgtgggacaatgtctgctggcgagatccctgtcaatctgcttacgcatctcaacatcgcattcggttacattaacagtgctttccaaatcacaaacatggacggtctgtccgccgatgtgtacaaacaggtcggcaacctcaagtcacgcaatccaagtctcaaaatcatgatcgccctaggcggctggacgttcagcgaccccggtccgtggcaggccatattccctacactagcgtccaccgcagcgaaccgagccacttttattcagaacctgcttgggttcatgtccgagtacggctacgatggggttgacttcgactgggagtaccctggcgccgatgatcgtggtggttcggactcgatggtcgatggagagaattacactcttctgctcaaggagctgcaggaggccatcactgcaagtggacggaactaccttgtcacttttactgcaccaacgtcatactggtatcttcgccacttcgacctcaaagccatgatggagtacgtggactgggtgaatctcatgtcgtatgacctgcacggcacttgggacagcgaaaaccccatcggcaatcaaatcctcgcccacactaacctgacggaaattgacctcgcccttgatctattttggcgcgtggatgtggacccatcgtccatagtgctaggcattggcttctatggacgaaccttccagctatcatcgggctcctgctggaagccgggctgtccatttgatggccctggagcagggggtcggtgcacagcgacgcccggtatcctgtcctacatggagattatggagctcttggagaattccggcgcaacggcacacttggacgaggaggcggctgtccagtatcttgtctatgcggacaatagctgggtctcctacgatgatgcaaccaccttcgcggcaaagattgactacgcgaagagaattggtctctccggcctgatgatctgggctatcgacctcgacgacagctacctcactgcactacgatccatt

SEQ ID NO: 36166 - DNA, 937 bp, Aspergillus nidulans
cgtccgaaaacgttagatgatgtcgctgcgcaggaccacacgactaaggtgcttcagcggacactgcaagcttctaatgtatggcattccttagcagacatgggcaagaactaatcaggcggctctacagctccctcacatgctcttctacggccctccaggtactggaaagacgtctacaatcctcgccctcgccaaatctctcttcggccctgccctttaccgttcccgaatcctcgaactaaacgcctccgacgaacgtggaatcggaatcgtccgtgaaaaagtaaaaggctttgcccgtgtccaacttagccatcccaccgggttagacgccgaatattttgaaaagtacccttgccctccgttcaagattatcatcctggacgaagcagacagcatgacgcaggatgcgcaatccgccctacgtcgtacaatggagcagtacagtcgaataacacgattctgtttggtctgcaactatgtcactcgtattattgagcctcttgccagtcgatgcagcaagttccgcttcaagccgctggacaactcagccgctggggataggctagcgcagatcgcgcaattagaaaagttatcgcttgagaatggggttgtggacaagctgatatcgtgcagcgatggcgatctacgacgtgctattacatacttacagagtgcggcaaggctagtaggggcggcgaaggctgcaaaagacggggatgaggacgaggaaatgaaagatcaggggtctgatatgatcaccgtcagcactattgaggaaattgccggcgttgtccctgagagtgttctggatgggctaatccaatcgctgcaaccgaagaggatgggttctccgtatgaagcagtttcgaaagtggtgacggagattgtggcggatggctggagcgcaacgcaaatacttttacaggtactt

SEQ ID NO: 36167 - DNA, 2393 bp, Aspergillus nidulans
atggtccgcttcctgcacctagctgggacccttccggtcctagcctctggcgcagtccaggacgccctccggccagttgccgagtccgccgcgaccgtaaccgcaaccgcgaccgtagccgggcaacaggctcaatttacactctcggattatgtggatgtcggggcagacttgattgccaatgtggacgatcccgaagccgtcaatgcccagtccgtctgtcctgggtacaaggcttccgatatacaacaaacggacctgggctttaccgccagcctacggctcgcagggcgagccctgcaatgtatacgggacggacgtcgagtctttgactttggagatgcagtatcaggatacggaccgcttgaacatccaaatcacaccgacctacgtggacgcatccaacgcgtcctggtatattctgccagaggaattcgtcccccgaccgaaaccggccgcagtgcgtccgagtcgcacagtgacttcgccgtgacatggtcaaacgagccaactttcaactttcaggtcacccggaagtcgacaggcgaggtgctcttcgatacggccggttccgtattggttttcgaaaaccaattcatcgagtttgtgacatctttgccggaggaatataacctgtatggtctaggagaacgcatcaaccagctccgtctgttgcgaaacgccacactgacctcctatgcggctgacattggcaatccgattgatgcgtacgttcggttactctcatccttgccccatgctaatggtatgcagcaacatctacggacagcacgcattttacgtagacacaagatacttctcagttgacgaggctggaaaacacacatacgtgaaaagtagtgaggctgaccttcggcaacatatacctcctactcgcatggggttttcctcagaaactcccacggccatgaagatgtgccccatccgcagggcctgacttggcggacgaaagaaggaagcatcgacctcaccctctactcggggccgactgtagcagaggtcacaaagcaataccagcgcagcaccgttggtctccccgctatgcaaaagtacgacacgcttggtttccatcaatgccggtggggttacaacaactggtcggtctttgcagatgttcttgcgaatttcgagaaatttgagattccgttggaatatctctggtatgcacgaatacgcacctatttgaatcctagcttacatctttagggccgacattgactatatgcatggttatagaaattttgaaaatgacgagtatagatttccatataacgagaccaaagttttcttggacaagcttcacgcaggtgggcgccattttgtcccaattgtggacgcggcgctgtatatccctaatccgcaaaacgcttcagattcgtaagtttttcgtttttattgccgagtactgctgacgatcttagttatgaaacgtacactcgaggcgcagctcgagacgtcttcctgaagaatccagatggcagcctctacatcggcgctgtatggcctggttatacagtctttcccgactggcatcatcccgatgcggctgatttctgggccaacgagctcgtgacttggtatgagaaagtcaaattcgatggagtgtggtacgacatgagtgaggtatcgtctttctgtgtgggaagctgtgggtctcgaaaccggacactcaaccccgttcacccgcctttcagattgccaggtgaaccgggcaacgttgattacgagtatcctgaaggatttgagctgtccaacgcgacagaggctgcttcggcatctgcagcttcttcgagccaggccgcaaccaccgccacagagactacgacatccaccagctcttacttgcgtacttcgcccactcctggtgtccgtaatgtcaactatccaccttatgtgatcaaccatgtccagacgggccatgatcttgctgtgcatgcagtctcgccaaatgctactcacgttgacggttatcacgagtacgacgtgcacagcctctacggacatatgggtatccaggccacctaccgaggtttgactcagattgcgcccaggaagcgtccattcatcattggccgctcgacgtttgctggctctggaaaatgggccggccattggggcggtgacaactactcccggtggtcatccatgtacttttcaatctcgcaagcgttgcagttttctctctacggcattccgatgttcggagtcgatacgtgcgggtttagtggaaataccgcggaggaactctgcaaccgctggatgcagttgtcggctttcttcccgttctatcgtaaccataatgttcttgggacaatccctcaggagccttatcaatgggcatcgaaaattgatgccaccaaaaaggcgatgag

SEQ ID NO: 36168 - DNA, 3700 bp, Aspergillus nidulans
ttggcaacccatgggttcgatctcatactatgactccagcagccagaacttgcgcccagtgcgacattcctcgcaaccgcccctgtcagctttccaataaacgggcttcttagcttcgctcatttttgcgtggcctgccacgtgttgggactgcatccaggtcaatttcgagatgctcttacagggacgacgggacactctcagggaataatcgttgcactgccgtatcaggctcaggcagttgggaggtcttcctgcgcgcggttgatgttgcgatgaagctgcttttctggctaggttgggaaagtcattaaggcaaaccgcaccagaaaagcaactgcctgagcggtgcgacatcgatgctcagtgtgtgtgggatgaagaaggaggttgtggaacgggtcctgcgtgaatgtaactttcatttgagtgaagatgagaaggaatgattctggaacagcatggtactacgatcaacacgaatcagaacagaatcccctaccctgatagactcccagttcttgactgccagttcctaccaatatctgccgcctttcattcgcctcatgtatatgaggcttatcgtcgtatttgcgagcgccctgactctgctggcttattcaagaggctcgacttcaccatccctatatatcatacctacactggggaagacatccatctttatctgcgcgatgactgcgtaccgatcctggctcgggcaatattgtgcgaacctgtcgactgggccaagacatgatgcgcacatccaccacgcatatactagactttgggcgggtaaacaagtctgttggcgcatgatcatctcactgggtcaggtcgccgaatatcctcgcttcagagtcgatggccccatcgcacagcgtgggaggcaaacatgaactcttttctccccagccaccgatcatgaatgagaactgggctaaatgctacggaccaaggttcatcaccgatgaatccggccggactcggttaataacacgcatgtgtccgactctaggggctccaccggtcatggatgcagaaatgacaccgaccacgagcgcaccgaattttgtcgcttgtatcatgaatgctgggtatcacgttgagctcgcaaccgcagggtctccagcaggccatgaagagcttgttgcatcgatgccaaaagctcgaggcatcacttgcaacgtgatctatgccaacccgagagctatttcgtggcaaatccctctccttcgccggcttcaagcagaggggtatcccattggaggactctgcattggtgccggtgtcttaagcccgaggtcgccaaagagtatattgagacgctcgggctgaagcacattgctttcaaaccttcgtccgtggactcaatccttcatcaagttcttgacattgcgaaaatgaaccattcaactccggttttgctccatggacgggcggaagggccggtggccatcattcttacgacgacctacatgagcctctcgtcaagacttatgggtctatccgaaagtataccaacgtcgcactgatcatcggcagtggcttcggcgatggtcaaggtatgatgatatatctgactggcgaatgtgctgagacctggggctaccctcgaatgcctgtggatgaagtcttgcttggtagtcgcatgatggttgctaaagaggcccacacgtccaacgctgtcaaggctttgattgctcaaatgcaaggggtgactgacgtagaatggcacaaaacatattcaggaccggctggtggtatgatcaccgtaaggtcagaaatgggtgaaccgatccacaagattgcgaaccgagccgtgatgctctgggattattttggatagatctttgttcaatgtcaaggacggggagcaatatatgcaaatattgaagaaatgccgcaccaagatcatctctcgactgaatagcgattacgctaagccgtggttcgcagtcaacagtctaggaagtctgtccagctgaaggatatgacatacgcggagtgcctgcaacgggttattgccttgatgtatatgcacccgcaaaagcgatgggttcatggatcctatcgagcgttctctgtggacttgatggatcgaatccgggagcggttcaacgtggtagacgagcactgtatggacggctccttgaacccgtctgactttccagagaagctcttcaccgtctgtcctgccatgataactgacattctctacccggaagatgtcgccttcttcatgagcctgttcaagcgacggggccagaagcctgtcaacttcatacctgtacttgatgcaaacttcgagacctggttcaagaaagactctctgtggcaaatgaagaaattggaatctgtcattgaccaggacccagagcgagtccgtattattcatggtccagtggtggctcgactttcgaccgctgtcgacgagtctgcagccgatattctgaacaggattcatgatgaaattgtggacgcaatgagacccatagtctcgattagttgcaatttcgagcttgatggagagagttctcatctagacattccgggcagtggcctctcgactcggttggactttgctgacatatcgagtcatgcaacagagctgggaatccaagtagactatcatttcacgaaaccactgcccaatggcgggagccgtttgcttctggatgtacttggtattggtagatcattggctgagcgcctgcttcaatgaggagactgtatttgtcgatcgccagcgacgaccaaatcgagtgcttgctgcattcctccttcgtgctggggacagggtgactgttcagtgcccgtctgccaggagcggctgtctttctctctctcttttctccaatattccaggtcagacagacgctcactctaccctttcacttgcgtctaccgatggcagcctgatccgcttcgatcttcgaggacctaaacaccttacatcagccctcagcttcgaccttgagctatagtgcgcaggagccagcggacactgcacgatactacccaggatagcgaggcaaagttgagacgattctatgcgtcttgttggtccgtcgatgctgaagagccgactaaagattcgattggtgtaaagctcaccacgggtcccgttgtactctcttcccaagttgtacttaattttgtctctctgatatcgagggccaaaggtcattaggttcgtccacatgttctcaacatggcctcccttgatgttggtatcattgttgcctgggaggcgctattaaggtcacttctaagcccgggactagggggggacctttctcgcttgttgcacatctcgaacacctttgaacccgtcccaggtatggaaccgcttcgcgttggcgatctactgaagacaacattacgcattaccgcggtaacaataaagccactgggaaaactggtcgaggttaccgtggtgattaaacgggaagaggcatccatcatgaaaatcacgtctgaattcctcatacaaggtcaatttccccatcatcatcagagcttcccatcctcagaggccaatgagtgggctctacctttggactccccgaaagcagtggttttactacgaagcagaccgtggttcaagccagatgcaaagtgtccagagcttcttgacaagactctcctattcaggatcacgtctcaatcgagcaagatgtcactttgaatactagtg

SEQ ID NO: 36169 - DNA, 1069 bp, Aspergillus nidulans
ttcgaaactccagtgcgaatgtgggtattcgaagaagaaatcactagtcccttccgattctccccaccacagcaaatatggcgacaagccacaaaaattgacgcagattatcaacgaaacgcacgagaatgttaagtatctgccaggcatcaaactgcctgacaaccttatcgcaacgccagacatcaaagaagccgtcaaggatgccagtatcctcgtcttcaacctcccgcaccagtttatcggcaagacactcgaccaaatcaagggacaccatttaccttatgcccgtggagtcagctgtatcaagggcgttgatgtttcagacgggaaggtgacgctcttctccgagcttatcatgcagaaactaggcatatactgtggcgcattatcgggtgcgaacattgcgcctgaggttgcggccgaaagactatgcgagacgacaattggatacgaccccccgcctatggatcttacctctagtgacggctcgcctgaggataacctgccccatgtagatggccagcgccagaaggacctgagctcgacggatataaagttggagcgtgtgccgcaggattatccgcatgtgaatgatgaactcctcgagaagatgttcgagcggccgtacttcctcgtacatgttatcaaggatgttgcaggggttgcgttgggtggagcgttaaagaacattgttgccctggcagctggatttgtcgccggaaagcagtggggtgaaaatacgaaggcggcgattatccggcagggtgtaggagagatgatccggtttggacggacgtggtttccttcctcggtcaatgagaagacatttacagaggagagcgcgggcattgcggacctggtagctagctgctatggcggccggaacgtaaggtccgcaacgcacgctgtggagaaaggggtgagcgttgctgagattgagaagacagagatgaatggacaaaagttgcagggggtttcgactgctcagaccgtgtccgggttcctggagaagcacggcaagacagacgaattccccttgttctgtgctgtgtacagtaagttggcc

SEQ ID NO: 36170 - DNA, 1314 bp, Aspergillus nidulans
cttttgcatttgatactggcgttatcagtatgtatcaatgtctggctgtgggaagttgtggctaacttatgactaggcggtgtcctcactctcgaatcgttccagagggactttcggtatactgaatcgcagaagacaaccgtcaattctaatgccgtctcaattctgcaggctggtgcgtttttcggctgtttcctcaccacgccagttgcatcgcgctttggccgtcgatcaggcttgatcatcagttctctggtcttcaccgttggaacaatcttgcaaatcatcaacgcgcatactctggcgacgttctacacaggtagagtaattgccggcgtcgggatcggcgcggcaactgtgttgattccgatgtactccgctgagatggccccgaaagagatccgcgggcgactcggtgcttgtttccagttattcttcgctttgggtgtaatgatcgcctactgggtcaccttcgccgtttcagagacccagccaccgaagcccaagcaatggcagatagcgctcggtctgcagctactgccatccactctgttgctgatcggaatggtcactgtcaaggaaagtgcccgctggctggcggtcaagggccggaacgaagaagcgtgggagtctctgaaatgggttcgaggtggagaggacacgccggagctgcagcaggaattcgatgaaattctcgcaggcattgcagaagaagcccgcgtcaaagaaaactttacttggcgtgaactccttctgcccgcgaatcggtaccgaatcttcattgccattacgattcagctctgtgcccagttgtccggtaatacttccttggcatactatgcgacccagatattctcggccgtcggcgcggggagctccgccaaactggtgactggcttctttggcgtggtcaaggtcgtaggtgtcagcatcttccaattgtttgtcattgacaagattggacgaagggtgccattcatggctggggctttcgcaatgggttcgttcatgcttattatcgcgtgcgtgcttgcaactcatcccacgagctcggatggggccgactcgggagcaacgccggccggtattgcaatgatcattatggtgtacgccgaagcctttagcttcaatatgtcctggggcgcgcttccatggctatacgtcggcgagattttctcgagtcggctgcgagaagtcggtgtgaccgttggagcggcgtcgcaatggctgtttaactttatgatgtctcaggtgacgccacacgccattagtaatattggctggcggatgttcttgatgtttgccatcttcaac

SEQ ID NO: 36171 - DNA, 1065 bp, Aspergillus nidulans
tctagtctcagccctgtcctcataactggtggtaatggcttcatcgcctatcacattattgctaaactcctggccgaagaccccaactgcaccatccactgtattgacatcaacaccacccgcaacattcacgcctccgactctgtcacctaccaccagggcgatctctcttcgcttgcagacgtctcacgcattatggagcttgctcgccccgtgacaatcttccataccgcatcccccgagttctcggaggcccccgaatccgcctaccacgacgttattgtcacaggaacccaccacctcctgaacagcgccgcgtcgatcggcaccgtcaaagcccttataaatacgtctacgtcgggcgtcatcaatgacaaccacaccgacctggtcaatggcacggaggacatgccgatcctgcgacccccggtgcagaaacgcctctattgcctcgccaaagcagacgcagaagaagccatccaagccgccaaccgccagcacggctttctcacctgcgcgcttcgcccgtgtcttgccttcggcgaacgggacacgaattccatgggaaaaatggttgctgttgcacgtgccggccgctcccggttccagatgggatatggcaagaacgcgtacgatttcgtgtacgtcggcaaccttgcagatgcgcatctccttgcggcgcatgcgttgattgacgctcatgccaatccgcctctccctgcggaccgtcgtgttgaaggggaagtgttcaacatcacgaacggtgagccgtggctgttttgggatttccagcgagagatctcgaaacagttaggttttcccattcaggaaaaagatattgtggtcattccgaagtgggtcgggttgttgattgggttcgtgagtgaatggttggtttggctgcttagtggggggtcaaaggtggcgaattcaacgcgcgagggcattcgatttagtacgttggagagaacgctgaattgcgagaaagcgcgaagggtgctggggtatcagcctagggtcggcatgcaggaaggtattgagaggggggttaggtggtttaaggag

SEQ ID NO: 36172 - DNA, 1057 bp, Aspergillus nidulans
ggtacttttgctcgagtatggctggcgagattacgcgacgacaaaacgagaccagagaaggtctacgcgctaaagatcctaaggaaagctgacggtatggacaatcaaatgccatcccactgtcacggtcttggctaataaaccgggactctattcagtgatcaaactcaagcaagtcgagcatgttcgcaacgaacggaagaccctggcggatgtgtctggccatccattcatcacgacattaatcgcctcattttctgatagtcaaagcctatacatgctggtactctccaactctgcgtccactgtctttggtcgttgactgacatctctcgagcttgactattgtcctgggggtgagatattcagctatttgcgccgtgcgcgacgtttcaacgagaatacctcgaaattctacgcggccgaaatcaccatgacgatcgaattcctccacgatgccgagggtgttgtataccgcgacctgaaaccggagaacatcctgcttgatgctgacggtcacatcaagctcgttgattttgggttcgcaaaacaaattggcgaccgcgaaacgtacactctatgcggcactccggagtatctcgccccagaggtgatacacaatagtgggcatggccttgctgttgactggtgggctttgggaattctaatatacgaatttcttgttggtcaaccgcctttctgggatcaaaatccaatgcggatctacgaacaaattgtcgaaggtcacatacgctacccttcgaatatgtcacccgctgcacagaacatcatttccctgctgtgcaaaacgaacccagccgagcgccttggacatatttcgggcggctcagccagggtgaggacgcatccgttctttgagaatattaactgggatgaccttttctatcgtcgtattaaaggacctatcatccctcgtgtcgaccatcccgcggatacagggaactttgaagaataccctgatcctgatccgaaatctcagaccatatacactgaggacatgcgttccaaatatgaaacactctttagcgatttttag

SEQ ID NO: 36173 - DNA, 873 bp, Aspergillus nidulans
ggaactttcctgttcacctccgagtccgttggacgcggtcaccccgacaagatcgcggaccagatctccgatgccatcctcgatggtacgtctacaaggattcactaaagtaaaagagtagatgcttacagagaaatcagcttgtctcgctgaggacccgctctccaaggtcgcttgtgagaccgccaccaagactggtatgttatctagccttgcctgaccgcataaccgggtgccttgctgattcctgcaggtatgattatggttttcggtgagattaccacccaggccagactcgactaccaggccatcatccgtggtgccatcaaggacattggttacgatgactccgagaagggttttgactacaagacctgcaacgtcttggttgctattgagcaacagtcgcccgatattgctcagggtctccactacgaagaggccctcgagaagctcggtgctggtgaccagggtatcatgttcggttatgccaccgacgagacccctgaactccttcccctcaccctcgtcctttcccacaagctgaacgctgccatgaccactgcccgcaacgacggctccatcccttggctccgtcccgacaccaagacccaggtcaccgttgagtatgcccacgacaacggtgccgtcaagcccctgcgtgtggacaccgttgtcgtctctgcccagcacagcgatgatgtgaccaccgaagagctccgcgctgtcatcaaggagaagatcatcaagaaggtcatccctgctgagctccttgacgaccgcaccgtctaccacattcagccctctggccgcttcgtcattggcggtccccagggtgatgctggtcgtactggccgtggtctcttaagcggg

SEQ ID NO: 36174 - DNA, 1459 bp, Aspergillus nidulans
gctgattctttcaaactggctgggaacaaattcttcaaagacgggaactacaacagagcgatcgaagagttcactaagggtttgtactaagtcgtatttgacttttgcgagctcggatgttaactgcaagcagccattgaactgaaccctaataactccatctaccgatcgaaccgcgctgcggcgaacttagccgctcataattacttggatgcacttgaggatgccgaacgagcggacgagctggatcccggcaacaacaaaattctgcacaggctaagccgtaccttgactgctctaggtcgcccggccgaggctctagaggttctcgaacgtatgcaacctccggcttcagcagcagaccgacaaaatgcagagaagatgctccgcttcatcaaccaggcgaaggagacgttggccgaaaaccgtggtgcgtcgatggcggtgttctgcattgatcaggcgcggcaactccttggaccaggcgtgaaagagcctcgtgcctggactcttttgacggcggaggcgcaactgaagatggctaccggtaactcctttggaaaggcccaagacattgccatcaacatgcttcgagacaacaaccaggaccctgatgcccttttgatccgtgcgaaagcttactacggcttgggcgagacggaccaagcgctcaagtcgctcaaaatgtgtattggactggatcccgatcacagagaagccatcaaacttctccgcatgctacagaagcttacccgaacgaaggaagaaggcaacaatgctttcaaggctaaggactaccgcaaggcaattgaactgtatacagaagccctcagcgtggatgagacgaacaaggacgtgaacgccaagatcctccagaaccgtgcccaggcatatatcaaccttaaagaatatgatgaggcgatcaaggactgcactgaggctttacggctcgaccccacatacattaaggcgcagaagatgcgcgccaaggctcatggtggtgcggggaactggcaggaggctgtttcagactacaaggctgttgctgaggctaaccccggcgagaagggaatccgggaggacattcgccgtgctgaattcgagctaaagaaggcgcaacgaaaagactactacaagatcctgggtgtctccaaagatgcgacggaaacggacctcaagaaggcctaccgcaaactagccatcaagtaccatccggataagaaccgtgaaggcgaagctggtgatgagaagttcaaggagattggcgaagcttatgaaactctcatcgatcctcagtatgtttcttttacctagtgttctaaaattgcaggatactaatgattgcaggaaacgcgctgcctacgataacggcgatgacttactggaccccgcagacatgttcggcggcggcggattcggcatgggaggcatgggaggaatgggtggaatgggcggtatg

SEQ ID NO: 36175 - DNA, 791 bp, Aspergillus nidulans
acgctctggcgtgggttgagtccgacgttaatgatgggataccaggaaatgtcatctattttgccggatacgactggttgcgcaccgacgacaggagtccgatcaagcgcgtcgtccctggcgcatacgttccattcgttgcgggagcagttgcgcgagttgcagcagccactgctataagtccgattgagatgttccggacgcggctgcaggcgacgcccggcactggcgcgggacatttcaaagccactttggagggcctgtatcaaatgacacaagccaaaggttacggctccttgtggcgggggttcactctcaccatgtggcgcgatgtgccattttctggactttactggtggggatatgaggaagtaaaaaaatcgatcatcgaggttcgaaagaaggcacgagggcataacccgccacagaccgcgccctcgtcaacgcagctggggacctccgatgtggagggcaacacgttcttggatagctttgtcgcagggtcgatatcgggcgcactagccgcacttgtgacgacaccatttgacgttgggaaaacacgccagcaggtgttccgccacatgggagatgatgcgccgagcacagctggcagcaaactccctaaggggcctcttcagccggagcagctttctctgccaaagtttctcttgcacatcttccgtgaagaaggtgcggcgggtcttttccgtggctgggtagcccgttgtcttaaggtggccccgcgttgcgctatcatgatctcaacatacgaggttggcaagaagtttgca

SEQ ID NO: 36176 - DNA, 1265 bp, Aspergillus nidulans
tcaaatccaaagcacacgaaatggattgcccccattctcaacatcgccgatgggcttctgtgcgccttcattatatggaaagtcccctgtaagttgcgcagctccatcgcatatgccattctagttagccaacctaacagcctcattactagataccgaaattgattggacaacgtacatgcaacaggtcaaactgtatctttccggagaacgcgactacactctaatcaagggttctaccggcccgcttgtctacccagccgcgcacgtctacagctactcgctcttccaccatctaaccgacgaaggaagggacattgtctttggccaaatcatattcgcattcctatacctgatatgtcttacggttgtcatggcgtgctataggcgagtcggagctccgccatacttgtttcctctattggttttatccaaacgtttgcatagcgtttacatgctacggctttttaacgatgggcttgcggcgctggctatgtggggctctatttggctcttcataaaccggaaatggactcccgcggttgtgctttggtcgcttgggctaggtgttaagatgaccttgattctgctggttcccgcggttatggtggtgctcgcgttgagcttggatattggacgatgtattaggctggctgggttggctttgggcattcaggtctgtgacatgttcttggtggagtattctgcgcacaaaggactgacagggctagattctccttgcgataccgttcctgaagacgaaccccagtggctattttgagcgcgcgttcgaatttggaaggcaatttatgtttaagtggacggtgaattggaggtttgtgggggaggatatctttctctccaaaggcttttgggcgggcctgatagttctgcatttgctcattttggttgtgttgggtttcacctgctttctgaacccatctggtactagcttgccagatttcgcgggcagattcttgactggacaacaccgcgggatagcacttcatccgtcttttattatgtccgcactattgacatccctgtccgttggcttgctgtgcgcaaggtcgttacattaccaattcttcgcctatctttcttgggcgactcctttcctcctctggcaggctggataccacccaattcttgtgtatgcactgtggctggtgcaggagtgggcctggaatgtttatccaagcaccaacctaagctcggccgccgttgttctcttgcttggcgcccaggtgttaggcgtccttgta

SEQ ID NO: 36177 - DNA, 1243 bp, Aspergillus nidulans
ggaattggcgctgcagatatcacaaagctgaaggcgaatggattcttcactattgctgtaattctcctgccagccctgttactgtcctgacgcttacttattgccatcgagtcgatccacggggcaacgaggaaaactctattgaagatcaagggttttagtgagatcaaggtggaaaagatcaaagaggctatcaacaagtgtttggtaagattagagaaggggtcttcaatatctatttatgctaaccgtaatagccttcggcttcgggtttcataactgcaatggaactcagccatcaacgaaagagagttgtccgtatttccactggcagcaagcaatttgattcgatccttggagggtgtgtatctcacagctgtgagaagctagttttctgacaaactgcagtggtttccagagtatgagcatcagcgaagtattcggcgagttccgctgcggcaagacccaactctcccacaccatgtccgttgtcgcacagcttcccaaggacatgggcggtgcagagggaaaggtagcttacattgacacagaaggcacattccgtcctgagcgcattgggcagattgcagaacggtttggagttgatcctgactctgctaaagagaacattgcttatgcccgtgctttgaatagcgagcatcagctcgagttgctaaacactcttagcaaagagtttgttggtggggagtataggctgctgatcatcgacagcattatgaactgtttcagggttgatttctgtggacgtggagagctagcggatcgccaacagaagctcaatcagttcctgatgaagctcgctcatatggccgaaggtgagcccgtcactcatcgtcaaagaactcggctgatgttttgtaatagagttcaatgtgtgcgtcttaatggtaagcacgacactctgcatttagaacgtggctcacaccactgttaagacgaaccaagttcagagtgatcctggtgccagtgcgctcttctctggagctgatggccgtaagcctgtcggtgggcatgttcttgctcatgcttcaacgactcgagttctgcttcggaaaggtcgcggcgaggagcgcgtggcaaaaatccaggactcaccaggttagttgacttttcctagcaagtaatggatgcctactgaatatatacttcagactgtcctgagcgtgaggcgacatatctgatcaccaatggcggaattgacgatcccgacaaggtatagata

SEQ ID NO: 36178 - DNA, 1628 bp, Aspergillus nidulans
gccgatactgtcgtcaaggttccgcagatggcggaatcaattacagagggtacattgaagcaattctcaaaacgtaggttattctaatctgtggccgaacctcgctgaactctcatgatagaggtcggagactatgtcgagcgggatgaagagattgcgacaattgaaactgacaaggtatattttggtttatatggacttgccgtgtgtcgcaattcaagtcacttacacgctttagattgatgtatcggttaatgcgccggagtccggagtcatcaaggagctgctcgtgaacgaggaagatacggttacagtcggacaggatctggtgaagctggaagccggtggtactccggaaaagaaatcagaggaagcgactgagaagcccaaggaacctgcctctaccggctctgaggctgaaaagccaaaggaaccagaatccgcaccatcttcttctgctcctgagaagagcacctcatcaacaaaggctcctcaggctgaaacttccaagccgacacaggaagtggcatccaagtctcgaccaacggaggaggcaaagcccgcactaggaaaccgtgaggagagaagggtgagtaacgtttcggattcgcgcttaatgcacggctggtgctaacgaccatccttgaaaaggtcaaaatgaaccggatgagactaaggatcgcggaacgtttgaagcaatcccagaacaccgctgcttccctgactaccttcaatgaggtcgacatgtcttctttgatggagtttcggaagctgtacacggatgagattcttaagaaaacaggagtcaagctggggttcatgagtgccttctctcgtgcttgagttctggctatgaaggatgttcccgccgttaacgcttccattgaaggccccaatggtggtgataccattgtttaccgcgattatgtggacatcagcgtcgctgttgccacggagaaaggcctagtgacacccgtggtccgcaacgctgagactatggatctcgttggtattgagaagtctattgcagatcttggcaagaaggttggcctagatgagcctcatttaggagatcataactgacgccattaggcacgtgacaacaaactgactattgaagatatggctggaggcacctttaccatcagcaatgtgagactcttatatttccttatcgagcaagccatgtactaatcggcatttagggtggcgtttttggatctctcatgggcacgcctattatcaaccttccacaaactggtaagttatgtgtccacgactactagtacaatcatcaaactaacccgctccagctgttctcggtctgcatgccattaaggacaaacccgtggccatcggcggcaaggttgagattcgtccggtatgtaaaatcctgctaaagcgcgcttggttcttgttgttaacctacctatcagatgatgtatcttgccctcacttatgaccatcgacttctggatggcagggaggccgtcactttcctagttaaggtatcttttacctcaccttttcgtgttctttctgtggaacaatttgactgacgatatcgacaggtaaaggagtatattgaagaccctcgccgcatgcttttgggttagacgaactgtgcc

SEQ ID NO: 36179 - DNA, 635 bp, Aspergillus nidulans
atctctaaccaagggaacaaggtcgaccgcggtcattatgcacctgctagaccgtactcagactcgccgcagccgatcggccatggagcgacaatttccgctccccatatgcatggacatgcgtgcgagtatcttatcaactaccttcgacctggcgcccatgtcctagacattggctctggctctggttatctaacccatgtatttgccaaccttgtcgtggatacgtcatcgagcgatggcccaaaaggacaagtcatcggcgtcgaccacatacaagaactcgtaaacctggcacacgacaatatgatgaagtcagaggatggaagaaaactgctagaaaatggaggcgtgaagtttgtcaaggccgatggcgccgtggatggctagatggcgcgccatatgatgcgatccacgttggcgcagcagcacaagagctacaccctctgctaatcgagcagctgcgagcgcccggacgtatgttcatacccgtcaatgccgaggacgaccaagggaccctgttcagtaccgcattcggcggtgggcagtatatatgggtagtggacaagaagaaagatggcactatacacaaagagaaagtgtttcaagttagctacgtccctctcactgaccca

SEQ ID NO: 36180 - DNA, 2177 bp, Aspergillus nidulans
ttaccgcactttcagcacgatgatgtcctcctccgcctcaatgcaattcaccgtctttcaactattgcgttagctctggggcctgaaagaactcgcgatgagctagtccctttcctcgatggttagtatctttatacagacgagaaccggtgtcacggttaagagctcagtattgacttttgcaattcagattctgtcgaagatgaggatgaagttttgactgcattaagtgaagaactcggttctttcatagagtatgttggtggcccagaatatggccacgtactgctctcccccttggaaaatctagcggccattgaggagccgctagtgagagaaaaggcaagtcgaggtcaagctatacaggttttacgtgttcagtctaacgtcctttaggctgttgaatcactaaacaaaatcggcgagcagctctccgaaaagcagatcgaagaatatttcgtcccaatggtacagcgcttatcgaaagccgactggtttacttctaaagtgtcagccactggactctactgcgtcccttacaggaagtcgtcctcttccctgcaacagaccctgcgccaatttttcgccggccttgttcgcgatgagaccccgatggtcagacgctcagcaggcaacaatctagcgaaatttgtgaaagagatgacgactccgattgtcatcgacgaaatgatacccctttttcaatacttagctagtgacgatcaggacagcgtgcgtctacttactgtagacattctcattgccattgccgaagagatacccaaggagcagcaacctagccacggcgtgttgttgacgtccctgcggagtttgttcgaagataagagctggagggtcagatacatggttgccgacagatatgaaaaggtatcttgcggatttctcgccgagtccttttttgaactgtctgacgagtcccatagatcgcgaaagcagtgcatgaagaggttgtcactcgggacatggtgccgtcattcgttaaacttttgaaagacactgaggccgaagtccgcactgctgttgccgggcagataccaggtatatccacgccaagcacctcattatagccagaccaagcttactaaccgctaattaggcttctgttccttgattgacagggaaactctgcttaatgagatcatgaccagcgttgaggatcttgtttcagacccctctcaacatgtgcgggcagccttgggaacgcaaatcagtgggcttgcgcccattcttgggaaggaagagtaagtggcttgcaaatttaccaagttgcgcgttgagcggaggtgctaactagatcgttgcaggaccatctcccaccttctacccatgttcctccagatgctcaaagatgagttcccagacgtgcgactgcatatcatttccaaactggagttggttaacaatggtaagttgccagcaaatttgtaacagttcatatagtttctaaccataacagttattggtatcgaactcctatctcagtccctcctccctgccattgtacaattggccgaggataaacaatggagagttcgtctagccattatcgagtacattccccttctcgctagccagcttggagtgaaattctttgatgaacaactcagcgacctttgcatgggctggcttggtgacactgttttctctattcgtgaggctgccacgcagaacctgaggaagttaaccgaagtgtttggggtcgattgggccaaggagtccatcatcccgaaagttatggcaatgggccaacatcctaactacctctacagaatgacaacgtgtttcgcgatttctgtatgcacactataacattgttggtgaaaactctgctaattatttttatccagacgcttgcacccgttgtcaccctggaaatcatcgaaaattcagtgctcccaatccttgaaagactcacttcagacgatattcccaacattcggttcaatgtcgcaaagtcttatgccgtcttgatcgacacgttgcgacgtcttccggctcaaggcactctgaccgacctcgagaaggaaggcaaaaccgaggctccttcgccaaggggtcaagagctcatccagcagagtgtccttccaagtctggagaaactccaaggcgatgatgatgttgatgttcggtactttgcgacaactgccgctggcggc

SEQ ID NO: 36181 - DNA, 1596 bp, Aspergillus nidulans
ttccaggaccacaccaaggccttggaggtcttggagaaggagtacccgatcaaggatggtcttgatgtcgacactctgcttgattctgacaagcacggtgcgctgacctacaatgacttcctcattcttccgggatatatcggtaagccgcgcgctggtctcctaaaccacggtccgtgactgaacttcgatggcaaggttttcctgcttccgatgttactctggacacgccagtcaccaagcgtgtcacattgaaggctccccttctttcctcgcctatggacacggtgaccgaacataacatggccatccacatggctcttctgggtggcttgggtgtcatccaccacaactgctctccggaggaccaggctgagatggtccggaaggttaagcgttacgagaacggattcatcttggatcccgttgtgctttctcccagggcgactgtccgagaggcgaaggagctgaaggcgaaatggggattcggcggcttcccagttactggtaagttctactttgcttctcttctccctcttttcgtgatgattcccatctatctcttatataactttcgttccactgaagcgacgagagttgcaatgtagagaaaaagattttatctgatttctatataattgcatttctggctcaaacacttaactggcaaatcagttatgctgactgattttgttctcagaaaatggaactctccgctcaaagcttgttggtattgtcagcactcgcgacatccagttccacaacaacctcgacgactctgtcactgccatcatgtcgaccgacctcgtcaccgcacctgctggcaccaccttggctgaggctaacgaggtccttcgtagctccaagaagggaaagctgcccatcgtcgatgagaacggcagcctcgtctctcttctctctcgcagtgatctgatgaagaaccttcactaccctcttgcttctaagttgcccgcctctaagcagctgatctgtgctgctgctattggcacccgcgaggaggacaagcaccgactgaagctcctcgtcgaagctggtcttgacattgtcatcctcgacagcagtcaaggcaacagtatgtatcagatcgagatgatcaaatacattaagaagacgtaccctgaaattgatgtcattggcggaaacgtcgtgactcgggaccaagccgcggctctgatcgctgctggtgttgatggcctgagaattggcatgggcagcggcagtgcttgtatcacacaggaggtcatggctgtcggccgtccccaggctctctccgttcgccgcgtcacccaatttgcggctcgctttggcgtcccatgtatcgctgacggtgggatccagaatgttggtcacattgtcaagggtctcgctatgggcgccactaccgtcatgatgggcggtctcctcgccggtaccaccgagtctcccggtgagtactttgtcagcaacgaaggccagctcgtgaaagcctaccgtggtatgggcagtattgcgccatggaggataagaaggctggcggcaacggcaaggacagcaaggcgagtaacgctggaaccgcccgctacttctccgagaagg

SEQ ID NO: 36182 - DNA, 924 bp, Aspergillus nidulans
gcgaaggagacaccggattggatagaaactggacccattgtggaaagccattggagtctatgcttacagacgctagaaggccacgatcgcgcggtcggctcagtttcattctctcacgattcgcgccttctagcttctgcttcaggtgacggaactgttaagatctgggatacagcaacaagttttctccaaaacacgctcgaaggtcacaatgaatgggtcaaatcggttgtattctcccatgactcacgtcttctagcctcagcatcagatgacggaactgttaagatctgggatacagcaacgggtactctccagcgcatgctcaaaggtcacaatgattcggtcagatcagttgtattctcccatgactcgcgccttatagcttctgggtcaaatgacaggacagtcaggatctgggaaacaaccacgggtcttcttcgacacacctttgaggatcatgaagatagtgttatggcagtttcattcgctcatgattcgcgccgtctagcttctgcatcagatggcggaaatgtcaagatctgggatacaagaacaggttctctccaaaacgtcctcgaaggtcacgatgattgtgtcaactcagtttcattctcccccgactcgcgccttcttgcctcagcatcagatgacagaactgtcaagatctggcatgcagcaacgggttccctccagcgcacgctcgaaggtcacaatgattgggtccgatcagttgtattctcccacgactcccgccttattgcttcacatcagatgacatgacagtcaagatttgggatacagcaatagttcctctccaaaacaaccttgaaagtcatgataattgggtcagatcagttgtattccccatgactcgcgcctgctagcttcagcatcagatgacatgacagtcaaaatttggga

SEQ ID NO: 36183 - DNA, 793 bp, Aspergillus nidulans
gaatcgaacactggaaccggctatcttgtcaagcgcaaaaacgtattgaatttctgcagccgtgctagtgattgtgctgagaatgaagcctgtcagctcttcgtgtgtgttgagtctaaccacagccaggcccaacccgacactgaggatgaggggaactgcaagaccgacgaggactgcggtgaaggtgctgaatgcatgggcggcttctgtatcgatcgtgacgttacagttgaggcatccctaacgggtgatgccatgtgtcagaaggacaaagactgcggtagtgttggcagatgtcttaacggcctttgcctcgcaccgtccaaattacgtttcgctcgtcggtctcctcagcttgtctgccacaccgatcgtgactgtgccagcccttcgggacctggtcactgcactcacggaggcatctgtattgctcctcctatcaataaggtcgaagcccgctcccctcaaattcagtgccgtaccgaccaagactgcgctagtccccatgggcctggacagtgtatagctggtggcatctgtattgcgcccactcgtcagcttgagactcgatcgcctcaagttcaatgccataccgatcaagactgtgctagtcctgatgggcccggatactgcattggcggcggaatttgcgtcgcagatcctccctcgcagttcctcgtcgagtctgcagctgctgatgtgtgaagtcgagtctcgctcctccaagagtcggtgccgcgacgacagggtttgttctataagggcatgacgaggaatatgccggagcatg

SEQ ID NO: 36184 - DNA, 1358 bp, Aspergillus nidulans
ttgaccgctttatgctccgcaaatgatgtcctccaacagaccggcattgtcttgcagaacacccgtgcccagcttgaagaggaagagatgctgcgatgtgcgcatgaagagactgaacaccagctccaggatgtcggcaaaggacttatatcaacccttggccaaaccgttgaagatattaatagcctacaatcaaagcttgatcggaaagccgagttggacgctaccaatgcggaattatggagagcttcctcaacggaggtttcagatgtcacgaagcggattgaccagcgggttgaggctttccagacgcggcatgcaaagcttctcgaaaccacgtctgtcaaagttaacgagttcattgctacagagatttctaacatcgagaggactcggtcagatctctccgagtataaccgctcgcttgatgcggcatgtaacaatgcgaaggctgagacatctagtgctcacgaagacatgaacaatgtgcttgaagaaatcaaagatctgcgcgaggaagtcaagtctaaagtaggagagggacttaatggcctctcagctgccgcagcccggatatcggaggaggttattggtgaattcacccaacttcacagccaagtaaggattaatccgtcacagtgggagtatatcattactaatatccctagctgcacacatccttcaataaccttggaaaagacctgaaatcgatctttgagacgatggccacgcatctttcagagcagaagaacgaaataaacaggctacgggccgagctacagagctcgaaccgccagaacatagaaacgacgcacaaggcctccgctcatctcgctcaagcgattgaagaagaacacgtcgctgcggaagcggaacgtgagattttaatgtcacagatcaaagcgctggttgaggaatctcgccagaagcaattcgcccgcctcagggccaagattgacggggtcaggaccgagatttcagcatcaggggacatgttagagcaggccacaactcagcatgaccgccagatcgatgagtgggttttcaagtctgagcaattcgctaaggatgtcaatgcatcgaaagatgagatcaggacgaagctgcaaaatgattgggaggtaagtgtattcctcgttttcggtatactttttactaagtatgtaggcatttgatcagcggaattcgacaatccggaaggcaacagaatctgtccataaggagacggtacgcattgttgacgttcaagtagacgacatgggacggcatatggaagctcttgacgatttcgtggcataggcacgatctcagaatggtcgttacgtgatgcgcatattgcaaccctggatcaatagcca

SEQ ID NO: 36185 - DNA, 315 bp, Aspergillus nidulans
aggattcgcacaattgcatggaacccgactggtcagctagtcgccactggatctcaagaccgcacccttcgaatctggaatcctgagcgctcacaggcgcgatattctacggagctgcgcggtcacaccgcaggggtcgaaaaggtcctcttcaacccggcccgagactctgagcttgctagctgttctagtgatggcacggtgcgaatatgggatgtacgttcgaaaacatgcgtgagccgtttagaggtcgggagtgatgcgtttactttgtcgtggtccgccgacgggaaggtcctcatcgctggacgaaag

SEQ ID NO: 36186 - DNA, 759 bp, Aspergillus nidulans
atcaccctgaaggataaggttattgtcatcaccggcgcaaacaggggcatcggtctggccatcgccgaggtctgtctggccaacgaagccgcagctgtttacagcctagaccttttcgagcctggcgaggaattcaccgctgtgcaaaaaaagtcagcgaatccgagtcgcctccaatacatccactgcgacgtcacatccgaggaaagcatcagctcggcaatcgacgctgtggtgtccgccagtggcgccgtccacggcttcgttgccaatgctggaatgaccaagcaccaaccagccctggacttcacccgggccgaaatcgacaagttgttcaacctgaacgtgtttggcgcgtacttctgtgcaacggcagttgcgcgcaaattcattgagctcgggatcaagggctctattgtatttactgcttccatgacgagttatagacccaaccgcgcgccgagcgcaccctatggcgctacgaagggtgctgtgcggaatatgacacatacgctggccatggagtgggcgcaccatggtattcgcgtgaactcaatatcacccggttttatcaagacccagatgacttattttgtcgaccaggcgccggactggaatctcaagatgcaatattacggtggtatgccaagattagccgatccgaaggagctaggaggggcttatgtgtatctgctgtcggacggagcgtcgtacacaacagggattgacattccaattgctggtattgtcggagcgtgg

SEQ ID NO: 36187 - DNA, 1883 bp, Aspergillus nidulans
tatgcgcctggtcgccaaatttctgtgaagtcttcctcaagctctttctcaatgttgaccgtcgtttgaacgtcaagcgtcgccatgttcggaaagaagtacttcggctttaggggcaggtccctcaacctggccatcagctcgctgggcagtcttgatttcctgtcggtctttgtatgccttcctatgtgactctggctaatggcgacaggcttttcggttatgaccaaggcgtcacaggcggtctcctcgagctgccatccttctacaagtacttcccggaaatcactgcagacatgtgcccggaagacgaaaacctcagctcctgcaggtcgcagcgtagcaccaaccagggcatcgctgtcgccgcatacaacctcggctgctttctcggagctatcttgaccgtgttcatcggtaacgcaatcggccgtcgcaggaccattttctgcggctgcgtgactatgactactggcgctatcctgcaatgcactgcttacagcctccctcattggatcgttggacgaatcgtgactggaatcggtaacggcatgaacaccagtacggttccaacctggcagtcagagtctgcgaaagcgcacgatcgtggtaaactggtgatgatcgagggtatgttgatcaccggcggaatttgtctcagctactggatcaactatggtacgtcgatttccttcctggtctgttttgtactggcgcgcagtaatcactgacgctcccttgcaggtttcgccttccttcccgaccacgaggtctcatggcgcttcccaatcgcctttcagattattttcgccgttactatcttcatatcaattatgaacctccccgagtcccctcgttggctggttatgaaaggtcgggacgacgaagcggttgagattcttgaactcctgaacgagaagccgcgcgacgacccttacatccagaacgaactgctgtcaatcaaggaaactgtgatggaaatgaacaagggatcattccgcagcctgttcaagatgagcgagtaccgtgaattccaccgtgtcgcgctcgcctacgtcaatcagatgttccagcagatttccggcatcaacctcatcacttactatgtgagcacatgttctgccttgaaacgcgttcattgctgatatgtctaggctcccaatatctacacggacattggtctcggtggcggtaacaccgcgaagctcatggccgccgccaacggcaccgagtacctcctcgccgcgttcattcccattttcattatcgagaaagtcggccgtcgcccgttgatgctctttggcgtacgttccctccctattcacttctttgctagaatctgacaaagccaggctgctggaatgtctatctccatggccattctcgcgggtacacactaccgccgcgaaacctacgacgacaccaaggccggtgtggcccaggcagtcttcctctttgttttcaacaccttcttcgccatcggttggctcggcatgacctggctgtatcccgccgagatcgtcccgctccgtatccgtgcgcctaccaatgcgctgtcgacttcggcgaactggatcttcaacttcatggtggtcatgatcacccctgttgcctttgagaacatcaaacataacacgtacacaatctttgcggtcatgtgagcttcccttttcttcagttcagctggctcttgtaccagggcacgtgctaatatcatcttcagtaatgcttttatgttccccgtcgtctacttctgcttccccgaaacccgttaccgttcgctcgaagagatggacgcaatcttcaaaaagtcggacggaatctggagcgctgtgcagcattctatcaaggagccgtaccgctatgataaacacggtcagctt

SEQ ID NO: 36188 - DNA, 1704 bp, Aspergillus nidulans
ctgcctcagcatgatagaacctggctgcgaatcccccatctgctgaaactgaatctcatccttctgatcccgctgctctcgtctgcagtagcaggttatgatggtagcctaccttatctacctctataccgccatcaatattaaatagctaatactgagactaggctccctgatgaacggtcttcaatccatttcttcatggaaaacctatttcgataaccccacgggctcgatcctcggcgttgtcaacgcagcccagtcgattgggagcgtgatttcactccccgtggtcggaatactctctgacagaatcggccgccggtggacactcctatccggggcaatcgtcatcatcatagcgtccattatccaggcggcaagtgtccagtacggcatgttcgtcttcagccgtgttctcgtcgggatagggagtatgctcgtcgtgcaaccgagcccgatgctgatcacagaattggcgtacccgacacaccgtggcaagtatacctgtgctttctggacgatgtactatctgggggcgatcttggcaagttggacctgctacggaacacagaaacatctctcaaatgactggacgtggcgcgtgcccagcatcatacaggccgggtttcccctcgtgcaggttgggttgtggtgggttgtgcctgagtcaccgaggtaaaccactgagcaattttccctcttttcttttattttgtcctgatctgtttctaatcttttattccttactgttttcttttcccttaccttttttcgtttttatttgtggaggaaaaatagcagaaattctaacgtttctagatggcttgttgccaaaggccgtactgaagaagcaaaaggattgctcgccaaataccacacagctggagacgctttccacccgctaattgagttcgaaatggctgagatcgtgcgcactatagagctggataatcaagctgctgagatgggctggtctgcacttgtgcagacgccgggaaaccggaaacggacctttattgcagtatgcattggtgcctttgcgcagtggaatgtacgttttgccgtcgagtacacccgagacttcctactactctttactgtgtttattgaccagtgcagggagtggccgtggtctcatactatctgaccctcgtcctcgacaccgtcggcgtcaccgacacagacacgcagacgctcatcaatggcctgctgcaaatcttcaattttatcgcggccctgagcgcggccttattcgtcgatcgactcggtcgacgaaccctcttcctctggtcggcagtgggcatgctcgtctccttcataatctggactgcatgctccgccgtctttgacagcagccaggcctctgccctcggccggactgtcatcgcattcgtcttcatcttctacttccactacgacatcgcctatacccccttgctactcgggtatccgaccgagatattcacatactcgacaaggtccaagggactcacggcggagctgttgtctgtctacgggagtctgatcatcctagcctttgtgaatccggtagcactggacaatatcggctggcggtattacatcttcttctgctgcttcgatgtcctcgttcttgcggtaacatattttgtctttcccgaaaccaaggggtattccctcgaagagatcgcaaaggtctttgacgggccggctgctgtatcgtcg

SEQ ID NO: 36189 - DNA, 1526 bp, Aspergillus nidulans
cccaagaaggctgttggcggaaagggcagctaccttcggcttgaagatggcaccaagttcctcgactcgacgggcggcgcagccgtttcatgtttgggccatggccacgagaaaattatccaagcgatcaccgagcagttcacaaaggtcgagtattgccatactgctttttttggaacagaggcttctgaaaatctggccagtttacttgttgactcgactggtggaaaactgtccaagttgttcgttgtgagctccggtatgccctccagccctgtttcctttctttctacctactgggatactgacactgctattaaggctcagaagctgtcgaagcagcactcaagctcgctcgtcaatacttcctcgaactgccaacaccccaacctcaacgaacacgattcatcgcccgcaagccttcctaccacggcaccactttaggagccctaggagtcggcggccatgccctccgccgccaacccttcgagccaatcctatcccaaaacgtctcgcatgtttcaccatgttatgcgtacagagggaagaacgatggcgagtcagacgcggactacgtcgcccgactcgcaggcgagcttgacgcagagttccgacgagtcggtccagatactgtctgcgcattcatcgcggagccaattgttggcgcggtacgtgcagttccctttgcatccacaaacaccccaagatttgttgcgtacggtcgatactgacgcaaatttaggccctaggctgcgtccccgccgtaccaggctacttcgccgccatgaagaccatctgcgagaaacacggcgcccttttcatactcgatgaaatcatgtgcggtatgggtcgctgcggcactctgcatgcctgggaacaagaagacgtcaccccagatctccagacaatcggtaaagcgctgggaggaggatacgcacctgtctcgggactcctaatctcggataaggtcgtgcagactgttgacaaaggcactggggcgtttcgccatggccagacgtaccagggacatccgatatcttgtgcggctgcgttggcagtgcagacggttattgtggaagaacagttgctcgacaatgtaaagtctatgggtgagtatctggaaaagaggctgagaggtactttagaagggatgcagtatgttggggatattaggggaaagggattgttttggggggtgagtcccacacatataccctgcaatttttcacctaaatcatacggtgtggatactaaccgggccgtgctggcaggtcgagtttgtcaagaacaaagctacgaaggagccctttagctcagagactgcactagccttcaagatccaggagacaggtatgaaacctgaattcgggatctcgttgtatgctggcacaggcactgtaaatgggacgcgcggcgaccacattatcctggcgcccgcttataatgttaccaaggaggagatagatattatcgttgacacaactgcgaaagtccttgctgacgtttttgcgcagctttaggctttg

SEQ ID NO: 36190 - DNA, 2044 bp, Aspergillus nidulans
atggatacaacagcatcggaagcatccacgggcaatgatggaacctcgccgtccgacaacgcctaccaaacgccgtccagcatgtcgacctatactgctcctgtgacaggaacccagaacaacaccaagaccgaagcttcgatgtcgtctaatgagcggccttcctacgatgaccaggtcgccaaggtgacgtgttttatgatgcagccgctgcaggaaggccagaagggttacgtagtttccatgtcgtggttaaagcgcgttcttgcacggagttccactcatgccgacaatatcgacaagagcgctgcagagggtgaaattggtccggtcgacaactcggaccttgttctggttaccgatccggtcaacgtggggctcaaggatgagcgcgagcaaccattcatccctctgcgtccgggattacagtttggggaagactttgaagttgtgccccaggaaggttgggatctcatcatgcaatggtatggtctcgccgagcagtcgccagccatcgttcgctatgcccacaacaccagcccgttcggtgctgcggagaacatccaatatgggctcaacccgccggtctacactatcctgaagctctcaaacccacaaaagggcgttactccggacactttgcgagacaaagcgaagctgcccgttaagagcttggccagccggcacgacaacttccagacttggctgcggaaggcgaaacggtcggtcaatgttgaccccttggtgaaggttcgtgtttggaggatcctcggaggcctgggcagtgccgctgcatcaaccaacattacccctgctgcgtctcgcagcgcatccccagccccattctcgccacttgtttcaaatgcaggcagcagctatgtccttgacctaaatacattcctctccctttcagaggggtctcagcgagaattactggatgtcaaagatcagtcaaacaatcccaagtataatggtaagatgacgctcgacgccgcaggcctaggcgaacccagcgtcatcgtccttgaagagggcgtgtttggcgccaatagcgacgcggagtgggtatccgacctctcccagcaagccatgaatcgactcggtgtcccgtccggtagcttgaagcccaacaagctgaagagcaagagcccagcaaccagcgggcgatcttctccagtaccagaacccatcaggaaaacccgtaaggacggcaagccccgaggcaataccggtcttagcaatttgggcaatacctgctacatgaactctgctctgcagtgcgttcgtagcgtagaggagctgacttagtacttcctgagtgagtgttaatgatcgtgctgcttgagtcactgctgacttgcgaagacgatgtctataagaaagatcttaaccccagcaatcctttagctcataacggcgacgtggccaaagcgtacgcaaatttgcttcggaatatctacgatgaagcaggacacggctcctttgcaccaaggcagttgaagaacaccattggccggtatggtccggcgttctccggctatggacagcaggactcacaagaatttctcttgttgctacttgacggtttgcatgaggacttgaacaggattcagaaaaagccctacatcgagaatgccgactcaacggacgagatggtgcacaataaagaagctctaaggaatttgccgacatgtgctgggacatttacaaggcacgcaacgattcggtcatcacggatctgtttgccggcatgtacaagtcgactcttgtatgccctgtctgcgacaaagtgagcatcatcttcgatcctttcaacaacctcacgctccaactgccgattgagaacctgtggagcaagagtatcttctacttccctcttgacaagaaaccgatcatcatagatgtcgagatcgacacgaactccagcatcaaggcactcaaggagtttattgctaagaaagcaggctctgatcctgagcggctggtcatgtcagagatctacaagtccaaattctacaggatgttgcgcaatgtcagctcgatt

SEQ ID NO: 36191 - DNA, 3169 bp, Aspergillus nidulans
tctccatcgtcaaaccgaacacgaccatcctcgagaagccaatggatatcatgttaaagtcacggacactcggtcctcctaagccggaggaaccccaaggtcctaaaagccgccttatgattaccacgttagttctaaataacttcaagagttacgcagggaaacaggtagtagggccatttcacgcttctttctcctccgttgttgggccgaatggatcgggaaagtcgaacgtcatcgacgcgttattattcgtgttcggattccgagccagcagaatgcgacagggcaagatctctgcattgatccataattccgccaaccaccccaacctgccgttctgcgaagtggaagtttatttccaagaaatcattgacctccccgggggggagcatgaagtagtcccagattcccaactgatcatctctcgcaaagagtttaaaaacaacaccagcaaatattatatgaatggcaaggagacgaacttcacggcagtgacgacgctgcttcgcgatcgcggcattgatctcgatcataaacgctttttgattctgcagggtgaagtcgagtctattgctcaaatgaagcctaaggccgcaaatgaacatgaagacgggcttttggagtatctcgaagatatcattggcacgtcaaaatacaaacaacctattgaagaggcggcgactgaacttgaagcccttaatgacgtttgtgtggaaaagaataaccgtgtgcaacatgttgagaaggagaagaacgcccttgtggacaaaaaggataaagccctggcctaccttcgtgatgagaatgagttggcccaaaagcagtcggcgctgtatcagatctacatcgatgagtgtgccgataacctccgggttacagaggaggcgattctccagatgcaagagctcttgaacctcgagcttgagaagcatgaaggcaatgaatcaggaatcaaggagctcgagaaagcatacaagcgtgctatgaaagagtacgagcgcatggaaaaggagacgcaagaactagcaaagggaatggcaaagtacgacaaagaaacggtcaaatttgaagagaagaagaaattcctagttggaaagcagaagaagctcgagaaagccatgactagcgctcgcctcgcggcgtcggagtgccaaagtttggtaaagagacacagcgaggctattgagaataagagcaaggaaaccgcggactacgagaatgaagtcgagcatgaggaacaggagctcacaaaaattcgagaaagcctgaaaggcaagacccaagggctctccgaccagattgctgctaagcagaagtctttggagccatgggacgagaagatcaacaagaagcaatctgaactggctgtggctcagagtgagctggatatcctcaaggagaagagcaacgccggggctgttttacttgaggaagcgcaatcaaagattacatccatagaggaaaccattgcgcggaaagaggaagatctacaggaatgcaagacccaacggtccactctcgaggatgaggttgagcagcttcagcacgacttgaagaaatatagcatgaaagaacctgacgtccgcgcgcatgtctccaatgctcggcagaaggccgaagaggctagggcaactgtcgcgagtacgcaaaaccggggaagcgtgctgaccggtcttatgcgccttaaagaatctggccgtattgaagggttccatggtcgactagggaatcttggtacgatcgatgagaaatacgatgtagccatttctacagcttgccctgcgctcgaaaatatggtcgttgacacagtcgaggtcggacagcaatgcattgactacctgcgaaagaacaatcttgggcgtgccaatttcatccttctagatcgtctccccaaacgcgatctgaacaaaatcctcactcccgacaacgttccccgattgttcgacttggtgaagccgaaggatccgaaatttgctcccgcattctatagtgtgatgcagaatactcttgttgcaagagatcttgatcaggccaaccgaattgcttacggcgctaggcggtggagagttgtcacgctcgatggtcagctcattgatacttctggtacaatgagtggtggcggtactcgagttgcccgtggcgcgatgtcatccaaacaggtcggcgatatcaccaaagagcaattagtccagatggagagtgaccttgaagagatggagaggaagtaccagcacttccaagagaagcagagacgtgtggagtcagccttgcgagagaaaacggaagaaattcctcgagcagagaccaagatccagaagatcatgattgagatagatagcgccaagcgcagccttgctgatgctgagcgacgtgtccaagagctgagtgcagcacacaagccctcaaagacggatgcgagtcgagtaaaagtccttgaagaacaaattgttggcctcgaagagcaaattgaggatctccgctcacagaaaggtgggatcgaggaagaaatccaggcgcttcagaacaagattatggaggtcggtggtgttagattacggagccagaaagccaaggtcgacggactcaaagagcagattagtcttctctctgaagaaatctccaacgccgaggttgcgagatctaagaacgagaagcttatcaaaaagcacgaaaatgcccgtgcggaagcggagaaggaacttgccaatgtcgctgaggagcttcagaagttgaacgaggatgttgccaaccaagccaacgatgcatctggatggaaggagaaggtggacgaagcacaagacgtgagtacggccaaaccagctgcgggatggaagctaacaactgctaggccttggaatctaagaaagccgagctcaagaccatgaaggcagaattggacgaaaaggtagcagagttaaatgaaactcgggccacggagattgagatgcgcaacaagctcgaggagaaccagaaagctttagcggagaacgaaaagcgtagccgttactggcaggagaagctgagcaagctgactttgcagaatatcagcgatttgggtgaagaccaacagcctagcgaattccagaccttcaccaaggatgagttagctgagatgaacaaggactctttgaaagcaacaatggttgttttgaaaaaaaaacccaaa

SEQ ID NO: 36192 - DNA, 1521 bp, Aspergillus nidulans
agcttcggacttggcaccaagcaagtagcggataatgagaagtccatcgccactaagacgctaggattcggtgaagaggaatcaactcgaagaaagctcgaacgcctgccaacaccgccgctagatgatgcggacgccagtaaaacagcagaaacgaatgcggatgatgacgacgatgttgatatgcaagatggggagaccgaagaggatgctgccgctgctgctcgtgtagccgctgaacggcgagaagaacgtctacagaacgaatctcttactaagacaaccaacggcaacacgacggcgaaagcagaagaagctgataagatggaagtcgacgctcaggaggaagagcttgatccattggacgcattcatgtctgaacttgccgagtctgctccgccgaaaaagaaagctggtgccaagttctccaaggcacaagaacctgaagctatctttggcgatgagcatgatgtgagcatgactgctgtcggtgaaggtgatgcggaagacttccttgccattgccagtaaggctaagaaaaagaaagacattccgactgttgaccacaataaggtggagtatgaaccgttccgacggaagttctataccgaaccctccgacttggctcagatgtctgaagaagaagcggctaatctgcggcttgaacttgatggcatcaaagtccgtgggttggatgttcctaaacctgtacagaaatggtctcagtgcggcctagggatacagacgctggacgtcattgacaagcttggctttgccagtttaacttctattcaagcccaagcgatcccagccattatgtccggtcgtgatgtgattggtgtggccaagacaggatccgggaaaacaatggcgttcttgatacccatgtttcggcatatcaaagaccagcggccgctggaaaatatggaaggcccgataggtttaattatgacgcctacccgagagttggcgacacagattcataaggactgcaaaccattcttgaaagctttgaatctacgagctgtttgtgcttacggaggtgctcccatcaaggatcaaatcgccgaattgaaacgcggagcggaaatcattgtatgcacaccgggacggatgattgatcttttggcagcgaacgctgggcgagttacgaacctgcgccgggtcacttacgttgttttggatgaggctgaccgtatgttcgacatgggatttgagcctcaggtcatgaaaattctgagcaatgtgcgtccagaccgacagactgtgctgttctccgctaccttcccgcgaaacatggaagcgttggctcgcaagactctaaccaagcccatcgaaatcgtcgtgggcggtaggagtgtcgttgcgcctgagattacgcagattgtcgaagtttgtaacgaagagaagaaattcgtccgcctactagaattactaggtaacctgtattctacggacgagaatgaagacgcgcggtcgttgattttcgtcgatcgccaggaagcggccgacactcttctc

SEQ ID NO: 36193 - DNA, 1195 bp, Aspergillus nidulans
ccggcgtatcaattgacaccgcgcccttcgcttgttgatggaatcccagacaatatcctcgcgttaatcctgccggttgttgcctactgggccgtgtctatgtttttccatgtcatcgatgtctatgatttattcccgcagtaccgtttacatactccggccgaagttcttacgagaaaccgcgcatctcgatgggacgttgtacgagatgtcgtcctgcagcaggtagttcaaacgctcgcaggccttatcttggcctactttgacgagcaggaatacattggacgggaagaatatgacgttgcggtttgggcgcgccggatccgttttgtacaaagaggtctcccctacctgttggctttgttcggtttggatgcctctggtgtggctgcgaacttttctcggaacggacacaagatgctagcgggagctgttgccggtggatattaccctggtgctacccagtccattgtctccagtggtggcattgagacagttgtgcctgcttttaccaactgggaaatgtctctggcagctttcatctcctggtatttcatcccggcgctgcagttcacctggggtatctgtgtcgtggatacatggcagtatttccttcaccgtgcaatgcatctgaaccgttggcttgatggtaagtcctgtagttcgaccttatgaggatatgagcattagctgtgcatcagttcacttccactcgagtcaccaccgcctgtacgttccatacgcgtatggcgccctctacaatcacccagtggaggggctcctcttagacaccgttgcagctgggattggcttcctgacatcgggaatgacacatcgccagagcatgtggttcttcaccttctccactatcaagactgtcgatgatcactgcggctacgctttcccttgggatccccttcagcatgcaaccaccaacaacgctgcttaccatgatatccatcaccaaagctggggcatcaagacaaacttttctcagccgttcttcactttttgggaccgcctcttcaacacccaatggaaaggcgaggtgaagctccgttatgagcggtctcgagaggccgctgaaaaaaagcttagcgagggaggaatgcaacaagactcggatatggagaatagttcatctgatttcgcgcaacctaacggggaagctgccgttgtgtcccccgaggaacct

SEQ ID NO: 36194 - DNA, 581 bp, Aspergillus nidulans
ccctcctacatcgaccttctcccctccatccaaacttgcaacatcacaaaccttccggagaactactttctgaaatactacctttaccacgcccttacttggccgcagctcagttttgtggccgtcgtccgcccccgcaatgggtaccccgacggcaagatcgcaggcaattaccccaaagtcgtagggtatgtgcttgccaagatggaggaggagcctacggatggtgtgcagcatgggcatatcaccagtttgagcgttatgaggacacaccggcgactgggaattgcggagaggctgatgaggatgtcccgtacgtttactccttaccgcaggggggtggtgggtttgtaacgtttgttgctgacggtttggtttttagagagggcatggctgagtcgcaccgcgcgcaattcgtttctctgcatgtgcgtgtctccaataccgctgcgctgcacctctaccgcgatacactgggcttccaggtcgatagcgttgagagcaagtattatgctgatggggaggatgcttacgcgatgcgcatggatctttcaaacatgtggcttgattgggcggagatc

SEQ ID NO: 36195 - DNA, 2034 bp, Aspergillus nidulans
aatgaggacgactttctcttcgcgagaacgatggtcggagtattcaagaacattgagcacatgtgttcaaggactcgaagcaagacctggggcaaagatgcctggaagaagattgtggtctgcgtcattagcgacggtcgtgctaagattaacccgcgaacgcgcgcggtcttggctggtctgggatgttatcaggatggcatcgcgaagcagcaggtcaacgggaaagacgttacagcgcatatctacgagtacacaacccaagttggcatggagttaaaagggaatcaggtccatctcaagcctcgctcgggagtgccggtgcagatgattttctgcctcaaggaaaaaaaccagaaaaagattaactcacatcgctggttcttccaggcttttggccgtgtacttgaccccaacatctgtgtcctactcgatgctggcacgcagcctggtaaggattcgatctatcgtttgtggaaggctttcgatgttgagccgatgtgtggaggtgcttgtggtgagatcaaggtcatgttagaccatgggaagaagttgttcaatccactggtcgctgggcagaacttcgagtacaagctcagcaacatcctggataagcctttggaatcggcttttggattcatttctgtgcttccgggtgccttctccgcctaccgctatattgcactacagaacgataagaacggccaaggtccgctggagcggtacttcctcggtgagaagatgcacggcgccaatgcaggcatatttactgccaacatgtatttggccgaggaccgaatcctatgtttcgaaatcgttactaaacgcaattgccgctggctacttcaatatgtcaaatcctcaactggtgaaactgatgtgccggatcagatggcggagttcatcctccagcgtcgtcgatggctgaatggtagtttctttgcggccgtctatgccattacacacttctatcagctttggcgcagcgaccacagcttcattcgaaagttcatgttgttgatcgagacgatatatcagacgattaacatgctgttcgcttggtttggcattgtaagtcctctctttggatacattggagcctactaattgctatagggtaacttcttcttggttttccatatcctcacaacgtatcttggcgatgcagacctcctaggaactgctggtaaggtcttgggagtagttttcgaatggctctacctcgcaaccctggtgacctgcttcgttctatccctgggtaatcgtcctggcggctccaacaaactatacatgacgatggtgtatttctgggttttcatcatgatctacctcgcgttcgctgcggtcttcgtgacggtgcggtccattcaagaagaagttaaggatggctcgtttaccttttcgacgcttttcaccaatagcactttcttctctataattgtctcgctgggctcgacgtacgtcatgtggttcatcgcatcgattattttcatggacccatggcacatgtttacatgcgtaagtctcgacttgtgatgttcttcaatatggttctgacatttgcagttcattcaatacatccttctaacccctacctatatcaacgtcctgaacatctacgctttctgcaacacgcacgacataacatggggtacgaagggtgatgacaaagccgagaaactaccatcagcaaatctcaagcccggtggtaaagtcgacgtcaacattcctcaggatgacggtgatcttaatgcccagtatgaggcggagctcatgaaattcgctcagaaaccacccaaggaaatcaaaaccatttctgaggaggaacgtcaggccgactactacaaggggttccggtcctccgtcgttctcgtctgggtattttgcaattttgctctgggcgctgttgtcctcagctcggccggactggatcgcttcagtgatgacgccgaggccgcggagacagataggaacaatcgggccatgatttacatggccgttgtgctatggagtgtggcaggtctctcgatcttt

SEQ ID NO: 36196 - DNA, 2296 bp, Aspergillus nidulans
ctgatgattgacgcatggtttgccctggagccagtgggcagaatccatatatcaatgagctttggtaattttatttatctaactaagtttgattcccatgctaacatgccgtccagccaagcactcgaaggaccgacgaccgttcgacatcggtctcaaccgtcaaggtgcggtccgacagaggaaggaggaagtacacgagaagcaaggtcacaagttcgtcacgcagcaattctacaacatcatgcgttgcgcgctttgcggcgatttcttgaaatacgctgctggaatgcaatgttccgactgcaagtatacctgccaccgaaagtgctaccccaaagttgtcacgaaatgtattagcaaggcgaactacgagacggatcccgacgaggagaagatcaaccaccgcatcccgcatcgctttgaagggttttccaacatttccgctaattggtgttgccattgcggatatttactgcctttcggtcgaaaaaatgccaagcgctgttcaggtaaggagacctgccataattacggcagaaagaaatggctaatttttctcgttagagtgtggtcttacctgtcatgcgcactgtacgcatctcgtacctgatttctgtggtatgtccatggaggcagcgaaccagatcctagagacccttatccgccacaaaaaccacaacaagtctccttccgtcagctctggattgagtgggaagacgcttcgacctggcggctctcaagatgcaggtcatgcatacccaaagcctgtggaaagcccatcatcctatggccagcgaccaccgtctgccgaagcagtgagtgccgcggcgacttcatatatcccaccaccacaatcgcctacttctcaacgacaaccattacccccacgaacttcttcgtcaagtcctgccgctgccgctgccgccgtggcgacaggacgtatgcctggtaagtagcagggtcttgctcttctgttgcgcaggtattaacaccttaaaaatagatgcaggccgacctgttcagcccccggcccatgctcattacgaccctgctgcatacgcatcttaccagcaaggcgctatgcagcaaggttacccgccagcccaggcaatgcagaaggtcaatgcgccagcgcagtacggcatgcatgcgcccccaccgccgcagcaacagcaacagcaaatgcaggcaatgcaacagcaagtggctgcgaaagaagatattccccagcaaccgaaggtcaggattggcctggaccacttcaacttccttgctgttctaggaaagggtaactttggtaaggtcatgttggccgagaccaaggctaccaagaaactatatgccatcaaggttttgaagaaggagtttatcattgagaatgacgaagttgagagcacgaaatccgaaaagcgagtcttcctgatcgccaacaaagagcgccacccgttccttctcaacctccacgcctgtttccaaacggaaactcgcgtttactttgttatggagtatatcagtggtggagatctcatgctgcacatccagaggggtcagttcggtctgtagagagcgcagtatgcatccccacctagtttaaatttggcgatacaactgacgtaattttccaggttctatgcggcggaagtgttactggctctgaaatacttccacgagaatggcgttatctaccgtgatttgaaacttgacaacatcctactaactctcgatggccatattaagattggtgattatggtctctgcaaggagaacatgtggtatggatctactacaagcaccttctgtggtactccagaattcatggctcctgaagtatgatcacctcgctcaatttgaattctgggatgctaatgacttgcagattctccttgacaagaagtacggcagggccgttgattggtgggcttttggtgttcttatctatcagatgcttctgcagcagtctccattccgtggagaggacgaagacgagatctacgatgccattcttgcggatgaacctctctaccccattcacatgcctagagactcagtttctatcctgcagaagctgttgacgcgcgagcccgaactgaggctcggttccggccccacggatgcgcaagaagttatgtcccacgcctttttccgaaacatcaactgggatgacatctaccataagcgcgtgccgccaccgttcatgcctactatcagcagcgccacggatactagcaacttcgaccaagagtttaccagcgtcactcctgtgctaactccagtgcaatcaggtaagacactt

SEQ ID NO: 36197 - DNA, 2707 bp, Aspergillus nidulans
atggccactcccttcctcgtctcctacgaccccgcctccgcgtccggcggcctctccctccagcagatcgcctacttcggccgcgttctgatcaaggctaccgacctcgcccaggctgagacctttatccgacaaaatttccgcctactcgatatctacgtcgacgcaactggcatctccgcaacgggcgatcttgtcgacatcctcaacgccggcgcggccaagatcttcatctcccttgaccaattgaatgccctctccgaagaacaatccgtcccctcgtcacggctcgttgtctacacttcttccaacgaccaagtggaagcgtttcagaaatgggtggttaagcacattgagcgcgaagaggccggcctgtgcacggactcggccgttgtccactctatctctgtgaagctcggactgaacccggaagcccagcttctctaccgtacatattctggagacgtgaccgaggatgcggtcaaggatacaatgaagcagggaggtgtcagtattgttcctgcggccgctctgactatcagccgcgaggagtccagtgggaagatccaggcgggttctttgattctgcgcggggtgtcaaggaccagggtaatggtctgtatgccacaacagtaacggacgagaggggtacttgcttggggtttgtgtggagtagcgacgagagtatcgcggaggctctgcgtacaggcaccggtgtctaccagagccggaagcgtggtctgtggtacaagggtcaatccagcggtgacgtacaggagttgatccgcatcggatttgactgcgacagcgactgcttggttttcatcgtgaagcagatcggaagaggtaggacgtctcgtcacttacgtacacctagtgctgactttcaggtttctgccacctcggcaccgccagctgtttcggaccttacaccggtttatcacgcctccaaaagacgctacaagcccgcaaggccgatgccccggccggctcgtacaccgcgcgactgttcaacgagcctaagcttacacaagccaagatcatggaagaggctgacgagttgtgtcgtgcggaaacaaaggaggatatcgctttcgaagcagccgatcttttgtactttgcgctcacccgctgtgttgccgccggtgtcagccttgaggatgtcgagagaaaccttgacttgaagagcctaaaggtgaagcggagaaagggtgacgccaagggcccttgggcagagaaggctggtcttgccgagaagcctgctgaagcgaacgctgctccgaagccagaggagccaaaggaagacacgtctcggatcgagatgacccgtgtcgctaccgcttcgacgccggcggagaaggtccaggagtacctcaagcggccatcgcaaaagtcaaacgacgccattgtcggccttgtcaagcccatcattcaggatgtccgtgagcagggtgatgctggtgttcttaagtacacacataagttcgaaaaggccacatctttgacctcacctgtcctcaaagcaccgttcccggccgagctgatgaagctgtcaccagaagttcaggaggcgattgatgtcagtatttccaacattgccagattccacagcgcccagaaaggcagcaatgatgcattgtcgatggagaccatgcctggcgtagtctgctcccgcttctcgcggcccattgagcgtgttggttgctacactcccggtggaacggccgtgctgccatctactgcaatgatgcttggtgttcccgccatggttgccggctgcaagaagatcgtctttgcctctccacctcgtgccgacggcagcatcacccccgagattgtctatgtcgcacacaaggttggagcggagagcatcgtccttgctggaggcgcgcaggctgtagcagccatggcctacggtactgagagcgtcagcaaggtcgacaagattttgggacctggtaatcagttcgtgaccgccgccaagatgttggtttccaacgatacctccgctggtgtcagcatcgacatgcctgccggacctagtgaggttctcgtcattgccgacaaggcgccaaccccgccttcgttgcttcagaccttctcagccaagcagaacacggtgtcgattcccaggtcattctcatcgcgattgacctgaacgagcaggaactgaaagccattgaagatgaggtagatcgccacgcccgtgctcttcctcgcatggacatcgtccgtggatccctcgcacactccgtcacctttgttgttagggaccttgatgaggcaatggctctgagcaacgattacgctcctgagcatctcatcctgcaaatccagaatgcagaggccgctgtcgagaaggtccaaaatgcgggatctgttttcatcggacagtggacgcctgagagtgtgggtgactactctgctggtgtcaaccactcattgcgtacgttcccaactcctatgattcttttaccaccgattctaacttctcttcctagcaacatatggctacgccaagcagtactccggagtcaaccttggctccttcctcaagcacatcacctcctcaaacctaacggcggatggtcttctgcgtctgtccaagactgtcgagacgctcgcggctgtggagggattagatgcccacaagcgggcagtgagcatccgtgttgcggctatgaagcaggagcagttgtagtaaaga

SEQ ID NO: 36198 - DNA, 879 bp, Aspergillus nidulans
aaactcgagcattttagcatggccaagaatcctctctcgtcacttcctccgtctatagggtgtttgaccgagctcaagtaccttaatctgagagagtgtaacttgcgaaggctgcctcaagagatctggtattgtctgaaactagagactctcaacgtctcatcaaacgttctggatagctttcccaagcatggcggcccgccacctcagcttccgggcgaggctactgctggtactactcccgcgatgacacccggtggctcagttacgccgagttatgatgacttgggcactgtagaagagcaggaaacacggcgtcccagccaggcatctggcagcgcgcccagtgggagctctcccggtggtgggagcactcgaaaaccgtcggtcgcctcctctcttagtcagggaggaaggaaggtctccactgcttcgaagttcgcagaaggcagcccatcatccaggaaagattcgaatttctctcagcatgtggccactacatttggtggctcgctccggaacttgtacctggccgataaccggctcgaggatgacgtgtttcgtgaactatcatttatccctgagttgcgaatagtgaatttgtcgtataacgtgctgaatgaaattccgcctgggctactgaaacgctggcctctacttacggagctatacctatctggcaacgagctaacctctgtggcctcagacgacctataagaagggagtcttctgaagatccttaacatcaatgccaatctatttcatgttcattccgcggaactgtgcatagcgagcaagctctctattctcgacgttggtagcacctactggaaatacagcgtgtcggactggtcctatgactggaactcgcatttgaat

SEQ ID NO: 36199 - DNA, 1571 bp, Aspergillus nidulans
ttcaatgcgacagaggatccgcgtttctacaagcctatcgacacctacgagggacttcaccgctgggacccggactttgagtggacggaggaggaggaaaggaggattgtgcgtaaggtgagcccacagctacctatggccattaaagacaatatcaaaatcataaatcaccaaaaaacaaaagagaagaaggctaagagggaccagatcgacgcgcgagtttgcacttttgcctgcgtcaccttctttgcgctgcagctcgaccggggcaatattggcaatgccctggccgacaacctcctccaagacctccatatgacgaccaacgactacaacactgggcagaccatcttcctctgctgttttctcttcgccgagctgccttcgcagctgatctccaaacgacttggccccgaccgctggatccccattcagatggtcgcgtggagtctcgtcgcggcgtgccaggcctttctcaagacccggtccggctacttagggctccgcgccctcctgggcctgctagaaggcggcttcatccctgacacaatcctctttctctcctttttctacaagtccagcgagctgcctaaacgtctgacctgtttctgggtttcgtacaccgtcaccaccatcatcggcgcgtttctcgccttcggcctcctacacatcaaggactctaacggcggcggctcgtggaggtacctctttgcgtatgagggcctactcactggagtcattggcatcatagcggccttctggatgccggcctctccgacgcagaccaagggcgggtttcgtgggaagggcggctggttcaccgagcacgaggagaagattatggtcaaccgggtgatccacgacgacccgagcaaaggcagtatgcacaatcggcaggccgtgacgcccaggctcctctgggactcactcaaggactaccacatgtggccaatctatatcctcggcttcgtgtggatgatcccctacacaccagagaccaactatcttactctgcagctccgctcacagggcttcaccactttccagacgaacctgctcacgatccctgctgccgttgtcagcatcaccaccatgatcaccacgacctggctagctgagcgcacaaaccaacgcctgctcttcggcgccgccatcgaagtgtggtatcttgttctgctgatcgcattgcagaccttgcctgagaagagcatgccatggccgcgattcgcgatcctcaccctgatcgtcggcggaccgagcctgcaccctgtgttggtggcgttgacttcgagaaatgccggctctgtgcgcacgcgcactgtggcatccgcattgtataatatgagcgtgcaggtcagcagtattgcggcagcgaatgtattgcactcctactctcctttattcaccccagatactagttttgctgaacagtactgcaggtgtaccgaaccgaagatcagccgtactacagaaagggcaacaaagtgctcatcgcgctagcagtagtcagtatcttcttgttcatctcggccaaagtctactacgtctggagaaacaagtacggcgattca

SEQ ID NO: 36200 - DNA, 1620 bp, Aspergillus nidulans
attacagtgaagtttgagggtgagaagcttcccgccattctcaacgccattgagaccgagaacaacggccagaagctcgttctcgaggtttctgtatgtaattgatatcaagaaaccgattgataacaccaagttctgatggctgacactttcaaagcaacacttgggtgagaatgtcgtccgtaccattgctatggatggtaagtcgcttcctttctggcgtgaaacttcgtgtgatcaccatgtctttgctcaagatattgatatctccgttctaggtaccgagggtcttactcgtggtgctcccgcccgtgacactggcgctcccatcaccatccctgtcggccctggcacccttggtcgtatcgtcaacgtcactggtgaccccattgacgagcgtggccccatcaaggccaccaagtatgcccccattcacgctgaggctcccgagttcaccgagcagtccaccactgctgagattctcgtcactggtatcaaggttgttgaccttcttgccccctacgctcgtggtggtaagattggtctcttcggtggtgccggtgtcggtaagaccgtgttcattcaggagctgattgtaagtttcgtatctgggacttcacacgaaaatgtctaatttctctttagaacaacatcgccaaggctcacggtggttactctgttttcaccggtgtcggtgagcgtactcgtgagggtaacgatctgtaccacgaaatgcaggagaccggtgtcattcagctcgatggtgaatccaaggtgtctctggtgttcggtcagatgaacgagccccccggtgctcgtgcccgtgtcgcccttactggtctgaccattgctgaatacttccgtgacgaggagggtcaggacgtgctgctcttcattgacaacattttccgtttcacccaggccggttctgaggtgtctgcccttctcggtcgtatcccctctgccgtcggttaccagcccactctggccgtcgacatgggtggtatgcaggaacgtattaccactaccaccaagggttccattacctccgtccaggccgtctacgtgcccgctgacgatctgactgaccctgcccccgccaccaccttcgctcacttggatgccaccactgtcttgtctcgtggtatttctgagttgggtatctaccctgctgtcgaccctcttgactctaagtctcgtatgctggacccccgtattgtcggtgaggaacactacaacaccgccactcgtgtccagcagatgcttcaggagtacaagtcccttcaggatatcattgccattcttggtatggacgaactttctgaggctgacaagcttactgtcgagcgtgctcgtaagcttgagcgtttcctctctcagcctttcaccgtcgcccaggtcttcactggtatcgagggtaagctcgtcgaccttaaggacaccatcgcctctttcaaggctatcatgaacggtgagggtgatgaccttcctgagggtaagtgtattcttttgtttctattcatcgactccatcactaacttccttatagctgccttctacatggttggtgacttggcctccgcccgtgctaagggtgagaagatcttggccgatctcgcc

SEQ ID NO: 36201 - DNA, 723 bp, Aspergillus nidulans
gatgttcccacccttttaccgacctcctgcacccttggccccatgatgaaacgggaagattcaagagatggattagtcatcaagaagggtctgccgaatatgagtttggctgaaatgccggcaggttcagtcgttggaacatcttccatccgccgcaccgcccaactcgctcggaaatacccgcacctgaaggtgatggacgttcgtggcaacatcggcactcggcttgctaagcttgatgcagaggatagtccgtacacttgtcttatcctggctgccgcaggcttattgcgtctggggctcggagatcgcatctaccagtacttggactcaaggaacgcggggatgctgtatgccgtgggtcagggagcattgggcattgagattcgcaaaggagataaggccatggaggatattctgaacactattggtcataaggagacaacctttgcttgtctagctgagaggagtctcttgcggactctagagggtggttgcagcgcgccgctaggagtagagactgagtggattcaggacactaacgggtcatcgaaactgcggatgaggtctgtcgtcgtcagcgtggatggtagtgaacatgctgaggtcgagattgatggaacagttgactcacctcagtctgctgaagaattcggtgtcacggtagccaaagccctggtcaacgaaggagccgggaagattctctcagaaatccagcaaaac

SEQ ID NO: 36202 - DNA, 2732 bp, Aspergillus nidulans
aaagcacgccatgacgaaagcttgaaagctgtccaatcggcaattgaagagcgccagacagaactcaaagagctcgttccccgtttcatttcggccaaagatgcagaggacgctgccagagctaaacttacggaagctgaaacagcccgccaaaggctgtatgctaagcagggccgaaattcacgcttcaagaacaagtctgagcgggataagtggctacaggcggagataaagaataacaacgcttctatttcgagcgtgcagtccgtgttgtcgcagacacaggaagatatcaatgatatcgagaatgatattgctctcttggagccggaaacggaacgcctgcgccagcagatcgatgggaggggcgatactattcaaagcgtggaacaacaggtacaagcggccaaggatgaaagagacagactcatggaccagaggaagtatgttgattggcctagaacctcatgtgcaacgctgactatccatagggaactttggcgagaagaagcaaaacttgactcgattctgattaatgcctcaaacgaagttgatcgtgcagagcgcaatttgtctcagatgatggatcacaacaccagccgtggtattgctgctgtacggaggattaaacggcagcacaatttggaaggtgtttacggtacacttgcagagctatttgaggtgaatgacagataccgcactgctgttgaggttacagcaggccagagtttgtttcactacgttgttgacacagacgatactgctaccaaagtcctcgagatccttcagcatgaaaaggcaggaagagttacgtttatgcctcttaaccggctcagaaccaagccgctcaatatgccaaaagccagcgacacgatcccgatgattgagaagctacaatatgaccgtgcatatgaaaaggcttttcaacatgtattcggcaaaacaatcatctgtcccaatcttcaggttgcttcgcagtatgctcgaagccacggagttaatgccaccaccccagagggggatcgctctgacaagagaggtgctcttaccggaggtttccacgactcacggcaatctcgtctcgacgcggtgaagaacctcgccaagtggagagacgagtatgaaactaagaagagccgcggaagtgaaatccgcaaagagctcgaggagctagatcagctcattaccagggctgtcggcgaattacagaaactggaacagcaaaggcaccaggtacaaaacagcagcgggccgttacgccaagaattgagaagcaagcgcgaccttctacagaagcaaaatgataatctggacgccaaacggagagctcttcggaacattgaaggcaaccttgctgctctaaaggatcaagtcgacgcattcgaagctgaactctcgtcgcccttccacaaggctcttaccgacgaagaagaggcccgccttgagtctttgaactctaatgttcaagaataccgtcgagaatatcaagagctttccggaaaacgaagtgagctagagactcgaaagtcagtgctggaggtcgagctgcgggagaacttgaaccctcgcctagaccagctcctggctcaagacgcagatatagctgatgaagatggccaagggaacatcaaggaaacacagcgcgagcagaagcgcctgacgaaggttttggacaagcttgctcaaaggcttgcacaggtagacgagtctatggaacaagcaaactcacgcgtaacggaacttacccaacgcaatgcggagtcccgacgggagttggaggagcttgctaagtccatcgagaagcatcaacgtcgaatggagaagagtatgcagaagaaggcagccttgacgaagcaggcggctgaatgtgctgccaatatccgtgaccttggggtcttgccggatgaagcattcaccaagtacaagaatacagactctaacacggttgttaagaagctgcataaggtgaatgaggcactcaagaaatatgcccatgtcaacaagaaagcgtttgagcagtacaacaacttcaccaagcagcgagagacacttaccagtcgaagggaggaacttgacgcttcgcaaaagtctatcgatgacttgatctctgtgctggatcaccgaaaggatgaagcgattgagagaacattcaagcaggtgtctcgtgaattcgctactatctttgagaaacttgttcctgccggccgagggcgtttgatcatccaacgtaaaacagatcgtacccagcgggcggaggacgatcttgagtcagaggatgaggaagcgaagcatagcgtggagaactatgtcggagttggaatcagcgtcagtttcaacagcaagcatgacgaccagcagcgcatccaacagcttagtggagggcagaagagtaagtcccctgtccccatttcatgtagcccattgttctaacatagacaggtctctgtgcgcttgccttggtcttcgctatccaggcttgtgacccagctccattctatcttttcgacgaaatcgacgcgaatctggacgcccagtacagaactgctgttgcacagatgctgaaaaccatttccgactccacaaacggacagtttatttgcacgaccttccgaccagagatgctgcatgtcgccgagaagtgctacggagttagcttccgacaaaaggctagtacaatcgacgtcgtgtcaagggaagaggcactcaaatttgtcgaggagcagaagtcataa

SEQ ID NO: 36203 - DNA, 798 bp, Aspergillus nidulans
acccagattctcgccctcgctctgtcgattgcttccgctgaggccgtctccaagggcttcaactatggagccaacaagcccgatgggaccctcaaggtccaggccgatttcgaggctgaattccgtactgcgaagaacctcgagaccacttctggtttcaacagtgcccgtctctacaccatgatccagggcaccggcagcaccccgatctccgctattcccgccgccatcgctgaagagaccaccctcttgctgggtctctgggcttctggggggaacatggataatgagattgccgccctcaaggcggctatcaaccagtacggtgacgagttcgccaagcttgtcgtcggtatctctgtcggcagcgaggatctctaccgcaactctgagatcggagtccaggctaatgccggtatcggcatcgagcctgaggagctcgtctcctacatccagcgcgttcgcgaggccatcgccggcaccgccttgagcggcgctccgatcggccacgtcgacacctggaacgcctggaccaacggctctaacgccgctgttgctgaggccgtcgactggctcggctttgacggctacccgttcttccagaacaccatgcaaaactccattgatgacgccaaggctcttttcgacgagtctgttcagaagaccaaggccgttgccggcaacaaggaggtctggatcaccgagaccggttggcccgtcagcggtgactcgcagaacctcgctattgcgtcggtcgagaacgcgaagcagttctgggacgaggtcggctgtcctctt

SEQ ID NO: 36204 - DNA, 1702 bp, Aspergillus nidulans
ttcattggtgccattgaccagggtactacgagtacgcggttcattattttcgactgcgtgggcaaccccgttgccaaataccaggcggaataccgccaactccacgagcattcagggtatgactctcatggtttcggctcgcctgccactttgtttgctaacgtctctttccctcgcttagatggcacgaacaagatccgtatgagatggtagattccgtctacacgtgtattgaagaggccatgaaaacattcctcgcccttggtcattctaagtcagatattgaagcaatcggtctcactagccaacgtgagacagtcctctgctgggattgggaaactggtgaacctctatgtccctcgattgcttggcccgatacccgaacaaaagcccttgttcgagaattgaaagcacaaaaaggcgccgatgaactgaagaacatttgcggtctgccactatccacatatccttcgtctgtctcattggtctggctactccgcaacaacgaggccgtgaaacaggcgtacgaggaaggacgacttgcttttggcactgtcgattcatggctcatctacaacctgaacggtggtctagagggtcgccaccacgtaacggatgtgaccaatgcctctagaaccatgttgatgaacctcgagacgctcgattatgataaacgacttctggacttctttgggttagaccccaagaagatccggctgcccaagattcttccatcctctgaccctgaggggttcggatatgtacggtcaggccccttagaaggagttccgatcactagcgaccttggagatcagtctgcggcgcttgttggccactgtgcgtttactccgggcatggcgaagaatacctatggtactggatgcttcctcctgtacaacgttggcgagaaaccggttatttcaaagcatggcctgctcggtactgtcggatttcaattaggaaagaaccggaagcccgtgtatgcacttgaaggaagtgtggccgtcgctggtagtggtgtttcattcctcatgaacaatatgggctttttccgagactcacgtaaagtgagtgacttggcggcaatggttccagacaacggagggtgtgtcttcgtcacagccttcagtggtctctttgcgccatactggattgatgacgccaagggaacaatttgttagtatattctcaattatttactggactgtaactgatcagctctagttggaatcacgcaacatacccaacgtggtcacatcgcacgtgcgactatggaggccgcctgcttccaaaccaaagcgattctcgatgccatggagatggacagtgggcactccctctctcagctcgccgtcgacggaggaatgagcaactcggatatctgcatgcaggtgagttgcgaacttaatttcgtactatcagtataaaataagctaacttctttgcccctcagacccaagcagacatcattcaaattcccgtcgaacgaccggccatgcatgagacgacagcgctgggcgcagcaatcgccgccggcttcgccatcgatatctggaaggaatttgatgaacttaaaaacatgaaccgcgccaaccgaacctcattcacccccgcaatctcccgcgaacaaagccagaagatgtataaacagtggacgaaagccgtcgaaatgtctcgcggttgggtggataccaaggagatg

SEQ ID NO: 36205 - DNA, 1767 bp, Aspergillus nidulans
gaagaaattcgccaatcctttgataacgattttgcgtctcttctccgagacgtcgagcagcggaaccggcgtggtgcgaacggcgatgcgcagggccagcagtcgtttctcgaactgaacatcggtttcgtgtctggtgttatccctcgcgaccgaattggtgcttttgagcgtattctctggcggacgctccgtggtaacctctacatgaaccaagctgagatcccggaccccatcgtcgacccgaccaccaacgaggagacgcagaagatggttttcgtgatctttgcacatggaaagaacattattgcaaagatcaggaagatctcggagtcccttggtgcttcgctttacagcgtcgatgagaacagcgaactgcgtcgggaccagattcatgaggttaacacgaggttgagtgatgtcaacaatgtcctgcggaacacgaagaacactctcgacgcggagctttctcagatcgctcgctccctggccgcttggatgatcattgtcaagaaggagaaggccgtttacgacaccctcaacaagtgctcgtatgatcaagcgcgaaagactcttatcgcggaagcttggtgtcccacaaactctctgtcgttgattaagtcgactttgcaagatgtcaatgaccgtgctggtcttagtgttccttccatcgttaaccagattcgcacgaacaagacgccgccgacttatgtacggaccaacaaattcaccgaagcgttccagaccattgtcgatgcgtatggtatctccaagtactccgaggtcaaccccggcctgtacactgtcgtcacgttccccttcctcttcgccgtcatgtttggtgatttcggtcacggcttcctaatggctttggctgctgccgccatgatcttctgggaaaggcagctctcaaagacaaagctcgacgaactgacgtatatggctttctacggtcgctacatcatgttaatgatgggtatcttctcgatgtacactggtctcatttacaatgatatcttctccaagtccttcaccgtcttctcgagttcctggaaatggcctgacaatattgaacaaggccagtctgttgaagcgtcactcaagggcagctaccggttccccttcggtctagactggaactggcacgaggccgagaacagtctgctgttcaccaacagtttgaagatgaaaatgagtatcatccttggttgggcgcatatgacctatgctcttatcctgcaatacgtcaatgctcgccatttcaagtccaaagtcgacatcatcggcaacttcatccccggcatcatcttcttccaatccatctttggttaccttgttcttactatcatttacaaatggtccgttgattggccggctagaaaccagtcaccccctggtctcctcaacatgctcatctttatgtttctgtcccctggaaacgtcgaagaggagctctatcctggccaaggcggtgtccagctttgcctattgctccttgccgtcgcacaagtccccattatgctattcttcaagcccttctaccttcgccgcgagcacaatcgtgcccgcgccctcggctaccgtggcctcggcgaacaatcccgcgtcagcgccctggatgaagacggcgacctcgacggcccccgtcaaagcacggcaagtgacggcgaaggcgttgccatgattgcccaggacctcgaagaagagcacgaggagttcgacttctccgaaattatgattcaccaggtcatccacacgatcgagttc

SEQ ID NO: 36206 - DNA, 1291 bp, Aspergillus nidulans
atgactagtcgtgacggttatcaatggacagcagagactggcctggtccagggcgtgccttcgatcagtgtcatctcgccaccaacgaatatctctcccgagtcccgccagtatgacgtcgttgtcgtaggagcagggtattcggggctcacagcggcccgcgatacgtgtctcgcaggtgagtgcggattcaagacaaatgaaagcagagggctaatatatcctaggcctcaaggtgctgcttctcgaagcgcgtgaccgtattggtggccggtcatggtcgtctgatatcggaggatatccattcgaaatgggcggcacctgggtccactggggacagcctcatgtttggcgcgagatttcaagataccagatgcggaatgaattggagagttcattcgacttttctcgcggggtcaaccattttgaactgcggaccaaccaaggaccagcgattatgagccacaaggaagaggtgagtatgcttgcgcgtacgggcagcttgacgctaacgagatccccaggatgaactgctggccgcagcactacacaagttcgtggacgtcgatggagatcttggccgccgggccgttcctttccctcatgattcattccatgtccctgaggctcggcaatacgaccaaatgtcggcaaaggatcgtatgactcagattgccgattctcgtgtcacctcgtgagcgagccgctctagagagctttgtgcttctctgtagcggcggcactttggcgacaacgagtttcttcgagttcctgcactggtgggctctgtgcggctactcataccaagggtgtctggacgccttgatttcttataagttcaagcggggtcagtccagctttgcccttcgattctttagagaggcgctctcgacaggaaacctgtcatacgccttcaacagccccatacagtcgattgacgaccagggcgccaaagtggtggtcacgactcgtgaaggccatcgctatgctggggcccgtcttatctcgactataccgctcaacgtgctaaacacagtcaccatctctccgccacttggtacgcagcgcacagccgcagcaaataccggccatgtcaaccaatgcgttaaagtccacgcagaaattgcgagccgcgacatgaggtcatggacgggtatctcgtaccccttcacaagctctgctacgctatcggtgacggaacaacaccagcaggggacacgcacattgtttgccttgtgggttttacaaccaccattaaggcggagaggatttcaaacaaacccagacagcc

SEQ ID NO: 36207 - DNA, 1725 bp, Aspergillus nidulans
cgagccctcccaaatgcacccgacggatacgctccggtcaatgtcacctgtccggctgtgagaccgtcgatccggagtgcagcaagtctgtcgccaaacgagacgaaatggctagagcctcgtcgcaaggagatcatctcgccaatgaaaaatctcctcactcggttgaatatttctgatttcgatgcggcggcctatcttggccgggtatctgccgactcctccaatatccctaccgtcgggatcacggtctcagggggcggataccgggccatgctgtacggggctggagccctcaaggcctttgatagtcggacagcaaactcgacggccgagagccagctcggcgggcttctccagtcagcgacgtatctctcagctctcagtgcaggcggctggttggtcgggtctgtcttcatcaacaacttcaccactatcgatgcacttcaatccagcgatcggatctgggatctgcggaccaatgtcctcgaagggccgaatgtcaaacactttcagctcctgtctacggcagagtactggagcgacctggtagaagcagttcactcaaggaagcacgccggcttcaacacttccatcaccgactactggggacgggcgctctcgtaccagttcattaacgcgtcagacggcgggcccagctacacttggtcgtccattgcgttgatggataactttaagaacggccaggtcccgctgccccttctcgtagccgacggccggaatccaggggaattggtggtcgggtcgaactcgacagtgtatgagtttagcccgtgggagtttggcacttttgacccggccatctatgcctttgcgccactcgaatatctcggctccgactttacggcgaatggatcctgtgtgaggggattcgataatgccgggttcgttatgggcacctcgtctagcctcttcaatcaggggctactccgcctgaatagcacgtctatccccgagacctttaagaaggcgctcgcgtcgatccttgaagcagttgggcaggcaaacgaagatatcgccagctacccgaatcccttcaagggctatcagggcagcaccgcggccatttcagccatcagcgagctcaacatcgttgacggcggcgaagacggccaaaacatcccctttcacccactcattcagccggccagacaggtagacgtcatcttcgcgatcgactcgacggccaacattcacaactggccgaatgggaagagcctggttcggacgtacgagcgcagcctgaactcgaccggcgttggcaatgggacggtcttcccaacgatcccagacaccaacaccttcataaatctgggcttgaatcagcggccgactttcttcggatgcgatgcgaagaatctgaccggccctgcaccgttgatcgtctaccttcccaatgcaccgtacacgcacatgtcgaatacctccacatttgacctgagctacagctatgccgaccgcgacgccatgatcctaaacgggtacaatgtcgccacacgcggaaacggaacagtggataggcagtggcctgcgtgcgtggggtgcgcgattcttagccggtctgcgaataggacggggacctcgctgcccgatgcttgcacgcagtgctttcagaactactgctggaatggcacaattgatagtcgccagccacaagattatgcgcctgcactcatgatcaagacgagtgcagcggggacgatc

SEQ ID NO: 36208 - DNA, 1703 bp, Aspergillus nidulans
actggccgggtttggcttgctaagcatgcagtgacaggtcatttttttgctgtcaagattgtctcaaagaaatgcgctgctatatcgcaaagcgatagcattgctgccatggacagaaatgcagggacttttattggagcaggaggtagacagatgccttcggggatcgaaagggaggttgtgataatgaagctcatcgaacatccaaatgttatcagtttgtatgacgtgtgggagaaccgaggcgagttgtaggtgtttgtgggcccgttgccatcaaatacagctgacgataaatagatatcttgtcttggaatacgtcgaagggggggagttattcgactacgtctccaatcatggaccactcccagaagaagaggcagttcggctctttcgacagatcatagccggcctagggtactgtcatcgctttaacatttgccatcgggacctgaaaccggaaaatatcttgctagatggtgagcacaacattaagcttgctgatttcggcatggctgctcttcaacctgcaggccattggctcaatacttcctgtggaagcccgcattatgcggctccggaaatcatctacggccgcaagtatcggggcgacaaggcagacctctggagctgtgggattatcctattcgcattgctcactggtttccttccatttgacggagaggatctacacgccactctacaacttgttcgaaaaggtgactatatgattccaccccatgtcagcgctgaggcagcagacctcattcagcgtatattacaaaagaaaccggacgatcgtatcagcatgaaggacatctggaaacacccgcttctcaaaaagtacgaaaaatttcaccaggctatatgcaaccattatttgggccctccacctcctctgtcaccccaggattgtggtccgcctgtggtaagacaggatatagatgtcgacctgctgaggaatctccaaacactttggcatgatgtaaaacccgaacgtctcattgaaaagctaataagtctggagtaagtgtccgtcctaatgtttttcgaatgcttttctgacaaacttcagaccaacgcaagagcggctgttctaccatgctttagtcaagttcaggaacgagcaactcgagaactacgaaggccagcctctcaggtattcaacgagtgactaccaccatatctcaagaggtcaggctcggctatctaagcacttgcggagccgatcacaaaacggatcacaaaggcgttctcgagccccgtcagtcaaagaaacgggcaaacgtaggccctctacgagagaactaaagccatcagctagcgttgaaacttacgatccttatcggtctccattcaatcgagtaccagataaatcaccacagtacgcccacgttaccattcaccgagaggctccagaaacgagccctaagccggccgaggtggaagtagactcgtcaaatccttttctcgacgatgagcaagaaatagaatgccaacaaagcccaccctttaccttggtgcggaagagaaagcagaattttaactcggttaagtcattccagtcaaaaacgtcgcttatcagttcacgtagagcattgaattctgcatccacgcctcggtctgtcagctacaaacggaatgtgaccttccatcataacagaaaccgctcacaaagctctgcatctgccaaggcaaaaaga

SEQ ID NO: 36209 - DNA, 3177 bp, Aspergillus nidulans
aaagtgggtgagcgtgtcattccctcctttgccgccgaggacgatggcggcgatgcactcatccatcctcggactgccaactacgcagattccaaggttcgactcctcaatccttccgaccattcacccggcgcatacatctacggcgatgaatcgaagcaagcatccaatactagtcgggattttgacggacgctctgacgccggttactcggcgtttaattcgggcgatatgtttcacaacttggagaccagggaacagatgctggaaaagggtaatgaaaaacagatggaagaggtcgacgaagtgccagtatccggcagtcgaaagcgctggatggccatcgtttggctgctcacattctacatcccaacccctgccattcgatacatcggtcggatgaagcgcaaagacatccaaattgcatggcgtgaaaagttcgcaatcaatttgcttatctggttggcctgtgctattgccgtattcatcattgtgggatttccctcgctcatttgtccgacacaacacgtctattcccctgcagaattgtcgtcacacgatggcaaagatggccacagctcctacacttcgatccgcgggcttgtcttggatcttggagagtttatggactctcattatccaggaatcgtgccagactcagcattgaagaaatacgctggtgttgattccaccgcccttttccccgttcaagtttcagcgctgtgtcttggtaaggacggcaatgtggacccaaaggtattgctcgactacaagccgacgaacttttctggctccgttacctcaaccagttccggtgaccccaactcggtgtaccacgatttcagatacttccgcgatgactatcgcccggactggtatgccgagcagatgatctacctcagggcgaactactataagggctggatcggatatagttcggaatacctgcacaccctggccagcaaatctcaaaacgttgcaagcattaacgggaaaatatacgacttgacaagctatattgctggaggtcgccgaatccaaggacgggagggtgacgacacaactggcattgatactgactttatggatagcttggtggttgatcttttccagcagaaggctggcgaggatatcacgaagtattgggaagatctgccgcttacccctaaattgcgtgtggacatgatggattgtctgaacaatctgttcattgtcggccatgtggacactcgaaattcgacgcagtgccagtttgcgcgatacttcatccttgcaatctccgtcctcatctgttcggtcatcgtcttcaagttctttgcagcactgcaatttggaaagaagaatgtacctgagaatcttgacaaattcatcatctgtcaggttccagcctatactgaggatgaagagtctctgcgccgtgccatcgactcgatggcccgcatgcagtacgacgataaacgcaagcttctcgttgtcatttgcgacggcatgatcattggtcaaggcaacgatcgccctacacctcggattgttcttgatatcttgggtgttcccgagtcagttgatccggagccgctcagttttgagagtttgggtgaaggtatgaaacagcacaacatgggtaaggtctattccggtttgtatgaggtgcagggtcatattgttcccttcctcgttgtcgttaaggtcggaaagccgtcggaagtctctcgacctggtaaccgcggtaagcgtgattcacagatggtcctaatgcgatttttgaaccgcgtccactataatcttcctatgagtcccatggagcttgagatgcaccaccatattcgaaacattattggagttaacccaaccttctatgagttcatacttcaagtcgacgccgatactgttgttgcgccggatgctgcaacccggatggtctcttcttgtctcaatgatacccggattattggtgtctgtggagagacatcgctaactaacgccaaaacttctgctgtcactatgattcaagtgtacgagtactatatctcccacaaccttacgaaagcgtttgagagtcttttcggttcaattacttgtctgcctggttgtttcactatgtaccgtatccggtccgccgagagtggaaagccgcttttcgtgagcaaggaaatcgtggaggcgtactcggagatccgtgttgacacactgcatatgaagaatttgttgcatttgggagaggatcgttatctgacgacattgctgctgaaacatcatcctaagttcaagaccaagtacaacttccgagcgcaggcctatactattgccccagaaagctggactgtgttcctttctcaacgtcgtcgctggatcaactctactgtgcacaacttggtggaattgatccctcttcagcaactgtgcggtttttgctgcttcagtatgagatttgtggtcttcatcgatctcatcagtaccataatcatgcctgtcactgttgcatacattgtgtacctgattgtctggttggtgcgagacacatcaactatcccctggacttcattcctcctccttgctgcgatttacgggttacaagcaattatctttattgtccgccggaaatgggaaatgattggatggatgataatctacatccttgctattcccgtgtactccctggctctgcctctctactcattctggcacatggacgacttctcctggggtaacacgcgtatcattactggagaaaagggccgcaagatcgtcatctccgacgaaggaaaattcgaccccgcgtccatcccgaagaagaggtgggaggagtaccaggccgagctatgggaggcccagacctcgcgagacgaccggtcagagatctctggtatctcatacggcaccaagtaccaccccgccacccaatccgaatacggattccccgggtcacggcctatgtcacagcttgagctgcctcggcatatgtctcggatgtctctcgccccgtcagagatgatgagccgccacatggacatggagctggaagacgtcaacctaccgagcgacgacgcgatcctatcagagatccgtgacattctacgcacggccgacctcatgaccgttacgaagaagaatatcaagcaggagctggagaggcggtttggcgttaacctagacgcgaagcggccgtatatcaattct

SEQ ID NO: 36210 - DNA, 749 bp, Aspergillus nidulans
tttgacgtgctgacctcagccttgtcttttcccaccagagaccaggagcaatggtggcgcaagaccggcccaatgtttggtcagatgctcgcctcgtctggctataccctcgatcagcagtatcggcacctcaccttctactacaaccaactcgttccccgcctcggccctcacccagcaacattccattccagtctgactgtcagcgggttacccatggagttcagcatcaactaccagcaaaagggtgcgcatccaatggtccgcattggcgcggaacctatcgactccttttcggggacggaacgggacccatttaatcagatcccgccggccgagatggtaaacacttctccagagcgggagttaaaggattcgatccggagctttatgcgtacttcgagccaaagcattctctaactcgtgagcagcaagccagactaccgaaagaagtacctggtggtgacaagttaaagacgcaatatgctttcgggttcgattttaagggtgatgaggtttcactgaaggggtatagctatcccgggctgaaagccacaatggcaggccaggaagttgcgaagctcgtcggagacggggtcaaggacctgaaaaaccaaggcaaactggactgcaccgaggcctgggcagctgtggaagcctacatgactgaactcaacaactggggctaccacaacctctgggcatgggattacgtcacgcctgcgaaatcacgtctcaagttgtattcc

SEQ ID NO: 36211 - DNA, 1628 bp, Aspergillus nidulans
cgttacgcctgcttgccaggcctcttcatcaacaacgaattcgtccccgccgcgtccggcaagaccctgaccaccgtgaatccctatgacgagtctataatcgcaacagtttcctctgccggcccgaaagacgttgaccgtgccgtcgcggccgctcgccaggcgtttgcctcagaatggcgcggcctcaccccctctgaacgcgggctcctgctcctccgccttgcggacctgtgtgaccgcgacaaggagatcctcgccactatcgacgcatgggataacgggaagccgtacgagcaggcactgggcgaggacatagccgaggtcattgccgtcttccggtactatggcgggtgggccgacaagatccacggttcgacgatcgatacgggcgatgcgaagttcgcgtatacgcgacatgaacccctcggggtgtgcgggcaaatcatcccgtggaattatcctgttatggtatttctcctcttcgagatttctcctttctgaaacatgaaccgcttgatttccagtgctgattgtgtagatggccgcgtggaaattaggtcctgcgctcgcgtgcgggaacaccgttgtcctcaaggccgccgagcagacgcctctctcggtgctgtaccttgcgactctgataaaggaagctggcttcccggcaggcgtcgttaatctgctgaatggcgaaggggccagcgccggcgccgccatcgccggccatcctggtgtcgacaagatcgctttcactgggagcacaaacaccgggcgcgtcattatgaaggccgctgcgggcaatttgaaagcgatcactctagagacaggcggcaagagtccgcttctcgtatttgatgacgcaaatatagaccaggctgtcaaatggtcccatgttggtatcatgagtgagtgccttggaatctagccactaacaggaccgaaatagaagctgattgggagatatataggcaacatgggccaaatctgcacggccacttccaggatatacgtccaagagacgatctatgatacctttgtcgagaaattcaagcagtacacgatcgagaacagcaaggtcgggtcgcaattcgacccctccgttactcacggccctcagatctccaaggcgcagcgcgaccgcatcctgagctacgtgcagtcggccaaatccgaaggcgctcagctggtactcggtgacgagcctgtctctgaaaagggctactttgtcccacccacgatcttcaagaatactacgcgggagatgagtgccgtccgagaggagatatttggtccctttgtcgtcattcagtccttcagtacgcagcaggatgcgattaacaaggcgaatgacactgagtatgggcttggggcggcggtgttcacggaaaatatcacgcgggctcatcgcgttgcggccgcaatccaggcaggcatggtgtgggtaagtgtctggtccttgtctattcttaggatatgccgatcagagtggatgctaagttaagtagatcaacagttctcaagactcgcattttgctatcccctttggcgggtacaagcagagtgggattggtcgggagttgggtgaatacgctctggcagcgtatacgcaagtcaaggctgttcatggc

SEQ ID NO: 36212 - DNA, 824 bp, Aspergillus nidulans
gacatcgtcaaggtccggctccaaacgaccactcaatattccagcgcccttgactgcgcgtccaagatcctgaagaatgagggacccctcgctttctacaagggaacattgacacctttgattggaattggtgcctgcgtaagcctccccaaacacgctctctacatccgcgctcacaaataccccaggttagcgttcaattcggagccttccacgaagcgcgccggcgactggaggagctcaacaaaaaaaagtacgctgacagcgccctcggctacggccaatattacctcgcgggcggcttcgcaagcatcacaaactccttcctctccggcccgatcgagcatgtccgtatccgttttcaaacccagccccacggcgcaggcggccttgataacggacctctcgactgcattcgcaagctcacaaaccaaggcggcttccttaagggtctttaccgcggccaggctgttacctatctgcgtgaagtccaagcttacggcgtgtggttcctgacttttgagtacctcatgaaccaagatgcgaagcgcaacaacgtcaagcgtgaggacatctccagtctcaaggtcgctacgtatggagggctagccggtgaggctctatggttgtctagctacccgatggacgtggtgaagagcaaaatgcaaagcgatgggttcggtgcgcagcagcaattcaagagcatgaccgactgctttaagaaaacgtatgcggcagagggactcgcgggcttctggaagggcattgggccgaccctactcagggctatgcctgtttctgcgggaacattcgctgtgtatgtt

SEQ ID NO: 36213 - DNA, 1490 bp, Aspergillus nidulans
ctaggctacgatgagggtggatacagcgcttctgtgcgcctctactccttcaaggccgacttcaacctcctcgactcgaactggacgaacaacgagaccggcttagcgaaccgcgtagcgaatataacttctttcaatgtcctgggtgcggcacttggcgctttggtttctttagacttgaatgaccggctgggaagactccggtcatggcaattagcctgtgcggtgtggatgtcaggcacattcatccaggcgtttgcctcagggatgtatggactgctgctgtttgctaggatatggggtggactcggtgctggcgcgttaaccgtggcgacgccgttatacttgtcagaaattggtttgtgaagccggccctgggattgagtgtgactgaccgttctcagcgcccgcacgaacgcgaggtctgattgtcagtatttacatggtcgttctgctgacagtgctagctcttggtaaggcgtcctttcttgcatacccattcgtttctaatatggcatttaggcttttttattaattacggcgctaatatccacatgtctccaacacgatcgcaataccgcctagtgcaatctataccattgatccctgtcggggtcgccttcggtgcctcgactatgatcccagagactccccgctatctcgtctcaaaatctcgtctcgaagaagggcggaatgtcctcgctcgcctccgcggattggatgctttgtcccccaaaatcgaagaggagttcagcctcataactacccaagcgcgcttcagagctgacactctttcatccatctccaactggacagcttttaaagaaacgcaatcaaatcccaactatcgtcagcgcttctggctcttgatggccatgcagacgatctcccaatggacgggcggcaatggcataacctactacgtttcgaccatcttcgagtccgctggcgtcacagggaacgctacatccctcgtctcctcgggtgcctacggagtcgtcaagctcgtcttcaccatggcctttacatgggggttgatcgactttctaggccgtcgttattgtgtgctcctcggcttaacactccaactagccgcgcatgtctatctagcctgctacatgggcgttctccgcccaagcgatgatacggagctggtaaacaaacccgcttccaacacagccatcgcagccgttttcatctacgccatcggctggtccattggcctctgcacagttccatacctctacggaacggaaatattccctacgcgcatccggaatgtcagctatgccgtaagcatgtcgcttcactggttcttccagtttgctgtcgtgcgcgtgacgcccaacatgtttgtctcgttgcatgattggggcgcgtacatgttctgggctatcatatgttttgtgggtttagttgtcctcggcatatggatgcctgagactaagggagtggatattgaactgatgggagagctttttgaggggcct

SEQ ID NO: 36214 - DNA, 1295 bp, Aspergillus nidulans
tacgtcctcggcgtgggcatgaccaagttcatcaagcctcgaggcaaggtcgactacaacgagcttggtttcgaggccggtgtcaaggctctgttggacgctcacatcaactacgacgatgtcgagcagggcgttgcctgctacgtctacggtgacagcacctgcgggcagcgtgtcttctaccagtttggcctcacccagatcccgatctacaatgtaaacaacaactgctcgactgggtcgacaggtctcgctatggcccgcaccctcgtgtctcacggcgccgccgactgtgttatggtcgttggtttcgaaaaaatgagcccgggatcgctgcagtcggtatacaacgaccgggccaaccccactggtcttttcggtatgatgatggccgagactcgcggtgtaaccaacgcacctggtgctgcgcagatgttcggtaacgctggtcgtgaatacatggagaagtaagcagcttctagcccatagtttctgacagagaaactgactggttaggtacggcgccaaagccgagcactttgcggagattgcccgcatcaaccacgagcactcgaagcgcaacccatactcccagttccaggacgaatacacgcttgagcaggttatgaaggctccgatgatccatgagcctcttaccaagctgcagtgctgccccacctctgacggagcccgctgccgccatcatcgtctcgcaggctttcctggatgcccgccctcacctcaaggaccaggctatcctgattgccggtcagcagctcgccactgacaacaccacgttgtacaacagaagctcgatcgaccttatgggattcggcatgtcccgcgccgcctgccgtgctgccgtcgccgaggccggtgtcaacatcaagaacatcaaggtgtgcgagctgcatgactgtttctctgccaacgagatgatcacaatcgacgcgctcgagctctcggaaccagggaaggctcacgagatggtcgccaagggtgacatcacatacggcggcaagatggttatcaacccatccggcggtctcatctccaaaggccacccgctcggcgccaccggtctggcacagtgtacagaactggtctggcacttgcgtggctgggccaacaaccgcttggtcgagggaaccgacgccgccctgcagcacaatctgggactgggcggtgccgtcgttgtcacggtgtacaagcgtgctgatggtaaggtcgccaagccggtatcttcggcggatgtcgcgaagatcaatggtctcggttacaaccctgcggtcgag

SEQ ID NO: 36215 - DNA, 1173 bp, Aspergillus nidulans
ggaaaatacacggtcactttgatcgagggtgatggcattggacccgagatttcccagtctgtcaaggatatcttctccgccgcaaacgtaacgcttcctctcgtcgtcatctagctgcgatgctgttatactaagtcgcccacaggcccctatcaagtgggaatccgttgatgtcacccctattctcaaggatggaaagaccgccatccccgatgctgcgattgacagtgtccgcaagaactacgtcgcgctcaagggtccccttgccgtacgtaaagccacgtccgtcgcaaagcgcattgctaaatcacgtccagactcccgttggaaagggccacgtttccctgaaccttacccttcgtcgtaccttcaacctcttcgccaacctgcgtccttgccggtcggtcgctggttacaagaccccctacgacaatgtcgacaccgtcctgatccgtgagaacaccgagggtgaatactccggaattgagcacgtcgtcgttgacggcgttgtccagagcatcaagctcattactcgggaggcttccgagcgtgttcgttcgtcgctttccagtatgctcgctctatcaacaagaagaaggtccgtgtcgtgcacaaggcgaccatcatgaagatgtccgacggtcttttcctcaacactgcccgtgaagtcgctaaggacttccccgatgtcgagttcgatgcggagctgctggacaactcttgcctgaagatcacgactgaccctaccccctacaacgacaaggtcctcgtcatgcccaacctgtacggtgacattctttccgacatgtgcgccggtctgattggtggtcttggtctgaccccatccggtaacattggtgacgagtgctcgatcttcgaggctgtccacggttctgctcccgacattgctggcaagggtcttgccaaccccactgctctgctcctcagctccatcatgatgctgcagcacatgggtctcaacgagcacgctagccgcatccagaaggccatcttcgacactctcgctgagggcaaggtaagtatctcgacaacctataacttcgttgatacttttaactaacttctttgtagactctcactggtgaccttggtggtaaggccaagactcacgagtatgctgacgccatcatcaagcgcctgtaagggattcag

SEQ ID NO: 36216 - DNA, 1245 bp, Aspergillus nidulans
atggcttctacactcagacttagtacctctgctgtccgctccagcactcttgctggcaagcccgttgttcagtctgttgcatacaaaagcctgcgcagctactctaccggcaagaccaaggttcgtctttgcgctgcgctccgactgggtcattggcgtgtgtttggctaaccataatctccttatctagtcccttaaagagaccttcgccgacaagcttcccggcgagctcgagaaggtcaagaagctccgaaagtgcgctattcctgatgattcttgtcacgcaatgatcgctaatcggtgatcgttcaaatttgtagggagcatggcaacaaggtcattggcgagctcacccttgaccaggcttatggtggtgcccgtggcgtgaagtgcctcgtgtgggaggtaagtcgcagtcaaacgaatttgcgaaatttggcaatggaactgactaacaattatattgtagggttccgtccttgattccgaggagggtatccgtttccgtggtctcaccgtgagtaacaccatttctccgttaatcaaagcctttctaactatttcatagattcccgagtgccagaagcttcttcccaaggcccccggtggtgaggagcctctccctgaaggtaagaatgctgcaaaatccaatcaggtggccatatctgacgaatggcaggtctcttctggttgcttctgaccggcgaggttccctctgagcagcaggttcgtgacctgtctgctgagtgggccgcccgctccgacctccccaagttcattgaggagcttatcgaccgctgcccgagcactctccaccccatggctcagttctctctcgccgtcactgctcttgagcacgagtctgctttcgccaaggcctacgccaagggtatcaacaagaaggagtactggcactacaccttcgaggactctatggaccttattgccaagctgcccaccatcgccgccaagatctaccgcaatgttttcaaggacggcaaggttgctcctatccagaaggacaaggactactcctacaacttggccaaccagctcggctttgccgacaacaaggacttcgttgagctgatgcgcctgtacctcaccatccactccgatcacgagggggaaaatgttagcgctaacactacccaccttggtggcagggctctgagcacccacatactttccctggcggatgctctaatcgtggtggccggtactctccatggatcgcaagcttaa

SEQ ID NO: 36217 - DNA, 790 bp, Aspergillus nidulans
gctgctcaacagagcgacaacatagcccatgctctggcgggtgctggtggtggcatactgtccatggttctgacgtgagtaatctgaagccagtcctcccctttcatgagcacatactcacctggatgatttaaccagatacccacttataacactctcaactcgagcgcaagtcgaatccaagcgtgcgcagtcttcgactattgatgcgattcgtcgtattgtgcagagagaaggaatagttggactttactctggcctcgagtcagcattattcggtatcagcgtcacgaactttgtctactactactggtacgaatggaccaggtctgccttcgagaaggctgccgaaaaagcaggtcgttcaaagaaattgtcaacactcgaatcgatgatagccggagcaattgcagggagtgcaactgtcctgctcacaaacccgatttgggtcgtcaacaccagagtgaccgcacgcaaatcggcagaggatgatcagtcactgccaggagctcccaagaagcagcggccgtctactttcggtacacttatggacctactccagaaggagggacccactgcactctttgctggcgtcctacctgcacttgtcttggtgatcaatcctattctacagtataccatcttcgagcagttgaaaaacatagtggaacgccgccgtcggatgacaccaaaggacgccttttacctcggtgcccttggcaagattttggcgacctcaatcacatacccatacattactgtgaaaagccgaatgcatgttgccagcaag

SEQ ID NO: 36218 - DNA, 835 bp, Aspergillus nidulans
tacgattacctttttaaacttctccttatcggagactccggcgttggaaagtcctgcttgctccttcgattcgccgatgatacctatacagaaagctacatctccactatcggcgtggattttgtacgtttaccctgctgtcgatcggttatcggttgtcaggcaatcattctgcggacagggattaactaacagcctctatgaaagaaaatccgcactattgaacttgatggcaagactgtgaagcttcagattgtatggaaagctgatagttttcttttagtgcatcggataaagctgacggcttacatagtgggacaccgcaggccaagagcgcttccgaaccattacgtcctcttactaccgtggcgctcatggtatctgcgttgtatacgatgttaccgatatggactcttttaacaacgtgaagcagtggcttcaggagattgaccgctatgcgactgaaggtgtcaacaagcttctcgtgggcaacaagagcgatatggaggacaaaaaagtcgtggaatacactgtcgcaaaggttggttgctatatccctgtcacgacatcacaacatcgatcggtggtcttcttcagctgttatttccggaaaccctctaacttctgtgtctacctataggaattcgccgatagtcttggaatcccatttttggagacatctgccaagaatgcttcgaacgttgaacaagctttcttaaccatggctcgacagatcaaggaacgcatgggcactgcaaccgtgaataacaagccaactgtgcaagtcggccagggtcagggtgtccagtctggatctgccggtggctgctgttag

SEQ ID NO: 36219 - DNA, 1421 bp, Aspergillus nidulans
cactccaaatatacctgctaatgttgtgttttgatatatagtgtttccgccgccgggttgcacgaggctgcacttgctgctggactggagtatttcggcacagcgacagataatggcgagttaacagatattccgtacgtaactcagctcaacaataccgctgactttggtcaaatcacgcccggaaacacccaaaaggtaggcagccgcatccacaatattgacccacccccaaacgtacaatacatgagaatgtcatgttgacatatgcgtgatagtgggatagcaccgagccgtcgcagggcactttcagcttcaccaagggagacgtcattgccgatctggctgacgccaatggccagtatttgcggtgccatacgctcgtctggcataatcagctgcccagctggggtaagatgttccaccgttctctgtaaaaaaggatggaaatcaaaatttaactaaaaagactaacatgagagcagtgactagcggaagctggactaataccactctaaccgccgcactacgaaaccatatcactaacgtagtgaatcattacaaggggcgctgcatacattgggacgtggtcaacgagggtaagtagagtccttactagcccgactcgtcccggttctccgtcggagtctgatcatgtctccttgattaaagcactgaacgaagatggcacatatcgcaccaacatcttctacaccaccatgggcgaagcctatatccccattgcatttgctgctgccgcagctgccgatccagacgtcaagctctactacaatgactacaacctcgaatacggcggtgccaaggcggctggtgcaagagctattgtgcaactcatcaagaacgcgggcgttaagatcgatggtgtaggctttcaggcacacttcagtgttggcactgtgccgagcaggagctccctggccagtgtgctgcagtcgttcacctcgctaggcgtcgaagtcgcgtacacggaggctgatgtccgtatccaactgccgacatctgcaacgacgctggcacagcagtcgacagactttcagaacctggcgggatcgtgtgtggacacggccgggtgtgtcggattcacaatctgggactggacggataagtacagctgggtgccgagtacgttctcgggttatggtgcagcgctaccgtgggatgagaactttgttaagaagcctgcctacgatggcttgttggtagggctcggcggcaccgtaactacaaccaccaccacaacagccacctctaccactaccagcgccacagccacaagcactgcaacctccccgcattggggtcagtgtggcggtattggctggactggcccgacattgtgtgcgagtccttggacttgcacctatgtgaacgactggtattcacagtgtctataggcggta

SEQ ID NO: 36220 - DNA, 1296 bp, Aspergillus nidulans
gatctatgttaacatgtagactgaatgtcattcttcacagtcgtcgtaacgcatagtgcgctcgttgaggggagcacttttgcccgcacagtaggagcctcctgtccatggtgtgattcacaggcccctcagatcctctgctacatgcagaatttctggacaggctcatatattaatgccaataccggtggtggccgatctggcaaggacgccaacaccgtcctggccagcattcacaccttcgaccccgacgctgcttgcgatgatatcactttccaaccctgctcctctcgtgccctcgccaaccacaaggtatacactgactcgttccgctccgtgtactcgctcaatacaggcatcgcacagggcgttgctgttgcagccggtcgctatcctgaagattcatactacaatggtaacccctggtttttgacaaccctcgccgcagccgagcagctctacgatgccatctaccagtggcagaaggctaggtccatctcgatcacgagcacctctctcgctttttttaaggacatctacagctcggccgccgtaggcacttacgcctcggggagctccgcgttcacggccatcatcgacgcagtcaagacgtacgccgatggctacgtgagcatcgtcaaggcccacgccatggctaacggctccctttctgaacaattcgacaagacatacggcacctgcgtatccgcgcgcgatctgacctggtcgtacgctgctctcctgacggccagcatgcgccgtaacggcgtcgtccctccctcatgggacgccgcctctgcaaacaccctcccctcatcttgttccacgggctctgcaactggaacttacagtaccgcgaccgtcacaacctggcctagcaccctgaccagcgggtcggctagcgcgaccacgaccatcatggctacgtcgactgccaccagcagcagcactaccaccagcaccaccaccgcctgtacaacaccaagcaccgttgccgtgactttcaatgtgatcgccacaactacctacggtgaaaatgtgtacatagtaggctccatctcccagctgggaaactgggataccggcagtgccgttgccctcagcgcctctaagaacacctcctccaacaacctctggtatgtggacatcaatctcccgggcgggacggcgtttgagtacaagtacatccgcaaggagacggacggctcgatcgtttgggaaagtgaccctaatcgctcgtacactgtgccttcaagctgtggagtgtcaacggctactgagagtgacacttggcgg

SEQ ID NO: 36221 - DNA, 879 bp, Aspergillus nidulans
atgcgagcagcccaattctacgccgccggcgacgtacgtgttgaagatgtcccagttccgcaagctagtgatgacagagtcctgattgaggtcgaatggtgcgggatatgtggaagtgatctcaatgagtacatgttcggtatgacagtcgtcttatgatccgcttggtgagccatgctgacaaggacgatagggcctttcgcgattccctcccttcaatctggaccacacccgctcacaaacgctctgctccctgtgacgatggggcacgagttcacaggacgcattaagtatgttccagagtccatctcccacctcaagaaggggcaggcagtcgtcgtcgacccgcgctactattgctcctcttgcacgccctgcttgcatacggccacaaacagctgcgaaaagatcggcttcatggggctctctggaggtggcggcggcctttcagaatttgtcgctgtcagaccggaggctgtgcatgttctctctgaggacggttctgcgtacatggatctcgcagccgcagccctgatctagccacttcgtgtcgcgtggcatgctcttaacctcttcctgtctatctcgccttgccaagcggctcaccaaaacgaggtagatctcagcaccgttcccatccttgttatcggtgctggaccggtcggtatagcaataagctatgtcctgcaagcccgtggcgcaaagacgatctatgtctctgaggtgtctcaagcgagaagggagacgttacgtggcatggagatcgtcacggaggtttttgattctggtcaagttgatgtgccgaagaaggtcaggttgttgacaggggatggtgtgggtgttgtgtttgactgcgctggtgcccaggcaggctttgat

SEQ ID NO: 36222 - DNA, 746 bp, Aspergillus nidulans
ctcgatcccaaggaatacaagagtttgccacttgttcagaaaaagacgcttgcgccaaacgtttacaagtttgtcttccagctgcccggtcgacaagacgttataggccttcccatcgggcagcatgtagccatcaaggcgaacatcgaaggcaaaacagtatcgagatcctacaccccgacgtcgaataatatagaccgcggtgttttggaactggttatcaagtgctatcccgacggtctcctaacgggaaaataccttgcaaacctgcaagttggagacaaggtcgagttccgcggtcccaagggcgcaatgaagtacaccaagggcctctgcaagaagattgggatgattgcaggtggcactggaataacgcccatgtaccaacttattcgggcaatctgtgaggatcccactgatactacggagatcagtctgatctatgccaaccgcagtgaagaggacattctgatgcgaagtgagctggaggagtttgcgagaaatttccccaaaaaccttaagatttggtacatgttagatacaccgccagagaagtggtcttttgggacagggtacatcacagctgagatcatgagggagcatctgcccatggccgacaaggataccaaaatcatgctctgcggtccaccgggaatgctgatgcgtgtaagaagggtttggtggcattggggtatgaggctccaggagctgtcgcgaagatggatgaccagattttctgtttctaa

SEQ ID NO: 36223 - DNA, 2112 bp, Aspergillus nidulans
acccaagaacgtgctcactatgcccgtgcggcggagcttactcaggagcctccgaaaggcaagccttactctgttgctatacctggcaccgagaaggatggacggagcccaatctaccgttcctggtggacacagaaggagctggttaaaacgctggatcctaaagtacgtataaagcttggttattttattatttgctgagaggctggatggagttaaccattttaggtcaccactgcccatgagatttttgagtcaaccgcgaatgataccccgaaggccgattgtcttggatggcgtccttacgacccagtgaagaagacctggggtcaataccaatggataagctatggtacagtccaaaaacggcgtaccgatttcggtgccgggttggtggagctacatcacaagcataactgtgctcgacccgggcagtacggtattggtctctggtgtcagaatcgtccagagtggcagatcacaggtacgtagctcttccttcagtataccggatagtgctgagtttcagacctggcatgcatgtcccaaagcctatattcggtttcgatttacgatgttctcgcctcggatgcaacccagtatatcattaatcacgccgagctaagctgcgttgtggcctcattgcctcacattccgacactgatcaagctgaagcctgttttgcctaatttgaagattatcgtcagcttagactcactcgaagcgggtgaaccagccggccactctaagcgcgctctcttagaatctatggctgctggccatgaccttaccatctacagcatggatcaggtcgaagccctgggggccgcctccaaccgccccctgaaccctccaaaaccttctgacattgtcactatcaactatacttccggtaccacaggtgctcccaagggcgtggtcctcacccatgagaacgctgttgcagctacttctggcgcgctcgtctccgtttctcaagcacggggtgatacattcccgtcctaccttcctctcgcccatatctatgagcgcctgacggagcatgccgcgctctggtctggtgcgcgcatcggctatttccatggaaatattctcgagctagttgacgacctcaaggtgctcaagcccactggatttgtttccgttccacgcctttacagccgcttcggaactgctattcgtgctgcaaccatcgaagcccctggtttccgaggtactttgtctaaacacattgttgcagccaagagcgcaaacttgaagaaccccgatcctagcaaagctaccgtgaagcatgctttgtatgatcgaatttgggctaagaaagtcgctgcggccgttggtttagaaaatgcgaagcagttgatttcggggtctgcgcctctagatccttctttgcacgacttcttgcgagtagccattggcgcagacttttctcagggctacggtctaaccgagacttatgctatggcatgcgcacagtctcccaaggatgttacgtctggcaactgtggacgcgtcgccccctgcacggaggtgtgtctgctgtccctaccggacatggagtactcggttgatgacaagcctttccctcgcggtgaacttcttgttcgtggccccaatgttttcaaagagtatttgaagaatccggaggagacatccaaagctatcactgaagacgggtggttccgaacaggagacgtcgctaagattgacgatatgggtcgcatcatcattatcgatcgccggaagaatgttctgaaattagcacagggagagtatatctcacccgaacgcctggagggtatcatctcctctgagctgggctacttagcgcaagtttatgtgcacggtgatagcatgcagacattcttggttgctatctttggtgtccaggccgagttgttcgcttcgtttgctagcaaggtgcttggtcgaaccattgaccctactgacgtcgcaggcatcaaagcggtattgcaggacaacaagatcaagaaggctgttttgagggatctcgagcgtgtagcgaaaaagaacaaacttgcgggatatgagagggtgaagaattgcgctctgatggtcgagccgttctcaatagagaatgccctgctg

SEQ ID NO: 36224 - DNA, 1396 bp, Aspergillus nidulans
gtcatgacagcattgggagaggttgccacatacttgcccatcccaggtgcctttacgtcctacgctactcgattgattgaccctagtctgggttttgctatgggctggatatactggttctcctgggccatcacctttgcccttgagctgacggcaactggattgattatccagttttggaaccaggatcttaacatagcaatcttcattggtgtcttctgggtcttcattactctattcaacatgcttccagtcagtttctttggtgaactggagttctggttctctagcatcaaagtcctcactgtcataggtagggatgccgctaatagcccaatattactttaactaaccatttgcaggattcatgatcttcggtatatgcattaacgctggtgccggaaaacaaggctatatgggattcgacacctgggtgcatccggggccatttgtggcctacgataatatttcacctgattcgaccgccaaatttgttggtttttgggctgtcctcatccaggctgcattctcttaccaaggaacggaattagttggtattgctgccggtgaaaccgagaatccccgcaaaacagtgccctcggccatccgcaagacgtttttccgtatcctgttttttttcgttttgacgatcttttttatcggcatccttgtgcgcagtgacgacaagcagcttttgaattcttccactgatgcgaatgcctctccgttcgtcatagtggccagaaatgcaggagtcgccgtcctgccggatatcatcaacgcagttctgctgactgtggtgctctctgccgccaattccaacgtctacagcgccagtcgcatactgatcggtcttgcccaagaaggcttcgccccccgtttcttcaagaaaacctcgaaggctggtgtgccctattacagtgtggcattcgcctcggcgtttggtctgctaggattcatgaacgtttccaattcaggtgccacggtgttcaactggtttctgaacatctccagtgtggctggtttgatttcatgggcgtccatcttagggtgtcatttagcgttcatgcgtgctctaaaagctcgcaacatttctcgcgaccttctcccttacaaggcgttgtggcagccatggttctcatggtacggccttttcttcaacgttcttatcatcattacccagggattcactgcctggatcccagaattcagcgtgaccgatttcttcgtcgcatacattagcttgattctcttcgtcgttctgtaccttggccacaagattgtctatcgaccatcgttcattcgccctatcgaggcagacatcgacactggccgtattgcgctggaaaatgagtactgggagactacaatctccgacgagaagtggtataagcgg

SEQ ID NO: 36225 - DNA, 1706 bp, Aspergillus nidulans
atggtcggagtcggtcccaaacgccctccctctcgcaagggtatgtcaccccttccaacccagtgctcgaattgattcttaatcgcacgctcgtattgcaggttccatgtcagacgtgccccaaaatctcctggagcatattaagcactttgaggagatcttcactgttgatactgccacgcttaaaaagatcgttgaccatttcgtcaacgagctgacgaagggtaagtggtttggaacttaaatttttgaaaacgatacttaaattgggacatttaggtctctctgttgagggcggcaacattgtaagtcttcgaaatcgccattcgcatcgactatctaacggtatagcccatgaacgtcacatgggttcttggattccccgacggaaaagaaacgggcacgttcctggccctcgatatgggcggcacccaacctgcgggtttgtgaaattaccctgaccgaggagaaaggtggattcgatatcatccaatccaaataccgaatgcccgaggagctcaagaccggcgaggcagaggagttgtggcaatatatcgtcgactgcgtcgagcagtttattcagttccaccacgagaacgagaacctatctaaattgccgctgggattcacgttctcctaccctgctactcaggactacatcgaccacggagttctccagcgctggaccaagggtttcgacattgatggtgtcgaaggtaaagacgtagtcccgcctcttgagaaggtcttcaaggaacgggtatggaacaatctgatccctgcgcatgtgcctgcgtctgcttacctttcctgttgtagggcctgcccatcaaggtcgctgccttgacaacgacacaacgggacccttcattgcttcttcttacaccgaccccgctatgaagatcggctgcattttcggcaccggtgtgaatgcagcatacatggagaatgctggctctattccaaagctggcccacatgaatctgcctccggacatgcccgtcgccatcaattgcgaatacggtgcctttgacaacgaacatattgtcctcccgctcaccaagtacgaccacatcatcgaccgcgattcacctcgtcccggccagcaagcttttgagaagatgacggctggtctgtatctgggcgaaatcttccgcttggccttggtagatattttggacacacagccgggtctaatcttcaaggatcaggatacctcgcagctgcggatcccataccttctggattcatccttccccgcagctatcgaagaagacccttacgaaaaccttatcgagaccgccgaactcgtccaaaacatgctcaagataaaagcaacacgctcagagctcgaactgatgcgccggcttgccgagctgatcggtactcgcgctgctcgcctatccgcctgtggtgttgccgcaatctgcaagaagaagaacatcgagtcttgccacgtcggggccgacggctcggtattcacaaaatacccccacttcaaggcccgcggtgctcaggctctgcgtgagatcctcgactgggcccccagtgagaaggacaaggtcaccatccatgctgccgaggatgggtctggtgtgggtgcggctctcatcgccgccttgaccctgaagcgtgtcaaggctggcaacacggccggtattcgtgatgcgcaggccatgctggctatgtgctaggcatatgcgtgc

SEQ ID NO: 36226 - DNA, 828 bp, Aspergillus nidulans
cccttcattaatggcgggttggccggtatgacggctaccgtcgtcattcagccaattgatatgatcaaagtgcgcttacagctcgctggcgagggtgtgcgcaccgggccccgtccttcagccttgggcgtcgcgcgtaatattatcgcatcaggaaaagtgctcgatctctacaccggtttatctgccggtcttctgcgtcaagcagtttacacaaccgcccgtctaggattcttcgacactttcatgaaagcattaacgaagaacgctgatacagcgaaccgaaaagtgacttttgccgagcgcgctggcgcaggtttgacagctggtggtatcgccgctatgatcggtaacccggcagatttggcccttgttcggatgcagtcagacggtctcaagcctccggaggcgcgggctcactaccggtccgtcatcgacgcattgttccgcatttccaaagccgaaggagtgactgccctgtgggctggcgctttccccaccgtcgtgcgtgcaatggccctcaacctcggccagttggctttctttgcggaatcaaaagcccagctgaagacgcgaacatcgctttcagcgcaaaaccagacctttgctgcttcagcgatcgctggtttcttcgctagtttcctctcgcttcccttcgactttgtcaagactcgcctgcaaaaacaacagaaagatcccaagacgggtcagttgccatacaagggcatgtttgactgtgctcgcaaggttgttcgtgatgaaggctggctgaggttctatcgcgggtttggcacatactatgtgcggatcgcccctcatgcgttagtc

SEQ ID NO: 36227 - DNA, 1235 bp, Aspergillus nidulans
gagagccccgtctaccgggccaccactactgcccctgttaacatcgccgttataaagtatgtctgaaccccgccattgtacaacacattggcttataccagttgtctaggtactggggaaaacgcgatgccactttgaacttgcctacgaactcatcgctttctgtcaccttgtctcagcgctctctccgtaccttaaccactgcctcgtgctctgccagctaccccgccgccgatgagctgacgctcaatggcaagccgcaggacatccagtcgtccaagcgtaccctggcttgtctcgccagcttacgggctcaccgacaagagctcgagagtgcagacccgtctctgcctaagctctctaccctccccctaaggatcgtttccgagaacaacttccccaccgccgctggcctcgcctcctcggctgctggtttcgcagctttggtgcgcgccgtagcagacctctacaagctgcctcagtcgccaacagaacttagtcgcatcgctcggcagggttctggctcggcttgtcgctctctgatgggagggtacgtcgcctggcgcgccggtgagcttgcggacggaagcgacagtctggcagaagaggttgctccccaggctcactggcccgaaatgcgtgctcttatcctggttgtgagtgcgcagaataagatcgttcctagcccgcgtggtatgctaacttccgttgcgacatcagagcttttcgcaacgcgggcgaacgctgtcgtccctgcgcgtatgaccgctatagagacagctattcagaaccgcgatttccccgcttttgcgtaaatcaccatgcgtgattccaatggtttccatgctacctgccttgactcatggcctcccatcttctacatgaatgatgtctcccgggccgccgtcaggctcgtacatgatatcaacaacgccgtcggtcgtacagtgtgcgcgtatactttcgatgctggccctaacgccgtcatctactaccttgagaaggattccaaccttgttgcgggaactttcaagtctattcttggcacagaacttgaaggatggtctggccccttctatgatgccgtgaaggacgtcagctcgggtgtatctctcgaacaggtcgactcccgcgccgtagacgtgctcaagactggattgagccgtgtgatcctcaccggtgttggtgaaggtcctatcagtgtacaggatcacctcgttggggaaaacggtgaa

SEQ ID NO: 36228 - DNA, 904 bp, Aspergillus nidulans
aacggtaatgccgagagcactacctccatcatcaagaacctcaactctgccaacctggataagtccgtcgaagttgtcgtctctcctcctgcgctctacctactccaggcccgcgaggtcgccaacaaggagattggagttgctgcccagaacgtcttcgacaagcccaatggtgctttcaccggtgagatcagcgtccagcagcttcgcgaggccaacatcgactggaccatccttggacacagtgagcgccgcgttatcctcaaggagactgatgaggtatgcccactgaaacacttcgtggtgatacgagcttgagtgcttaaagatctagttcattgctcgcaagactaaggctgccattgagggtggcctgcaagtgattttctgcatcggtgagacgcttgaggtatgactctttttttgtttcggcttatcccgattacccactttgactgggcattcccctatgttgagctttctaccgtattaacaatgcgtaccaggagcgtgaggccaacaagaccatcgatgtagtcactcgtcagctcaacgcggcggctaaggagctctccaaggagcagtgggccaaggttgtcatcgcctacgagcccgtttggtaagacacccatctgtctgcgcctcgtctcactgagagcaaacgggctaattgtgttacagggccattggaaccggtaaggtcgctacaaccgagcaggcccaggaagtccactctgccatccgcaagtggctgaaggacgccatctccgctgaggccgctgagaacacccggatcatttatggcggctcagtgagtgagaagaactgcaaagatctcgcgaaggaggccgatatcgatggcttcctcgtcggcggcgccagccttaagcctgcctgtacgtct

SEQ ID NO: 36229 - DNA, 1156 bp, Aspergillus nidulans
atgcatttccttcaaaactcccttattgctgcggcaatgggcgctgcgctggtcgctgccgcccctgctgctgatcttgatgctcgaagctcgtgcaccttcacctctgcctctgcggccaagtctggcgcatccaagtgctccactgtcaccctcaagagcatccaagttcctgccggtgagacccttgacctgaccggtctcaaatcgggtgctactgtacgtagttccccttccccctcgccgcctcattgatctcggctttctaacggaggagcaggttatctttgaaggcgagacaacctttggctacaaagaatggaaaggaccgctgatctccatgtccggtgacaaaatcacggttaagcaagcctctggcgcaaagatcaactgcgacggggcccgctggtgggacaccaagggcagcaacggcggcaagaccaagcccaagttcttcagcgcgcataagctgaacaactccaagattcaggggctgaagatctacaacacccctgtccagggattcagtatccagtccgaccacctgaccatttcggacgtgaccatcgacaactccgccggcaccagcaagggccacaacaccgatgcctttgacatcggctcctcgacgtacattaccatcgacggtgcgactgtctacaaccaggatgactgtattgccattaactccggcgagcacatcaccttcaccaacggatactgttccggcggccatggcttgtctattggctccgtcggcggccgcagcgacaacaccgtcaagagcgtcaccatctccaacagcaaggtcgtcgactcccaaaacggcgtccgcatcaagaccgtctacaaggctaccggctccgtcaccgatgtcaccttccaggacatcgaactctctggaatcaccaagtacggcctcattgttgagcaggactatgagaatggtagcccaacaggtacccctaccaacggtgtcgaggttgaagatatcaccttcaagaagattaccggctctgtggatagcagtgccacacgtgtcaatatcctctgcgggtcagggagctgcaaagactggacttggtctggggttgatattaccggcggaaagaagagctctaagtgcaagaatgttccgtctggtgcttcgtgctag

SEQ ID NO: 36230 - DNA, 2519 bp, Aspergillus nidulans
catcttgatcggttcgcctcggcgagcatacctgtacagcgacttcatgttcacgtaaagcgtctcgtcgctgccggtcacaaggtcggcgtcgttaggcaattggaaactgctgcgctgaaagcagctggagataaccgcaacgcaccgtttgttcgtaaattgacgaatgtttacacgaaaagcacctatattgatgatatcgagagccttgaagggtctacggctggggcatctggtgcatcggccacgggatatattctttgcataacggagacgaacgctcggggctgggggaatgacgaaaaagtacatgtgggtattgttgccgtgcagccgactaccggggatatcgtttacgatgagttcgatgatggcttcatgcggagcgagatagaaacaagattgctccatatcgcgccctgcgaaatgctaatagtcggtgagctatcgaaagcgacggagaagcttgtgcagcatctttccgggagcaagatgaatgtattcggtgacaaggtgcgggtggagagagcacccaaagcgaagactgcagctgccgaatcgcacagccatgtttcgagtttctacgctgaaaaaatgaaatctgcagacgctgcggatgatgaggttgcgagtaacctgctccagaaggtgcttggcttgccggaccaggtcacgatatgcctctctgccatgatcaaacatatgactgagtatggcctggaacacgttttacagctgacaaaatatttccagcatttttcttcacgctctcatatgcttctcaatggaaacaccctgacaagccttgagatataccaaaaccagactgattattcgtccaaaggcagtttgttttggactctagatcggacacagacccgatttgggcaaagaatgcttcgaaaatgggttggacgaccgttgttggataggcgtcaacttgaggatcgagtcaatgctgtagaagagcttaaggacttccgaaatgtcgtaatggtcgaacgaatcaaaggtttgcttggtaaaatcaagcacgatctagagaaaggcctgatccggatatactatggaaaggtgagtaacactgaccctcgtctgacgtggctaacagtgaaagtgctcccggccggaacttttgaccatcttgcaaacaatgcagatgatagcacaggaatttgccgatatcgagtcaccagcagataccgggttttcctcacctgccatcagccaagcaatcatgtctctgcctacaattttgaaagatgtcgtgtttttcctgaacaaaataaacatgcacgcggctcgaaatgatgacaagtacgaattcttccgcgaagaagaagagacggaggaaattagcgagcacaaactcggaattggggccgttgagcatgaacttgaggagcatcgtcctgtagccggagaagctttagggaagaaaatggtcacctatgtctcgttgcaggcatcgactatttggtggaagtcgagaacaattcgccggccatcaagcgagtgccggcatcatggatgaaaataagcggcacaaaaaaggtgtcaagatttcaccctcccggagttgtcaagatgattcggcagagagaccaaccacaaaagcgctcgccgcagcctgcgataaggcgtttttggccctccaggccgagatagcgaccaattaccaggcgctacgtgactgcgttcaatccctggcaacgctagactgtctggtgtcattggccaccttagccagccagccggggtacgtgaaacctgaatatacggaagagacgtgcatccatgtcgagcaagggcgtcacccgatggtggagcaactccttctagacagctatgtgcccaatgacatcaacctggatagcagcaagacgcgcgctcttcttgtgactggccctaatatgggtgggaagtccagctacgtgcgccaggtggcacttattgcaataatggggcagattggctcatatgtcccagcacaggccgcaaagcttggtatgctggacgcggtgttcacccggatgggcgcattcgacaatatgctcgcaggcgagtctaccttcatggttgagctttccgagacggcagatatactgaagcaagcaacgccccgctctttagtaatactagacgagctgggccgaggcacgtctacccatgatggagtcgccattgcacaggccgttctcgactacatggtgcggtctatccgcagtctcaccctcttcatcacacattaccagcatctttctgccatggtgcattcgtttcctgatggcgagctgcgaaatgtgcacatgcgattcagcgagtcggggactggcgcggacgaagacattacctttctttatgagattggagaaggtgtcgcgcatcgtagctatgggcttaatgttgcgcggctggcaaacttgcctgcgccacttttggagatggccaagcagaagagtgccgagctggaggagaaaattcgtcgccgaagacttgctggttttgttgctgcg

SEQ ID NO: 36231 - DNA, 677 bp, Aspergillus nidulans
gaaggacgtcttcaacaatcgaccctcgacctcctttccggctgcgacatccaattccgccgtgaaaaccgcctcgacatcgccttggtcaagaacctgcctatcgccctcatcttcctccccgccgctgacatcccgacgtttgttggagagggccgcgtcgatctcggtatcaccggccgcgatcaggtcgccgagcacgatgcccagctcggcctcccagagggcgaagtttctggtgtgcaagaaatccttgatctagggtttggcgggtgcaaactgcaggtccaggttccggagaagggagacgtccagaaagtcgagcagctgattgggaaaaacgttgtgacaagcttcactgcgctgagcgagcaattcttttcccgcttggagaaggagcatggccctgcggagaagaagacgaacatcaagtatgtggggggcagtgtggaagctgcttgtgcgctcggcgttgccgatgggattgtcgaccttgttggtatgtttctccctccagttacttgttaataactatgaagctaaggaaggcagaatccggcgagacaatgcgctgccgctgggctaaaggctatcgacaccgtcgtcgagagcaccgctgtgctcgtcaagaaccgtaacacccagaacccgcttgttgacttgatcacttctcgtat

SEQ ID NO: 36232 - DNA, 1453 bp, Aspergillus nidulans
tggggctccgatgggaaagatcgcgccttgctggcgaaactggacactacattactgccgtatttctccttgatctggtttcttttcggcgtcaccagagccagctactcctcagcatatatcagcggaatgaaagaggccctcaactttcaaggtaaggactacaattacatgagaaccgcctacctggtcacctatgctgtttgccagataccggggaccagtcttctcactctggtgcggccgaaacatgtcttcgttccggcaaacgttacttggagtgtccttacaatggtcacgtttcggacgacccacgcctggcaggtcattctgttgaatgctatcgaaggggcgttttcagcgattgcatagtaggtctggtcttgttggctcgggctgtggctgaccccgatagtgtcggagccctgttcatccttggttcatggtacaagcgatctgaactggggaccagaaacgccatcttctgcgtctttggccatctcgggtctatggctggtggctggattcaagcaggactgttgaaaagcctggcaggcaagggtggccttcctgcatggaaatggatcttcatcattgtctccgtcatgactctgcctgtcgcgttattcggtaccccttccctcaaaataagtaaagaaaaaaaaaataaaacctaggcttattcagacaatgcaggctggttcttcatccccgatctgcctgtccatcgaacggcgtggtatttgaacgcggaggagaaggagcatgcggccgctcgactcggctctcccagcaagcagtcatgggacctgacggtcttcaaacgggtgctttggagctggcagttctatctcttgccgcttatcttcatgcgttagtctccttgactatttgaggcgctccactctaacaaattctagtatactcgctctgcgtccagagtctttctaacaacgtcatgccgctgtggatggcctcgcgcggatacacaaccgtgcaacagaacaactacccaaccgctatctatgccacagccatagtaggaactgtcctctacgctgtcgtctctgacaaactgcgttcgcgatgggaagtctctattgccattggcctaacctttgtcataggctccgccattctcttctcagatcccccaacagcaggctacttcttcgccttctacttgctcggcaccacgtacgcgccgcaggcagtatggtatggctggttggccgacgtgaccggccatgacgtgcagctgcgcgccatcgcgacggggttcatgaactcgtttgattttgcatttgtcacttggtggccgttgattttctaccctgtcacagatgcaccggactatcgaaggggttatttcgctagcttggttactggggccttgacgctgccatttatagggttgattgcatacctggagaggagggataggaaaaggggt

SEQ ID NO: 36233 - DNA, 1012 bp, Aspergillus nidulans
gcgaagactcgatcgcagctcaatcgcaggctacccgactcgaagaagctcccatggccgccttttggaaaacaatggtacgccggttgtacaacattgattattggaaattctttaaaagctggaattcgtgagtccctggtgttatgcgtatagactgttgtggtttggggcgctgatacattgtcgctatactcaggattcgtcgcgttcgatacatttaagtcgatgctgcaggatcaggatggaaagatatcaggcccgagaactgtcatagctggctttggggctggattcaccgaatctctgctggctgtaactcccttcgaaagcataaagacacaattgtcagtcttaccccatatcccagttgttctgtctatgcgcctggctttcaacaatcacgagacgggtagtagctaataccgtactctttccacctcctacaggattgatgaccgtaaatccgccaacccacgtatgcgcggatttttccacggtagcggtgtgatcttccgagagcgaggtattcatggctttttccagggattcgttccgactacggctagacaggccgcgaattcagcgacgcggttttcgagctacaccatgctgaagcagatggcagagggttatgttgcacccggtgaaaagctagggactgcaagcacgtttgcccttgggggcatggcaggcttaattactgtgtatgtcaaatatagttcacaacatcatctcaaaagacatactgacaacattatctagatacgtgacgcaaccccttgacaccgtgaagactaggtttgaccaaccagctcttagatttgggcgagatgctagctaacagcgaaataggatgcaatcgcttgaggcaagcaagaactacaaaaacagcttcgtctgtgccgcgcgaattttcaaggacgaaggtatcctgaccttttggtccggggctgttccgagactcgcaaggttgattatgagcggcggcatagtattcacaatgttcgtt

SEQ ID NO: 36234 - DNA, 3177 bp, Aspergillus nidulans
tttgccgcgtggcttgaaagtgttggaagatggacgcaggcggacgaagtgtacaggcttggcatcgaccgagaagcacgaccaactgaacgtctgatccgaaaatacggtgaatttcagagacgctatgaacaacaaccgcaggacaatggaccttcgtcaccggcgctccctgcagtgcgcccggcactggccgccaaagtcgacccgttcgcttcgagtgcagccgcacccacagatccccaatcccagcagcagggttcaagaaccacgaacgcgccgaagacaaaatcggggaagccgaagatggccatatttactgataccgagcctgcagcaaatcaaccggctttaggcgcacaaactaaagggtgggacagtcttgaatctaggcacgatcgacgaaaggagaaccaaatagaggccaaaccctgggccggggaaacattgaaagctggaaggaaagctccgccaaaggagaagctagctgtttttagggatgaggtaagttttgtgatttattcaaccccgttcgtcagcattccgtatatttacgatcataggactaattggtggcatgaacctggattggtttactgttatgtattcagtcaaagtcagatttaccaaccaaagaggaaatgcaatcaaacccagttccagagcaccgcatacgggaagccgtaaacccacgtacaggaaggagagagcgagtctttgtcgacctcgatgcagtgtaccccgattataagaatcctagcattgaggttagctttgaggagctgagggccatgaagcgtggctggatggacagggactggcgcaagaaaggacctctcaagcagatctctggcaacgctgtccaaacagagcctaatccatttaacgacaaagcccttcgagaccagttccaacaaaagctgtcgttgaggaatacagatgaccatgctttgaatcaacccatcgtctctgagaagactcatgacgccaaagctgccaaaggacggaagctgaaagtccgcgaagttaagggcgaaacacagacaagtgagaaactatggcctacctgtccctaaatgtcttattaggctaactttcgaaatagtcaaaatgaaatttgactctcccactggaggcaagatccgccgcaagagcaccgcagagcctacgatgacaatccatacgcgcgctgcaacagacgaaatatacagcattttcaaccagcctttgaaagcggagaccgaaaatgtggccgaaagcagtgatttcgatgatgatgactataccagtgccggtgaaagtacggttggacgaatatctgctgcgtcaagcgattttggggacgacacattccacaaatcgttcgatgaaggtgacggcgatgacttcgaaaacacgagcgccgacagcgttgtcaatggagaatggactcgattttccgctgctgaactgggcgctgaagcaacctcgttccactcagaagctgctgacccaacacaatcaacgattcaccatgccgaaagcgacgacacagaagaccaggatgctggaccagaatttgagcagccgcaaaggccgagattcattccagagatgccagaggattatgtaccacccgttggaccgtaccgagatccagtcgttgtggctcaaagccgcttgccattcatgacacctattgttgaacgcaccgagcattcattcccttccatgactgcagcgcggtctaacctatacagcgcgaagactccttcgaacgtgctgaacccgacgacaacacctcgcatgccccggatgggaaatcttctttccagtccgcttccaacggaaacaccttttcatggacaaaccatgcacggcctagaagatatcattgaaagtcccaccgcaaacaggtcaggttcttctagcctgagagtaccatctcccacaaaggattccaatccacaaggtactataatcaaagatactctttgcaatcccatagaccggtcgattcgagacactatccttcaggaattgcacaccacgctcgctgcgtaccctggctaccatgctcatccggatacccaatctcattacgcccctgagatagaaaggttcatgaaaagcagcagcaagcgttccagaagtggcggcgaggcggcgtttgacgtgccgatcatcgatccgccgggaggagagcgcagttatatcatcagacgggagctcggtgcaggagcctacgctccagtctacttagcggagagcattgacaatctagactctgactcggaaatggaatccgttggcagcaatagcgggcgctctaccgtttccaacagcttaacgcggcagaaaacaccccgttacagcttcgaggcaatcaagctagaggttggcccgccaaacgcctgggagttctacatgatccaaaccgcacatcaccgattaagccagcttccaacgctctcgcgtgcagccgacagtatcgtacgtgcgcatgagatgcacattttcaagaacgagagcatccttgtcgaagattaccgcccacagggaacgttactggacctcgtgaaccttgtccgcaacgaagggatctacggcccggcgactggagagggaggcttagatgagtctctagccatgttcttcaccattgagctcttccgcactatccaggctctccacacctgcggcattcttcacggcgacatcaaagccgacaactgcctcatccgcttcgacgacaaaccagaccccactcagcagatactcgatgaaaacacagatccccgcgaattctactattcaccttccggcgcttttggctggaaaaacaaaggccttgcccttattgactttggccgcgggatcgacatgcgtgcattcgacccgtctgtgcagtttcgttgcagattggaaaacaggggaacatgagtgccctgagatccgtgagatgagaccttggacgcaccaaattgatcttttacggtcttgcggggacagttcacgttatgctttttggaaaatacattgagagcgtccctaccgatgcaagcaaaaaaacgtatcggtttcgcgaaccggtgaagagatactgggaaaagattttctggcccgattttttgatcttctttgaatcctatacggaccgggggtttgatggagcaaaaataattgtacccccccacc

SEQ ID NO: 36235 - DNA, 1543 bp, Aspergillus nidulans
ccgataatcaagaaggtcttgattgcaaaccgcggcgagatcgcctgtcgtattattcagacgtgtcacaagctcaacatagctaccgtcgcggtctacgtcaatgagtatgttctccctttttgcatgaagacacgttgtcgctaacagaagcagagacacatcatctcgccatattagagatgcagacgaggccattaatattggaagcattgatcaatgccctcgcaatccgttcctagatggagaactccttatccgcaccgctctgtctgtaaacgcggacgccatccatcccggatacggctatctcagtgagaacgctgagtttgctcggtccatccgcgacgcaggaatgatattcatcgggccaagtgataccgccatgtccactttgggcaacaagcgtgcggcaaaagagtacctcagcaagcatgcgccagatgtccccctaatacctggctacgtaggatcaagccaagacgcaccggagcttagtaggattgctgcacagatcggctttcctgtcatgctcaaggcgtctgctggcggtggtggcaagggaatgcgaatcatccgggaagctggacagttgcaagccgagttggagcgggcacagtctgaggccctgcgttctttcggatccgccgattgtattcttgagatgtacgttgagagcagcaaacatgttgagattcagctactgggagactcgtatggagaggttgtctcgttcttcgagcgcgattgttcagtgcaacgacgacatcagaaagtcatcgaggaaacgccgtgcacctttctgacggagaagacgaggcaagagatgagtgctaccgctgtgcgcattgccaaactccttggctacgaaaatgctggcaccgttgaattcgtcgtcgatgctgtgactggcaagttctatttcctcgaagtcaatgcccgtctccaggtcgagcatcccatcacggaggaggtgacaggcgtggacttggtctcgctgcagctctatgtagctgcagggggaagtctacgtgctctacctgcgctccaaggcctcacccaacaaggtcacgcaatcgaatgccgcctctgcgccgaagatccacgcaagaacttcttccctgagcatggcaagatccatttgtggctgccagcatccggcgtgctggggccaggccgtgatgttcgctacgaggctgcagtacagtcaggctcctcagtctcgatatatttcgactctatgattgcgaagattgtcgtctgggcaccgacaagagccctcgctatagagaaaatggtcaaagtcctcgcgcatacaatctgcgctggtgtccaaaccaatcagcttctgatgcagcgatgcctcctgcataaggcattccataaccctgcatacacaacgtctttcctcagcttacatctcgatgagctacttcacgagcctggtggcctaattgctgagatacgcaagtccctgccgatagtcccggcagttgctctgcgtcacctggccgccttatctgcgtctcaaaagcgtcctttt

SEQ ID NO: 36236 - DNA, 1124 bp, Aspergillus nidulans
gacgactctctcctcgagaagtatggactcaaagccaacgatgctatccttgccgaagagaagcacatgggcctctacgaagaattgctccagcaccgtgatgccaagctgattgctggtggtgccgctcagaacactgctcgtggcgctcaggtaatccgccttcgtttgtgatatctgcatatgacaattgctgattcaattgctcatagtacatccttccggataactcgactctctacattggctgtgtcggtaaggacaagtacgccgacatcctccaggacgcctgcaagaaggctggtgtccacaccgagtaccgcgtcgatgatgctcagcccactggcaagtgcggtgtcattattaccggccacaaccgcagcatgtgcactcaccttgctgcagccaacgaatacaaggtggaccatctcaagcagcctcacatctggtcgcttgtcgagaaggcccagtactactatgttggtggctaccacttgacagtctgtgtccccgcgatccaggccctaggtgaagaggccgctgcgaagaacaaggtatgaaacactgggtccgtatcttacggcttgagactccgctaatcaagcctgactcattaggtctttatgctgtctctctccgctcccttcattccccagttcttcaaggaccagcttgacagtgtcctcccctacaccgactacacattctgcaacgagacagaggctgttgcttacgccgagagccacgaatggggcaccaccgacattgtcgagattgcgaagaagctggctcagctgcccaagaagaacaccaaccgctcccgaattgccgttgtgacccagggcactctgcccaccatcaccgctactgttaccaccagcggtgaagtcgaagtcaaggagttccctgtgcacgaaatttcgaaggacgccattaatgacaccaacggtgctgggtaagttttcaagctggctacgctgaacacatctgacgattcgcgctctagtgatgcttttgccggtggtttcgtcgccggagttgtgcagggcaaatcccttgaagagagcgtcgacctcggccagtggctcgcgaagttgagcatccaagagttgggaccttcgtga

SEQ ID NO: 36237 - DNA, 2185 bp, Aspergillus nidulans
aaagtcttgtgcgtggctgagaagcctgcaatcgccaaagctgtcgcacagcacctatctggaggtcgtatggaaactgtaagcgaatgacctaacttgctgaatgtgaactgaaaatggaatagaaaaatgtcactggaaatcgatttgtgaagaactacgtatttgatttcaatttcgggaatcaatggggaaacagttctgtcacgatgaccagcgtcttaggacacttgacaagcttggaatttgagcgccagtacagtggttgggcatcttgccctcctgcagctctgtttgaagctcccgtcaagattgctgtcgacgacgtaggttaagccgatgtctgtccatcagccgtctttgctaagtcctaattgcaggataaaaaggcaatcgcaaacaacatcatgaagcaggcgacgcatagtcagtacctggtcatttggaccgattgtgaccgggagggagagcatattgggacggaggtacgcgatcaggcgaaggcgggcaatggacgaatcgtcgtcaagcgagccaagttcaacaatactgagaagatgtaggtagatgcaccacccctttcatgtgtgcttcgttaaccgatttaagccacgttctgaatgctgcgaggtctctcattgaacttgatgagcggcaagccaacgcagtggcggcgaggatagagctcgatcttaggattggggctgcgttcactcggctgctcacactccagctacaaaatcttcatgccaccctgacacagaaggttatcagttatggtatgccacgccgtccattttgaaacgcgctcccatctgacagactactatccaataaggatcctgccagtttccgaccttgggatttgtggttgatagatatctacgagtgaagcgattcaagcctgaaactttctggggaattaaggtcatgcacactagggatggtatcaaagtgagctttctctggaatagagtccaccttttcgacagagccgctgtcactattatgctggagcgctgtctgatggcaacaaaggcggaggtcacaaaggtgaatcagaagccgacaagcaagtggaggcccttaccattgacaacagtggacttgcaaatgatgggaacaaaatatttgcgcatggacagtgcaaaggtcatgaaggtaaatgctctatcacgtaaaatgctaatatggtgactaatggaacctagattgcagaaaatctgtacactaaaggatttataagctacccacgaacagagaccgatcagtttgacaaaggaatcgacctgaagaagcttatcgagaaacaactacctgatgagagatggggagagtacgctcgctggtgtgttgctcactctctaagctctatcaactactaaactgcattactagtctcctcggcggcaatttcagaactcctagggctgggaggcacaatgaccaagcacatccaccaatccatcccgtctgctgggttaaccccaccacactgactgaagatgaaagaaaggtgtacgagtttgttacccgacggttcctcgcctgttgctcagacgacgcaaagggacaatcaaccgacgtcgagatacgttacggagatgagatgttccacgctcacggactcctagtcttagaaaggaactacctggacgtctacgtctacgacaagtgggagagtacccaacaactacctaactatcaagtcggcgagctattcgaacctacagaagcgaacatgttcgatggaaagacctcgccgccaaactacttaacagaacccgagcttatcggactcatggacgctaatggtattggtactgacgccacgatggccgagcatatcgaaaggataaagagtcgtgaatacattggcgaaatgacccgaggaagcggccgaaacgcggtgaaattactcattcctactcgtttgggtattgccttgatactaggctatgaagatgttttcgctgggctcgcagacagcccctccctcagcaagccttttttgcggaaacagatggagctggaaatgcgggacgtctgtgctggcacgaggttacgaacacatgttgtccagcaaaatctggatatgtaccgggagttgttcattcacactcaaaggcggatgaatatgctgaaggctgcatttcggaaatacattgtcgaaggagaggatgtg

SEQ ID NO: 36238 - DNA, 1674 bp, Aspergillus nidulans
atggcttctgccttccgctccagcctgaagctgcgggcttcagctcgtctcccagctgttcgcactattacaaccacaccccgccttcgagctgcggagaagccttacttccccaatgagcctactgctcccaagctggctacggccattcctggcccaaagaacaaggccgctagcgaacagctcaacgaggtcttcgatgtccgcagcttgaacatgctcgccgattacaccaaatccgtcggaaactagtacgtcaatttgccgtcaatctaccccgcgcagtgtttgccagggctaacaccgaaccagcatcgccgatctcgatgggaacatgctcctcgatgtgtacgtggtcaatcatattttatccctacttgtagacgaatggcatttctaacccgactgcagttatgcccaaatcgcgtccattcccgttggttacaacaaccctcacctcctcaaggtggccgcttcgcccgagatggctacctccttgatcaacaggccagctcttggcaatttcccttccgctgactgggctcacatcctgaagaccggcattctgaaggtcgctcccaagggcttggaccaggtgtttaccgctatggcgggttctgacgccaacgagaccgcttataaggccgctttcatgtactaccgtcagcaacagcgtggcggtcccgagaaggaattcaccgaggaagagattcagtctagtatgctgaaccagacccccggatctcctcagctgtctatcatgtctttcaaggctggtttccacggccgtctattcggcagtctttccacgactcgcagcaagcccattcacaagctcgatatccccgcctttgactggccccaggctcccttcccctccttgaagtatcctctcgaggagcacgctaaggagaacgctgaggaggagcagcgctgcctgcaggaagccgagcgcctgatcaaggaatggcacaaccccgtcgctgctatcattgtcgagcccattcagtctgagggtggtgataaccatgcctcccccgccttcttccgcggtctccgtgaaatcactaagcgcaacaacgtcctcttcatcgtcgacgaggtccagactggtgttggtgccaccggtaaattctgggcccacgaccactggaaccttgagactcctcccgatatggtcaccttctccaagaaggctcagactgccggttactactttggcaaccctgccctgcgtcccaacaagccctaccgccagttcaacacctggatgggtgacccctctcgcgctctcatcttccgtggtatcattgaggaaattgagcgcttgtttctggttgagaacactgccgcgactggtgattacctctactctggccttgagcgcctcgcgaagcagtaccccgagcacctgcagaacctgcgtggtaagggccagggtacgtttattgcttgggatactcccaagcgtgacgagttccttgtcaagggcaagggcgttggtatcaacatcggtggtagcggacagaacgcagtccgcctgcggcctatgctgatcttccagaagcaccatggtaagttccctgttatcgctactaatgtgaacatggctaacttctcacagctgatatcctccttgagagcattgagaagattatcaagcaactgtagggt

SEQ ID NO: 36239 - DNA, 1918 bp, Aspergillus nidulans
cctccggggcccagccgaagcaagaaaagcagtttttcgagcttcgttaatagcatgctaggttccccccgtggaatcaaaatttctgcaccagagaacccggtccatgtcactcatgttggttacgataaccagaccggccagtttactggtctgcctaaagaatggcagcggctgctccaggagagtggtatcacgcagaaggaacaggaggagcatccacagaccatggtcgatatcatgagattttacgagaagaatgcccgaggggatgatgaagtctggcataagtttgaccatgcttaccctcaacagccaaccgccgcgagcccaatatcccagccagcgggctccactacgtatggcacgcaacgaacgtctcctcccaccagccctcgattccctcagaaccatgaggggagcttcgaaaacccacgagcaccgcctccgattccccgcgccgcgcctatcgctgcacatgccatgtctccgcccttaggagggcttgtccctaaccgcgcacctcctaaaccaccaactgctgctgctaacttagttccgagtcggcctgcgccgcaacctcctacgtcgagcccttattccaatatctctaccaggccatccccggagacgcagagccctcaattcagcacgcctcccattccagaaacggagcccttgccttccgagtcgcaacgcagccgatcgaattctagaacaaatggggcgcaaggtccatggccgtcggtgtcaccgagtcattaccaacaacagcaggagcaggcaatggccgtagctcagcaagcccttgccaataagcagcttgaacggagccgtagccaacgtcagcagcaacagtctccacggccagaccagatgccgatcgcgcagcccgcactcccgcagcacgctccttcgcctgaagatgttgctctgacacaagcttcccagactgcgcgtgctgcaccggcagctcggcctcgccaaagaccccgccaaagtaatgccatggatgtcagagcacgattggtcgcaatttgtactcccggtgatcccacaaaactttactacaacttgaataaaatcggtcagggtgcatctggtggagtcttcactgcttatgaacagcataccaataattgcgtcgcgatcaagcaaatgaatctggatctacagccaaagaaggatctcatcatcaacgaaattttggtgatgaaggacagcaagcacaaaaacatcgtcaacttcttggacagttatctccatgggctagacttgtgggtggttatggaatacatggagggaggtagtcttacagatgttgttaccttcaatatcatgagcgaaccccaaattgctgctgtttgtcgagaggtacgtttctttgagcgatatttgagttctagtactgatttcgtctcttagacgcttaacggcttgcagcaccttcactcgaaaggtgtgatccatcgagacatcaagtcagacaatattcttctttccttggatggcaacatcaagctcagtaagtgggacattgcaacattacgctcagactgaattttaatgattcgcagccgatttcggtttctgtgcccaaattaatgactctcagaacaagcgaaacaccatggtcggcacaccgtattggatggcccctgaggttgttacgagaaaggagtacggacgtaaagttgacatttggagcctcggaattatggccatcgagatgattgagggagaacctccttacctcaccgaatcgcctctcagggctctatacttgattgccacaaatggcacacctaagatcaaggacgagcacaacctgtcgcctgtcttcaaagatttcctccattttgcgctcagggtggaccctgagaaacgagcatcagctcatgacctattgaaggtatga

SEQ ID NO: 36240 - DNA, 544 bp, Aspergillus nidulans
gagcttggtgctttcgccaagcttgagcccgagttcactgctcgtggcgtcaagcatgatcggtctcgtgcgtggacaccgttgtgcccctcatactaggtcccttactaactcctcatagagcgccaacggactgaatcccacaaggcctggatcaaggacattgacgaggtcaccggctcaaagctgaccttccccatcatctccgatcccgagcgcaagatcgcccaccagtacgacatggttgactaccaggacaccaccaacgttgactccaagggtatgtgggatctaggaatatgctgaacttgagcttctctctaaccactttcccgcaggtatggctcttaccatccgttccgtcttcatcatcgaccctgccaagaagatccgcctcatcatgacctaccccgcctccaccggccgcaacacggctgaggtcctccgtgtcgttgatgccctccagaccaccgagaagcacggtgttaccacccccatcaactggcttcctggtgacgacgttgtcatccctcctcccgtctcc

SEQ ID NO: 36241 - DNA, 1686 bp, Aspergillus nidulans
tttgttggttctatcgatcagggaaccaccagcacccgatttctaatctttaatcgcgagggagatcctgtcgcatcacatcaagtcgaattcaagcagatatatcctaacccggggtaaggactgttgttcctgatgctttatgacagcgctaacggagttggcagatggcacgagcacgatccgctagagcttgtatcttctgtggaaacctgcatcgaagaagctgttaaacaattcgaaatcaacgggtacgaccaacaatctattaaggcggtgggaattaccaatcagcgagagactacagttgtttgggaccatgaaaccggggagccactttataatgcgattgtctggaccgacacccgctcgcaagctgttgttgatgagcttaaaaagaaacccggagcatcgcaacttcaacagatctgcggtctgccgctctcaacctattcctcttcctctaagctcctctggatgcttacaaatgttcccaaggtcaaagaggcatacgaaaaaggcaccttggccttcggaactgttgatgcctggttggtttaccgactgaacggcggaagcgctgccaatgttttcgtctctgattgtacgaacgcctcacgtacaatgttcatgaacctagagacactgggatacgacgacttcttgctggatttctttggcattaagggccgagtacacctgcccaaaattgttccttcttcagatgtcacagcctacggtgcactctccaacggcaggcttgcgggggttcctatcatgggatgcttgggagatcagtcctcagcccttgtagggcaaaaagggttctcccccggcatggccaagaatacatatggcacaggatgcttcctgctgtacaacgtcggggacaaaccagttatctccaagcacggccttctggcgactatagcgtataatttcgatggacgaccagtatatgcgctcgaaggaagcatagcggttggtggatctggaatcaaattccttcagaataatttagagttcttcagggagtctaaggaagttaacgacttggctttaactgtggaagacaacggcgggtgtgttttcgttaccgcgtttagcggactttacgctccgtattggatcgatgatgcaaagggaactatatgtaagctggaacttctcaaatttaccctcatatgctaatactaatacaaaatagttgggatcacccaatatacccagaagggccacattgcccgagcaacactggaagcgacctgcttccaaaccaaggcaattctgaatgccatggagaaagacagcggacaccgcctattcgagctcgctgttgatggaggaatgagcaactcggatctcgctatgcaggtacagaacggataactctctacccctgcctaaatacagagactccatactgatatatccttctttccaatgcagaagatccaagccgacctcatctccatccccgtttaccgccccaagatgcgcgaaacaaccgccctcggcgccgccattgccgcaggcctagctgtcggtctctggcgcaacttcgccgagctccgcgacatcaaccgtgccgggggtacagtcttccgcccgcagacgagtcaggacataagccgcgagcaattttccctctgggaaaaggcagtgagcatgtgtagagggtgggtt

SEQ ID NO: 36242 - DNA, 539 bp, Aspergillus nidulans
cgccctttgttggaatccgagcgtgagcgactggacgagttcatcgactctatccattattcagcaaggtgcgtacattacctcaaattaccttcagcttctaaaatgcgcagatactctgatgatcaatttgaatatcgccatgtccagctgccgaagaacatgctgaaaaaaatacctgccgactactttgacagttccaaagggaccctcaaattattatgggaagaagagtggcgagctcttggtatcacacaggtacgcattattattccccggcaaagaattgtctaaccctattatagagtctgggctgggaacattacgaagttcatgaaccagagccgcatattcttttgttcaagtatgttcctacagtcggcctagccagtctacgtgctcacagtttacacagacggcccttgaattaccagccatcaatcccacaatgaacggcgtattccgagctgccgactacgcgttcgcagcgtttacacgggcgtcgacagtccagacaccgaggaagagccatctcgacg

SEQ ID NO: 36243 - DNA, 924 bp, Aspergillus nidulans
agcaccttctctccggaaggtcgtttgttccaagttgaatactcgctcgaagctatcaagcttggttcaaccgctatcggtgtatgttattcatttttatactcatcttccggcatggacactgaagtgtcgtaaacggcggagcactttataagcttcttcgacaatgaccgcaacgaatccgctgactgcttccacaggtagcaacatccgaaggtgtcatcttaggtgtcgagaagcgcgtcacatccaccctgctcgaggcgtcctcagttgagaagattgtggaaattgaccagcacatcggatgtgctatgtctggcttgcagcagatgcccggtctttagttgagcatgcccgcgttgaaacccagaatcatgccttccactacgcggaacctctgcgtgtcgagagctgtacccaggcgatctgtgacttggccctacgattcggagagactggagatgatgaggagagtgtcatgagcagacctttcggcgtcgctcttctaattgctgggattgacgaggatggtcctcagctgtacgtctctctcccttctatccgagccctgcttgcctgtctttcgcctcgtttagcactacatacctcttatactacgaaaattatccactgactcttgtctctaccagatatcacgctgaaccttccggtacgttctaccgttatgatgcgaaggccatcgggtccggaagtgagggggcacaggcagaactgcaaaatgaataccatcgctcgttgacacttgccgaggctgagacgctagttctgaaaacacttaagcaagtcatggaggagaagctagacgcgaagaacgttcagctggcgagcgtcaccaaggagaagggtttccgtatctacaacgacgaggagatgggacgcgctgtcgcgcagctaggtggg

SEQ ID NO: 36244 - DNA, 1152 bp, Aspergillus nidulans
atcaccatggcgcgcgtctacgctgatgtcaataagcacatgccacggtcctactgggactatgacagcgtgaacatttcatggggcgtcctggagaactacgaggtggtccgcaaaatcggtctgttcccattcagtatcgtcgagatttgaggattttgtactaatcgctgctcatgcaggccgcggaaagtactcggaagtgtttgaaggaatcaacattgtcaactaccagaagtgtgtcatcaaggttctaaagcccgtcaagaagaagaagatcaagcgagagatcaagattctccaaaatctggcaggtggacctaatgtggtcgcgttgcttgatgttgttcgcgacaatcagagcacgaccccgagtttagtttttgaatatgtcaataataccgacttccgtacgctatacccgcgcttttctgactatgatgtccgcttctacatctacgaacttgtgaaagcgttggatttctgccacagcaagggcatcatgcatcgcgatgtcaagccgcacaatgtcatgatcgatcatgagaagcgaaaggtttgatgcgttcctgttttgaatgaatgagctctgattttcttctagcttcgcctgattgattggggtctagctgaattctaccacaaaggcacggaatataacgtgcgagtcgcctcacgctacttcaagggccctgaattgctcgtggatttccaagaatatgactactccctggacatgtggtcgctcggtgctatgtttgcttcgatgatcttccgcaaggagcctttcttccatggcaacagcaactccgatcagttggtcaagatcgccaaagtgcttggaactgaggaactattcgagtatcttgacaaatatgagatcgagcttgatcctcagtacgacgagatcctttcccgcttccctcgcaagccttggcaatcctttgtcaacgcggagaaccagcgattcatcagtgatgaagcgatagacttcttggacaagctacttcgttatgaccatgcagtaagcctactcaatgcatctccgcaaaggatatctcgctgacctgcatttaggaacgcctcaccgctcaggaagccatggctcatccttatttcgcacaaatcagagccgaagaggcggctaatcga

SEQ ID NO: 36245 - DNA, 1344 bp, Aspergillus nidulans
ttcctcgatattgacctcaagtactacgacctggtatgtcttgaatgcttgtctcccattttcagtgcactgatcttgctttagggtcttgagtaccgtgaccagaccgatgacaaggtcaccaccgagtccgctgaggccatcaagaagtatggtgtcggtgtcaagtgcgccaccatcactcctgatgaggcccgtgttgaggagttcaagctgaagaagagtaagcattatatgctcactgcgcggaagagctgactgacaaaacaaccctagtgtggctgtctcctaacggtactatccgtaacatcctgtatgtcacctttaccttttgaaatcccttgctattgcagtgtgctgataccatcaagtggcggtactgtcttccgtgagcccattgtcattcctcgcattcctcgcctcgtccccggatggactaagcccatcatcatcggtcgtcatgctttcggtgaccagtaccgtgctaccgaccgtgtgatccctgggcctggcaagcttgagctcgtctacacccccgagggcggccagcctgaggctatcaaggtctttgatttccctggcggtggtgttacccagactcagtacaacaccgatgagtcgattcgcggcttcgcccacgccagtttcaagcttgccttgactaagggccttcctctctacatgagcaccaagaacactattctgaagaagtacgatggccgcttcaaggacatcttccaagagatcttcgagtccgactacaagaaggaatttgatgccaagggcatctggtacgagcaccgtctcattgatgacatggtcgctcaaatgatcaagagcgagggtggtttcatcatggctttgaagagtgagtgcatctaaaacagttgatgctgtcgtcgactaacccctttagactacgatggtgacgttcagtccgacattgttgcccagggcttcggctccctgggtctgatgacctccacactcatcacccctgacggccaggcctttgagtctgaagctgcccacggcaccgtcacccgtcactaccgcgagcaccagaagggccgcgagacctccaccaaccccattgcctccatcttcgcctggacccgtggtcttatccagcgtggtaagctcgacgaaacccccgacgttgtcaagttcgccgaggagctcgagcgcgcttgtatcgatgttgtcaacgaggagggtatcatgaccaaggaccttgctctgtcctgcggccgcaaggagcgcgacgcgtgggttaccacccgcgagtacatggctgccgtcgagcgccgactcagggcaaacttgaaggcccgtctatagata

SEQ ID NO: 36246 - DNA, 1535 bp, Aspergillus nidulans
aagaacttcctaactgaagagacccttgcccttctggtcaagctggctaagcaagctggggtcgaggagctccgcgaccagatgttcgctggcgagcccatcaacttcactgagaaccgtgcagtctaccacgctgctctgcgtaatgttagcaaccagccaatgcaggtcaatggcaagagcgttgttgaggatgtcaactccgtcctcgagcacatgaaggagttctccgagcaagtgaggagtggcgagtggaagggttacactggcaagaaaatcaatactatcatcaacattggcatcggtggttctgacctgtaagttttgtcacctgagtcagcagcaatgatattctgacgcgcgcatcagcggccctgtcatggttactgaagccctcaaaccctacggccaccctgatctcaagctgcacttcgtctccaacattgacggcacacacatcgctgaggccttgaaggactcagatcctgagaccacactgttcttgatcgcgtccaagaccttcaccaccgctgagaccactaccaacgccaacactgcgaagtcatggttccttgagcatgcaaaggatggcgcccacatcgccaagcacttcgtcgctctttctaccaacgcagaggaggtcgccaaatttggcattgacaccaagaacatgttcggttttgagtcatgggttggtggtcgctactcagtctggagtgcgattggtctgtccgttgccctctacattggctacgacaacttccaccagttccttgccggtgcacacgccatggacaagcacttccgcgagactcctctggagcagaacatccccgttctcgggcggtcttttgagcgtctggtacagtgacttcttcggtgctcaaacccatctcgttgctcctttcgaccaatacctgcaccgcttccccgcctacctccagcaactttccatggagagcaacggaaaggccatcacccgtaccggcgaatatgtcaaatacactaccggccctgtcttgttcggcgagcccgctaccaacgcccagcacagcttcttccagctgctccaccagggcaccaagctcatccccgccgacttcatcatggccgctgagtcgcacaaccctgttgagggtggaaagcaccagcgcatgctggcctcgaacttcctcgcccagtctgaggcactgatggtcggaaagacccctgagcaggtcaaggccgagggtgctgctgacaacctggtgcctcacaagaccttccttggtaaccgcccgacgacctccattctggcccagaagattacacccgccgccctgggcgctctcatcacttactatgagcacctgaccttcacagaaggagctatctggaacataaactccttcgaccagtggggtgtcgagctcggcaaggtcctcgcgaagaagattcagaaggaactggaaaccgagggcgagggcagtggtcacgactcctccaccagtggtctactcctcgccttcaagaagaaggcgaagcttgcgtagcgc

SEQ ID NO: 36247 - DNA, 3241 bp, Aspergillus nidulans
ggacaagaaggggacaatgacttctcgggaaataaatacgtctggttacgtgatcccgagaaggcctttgtcaaagggttagttttagaagagcaagatggagctcgattactggtacagacggatgatgggcaggtatgagcaaccggtgctaaggtcatccgcatacttacaatctgcaagcaacgagaagtggacgtcgaccaagttgatagagtcaatccggcaaagttcgacaaggcagatgatatggctgagcttacacatttgaacgaagcgtccgtggtgcataacctccacactcgatatctggcagatttgatttatgtaaggctttatctttcttccgcttgttgccaaagcctgattgacaatacgttactagacctactcagggctgtttttggtgacagtcaacccttactgtcccctgcctatctattccaatgagtacattaatatgtacaagggacaaagtcgcgaggagactcggccgcatattttcgccatggccgatgaagcatttaggaatcttgtggaagagggcgagaatcagagtatccttgtgacgtgagtctttgcgacgcatccgtgtaaatgcaaattctgacgcccgcacagaggagagtctggggcaggcaagacagataacaccaaaaaagttatccagtaccttgcagccgttgcaacatcagataatatgtactctcgctcaggaagcaagcagatgaacaccctttcgcagcagattttgagggcgaacccgatcctcgaggcatttggtaattcgcagactgtcagaaacaacaactcatctcggttcggcaagttcatcagaattgagttttctcgatcagggcagatttcaggtgcttcgatcgattggtatcttttggagaaatcccgcgtggtgaaacccaatttgcaggagagaaactaccacattttttaccaactactcaggggtgccgagcctaaactaaagcaaaagctgcttctgtcgaacttacagatcgaggacttcgcttacaccagagaagggaacgatacaattgctggagtttctgacgaaaaagaatgggactcgttgctcgaggctttccatatcatgaatttctcggaagaggatcaaatgtgcatccttcgcacagttgcagctgtcctccatctaggaaacattaccatcgtgaaagaaagtctacgggctgatcaagccgcccttagtcgagacgcccttgatagtgttcataaagcatgccagcttttgggaattgagactgagccctttgtcaagggcttattacatcccaaggtaaaggcaggccgcgagtgggtagagaaggtacagactccggagcaggttcggctggcattagatgctttagcaaagggtatctacgaaagaggttttggtgaccttgtcaaccgcatcaacagccgactggaacgaaacactgtcacgggtgaagacagctacttcatcggtgtacttgatatcgctggttttgagatcttccaaaacaacagctttgaacaactctgcatcaactacacaaacgaaaagctgcagcagttcttcaaccaccatatgtttgtcttggagcaggaggaatacgcgcgggaacaaattgaatggcagttcatcgactttggcaaagatttgcagccaacaattgacctcatcgaagtcacaaaccctatcggtattttttcttgcctggatgaggactgcgtcatgcccaaagccacggataaatcgttcaccgagaagcttcattcgctatgggacaccaagtccaccaagtatcgcgcctctcgcctccgacaaggctttatcctcacccactatgcagccgaggtggagtattccactgacggttggttggaaaagaataaagaccccttgaacgataacataaccagactgctcgcatcctcgcaagataatcatattgcagctctgttttcagactgtggaaacgcagatgaggttgaccatcccagaagtcgcgtgaagaaaggcttgtttcgcacagtggcccaaagacataaggaacagttgtcaagtctcatgaatcagcttcactcaactcaccctcattttgttcggtgcattatcccgaaccacaaaaaacgcccgaagatgttgaatgcccccttggttcttgaccaattacgctgcaatggtgtcctggaaggtattagaattgcgcgtaccgggttccccaaccgattgtcctttaatgaattccgccaacggtatgaggttctttgccgggatatgcccaaaagctatatggatggacagtctgccgcccggataatgctgcagaagctggctctagataaagcgtggtttagagtcggccgcaccaaagtgtttttccgagctggcgtcctcgcagagttggaggaaaaacgtgacgagctcatccgtacaatcatgacacgattccagtctgtagcgaggggttttgttcagcgcaggatctcaaacaaaaggctgtatcgtgcagaagcaacccatatcatccagcacaacttccgagcctatttggagatgaaggccaacccgtggtggcgtttgttctcgagaatgaaaccgcttcttggggagacacgtactgctcaagaagtgaagagaagagatgaaaagatcaaacaactcgagacgaaaatgaagcaggaccaatccgaacgccagaaagttgaggaagaaagacggcgagcggagatagagatacaacgaatccagcagaccctggagagcgaacgggcattggcccttgacaaagaagaaatcttcaaaaggctgcaagatcgcgaggtagagctcagcgagaaactagcaggcgctattgccgaccaagaaaacctcgaagatcaactagacgaactaatccttgcgaaaaagaagacggacgaagagctcgacctgcgaaaaacacaactcgagcaggccggagagattatccagcgcctagaggctgagaggaaggagatgcagcagaagttggaggatctggagcagaagctgcttgaggcacagagcagtgcctcagagacggaaaaccatatgagggagcttggacaagaggtcaaaatgctgcaaagtcatctcagtctgaaggagcggaaactgcaggatttggaggcaaaactgctgaagaccgaccaagatctggatgtcaagctggcaaaaacatcaaaggaattggaccgatcgaagaaagaagtcaag

SEQ ID NO: 36248 - DNA, 1123 bp, Aspergillus nidulans
cacccgtccttcatccaggtagcaaagccgtatatcttcgagcagaccatccagcaatgcctggccgcaatgggcgtcaatcctctgcgtgaggagtctctacgtctgcagggcgtgacctggatcgataatgttcgtcgggcgctgaatctgtatgtggatcactccattaactgtgaaagttgcttgctaatgagataggccgattcgaacattcaatactgcagtggtatattatcacaagttccggctgatacaccacgacacggactacaataatatggtaaggtttctgacattctcgttttgttgaccgagtctaacggttaaggatgctgccgcggctgccctgtttatggcctgcaagatcgaagacacgctcaaaaagtcgcgtgagattctatgcgcggcgtataatctcaagttaccgcaatcagaacacatctcttcagataatcaggtatggtgcttgttccaacaatgccttgcgactgaatgctgacatcgggtctaatagatactcgacgaacccgcccgaggcatcatcggcctcgagagactcatgctcgagagttccggtttcgattttcgaacgcggcatccacaaaaaactctcataaagctggcaagacagtatagacttacacctcaatcagaagtctcgaacgtagcctaccgcatctcgcaagacctctatcgcacctttgcgccgctcaagcagacgacatctacgatggctttcagctgcctggagctcgccggacgcttactggaacaacgaatcaaggaggttgagcttgggacagactacgcgagatggagaacaagccgggaggaggttatgggtacgtcgaagccacaaagaagccatcagaggactaatggatttagaaactctacttgacctcctcgagctatacacacacaaccgcagtgctacgaccgtcggccctcattttcccgctgaccgcttcctcaccgtacgcattccattgaacaaagaggcagaagaacagaatctcccgcggtacaccaactcgattgatgaagacaaactcacaaaggactcgcgcaagggaccagcaaccaacagctcaaagacggaaaaaggagcaccgacgac

SEQ ID NO: 36249 - DNA, 886 bp, Aspergillus nidulans
atgcacgggttgacgcctgccccagtcacgccgttcactcctaccggtgagatcgactacgacgctatccaacggctgggaagctggctcagtagtatgaacggcgtcaaagggctcgttgtactaggccacgcaggggagggcacctttctgactgccgaggagcaagtcgcggtgatcaaggcatttgtcaagtcagttgacgacaaaatccccatcatcgctggcatcaccggcgaaggaactgaggtggcggcactagaggcgcacgcgtgaaagctgctggggcgaaacgggccttctgtatccatctcacggctggctgcggtttggataccaggacggagcaccccaggatcgctaccgccgtgtctacgaggtcagcaatctcccattgattctcttccagtatccagacaacaccaaggccacatatagcttgcagacgatgctcgatatcgctgcgcaaccgggtgtctttgcaatgaaaaacggtgttcgaaatatgcggcgctgggatacagaaatccctgtaatccgacgcgagcggcctgacctgcagattctgagctgccacgatgagtatctgctacatactgcctttgatgttgacgggtttttggttggatatgggaatattgcgccggagccgctgattgagttgattgaggcgggcaaagccaaagactacagaagggccagggctatccacgaccggcttctcccggtgaccaagagcgtctatcaccgtggatcgcacatggaggggactgttgctttgaaacacgcattggtggcccgagggattctctcacacgccaccgttcgatctccgcttcgtccgctggaggctggtgctgagcaggagatccatgctgcaatcggc

SEQ ID NO: 36250 - DNA, 1282 bp, Aspergillus nidulans
tttgcgactctggccgtccatgctggagctcctcacgatcccaccactggagctgttatcgcaccggttagtctgcgcttttgagacttcccattttgcctggaccagcgctgactgtgacagatatccctgtctacaacgttcgcacaggaaagtgttggtaagccggtagggctgtacgaatacactcgaagctcgaatcccaatcggtcagtacaagatttcaaattaaaaattcagttgaatactgacttcagccagagacaattttgaagaggcggttgcttcgctcgagcacgcgaaatatgcactagcattctcctccggatctgcgacgacggcaaccattctccactcgttagctcctggctcgcatgtcgtttccgtctcagatgtatatggaggaacacacagatatttcaccaaggttgccgcggcacatggcgtcaatgtgtcattctcctcgtgcttggaattggacgtggagaagctgatccggccaaacgagactaaacttgtctggattgagactccttcgaaccctaccctagcgctggttgatatccgcaaagttgccgcggttgcgcatcgccatggcgttctggttgtggtcgataataccttcatgagcccttacgttcagaatccattggatcacggtgctgatgtggtgattcactccgttacgaagtacattaacggccattccgtaagccaccttgtctccggtcctttcacccgtgtgctaacgatccggtaggatgttctgatgggtgttgcagccttcaattcggacgaattgaaagagcgctttacgttcctccagaatgccattggggctgtaccatctccattcgattgctggctggctcaccgtggtctcaaaacactgcatttgcgtgcgcgagaagccacagccaacgccacggctgttgctctagcactcgaatcttcacctcacgtcatatctgtgaattaccctggactcaactctcatccgaaccgtgaaatcgccgtcaagcagcatcgcaagggcatgggaggcggcatgctgagtttccggatcaagggaggtcacaaggccgcccatctgttctgtgaatataccaagatcttcacacttgcagagagcttaggtggtgtagagagtctctgcgaagttccttcaagcatgacccatgctggaattcccaaagaagagcgagaagctgctggtgtttacgatgacttggtccgcatgagctgcggaattgaagatgttgaggacctgacggctgataca

SEQ ID NO: 36251 - DNA, 1206 bp, Aspergillus nidulans
gggtagcgttggatacagctacgatcataatcaaagcaataaaacagcaacttgaacacaagtactgacggatattgttacgctagcgccgctacgaatgtccagacgggggagggcgttgccatcaaaaaggtaaccaacgtcttcagcaagaagattttggccaagcgcgcccttagggagatcaagctgctccaacacttcagaggccaccgcaatgtatgtcgtatcagcgccttttgcatacgggacaaatgaggctgacctgggtgcagattacctgtctctatgatatggatattccccgaccggacaacttcaatgagacatatctatacgaaggttagagcattggtcgcctataggtcgctcactggttactgatactcttattcgaccagaactcatggagtgtgatttagctgctattattcgatccggccagccactgaccgatgcgcactaccaatccttcatctaccaaatcctatgtggactcaagtatattcactccgccaatgtccttcacagagatctaaagcccggaaacttgctggtcaatgcggactgtgagctcaagatttgtgattttggtctggctcgtggtttctcaattgaccctgaggagaacgccggttacatgactgaatatgttgcgacaagatggtatcgcgctccggaaatcatgttgagtttccagagctacacaaaagctagtatgtgccttcgcgctgtttcgaactttgaccaagctgacgtgatgcagtcgatgtgtggtccgtaggttgcattctggcggagttgttaggtggccgccccttcttcaagggtcgcgactatgtcgaccagctcaaccagatcttgcactacctgggcactccgaacgaagaaactctgagccgcattggctcaccacgtgcccaggagtatgtgcgtaacttgccctttatgcccaaggtgcccttccagcgcctgttcccgaacgccaatcccgatgctctcgatctactcgaccgcatgcttgctttcgacccttcgtcacgtatctcggtggaagaggctctggaacacccttaccttgcaatttggcacgacgcatccgatgagcctagctgccccaccacctttgacttccactttgaggtggttgacgatgtgcaggagatgcgccgcatgatctacgaggaagtcgtccgttttcgccaa

SEQ ID NO: 36252 - DNA, 1130 bp, Aspergillus nidulans
ctcttcagccttgttggcgcagctctctgcgcgcctcgtgagcacttcaagcgcactgccagaacgtctgctccggccggctgtctcaccgttggaggaagcgggacctactcgacgatcggcgctgcgtttgcagctttgggctcatcctcgtctgaggcctgcatctacatatcagccgggacctacaaggagcaattgaccttccaatacgctgggccgttgaccctctatggcgaaaccacggacacgagcagttacaagaagaacaccgtcacgataacccatacgatttcctcacctgaagcagggtcccttgttgcgagtgcgactgtcaatgcggccatggataactttaccatgtacaacatcaatgttgtgaatgggtacgggaagggggctcaggctgtcgcgtaaggattttttcatttgcacttcattttcatctccaacttccaatttcatacgattttacttattttatttttattctaacgaatgtatcacactgctgctgacgcctacttttgcagactggctgccagcggagaacgccagggttactatggctgccaattccttgggtatcaagatacgctgtacgcacgcgtgggcgtgcagtactactccaactgctatattgagggtaccggcctcttaattctttttctactctccgggaacagcactgaacatctacaggggccgtagactacatattcggcgacgcaagcgcctggttcggcgaatgcgacatcgtctccaacggtgcaggctacatcaccgccatgtcgcgcgagacagcctccgatccggcctggtattgcttcgaccactgcaatatctacggaaaatcggggctggacttgaccggcgatgtatacctcggacggccgtggcgcgtcctcgcgcgggtcatctatcagaactcggagctgagtgatatcatcaacgcggctggatggacgactatggcagaaggagccacgccactgtactacgagatcgggaatacgggtgacggggcagacacgtccaaaaggctgtatcttagcgagatcagtgcggctgtcaccaaggctacggtgctggggagcgactggacggactggcttgactggagctattga

SEQ ID NO: 36253 - DNA, 781 bp, Aspergillus nidulans
gaagctaccacatggcagtctcggatgactctttttattgcacacggtaacgatagccagaggggtcatattgtcgcggccgctaagtttggattcgccctcgtgaaccgcaatacaggcgagctgtcatacatcgctcgcccgtgggatgaaccagatctgctcagaaggtgagttgaattgtgctctgtgaatcgaacgagttcctgacccatataacagaatgcgcttcaacgatggggcggtcgacagcaagggccgtctctgggctggagccatgaacgatcccaaggtccaaagtctgatcaatgaaggggtgcttttccggctagatccagacctgaaactgagtcgtatggttgagcagttgacgataccaaacggtattggctggaactccgccaacgatacgatgtatctgacagattccccaacggggaagatcttcgctttcgactttgacgagagcactggagagatcagtaacaggagagtccatttcgacactggagagccaaaagaacctgacgggttcgccatcgacagtgaaggatgtatctggagtgcaatctacggcgggggtaaggtgatccgcatcgatacccaaggcaaagttattggcgagatctcacttcccacccgaaacatcacctgtccggcttttgtggggacagaactattcatcaccacggccaaggacgacaaaaatgacgacaagttcccggagtcgattcggtatggagggcatctctacaaagttgatgtgggagtccgaggacaa

SEQ ID NO: 36254 - DNA, 1089 bp, Aspergillus nidulans
ggcactttctctactgtatacaaggccgaagatctcctatacgaccactaccgaaatgattgggatgtatttcaagatactccgagagatgaatcgacaaattcgccgtcaaaacgtcgtcgagtagaagacgagaacgggaatacgatacccatcaggcgaacgaaaccacgatatgttgcgctgaaaaagatatacgtcacaagcagcccactgcgcatccagaatgaactggaactattacatgatctccggggatgccgatcagtttgccctctgataactgcattccgtcatcacgatcaagtggtcgccgttctgccctttttcccgcatacagactttcgacttcagtaccgaacgttcatggtggctgatatgcgccattactttcgatcgttgttcactgcattacactcggttcataagcacaatatactgcaccgcgatatcaagccaaccaactttttgtacaatccggacttacgggaaggcgttttggtggacttcggtttagcagagcgcgaaggctccgagtatacagggacatgtctctgcacaagcacgagccatatacgtcgcgcgcgttacacccagagttaccactatacccactgtgcctcttccggcctcgctataggctatccgaaaagtgactctcggccgtcaaggcgtgccaatcgtgccgggacgcgagggtttcgtgcacctgaggtcctgttcaagtgcacctcgcaaacaaccaaaatagatatgtggtctgccggcgtgattctactaacattgcttggtcgtcggtttccattcttcaactcagccgacgacgtcgacgcactgatagaaatggcgagcatattcggcacccgccgcatgaaaaatgccgctgccatgcacggccagatatttgaaaccaatattccgaccatcggagaaaaaggttatagctgggaaaagcttgtgaaatggtctagctgtgtagaagagctgacagagagtgagaaacaagctacccgactgttagcaggattgatggaactggatccatccaaacgtctaaatgctaaagaggctatgcagcacgaatttttt

SEQ ID NO: 36255 - DNA, 1074 bp, Aspergillus nidulans
gcagggatcctcgtttacagcgtcatagtcaacttcatgtgcggccatgtcaggaatgcaggggcattcttcacttttgtgctgctcatttatacgggctatatcaacatgtctgtcatcttcagaaccatcggttgcctgtcgcctgctttcgatcacgcaatgaactttgtatctgtcttgatcactttgtttatactaacgtctggataccttgttcagtggcctaatgcgcaggtttggctacgatggttttactatatcaaccccttcgggcttggatttgctagcttgatggtcaacgaatttaaaagcctcaatatgacctgtaccagcgagtccctaatcccaaatggtgatggatacaccgatatgaaccaccaagtgtgtacgcttgctggaggtgaagcaggttccccaataattcctggtcagagctatttatcgaccacattcaactataacagagaggatctctggaggaactttggcatcatggtggccctcatcattgctttcttagggatgaatctgtacttcggtgaagttgttaggtttaacgctggcggcaagaccgtcaccttctatcagaaggaaaatgctgggcggaagaaactgaacaaagcactggacgaaaagcgcgctgctcgacagtcgaacgaccttggtggccctggagccgatatattgctgacatcgaagccagtcctaacatgggaagatgtatgctatgacgttcctgtgccgtccggcactcgacgactgctgcacaacatctacggttacgtacagcctggtaaactgacggccttgatgggcgcatccggagcggggaagacgaccctgcttgacgttctcgccgcgcgaaagaacattggcgtaatttctggcgacattttggtagatggtgccaagcatggtacatcgttccaacgaggcacttcctatgcagagcaaatggatgtccatgaacctatgcagacggtgcgcgaggcactgcgtttctcagccgaccttcgtcaatcgtatgacgtcccgcagtcggagaaatatgcttatgtgaagagtttccta

SEQ ID NO: 36256 - DNA, 1552 bp, Aspergillus nidulans
atgcctatctccaagatccacgcccgctcagtctacgactctcgtggtaaccccaccgttgaggtggacgttgtcaccgagaccggtcttcaccgtgctattgttccttctggagcttctaccggtgtgtaacctattgagcatgcgtcgattgatgaaaaacaaacgttcctaacttcaattgcaggtcagcacgaggctcacgagctccgtgatggcgacaagtccaagtggctcggaaagggtacgtttgcaaccactcccacaagtttgatacgagatggggacctctaacaatggttctcaaataggtgttctaactgccgtcaagaacgttaatgagaccattggccccgccgtcattaaggagaacctcgacgtcaaggagcagtccaagattgacgagttcctcaacaagcttgacggaactcccaacaagagcaaccttggtgccaacgccatcctcggtgtcagtctggctatcgccaaggctggtgccgctgagaagggtgtccctctttacgctcacatctccgacttggctggaacaaagaagccctacgtcctccccgtccccttccagaacgtcctcaacggtggttcccacgccggtggtcgcctggctttccaggagttcatgattgttcctgagtgagtttcttgccggccgtttgcattcgttcaagtatactgacatatggaaagcactgcttcctctttctccgagggtctccgccagggtgctgaggtttaccacaagctcaaggctcttgctaagaagaagtacggccagtctgctggcaacgtcggtgacgagggcggtgttgctcccgatatccagaccgctgaagaagctctcgacctcatcaccgaagccattgagcaggccggctacaccggcaagattcacattgccatggacgttgcctccagcgagttctacaagcccgaggagaagaaatacgacctcgacttcaagaaccccgacagcgacccctccaagtggctcacatacgaacagcttgccgacctctacaagtcccttgctgccaagtaccccattgtcagtattgaggaccctttcgctgaggacgactgggaggcctggagctacttctacaagacctctgacttccagattgtcgggtatgtattgcaatccgctttttcctagtaactgatctaactagttaatagtgatgacctgactgtcaccaaccctctccgtatcaagaaggccattgagctcaagtcctgcaacgctctccttctcaaggtcaaccagattggtaccctgactgagtctattcaggccgccaaggactcctacgccgatggctggggtgtcatggtctctcaccgttccggtgagactgaggatgtcaccattgccgacatctctgtcggtctccgctccggacagatcaagactggtgctcctgcccggtcggagcgtttagccaaactgaaccagatccttcgtattgaggaggagctcggcgaagacgccgtctacgcctgccagaacttccgcagtcttgtaaccttgaaa

SEQ ID NO: 36257 - DNA, 708 bp, Aspergillus nidulans
ggcatcggcctcgccatcacaaaatacctcctctccgccccccaatcgcacaacgtcgtcgtgatcgcgcggagcgtcgagcccctccaggccctgaagaacgaatacaaggaccaagtcgccatcttaaacggcgatatttccgacttctcgctcgcgacgagagcagtcgagctcgcactgaagagcttcggacgcatcgacggtctggtcctgaaccatggtatcttgggacaggtgggcaaaattgcgaccgctaatattgaggagtggaagaagggctatgatgtgaatttcttcagccttgtctcgttcgtgcaagcggcactgccaaagttgcgggagagcaagggaaagattgtgtttacaagttccggagccgcggtctctgcgtaccgcggatggggactctacgggtccacgaaggccgcaatgaatcatttggctttgagcttgggtgaggaggagccagatgttacaagcatttttatccggccgggcatggtcgatacggaaatgcagagggaactgagggaggatcatgcgccgcccctcgagccgcaggtccattctaagtttacgacagtgcacaacgaagggaagttgctgaagcccgagcaaccagggcatgtcatggccaagttggtgcttgatgctcctaaagaactgagcgggaagtttctttcgtaagtttctgctcaaattgct

SEQ ID NO: 36258 - DNA, 998 bp, Aspergillus nidulans
agcaaggtccctcagccgggcccagcgaagctcaagcgcaatgcaggaccggacgagtggttagaggcagccaaggactgcaaatacctctcggagtcacatatgaagcagttatgtgagattgtgaaagagtatatgatggaaggtgcgttctgcgcgagctagctgaaactattttcagatgctgagatctgtgcgtctgcctagagtccaatattcagccagtatcgacccccgtcaccgtctgcggagatattcacggacaattctacgacctcttagaactatttcgcgtctccggtggtatgccagacgcgtcgctagctgaacctccgaagacttcttctgctgtgattacatcggacgacattgaaccgcccaccacgataacagatccagagttgagaaagaagttggggaagccagggacagcaggagatgatgatgatgacgatgatgataataatgagaatgctggtcaaaaagaaaagtcttcgagttcagggacttcggaaatagctgtcaaccgcaacttcgtgttcctcggcgactatgtggatagaggatatttcagtctggagaccctgacattattattgtgtttgaaagcgaagttcgtcatccagactgtttttgatatgggtgtagctgactattgaaggtatcctgaccgggtgacgctcgttcgtggcaatcacgagtctcggcagatcacacaggtatatggtttttacgaggagtgtttgcagaagtatggaaatgcttccgtctggaaggcctgctgtcaagtgtttgattttatgaccctgggtgctattattgatggtcgggtcctgtgcgtccatggaggactaagtccagaaattaggaccctggatcaagttcgagtcgtcgccagagctcaagagattcctcacgaaggtgcattctgtgacttggtctggtcagatccagacgatgtcgagacatgggcagtcagccctcgaggagccggtaag

SEQ ID NO: 36259 - DNA, 1543 bp, Aspergillus nidulans
cagcgtcgactgggaaaccgccagatccaattaatcgccattggaggctcaatcggtacggcgaccttcgtctctatcggcggcggcctggccaagggcggttcaggatctcttctgatctcttggttcatccactgctgttttctggcgatggtcaataactgcctgacggagatgtccgtataccagccggtcgagggagggtttatccgcttggccggtaaatgggtcgatgatgcctggggtttcatggctggctggaacttcttcttgtacgaggcgctgctgatcccgttcgagattacggccatcaatgtggtcttgacctactggagggacgatattcccgtgtggagtatttgtttagcatgtgttataatctatgggtacgtttgcacggtccctgcggtagtccctcacgaaagactgaccggctaggcttttgaatatcctcgccgtccgggcatacggagaagccgagttctggctctccggcggaaaagtgatcctcatcctcatgctcttcgcgtttacgttcgtcaccatggtcggcgggaacccgcagcacgacgtatacgggtttaggaactggaacaagcccggcgcattcgccgaatacctcagccacggtaaccttggtcgttttgagggtttcctcgcctgcctctggtctgccgggtttgcctgcgtcggacccgagtatatctccatggtggcagcggaggccaaacaccctcgcagatacattagagcggccttccagaccgtgtatttccgattcattgtgttcttcataggctcggccctttgctgcggtattgtcgtctcctatgcggatcccaccctacgcgccatccatttcggtgacggtgaaggctccggcaccgccgccgcctcgccctatgtaatagccatgaaaaacatgtctatcgaaggcctaccgcatgtcgtcaacgccctcctgatcacctccattttcagcgccggaaacacctacacctatacagcgacccgtatcctgcattccctagccctagaaggccgagccccacgcatcctccgcaagtgtaccaagcagggcgtccctatctactgcttccttgttgtaatgatcttcccgtttttgtccttcctccaaatgggcgacagttcctccacggtcctcacctggctcacaaacatcatcacggctgccggtcttatcaactacgtcatcatcacccttacgtacatcttcttctaccgtgcgactgttgcccaaggattcgaccgctccacgctcccttacactggttggttccagccgtactgcggctacctcggctttgcgtggatgtttaccgtggtctgctgtttcggctacgagagtttcaccccctggagtgtagagaccttcttcaccaactacacgatggtccttcttgcgccggtcctgtttctgggctggaaattggtgaaacggaccagatttgtcacaccgcttgagacagatctgatctgggaggcgcctgagattgatctgtacgaggaggagctcagtgtg

SEQ ID NO: 36260 - DNA, 1849 bp, Aspergillus nidulans
aaacacttcttctcagaccccacccatctggttcacacggcgctcaattcgctgacgctcactaacccgtcactcgcgttcgaccgcgagaataagatcatcttccgtcgtcccgatgtcgtgaggaaggggaaagtcgccatcatatcgggtggagggtctggtcacgaacccgcgttcgcggggttcgtcggccagggtctcctggatgcatcggcggcaggcaccatctttgcgtctccgaacgcagagcagattcgtatcgctgcaatggagcgtgttaacaatgaacaaggagtgctcatcattcctatgaactacaccggcgacgtcctcaatttcggtatggccgcggagaagtcgcgcgctgccggaatcaagaccgagttcttcgccatcaatgacgatgccggtgttggcaaaaccaagggcggcaaggttggtcgccgcggtattggaggcggtgtcctgatcctgaagatcgtcggcgcgctggcagaggctgggtaagttgtctcgttactcggaactgatgaaatcctgacaagttgtagtggctcgcttgaagaggtctacaagaccgctcagttggcaaatgagaatcttgcctcggtcggctcatcattggagcacgtccatgttcctggtcgagagccatcggatgaccacatcccagagggcgaggttgagatcggcatgggtatccataacgagccaggatctacccgcaccaagactactctcgtcgatctagttgcgacgatgctcctccagatcctggaccacaacgaccctgaccgatcatatatcacgcattcgccaggggacaaatttgtgctgctggttaacaaccttggtgggctcagcactctcgagctgtccggtatcaccgatgaggtctaccgccagctcggtaaatcgtatcagatcaagcccgagcgagttatccagggcaccttcctcaccagtctgaatggactcgggttcagcatctcactgctcaagctggcagacaccgggctgggccccggcaagtcgttccttgagctcctcgacgctcccgctgaggcggtcggctggtccgcgcctatcaagcctgcgacgtgggaataccgcaatgcccccggaattgaagtcaagagagccaagccagccgagcagcctcccagcaacgtcaagcgtacgtcccgtgcctccctttattgacacgtgctaacagtacacagtggatatcgcaaaggttcgcaaagtcctcggggccgctcttaagcgcatgatcgatgcggagccccagatcacccgctacgacaccatcgtcggcgacggcgactgcggcgtcgggctcaagcgcggcgcccaggctgttctcgacctcctcaacgacgcctctgcaaacctcaacgacgatatcgtccacacagttaatcgcatcgtcaccgtcgttgaaaacactatggacggcacctctggcgccatctacgccatcttccttaatgcccttgtccacggcctccgtgagcaagacaagggtaccgaaacgcctgctgataccgacgtctggggcactgcgttgaaatactctatctccgcgcttgggaagtacacccctgcccaggtcggtgaccgtaccatgattgacgccctcgtaccgtttgcgcaaactctagcggacaagcgggatgtgcatgctgctgccaaggccgcggaggagggcaccgaggccacaaagcacatgaaggcgtcgctggggcgggcggtgtatgttggaggcgagcaggaatgggttggcaaggtgccggatccaggcgcctacgggctcagtgagttctttactgggctggcgggcgct

SEQ ID NO: 36261 - DNA, 1022 bp, Aspergillus nidulans
gacgtggtgagaatgatcagaagagtagtcacaactcgagctcgagctcatctgccggaaactcggcgaattcctggtccttgggccggatggctgttgtcgcgtcgctagctgctggaatcggctacggaattggcaactcggaccaactgttggagcccaaggacgctggcaccccacggtatggaaccgcaaaagatttcgaaaaggtacaaacaaggacccagtacggctattgtgaaatgttgctaacgatcgcctttgtcgtttaggccatcgctgagcttcaggttaaattgggagaagatgcgattagcacggatgaagacgacctacaacgacatggcttctcggagtggtcaagcgtcaatgcgcagcgcttaccggtcgccattgcctacccatccagtacagaggacgtttcggagattgcaaaaatctgcaacaaatacaagatgccaatggttccgtactccggtggttccagtctggaagcaaacttttcagctgcctatggcggcttgacgattgactttgcatacatgaacaaaattctggacctacatgaagcagacatggacgttgtggtacaaccgtctatccagtggatggatctcaacgagaaaatcaaagacactgggctcttctttccggtcgatccaggtccatctgccatgattggcggtatgattggcacaaactgcagcggtacaaatgctgtgcggtacgggactatcaaggattgggtgatcaacctcacagccgtactagcggatggcactgctatgaagactcgaagacgtactcgtaaaacgccagtgggatacaaccctactggcttggttggaggggtaaaaaggaacattcggtttggcacccaagcttcccttaaggttgcccctaattccgacggaaaacgggttggcagtggtttccttccttacaatgcgcgatgatgcatccaccggaaccacttgaaagggaaagggcttcctgcccggggaatggaaatttggacaatt

SEQ ID NO: 36262 - DNA, 1516 bp, Aspergillus nidulans
ctctcgccttccacgggcaaagtttttttcgaacagccccggcgtcacggtcgaacaagtgagacagatcgcccaagcctgcgaagatgccttccgcacttacaggaaactgtccctcgatcagcgcaaagctatcgtcgttaaggcgctggaaatcatcgatgccaacaaagagactcttgcgcatgagttgactacacagatgggtcgtccgatttcatataccgccggtgaggtagataccatgcgcaagcgagccaactaccttatcgatcaggcggaggatgccctcaaaacgatcccgggacaagaggagaacggtttcaagaggttcgtcaagaaggcgccagttggtcctgttcttcttgcaaccgcatggaatgtaagttgccccaggctttccgaagggttggaagctaaccggtcagtatccttacttgatcaccatcaacgcactcgtccccgcgctccttgccggaaacaccgtgatccttcgtccttcacctcagactcctcttgttggcgatcggctctctgaatactttgagaaagctggtcttcctaagaatgtgctgcaggtggtgcatctgggttcgtgggacgttctagatgaggtcgtcaagattccccagatcaagcttgtttctttcgtcggttctactcagggtggtctccgtctccgccaggcgaccgccggccgaatcttgccactgaacttggagcttggaggcaatgacccggcttacgtccgtgccgatgcggatctcgcgtacactgccgcgcaggttgtggacggcgcagtctttaactctggccagagctgctgctcaatcgagcggatttatgtgcatgcagatgtgcacgacgctttcgtagccgaggttcgaaaggagctagcaacgtacgtctctcaccctgaatcaagaacatcattaacgaatgtagatacaaactcggcgaccctctcgacaaggctactaccactggccccgtgatctcccatcaagctgtcaagaacattcaagcccacattgacgacgcattgtcacgcggtgctgtggactcgacccccgagaaccctactttcgcgaaaattcccagtgaaggaagcttcatcgccccacgcgtcctcactaatgtatcgcacgacatgcgcgtcatgcgcgaagagacttttggccctgttgttcctattatgaaggtgcagagcgacgatgaggcagtggcgcttatgaatgacagtgactatggtctgactgctagcgtctggaccaaggatatcaaggcaggagaggacttgattgagcgtatcgaggcgggaaccgtcttcatcaatcgttgtgattatccttctccggttcgtggcaaaacccactatgcatcgaatatgatactaactgcaaatcaggacctcgcatggattggctggaagagctctggcttgggctgctcgctcggtccgcaagcgtttgacgcattctacaagctgaagagcttccacatccgtacaacccac

SEQ ID NO: 36263 - DNA, 2736 bp, Aspergillus nidulans
gatgatagagagcaagatattgacgacctcatcgacgaacttgagtctcaggatggactccatgataatcctagtcgaaagagtatggactctggaagccggattcctggtatggaggcgcagtttgacaccgacataacgactggtctcacttctgtcgaagcggcacagcgccgcaaaaagtacggacccaaccagttgaaagaggagaaggagaatatgttaaagaagttcttgtccttctttgttggcccggttcaattcgtgatggaggtcagtaacagagctcattttgcccgacttccatcatcgctgacgctgattggtcatagggtgctgcaatcctagctattgggcttcgagactgggtggactttggcgtgatatgtgctctccttcttcttaacgccactgttggcttcatccaggaataccaagcaggatcaatagtggaggaactcaaaaagtcgttagctctcaaagctattgtggtccgcgacggtcgagtaactgacattgacgccactgaagttgtaccgggtgatgttctgaagatcgatgaggtattacccatattgtggctgattgaagacggcgaaggctgactcctagcagggcacgatcgttcccgccgacggccgtgttaagacgaaccatttactgcaaattgaccaatcctcagttaccggcgagtctctagccgttaacaaatgcaagggcgaagtttgctacgcttcatctgtggtgaagcgtggccatgcgtatctcgttgttacggctaccggtgattacacatttatgggaaagacagccgccctggtcaagtctgcgtcgtcgaattctggccattttacagaggtactcaaccgcattggtgctactcttcttgtgttggttgtactcaccttgatcgtcgtctgggtgtcgtctttctaccgttcaaacgagaccgttacgattctcgaattcacactggccatcactatgattggagtacctgttggcctgcccgccgtcgttaccacaacaatggctgtaggcgctgcctatcttgccaaacgacaggcaatcgtacaaagactctccgccatagaatcgttggctggggtagaggttctctgctctgacaaaaccggaaccctaaccaagaacaaactaaccctctcagatccctacacagtcgctggcgtggatcctaatgacctcatgttgaccgcttgtttagcagcttcaaggaagctgaagggcatggatgctattgataaggcattcattaaagcacttccaaactatccgcgcgctaaagaggctctctctcattacaagattcagcaatttcacccatttgacccggtctccaaaaaggtcaccgccgtggtgttatctccagaaggccaggagatcatctgcgttaagggggcgcctttgtgggttctcaagacggtttcggaggagcagcagatcccagagagtgtcgagaaaggatattctgacaagatggacgagttcgcccagcgtggctttcggtcccttggtgttgctcggaaacctgcgggtggggaatgggagattcttgggatagtgccatgctctgaccctccacgcgatgacactgcggcgaccattaatgaagcgaagacgctcggactatcgataaagatgctcactggggacgctgtacccattgcgcgcgagacttcacgtgagttagggttgggaaccaacgtctataattcggataaactcggtcttggaggcggcggtgacctgactgggtctgaactttacaattatgttgaagccgcagatggatttgcggaggtttggccccagcataagtataatgtcgtggatatcctgcagcaacgaggatacttggtggcaatgacaggggatggtgttaatgatgcaccatcgctcaagaaggctgatactggaattgccgtcgaaggcgcatcagacgctgctcggtctgctgctgatatcgttttcctcgcgcctggcctatcagcgattatcgacgctctgaagacttcccgtcaaatattccaccgcatgcatgcatatgtgatctatcgcatcgcgttatctctgcatctcgagatattccttgggctctggattgcgataatgaacgaaagcctgaacctgcagcttgtggtcttcattgcaattttcgcagacattgcaactctggcaatagcttacgacaatgcaccgtactcgaagacgccggtgaagtggaatctcccaaagttatggggcctgtccgtcatactgggtattgttctagccgtggggacatggattgcactgaccactatgatgaacgcgggcgaacatgccgggatcgtacaaaattacgggaaacgcgacgaagttctcttccttgagatatctctcacggagaattggttaatatttatcactagagccaatggcccgttttggtcttctctgccgtcatggcagttggcggcggccatttttgttgttgatctcgttgcaagtttcttttgctacttcggctggttcgttggtggacagacttcgattgtcgccattgttcgtatctgggtattttctctcggcgtattctgcgttatgggaggtgtctacttcctgctgcagcgttcccagacttttgacgacattatgcacttcaactttctccagaaaagggactctgtatctcagcgtgttcttgatgatcttggtaagcttctccaaacagcc

SEQ ID NO: 36264 - DNA, 1387 bp, Aspergillus nidulans
cgatttcccggcgcagtcaacagcaaattcacaacggagatggccttcatcaacccaatggataaacctgggattccaacgtaccgcgttatggattccgacggtgtgctgatcgataaaagtcgtagcgagctcagtgtttcgaatgaagaggcgttggcgtggtataggaatatgttaacgggtgggttttgggtgtacattcctataagtctattttcagcattaatgggtatgcgatatacagtgagcattatggacgtgatcatgttcgaggcacaacggcaggggagattaagcttttatatggtacgagacctcttcctagccttagaagggcagtttttgctgatgagatacattctcgaaaggtctcagccggtgaagaaggcatcagcgttggctccgcagcagctctaacaccggacgatgtcgtctttgcacagtatcgcgaaaccggcgtttttcagcagcgaggctttgcgctaaagaacttcatgagccagctcttcgccaatgcgaatgataacggtcgaggaaggaatatgcctgttcactacgggtgcgagtatccgaaaaccgtacttctatccctcctccctttgatgaagttcacactgacaaattgacccagcatacaatctcctccaccctagcgacccagataccacaggcctcaggcgctgcctacgcactgaaactccaagctctacagaatcccgacacgccaccacgcattgtcgcatgctattttggtgaaggcgccgccagtgaaggcgacttccacgctggtctcaatatcgccgctacaagatcctgcccagtggtcttcatctgtcgaaataacgggtacgccatttctacgcccacattagagcagtatcggggagacggaattgccagccgcggggtgggctatgggatcgacacgatccgcgtcgacggaaatgatatcttcgctgtttacgaggctatgaaggctgctcgaactctggccctttctcaaggaggaaaaccggtacttattgaggcgatgtcttaccgtgtctcgcaccatagcacgtccgacgatagctttgcgtaccgtgcgcgcgtagaagttgaggattggaagagaagagataatccaatcatcaggctccggaagtggcttgaaaatgaggggatttggaatgaggatatggagcggcaggctagggagagtattcgaaaggaagtactgagagagtttggggaggcggagagggcgaagaagccggctattcgatttgcgtttgaggatgtatatgatgaggttacggaggaggcgagggagcagatgaaggagttgaggagaattctggaggagtatccggaagagtatgaccttcgctcgtttgaaggagga

SEQ ID NO: 36265 - DNA, 1089 bp, Aspergillus nidulans
aacctctccttcgtcctcgaaggcattcatcgggtcaaattcgaggatcgccccatcccaaagctcaaaagccctcatgatgtcatcgtgaacgttaaatacacaggcatctgcggcagcgatgtatgtacatgaccacaaacgaccgggacaatcgggctaacacaccaggttcactactgggatcacggagctattgggcaatttgtagtcaaggaacccatggtcctcggccatgaatcttccggaatagtcacacaaattggatcagccgtcactagtctaaaagtgggcgaccacgttgcaatggagcctggtattccctgccgacggtgcgagccctgcaaagcgggcaagtacaacctctgtgagaaaatggcttttgccgcaaccccgccgtatgacggtactttggccaagtactacacgctgcccgaagacttctgttacaaactgcccgagtcgatcagcctgcccgagggtgcactcatggagcccctgggagtcgccgtacacatagtgagacaagcgaatgttactccgggtcaaaccgttgtagtctttggagctggtccagtgggtctattgtgctgtgcggtagccaaagctttcggtgcgatcagaatcatagccgttgatatccaaaagccaagattggattttgcaaaaaaattcgccgcaacagccacattcgagccgtcgaaggcccccgcgaccgaaaacgctacccgcatgattgcagagaatgaccttgggaggggtgctgatgtcgcgattgatgcttcgggtgttgagccgtcagttcacacgggtatccatgttctccgccccggtggcacctatgtacaaggtggcatgggtcggagtgagatgaatttccccatcatggcggcttgcactaaggaactgaatatcaagggaagcttccgatatggtagtggtgattataagctggcagtacaactcgtggcttctgggcagatcaacgtcaaggaactgattactggcattgtcaaatttgaagacgccgagcaagcttttaaggacgttaaaaccggaaaaggcattaaaacgcttattgctggccct

SEQ ID NO: 36266 - DNA, 1283 bp, Aspergillus nidulans
ctgcgcgaggcgttacgtcgaagggaagacaagctgtgccgtcgaaaactgacgattctaccttcgtcttcggttgatttctcatcaaacgactttttgtcactatccacatcgccagcctatcgagcgcggtttttggatattttgcaacaagcgccgccgttgcacccgtttgccagcggagggtcccgcctcctagacggcaattcagcctatgccgaagagctggagaacttcattgccgcgttccacaatgccccgagtggcctactgttcaattccggatatgatgccaatgttggcgttttctcgagtatcccgcaacccggagatctgatagtatacgatgaactcatccatgccagcgcgcatgagggcatgcggctctcacgagcagggaagcgtatcaagttccctcatagctctcccgatggcctgagagcagtactgcaagcagaaataactgcagatccccgacttcttcagggccgccggaacgttttcatcgcctttgaatccgtctacagtatggacggcgatgttgcgcctattcgtgagttcgtagagatcgtggaccagcttctcccttacggtaacggatacttccttgtggatgaggcgcatgcgaccggcgtctttggaccacgcggttctggggtagtccaagagttgggactggaggatcgtatgttcgtccgggtacatacgttcggtaaagcactcgctagtcatggaggtaagtctcgcgcgttgtctttgggtgtcgatattgactgtcctgctagcaatcgtattgtgttgtgcggatactagagactacctgatcaattacgctcgcagcctgatctataccactgccctgggatttccctttcttgcttcaatacgtgctgcctatgaactactcgttgagggaaaaactgagcaggtacggtccttcgcttgaggaagcaacgtttcattacaggcctatgggaaagctaacaaatatccagctccagcacaaactcggacaactgattgctcacttccggacggggttggacaatctcaaccacaaggactcgtcgacctttgaagttgaacattttacgaactcacccatattttcccttcgcagcagtgtgccccgtgtgctcgccagcgtatgccaggagcagggatataccgtccgtgcaatcatgccgccaactgttccagcagggaaagaacgtgtacgcgtatgcttgcacgcgggaaacacggtggaggaggtcgacggcctccttgagaccattgctacg

SEQ ID NO: 36267 - DNA, 3020 bp, Aspergillus nidulans
ctactggtccttggacgtcctggatcgggctgtacgtctttcctgcgtgtgctttccaacgaccgagaatccttcgatgaagtcaccggcgagacttggtacggatccatggaccataccgctgcaaagaaataccgccagcaaatcatgttcaacaccgaggacgacgtacatttccccacattgacagtaaatcggacgatgaagtttgcgctgcgaaacaaggtgccccgccagggggaagagggaccaggggagaaggagtttgttctgcgagagcgggatagtatcttgaattctctgggtatccttcacaccaagaagacgctggtcgggaatgaattcgtccgcggtgtatcaggaggcgagagaaagcgtgtgtcgctggcagaggtcatggctggacaagtatatcagcccacagtcacgcgcatggaagttcatactgactttgtacgatgtacagagtcctgttcagttctgggataaccccacacgcggtctagactcgaaaacagccgcagagtttgcgggaatgatccggagagaggcttatgaaaacgggaagacgatagtgtgcacaacctaccaagctggaaatgacatctatgacaagttcgacaaggtcctcgtccttgcagaagggctagttacctactatggtcctcggagtcaagcccgcagctattttgaggatttgggcttcgtgtttcctaagggcgccaatgtcgctgacttccttacttctgttactgttctcactgagcgtattgttgctccagggatggaagagaaggtcccaaatacccctcaagagttcgaagctcgctaccgtgcaagcgctatctaccaagaggcggtcgatgtaatcatccctccagaaaagctggcttctgaggaggaggatcttgcaacagcagttgctcgcgagaaggggaagggccatattccccggcctccgagtgtgtacacaactggcttgtgggcccaaatcatcgcttgcatgatcaggtcagttccctagtcattccagaagcccttgctgacaagtcagacaattccaaatcatggcaggcgacaagttctcccttatcatcaaactcgcctcctccataatccaggccctggtctgcgggagtctattctacaatctccagatggatagctcgtccatcttccttcgacctggcgctctattcttcccgtgtctctactacctccttgaatctatgtctgagactactagctctttcatgggacgtccaatcttctcccgtcacaagcgatttggcttctaccgaccgacggccttttgcatcgcgaatgcaatcactgatatccccattactatcctgcaagtctcttgcttttcgctgatcctctactttatgagtgcgctgcagatggaggccggaaagttcttcacgttttggatcatcatcatcgccaatacgctatgttgcatgcaaatgtttcgtgccgtgggggcgttgtgtaagagattcggcctggcgtcgcaattaacaggcctgatttcaactatcgggttcgtttatggaggtaagataccggagtgatacgcagcctctgtttagctagggctaacatgcaatcaggctatctcatcccattttctaaaatgcacccctggttccgttggattttctacttaaacccttgttcatacgcattcgaagcaatcatggccaacgaattcacaggcctcgagctacaatgtgtcgagccaaactacatcccttacggcccgggttactcggacacctcttcgtcaaaccgcggctgttccgcccaggaagcaaaggcgacttgatctcaggagccgcgtacatccgcgaacagtatagctacttgcccggttttatctggcgtagctttggtgtactcgtcgggctctgggtattctttatctttttgaccgccgtcgggtttgagaagctgaatagccagggtgggtcgtcggtcctgctgtataaacggggcagcaaccccagctgccagaatgagcggccagcgaccgcggcgaacagggagatggctcttgcacagtctggaaagcaatccatattcacctggaacaagctcgactatcatgttccgtttcatgggcagaaaaaacagttgcttgatcaggtgttcgggtttgtcaagcctgggaatttagtggctcttatgggctgcagcggtgcgggaaaaacaacgtgtgtatagagaatacatcattatttgctaggatactgaccatttaccaggctcttggatgttcttgcccagcgtaaagatattggtgaggttcgtggttctatcctcatcgacggacggccccaaggtatcagctttcaaagattaactgggtattgcgagcaaatggatgttcatgaggggacttcgactgtccgcgaagctctgattttttctgcattccttcgacagccatcaagtgtcccagaagaggagaagttggcttacgttgaccacattattgatcttcttgagctatatgatatccgcgatgctcttattggaagtaagcttttcatggattgaaaagctggaaaaacgttaacttgtacagctcctggcgctgggctcagcattgagcagcggaaacgggttacattgggtgtggagttggttgcgaaaccaacgctgctcttcttggatgaacccacctctggtctggacggacagtcagcatataatagttagtacgcttgataccacagtctcgtacgtgtgctaaccacggaagtcatccgcttcctgagaaaactagtagacggaggccaggctgtgctctgcactattcatcagccgtcagctgtgctctttgacgcatttgactcacttctcttgttggctaaagggggaagattggcatactttggcgagagtaggatcccttcccctacttatcgacccaaggctctaactagactagctggtaaggactccgagaaggtactagagtactttgctgggatttgaccaccatgtccgcc

SEQ ID NO: 36268 - DNA, 1049 bp, Aspergillus nidulans
gagacgcccccgtatgagttcgaagagctcattggtaagggcgcctacggtcgtgtgtacaaaggccaccagcttccgtctcgagaagtcgttgctatcaaggttcttgatatcgactcattagattataaatcggtgcgcgatttcaaggatgagtcgattaaggatttcatacatgaaacgaaggtgatgaagcaggtcaaggatgctggggcgaagaatatcaatgaaatcatagaggcggtgtctattcattcacagctctggttggtttgcgagtattgcccaggtggtagtgttaggactttggtaggttgctcaaacttggacttgtgaactgttgctgaatgttcagatgcgagcaactggtgatcgactcgaggagaggtttgctatcccggtagctcgtgagctggctgctggattacgtgctatacacgatgcgggcatcatccatagagatattaaaggtgtaaacgctatgttacatgatttggtgtaaactcttgctaactcagatactagctgccaatgtccttattcatgaggaaggaagactacaaatatgtgactttggtgttgctggtgttctccagtcacaaatggataaacgatcgacctggatcggtacaccccactggatgcctccagaaatgttcactgccaagcaggatcatcagtacagtagcgaggtacgtacattgatactcgtcatatattgtcactgacaacctcaggttgacgtttgggcatacggttgtacactgtttgaacttgctacaggaaacccgccaaacgcaaatcttcgagagagaatgcagattggcagacagttgaacagaaaaacaccacaactagcagatggcggtgaataccctgagggtttgagagatctagtagcatatgctttgaactcagatccggttacccgaccatcaatggcggatattttattacacccctatattgcgaattccgaggaagagtacccaacatcatccctgagcgagctcgtccgcatatactaccaatggtcccagcgcgggggc

SEQ ID NO: 36269 - DNA, 906 bp, Aspergillus nidulans
gtcaaagctaaaaaactaggtgaaggtacatacgctgtagtctatctcggccacgtccgatccgatcctacttcattcgtcgccataaaaaagataaaagtcaatacggaatacagagatggattatccatggacgcaattcgggaagtgaaatatctccaggagctctcccatcccaatgtcattgcgctccatgacgtattctcgtcaaaggaccagaatctcaaccttgtcctggagtacttaccacgcggtgacttggagatgcttatcaaggacagcgatatccactatggtgctgccgatgtgaaagcttggatgggaatgcttatccgcggggtctggttttgtcatgagaactttgtcctgcatcgtgatatcaagccaaataacttgcttattgcctcggacggggaagtcaagttagctgatttcggtctggccagatcgtttgctgacccttatatgaacatgactcaccaagtgatcacacgatggtaccgaccacctgaacttctgtatggtgcccgccaatattctggcgctgtggatatttggtcagtgggaatggtcttcgcagaactccttctgcgagtgccatttgtcgctggcaattcggatcttgatcaaatcagcaaaatttgcgaagcgttcggcacgccaaccgaagaaagttggcctggtgtgtcgaagctgccaaattatattccagcagataataacatacctttgcaaggccgagagttcttcctcaggcaattcccgacagctggtcctgtcggcgcagatctactcatgtccatgtgtaccttagatccaagacggcggaccactgcgcaccaagcccttcagcatagatggtggactacggagcccagaccgacaaataaacaggaccttccacaa

SEQ ID NO: 36270 - DNA, 995 bp, Aspergillus nidulans
ttcgactttatcgtctgcggcggtggaacagctgggctggccatcgccgcccgtctgagcgagatttcgaatgtcaatgtcgggattgtagaggcaggaaaataccgcatcggcgacccgctcatcgagacgcctgcgacgttcatgcagatgtttgaggacccagagtacgattggtgtctgtttacagcgccacaggaagcgaacaacggcaaggtccatcatataccgcgcggaaaagtcctcggcggatccagtgcaatcaattacttgatgtatgtacggggatcgctgcaggactacgatgactgggccgcgcttgtcggtgatgaggggtggtcagctgcaaacatgaaggcgtatatgcgcaaacatcaggctcgtaatacctttgcaaatccatcctatgagatatccctaacactccccttcttagaccctagaaccggtcaatccagagtccaaggcggcagcatctcccatcgcccctgagcaccacggtacgaccggccccattcgaacgagcttcaatgagtcaaacctgcccatcgaaaccgactttgtcaaggcttgcgccgagacggcgaacttgccaaacatgcctattgacgcttggagcggagaaccatatcggttctaccataccctgggcgctgtcgcccgtacgggtccgaaccgctggaaacgaagctactcctggatcgagtattacgaagcgaacaggttgcggccaaatctcaaacttttctgtgaagcgcgtgttaacaaagacattctcaacggtactagggctaccggcgtcagtataacattccgaggacaggagtacaccgtctatgcaagatgcgaggtcatcgtttttggcgggaccatccagtcccctcagattctggagctatccggcattggcgacccagaaggtctggctgcctccggcgtccagagtatgcttgagaaccctgctgatcggtgctaacgtacaggaccacagtgtc

SEQ ID NO: 36271 - DNA, 1132 bp, Aspergillus nidulans
cctcatcagtcggaacctgaagaatactgggacgatgacgatgaggagaacgaggaagacgactatatcactgcccgatcataccgctcccgtagcgagaataccaccggcggagcaacgaccctactgtttcccagatataaccagcaggtcaaacgtgagctggctctcgcaaagcagatagtcgaggctacccgcaccgtggaagatatcgaggacgactattgtgatacaagtatggtggctgaatacagcgaggagattttcgagtacatcagagagcaagaggtatgtacagatatccgcaactatcaaacggggctaagctcacaatatctttgtagatcaagatgctgccaaatgcacattatatggacaaccaagccgagatccaatggtccatgcggtctgttctcatggactggcttgtgcaggtccaccatcggttctcactgctccctgaaactctttttctttgcgtcaactatatcgaccgtttcctctcatgcaagattgtttcgcttggcaagctgcagcttgttggtgcgactgctatttttatcgccgcgaaatatgaagagatcaactgtccgtctgtccaggagattgtttacatggttgacggcggttacactgtcgatgaaattctgaaagcagagcggttcatgctaagcatgctccagttcgagcttgggttttcaggacctatgagcttccttcgcataatcagcaaagctgaccattactacctcgaaacctggcccccttgcgaaatatttcctggaggttactatcatggatgagcgattcgttggtagtcctgctagtttccttgctgccggcgctcattgcttggcgaggttaatgctcaagaaaggcacctgggtatgttttctttgatctgtttatgtatacgtgactgacgattcattagtctcctgctcatgtgcattacgccggttatacttactctcagctatacccgctcgtctctctcattgttgagtgctgtgagatgccccgcaagcatcattcagctatttacgataagtacaacgatagacgattcaagcttgcttctgcttacgtggaagccgaaatgaggaagaacttccgtcttccagagccggct

SEQ ID NO: 36272 - DNA, 1471 bp, Aspergillus nidulans
actaagtctggctgcctcagcaaacgtggccgacaacgttttcgccgccatcaagaaggactttcccaagcttgtctggaccgtcaaggagggggacgagaacctcacatggttctttgacaaggctgatggcagtctaagccgagacggcgaggttctcttctggtacggagttgagagtagtgatgaggtgaagctgttggttcaggaattcactcagcacggtcgccagatgttcggcgacatcaaccttgagtccaggcttcagcgcgctgctcatgcggctgccaatatcggcaagcccctcggtgctgctgctggacagaagcgtactttctccactgcaagcaacgcccttcgttctgcccgtttcggacgcccttcagttcccgttcagactgtccgcacctacgccacaaccaaccctaaccctcctcttggggagaagaacaactccaacactaagccttccaaagtcgccctcatcggagcccgtggctacactggacaggccctgatcaacctcatcaacgcccaccctcacctggatttgcgtcatgtctcttcccgcgagctggctggcaagaagctgcagggttacgacaagcgagagatcatctacgagaacctgagtcccgaggatgtcaagcgcatgtcatccaacggcgacgtcgactgctgggttatggccctccctaacggcgtctgcaagcctttcgttgatgccgttgaccagggtgccaaggatggtaacgtgatcatcgacctgagcgccgactaccgctttgatgagaactgagcctacggtctccctgagctggtcagccgctctaagatcgcccaggcaactcgcatcgccaaccctggttgctatgccaccggaacccaagttgccattgctcctatcgttcctcacctcggtggacaacccaccgtttttggcgtttccggttactctggagctggtaccaagcctagccccaagaacgacgtccagaaccttactaacaacatcatcccttactccttgaccgaccacatccacgagcgggaaattagttctcagctcggtactcccattgccttcatgccccacgttgctgtttggttccagggcatccacctcaccatcaacattcctctgaaggagacaatgtcatctcgtgacattcgcaacatctaccaggaccgttacgctggcgagaagcttgtgaagatcgtcggtgagcctccggttgtcaagaacattgctggtcgtcacggcgtcgaagtcggtggctttgccgtccactccaaggagaaccgtgtcgtcgtttgcgccaccattgacaaccttctcaaaggtgctgccactcaatgcctgcgtaagtccccgcacatatccccatccgccttaggccctactaacatacggcgtacagaaaacatgaacctcgccctcggatacagcgagtacgagggtatccctctt

SEQ ID NO: 36273 - DNA, 1263 bp, Aspergillus nidulans
gacatgagcggcgagcagatgcaggccaagattaccgccgccagacgcgaagctgaagggctcaaggacaagatcaggcgcagaaaggatgatcttgccgatacaacctgtacgaaaatcccctttgtttctttgcatagtgtggtggaaaacggccatctttatcgcgtctgccatcctactgtctccggagagttgctgactagagcaaattgaacagtgcgtgatgttgcgcagaatcagaccgacgccttgcctcgcattggaatgaagccccggcgaacactcaaaggtcatttggccaagatctatgctatgcactggtccaccgaccgtcgccatctcgtgtccgcctcacaagatggaaaactcataatctgggatgcgtacactacgaacaaagtccacgccatcccgctcagatcatcgtgggtcatgacctgcgcttatgctcctagtggaaactatgtcgcctgcggtggtctggacaacatttgctccatttacaatctttcctcacgagagggcccgactcgtgtcgcgcgcgaactctccggtcattccggctacctctcctgctgccgtttcatcaatgaccgtcgaatcatcacctcttccggcgacatgacctgcatgctctgggatatcgagtcaggctctaaagtcaccgaattcgcagaccacctcggcgatgtcatgtcaatcagcatcaaccccactaaccagaacatcttcgtctccggtgcctgtgatgcttttgctaagctctgggatatccgtactggaaaggcagtccaaacttttgctggtcatgaatctgacattaacgccatccaattcttccctgacggcaacgctttcggaaccggttccgacgataccacttgccgtctcttcgacattcgtgcagacagatcactcaacacctaccaggtgagacccggttgccacactcattgtaggacagtattgttaacaaatgccacagagcgatcaaatactgtgcggtatcacatccgtcggtttctcggtttccggaagattgcttttcgccggatatgatgattttgaatgcaaggtatgttctgttctcgacgcctgtgattctggagacggtgactgaccgatgaataggtctgggatgttctccggggagacaaggtggggtctttaagcggccacgagaaccgtgtcagctgccttggtgtcagcaatgatggcatcagtctttgcactggatcttgggactctttggtaagtaaa

SEQ ID NO: 36274 - DNA, 936 bp, Aspergillus nidulans
gaaggtttccctcttcgatcatggtcaatcgaggtgtatctcctcaatgagcatggggagcaggtgccagccaatgtcttcgacaaggtgacttactcattacatcctagtttcggaaaccgagcgactcaaggtcagtcactttccctttgagcttctgtggtctttataccctgcttttatcccgattctcattacagggagagctcggatgataaacgcaacatactggattactacagctagggctaacctggaacgatagtattcaaaaacccaccgttcagaattcaagaagagggatggggtgagtttgatatgcagatcggcctcactgctgcggacaacaaggagcacttcatcgcacatgatctcaactttgcgcaatcgcgttatgagtctaagcacgttattgtacgtctcgactgcttccagacagactcttatgtcatatatgcttacatcttctgtagacgttcaagaaccccaagccggctttattggcggcgcttcgtgaatctggacctgttcctggcgatgagaacggagtgaagtcgaagcgctctgcaggtggagaagaaggatccaagaagaagaagcgaacggataagagcgtgagtcaatgaaaatatagagactgaaatgttgacgtctgacattcttactcccaggttgacatggataaactagccgatggtctccagcgactgggggaagatgacctcctgcaagtggtacaaatggtacacgataataaggcccctgattcttacaccaagaatgatgtcgagcgtaagtcctccattccagtcagatctagtccgaaaaaccaaccactaaccacatctaacagaaggagaattccatgtcgacctctatacactgccagacccattgatcaaaatgctttgggagtttacacaggaaaaaggagct

SEQ ID NO: 36275 - DNA, 574 bp, Aspergillus nidulans
gaggtctgccctgtctgcaaatcctcgcggtatctgaacccggacatgcgattccttataaacccagaatgctatcataaaatgtgcgagtcatgcgtggacaggattttctccggaggcccggcgaactgtcctgtggccgggtgccacaagacattgagaaagcaacggtttcgcaaacagacattcgaggatataaatgttgagagggaggttgatatacggcgcagggtaatgactgtgtgagttgttctcctgtctgcctcccccctgagtgctaaccatgcttagccttaaccgccgagaagaagagttcgattccaagctagactgggacaactttttagagcagagagaggagattatattcaaccttgtcaacaggattgacgtcgcgaaaactgaggccgatcttcagagctatgcatcggagaacatgaagtctatccgtgccaaccaagctctcgaagctaaagaagtctcctcgttccaagaacgccagaaccaagaacaagagctagcacgtctgcggcgccaggccgctaaagaggaatacgaaaatgagcggaaagag

SEQ ID NO: 36276 - DNA, 484 bp, Aspergillus nidulans
attccaacgatcggcttcaataccaagcgggtccaaaaaggacatgtgacgctcaaatggttcgtgaacctgcattcatccagggcatctctctaaccgcctcagttgggatcttggtgggcagccacggtttcgacccatgtgggagcgttattgccgcggcgtcaacgcgatcgtgtaagacaggtatcgatgattgattgcgacactgctgacatcggatagttatatcgtcgacgccgcggacagggcggctctgcccgtggcgactgaggagctgcacgagctgatgaacaagcccaccttggatggaatccctctcctggttctgggaaacaaatccgacctgcccaacaagctatctgttgacgacctgatagaacagatgaatctgaaatcgatcacgcggcgcgaagtgagctgctacggcatcagtgcaaaagaggagacaaaccttgacgcggtcttgcactggctgattgcg

SEQ ID NO: 36277 - DNA, 1219 bp, Aspergillus nidulans
ttcaaggattacttcaaccaaccgtcgcgagcggaaattggcactgtcgtcgcaatattagaagttggggccttcatttcctcattactcgttggaaaaattggcgacttaattggtcgccgcagaaccatcctttatggatccatggtgtttttcgtaggaggcgctttccaaacctttgcgacggggctacctatgatgatgcttggccgtatagtcgccggtctgggcgttggagcgttgtccactattgtcccggtatatcagtccgagatatcggtacagttgccctcatctccctaatcaagaaggctactatggacgatgctaatttttgatcaccagccccctcacaatagaggcaaattggcatgtattgagttcacgggaaatatcttcggatatgctgctagtgtttgggtcgattacttttgcagtttcattcgcagcgacttttcctggcgtctcccgctgcttttgcagtgtatcatggggtttttacttggcctgggaagtctcatcatttgcgaatcgccgaggtaaggcctttattgattctcgaaaacgcgcaattcgtgaaattggctctaacgctcaccctaattgtaggtggttattggataatgatcatgatgaagagggtatggtagtcattgcaaacctctatggtaaaggagatcttcacaatcccgaggctcaaagagagtacagggaaatcaagatgaacgtgcttattacacgtcaagaaggggaacgatcttacgttgatatgttcaaaaggtacaacagacgtgtccttattgcaatgtccgcacaagcactcgcgcaactgaacgggatcaatgtcatctcatactacgcgccgcttgtcttcgagtccgccggttgggcgggccgtgatgccatcctcatgaccggaataaatggtctaacttacttggcgtcgacggttcctccttggtatcttgtggatggttaggaaaggcgtcccattcttctttccggtgccttggctatagttctttctctttgggcaatttcctatttcatttttatccatattgaagccacaccatcccttaccgttatatttgtcatgatttgcaatgctgcttttggtgcctcatgtggtccgataccatggctataccctcctgatattcttcccttgggctttcgtacaaagggtcccagtctcagcgcggctacccagtgggac

SEQ ID NO: 36278 - DNA, 3314 bp, Aspergillus nidulans
gagattgtcattgataaaacagccttcttcaatcgtctctcgagcttctatgcagcatggaaggcagacaaacgatccaccaactctgtctttggcggtgcgggatctatcattatcctgatggggaagacggatgaagcaaacagctatcaaaagaacaatgctatacatgtatgctgcttacgtcgtcggttacttattatatctactgatacttttagttttggttactcggctacgaattcccagctacacttttcgtcttcacaccggaggttatgtacgttgtgacaacagcgaagaaaggtatcacctgatctgaacaaggaatagcccaggaatcctctctccctaacttcatgacagccaaacatttagaacccttgaagggtggaaagatcccggtcgagattctggtaacgactaaggatcaggaagaaaagacgagattgtttgaaaagtgcgtggatataataaagtccgctggggtatgttttctatcatgtccagggatcaagatgaccatgcgtggttcgttaacttccgacgctaacaagctatctgccaacagaataaggttgggatcttaccgagagacacaaccacaggtccatttgtggaagactggaagcgcgtatatggaaagatatccggcgatgtagaagaagtcgacatttcgcccgctctttcagccgcatgcttttcggtcaaggatacggatgaactagtacgtctattcacttacaacgtcgataaaagtggtctaaagttttgcaggtgtccataaggaatgcatctagagcttgcagtggtctgatgtccgattattttgtcgatgaaatgtctcgcttgctagacgaagaaaagcaaatgacgcataaagctctatctatgcgtattgacgccaagattgatgacgctaaatttttcaacaagctcgcaaaactaccgtcggaatttgatcctcagcaaatcgattgggcttatggtcccgtcattcagagtggcgggaaatatgacttgaagttaacagctgtgtctgatgacaacaatctggaacccggaatcatcattgctggattcggcattcgctacaaaacctacagttctatcattgggcgcacctacctggttgacccgacaaagtcccaagaggcaaactattccttgctcctaagtgtccatgaggctgttttgaaggaggctcgtgatggtgtggtcgccaaggagctctacaacaaggcaattggaattgtgcgagctaggaagccggaactcgaatcccacttcgtgaaaaatgtcggtgctggtataggtattgagcttcgagattcgaacatgattctcaatgggaagaacacccgggttttgaagagtgggatgacattttctatcacggtcgggctggtggatgttgaagagccgagcgtgaaggacaagaaaaagaatgtctattcaatgatgatcacggacaccgttcgggttggagaacagggacctcacgtattcaccaaggacgcgggcattgatatggactctgtgtccttctatttcggtgacgaagaagagccacagaaacctgcaaaggagaagaaagaaaccaaatcgagtgcgattgcgagcaggaatgtcacgaggacaaagctccgcgctgaacgtcctacgcaggtaaatgagggagcagaggcgcggcgccgcgagcaccaaaaggagttggccgctaaaaagaccaaggagggtttagaccgatttgcaggtaccactggcgatgataatggagtcacgcagaagaagttcaagagattcgagtcctacaagagggacaatcaattgccagccaaagtcaaggatctcacagtttatgtggatcacaaggcatctactgttattgttcccgtaatgggtcgaccagtcccttttcacatcaataccatcaagaacgctagcaaaagtgatgaaggggagtacgcctatcttcgcatcaactttctttccccaggacagggtgtgggaaggaaagacgaccagccatttgaagatctgtcagcacattttctaaggaatctcactctcagatcgaaggataatgatcgatttgcgcaggtagctcaggatattactgagctcaggaagaatgccctgcgccgtgagcaggaaaagaaagagatggaggatgtggttgagcaagacaagctagttgagatcagaagtttgtcacccttttatgacatatgcttttgaaactaatccagagtcagatcgtcgccccgtgaagttgcctgatgtttaccttcgacctccgcttgacggtaaacgagtacccggtgaggttgaaatacaccagaatggtcttcgctatgtctctcccttccgcaacgaacacgtcgatgtgctgttcagcaatgttaaacaccttttttttcagccttgcgctcatgagttaattgtcttgatccacgtccatctcaagactcctatcatgattggcaagagaaagactagagatattcagttctacagggaggctaccgagatgcaattcgacgagaccgggaaccgaaggcgaaagcatcgctatggggatgaagaagagtttgaggccgagcaagaggagaggaggcgtcgggcagctttggacagagagttcaaagcatttgctgagaagatagctgatgctggcaaggatgagggtgttgatgtcgatattcctttcagagaaattggcttcaccggtgtccctaatcggtcgaatgttctgattcagccaaccacagatgcactcgttcaactgactgagcctcccttcctggtcatcagtctcaacgaaattgagattgcgcatctagagagggtgcaggtaagttaacacagatattctagtcattcaggcggggactaaaatgctgtacagtttggcctcaagaatttcgaccttgtcttcgttttcaaggacttccacagggcaccagtgcatattaacacaattcctgtggagaatctggaaggtgtgaaggattggcttgattctgtggatatcgcgtacacagaagggcctctcaatctgaattggactacgattatgaagacagttgtcagtgacccgtacggcttctttgctgacggtgggtggtctttcctggctgccgaatcggattccgaagacggctccgatgaagaggaggaatccgctttcgagctctctgagtcagaacttgccgcagatgaaagctcagaggaggatagagactacgatgacgatgctagtgctgacgatgatttcagtgcggatgaagatgagagtgacaggactggca

SEQ ID NO: 36279 - DNA, 1463 bp, Aspergillus nidulans
ggcactgctaataataccaatcatcttaatggccattcctctaatgggtcaaagaaaatggctaccagaaagacagccatttatcgacatgctgtggctgttcactcgcaagtccagcactcatgcctcagcagggactcgaccaaggctacgagttttattggattccggaacctgatggtggtcgtgttgggtgaggatatcgtcgtcttgactacattgatactatgctgactctcgatagtggccatgaatcttcgcctagtgattgaaaacttccttaaggtgagcttcttgcatatgacgcaatggttgggctcgtttaacaagccgtagtatggtgttttgatttgcatcagatgtcatgactatcgcaaacaagacgttgtgatcggagcgattctcttcgccctggtcccttgccagttgctatgttcgtacttcatcgagttggctgcttctaggcatgctcaacgcgttatcggtcgagcaaagaaacaggacaaggacaggatcctgaacgagtctaaaaggacttggttcgccattgcgctgctgcattctattatcagcttctttggtctggctgcaacaagctatgtcatcttctactacgtcaaccaccccgggatcggcactgtctgtgaagtccaggtgatcatcgtgtcgctaaagtcgtactcgtacgcactgacgaatcgcgacctacgtcgcgctatgctcggctctccgtcggcggactctgatatcccagaactctaccggtcttgtccatatccgcggaacatcaccctgggcaatctagcatatttcctttgggccccaacgctcgtataccagccggtctatccccgaacgcctcgcattcgctggtcttttgttggaaagcgtttattcgagtttgtttgtctctcagtggttatgtggctactttccgcgcaatatgctgcccccctcctgcgcaacgcgacccagaaaattgccacattagacattgcatctattttggagagaggactgaagctctccactatctctctcgtgatctggcttgctgggttctatgccctcttccagtcactgctgaacggactggctgagatcatgcggtttggagaccgcgagttctacacggactggtggaacagcccaagttttggcgtgtactggcgatcctggaatcgccctgtgtatatattcatgaagcggcatgtttacatgccgctcgttacccggggctggaacccaacgttggcaggtaccgtcgtcttcgcggtttccgccgtgctgcacgagatcctggtaggagtccctacacataatctgattggtatgtttcctcggacacaatcctaaggctcttgctgacgatgttaggtgtcgcgtccatagcgatgatgttccagctcccgttgattcttctgactgcgcctttcgagaggttcaaatcccctctgggaaaa

SEQ ID NO: 36280 - DNA, 1170 bp, Aspergillus nidulans
ctccttgcctccgccaacttcaccctctctcttctcccagcccgactggcttcccgtattgaagctcttcgaaacctcccatttattgtcgtcgcaaacccgcatgtctccaagatttacggcaattacgttcattcgctgtcaacgctactcccctggcaaaagcggcaggtcacgaccctggaggaagagaatcaatttgctgaggtactagcagacctcgtccacacgcattccaacacgatccccatcctagcacgcggctttcttgaatgtcgtaagtacatcgatcccgctgaggtgacgcggttcctggatacacatttgcgagcgcggattggtacgcggttaatagcagagcaacacctggcgcttcattttgcgtcgcggcctgctggggacggatcagccgaaggacgagagcagccgcggaaggatgcgccgccgtcaaactatatcggggtaatcgataccgctttgcaaccggctcgtattgtacggtcgtgcgaggaattcgttggagaaatttgcgaactgaaatatggggtgcgcccacggctggagattcacggacaaccggacgcgactttcgcgcatgtccctgtgcatgtggagtacatcctcaccgagctattgaagaatgcattcagggccgtcatcgagagtggaaacgagcaggagccgattgaagtgacaatcgccgccgcaccagatgtacctggcaatcatttacaagcacatgagccagtcaccaacggtaaaccagcagacgccctagacacaggcgctcaatccgacagcgacgtcggattccacgtcgatacagttgttggtactgcagacgcaaacgagtccatcaaattctccactccatcctcgcaaagcattaccctccgaattcgagaccgcggcggcggcatatccccggacgtcttgccccagatctggtcatacagcttcaccacgttttctgacctggatatgggcgaagcaggcgggatagacgcgctaaacacgatttcttccaatagtggccagctgagcagcattgctggccttggatatggtctcccgttgagccgcgcctatgcggagtactttggtggtagtattgccgttcagaccctgtgggggtggggaacggatgtgtacttgacgctcaatggcgtt

SEQ ID NO: 36281 - DNA, 1909 bp, Aspergillus nidulans
ctgcaggatctgacgctgcgcatcccggcaggcaagcagacggcgcttgtcggagctgagtggcagcggcaagtcaactgtcgcgggcttgatcacgcggttctatgatgctgaggaagggcaggtgacgattgggggccatgacgtgcgcgagctgaatgtgcggtttctgcgcagtgctattagtcttgtccagcaggaaccttgtctgctcgatcggtcgatactggagaatattgctcttggactggtgaactcctcagcacatgtgcatttgatggatgtgctgaagagcagtgccttggaggatattgccactgctattcgggaaaaaggcttgagtctcaaccacgccattgacttgcaacccagcaacaaagaccagatccgcgagattgtgtccttggtcgaaacagcagctggcctagcagacgcaagcaacttcatcaacaagctcgaccacggctacgcaacaatggtcggatcaagcgggaacctcatcagtgggggccagaagcagcgtatctcgatcgcccgagccttggtcaaaagcccccaaatccttatccttgatgaagccaccgcatctctggattccgctacggaattacgcgtgcaacgggcgttggaggcggcggctgctggacgcactctagtcactatagcccatcggctctcgaccatcaagaaggcggataacattattgtgatgagacagggaaagctcattgagcagggctctcatgcagaacttcttgcggcagatggagcgtatgcagagctggtaaggttgcagaatctcaatgtcaatgcctcgcaggagagtgcgtcttcgtctgctcggccgtcactggacagtacggcgcttgagaaagaaaggaatgcagaggtaacatcggtacaagacgacgaaagctccactccatcccctaaagagaagccagcagacgaagaaccagttactaccgagcgctctgtcggttctacctctaaggccattgcctctctcttccgtccgtactcgctagccctccttgtagccatcatcggtgccgtcgtcatcggaggcacatactgcggttctgctgtcatattcggtaacgttgtgggcaagctaagctcgtgcgagacagcagaatccatccgccacgcgggagaattctgggggctcatgttcttcgtcctggctctgattgagtttttcgcaaacctcatcagctggtccctcttcggctggatcgcggagcagctcatatataaagtccgcgtgctctctctacgttccattctcgagcagaagctggaatggcatgaagcgcgcacaccctccggcctcctatcactcattgtcaaggacagcaacgcgctcaatggcctcacgggatccgtcatttgcacaatcctcagcatcctcgtcaacctcttcgccgccattattatgacccacatcattgcctggagaattgcactcgtttgtctctccgtcgtgccacttctcttgggcgctgggttcatgcgtgtctcaaccttagcccgctttgaggagcgccacaatgacgccttcgcccgctccctgggcataaccgtcgaagccgtgacatccattaagaccgtccacgcgctggccattgagtccgaagttctttccacctaccgccgctccctgcagggccccatgcgcgagataacagggcaatccgccttcaccaacctctggctcgccgtcggttacggcctcagcaacttcgtctatgcgcttgcatactggtggggtgcgaagcagattatcgctggtcactacacccagacacagttcttcattgttcagctggccctgctcgtctcgtctcagctctggggccagatgtttgctttggctcctgatgtgtctcgcgccgtgcaggccacc

SEQ ID NO: 36282 - DNA, 1526 bp, Aspergillus nidulans
ttcgatgatgctgggcttcatccaatcatgcgccagaacatttgtctctgcggttacgaatttcctacgcctattcaagcatacgctatccctgccgtcctgacttcacatgatttgatcgctatcgctcagactggttcgccttgagacatcataaactcatcatcttactaacatgcccaggctctggcaaaacggccgcctttctaatacctgttctttctcagttaatgggaaaggcgaaaaagctagcagcgccccggccaaacctggctgcaggctttgatcctatcacggatgtggttcgtgcagagccgctcgttctgatagtggcaccaactcgcgaactggcaacccaaatcttcgatgaggctcgtcgtctatgttatcgatcaatgctacggccttgtgttgtgtacggtggcgcgccagtagccgaccaacgcaacgaacttcaaaagggctgtgacattctgattggaaccctgggaagacttctcgacttcatggataaaccttacaccctctcccttcggcgtgtcaagtatgatacccagcaccacgtaaaaacctcaattaacctaccatctaggtacactattatcgacgaggctgacgagctgttgctctctgactgggaagaatacttcaagaaaatcatgtcaggcggaggtggttcctgtcttcccaggcgtggggctaatgctgacaagtacagacataaatgaggacgcagaccatcgttatatgatgttctcggccacattcaacaaggaatgtcgcgagcttgctcgcaaattcctcgctgacgaccatgtccgtgttcgcatcggccgcccgggctgcactcacgtcaatgtcgatcagaatgtacgtacccaggatgcccacaaaccatgcttcaaccactaagaaattcgaatatcagattatttataccgaaccgcaactgaagaaaaagtgtctttacgatctactcctggctatgcagccttcacgtactctagtgttcgtcaactcgaaagcaacagctgaccagattgacgactacctatacaatctgggattaccaagtacctcctttcacgcagatcgtactcagcgtgacgtgaggatgcattgtaagctggcaattggctccgatcctgatacacttgtgctcatgtgcttttaggcgtgcgttccgctccgcgaaatgcccgatcatggtcgccacaggcgtttccactcgtggtttagatatcaagaatgtaatgcatgttatcaattacgacctttttaatgcgttgcacggtggcatcactgactacatccacaggatcggtaagttgatttaccaatgcaagtcccgacacacgtcgtccagcaagccctaacatctgagaggacgaactgctcgtattggtaatgaaggtcttgcgacttcgttctacagcgacaaagactcagcccttgcccctgatcttgttaagatcttaatcgaggccaataaacccgtccccgacttcctctctagattcaagccc

SEQ ID NO: 36283 - DNA, 1582 bp, Aspergillus nidulans
tacacggatgccgacacccgacgctcctatacctacaatgatgtgaaacagtctgccattactttgtgccaaggcctgaagtctctctttgactggcgtaaaggcgatgttcgcgctctttacccctaacagcatcgacactcccattgtcatgtatggcgcgctctgggcaggcggtgttgtctcgccctctaacccagcgtatacagttgaggaactcgcgttccagctaaggaattctggtgcaaaggcagttgttactcaactacctgttctctcagttgcgcgagccgcggcgaaagaggtaggcatccctgacgaccgcattatcttgataggagaccagcgcgatcctgaggccaggttcaaacacttcacctctatccgcaatatctccggagccactcgttatcgtcgcacgaagatcaacccggagaaagatctctcgtttcttgtttacagctctggcaccactggggttcccaagggtgtcatgctcagccatcgcaacattgtcgccaacagccttcagttggctgcaggcgaagccggtaacctgacgtggaatggcggggcagatggtaagggtgaccgcttacttgctttccttccattcttccacatatacggcttgacatgtcttgtccaccaaacgatctacaagggctatgagctttttgtcatggccaagtttgacctcgaaaaatggtgccagcatgttcagaactaccgtatcacattcagctacgtagttcctccggttgttctccttctgggcaaacaccctatagtcgaaaagtacgatctttccagtctacgaatgatgaactccggtgccgcgccgcttactcaggagcttgttgaagctgtctacaaccgcctccacatcggtatcaaacagggttacggtcttagtgagaccagccctactactcacactcaaccatggggtgaatggcgcgagagtgtcggctcggtcggtaaactcctccccaacatggaggccaagtatatgacgatgcccgaggacggttcagaacccaccgaggtgcctacaggtgaggttggggagctctatctccgtggaccgaatgtcttccaaggctatcacaacaacccagccgcaacagcagactcaatctctccagatgggtggtttcgcaccggcgacgtcggctaccaggactccaagggcaacttctatatcacagaccgtgtcaaagaactcatcaaatacaagggcttccaagtcgctccagccgagctcgagggtatcctggtcgataatcctgcagtcgacgatgttgccgttgtcggtgtcgagagcgctgaacatgggactgaggtccctgttgcatttgtcgtaaggagcgcgaagagcaagagctcgggtgtttcggcggcggaggaagcaaagaatatcgccaagtggctggatggcaaggttgcgcatcacaagcgcctgcgcggcggcgtgcgatttgttgatgagattccgaagagtgctgcaggaaagattttgaggagactacttaagaagcaagcgcaagaggaggcggcttctccgaaggcgaagctttaa

SEQ ID NO: 36284 - DNA, 1125 bp, Aspergillus nidulans
cccctcaccgtttctggccgctggatcctcgactctaccggtgcgcgcgtaacattcgcgggcgtaaactggcccggcgccggtgaggccatgattcccgaaggactgcagtatgcctcggttgcctcgacaatatcaaagattaagtctatcgggatgaatgtgatccgcctaacgttccccattgaactcgtcgatgatatctacgccaatgatggcgatactacagtcctagcctcgcttatcaaggctctgggcgttacgaatggaacggatgtcttcaaccagatcgtaaccaacaacccattaatcacgaatacgacaaccagaatgcaagtgtacgacctcgttgccgctgaatgcgcagcccaagatgtctacgtgcacctagataaccatatctccaaagcaatgtggtgctgctccaccactgatggcaacgcctggtttggggatacgtacttcgatgtggacaactggaaacgcgggctgcagtatatggcctcccatgcggcgtcctgggagacgttcacgtctatcgggttgcgaaatgaactgcgacagccggccagcgcaaaccccagttatccgtacaactgggaaacgtggtatagccaaatgactgaagcggcagacctggtgaacgctgcgaatccggacgcgttgatctttctctcgggcctgaactacgatacaactcttgcgccgatcccgactgggagcgatctgggtgaggggacgagattctaccttgaagatttcagttacgctgataaactggtgctggagttgcacaactacgatacaggcgcatcgagctgtgccaatctctccggcgccctctggaacggggggttcaaggcgctcgatacgaacagttccgacatcgttaacatcatgcccgtcgtcctgacggagttcggtttcgcgcaggatgaaacgacatggcagagtgtctatgcttcgtgtattagggagtggattccccagcagcaggccggctggatggtttggaccattagtgggagttactatattcgctccggaggccaggactatgacgatacctgggggatactcgatcacacttggtcaggctggcggaatgaggaggcaatcgagcag

SEQ ID NO: 36285 - DNA, 1248 bp, Aspergillus nidulans
gtcacacttatccatttactcgagatcctcggcggagactcactcggtcgatatgctgccaacccaaagcttcgtgtgcaaaaattcgaaaatgttaacaaaagtctcgactatatcaaggggcggggaattcagatgaccaatattggtgcggaggatattgttgatggtaaccagaagatcatcctaggtctaatttggacgcttatcctgcggtttactattagcgatatcaatgaggagggcatgaccgcgaaggccggcctcttactttggtgtcaaaggaaaacagcatgctatgagggtgtggaagttcgagacttctctacgagttggaacgacggcctcgcattctgtgcgctcttagatattcaccggccagacctgatcgactatgactctttggacaaaaacgaccaccgaggaaacatgaagctagcctttgatatcgccgcgaacgaagtcggtatccctgatctactcgatgtcgacgacgtgtgcgatgtcgccaaacccgacgaacgatccttgatgacatatattgcgtactggttccacgccttttcccagctggagagggtagaaaatgcgggacggcgtgtggagaagtttgtgaacaacatgcacggcgcatgggagatgcagaactcttacgagaaaagaatgagggaactcttacgattgattcgcgcccagcgtgaagagtggaaaaacgcctcattcgaagggacatacaaggacgcaaaggagcaggcctcccagtttgccatgtataagcggaaccagaaacgtcagtgggtagcggagaaatcagacctcgcagctctcttgggaaatatcaaaacgaagcttagcacgtatcgccttcgtgcttatgatcctccgccagagttgtctcccgaagcctgtgatcaagagtgggaatgtttgacccgtgacgagcatgagcgcagtcagctcattaacgaaaccattcgagatattaagaacgctctgcgccgctcattcgcagataaagcgaacgacttcgcgcttaccttgaagacgctgtctcttgcaatctcaggccttgacggagacgttgaagatcaacttgcccacgtcaagcgactgaacgacaacttaccgccgctcgatgccttcttggaaactattgcggagcttgatgagcaatgccaggaagcaaatgttgaagagaatgactacacaacatatacattggacgaactggcttatgagttgagcctg

SEQ ID NO: 36286 - DNA, 1879 bp, Aspergillus nidulans
atgagctcttcagatgatgataccccactcgtcaaaatgaacggtagatcctctggtaagtcgcggcttgttcttgtcaaatctgatgcgcttgcctcttttcccggctttccttgatattttactcggttttttacttcgtcgattcaatcttaattaatatatcttccggataaaggtggtcaatcggacgtgaaggtgaacggcgcagcggacaccaacggtcacgtcgatcccggtgtctctatcagatttgggccggtgcagaaagatgaggacgttgaaatgaatgatgcgaacggcgccagtgcgagcaagaggaaggcgcgatcaagtcgccaatcaggcgcaatcatacgcggagcccgaaagcagtgaggaggacgaacctctggtacggccacccaccacccagatcactacggcattcttgccatcgttgtttgcttcaacggctgactcccccggcagagcaagcgtcgacgcactttggtgaaacacgaggatccggagactgacgacgatgtaccacttgcacttaatgggcggaagcttcccaaggcttgggagggagcaatcggcgaagaatccgactctgatgttccaattgaaaggaaattagctgccgaaaaaaagaaaatttaagtcaagggagaaaaggacgcggatccatctgcacaggccaccaagtcagcggcttttggaaaaaagcaagcgaatggagtgaagaaagaacctgcctttgctaagcaaaccctgaagcaagtaaaggccgagccaaagtcagcgcagtcaaccccagcaaagaagaacgcgaaggctacggcattgaagaaggaggaaagcgaagaagctgaagagccagaggaagaagaatacaggtggtgggaggatccaaccaagggcgatggaacaatcaaatggaccactcttgagcacaacggcgtagttttcccgcccccgtatgaaccgcttcccaaacacgtcaaaatgaaatatgacggcattcctgtcgaccttcaccctgaagcagaagaagtggccggcttttttggcagtatgttaaactcgactcagcatactgaaaaccccacgtttcagaagaacttctttgcagattttaaggaaatcctcaaaaagactggtggcgcgaaagatcagaagggtaacaaggtcgatatcaaggagttctcgaaatgcgatttccagccaatcttccaatactacgatgcacaacgtcaggagaaaaaggcgctgccacccgctgagaagaaacgtctgaaggccgagaaggatgcacaggaggctccctacatgtactgcatgtgggatggtcgcaaacaaaaagtcggcaacttccgagtcgagcctccttcccttttccgcggtcgtggtgagcaccctaagacaggtcgcgtaaaggctcgagttcagcccgagcagatcaccataaacatcggcaaagaggcgcgcgttccccctccacccgaaggccacaagtggaaagaggtgaagcatgaccaggaaggcacctggctagccatgtggcaggagaacatcaatggcaattacaaatacgtcatgcttgcggctaattccgacgttaagggtcagagtgactacaagaaatttgagaaagcccgcgaactcaagaaacatattgctcggattcgcaaggattatcagaagaatctaaagcacgagttgatggtagagcgacaaaaggccaccgccgtttaccttattgaccagtttgctcttagtgctggcaatgagaagggcgaagatgaggctgaaacggtcggctgctgctctttgaaatatgagaatgtcacgctcaaacctccgaacaaagtgatattcgattttctcggtaagg

SEQ ID NO: 36287 - DNA, 1931 bp, Aspergillus nidulans
ggggttcattttactggcatcagtctccgaacgctcatggaaaatctcaaacctagacttacgaagggtgcagacggcagtcagctttccacgcgggagacttttcaagatctttttgggattctatttcctgcaactggtgggatatttgcgtaagtatctgtctcaagtctgctggatatcaggcttatctgggtagtggtgcaagcatgtcaggcgacttgaagaaccccagcagatcaataccgaagggtactctctatggactggctctgacctttatcctctacacacttgtgattttcgcaatggcggcttccttaacaagggactctctatacaataatgccaatatcgtgcagattgtaagcttccaaacgaccttgttcatcacaatctgacatttttaggcaaatctctctggggctattgttctttcgggcgagttcgcaactagtttcttttctgctctgatggggctgattggatctgccaagctgctccaggctattgccaaagacagcttgcttcctgggctgaatctgttcagcaagggcacgaggaagaaagacgagccggtccgcgcaattattgtaactttcatcgctgctcaactgactatgctgtttgacatcaaccagatcgcgtcgttcgtcacaatggcgtacctcatgacattcttagtgatgaaccttgcctgttttctgctaaaaatcggatctgcccccaactttcgtccttccttccactacttcaattggcagacggctgcaaccggtaccttggtctgcggagctagcatgttctttgtggacggggtctacgccactgcgtgttttgctgttttgatcacactattcttgctgatccactatacttctcctccgaagccatggggcgatgtcagtcagagcctgatctaccatcaagtgcgtaagtatttgcttcgtttgaagcaagagcacgtcaaattttggaggccccagattctcctctttgtgaacgacctcgaacacgaatttaaaacttgcgctttctgtaactcactgaagaagggttcgttgtttgtgcctggccatgttattgttaccgacgatttctcgttcgccgtgccggaagcgcgccgacaacagaccacttggacaaagctagtcgagagcttgaaggtcaaagctttcgttaacattgcagtatctccttcagttgaatggggagttcgcaatattgtactgaattctgggctaggtggaatgcgacctaatatcgtcattatagaccagtttcgggagggtcggtctcttggcgagtcaatataccaccataaccaccattcacatttattatcgccagatgcttccagatctgagtcgtcgaagaaaccggcagactgccggacctacgttagggtgttggaagatctattgttccagctacgtataaatgttgccgtagccaagggatttgaggagctcaagctgcctgggcaacgtggatcggagtccaaaaaatatatcgatctttggcccatccagatgtctgctgaaataaacgccaacagtgaaacgaaacgaaacattttgactacgaacttcgacacatacacactgatccttcagctaggttgcattctgaatactgttccttcgtggaaaaaggcatataagctgagggtagctgttttcgtcgagtatgaaattgacgttgaggatgagagaaagagggttgaaaccctccttgagaagttacggattgaagcggaaattctggtcttctggctcgcatgcggtgatttgaaaacataccgcatcatagtcaatggagacccccttccagaatgtcaggacgtccacgagacggtccacaaagtactgaagaatgaaaattggtgggaggatgttcagcgaggccgcaggagctcagacgagtcgtta

SEQ ID NO: 36288 - DNA, 1637 bp, Aspergillus nidulans
ttttttaccgcgacgccaggcaaatacctcagctggacaagcgcatacatcctcgtagtctcacgggtcatcggcagcggcatcttcgcgaccccgggctcgatcgtaaagtcatcaggcagtatcgggctctcgcttttgctctggggcgccggaaccgtccttgcggcatgtggaatggtcatatcgatggagtacgggtgcatgctgcctcgttcaggcggcgataaggtatacctcgagtatacctaccctaaacctagatacctggcgtctacgctcgttgctgtgcaggccgttctcttggggtttacggcaagcaactgcatcatctttgcaaagtacacggtgtttgcgttcggcggcgcacccacagagctcactcataagctctttgcgacgggtctgctgaccctcatcactattgtccacggccggttccgtcagacgggcatctggatccagaacgtgctgggatggctgaagatcttcctgatctcatcgatttccctgacggggatctgggtcatcctcctccggccaagtggaattgagagcggtgccggcgctgcatctgcggcaatggatcagggcttgatgaactgggataccctctgggagggctcaaactggagctggaatctcctttcgacctcgcttttcaaggtcctctactcgtatgccggcctgaataatgtcaataatgtgcttggcgaagtgcgcgatcctatccgcacactcaagacggtttgtccggccgcactcttaacatcggcggcgctgtatttgctagccaacctctcgtacttccttgttgtcccgcttaacgagattaagcagagtggagagcttgttgcggccttgcttttcgatcgtctgttcggtccgcgtgtaggaggaacgctgttcccttttgctatcgccgtctctgcggcaggtaatgtcatggttgtcacatttgcgctggtacgtcttatctcactttgattttctttttttcacctccaactacagtcctaaagaaagggagaacaggcccgagtcaaccaagagatcgctcggcagggcttcctcccttggggcgacctcctctcctcatcgaaaccattcggcacccccctctggggcttgatagtgcactacatcccatcaatcctggtcataaccctcccaccgcaaggcgacgtctacaacttcatcctagatgtcgagggctacccgggtacgattttcggtctcgccatcacagtcggcatgctgattctgcggtatcgcgagccgtacctgacccgtccattcaaagcgtggttacccgctgtttggctacggatcgttgtgtgcttggccctcctggtttcaccgtttattccccctccagggcacaagggtgatgtggagtttttctatgcgacgtatgccgttgtcgggaccggagtgtatgtccattcatcttttgcattctcattcttcctcgtaggttccgaagtgatgctgactgatcatgcaggcttgcctttggagtgatttactggtacgtgtggacagtcttgcttcccagatggggcgggtataaactcgaggaggaggagaaggtgctggacgacggaacagctgttacaagattggtaaaggtttga

SEQ ID NO: 36289 - DNA, 1632 bp, Aspergillus nidulans
tacaaaaaagcagtcttctgggccttatttctgtctactagtttggtcatggaggggtatgacctggtgatagtatgaggccttggcgatcaatccttgacggatactgactggcatcagatcacttcattctacggccaaacccagttcaaggagcgtttcggcgtctacgacccagcttcagaccagaagctgattccagctgcatggcagtccggtatatcgaactcggctctggtcggccaactagctggtcttgttgtcaacagcatctgccaggaccggttcggctgccgtcgaacaatgatggtcttcatggtgtggatggctgtcgccatattcgttcctgtctttgcgccatctcttccagtgctcgcttttggagaggcattttgcggtataccctggggcgtatttcaggtaaatatccgcgaaggacatgagcttttcttgtctgactttgcttatagacgctgtcaaccacatatgcttccgaagtagtgccaacagttctcagaccatatgtcaccgcgtatgtctgtatgtgctggggcgccggcatccttctctcctctggcgttgttagggctgtagcaggactccagggcgaattgggctggcggctcccattcatgttgcaatgggtctggccccttccacttttcatcggcgcatactttgctccagaatccccttggaactcggtgcgtcgggataagatcgacgaggcaaggacaaacttgatgcggctataccaggatatgccggagcgagagcatcaagtggaacaaaccttggcctatatcaaatacacgacagagatggagaaagccgagactgccaacgctagctttctcgaatgcttcaaggggaccaacctgcggcgaactgagattgtgaggttcctcactaccgttgtttctctggcccaactgactggtctcagaattgtgttgtttgggcagcccaaattctctgcggaaacgcgatccttggatactcagtcgtgtttctccaggccgcgggcttcagcgaactgcaagcattcaacatcaacatttcgttatcggcctgttacattgtcggcggcatcatttgttggttcctcttcccccacgtcgggagggcgacaatctacatgagcgggctgaccttcatgttcttctgcctggtcaccatcggaggactagcttggggtccagggaaagacgcccagcttgccatcggtatcctccttgtcatttccacgttatgcaacatgattgccattgggccgacatgctaccccattgtcgcagagacaccgtccggaaggctgagatacaagacaatcaccattggtcggtttgtttataacctaaccagcatattcaccaactctgtcacgcctcgcatgctctcctccacatgtaagttgcctcgatcgtccttgtgcgcaattctgacttgggaacagcctggaattggggagccaaggccgccttcttctacgcagggaccaacctgctttgcaacatctggtgctggtttcggcttcctgagacgaaagatcggacgtttggtgaaatcgatctgctttttacccatcgtgttccggcgaggaagttcaagtctactcatgtcaaccgtacg

SEQ ID NO: 36290 - DNA, 924 bp, Aspergillus nidulans
gttcgaaatatcgtcgtcattgggggcacttcccatcctcaactgactcagacgatttgcgatatactcgggattcctccagccgacgtgttgctgtcaaagttttctgtcggtgagacaagggttgaaatcaaagaatccgtacgtggaaaggatgtctacattcttcagtctggtggtggaaaggtgaacgaccatcttttggagttgcttatcactatttcggcatgcaaaactgcgtctgctcgaagagtcaccgctgttctcccgctctttccatactctcgccagagtgatattccttacaacaaatcgggagctcctctagtcaaatcatcgcttgaaggaaagggcgcttccaacgggtataccttcgagagcacccctacaaccccccatcccgggaagctcgaggtcggaaacccgataaatggagtcagtattgataacctacaaaagagtctggcaaaggctcagctggaggagtcttctggtagccctgtcaagaaacgcctacccaacgggctttctcgcagtgacactatggaatctttgaagtcggacagcagcaagtccacgcttccgaacggcctcttagatgacagccaagacaaaattaataaatttgaaccgcgtcctggatataaacagtgggtggctcaagcaggtactctcgtggctgacttgctcacttgtgctggcgcggatcacgttatcacgatggacctgcatgatccccaataccaaggcttctttgatattcctgttgataacctctacggccgaccccttctcaagaactatattatgcgcaacatcgccaactacaaagaagccgttgttgtgagcccagacgctggtggcgccaagcgggcaactgcgattgcggactccatgggcatggaattcgctctgatccacaag

SEQ ID NO: 36291 - DNA, 487 bp, Aspergillus nidulans
ctgcaatctgaattgatgcagctcatggtgtcaccttctccaggaatttcggccttcccggacgctgatggaaacctcctatcctggactgctactattaccggcccttcagaaacaccatacgagggtctgactttcaagctctccttctcgttccccaacaactacccatactcgccacctaccgtgctcttcaagaccccaatctaccacccgaatgtcgacttctccggccgcatttgcctggatatccttcgagacaagtggagtgccgtgtataatgtacagaacgttctgcttagcttgcagagtctccttggagagcccaacaagtaaggctacatcctgaatttattttttgttgttatactaacggtcaattagcgcgagccctctgaatgcccaggctgctgaactctgggacaccaaccaggaggagtataagcgccacgtactggccaggcactgcgacattgaagacattgaa

SEQ ID NO: 36292 - DNA, 751 bp, Aspergillus nidulans
gcgtgtctctttgacatggacggccttctcatcgactccgaagacctctacaccgacatcaccaatcaggtgctgcactcgttcggcaaaccttcgcttccgtggtccatcaaggctcaattgcagggtcgtcctcagccagaagtacgctgtaaccttctcaccaacctacaacaccttatctgccccgctccctcagaagctcaagaaacagggtctaatttgactgaattctcaggctgccagaatcttctccgattgggcgcaactccctatcagtcacgaggaatatgtttcacggatctcagcgctacaagcagaactcttcccgacgaccaagccgctgcccggcgtagagacattgctcaagaatctcgtgtctacgcagaagggccctaacccggtgcacattgccctggcaacatccagccacacacggaactaccacctcaagacgagccatttgcaggatctcttctccctcttccctgagtcccagcgtgtgctaggcgatgacccccgcatcggcaagggtagaggaaagccactaccggacatctacctccttgccctagaaacaattaacgccgggcttcgagagaagggtgagaaggagatcacgccggaggagtgtcttgttttcgaggatgcggtgcctggtgttgaagctggccggcgcgcgggtatgagggttgtttgggtcccacatccgggattgttggaggcgtataagggacgtgaggaagaggtg

SEQ ID NO: 36293 - DNA, 1037 bp, Aspergillus nidulans
gaccatgtccgcatagttgaagtcgggcctcgcgacgggctgcagaacgagaagaagtctatatcgctcgagacaaagcttgagcttatatcgaagcttgcaaagacgggagtgacgaccatagaggcaggttctttcgtgccggcgaaatgggttccccaggtatgtctccaaatgccgcccgctcgtaaccgataaagccaacgaagttcgaaatttgatgctgatatttgcaaatgatagatggcaagtaccgcagagatatgcgagcacctccttcaaaccccgccgcagtccctgaacgcgattgcatacaattatcttgttcccaacgtcaagggattagagggtctcatcaaggtcatggatgcaacaggggcctcggcaagcacaccgggaaccaaaacaactccgcgacaacgaccgagatttctctttttgctgcagccacagaagccttttccaaagcaaacaccaattgtaccatccaggaatctctggaccgcattcgccctatcgtagcattggcgaagaccaaagacattcgagttcgcgggtatgtctccgttgccctaggctgtccgtacgaaggtccagatgttccgccgtcaaaggtggctgatatcacggcaaccttgctcgagatgggagcagacgaagtatcagtagccgacactacgggcatgggtactgcaccgcgcacgatggagcttcttcaggctctgaaggcagccggcatcgccaatacagatctggctctccatttccacgacacttatggccaagcgttggtgaacactatcgtaggcttagagcatggggttcgcatttttgacagtagtgttggcgggcttggtggctgtccttattcaaaaggagcgacaggcaatgtctcgacagaagatctcgtccatacaattcatggtctcgggatgcatacaggtattgacctggaggagatgtcgaggattgggcaatggatcagtgatgagctaggtcggccgaatgaaagcagggctggcaaggcgactatagca

SEQ ID NO: 36294 - DNA, 1669 bp, Aspergillus nidulans
ggatcttctgctttgttcgattcatttgcatatttagcctccgagaaatcgggctggagtcatacacttgtcgggtggaccggtgaagtggaaccactcaacgaggggagcaatcccttgcaggcacttaactccaatgcgaatacaaacttgcctgcagctcttgacaacacttcgcgatctcttagtaaaggatcagctcctgtggtacccgatataagtttgctgcaatcaaatagttccgttgcagaaacctcgactgtgggacctgatgatcggaaaaggttggaggatcaattgagttcaagtcgccacggcaaggttgttccagtatggctgtcagatgaatccgacgtgcccgaggacacaataattcttggggatcaaagcagatggaggcgctatgcggagaaagagctctatgctcttctgcactataaacaaaatggaccaactgacggcaggttcgagcgcgattcttggacagactacgtgagaatgaaccagctctttgcagagcgtattctccaggaatacaaggagggggatattgtttggattcatgattaccacttatttttgctcccaagcattctgcggcagcatgttccgaatatctacattggtttctatctgcactcgccgttccctagcagcgagtacatgcggtgcctagccaaaagaaaggagattctcacaggcgtgcttggtgcaaacatgattggcttccagacgttctcctactcgcgtcacttctcgtcctgctgtactcgcgtactaggatttgagtccgactcggctggcgtcgatgcatatggtgctcacgtggctgtggatgtctttcctatcggtatcgatgctgaagcaatacagaagattgcgtttgaaaacgcagacacggagaaggctgtagaagggttgcgacagttatacgctgggaagaaaatcattgttggccgtgatcgcctagacagtgcccgcggggtcgcccagaagctccaagctttcgagacgttcctcgaacgattccctgaatggcgtgacaaggtcgtacttatccaggtcaccagtccgacaagcgtcgaagaggagaaagaagaacaaaagattgccagccgcatctccaacttagtcagtacaatcaacggccgtttcgggtcgctgagtttttctcctgttaaatattatcctcaatatctctcgccgcacgaatacttcgcgttgttgcgggtggccgatgtcggccttattacaacagtccgcgacggtatgaacacgacgagtttggagtacatactttgccagcaggaaaaccatagtccgctcattctttccgaattctccggaacggctggcgcattatcgagcgcgatccacattaacccatgggacactatcggcgtctcagaagcaatcaacaaagccctaacagaatctgtcgctgacaaaaaggagcagcatttgaaactctacaagcatgtcacgaccaatacggtttcagcatggtctaaccagttcatctcgcgcctgctcgcaaacctctcctctttcgatcagtctatggcgacccggccctagacagaacaaaactcttgaagcagtatcgcaaatccgaaagaggccttcatgtttgactcgacggcaccttacccgatcgtgaaggacccca

SEQ ID NO: 36295 - DNA, 2539 bp, Aspergillus nidulans
ttgtgctttgatgacccgacccgaggtcttgatgccttattcggtctagactatgcccggttttcttggctcatgaccgacacttgcggatatgccacgcttatgaccgcgtaccaccctgttgccgcgataaatgacatagccctggtggctggcgttcacaccgccaaagggatctgctctacctaggtcccgtgcacgctggcactgcatccttacatgatcctacagatcagtgtgttcgcatgcttgcagcatatgatctcattactagttctactgtccaaaaaagaaggaagttccgagaagggtgggaacagcgcgcaccaaaaggacccattgagctggaacaagctttcagaaagagcgctgcgttcatgaacgttcagaaggaagtacggagctatgacagccagggattcggtgggaggagccgcgccgagtcgcactctgatacagactatgaaagcttagaagacgtcaaagaggccctccaaaccgacaaatcccgattcgtgtcctccaaatctccgtataccatctccctcttccgacaggtggtattatgtgctaaacgtcagatatggcagattagaggccacatgtcgcccttgtacatcaaacttatctcctcggtcatttacggactccttgtcgggtccatgttttatgaccaaccgcaaaccacggacgggatgtactcacgagggggcgtgattttttactcatctattcttctggcctggctccaaatgtctgaattagaagaagcaatgcagggacgtgacatcctcagtcgccagaagaaatttgcattcgtccggcccagtgctgtgtgcctggcccgagtcgtcgcagatatcttcattgcagctctccttactttcctctacctagtggttgtttattttctgtcagggttgaagtctgatgtgagtatctgccaagcgattgtgcacccagtcgctaactctatcataggccggggccttcttcatcgatttcttgttcatctatatgtgcacgatatctctaacagctcaattccggctgtttgccgccgcgtcctctaacttcgaggttgccctccgctacacaggattcctcgttctgctttgcattgtttttggaggttacgtactctctgtggacaagatgatggctgatgttccctgggtcggatggatagcggtgagtatcttacctaatgtctatataataaaactaatgcatacctagtatatcacaccagcgttatatacatacgaggcaatgatggctgcggaggtttcacaacaccaactttacctgctccccagcttcggttgtccctgcaggacctgtctatactgacattgcctaccagacatgtgcttatgctggaagtcagatcggaagcactatagtcaacggcgatgactatcttgcagtcaaatacgggttctattttagtcatgtttggcgcaacttcggtatcctctgtcttttcactgttgcttccgttgctgctacctgccttctgagtgaaattatggaatgggaaccagacagtgccggaccagtccagtacaaaaagtctcgaaaacagctgaggaagattgcgaacattagtgatgaagaagagcgccctgtgcaggtcaatcaaacatcgccttcagcatctgacactgatggaccgtctgttggagccctcactgccaccaaatcaaccttcacctgggataacctggaactgtttgtccgtgttggaaaggaaaatcgcaagctattggacggtgttagtggatattgcaaaccggggaccctgactgctttggtcggagcttctggagcgggcaaatcgacttgtgagtgaacctggtctgtgtttttgctcatcccaggattgtgtcctgacattcttagtgttgactgcgcttacccagaggcaaagctctggcgaccttacaggtacgatgtatgtagacggaagacctatcgactcttctttcaaatctagaattggctactgtgaacagatggacattcatgacgaaagcagcaccattcgcgaagcattcgagttctctgcactgcttcgtcaagactccactgtacctgatcaggagaagttggcttatgcaagaacggtgctagagacgttagacttggtggaattgcagaacgccattatcggctctttggacatcgaaaagaagaaaagggtcaccatcggcgttgaactttgtgcaagacctgagctgctactattcctggacgagcccactagtggcctagacagccaggctgcgtctagtatttgtgccctactaagacgactcgccgaccagggtctggcaatcctttgcacaatacaccaagcaaaccaggagcagttcgagatgtttgatcgagtgctggctctgagtcccggtggcaagacctattattttggcgaagttggagaggcagggcactctatcttcgactactttgcgaaatacgggcagaagcctgaaaatattaccaacgctgcggactacattattgaagttgttgt

SEQ ID NO: 36296 - DNA, 900 bp, Aspergillus nidulans
agattcaaacccgataaagaaggtgatatcattcagtatactggcctctcgcagtctgctatccgagaaatggcgctttgttccgaacttgaccatgccaacgtagtgcagctcgccgagatcatcttagaagacaagtgcatctttatggtcttcgagtacacagagcatgatttacttcagatcattcatcaccatactcagccccagagacacccaatccccgcagcgatggtaagatcaattcttttccagcttcttaacggcttactatacctgcacacgaactgggttttgcatcgagacctgaaaccagcaaatattctggtaacgtccagtggcgcaattcgcataggagacctaggcctcgcgcgtcttttctacaagcctctcaattcgctcttttccggcgataaggtcgtcgttaccatttggtatcgtgccccagaacttctcatgggcagtcggcattacacccctgctgtggatctatgggctgttggttgcatattcgcggaattgctctcgcttcgtccaatattcaaaggtgaagaagccaagatggacagcaagaagacagttccgtttcagcgcaaccaaatgatgaaaattatcgatataatggggctacctcacagagataactggcctggcatcgtccacatgccagaatattctcagcttcaatctctggcaatgtcccgcgccccaaaccatattagccgaacctcgaatcttggaagctggtaccagaattgcttgaaaaacggcgggtactctgtcaactccagcgttggcacccctggcgatgacggcttcgacctcctttcccgattgctggattacgatccaacctcacggataacagcaaaggaagccctggaacatccatatttcaag

SEQ ID NO: 36297 - DNA, 1083 bp, Aspergillus nidulans
cgtatctggctcgctgccgttggtggtggtgccgtcgaaggttctatccgctggtgggctcgtgaccaccgcgctcaccaccgctacaccgataccgacaaagacccgtactccgttcgcaagggtctgctctactctcaccttggctggatggtgatgaagcagaaccctaagcgtattggccgtaccgatatttccgacctgaacgaggaccccgtcgttgtctggcagcaccgcaactacctcaaggtcgttttcacgatgggattggctgtgctatgcttgttgctggtcttggatggggtgactggttgggcggcttcgtgtatgccggcattctgcgtatcttcttcgtccagcaggcgactttctgcgtcaactctttggcccactggctcggtgaccagcccttcgatgaccgcaactcacctcgtgaccacgttatcaccgctctcgtcacccttggagagggctaccacaacttccaccacgagttcccctcggactaccgtaacgccatcgaatggcaccagtatgatcccaccaagtggtccatctgggcctggaaggcagcttggtcttgcctacgacctgaagaagttccgtgccaacgagattgagaagggtcgtgtccagcagctccagaagaagcttgaccgtaagcgtgccactctcgattggggtactcctcttgaccagctccccgtcatggagtgggacgactacgtcgagcaggctaagaacggccgcggtctcgtggctattgccggtgttgtccacgatgtcacggacttcatcaaagaccaccccggtggcaaggccatgatcagctccggtattgggaaggacgccaccgccatgttcaacggtggtgtctactaccactccaacgccgcacacaacctcctctctaccatgcgtgttggtgttatccgcggcggctgtgaagtcgaaatctggaagcgtgcccagaaggagaacgtggagtacgtgcgtgatggctctggccagcgcgtcatccgtgccggcgagcagccaaccaagatcccagaacccattcccacagcggatgcggcgtgatct

SEQ ID NO: 36298 - DNA, 877 bp, Aspergillus nidulans
atggctgagatccgccgcaagcttgttatcgttggtgatggtgcctgcggtaagacctgtctgttgatgtaagtcttcctccaggtcatctgaagtatcctttcagcatcatttacttactctattcttcccgtgcagcgtcttctcaaagggcactttccctgaggttagcttccacattcagttcgtgccgcccagcgccgtcgaactctgtctatgacctgggtgttctcttttacgcaaactaacggcgatcctctcaggtctacgtccccaccgtctttgagaactacgttgccgatgttgaggttgatggcaagcacgtcgagctcgctctctgggatacggctggtcaagaagattacgaccgtctccgccctctctcctaccctgactcgcatgtcatcctgatttcgttcgctgtcgactcaccggattcccttgacaacgttcaagagaaggtgagctttttttatcttataaataaaataatactcgcggacactatgctgacccttgaacaagtggatctctgaagtcctacacttctgccagggtctccccatcatcctcgtcggatgcaagaaggatcttcgccatgaccccaagacgatcgaggagctgaacaagacctctcagaagcctgtcacccccgaacaggtaagatctcgagggaaaatgtgattgtttggaacacaactgacatattctgtagggtgaggaagtccgcaagaagattggcgcctacaagtacctcgagtgctctgctcgaaccaacgagggtgtccgtgaggtctttgaggctgccacgcgtgctgccctcttgaccaagacccacaagagcaagaagaagtgcagcatcctgtaaattagtcta

SEQ ID NO: 36299 - DNA, 705 bp, Aspergillus nidulans
atcgatctggaagcgcagaagaaatattacgcctacctatccaaaactggtctcaccggtctcgtcatactaggaacgaactcagaagccttcttgcttacccgcgaagaacgtgcacaactaatctccgcagcccgtgaggccgtcggcccagacttccctctgatggccggcgtaggagcccactcgacaaagcaggtgctcgaattagcggcggatgccgccagcgcaggcgcaaactatctccttgtcctcccacccgcatacttcggcaaggctacaacgatgaacgtcgtgaagcgcttcttcgccgatatagcccgtcgaagcccgctccccgtcgtgatctacaacttccccggcgtctgcaacggtgtcgacatcgattccgagaccattacagatatcgttcacgaatctgcaaagtcaagccccaacggtgtctcgaatgtggtcggcgtgaaattgacttgcgcttctgtgggaaagatcacccgtctcgcggcaacatttcctgcgtcggagtttgctgtgtacggcggccaagcagacttcctaatcggggggctcagcgttggctcagcaggatgtatcgcagctttcgcgaatgtcttcccgcgcacggcgtcgaaggtgtatgagctctatgtgtctgggaaggtgactgagaaaatgaacttgcatcagaaggccgcgctggcggag

SEQ ID NO: 36300 - DNA, 1155 bp, Aspergillus nidulans
atcatggctgagacagattctttcctgcacctttcccgtcctctaggccctgtcctggcggggtctgcacccacaactgctcccttgaacgttgtcatccagcctcaggtacaactcctttgtttgaggaaaatcaagaattacgtcgctaatttgctgttcaggcccttttctcaatcctcgaccactctcttcgccgtaacgctgatcaggaacgcgtcattggaactcttctgggaacccggtctgaggatggcaccgaggtggaaattcgtagcacgttcgctgttggacacacagagacgacagaccaggttgaggtggacatggaataccagaagcagatgcttgccctgcatctcaaggcgaatcctagggaggttcttgtgggttggtacgctacctcgtccgagctgaacaccttctccgccttgatccaaaatttctacagcggccagggcgacggcacatggcctcacccagctgttcacttgactgtctctaccgaacccggaaaagatatcgaaacccgcgcctatatctctgcgccagttggtgtgaccgccgagagggctgccgacagtgctgcctttattcccgtgccccacgagattcggtacggcgaacaggtaagagcggtttggaggccattgctgcggctcgggattcagaggagcgttccacctccctcttcaccgatattgaggccctggagcgtgcgatcgaggaggttcttggtatgattgacagggtttctcgatacgtcgagtcggtcatcgatgaggaggctcccgcctctacagcattgggccagttcctgctcaatgctcttgccttggctcccaaggttgagcctgctgatattgagcgtgacttgtatgagccacactttcctatgatattgtatcagtttactaaccatattctagtaacaaccacatccaggacgtcctggtggtttcgtacctggcaaacaccattcgtacacagatggagctttctaaccggcttgcaactgctcaactcacccttggcggcgagtctggtaacgcagagcaaggtggtgcccagcgtaatcagcgaggcaagggaggccgtggtgggcaacagcgcaaccaagagcggggtgctgaggaaggtcgcgcataggatgat

SEQ ID NO: 36301 - DNA, 284 bp, Aspergillus nidulans
actttggccgaagtcgcgcggcacagcagtccgaatgacctctggattgtgatagagggaaacggtaagaaccgttcagcgcagaaggactcaactaacgaaatggaatagtctatgatgtagcagaatatcgtgaggaccatcccgggggtgatgaaattctccgccaatttgctggaaaggatgccacgacagagtttcaagacgccggccactcgaatgacgcctacgtgaaactgaagacgttgctcgtcggtagtctgcaatcgaaaaccctaccggaa

SEQ ID NO: 36302 - DNA, 1513 bp, Aspergillus nidulans
tccaatgtagtgggtgtacactacagagtaggaaagaaaattggtgaagggtcttttggtgtgatctttgagggcacgaatctcctgatcaatcagcaggttgcgattaaattcgtaagtcacgtcccaaaaattggatggaagttaaaaaaagctaacgacaccaggaacctcggaagagtgacgctccccagttgcgagatgaatatcgaacgtacaaaattttggtcggatgccgtgagtgttctccaatatgcaacgaaacaatcactgactggtctagccggcattcctaatgtctactactttggccaggaaggtttacacaatatcctcgtgattgacctgcttggtcccagtttggaggatctgtttgatcactgcaaccgacgcttctctgtgaagaccgtcgtcatggtcgccaaacaaatggtgagttttccatgctgacttgagaaaagagaaatgcgttcctgactttcttagctctctcgagttcaaacaatccacgagaagaatctgatctaccgtgacataaagcccgataacttcctcatcggtcgcccgaactccaaggccgccaatgttatccacgtcgtcgacttcggaatggccaagcaataccgggatcccaaaaccaagcaacatatcccataccgtgagcgaaagtcgctgtccggtacagcgcgctacatgagtatcaacacccacttgggacgcgagcagtcacgacgagacgatcttgaggccttgggccacgtttttatgtatttccttcgaggtggcttgccctggcagggcctgaaggctgccaccaacaaacagaagtacgaaaagattggagagaagaagcagaccaccgccatcaaggaactctgcgagggatttccaggtttgttcatcgtcgaaccctccccggctgtgctgaccacgtctagaagaattcacaaagtaccttagctatgtgcgcaatcttggtttcgaagacacccctgactacgattacctgcgggatcttcttactcaggccctcaagaacgctggggaagttgaggatggagagtacgattggatgaaactgaacaacggtcgagggtgggaatacaagtcctattcgtcccagcaggctctccagaactccgccatgcatacttctgccagggacctccacggccagcagatccgcaacagccaaagacccggcgtgaccgcagaccgtttaaacgccgcgcagcccccgcccccgtctcctgcgaagcccggagccgggaagacgcgcgagccgcaaaacgtcagaggcggcatcccgccaaaacgtcagagcgggggattcgacacgacaccagctgcctcgacagtggcacagtttcagaactcgaacgcgaacatctcgggtcatcggataggcagcccggcgaccccggccaagaaccagccagcccctggcggccagcaggcgagcaatgagccgcagcccaccttgatgcaaaaggtgatgaaagcactttgctgc

SEQ ID NO: 36303 - DNA, 1010 bp, Aspergillus nidulans
gaacgccaagccggtgattccaggctcaatggcgaccccagtgaagcgcctccgaagaagcgtcgacggctctcaaatgagcagcagccgggatccagcggtgagcaggctgcgaaacaagggaaaccaacgacactgttacaattccccgcgttggaatggggaccctgtcgccatgtggacaacttcgagcgcctgaaccatattgaagaaggctcatacggctgggttagccgcgcaaaggagctcacaaccggcgaagtcgttgccctgaagaagctcaagctagacaattcccccgacgggttccccgtaactggacttcgggagatccagactcttcttgaagcgcgccatcaaaacgttgtttacctccgcgaggtcgtcatgggaaacaaaatggacgagtaagcctgattaccaacccctatgattcatagcccggcctattcatgccccatacgagggtctttagccctcttccctctactcctctcatcgcatgctcctccaccatgaaaagtatcagatacataatgttaaccatcaaacccgggggaggcttctcccccttctccggcatatttagagtctacctcgtaatggacttcctcgaacacgatctcaagaccctcctcgacgacatgcgagaaccatttctcccgtccgaaaccaaaacccttctcctccagttcatctctggtctcgactttcttcactcgcaatggataatgcaccgtgatctcaagacatccaacctccttttgaataaccgcggcgagctcaagatcgctgattttggaatggcacgctactacggagaccctccgccaaaactaacgcaactcgttgtgacgctttggtaccgctccccggagcttctgttgggtgcggagagttacggtcctgaggttgatatgtggagtgtggggtgtatattcggggagcttcttacgaaagagccgcttctgcaggggaagaatgaggtcgatcaggtgtccaaggtgtgt

SEQ ID NO: 36304 - DNA, 1579 bp, Aspergillus nidulans
  unsure (1)..(1579): unsure at all n locations
ctcgatcaaaaagcaaaggctatgttcacttgcgttncgcttctcccacgggctctgaaagcggcatttgcggcagggctacctaaagaccgtatttatttgattgatgtgttgcccggtagcgggaagatcccgccggaatttaagacactctcacagatcgtcgaggaaggaaagtctcttccgaagttggagaagctcaaatggggggcaggcgagggcgcgcgtcgaactgcctatctatgctattctagcggaacgtcagggttacctgtaagtaaccaccctccagataaggggcatttcttgagcgctgacagagcattagaaaggagtaatgattgcgcaccgcaatgttattgcaaatgttctgcagatgacggctttagagaaatcatggcgtgatacccgcaagaatgcggacggcagctactatagtgacgtcttgctgggcctgctcccccagagccatatttacggactggttgttatctgccatgctgggaccttccggggagatcaagtcatagttcttcccaagttcgagttgaggtcgtgtttggccgccgtccaaagattcaagatctctgttttgtttgtggtaagtcttatcctgtccggaagcgaacctatctaacgagctgcaaggttcctccgatcattatcactatgcttcggagcccagaaatatgcgctgagtatgaccttaactcggcggtggcgctcgtgactgggcgcgcaccactgggtcaagagaccgctctcgactttcaaaagagatatccgaaggttgctattcggcaggcatatggtaggtcatcagcttcatgagtatgaccgatagattactgatttcgattcacaggccttaccgagacatcaacggtcgtcacggccacacactttgatgacatcgtgcctgggtcttccggttggcttatccccggcgtagaggcacgtatcgtgaccccagaaggggaggatattaccaagtatgacacccctggtgagctctgggtccgagctcccagcgtcgttcttggctatctcaacaatgagaaagctaccaaagagacgtttggcgatggatggatgcataccggtgatgaagccgtgattcggaagagccccaagggcaatgaacatgtgttcattgtcgaccgaatcaaggagctgatcaaagtcaaggttcgtagcaatgtacaggaaagcatgaccccccgataactaacctgcgtgctagggtcaccaagtcgctccagccgagcttgaagcgcatctcctcacccacccagcggtggcagattgcgctgtcatcgccatccccgatgacgctgccggtgaggtacctaaagcaattgtatctaagtcacctgaggcgggaccagatgacgaggctacagtcaagtcgatcgtcaaatatgtgcaggatcataaagcgcgacacaaatggcttaagggtggtgtgagattcatcgacactgttcccaagagccctagcggaaagatcttgcgacggctacttcgtgaccaggaggcggctatgcgcagacaagcaggctctaagctatagatgtct

SEQ ID NO: 36305 - DNA, 765 bp, Aspergillus nidulans
aaggtcttcattattggccggcgggaaggtgtccttcaggaaacagccgcttctgccgtcaacggatcgatcattcctgtcactgcggatgtgacgtctaaagagtcactgcaagccgcctacgacacctttgcttctcagaccgaccacattgacctgctagttgccaacagcggaatcgcaggtcccattacaaacacagagatccagcccgattgctatcccaccctatccgagtttcgcgaccagttctggtcgatccccatggaggaattcacaaatgtgtcccatgtcaatgtcacgggagcgttctacaccatattggcattcttgccgctgcttgaagcccagaacaagaaacgaccggcgccgataccgggcactgtatcctctcccaaaccacaagtgatcattacaggctcaattgcagggtttacccgccttgcacttcccggcttcccatacaatctatccaaggcagcagtgacccatatggttaagatgcttgcgacaaccttcagtcaatacgacatgcgtgtcaatggtatcacaccaggtctttatcgtactgacatgtcgttgccgttttacaagtcgcagggtgtacgtgggaatgggaccgaggatgggtcgtttccacgatctatggttcccgtcacaaggagtggtagtgaagaagacatggccggcattatactctggatggctggtgccgcggggggatacctgaacgggaatattgtcgttagtgatggaggctcggtg

SEQ ID NO: 36306 - DNA, 1268 bp, Aspergillus nidulans
tcacgacaatgctcaaaacataaccagacatcgggaattcgagcttcgtcctcaacacgccaatatcatgttgctgccattgaatcgcctgcgaggcgtcggcgggacagcaccttcatgaaacgctcagacttcatccaagctagggtaggtaacccaactcgaaatgtctcatcgctcgaaaaatggctgaccgctgtcttatctagaattttcacgctacgaaagtacttgcggcaatccctgacccgtataaagtcctgggggtggataaaggagcctccgcgggcgacatcaaaaaggcttattatggaatggcaaagaaatatcatcccgataccaacaaggatcccggcgccaaggagaaattcgctgaggctcagtcggcttatgaacttctatcggacaaaaagaaacgtgagacctacgatcgattcggctcggctgcctttgatcagaatggcggctttgacccgagcgccggcgcaggaggcaatccgttcgctggcggcggaggcttccacgggtttggtggaggatttggtggaggattcccgggcggctttgcagcagatatcaacatcgaagatcttttcggcgctttcgcgggtggtgctcgtcgttcaggtcggggtagacggggtccgttccaagagattctagttggcgaagatatcgaagttcaaaccaatatctcgttcatggaagctgccaaaggtacttcgcaagacatcgttatcactccattgaaggagtgcggtacttgcaaaggtgacgggttgaaagagggtgcaaaacggacccaatgtcgtcaatgcaatggtactggaacccgagtccacttgatgcagggaggcttccaggtagctgctacatgtgatgcttgtggaggagctggtcttattgttccccggggttcgcactgcggcacctgcaagggagatggagtggtccgcgagcggaagacagttcgggttgatattcccggtggtgtagaagatggcatgcgtctgaggatatccggtgagggtgatgctcctcctacgggcacagcagctgcacctggcactcggacgcagcgtggtgacctctatgtgtccattcgagtgtcgcctgacgagcggttcagtcgctccggatccgacatcctcgatagggcatccattccactcaatacagcgcttcttggtggtgaagttctggttcctacattggacggccaggtaaaagtcacggttgcgaccggacctggaaccggtgacaggatc

SEQ ID NO: 36307 - DNA, 1936 bp, Aspergillus nidulans
aatctcgccttcccccgtggtcttatgatcggtaccgattctcacactcctaacgctggtggttttgctattgctgctattggtgttggtggtgccgatgccgtcgatgtcatggctggccttccttgggaattgaaggctcccaaggtcatcggtgttaggctcactggtgagatgtccggctggaccgctcccaagggtaagtatcattatttacatctgacccaaggcttgaggggaattgtgcactaatactctcttagatatcatcctcaaggtcgctggtctcctgactgtcaagggtggtactggtgccatcattgaataccacggtcctggtgtcaactccctctctgccactggtatggccaccatctgtaacatgggtgctgagattggtgccaccacctttctcttccccttcaagcgacggtatgtacgactatctgaaggctaccaagcgtcagcagattggtgactttgcccgctcctacgccaaggacctacgcgaggatgagggtgctgagtacgaccagctgatcgagatcaacctgtccgagctcgagccccacatcaacggtcccttcacccctgacttggctactcccatctctcagttcaaggaggctgtcaaggccaacggctggcccgaggagctcaaggtcggtttgattggctcttgcaccaactcttcttacgaggacatgtctcgtgctgcttccatcgcccaggatgctctcgaccacggtctgaaggccaagtctatcttcactgttactcctggttccgagcagattcgcgctaccattgagcgtgacggtcagctcaagacccttgaggagttcggtggtgtcatcctggccaacgcctgcggtccttgcattggacagtgggaccgcaaggatgtcaagaagggtactcccaactccattgtctcttcttacaaccgtaacttcactggtcgtaacgatgccaaccctgctactcacgctttcgtcacttcccccgaccttgtcgttgctctgagcattgctggtactctcaacttcaaccccctcaccgacactctcaaggacaaggatggcaaggagttcaagcttaaggcccctactggtgacggtctccccagccgtggctacgaccccggccgcgacacctaccaggctcctcccaccgaccgcagcagtgtcgatgttgctgtttccccctccagtgaccgtcttcagctcctcgctggattccagccttgggacggcaaggatgccactggcattcctatcctgatcaagtgccagggcaagactactactgatcacatctccatggctggcccatggctcaagtaccgtggtcaccttgacaacatctctaacaacatgctgatcggtgccgtcaacgctgagaacggcgaggccaacaagatcaagaacgttttcactggcgagtatggtgctgtccccgccacggctcgtgactacaaggctcgtggtgttaagtgggttgttatcggtgactggaactacggtgagggtagctctcgtgagcacgctgcccttgagccccgccaccttggcggtctcgccatcatcacccgcagctttgcccgtattgtaagtctcatgcgtctcattcagactaagtagtatttggactaacaaatattctccagcacgaaaccaaccttaagaagcagggtatgcttcccctcaccttctccgaccctgccgactacgaccgcatcccccccgacgccaccgtcgacctcctctgcacggaactcgccgttgacaagcccatgaccctccgtgttcaccccaaggatggtgcctccttcgacgtcaagctcagccacaccttcaacgagtcccagattgagtggttcaaggacggttccgccctcaacaccatggcccgcaagtctggcaactaaacgaca

SEQ ID NO: 36308 - DNA, 1672 bp, Aspergillus nidulans
ctcatcgcatacgcgatctctggcggaatcgtctttctgacgatgctgagtcttggtgaaatggcggcgtttatacctgtcgctgggagtttctgtacttttgccgggtgagccagccctatgtcttacggctcctaaccaacttcgtttcgagctgaacattgaatctgaatctgggactgggctaacatgcaactagtcgctttgtggatgatgcgtttggattcgccttaacgtggaactactggttcaacgacgcggtatctacggcgtccgatttggttgcgctgcagattgtgctgcagtactggaccgaatcggacaacttccccggctgggcgttcagtctgatcttctgggctgtgctgattgggctgaacttgttcgccgtaaaagtttatggcgaggtatgcgttgtccacccgccacggatcttccctccgctaatcctgtttccctcaggttgagtactggatgagcgtgctcaaggtgatcactatcatcgttagtgggcgttgtcctctgatctagcagaatcggcaagtgttgattgcggaaataggtcttcatcgtcttaggaatcgtggtcaactgcggcggaaacgaatctggccgctatatcggcggcgagaattggcatattccagatgcgccgttcgttggagggatcggggggttcgcttctgtctttgtaacggcagcgtttgcctgtgagagtttccgttcctttttctaaaggatcgctgctaagtcgagattgttagacggcggcacagaatccatcgccatcaccgcaggagaaaccaaggacccagcgcggactattccaaaagtcgttctcaatgtcttctggcggattctcatattctagtctgtctttttcacgcactttaatcgtcttctgccgctttactgatggacaatagcatcctctcctccctgatcatcggcctcaacattccccacaactatccctcgctcaacgacggcacggttaaaacgtctcccttcacgctcgtcttcgaaatgacgggcacaaaggccgccgggagcgtcatgaacgccgtgatcctcacttctgttttgtctgccggtaaccacgcgctcttcgcgggcgtccggcttctgtacacactctctgttgctgggcacgcgccgggcttctttgggaagctgaatcggaaccatgtgccatggattgctgttctagctaccggggccgtgagtgggctatgctttggctcgagtaagatcggagctgggcagctctggacttggttgcagaagtacgctcccattccctcgcattcatgctacacaaggtatactgacaaaccactgcctcagcatcgtcggcgtctccaatcaactctcatggatctctatcggtataaccagcatcaggttccgcgccgcactgaaacagcaaaacaagacacacctgctgccgtttcgcaacttcacgtacccggtaggtccctgggtctgcgtgatcctgaatatagtcatcgtgcttgtacaggggtggagctgttttagcccgacatttgacggtgttagtttcgtgagcttttatctcgagttgccgattatgctgggcatgtttatcgtttggaaggtctggaagaggacgacgtttgtgaactcgagggaggtcgatctggttacggat

SEQ ID NO: 36309 - DNA, 1012 bp, Aspergillus nidulans
gtcgagacgatcccaaccgtcgacatcagcgcctggcttgatccgtcttcagcggaggaggaccgccagaatgtcgtcaacgcgatgcgccacgcatgtactacttacggattcctgagcctcgtaggccatggagtctcgctagaagagcaaaagcaggcgatggactgcgcgaagctcttcttcaccctgtccgaggaggagaagatggacgtatggatcggtaagagtaaggggaggtcgttccgcggatatgagcctcccggcatccaggtccaccaggaaggtctccttccagataccaaggaggtaagttcttttgctctagagaggtgatgtgctgatgttgagatattgggaagtgcttcattatcggccatgaggtgcccgaggaccatcctgacagcggtacgttctccacgggtcccaatctgtggccgaagtcactcccggaggaccagttccggatccccattatgaaataccaagctcgcatggtccagctggtgaaagtgctgctcaaaatccttgcaaggggtttaccctcagagtggaattgcccgccggacgcgctggacgcgctggctgagaacgagccctcgattcctatgcgacttctgcattacgctcctcagccagtcagagacgagagacagtttggtggtgagtcctcttctatccctagacccctcatagacaaagggaaaaccaatcctaactgtcagcagtcggcgatcacactgattttggatgcatcaccatcctcctacaagaaatgggcaccgagggtctagaggtctggtatccacccacggaaacctggattccagtccctccacaggaaaatgcctatgtgatcaacatcggcgacatgatccaaaagttcacgggtggatactaccgcagcgcccgtcatcgggtgatcaccttcaccgagaagcataggtacagcgtcccttttttcctcaatggccagctgaagttgaagtgcactgcacttgacgggtcgggg

SEQ ID NO: 36310 - DNA, 1564 bp, Aspergillus nidulans
tcacccctagacagatccatgttagtatcaccgatcctggaaccaaggaagcccgcttacattgacaggtcatcgcgctgggttccaacgtcggaagtggcttgtgtattggtacaggcaaggcctttgctaatggagggccggcaaatatgatattgccatactctactgtctgcatcgctatctgggctcatctacaaacatttagcggaaatgaccatcgtctctccaacttcgggaagctacatcgactacgctgaccgatgggtcgacccggctctggcttttggtgccggtctagctgagtggctgggtatattcatccaaccctattccacaaagagctaatagttggatctcaggttggacggccgtcttcgcatccgaggctacattctttgcctttctggtagactactggacaaaagacgttataccagaagctgctttacgtatgtctttccccgcacctatatgtgtaggtaatctcacaccggtctagtatccatcttcatcgtgatatgtctagcggtattctttctgccaaacacctacttcgcctggcttcattattttgggcccctggtaaaagttattcttttcgttttcttcggtataatctctctggccattagtggggggtgcagggctaactggctcggtcaaggatggcagcacttggacggacctcccagcattcaaaatggcttcgaagtatgcacccgtatataaactccatttcagtggaccggaaacttagttattgcggtttagggctttgctagtgcagctcttcttgccgtctgggccgtcggtgatcatatctatattggcgtattgggtggaggagcacggtcgccgcgctattcatggcacatgcggccaatgcggttccctggcgcgtgactgtcttttatatggtcttgattacctttgtctctgtgattgtgccattatcagaagccagactgctcggtggctctggctcgcagcctctccattcgtgatcgccatcgacaatgccggcatcaaggtggctccggacctggtcaacgcctgcatgatcattcgtatcgtggtcattgcgctagagtgtatcttcttgacttctcgcatgttgcgaacaatggccctacaaaagctcataccatcgttcatcgccgaggtcgataaaagggccgaccccgctgggcgctcatgattactggcgtggttggagttgttttgacctacatcagcctaagcggtaggtagtcgagctcacagcaataaaacggacagtgctaatctagagcagggaagggaaccgagttgctcaactgatttatcgctattactagtgcatccttcttcatcaactttgccatcgtagctcttacctccttccgcttccgcgcagccgtcaaggcacagaaaggggaccttctttacagagagctacagctggaaatcccctctttggccactgactccgatcattgttctcgtgctctccgccctactccttgtcagcctactatacatcagtataaaaccagtggtatacctctttctgctgatatct

SEQ ID NO: 36311 - DNA, 1267 bp, Aspergillus nidulans
tattcgcaaataggccaattttgctaatggtgggggttttctagcgtcgtcgccgagtctcgtcttgccgacggcaacctcttctctatgcccattactctggatgcttccaaggcagtcattgaacaggccggccttaagcctggctcccgtgtcaccctgcgtgacttccgtgacgaccgcaaccttgctattcttacaattgacgacatctaccgccctgacaagtgagttgttttcatgaccttgggcaactgcctcgtcattggtactccgcgttcgcttggtcttccggatggcgggactagcgggcgctgcggatttgccaaggacgtggcatttatctaaacgaggattgcgcaatttctaacatctttgcttattccagggagaaggaggccaagctcgtcttcggcggtgacccagagcaccccgccatcaagtacctgaacaccaaggtcgaggagtactacatcggtggaaagctcgaggcagtcaacaagcttaaccactacgattatgtcggcctccgctgtacgtttgagaacacaacaggagcctgcataaatcaagaaagataaatctaacgcgattttagacacccccgcggaactccgtattcacttcgacaagctcggctggacccgagttgttgccttccagacacggttcgttctggttacttgactcgagactgggatgtcatggctaacagacctaattaaccctatgcacagagctcaccgtgaattgaccgtccgtgccggtcgcgcccgccaagctaatgtccttatccaccctgtcgtcggtctcaccaagcccggtgacattgaccacttcacccgtgtccgtgcctaccaggcccttcttccccgctaccccaacggaatggcggctcttgctctcttgccccttgctatgcgcatgggcggtccccgtgaggctgtctggcacgctatcatccgtaagaaccacggtgccacccacttcattgttggccgtgaccacgccggtcctggtaagaactccaagggtcaggagttctacggcccctacgatgctcagcacgcggtcgagaagtaccgcgcggagctcggtatcgaggtcgttgaattccagcaagtcacctacctccccgacaccgatgagtacatgcccaaggacgaggttcctgcgggcaccaagaccctcgacatctccggaactgaactccgtaaccgtctccgtaccggtgctcacatccctgagtggttctcttaccccgaag

SEQ ID NO: 36312 - DNA, 954 bp, Aspergillus nidulans
gttccaggatactgattattatttgctctataggccattcacaccaacgtccctggcggcaagctcaaccgcggtctctctgtccccgacaccggcgtggccctcctgcagaaggaactgagcgaggagcaatacaaggaccttgctacacttgggtggctgaccgagctgctccaggccttcttcctcgtcagcgatgaccttatggatggttcaatcacccgtcgcggccagccctgctggtaccgccaccagggggtcggtctcattgccatcaacgacgctttcctccttgagtccggtatctacgttatcctgaagaagcaattccgttcacaccctgcctacgtcgactttattgagctgttccatgagaccacctggcagacggaattgggccagctgtgtgatctgatcacggcgcccgaggacaaggtcgatctcaacaacttctccatggagaagtacatgttcattgtcacctacaagaccgcctactatagcttctacctcccggttgccctggccctccactgccttcagcttgctacccccgaaaacctccgtcaggctcacgacatcctcattccgctcggccaatacttccaggtccaggatgactacctcgatgcgtacggcgacccctaggtcattggcaagatcggaacagatatccaggacaacaagtgctcttggttagtgaaccaggctctgcagcgctgcagtgccgagcagcgcaaggtgctcgacgctgcctatggtcgtaaggacgctgagcaagaggccaaggtcaaggctattttccgggaattggacctcgaatccgtctacaaggagtacgaggagaagatcgtgggtgagctgaagacgaagatcgcggctgtcaacgagtcggaggggttgaagaaggaggtttttgaggcattcctcgggaagatctacaagcgcagtaaa

SEQ ID NO: 36313 - DNA, 1368 bp, Aspergillus nidulans
caaaacctgcactcccagtcaaaagagaagatcaatgaatttgtcagagggcatttctatggacacaatgactttgattttgacgatactctttacgtatttacatccggtcggtacgaatttcgcaacaagggtgttgacatgtttatcgaagggctggcgcgtctcaatcatcgtctcaagtccagcggatcgaagaccacggttgtagcattcatcatcatgccagcgcagacctcgtcactcactgtcgagtcactaaaaggccaagcggttgtcaagtcgcttcgcgacacgattcatatgatcgagcaaggcattggaaagcgcatgtacgagcggtgtctagcctggaaggagggtgacaatatgccggatgagaaagaccttatcaccagccaagaccgcgtcctcctgcgacgtaggcttttcgccatgaaacgtcatactcttcctccaatcgttactcataacatgatcaatgactccgaggatccgatccttaaccagatccggcgtgtccagctcttcaatcaatcttctgatcgcgtcaaaatcgttttccatccagaattcctcaactcatctaacccagtgttgcctttggactacgatgactttgttcgtggtacacaccttggagtcttcccgtcttactatgagccctggggttacactcccgcggaatgtacagtcatgggagttcccagcattacaaccaatctctcgggcttcggatgctatatggaggagcttattgagaactcctcggactacggcatttatattgtggaccgccggatgaagggcgtagacgattcagtcaaccagctgaccgatttcatgtacaacttcaccctcaagagccgacggcaacgcatcaaccagcgtaaccgtacggaacgtctcagcgacctgctggactggaagcgcatgggcttggaatatgtcaaagctcggcagttggctcttcgacgaggtatttctcgcagcccgggttattctttgtttgcttactgactacgtgcagcatacccctcgtctttcgacaaccaggaagattactttgacgttattggcgggacagagcagaagatatcgcgaccattgtcggttcccggatcaccacgcgatcgctctggtatgatgacacccggtgatttcgcatcactgcaagaagtcaaggagggtctctcgaccgaagactatgttgcatggcgccttccgtaagtcctgcacatctacctaggaagctcgagctaattcagcatcagaacaagcgaggaagatgatgcggaagaccacttttaccctctcacccttcggacgaagaagtccgaccgaccgtcttcacctcttgaccggata

SEQ ID NO: 36314 - DNA, 1021 bp, Aspergillus nidulans
tttaccgttaatacgggtgcccagatccccgccattgggtgtaggacattccaagatgaagagcaacaagagggtgccgtacttgaagcgctgaaggctggtgtgaggctcattgcgagagtgtatgctcttctacatttccttcttattttctgctcctacatgccaaggtataatactaatccccatttcagctatgacacagagtctttcatcggcaccgcaattaagagatcctcgattccacgagatgagatcttcctcaccacaaaactctgatgcaactccttccacccagacgacgttgattctgcactatatgaaactctgagagacctgcaaaccgagtaggttgatctatatctgcttcaccacccatgcacgtttgcgcgtgggaaagaccgctttcccaagggtgaagatggactcatgcgtatgggagagacgacctacgtcgatacatggaaagcactgcaggagatcatgaagaggaccaggaaggccagggcaatcggagtctcaaacttcagtagggatgagactaagaatcttatcaatgctgaaatggtgagcttcttcttggtcccactcagccaggcatacgatggaggttagggctaatgtcgttcgatgggcgcagaccccagcagtccatcagatggaactccacccgttcctctctcaaaaattcttcgcagtctggcacaaaagtcttgaaatccacgcgcagcagttcagtcctataggtaatatgaactcgttctaccgcgatgtctactggagcaacaggcgcgccaacctcggccgcctcctcgacgagcccgtcctctccgaaataggcgcaatgtattccaagaaccctgcacacgtggtattagcctggagcgtgaatcatgggcgctctgtgatcccgaagagtacgattccttggcagatcaggcagaatgttgagagtgattttgtgcttgaggaggatatggagaggattgatgagctgaatgcggatttgaggttcaatacg

SEQ ID NO: 36315 - DNA, 846 bp, Aspergillus nidulans
agactgcgggaggtcacaaagcgggtgaaccgctcgccgctcggtaccggtgcgctcgcgggtaaccccttccacattgaccgagaggctatggctaaggagctgggctttgaggggctcctgtacaactcgatgaatgccgttggcgatcgagactttgcgatggagacgatgcagtggggaagctcgtttatgcttaagatctcgcgctgggcggaggatctgatcatctactccagtctggagtttgggttcgtccgcttgtcggatgcgtactcgactgggtcgtcgttgatgcctcagaagaagaacgctggtgcgttttccccatgttctgcgttatgattctctaatcattgtatagacagcctcgaactcctccgtggcaaagccggccgcgccttcggccacatggccggcctaatgtgcacgatcaagggtctccctacaacatacaacaaagatctgcaagagagtgtcgagcccctcctcgatcacatcaagaccgtcggcgatagcatccagattgcgactggcgtgctgtccacgctgaccactatcccagagaagatggccgccgccttggcacctgaaatgctcgccaccgagttcgccgactaccttgttcgcaagggcgtgcccttccgcgagggccaccacatttccggccgcgtcgtccagctcgctgagaagcacggcgttcccatggaccagcttagcctggagcagctcaagagcgtggatgacaggtttggcgatgatatccaggagtgcctggactacgagcgggcggttgagttgaaggatgctattggtgggtgcagtaagagggcagtgctggagcag

SEQ ID NO: 36316 - DNA, 1350 bp, Aspergillus nidulans
gaccctggtaccgatctcccctgggcaagttgccctacaaactctgctgaagacgtcgttttttccgtccagatcgcgcacgacgcctttgtgaagtttaagaaggtcaacccccgccaacgtgcccagtggctgttgaaatgggactcgctcatccgtgaggccagatccgacctggcgaagatcctcacccatgaaacaggcaagccaatcgccgaatcctatggcgagatcgactacgcgaccggtttcacctggtggtttgcgggtgaggcagaacgtatacaagggtcaatcgccgtgcctgccgcgcctaaccggcgcgtcttcactgtcaagcaaccgatcggtgtcgctgctgcccttgtgccgtggaatttccctattgctatggtgttacggaaggccggtgcagctctcgctgccggttgcacgatgattgtcaagcccagtcccgagactcccctcacagccttggtattagcgcacctagcggagaaggcaggcttccccgccggagtgttcaatgtgcttacgacggatctggaaaacacgccgccgctaagcgaagcgctgtgcaagcacccgctcgtgaagaaggttacgttcactggctcaactcgggttggcaagctgattgcctctcactgtgcacacgggttgaagaaggtcacattggaactgggcggaaattgtccattccttgtgtttgacgacgcggaccttgaccaagcgctggaccagctgatggctctcaaatggcgccacgctggtcaggcttgtattactgcaaaccggatttacgtgcaggctggaatctacgacaaattcgcgcagctgctcaaggagcgcacggccaaattggtgatcggccatggtgctaaagaaggcacgactctgggaccgctcacgaccccgcgcagtatcgacaaggccattagccaagtcgaagacgcgcgacggctgggcgcagacgtgattcttggcgggagccgtgtccaaggaacacagggttacttcttcgagccgacaatcttaaaaaacatgaccaaggacatgttggtgtcgcgcgaggagtcctttgctccgatcgctgctctctatcgctttgagactgaggaagaagccgtcaagctggcgaacgacaccagcatgggcctggctagttatgcgttctcgaagaacattgaccgtatgtggcgactgctggagaacttggaagcgggcatgatcggcatgaacacaggaaactcgtctgcggctgagtcgccgtttggaggaatcaaggaatcgggttatggaaaggagagcggaaaggaagttgccgtgaatgagtacctgattaccaag

SEQ ID NO: 36317 - DNA, 2993 bp, Aspergillus nidulans
gagctgcgctttgacaaccagaccgtcgtcgtgacgggagctggcggtggtttgggtaaggcatatgctctattcttcgcctcaagaggtgcaaatgtcgtggtcaacgacctgggcggctcccaccagggtgaaggcaagtcaagcaaggtgagcccatcacatgcaattattacttttcagtatgtccccagtgctgacccgcgttctgtggtaggctgccgatgtggttgtcgacgaaatcagagctgctggcggcaaggctgtagcaaactacgacagcgtcgagaacggcgatgcgattatcgacacagccattaagaacttcggccgagtggatgtcctcatcaacaacgccggtatcctgcgggatgtcagcttcaagaacatgaaggatcaagactgggatctcatcaacaaagtccacacatacggtgcatacaaggtaggaaccggttcttcggcgttcgacggatgagaggctgatttcacagtgcgcgagagccgcgtggccgcatttccggaaacaaaagtatggccgtatcatcaacaccgcctctgctgctggtctgttcggtaacttcggacaggctaactatgctggtatgtctcacaccgacgcaaatgcgaataagctaacaaatcagctgccaaactcggccaggtcggtttcaccgagacccttgcaaaggagggcgccaagtacaacattattgccaacgtcattgcccctattggtatgttagcgtgttgacactcacgggcactgctaaccccaacagccgcgagtcgtatgacagccaccgtcatgccccctgaggttcttgaactcctcaagcccgaatgggttgttcccgtcgtcgccgttctggtccactcatccaacaccaccgagtctggttcaatcttcgagattggaggcggtcatgtggccaagctccgctgggagcgttccaagggtgctctgctgaagaccgatgcttcactgacgccttgcgccatcgccagaaaatggaacgaggtcaatgacttctccaagcccgactaccccactggacctgccgactttatgggactgttggaggacggtctgaagttgcctcctgccccgtccggccccgagccagagttcaagggcaaggttgctctagtcactggaggtggtaacgggtatgttatttgaagcctagggtatgctcaagctaactttattagtcttggccgtgcctactgccttctgttcggcagactcggtgcgaaggttgtggttaacgacctggttgaccctgagcctgttgtccaggaaatcaagaaagccggcggagaagctgtaggaaacaaggcttcatgcgaagatggtgccgctgttgtcaagaccgccattgacacctacggacgtattgacatcctggtcaacaacgccggtattctgcgtgacaaggcattcaccaacatgaacgatgacctgtggaaccctgtggtcaacatccaccttcgcggaacctacaaggtcacccaggccgcctggcctcacatgcttaagcagaagtatggtcgcattgttaacactgccagcaccagcggtatctacggcaacttcggacaggccaactatgcggcagcggtatgttccctgaagtcatctatcttacattagctaatctatgtcgtagaaacttggtattctcggattctcccgtgctctggcgattgagggcgccaagtacaacatcaaggtgaacaccatcgccccgaacgctggtaccaatatgactcggacgatcatgcccgaggagatggtccaggcattcaagcccgactacgttgctcctctggtggttctgctctgctccgatatgaccccagagccgtactctaccaagggtctgttcgagtgtggtagcgggtggttcggtagcacccgctggcagcgcagcggcggccacggtttccctgttgatgtcaagttgacccccgaggctgttgcaaaggagctcgcgaagatcgtcaactttgacgatggccgtgcagaccaccctgaggacatccaggccgctaacgagaaggtcatgtccaacttcagcaaccgcagcggcggtgagagtggtggcagtggcaacgagatcctgagcgcgatcgaagcggccaagaaggcttctactgacggaacctccttcgactacactgaccgcgatgtcatcctttacaacctcagcttgggcgccaagcgcactgatctccctctcgtctacgagaacaacgagcacttccaggccctccccacatttgctgtcattccctggttcaacaccgccaccccctgggacatgaatgacattgtcaagaacttttctcccatgatgctcctccacggagagcagtacatggagattcgcaagttccccattcccactgaggccaagaccaagacctaccccaagctcattgatgtcatcgacaaaggcgccgctgcgctcgtcgtcgctggctacaccaccaaggacgtcgccaccggcgaagacctcttctacaacgaatccaccgttttcatccgcggtagcggtggctttggcggctctcccaagcccactgctcctcgccccaaggccgctgtcgccgcctacaaacctcccaagcgcaaggctgacgtcgtcgtcgaggagaagacatctgaagaccaggccgcgctgtaccgcctgaacggcgaccgcaacccgctccacatcgaccccgagttcagcaaggtcggcggcttcaagatccccattctgcacggcctctgctcgctcggtgtctcgggcaagcacgttttccagaaatttggccccatcaagaacttgaaggttcgctttgctggtgttgttctgcccggccagactctcaggacggagatgtggaaggagggcaacactgtcctcttccagactaccgttgttgagacgggcaagcctgctatctcaggtgctggtgcggagctgctggagggtgccaag

SEQ ID NO: 36318 - DNA, 845 bp, Aspergillus nidulans
aagttcgaaggatggcttggccttgatgccggttccgttgatggcaagatgcagtggaaggagtttgagccaaagccctgggaggagaccgacgtcgacatcaagatctcccactgcggtatttgcggttcagacctgcacactctgcgcagcggatgggtatgttctctccactcctgccctctttttgcctttcagagatctcgagactaacaatcgtgatcatatagggccccacaaactacccctgctgcgtgggccatgaaatcgtcggtacagctgtccgcgtcggctctcaagtgaagcacatcaaagttggcgaccgcgtcggtgttggcgcgcagacgtagtcctgcgtcggccgcaaaggcgagtgcaacgaatgcgcaacctccaacgagccctactgcaccaaacacttcgccgggacatacaacggtgttttcatgaacggaggcaagtcctacggtggctacgccctatacaaccgctctcccgcgcacttcgccatcaagatccctgacgctattccctccgcccacgcggcgcccatgatgtgtggtggtgtcaccgtctactccccgcttaagcactacggctgcggacctggaaagacggttggtattattggaatcggtggacttggccactttggtgtccttttcgctaaagccctcggtgcggaccgcgtcgttgcgatctcgcgcaaatcggataagcgcgccgatgcgctgaagctgggcgcagacgagtacgtcgcgaccgccgaggatacagagtggatggcgaacaacaagcgctcgctcgacctgattgtttgcactgtctcatcatccgagatgccc

SEQ ID NO: 36319 - DNA, 1602 bp, Aspergillus nidulans
attcgcatcttcgaccgtggggattggtactcagcccacggcaaagaagccgaattcatcgctcgcacagtctacaaaacaacctctgtccttcgtaatctcggccgcagcgaaacgggcggcttgccgtccgtcacaatgagcattactgtcttccgtaattttttacgtgaggctctattccggctaaataagaggattgagatctggggctccgccggcacgggcaaagggcactggaagaaggttaagcaggcgagtcccggaaatctgcaggatgtggaggaggaattaggggcaatgggtatggagggaagtaacggagcgcccattatcatggcagtgaagcttagtgcaaaggccggggaggcgcgaaatgtaggtgtttgttttgcagatgcaagtgtgcgcgagcttggtgtgagtgagttcctggacaatgatgtttactcaaactttgaggcgcttgttatccagctcggtgtgaaagagtgtctcgttgtgcaggatgtcaatcggaaggatgtggaggtggccaagatccgagcaatatgtgataactgcgggatagcgatatcggagcgcccggcatctgattttggggttaaggatattgaacaggaccttacaaggttgctgagggatgagcggtcggctgggacactgccggagacggagctgaagcttgcgatgggcggtgcggcggcgctaattcggtatttgggcgtgatgtcggatgcgacaaatttcgggcagtatcaactctaccagcatgatttggcgcagtacatgaagctcgatgcggcggcattgagagctttgaatcttatgcctgggccgagggatggatcaaaatcgatgagtttatttgggctgttgaatcattgtaaaacgcctgttgggagccggttgctggcacagtggctgaaacagccgttaatggatctggcggagattgaaaagcggcaaaggcttgttgaggcgtttgtcgtgagcacggagcttcggcagatgatgcaggaggagcatctacgatctattccggatctgtatcggcttgcgaaacgattccagcgaaaacaggcgaatctggaagatgtagtgcgtgtgtatcaggttgctattcggctgcctgggtttgtgaactctctggagaatgttatggatgaggagtaccagacgccgcttgagacagagtacacggccaagctacgcaaccattcggcgagcctggcgaaactggaggagatggtcgagacgacggttgatctggatgccctcgagaatcacgagttcatcatcaagcccgaattcgatgatagtctgcgcatcattcgcaaaaagctggatcagttgcgccatgatatgtaccttgagcataaggctgtcgcgagagacctagatcaggaaatggacaagaagctgttcctggagaaccaccgcgtgtacggatggtgtttccgtctgacgcggaatgaggcgggttgcattcgcaacaagaaggcctaccaggagtgctcaacgcagaagaacggtgtgtactttaccacatcgacgatgcaatctctccgccgcagatcatgatcagctctcctccaacta

SEQ ID NO: 36320 - DNA, 1485 bp, Aspergillus nidulans
atgagcaataccgacttccttggccgagcaatcgacacggtcaagaaggccatcgagagcgacaatgaaggcgagtacgagaaggcttatcagcaatattactctgcattagagttattcatgcttgcgctgaaatgggagaagaatcccaagtccaaggagatgattcgcgctaagacgggcgagtacatggatcgcgcagagaagctgaagaatcatctagcctcgcaagatagtcggaaaaagccgagcgcggtgggcgccaatgggaaagtgtcgcaggggagtggtaaaggcgggtatgttctacttatcaatacttccaggggggtatgctcggtagcgctgatgctcttatttctttgctggcagaaaagaggatgatgacaatgaggacgctgattcgaagaaactgcgatccgcccttgctggcgctatcttgtcagagaagccgaacgtcaaatgggaggacgttgcaggtctcgagggtgcgaaggaggcgctgaaggaggctgtcatccttcctataaaatttccacatttgtttacagggcgacggcaaccgtggaagggcatcttgctttatgggccaccgggtactggaaagtcgtaccttgctaaggctgtcgcgacggaggcaaacagcacattcttcagtgtcagcagcagtgatttagtttcgaaatggatgggtgagagtgagaggtatgccgccgaatcgtcgacgacagttctgccgctaactgaaacctcataggctcgtgaaacagctcttcaatatggcccgggagaacaagcctgccatcatcttcattgacgaagttgatgcactttgcggcgctcgtggagagaacgattccgaggcctctcgccgcatcaaaactgaactgcttgtccaaatggacggagtaggcaacgactccaagggcgtccttatcttaggcgctacaaatattccttggcagctagatgcggccatccgccgaagattccaacgacgagtgcacatcagtcttccagatattaacgcacgcatgaagatgttcatgctagctgttggctcaactccctgccatatgacacaggccgactaccggtcactggcagagcagagcgaaggctactccggcagcgatatcagcatcgccgtccaagatgcacttatgcaacccattcgtaaaattcaaacagcaacacactacaaaaaggtaaccgctcttggctccaaccctatcagctcagaactaattcaggtcccaggtactgcatgaaggtcaagaaaagctaacaccatgctcccctggtgacaatggcgccatggagatgaggtgggagaacatcgaggccgaccaattactagagccttctctcgtgctcaaggatttcatcaaggccatccgcaattcacgaccgacagttagccaagaagacttgaagaggaacgcggaatggacacaagagttcggaagtgagggtgcttagccc

SEQ ID NO: 36321 - DNA, 1981 bp, Aspergillus nidulans
acagacagtcggccgaaagccgtcgacagggacagcacagctaccagctgcaactcgaccctggatgaaaatcagatcgaaaacgaccgcgaggtgaccaacttggcgcgggtactgagtgagcggtcgaagcattcgcatcatcagctcccgttcaactttggaaaagacccgtccctcgacccccagaatgcccagttcaatgcgagagcctgggccaaggccttctacaatgtccggtacagttcgacagacgcgcctccaccacgagttgctggtgtcgcgttcaagaatctcaatgttgctggctacggaagtccagtcgattaccagatgagtgtagggaatgcgcttctcaagttgccgacgcttgcctggcaatggctagggggcaaaaagcaacggactgagatcctccaggacgtggacgggctgctgcttcccggcgaacaactctgcgtgcttaggctccggggtcaggctgttcgactctgttgaagaccatcgcacaggaaactcacggctttgaagtggatccctcttcgtacgtcaattaccagggcattactccgaaacagatgtccaaaaagttccgtggcgaagcgatttataccgccgaggtggacgcacattttcctcagcttgttgtcggggacaccctatactttgcagcgctcgctcggacgcctcgccacgtccctggaggcatgagccgagaggagtacgccgttcacttacgcgatgtcatcatgtcgacctttggcatcagccacacgatcaacaccaaggttggtaacgacttcgttcggggggttagcggaggggagaggaagcgagttactattgcagaggcggcattgagctacgctcctctgcagtgttgggacaatagcactcgggggttggatagtgccaatgctgtcgagttttgcaagaccctacggacacaaggagacgttttcgggatcacctcctgtgttgcaatctatcaggctcctcaagccgcctatgaggtatgttggaagtctttttcttgccaactgtactgaccctttcctagctcttcgacaaggtcaccgttctctacgagggaaggcagatttacttcggtcctgcaaaggaagctaaagactacttcatccgtctcggcttcgtttgccctgaagctcaaactacgcctgactttttgaccttcatgtcgagcccagtcgagcgcgtcatccggcctggattcgagaacttagtgcccaggacagccgatgactttgcgcagaggtggaaagagagtcctgaacgccaggcacttctacgtgacattgaccggtataacaccgagcacccctttaacgccacagaccttgatctcttttcgtcttcgcgggatgcagagaagtccaagaaccagcgaccgaaatctccatataccttgtcatactggggccagattcgaatctgcttgtggagggatttccaacggctgaaaaacgaccccagtgtgacactggccatgctgattctaaacttcttcgaggccttgatcatttccagtgtgttttacaatcttcctggaaatacctcctccttcttctcccgtggcgcattgctgttcatgatggtcctcttgagtgccttttccagcgttctcgaaatcatcacgttgtacgagaaacgaacaattgtcgagaaacacagcagatacgccctttaccaccctagcgctgaggctatttcttcgatgattatggatatgccatacaagattgtcaactccctgctcaacagccttgtcctgtacttcatgggaaacctccgacgtgaagcgggagcgttctttttcctctacctgatctccttcgccatgatgatgggcatgtctatgttcttccgttttttcgcctctctgacgaaatcgattgaacaagccctcgccccctcttcaatcatcttgcttgctctggttctatacacaggctttgcatcc

SEQ ID NO: 36322 - DNA, 2292 bp, Aspergillus nidulans
  unsure (1)..(2292): unsure at all n locations
gctggttatctcgtcaccttaggccaggaactcgcgaatgaaaactccgcttcccacattagaaccgccgccggtcttgctctgaagaacgcttttacttttagagatcgagagaggcttaacgaggttcaacaaaaatggcgccagcaaattaccccagatattaaggcgcaggtcaaggaacttgcgcttaagacgctcgcctccaaggatgggcgcgccggtcagtctgcggctcagtttattgtttctattgccgctatcgagctgccccagaatgaatggccggatttgatgcagatcctcgttcagaatgtagcgagcggatccgaccagatgaaacaggcttccctcgtcaccattggttttatttgtgaatctcaggaaatggagctccgcgagagcttggctgcgcactccaatgctatccttactgctgtcgttcagggcgcccgccgcgaggagcagaacatggacattcgattcgccgccataaaggccctcagtgactctgtggactttgtgcggtcgaacatggaaaatgagggtgagcggaattatatcatgcaggtcgtctgtgaggctacacaggcggaggaccttcgtgttcaggctggcgctttcggttgtctgaaccgtatcatgggtgcttactacgataagatgagtttctacatggagaaagctctgtttggtctgagcattatgggaatgaagagcgaagaggaagatgtagccaagcttgctattgaattctggtgtaccgtttgcgaggaagagatagctatcgaagatgataacgccgcggtatgtctgacccaacattgtcttgatgatcaattgctgattatgttttcacggcccaagctgagggtttgactgatgtccgcccaatgtacggtttcgcgcgcatcgcttgccgtgaagttgtcccggttctgttgcaggctatgtgcaaacaggacgaagatgcaggtgatgacgagtacaacatctctcgcgctgcttaccaggctctgcagctgtacgcccagtgcgtacaggccgacgtcatccagcccgtgcttgcttttgtcgaggagaacatccgaagcgaagactggcgccgcagggacgctgccgtggctgcgtttggtgccataatggacggtccggaccccaaggtcctcgagcccctggtcaagcaggccttgcacgtactggttagcatgatggaagacagctccatccaggtccgcgactccgctgcttacgcgctcggccgtgtctgcgacttctgctctgagacccttgaccctgacgtgcacctccaaccccttatctcttgccttttcaacggccttgcaagctccccgaagattgccagctcatgctgctgggcgttgatgaacgtggccgaccgttttgctggtgatgtcggcgcgcagaccaacccaatttcaaaatacttcgaggagagcgtcaagtcgctccttgccctcacagaaaggtacgtgcctcggattttcatttcttaagttaaacctaactcccgtctagatcagacgcagataatcagcttcggaccgctggctatgaagtcctcaactctttcgttaccaatgctgccaacgacagccttcccactgttgctcacctatccgacgtcgtcctccagcgtctggagcgtactattcctatgcagcaacaggtcgtcagcgtcgaggaccgcatcatgctcgaggaaatgcagaccggaatcacaagcgttgtcctggtaagtacacggaagtttccttcactaattgtttactgacttgactaggctattgttcaacgcctcgaggctgaaatcaagccgcaggccgaccgtattatgcaaatcctgctccaagtcctttctactgttcctccgaagtccagcgtgcctgacgttgtgttcgccactgttggtgccattgctaatgccttggaggaggagtttgttaagtacatggagtcttttagcccgttcctcaacggtgcccttggcaaccaggaagagcccggcctttgcgccatggccatcgggctggtcagtgatatctctcgtgcgttgaatgagaaggttttgccttactgcgacactttcatgaaccacctgatgaacaacttgagcgtaagaaacctttcttatattcaatgtacgaatcctaacatgatttccagagcgccaccaaccagctcaagccagccattctngaaacttttggggacattgaacaagcaattggagagcactttgataagtacttgaccgttgtcggtcagagt

SEQ ID NO: 36323 - DNA, 1214 bp, Aspergillus nidulans
agcccccgaaccgaaagcgcgctcagttcttcgcttccagagtcttccttacacagatacggaaatatggacccagcgctcaacgttccacagggctcactgaataattccgcgggcgaatcttcaccaactcctcgatcatctttcagagtcggcgttacagaggaccggaacaaaaaatgtcgccggactatggaagatacccatgcctatctttataatttccttggtaaccctgtaccgtcagcgcaaaatgatgattctgatcagagctcgcatcctagcgacgcttcgccaaagaccggagaattgacgcccattgttgaaacagataatggctacttcgcaattttcgatggccatgcaggaacttttgctgcccaatggtgtggaaagaagttgcatcttatcttggaagacgtaatgcgcaagaacataaatgcgcctgttcccgagcttctcgaccaaacatttacttccgtggaccagcagctggaaaagctgccggttaagaatagcggttgcactgcggttgtcgcattactcagatgggaagatagaattcccaccccaagttccgtgaccggttcgtccgccatcgggccggcagccgtggcagcgaccaaggccggagcggattcaaaggcagatgacacccctacccaggaagccgccgctaccccggttcctgctattccccccaagttacgcgaaaaggcgattcgccagcgtgtcctatatacagccaatgttggcgatgcccgtgtgatactgtgtaggaacggcaaagcccttcgcctgtcttacgatcacaagggtagtgatgagaacgaagggagaaggattgctaacgcgggaggcttgattctcaataatcgagttaacggagttctcgctgtaactagagcccttggcgatgcctatatcaaagatcttgttactgggcatccttacacaacagagactgtcatccagccagaccttgacgagttcatcattttggcctgtgacggggtaagtcaacatgcgtttctagcacggatttcgattgagctaatagttctttgcagctctgggatgtatgtagtgatcaagaggctgtcgatttgattcgcaatgtgtctgatgcccaggaggcatcgaagattctggttgatcatgcccttgcgcggttcagcactgacaacctttcctgtatggtgattcgtctctat

SEQ ID NO: 36324 - DNA, 666 bp, Aspergillus nidulans
gcaaaggttcccaggaacttcaggcttctagaggagcttgaaaagggcgagaagggcttgggagcaggtaagcaagaggcacaggatcatctgatgtaagagccaagctgatgtagtactgcgtttctaaacagaggcgtgctcttatggtctcgcggatggcgaggacatgatgatgagcaactggaacggaaccgtccttggcccccctcacgtatgccgcataccaatttatgtcccatgcttggaggtctagtgtactaaactggcaccacacgactatagagcgtccacgaaaacaggatatacagtcttaacattcattgcggtcccgagtatcccgatcaacctccgactctacaattcatctcgcgcgtcaacctcccttgtgtcgatgcacactctggcaaggtccgaaatccccaaagccgaagcaatagcactcgacgaagctaacggctcctaggttgacccctccaagctgccctgtcttgcccagtggaagcgcgattatactatggagacagttttgattgaacttcgaaggtaagctcccggtagtcctagaccttggcggcggtatcttaaacatccaggtacatggctttaccgcaacataaaaagcttcctcagcctcctgagggttcgactttttaagtttctgca

SEQ ID NO: 36325 - DNA, 626 bp, Aspergillus nidulans
ggcgcagtcgcagttgtaacagttgatttcctcgtctaccccttcgacacgctcaagactcgcgtccagtcgccacactacgcagaaatctacaaagatgcagccacgaacacgatcaagaagggtgtgctcttccgcgggctataccagggtgttgtcagcgttgtgctgagtacaattccagcttgtactgggcccccatccccaagattcaaacgagtagggatattaacagttggtgacacctcgcagcaggagcattctttacaacttacgaaaccgtaaggtctaccctcaaccgaactaagcaagcttctgccataccatttcttcaatcagtccccgcacccgcgataaacgccatctcctcatccactggtgaaatggtctcctgtctcctccttacacctgccgaagtcatcaagcaaaatgcgcaggttatcaacaactcaccaagcgccaacatctctgaaaagctaaaacaaggtggaaccagcgtaaccctccaagttctcagacgcttcaagcagcaaccttggaaattgtggagtgggtactcggcgcttgtaggacggaatttaccgttcacagggatcaatttccgatctttgaggcgatcaaggggt

SEQ ID NO: 36326 - DNA, 1262 bp, Aspergillus nidulans
atcccgtatccgccatcgactgcgcgggatgtagcgattgaggtgcaaaaagtcaaggagaatcgtgataggtttcggattgaatctaggacaggaggcgttggtcctgccgttagtgtgtgcatgttcactttccacaacacttatgacgggttagtcaatttagatccgtctctgagggtcgatcgctaattaggttaggatcaactgccttgatttctcggatgataatctgctcgttgcagctggtatgcaagagtcatacatccgcgtttggagcctagatggaaagaaaatcccttcagacgacagtgcagatgaacccccaactaattcgcgccgcttaatcggccattcggggcctgtatatgcagtggcatttgccccatcagccacccccagtgagaacgccgtggcaccaacaaacgcccgatggctcctttcatcttccgccgaccgaaccattcgcctttggtcccttgatctctggcagtgcatggttgtctacaagggccatgatcagccggtctgggatcttcaatggggccccttcggccactacttcgtctccggcggccatgacaaaactgcccggctttgggtaactgatcacatccgtcaacagcgcatctttgtcggccacgagcaagacgtcgactgcgtctgcttccaccccaactccgcttatgtcttcacgggaagcttagaccgcactgtaccgcatgtgggccgttactaccggcaacgcagtgcgcatgttcaccggtcacactggaaacatcacagccctggcgtgcagccgcgacgggaaaaccctcgcctccgcggacgaccacgggtctatcttgctctgggatctgggacccggccgcctcctcaagcgtatgcgcggccacggaaaggggggcatttggtcgcttagttggagtgtagaatctaatgtgcttgtctccggcggcgcagacggcacagttcgagtatgggatgttatgggtcctgcccatgacccgtcgcagggccgcgttgccggagaaggcggcgcaggcacgaagattgacggggcttcctccgctgccgcgaattctacgcagacacctggcaccgttgggccagggatgggcagcggcaagaagaagggcaaggacgttgttgtcacaccggaccagattagtgcgttccccactaagaagagccccgtctacaaggtgaaattcaccaacatgaatttgattattgctggcggcgcttatcttccttgactg

SEQ ID NO: 36327 - DNA, 340 bp, Aspergillus nidulans
tacacgcttgaacaggtcaaggcccactgcacaccggatgatatctggataatcctgcacaacaagggtacatattgctcccatagtcgaggatttattctctaaccatgtacagtctacgaggtgaccaagtatctcgaagaccaccctggtggaagcgccgtccttattgaagttgccggggctgatgccacggaagcttttgaggagatcggccactctgatgaggcgcgcgacagctcgagccgtattatattggtgatttgccagatcaggtaatgccggctcttgatcgttgactgctccaccaagccctgacggtgtacaggaacaagccgag

SEQ ID NO: 36328 - DNA, 1326 bp, Aspergillus nidulans
  unsure (1)..(1326): unsure at all n locations
cttaatctgcctgatcccttcgccacaattccacgggtaagcctgctctacccgttctcttcgccaatccaccccctgcaaagcctgtctggtttagcttctgccccggccccagcctcagcctcagcctcagcatcaacaacacactcagcaccaggcagcactcggtctcaaggggcacgcacagagggcatccacgtctccctctacgccaagcgcgaggaccattcttccccgctcgcatgtgcggggaacaagtaccgaaaattggagtacatcgtgccagatatcctatcttccagtccaagatatggcgctggcattgcggctgatgtacccacaccaatacacgggaaaggaaaagttacaactctcgtcacagagggcgcaatccagagtaaccacacggtccaggtggcctccgtggcttcgaggataggcctagaatctgtggtcctcctgcacaagggcacggggggcggcttagccagtgcgaaggacaaagcagcttttttgagaacgggaaatgtccagattgtgaagttgcttggtgcagaagtgaggatgtttgagaagcctgtggccccaaagacacaagatgatattgtcgaggaggttctgaataatctcagagcagagggaaaggttccctattggatcccgtctggtgcgagcctgcatccgctgngggggttgggatatgcaaggtgtgcgtttgaaattgcggcgcaggagaaggacattctgggatcaccgaatgatcgtggtagtggtggttacggtatcaaacagccgcgtttcgattacatcttcgtcgcatgtgggagtgggagtacagtcggcggactgattgcgggcttcaaactactcgagaagatggagaactcacaaccgcacgagcaaacacgaggagaaagaaagcgccgtgttatagggattcttacctccccgacgatgcgaaagagatatcatgaagaacgcatcttgcgctttgcgcgaggcgcggggaaattgatcggattgaatccccagactgatattacaatggacgatgtagtcctggatgaccggttcgcgggagagagatatggtgtgctagatgcaaagaccaatgacatgctctctctgatggcagaaaaggaagaagtcatacttgatcctgtgtatacggcgaaagtggcgaggggtatgatgcattgggttgccgaaggggagatagagaaagatttactagctagtcccgctacttataggggtcaagatggggaacaggttaatgtcttgtttatccacacaggcggacagtctgcgctgggagcatacgcg

SEQ ID NO: 36329 - DNA, 1401 bp, Aspergillus nidulans
gcacttctcccgtttattctattcttcctaagcttccccgctcccgcatccgccgtgggttcagcggtcctcggaatcgacgtcggcacggaatacttgaaggcggcgcttgtcaagccagggattccgctggaaattgtgctcactaaggactcaaagcgcaaagaatcagctgctgttgcattcaagcctaccaggcaaagtgatgcgtcgtttccggaacggttctatggaggtgatgctcttgcattatctgcgcggtacccagacgatgtctacgtgaaccttaagatactgctcggagtccccttcaacgatggaaagaacgagctcatagagacataccgggcacgcttccctgctttgagattggaggatgctccttttgagaggggcaccattggcctccgaagcaacagactgggcgaggcggaacggaaagatgctttcttggtcgaagagcttttggcaatgcaactcaagcagattaaggctaatgctgacaatttggctggcaagggatcggatgttagagatgccgttatcacatatccggcgttctatactgcggatgaaaaaagaagtctgcaattagccgctgaactggccggattgaaagtcgacgcgcttatcagcgatggccttgctgttggactcaactatgcgatgagccgaacctttcccagcgtttctgatggggagaaacctgagtaccacgttgtatttgatatgggcgctggctccactactgccactgtcctccgcttccaaagccgcaaagtcaaggacattggaaagttcaacaaaaccatccaggaggtccaggtcctgggagcagggtcggacaggactcttggcggcgactctctgaacgacctaatcgttggtgatatgctttctcaactccttgatgacaaaaaactcaagggccgtgttagtctcgcagatttgcgctctcacgggaagactatggcaagattgtggaaagatgcggaaaaagtccgccaggtcctcagcgccaacaccgaaactggcgcttcttttgaaggtctcttcgacgaagatgttaatttcaagtaccgcgtgacccgttctaagttcgagtcactggcagagcagcatatcgctcgtgttgggaagccacttgaggaggccttggcagctgctgggttacaattgaacgacattgattcagtcattctacatggtggttcaattcgtaccccatttgttcagaaggaactagaaagattttgcggagggtcggagaaaatacgaacaaacgtcaacgccgatgaggctgccgtttttggcgctactttcaaaggagctggtctcagcccaagcttccgtgttaaagaaattcgcgctatcgaatcgtccggctaccctgtcgtcctc

SEQ ID NO: 36330 - DNA, 1404 bp, Aspergillus nidulans
gtccgctttagtgatgttcatggctgtgtttaagcaaaggatgagctccaggaactagttgagtttttgctgaacccggaacgattttcttcactcggtggcaaactccccaagggagttttgcttgttgggcctcctggaactggaaagactctgctagcccgtgccgttgcaggcgaagccggtgtccctttcttctacatgtcaggctctgagttcgatgaagtgtatgtaggagttggcgccaagcgggtccgtgaacttttcaaccaagcccgaagcaaatctcccgcgatcattttcattgacgaacttgatgccattggtgcaaagagaaatgaacgagatgctgcctacgtgaaacagaccctgaatcagctcctaaccgaactcgacggattctctcagtctaccggtgttatcatccttgccgcaaccaattatcctgaactgcttgacaaggccttgacccgtcctggtcgatttgatagaaaggtcgttgttgacctaccagacgttcggggacgcatggacatcctgaagcatcatatgaagaatgtgcaaatcagcactgatgttgatgtagcagtgatcgctcgtggtacgagcggcttctctggtgctgacttggaaaatctagtcaaccaggccgccattttcgccagcaggaataagcaatctaaggtcactccgaaagattttgactatgccaaggacaaaatcatcatgggtgcagaggctcgcagcaggattatccaggataaagacaagcttttgaccgcctaccacgaggcggggcatgctctggttgcctacttctcgccgtcctctatgcctttgtacaaaatcaccatcatgcctcgaggaatgtctctaggttcaacgcatttcttgccggaaatggacatggtatctaaaaactatgtccagtatctaagcgacatcgacgtctccatgggcggtaaggtggctgaggagctgatctatggggaagacaaggttactagtggtatctcagcggtatgttcacaacgcttgaatctttaagctcagggcagtcgctaatggatgtaggacctcgcgagtgcgacgcggacggccttcacgctcgtcacgcgttttggctactccaagaaacttggaaacgtcgacctgtacgccaactacgatagcctatcttccgaaacaaagcaggaaatcgaagctgaagttcggcggttggtcgaggaagctcgccagcgtgccaccaacattttgaccgaaaggagacatgaactagagttgctgacaaaggcgctgattaagtatgaaacattgaccaaggaggaaatggagaaggttctgaggggcgaaagtctcgacagacttgtcgtgccggccgatgcgcctatgaaactacctgag

SEQ ID NO: 36331 - DNA, 552 bp, Aspergillus nidulans
gttggtctgtcggcaaggcttgcccaaatcctgggtggctgcatcaacatgatgttcatgttcggctcgatcgtgccttccttttttctcgaccgcatgggtcggcgaaatacaatgatagcaggttgcgcaggacttagcctgtgcatgatgatgatctcagctctgttgtcacaagctaaaacatctaacggacactcttactcatccgctgctgtgactttcttctttctctatatgctagttttcggcatgagcgtgaactgtgtgccctgggtctatgttccagaaatattgcctctggccgcccgcactcgcggtactgcgatcggtatcagttcgaactggttatggaatttcacggtcgtcatgattacaccagtcattatcaaccgcctacactggaaggcatatttgatcttcatggtcacaaatgcgctgttcgttcccgccttttatttcttctatcccgaaacaagcaacttgcgactcgaagatgttgattacatcttttctcgcagtggggatccggtgaaaaatgcgcagcagatt

SEQ ID NO: 36332 - DNA, 862 bp, Aspergillus nidulans
atttagctccgctcatttggccctaagggtagctgggcaattgttacaggtgcctcggatggtttgggcaaagaattcgccctccagatcgctcgcgctggctacaacatcgtcctcgtttcacgaactgcttccaagctaaccgccttgaccgatgagattacgtctaaatacccctcggtccagaccaagatgctggcgatggattttgctcgcaacttggacgaggactacgaaaagctaaaggccctcattcaagacctagacgtagctatcttgatcaacaatgttggaaagagtcacagcatcccggttcctttcgccctgaccccggaggacgagttggcggacatcatcaccatcaactgcatgggtactttgcgggttacgcaactggttgttccaggcatgacccaacgcaagcgaggattgattctgaccatgggttcttttggtggtctcgttccatctcctctccttgctacctactccggaagcaaggctttccttcagcagtggtccacagctcttggttcagaactccagccgtacggcattactgttgagctggtgcaggcctatctcattacctccgccatgtccaagattcgcaagaccagtgccttaaatcctaacccgcgtgcgtttgtcaaggcgacattgtccaagattggcaacatggcggttccccaggctacgcatacagaatcctccatactggagtcacggattggtcgcataccttgcgacatgcgtgatcaacccgatgagcaaatggctcgcaaaccaaaacaaggctatgcacgagtcgatccgcaagcgggctctgcgcaaggcagaacgtgagaacgcgaagaagagt

SEQ ID NO: 36333 - DNA, 1168 bp, Aspergillus nidulans
cagatggcccggactcagaagaacaggaacacttagtatcacttggggaggattctagcggacttctttacgagacgccatcactgatggaacgactacaggacagttgaaggccaagctcgccaaactgaagcgtgaacttttgacaccgtcgggaggaggtggtggcggcagcggcggtaagaacaaacctctctgatacccaacctagttgcgctaacgttgtatgaagccggcttcgatgttgctcgtaccggtgtagctagtgtgtatgtttcttccgtcgttcgacgtcgctctgaaattgtcattaactatggaatagtggtttcatcggtttcccgtccgtcggaaagagtacattgatgagcaggttaacgggccaacattccgaaggtatgcttaacgaagacaggagccgtgtgacggacactgacgcatttttgcaacagcggcggcgtacgagtttacgacgttgaccaccgttccgggacaagtactatacaacggcgcgaagattcaaattcttgatcttcccggtatcattcaaggtgccaaagatggtaaaggtcgtgggcggcaggttattcgtgtcgccaagacatgccatctcattttcattgttctcgacgttaataagcctctggtcgacaagaaggtgattgaaaatgaattggagggattcggaatcagaatcaacaagcagccccccaacattatgttcaagaagaaggacaagggtggtatatcgattacgagcactgtgcctctcactcatattgataacgatgtaagtcgttaagagaccggtttcaattgttgtgacggttattaacacttccgttttcgaacttaacaggaaatcaaagccgtcatgagcgaatacaagatttcctctgcggatatctcgattcggtgcgacgcgacaattgatgacctcatcgacgtgctggaggccaaaagtcgcgcatatattcccgttgtctacgctcttaacaaaatcgatgccgtcactatcgaggaactcgacctgctgtacagtattcccaacgccgtccctatcagttcagagcacggctggaatatcgacgagctattggacatgatgtgggagaagctcaacctccgacgaatctacacgaaaccgaagggcaaggcccctaactat

SEQ ID NO: 36334 - DNA, 2139 bp, Aspergillus nidulans
aaggttcgatcactaatccggtcgcagggcttcaaatcgtacgctgtgcgtacagtgatttcaggatggtatgtggcggactttcgttgtcatctacagatcgcagaatttgcgaccgtgtataagtggatgttaacttcgattcctagggatgaatcgttcaactcaatcactggcctaaacggcagtggtaaatccaacattctcgacgccatctgtttcgtgctcgggatcacaaatatgagcacagttcgagcgcaaaacctccaggatctcatctacaagcgcggtcaggccggcgttaccaaagcgagcgtgacaatcgtttttgacaatagggacaccgcgaaatcaccgatcgggttcgaagaatatgcgaccatctccgttacgcgacaaattgttctcggcgggactagcaaatacctcattaacgggcaccgtgcccaacaacagaccgtacaaaatttattccagagcgtgcagttaaatatcaacaatccaaactttttgattatgcagggacggattacgaaggtgctcaatatgaaagcgggggaaatcctgtcgatgattgaggaggcggccggaacaagaatgtttgaggataggcgggaaaaggcggcgaagacgatggctaaaaaggacctgaaattacaggaaattgaaggtttattaaaggaggaaattgagccgaaactcgaaaaactgagggctgagaagcgagctttccttgatttccagcagacacagaatgatttggagcgattgacccgccttgtggttgctcatgactatcttaggagcggcgaccgactccgtgcttctggcgaggaatgcgagaaaaagaagcgaaagatccaggcactggaagataacacggcgaagctcaagagcgagatagcacacatggaagaagatgtaaagcgggtcaaggcggttcgggacaaggagctacgcaaagggggaaaatttcaggcccttgaggatgaggtcaaggctcattctcatgagctagtccgtttgacgactgtttttgacctcaaaaaggcgagtatcgctgaagagaaggagaagagcaaagagctccagaagtcagtgaaggacctcgaaacatcactcaaggagaaaaagaagatatatgataaactgcaggcagaatatgatgcggcgaaagcggaacttgatgcacaaacagccgaagtcgaacagaaggaggagttgctccagactttgcagaccggtgtcgcttcgaaagaaggccaagaaagcggatatcagggtcaattacaggacgcccggaaccgtgcgagcaacgccgctacagaacaagaacaggcgaagctcaagattgcgcacttggaaaagaggatcaaggaggaagaaccgcgagccaagaaggctaaggagcagaattcagggcttctaaaagaactcgaaggcctcaagtctcaggccaagaaattggaatatgagctctcgaagttaggttttgagcctgggcgcgaggagcagctatatcaagaacagagcgggctccagaaagaaatccgtgaattgcgccagagagctgacggtcttcagagaaaggttgccaatatcgaattcaactactctgatccctacccgaactttgaccgatccaaggtcaagggtcttgtagcccagcttttcactgtggacaaagagaagctccaggctgctacagctctggaaatctgcgctggcggtcgcctgtataatgtcgttgttgactcttccgatactggtacgcagcttcttcaaaagggaaagctccgcaagcgtgtgaccattattcctctgaacaaaatttctgccttccgagcgtctgtagagaagattggggctgcgcaaaacctcgctccaggaaaagtcgacttggctttgtcgctcattgaatatgatgaagaaattactgcagccatgaattacgttttcggcaacactttaattgccaacgatgctgagacagcgaagcgggtgacctttgatccttctgttcgtatcaagagcgttactcttgacggtgatgtctatgacccgtctggtacactctccggtggtagcgcgcccaactccagcggcgtgcttgtgaccctgcaaaagctcaatgagatc

SEQ ID NO: 36335 - DNA, 2022 bp, Aspergillus nidulans
tttaccacaccggaactgtatggcccggcgaatccgcccgaggatgacactgtaaagacaccaggctcagttgactctggcaatgccaacacaacatcccttaccgatatgttccgaatcgagaggatgctaaccgtcaaggtaactgaagcgaagatgttcggtaataaaggcgtcgatgagacgcctaggagtcgtaaacagtcgcggtctcactttaatgcggccgcggcatccgcaaccaacgattactacacggaggtccttctagatggcgagattcgggcgagaacggctgtaaagtaccgtacatccaatcccttctggcgagaagagtttactttcaacgatcttccgccggttctgtctcaggtttccataatggtgaaaactctcaacccagcacaacgtgattggtcgttagtggcgcatggtacatatgctttgagccaggacacaaatccaacgcgtctattggatgatgttgaggtatcttctcaagacgccatgtgtggaagggtggatatccgactcgacgacctagaaccaggtacggaaaccgaaaagtggtggccgattctggacgatagagatcaatgtgtcggcgagatgttgatgaaagctcggatggaggagacagttgtgctcatgtctcaggagtacgcaccaatgtccgaaattctccactcgtttggtaacggcctcactgtcaacatggctgagattatgtcttcggaattgaatcagctgtctgaagcacttataaatatttatcaagtgtcagggtcgacggtcgaatggatatccgcgctcgttgaagatgagattgatggtattcacaaggagtccacggccaacagacttcggtatacatcgcggctccattccaacgacaccagagagcacggtcaagatagagaggtcctagttcgcgatctaggacgcactgcaaccctagaagcaaatctccttttccgaggaaactcgcttctcaccaaagctcttgatttccacatgcgtcggctgggcaaggaatacctagaagaaacgattggtgaacgtctttacgaaatcgatgaaaccgatcctgaatgcgaagttgatccgtctcggatacatcgggcagacgatctcgagcgcaactggaaaaatctggtcagccttactacgagtgtttggaagtccatagctagttcagcctcacgatgcccggcggagttaagacttatttttcgacacattcgagcttgtgctgatgaccgttatggcgatttcctccgctcagtcacgtacagcagtgtatctggattcctcttcttgcggttcttttgtccggcaatcctgaatccgaaactgttcggactgttgaaaggtaaatctacattaatttctctacggctgtaacaccttactgatgcgcgtctagatcatccccgaccgcgcgcccaacgcaccctaacactgattgccaaagccctacagggcctagccaacatgacaacattcggaagcaaagagccgtggatggagccgatgaacaaattccttaacagcaaccggaatgagttcaagacatttgtcgactccatttgtgcaatcccggccgatcgcccgactcccatcgttacgccatcctatgccactcccatccagattctcggtcgtcttccgccaccgtcgcgcgagggattccccagccttcctttcctgatcgaccatgcacgaagcttcgccaatctgatcagaatatggctagaagttgcgccaggcagactttcacaactggaagaattagaccctgcagttatgaaattccatgagattgctatccgcttacaacagagaactaaagaatgcttaagcagggcggagttggcggagcgtcccagcggcaacctcgaagttaagtgggaagaattggttgattctctggagcgttctgtgacactttacgaagaaagctcatccaaacctgctactccggccgcggcgccttcttcagcgcccatctccgaaaccgtt

SEQ ID NO: 36336 - DNA, 566 bp, Aspergillus nidulans
tccatgacgcagaatcgccttttccgcgaatataaaacactatcaacaaacccgccggatgggattaccgcggggcctgtctctgaagatgacatgtttcactgggaagccttgatacagggacccgaaggcaccccttacgaaggtggggtttttgctgctgagctcaaatgccctaaggattaccctttaagtccaccgacaatgaagtttgtcggcgggggaaggtggcatgcgaatggtgagttgtgacctctatgtttcttttcgtttgaacgaaaggggagatttatcggctaatgttccgttgggcagtctatcccgatggcacagtgtgcatctgcattctacacccacccggcgatgatccgaaccactatgaacatgcctcggagcgctggtcgcctatacaaagagtggagaagattctcatcccagtaatgagtatgctagcggagccgaatgatgaaagcccagcaaatgtggaggctgcgaagatgtggagggaacggagggctgcgtatgagcggaaggtcagagaggaggttagaaagggactggggtcg

SEQ ID NO: 36337 - DNA, 1403 bp, Aspergillus nidulans
actatgaacagcttactccgagccgcacgcgatgcagagaattctcagtccaaacaatatctttcatttgtcgaggccgtccggttggaacatgtcgacgtcgtcgagagccagatcaattctgctgaactcaggacgcagcttacctcagcgatcaacgccgaatgcgaacgggtcctcaaggtcctggaagctgctcagactcttggcgaaatcagtgcgcgttgtgtggataaagtgataagcaccggagagaagttgagttgccgcctgatggccgcattcttacaggatcgaggagtcgactcggagtacgtcgacctgtctgaaatcgttgattttcacatttcaggtcaaggccttgaccaagagttttatgacaatcttgcggctgctcttggtcgcaaggtacatgcctgcgaaaataaagttccagtcatcacgggatattttggaacgataccgggaggccttctcgatcagatcgggcgtggatacactgatctttgtgctgctctggtcgccgttggcgtacaggctggggaacttcaagtatggaaagaggttgatgggattttcactgcggacccccggaaagtgccaaccgcccgtcttctaccagcgataacacccgctgaagccgcggagttgactttttatggctcggaggtgatccatcccttcacaatggaacaagttatccgtgccaaaatacccatccggataaaaaatgttatgaatccgaaaggcgacggaaccgtgatattcccagattccacctatgagttggaaaggacgacgcccggccacgatccgagactattccgtacaaggagccctagccttcttcaacgccctaagcgcccaaccgctgttaccatcaagcacaacatcctcgtcattaatgttcattccaacaagcggtctctctctcatggattcttcgcaggaatattctcggttctcgaccgttggaagctgtcgattgatctgatatcgaccagcgaagtccacgtgtcaatggctcttcactcagaaaggccgcttctgaatggtgttgggagggatgaatatcaaatcatcgacgaagatttgaagggagctttgagtgatttacagagatatggtaccgtcgatataattcctgggatggctattcttagccttgtcggaaagcaaatgaagaacatggttggagtggctgggcgcatgttctctactctgggagagaacaatgtcaatattgagatgatttctcaaggtaacagttattattcttggtcttggataatgcgaaactaactaagttcatcttaggtgcaagcgaaatcaatatttcatgtgtcattgaagaacgagatgcggaccgtgcactcaacataatacacacaagtttatttacg

SEQ ID NO: 36338 - DNA, 900 bp, Aspergillus nidulans
aacttcatcactcagtttgaaatcatgttgaagttgccgcagcctaccctcgcgacagccgcagtttacctccatcgcttcttcatgcaatatgcgatagccgacaagccggagcgaccgggaatccaccggtaccccattgccgctacatccctttttttagctacaaaagtgaagaagaatgtccgaaggatgaaaaagctggtgatagccgtctgccgggttgcacagaaaaagccggatctggttgtggatgagcaatccaaagagttttggaagtggcgcgataccatccttcaccacgaagacattctgctcgaagcgctatgcttcgatctgcagctcgaacagccatataggatcctctacgattttatctgtttcttccgcgtcaacgacaacaagcatattcgcaattcatcctgggcttttctcaacgattccatgtacacggttctttgcctccagtttccagcccgcgttatcgctgctgctgccttttatgcagccgctagccactgtgatattggatttgaggatgatgaattcggccgatcctggtgggagcagatcgacgttgatatagcacaggttcgccgcgcatgcacccggatggcagagctatacgaaagcaattcgcaacatagacacagccagtactacccacccgttccattagcttggaaagaaggtgctgaaaagaccaggattccgcgtcctggtggctcactcgacgcaccaccagacccaagctccaggaagcgctcgcgggagccagaggacagttcaaaaagcagccagcaaccctcacaggacaccgcatccttgaaaaaagaggaagcctctcagaacggggcccgctcgccaaaacggccccgagtaggttcagacgcagatcaa

SEQ ID NO: 36339 - DNA, 1220 bp, Aspergillus nidulans
gtaacaagcctagtgatcctggccctgaacgtcttcgcggtcgagtggtacggagaatccgagttctggttcgctggtctgaaaatattggccatcatcggtctgattatcctgggcgttgtgctgtttttcggtggaggcccaaatcatgaccgcttagggttccgctactggcaagaccccggtgcattcaatccgtacctggttcccggggacactggcaaattcctggggttttggactgccctgatcaagtccggtttttcgttcattttctcgcccgaattgatcaccacagccgctggagaggtcgaggcaccgcgtcggaacatccccaaagccaccaagcggttcatctaccgtgttttcaccttctatatcctgggcagtttggttattggagtcactgtggcctacaacgaccctacccttgaggctggagtcgaaagcggcgggtcaggggccggcgcgagtccattcgtcgttgccatccaaaacgctggtattggagggctcaaccatgtcgtcaatgctgccatcctgatctctgcctggtcatccggtaacgcatggtgttacgctggatcgagaacgctgtactcgctcgccggtgagggccaggccccaaagatcttcacacgcaccaaccgcaccggcgttccctatgtggctgttcttgcgacatggacaatcggactgctatccttccttaatctgtctagctccggacagacggtcttctactggttcaccaatattactaccgttggcgggttcatcaactgggttctgatcggaatcgcctatctggtatgcttccctccatctcttcatctgaacacacctgaccaaaaacagcgttccgcaaggccctgcaattccacggcatgctggacatgctaccattcaagaccccgctgcaaccatacggtacctactacgtgatgttcatcatctcgatcctgaccttgacgaacgggtacgcggtgttcttcccgggccgcttcactgcttcggacttcttggtctcgtacattgtttttgctatcttccttgcgctttatgctggacataagatctggtaccggacgccctggttgaccaaggtgtcagaggttgacatctttacgggcaaggatgagattgaccgtttgtgcgagaatgatatggagcgacagccccggaactggttggagcgagtctggtggtggattttttag

SEQ ID NO: 36340 - DNA, 1158 bp, Aspergillus nidulans
aattccgacagccctgcgtccccgaccgttcatatgcccccagcggttacgtccagtcggagctccgcctttgtcactcgcatcgagctcttcgctgccggtgtgccggattggtatgtcgctccaatttgcggggctagcgcaggtgtagcttcggggattgtgacatgtccgcttgatgtgatcaaaacgaaacttcaggcccaggggggcttcgtgcggcgagggaaaatggtggaggcaaaaactatatacaggggaatgttgggaactggcaaagtaatctggagggaagacggtattcgaggtctttatcaaggcctaggcccaatgcttctaggatatctccctacgtgggcggtatatctagctgtttacgaccggtcacgcgaatactattatgagactactggtgggtgctacttatttttttttggctagcctcggactttcactgaattcattataggcagttggtggctatcaagaggatacgcttctgtaacggcgggcgcttgctctactattgtcactaaccccatttgggtgataaaaacgcgactgatgtcccagagtctaaggtccacgacagaaggattccgagctccttggcaatacagcggcacttgggatgctgcccgaaagatgtacaagaatgagggcatcctctcattctattctggcctaacgccagcattgctgggactggcgcacgtggctattcaatttcctctttatgaatacctgaaaatggcttttaccggttacagcatcggagaacatcctgatactggaagttcccactgggttgggataagttgcgcaacatttctgagtaagatctgtgccagcactgtgacgtatcctcatgaggttttacggacaaggctccagacacagcaaagaactccgccatcaccttcaccagaggagattgcattccggggtggactgggtggcatggatcgtggacgtggtgcaggtgcatcttcatctgacggtatgcctaacaggcctcgctattccgggattatccgcacatgtcagacgattctacacgaggagggctggcgggcgttctactctgggattggaacgaacctatttcgagccgtccccgctgccatgaccaccatgctcacatatgagtatctccga

SEQ ID NO: 36341 - DNA, 894 bp, Aspergillus nidulans
cggggaggatactatggaaatccgctccaggctgcatcagctagaggtcatgagaagatagtgcaaattctacttgatcatggggctgacgtcaatgctcaaggcggaaagtacaggaacgctctactagctgcatcagttgaaggccatgggaagatagtccatatcctgcttaaccagggggctgatatcaacgctcaaaatggatattatggcagcgctttccaggctgcattggtccaaggccacgagaagatagtgcaggtcctacttcagcaggtggctaatgttaatactcaagacggaatttatgccaatgcactgcgggctgcatcagctagaggatatgagaagattgtgcagatcctgcttgacaagagagctgacgtcaacgctcaaggcggagagtacgggaacgccctactagctgcatcagttgaaggccatgagaagatagtgcagtttttgcttgagcagggggccgatgctaatactcaagttgaatggtatggcaacgctctgcaggttgcgtcgtccaaaggccatgagatggtggtgcagatactacttgactatggggctgatatcaatgctcagagtggacgatatggcaacgctctgcaggctgcatcggctgaaggctatgagaggacagttcatatactgcttgactatggggctaatgtaaatgctcaaggaggattgtatggcaacgctctgcaggctgcatcgtcccaagggcatgaggaattagtgcagatattgctgcaccagggtgctgacattaatgctcaaggtggaagatatagcagtgcactccaggctgcatcagctgaaggttttgagatggtggtgcagatacttcttgatcaaggtgctgatgtcaatgctcaa

SEQ ID NO: 36342 - DNA, 1123 bp, Aspergillus nidulans
gttgctggagaatctgggctaggaaagaccacgttcatcaacactctgttttccaccaccatcaaaaactatgccgaccacaaacgacgacaccagaagcaggtcgatcgtactgtcgagatcgaaatcactaaggcagaattggaggagaagttcttcaaaggttatattgaacggccctggtccaactaggccactgctaacaagaattgcgctgtatagttcgcttgactgttattgatacccctggatttggtgactatgtcaacaaccgcgattcctggcaaccgatcatcgagtttctcgacgaccagcacgagtcgtacatgttgcaggagcagcagcctcggcgtacagacaagatcgatatgcgtgtacacgcctgcttgtatttcatccgcccaaccggacacaccctgaagccgctggatattgaggttatgaagcgcctgagctctcgtgtcaacctcattcccgtcattgccaaggccgatactcttagccccgctgatctctctcgttttaagcaaagggtacgccgtcttgcgccgtattaacaaatccgaaggtgtaaagctaatcgcatatcatggttaacagattcaagcggttattgaagcccagggcatcaaaatttacacacctcccattgaagaggacgacgagactgccgccgctcacgctcgcagcctgatggcggccatgccgtttgccgtgatcggttccgagaaagatgtgaagacgaacgatggccgcgtagtcaagggtcgccaatatgcttggggtgttgccgaagtcgaggatgaggagcactgcgacttcaagaagttgcgctcaattctgatccgtactcacatgctcgaccttatccacacaaccgaggagcagcactacgaagcataccgtgcccaacaaatggagacccggaaattcggcgaggcttcggcccaggaaactcgacaaccccaagttcaaggaagaggaagagaacctgcgcaagcgcttcaccgatcaagtcaagctggaggagtcacggttccgacagtgggagcagaagcttatttgcggagcgagatcgcctcacaaggatctggaggctacccatgctgcgtatgtcccttga

SEQ ID NO: 36343 - DNA, 1940 bp, Aspergillus nidulans
cccggttgagcttcgaccatgagttattcttacctacctacgagcacccatgcttacggtcctgctcgtcgagagattacctcgtccggtattctccaatccatacatgatgcgctgccgcactgggtttcgcaaaggatgtcgtcggtcgtccacacggcgtcgaatcagttggaaaagtacaagagtcggactgagctgaaagcgctcacattgagaataatacgaaccctctttacggtcacaaatggactgatcattatatggatatggacgctatggtggggagagcggaccgtgttccgcgacagtgtagatgcgtgcgcttgggacgcttgggagaaatgggtgagcttgtcgcgggcattattcattgaggtaatggaacaatgctgatgtttcttatttagccgagcaatgctagacctcatcatgtcgccttcattgcagacccgcagctcgttgatccgcacacttaccccgaccgcccgtggcctctgtctaccctcaccatcaaatttacagaccagtacatgcgtcgctctttctcgtcaatacaacacacgctggacccggactcggtgttattcctaggtgacctctttgatggcggaagggaatggtcgacttcccgcagcagcagcccagaagagcgttggagacaatacaacgatgatttttggaagaaggaattccatcgctttgttaaaatcttccttggtccgtggagtagccaggagacacagtctacgaactcgcgaggtcggagattgatcgccagcttgccgggcaatcacgaccagggtttcggctcgggggtccagctaccagtccgcgatcgctttcagaacttctttggcaagggaaatcgagtggacgttatagggaatcatacgttcgtctctgtagatactgtttcgttgagtgcgatggaccaaccagatccccgtactggaagtacgggtggtggaaacggagatggcgaccggccaaaccaggagatctggcaagagccggaagattttctgaatgccatgaaggtacaccgcggtcgcgccgaggcggacgaactgcgtttcatgggggaaccaagaaagggtcggctgttcaagcatgaagtttccgaagtctcaaagccttcgatataccgagaagatgacccagagattatcggatttccggctatccttctgtcgcacgtgccgttgtaccgcaagccagccacgccttgtggaccactcagagagcgatatcctccctccgcagatggcttagaagaggacgagcaaaacgcgcttaagatcagtggcggatatcagtatcagaatgtcttgactaagacaatctctaacgacatagtgtccaagattgggcccaacctagtccaggtatactctggcgatgaccatgattactgcgagatctcccaccgcgagttcagcggttcgccgaaagagatcactgttaagagtatatcgtgggcaatgggggtccggaaaccaggctttgtcctgacaagtctctggaatcctatcgaccctaccaccgggacctccatcgagtcttccagccctggaagcaccatccaaaaccacctctgcctcctccccgaccaactttccatcttcatctactacggcgtcatcctagcattcacccttaccgttcttctcgtgcgagccgtcatcctcgctctccgccgcaccgaatctacaaccccggaacctatccttccgctcaccgaaaaccccgtaatccgcacccgcagccgagctgtttcgcatacatcctcttcgagcatcccaaacaccgccttcatcaaaccaggcgggctagctagccgcgcgacgaataattacaatccccgctattccccgccacactcgtataatgacccctcggcctaccccagctctgactacattggggaaaccgataca

SEQ ID NO: 36344 - DNA, 1655 bp, Aspergillus nidulans
actatagtgactgggactgggcggcgctcttcgatacgacaaaccgacctgcaaacatcagtcagagtatctagccctgagcccatggccagtccaatagataagtttccagcgttccaggacgagcaatttggcaccgcggagccgacaacactttacccaaacacaacagtcagatatgcgcccagtgatcgctgggactataaaccagtccgggattccaaacgaaggccgagaaagagcatcagcgaaaccataagtgccatcaggactcgcaatggtagtgttagtgcaaatgcgcaagatctggctcaagcgcttagagcacctgtgtcgtacaggctcatagtacggctttccaaccccgtcgcctattgcagtcgcttactcgtccgcagatgctctgccttttctggtatactacttcagcattaacgaatacgtcctcaaaatccattttgaacgcgcttccgaggcccattactctcacaatggtccagttcgccttcgtgtccttgtggtgcctgctactttcgtacctgtccaccaagttaccatggcttaaaaccagcataccggctctcaagaacaacatacgcccgccgtcacgcgatgtgataatgacggcgctacctctcgccatattccaactagcaggtcatatcttgagttcaatggccacttcgcaaatcccagtttcgcttgtgcacactatcaaaggactttcgccattattcaccgtgctggcataccgcttccttttccgcattcgctatgctaaggcgacctatttatctctcgtgccactgaccttgggtgtaatgcttgcttgttccacaggcttctccacgaattttttcggcatcctatgtgcgctggttgcagcccttgttttcgtatcacagaatatattctctaaaaaactcttcaacgaagccgagcgtgcggagtcagatatacagtctgctggtcgccgcaaactggacaagttgaacctactctactattgctctgggttagcttttatcctgacattacccatttggttggtcaccgagggctaccccttattctctgatctgatgcaagatggcgccatctctcttacgaacaaagctggatcgttggatcatggcgcccttttcctcgaattcgtgttcaacggggtgtctcactttgctcagaatatcttggcgttcgtcctcctttctatggtttcgcctgtctcatattccgtcgcgtcacttatcaaaagggttttcgtgatcgttgtcgcgattgtttggtttggtaattctactacgcccgtcagggctttggaattgccctcacccttccttgggctatacctatacgaccgcaatagccatgatgacgtcgcagaccagaaagccaatgcggaccactttcacttcaaaaatcccattctccctctgaacacccgcggagcgagcaaactcaggggatccaatggctatgcgatcccacaagggaggcctgttgaccagcacgtcttggaccgttcatttcccatctccagtaactcaaaaaaggacgacggcgtcggtcatgcacgcccaagagcgagtagcaacacgaaagcttggctgccacctggtacaaagcaggagacgacctggcagtcaagcgactct

SEQ ID NO: 36345 - DNA, 780 bp, Aspergillus nidulans
gtcctcattgtcggcgctacctctggaattggccgggctattgcaaccagaccgattgagaaaggcatacccgtcgtgatatccggccgccgagaagagaacctgcaggagtttgttcgccaacatggcagcgacaaggtcaaaagcaaggtctttgatgtgacaaaattggacaaagtaaggagaagcatgcaatgtacaaggacaagctaacagctcaagattcccgttttcgcctctgaagtcctcatcgagaaccccgacattgaatgcgacttcgtcaattcgggcgtccagcgcccctttgacttctccaagcccgacactgtcgacctcccgatgttcgaccaggagctggtcacaaactacgcatccgccgtatacctcagcaaagccttcatcccccacttacaggcccggaaaatcagacgtcactcatttatacaacctcacagatggcccttgttccaatgatgcggtgcccgaactacggggcttccaaagctgcgctgcaccactttattctcgctctccgcacgcagctgcgagatggtctggtggtagagatctacccgcctcctgtgcagacagagctgcatgacacgaagcatcagcgatctcaagaacggacatctaattgggatgccgctggatgattttactgacgaggtgtgggcaaggctacagaaccgcgaggagcagattgctgtcgggtcagcgcaggaaatctttgacgcgtttgagattaagcggcaggggctgtataaggagatgacgaag

SEQ ID NO: 36346 - DNA, 872 bp, Aspergillus nidulans
ctcgttactcctaaagagctctcagatgccctgaagaagaatccgtctacgaagatctcgacttctccccgcgtaatacccttatgcgcagcttggtttatgcccaatgaccctgagggtcgcacagggattgatgtttttcgtaaacaccgtgtaccacaagctcgcttctttgatctggatgctattaaggatactgagtcgccttacccgcatatgcttccaactgcagagacgttcgcccaagcaatgagtgagcttgggattcgacgtgatgatgaggtggttgtctatgatacggaggagctcggaatattcagtgcacctcgcgttgggtggacactcagagtgtttgggcatcccagagttcatatcttgaacaactacaggttatgggtgcgcgatggctacccgacagagaccggcgagcctcgtcaaccggagaggacgaactaccctgtgccttcatacgactcaaagctcgtgattccatttcgtgagctgaaggagatcgccaaggagcatcgcaaggagggtgcgaaagaagttgaaatcctggacgcccgatctcagggcgctgggcgggaactgaccctgagccgcgccccggtctatcctctggacatatccctggatcaatgagtctcccgtttcaggaattgctggatcctgagaccaagacataccttcctccagaccaattacgaaagattttcgagtcgcgcgatattgatgagaccaagtctatcatcagctcctgcggtaccggcgtgacagctactatagtcgagacggcgctggggctggccgaatacggtgaccctagtattcgaagagtatacgatggaagctggacgtaagtgatctttcct

SEQ ID NO: 36347 - DNA, 363 bp, Aspergillus nidulans
ttggcgtgtgcggttcacactggcaacgtcgaactggtggatttgctgctcgcgcatggggcaaggctgaaggggagtaatgcaattgtaagggcggcgattgatgaggacctggagatggtcaagtatcttctgttaaggggggctgatattgacgaggttgggatcaagggcccgccaggcgctgaggcttatggtgatatggggagtccccttcatcaggctgcggtagagggatacatggagatggcgcttttcttgattgaggctggggctgatatctatcttaaggatccgcttggacgcactgcggaagaccttgcgctggaaaagggacatatggaaatccttgatgctctgcgc

SEQ ID NO: 36348 - DNA, 747 bp, Aspergillus nidulans
acaaactctcccctgggcattgggcgcgcaacagcgcaccaattcgcgcgcaacggtgcgaaggccatctatatctgcgacttcacgagcacacaccttcccacccacgcccgggaaatcaagtccctctacccctctgtcgacgtgcacacgcgcacctttgacgcagcagatgaagctgcgctgaaggctgtgattgacgaggccatccagaactacgggcggctcgacatctttttcgccaatgctggaatctcaggctctaacgttcccttcacggaagtgacaggtgagcaattcgcggagacgctgcggatcaacacagttggtgtgtttttagccgcaaagcatgctagtctggcaatgaggaagactagtcccgagaagaaataccctggaggcagtattatagctacagcgagtgtggcggggttgaggtcgaatgcgggggcgacggattacagcgcgagcaaggcggctgttgtatctattgcacaaactgtggctttccaattggctgggacggggatccggattaacgcgatctgccccggggtggtagagacggggatgacagctgcgatgtacgaggctgcgcgggcgagggggacggagcggaagattgggcaactgaatccactgcagcgcggtgccgtggcagatgagattgcacgggttgcgctgttcttgggaagcgatgagagtagttacgtgaacgggcaggcgtgggcggtttgcggtggactc

SEQ ID NO: 36349 - DNA, 2096 bp, Aspergillus nidulans
cgcgcctggccattgcatgttcttagctacagtcggtctgcactcaacatgctcttctccatgcgccagccgtacatcgtcattccatcgtatgtcgcccaggtcgtcgcctaccccattgagcgttgcgtgggccaaggtcatgccccataagacaatcaggatgtttggaatgagtgtcaatttaaatcctggaccttatagtaagaaggagcatgccattgcggtcatcatggccaatgccacctttggcggtggtgcggcctacgcgaccgatgttctgctcgcccagcgcgccttctacaagcaacgctttgactgggcgtttgagatcttcatgtgcatctcgacccagatgctgggctttggaatggctggcttcttccaccggttcttggttacaccggctgcaatgatctggccgtcgacgctgatcaatagtgcgcttttcaccgcgctccatgaccgaagtcggcccgacccaagcaaagtctctggctggacaattggcagataccgtatgtttctgtactgtctgattggatcttttctttggtattggtttccgggatacattgccccattcctgagcgtttttgcctgggtgacttggatcaagccgaacaacgtggtcatcaatcagttgttcggcggctggaccggcctttcgctgattcccatgacttttgactggactcagatttcgggattcaactttagcccgctcatcgcgccctggcacggaattgccaacactaagctgggcatgttcatcttttttgggtcgtcaccacggctctgcactacactggcactcactgggccaagtacctgcccatcagcgactcaaatagctacgacaacacgggtcaagtctacaatgttacgcgtattcttaccccgcagatgaccctggacaaggccaagtacgaagcttactctcctctgttcctatcaaccaccttctctctcgcctatgggctgtcctttgccaccatcattgctgtgcttatccatgccatcctgttccacggaaaagacatctgggtgcggttccgtcagatcggtcatgaggacgaggatgtccatgcacggctcatggctcgattcaagcctgttccgttatggtggtacggcgctatcacacttattatgatcggaatggctcttggtgtcacactcggctacccgaccaatctcagctggtgggccttcttcattgccctgatcatgggtgcagtatggttcgtgccttgcggtattatccaagcctcgaccaacattcagatcggtctcaacgttatcaccgagtttgtgattgggtacatgcagcctggccgcccgatggcaatgatgctcttcaaaacttatgggtacatcagcatgtaccagggcctttacttctgccaggacatgaagctcggccactacatgaagattcctccgcgggtgacctttgcagcacagatgatatcttgcctgtggtcatcgattgtccagatctgcgtcatgaactgggctctcggcgccatttcgagcgtctgcaccctcgatcagccgaaccgctacacctgtcccaacggccgcgtcttcttcaacgcctccatcatctggggcaccatcggccccgcccgcatgttctctcctggccaactctacgctagtctccaatggttctggctcgccggtgccgccctccccgtcgccatctacatcgcagccaagcttcttcggaacaccaagtacgcccgctacgtgcgccttctcaatgcgcccatcatcttcggtggatctagctttatccctcctgccacgccgctcaattatctgtcctggggcattatcggcttcatcttcaacaagtggatccgcgaccgttggcgcggctggtggatgcaatacaactatgttctttccgccggtctagatgtggccttgccctgtgcaccatcttgattttccttaccttgaacttgaccaacacggagttcccatcctggtgggggacgaacattgcggcgaatacgatggatgcggcggggacggctgtgcaggtgacggaggtgaagtttgggccggagagttggtagtgtcta

SEQ ID NO: 36350 - DNA, 935 bp, Aspergillus nidulans
attgttcttgctccgtgggaatatatacggtcgttgcccgggaagaagaccctcggccgcttaatcgactgcctacagtgttggctaacattgcctgaggactcaacaaacataatcggagaagtttcaaggatgttattcgatgccgtattaatgttggactgccatttcagtagtcaacatcaaactgacagcgtaggcttgatgatatccaagacggatcacggctgcgccgcgggcgaccagcagcccacgctgtctttggccagcctcagactctcaacagcgcaacctatctctatgtcaaagggagtcgactggtgaagaagctgaaacactccaatgagtgcgcagacgtatttataggtatgtatacccttgggattaactgtaacagctaacacgcgcagatgaactagaaactctctcattcggacagggcctcgagttacattggagatttaacacaatattaccatcaacaaaagagtaccttgttatggtggacaacaaaaccggtggtttcttccgtctggtgcttcgacttctcgaggtagagtcggaaagcgagccgaaccccgaattgatgcatcttttcaccttgctgggaagatactaccagatcagagacgattacctaaacttagcttctgaagaggtaacttaccgttcaccataattcgtgacactggctgatagttgagtcctagtacactgccaagaaaggattttgcgaagatctatcggagggaaaattctcattcccgctcatccacctcctgcaaaacattgctaaccccgagcccatacgtggtatactcttccgccgcgacaatgctaccgacctttcggtcgaaatgaagcaatttgttaatgaagagatgaagaaagccggaagtcttactcacacggaggcagtcctcaatggactgttt

SEQ ID NO: 36351 - DNA, 2004 bp, Aspergillus nidulans
  unsure (1)..(2004): unsure at all n locations
acaggtccccgtgctctgcaaccttcgcaatttggaatgatctgcctagcttacactcttgaaggtgaagcctgtggtctcgtgaaaaatctggctcttatgacacacattacgaccaatgatgaagaaggtccaatcaaaaaccttatattcatgcttggtgcagaagacatccagaccgtaggtggaaaggagatctatgcacctggcagttatactatctcgattaacggtacgccaatggcgctaacccgtcgcccgaagtacttcttgaatgcgttccggcgactgcgacgaatgggcaggatctccgagtttgtcagcatctacattaatcatcatcagcgtgctgtgcacgttgcaactgatgatggacgtatctgccggccactcattatcgtcgaagatggcaagtcgcgcgtcaagaaacatcatctccgcaagctccgtgatggaacgatgcagttcgatgatttcctagcccaaggcctagttgaatatgtggatgtcaacgaggagaacgattcgttaatcgccatatacgagaaggatataacggacacgactactcatatggaaatcgaacctttcacaattctcggtgctgtcgccggtctgattccttatcctcaccacaaccagtccccgcgtaatacttaccaatgtgctatgggtaaacaagcgattggggctatcgcgtcgaaccagttcctgcgtattgattccattctttacctgatggtttacccacagagacccatggttaagtcgcgcacgattgaattgaccaaatacgatcagctacctgccggccaaaacgccactgttgccgtcatgagttactctggttacgatattgaggatgccctagtcttgaacaagggctcagttgaccgtggcttcggtcgctgccaggtgttccgcaagtatgtcacaaacatgaaaagttattccacaggcacgaaggacatcgtgagccctaccacttatgagaacaaagcgcccataaggaaacacgctctcttagagaacaaaagtctggcagccgttggagaacaagtcaatgctggagaggtttacatcaataagtctacaccagatcagtcaatgtcctcaggaatgccaggctctgatgcagggcgaccgatcagctacaaccncactccgatgacctacaagcttcccgatcctgcctacattgacaaagtcatgatttccgctactgaaaacgagaatcaaatcatcaaagtactcacacgccaaacacggcggcccgaagtcggcgacaagttctcttcgcgtcacgggcaaaagggtgttacaggtattattgttgaccaagccgacatgcctttcacggaccagggtatcaacccagacatcatcatgaacccccacggtttcccctctcgtatgacagtcggaaaaatgcttgaacttgttgcaggtaaagccggtgttctttccggccagcacggctatggaacatgctttagcggcacccctgtcgaacaaatgacccagaccctcattgacaaaagcttcagctacggtggcaaggactatcttacctctggcatcacaggcgaagctctccctttctacgtcttcacgggacctatctactaccagaagctgaagcatatggttcaagacaagatgcattcgcgtgcgcgcgggccccgcgccacactcacccgccagccaacagaaggtcgttctcgggatggaggtctgcgtctcggagagatggagcgtgattgtttaatcgcttacggtaccagtcagctgcttttggaacggttgatgatatcgtctgatcgccacgaggttgatgtctgcgagcagtgcgggttcatgggctacctgaactggtgccagcgctgcaagtcatccaggagtgttgtgaagatggtcattccttatgcggctaagctccttattcaggagctgatgagtatgaatgtcacggctagactaaagctcgaagacgagttccccgag

SEQ ID NO: 36352 - DNA, 1566 bp, Aspergillus nidulans
atgcagcgagctctttcttcccggacttcggtcctctctgccgcttccaagcgcgccgctttcaccaagcctgctggtctgaaccttcagcagcagcgatttgctcacaaggtaagctggataccaattgcgattcaaaagaggccctaggagctttcggccagccttccgcagctctccggatagctccagcaaaattgctaacaactgggcaggaactcaagttcggcgttgaagctcgcgctcagctccttaagggtgtcgacacccttgcaaaggctgtcacatctactcttggtcccaagggtcgcaatgtcttgatcgaatccccctacggctcccccaagatcaccaagggtacgttcgcgctttagtcatcatttttacctctatccctttacacaaccctgtcaaaagttgtcattacattcactaatttgcttagatggtgttactgttgccaaggccgtccagctccaggattagctcgagaacctcggagctcatgttctacaggatgtctcttacaagaccaacgaactcgttgatgacggtacagccaccgataccgctgttgaccgcgctatcttttccgagaccgctaacaacgtcgctgctggctgcaaccccatggatctgcgccgcggtatccaagctgctgtcgaagccgctgtcgattacctccagcagaacaagcgtgatattactactggagaggagattgctcaggtcgctaccatctctgctaacggtgacacccacgtcggcaagcttatctcctctgccatggagcgcgtcggcaaggagggtgttatcactgtcaaggagggcaagacccttgaggacgagcttgaggttactgagggtatgcgtttcgaccgtggttacacctccccctacttcatcaccgacgccaaggctcagaaggttgagttcgagaagcctctgattctcctttccgagaagaagatctctgctgttcaggacatcatccctgcccttgaggcttccaccactctccgccgccctctggttatcatcgctgaggacattgagggtgaggctcttgccgtctgcatcctgaacaagctccgtggccagctccaggttgctgcagtcaaggcccccggcttcggtgacaaccgcaagagcatcctcggtgacctcggtgtcctcaccaacggtaccgtcttcactgacgagcttgacatcaagcttgagaagctcacccccgacatgctcggctccactggttccatcaccatcaccaaggaggacactatcatcctgaacggtgagggcagcaaggacgccatcgctcagcgttgcgagcagatccgtggcgtcatggccgaccctaccacctccgagtacgagaaggagaagctccaagagcgtctcgccaagctctctggcggtgttgctgtcattaaggtcggtggtgcttccgaagtcgaggtcggtgagaagaaggaccgtgtcgttgatgctctcaacgccacccgtgcggccgtcgaggagggtatccttcccggcggtggtcccgctctccgcaaggcaacacgc

SEQ ID NO: 36353 - DNA, 1497 bp, Aspergillus nidulans
tggtatcgtgattggacccttctgaaactcaataccctgcttctttgcgccctccttactcagatcgcctccggctacgacagcagcatgctcaacggcatgcagtcgctcccgcagtgggtgagctactttggccagccgacgggcacgcgtctgggcgccatgacatttggaccgacaggcggcacactgatctcggttttgatctcatcacagctatgcgagcgatttggtagacggtatccgatctgcggcggatcaatcgtcataatcatcggcgggatccttcaagccgcagcggtgaactacggcatgttcgtcctcagtagattcgttgtcggctttggactgggaatagtggctactgctgcgcccccgttgcttactgaagtggcctacccaacgcaccgcgggaaactcgtctccttctacctggttacttggccacttggttcgctgatcgccgcctgggtgacatacgggaccttcaagatggaagggtcggactggagctggcggatccccagcgcactgcaatgcttcttctcgcttgtccaggcagtcctagctctcctcgcgccggaatcaccccgttggctcatctaccaaggccggcgcgaggaggccctcgccatcctgacagagtaccacggtcacggggacgctgactcccgcctcgttcgtttcgaaatggccgagatcacggcgacgctcgaaatggaaaaggtccagcgcctatcccggtggacggaatggctctctaccaggggcaaccgccatcgcctcttcctggcttgctatattcctgctatgcttcagtggtcgggtaatgcgctgacatcctactacctggccaaggtgttagtgactattgatattaccgatccaaaaacgcagctcatcattaacgcctgtctctccgtttggggcttcctcactgctgcggtgttcgcgacactagtcgatcgcgccggacgacgccgcttgttcctgtccggcatggggagtatgggcatagcgtacatcatctggacgatctgctctgcactgaatgagaaacacaatttcgaggataaagggtatgccggcggtgtgctggctatgatcttcgtcttcagcgctgcgtaccacatgtgctcgcctgttgcgccaacgtacataatggaagtcgtccccttttcgctgagatccaaagcggctatgatgtaccagctgacggggaatcttgcgggtctatataacagctttgcaaatccggttgccatggacgcgattagctggagatactatatagtttggtgtgtggtcatcggcgtcaacttcaccctaatatttctgtttttccctgagacgaaaggcaagggccttgaggaggttgcggagatctttgatggacccgacgcactggcaggcaagaacgccatgagggagatggggttggatgttaatgccgacaaggctgttgctgttggggagagaaagcatgttgaggaggct

SEQ ID NO: 36354 - DNA, 483 bp, Aspergillus nidulans
aaccgagcgcgcgataactgtatcggactcatgtatgatggactctgtctacactcagccgaaccgccgaaggccgttctatcaaaggccgcagcagtcgaagcggcggcatatgacgcctacggaccagaaacgaaagaaccctaccgtacgaagatccgcagtctattccagaatctcaagaacaagtccaacccaacgcttcgagttcgtgttttaagcaacgaggtcacccctgaacgattcgtgaaaatgacacatgaggagctccgatccgacgaacagcgcgagaaagatcgaaagattcaaaaggagaacatggataaggccatggtggcccaggcagagcgcagcattagtacaagcttgcaatgcggcaaatgcggacagcgcaaggtcacctatactgaagcgcagacccgcagtgccgacgaaccgatgacgctgttttgcacatgcatgcattgcggaaaatcatggcgc

SEQ ID NO: 36355 - DNA, 1216 bp, Aspergillus nidulans
atggcggctaccgaaagtgcgttgacgatacacaatgatatctcaatggagctgcctgaactagcccccaatcaaggtctagaggccttcaaagatattgtttttggatcagtaagttaccggaagtcccctacgatgtacgggctttgctaacgccatctttaggctgcaggaatgataggcaaggtcattgaatatccctttgacacggtcaaggttaggcttcagtcacaaccggatcaccttcctctccgatacaatgggccgttagattgtttccgtcagtcattccaggcagagggtcttcggggtctctatcggggaatcagcgctccgatggcgggactgctgtagagaacagctgcttgttcttcagttaccgtgtggttcaagagctacttcaggcctcgtactattcctcgacagagccgttaccgttaactgctttggtgttcagcggtgctgcatccggatccatcacctcccttgccttgacaccgatcgagctcatcaaatgcaagatgcaagtgccctcggagccttccagcgcacgagtgggacccctcaagattatagtctctgttttccgccaggacggcgtcttggggttctggcgcggccaactgggtacgcttatccgtgagacgggcggtggtgctgcgtggtttgggggttacgaaggggtgtcagcacttttccgttcataccattattcaccttcgacaaccttttcctctgaggtcgaatctgggtcactccctctttatcaacagatgttggccggagcagcagccggtgtcagctacaatttcctcttttatccagccgacacaataaagtcgagattgcagacagaagatatcaacaacacatctagcaaacgacagacattcgggggcgccgctagggctctctggcatcagcaaggacttcgcggcctatatcgaggctgtggtatcacttgtgcgcggtctgcgccaagctcggcattcatttttacagtatttgaaggcctacggagttactttggatgagcgaattcgttatgtgattagatttcattttgattctcgacgattttttggcccatttctgcttattgatgatacctatgatttgtctagacttagattttcttgtttgatcattcgtctgttcaaccaatctggcattggggccgcggtcaaaagtccgttggaggaaacagccatagatt

SEQ ID NO: 36356 - DNA, 444 bp, Aspergillus nidulans
ccactctacgtccgcttcatccacatgctgcttgccgcccaaggcgtcacagcctcccaagagcgtgtgcagctgcagctccttgactttgcataccgctacacatccggcgtgttacaagatgcggtgcatcttacaacagaaggatacgcggggacgggagcggatactactacaagcagtgggaataagggtccacctgaagtgaactctgtgacattgccagcattacgactaagcatcgcgtcgcgattacactatcagttccagacgggtctaccaaaggagtttctcatggatgttgcagcagagaggaatcgagttgcgctgccgggtgcgacgagggggtttgacgcgggtgctggtaaacctgcggcaagtaacagtgtgcttatggcgggaatgaggctgccgccggagcggatttgcctcacggcatctgat

SEQ ID NO: 36357 - DNA, 1160 bp, Aspergillus nidulans
aaatcgggcgggtggaagctgaagaatgtcgcactacgtccgctgcgcgaaaaggaactcctcgtcgagatggtcgcgtccggaatctgccagacggatctccatttcgcggggatggagaccgggtatggagtgcattacccaagggtaatgggtcatgaaggtactggactgccccgctggtcattggccgttctgctcacctatctacaggcgccggatacgtgcgggctgttggaccagatacaacagtcgccagagtcggcgatccagtcatcctgtctttctcggcctgcaaggactgtgagccttgcaagggcggccatccggcccattgctccaacttcaacgctatcaactttgaagctgtcgcggaagattacgtctttcgcgacgcctcttcgccagagcctgcttctggcggtgatatctacggcagattcttcgggcaatccagcttcgctagtctgtcaatcgtccagcaagactcgattgtcaatgttgctggggtggttaagagccgacaggatctggcattgctgtcaccgttgggctgcgggatccaaacgggcagcggcgctattatcaatgcggctggtgcacgtcctgcagaccgcgttgctatcatgggcctggggggtgtcgggttgagcgcggtcatgggcgcgaagattgccggatgtacgcagattatcggcattgaccggcacggatcgagactcgagctggcaaaggagctgggtgctacccacgtcgttcaggtcgccgagggaatgcccctagacgaggtgaccgcggctgtgaaagctattaccggtggcctgggctcgaatatcaccctcgacaccaccggcgtgcctgccttgatcgcagagggggtcaagatgacggcattcaagggcaagatcctgcaggttgggacagcacccgagacagccacactgtcgattcctattcacgagttcatggtgtctgggaaacagtttattggagtcgtagagggcgatgtcgtaccgcaagagtatcttccaaagttgctcaactgggttaatgagggtaaactgcctctggatcggatcgtcaaattctaccaggccgaggcctttgagacggctatccgtgatatgcagtccggggtgacggttaagccggttatttta

SEQ ID NO: 36358 - DNA, 958 bp, Aspergillus nidulans
attgaggggcctttcggcatccacctatggccgatattcgacaaggcctttcaggccgttatgggctaccctgccagcgagttccagttcgttgagggcaagacgccgatgtcgaccttcagggagacggcaatcatgctcattgtttactacgtgacaatcttcggaggtcgcgaggtgatgagaaaccgcccggctttcaaactcaacaccctgtttatgatccacaacttcgttttgaccgccgtcagcgcgattctgttggccctctttgttgagcagcttgttcctaccatctggaaccatggcattttctactccatctgcgaccaccgcggtggatggacgcagcccctgattgtcctgtactatgtgagtgtgtcggttgcatgggaatgaagcgctactaacaagagtagctcaactacctgaacaaatacctagagttcctcgacaccgttttcctgttcctcaagaagaagcctctgactttcctccacacctaccaccacggcgccaccgctctcctttgctacactcagttgatcggcctgaccgccgtccaatgggttccaattactattaaccttttggtgcacgttgttatgtactggtattacttccagagcgctcgcggtatccgtatttggtggaagaagtacattactcgccttcagatcatccagtttgttattgacctcggtgagtctctgctgcgcttgcgtggaccaatctggacccgtggctaaccgcaactttagtcttcgtttactttgcgtcgtacacctactttgcatccacctacttcccctgggctcccaacgctggcaactgcgccggtgaggaattcgctgccttcgctggaatgggcatcctcacctcctacctcgttctgttcatttccttctacatcgtcacctacaacaaggctgctaagaccggtcgcccgcgtcgcaac

SEQ ID NO: 36359 - DNA, 1499 bp, Aspergillus nidulans
atttactacctcgcagccgtcgtctgtgccggcggtctgctctttggctatgactctggtgtaattggtttagtctctcttttctcagctctaccatgtttaatgcggtccgttaataagcccgttaggaggcgtcctcacgttcccttccttcgcagacttcttctaccccagcgccagcaccaaccaaagtgagacagatatcagcgcactcgccgtagccacccagcaagctggcgcactcctaggctgtctggtcatttggccggtgacaaactctgtcggccgccgaaaagcactagccctctgctccctcaccttctgcatcggcgtgcttttcgaaatcctcaccctccattcccttgcgctcttctacaccggccgtatcatcgccggcctcggcgtcggcggttccacgaccgtcgcgccaatatacctcgccgagatgagtcctcctcatctccggggcagactgggcagtgggtaccagtttacctttacaatcggtatcttcgcgagctactggatagattatgcgtttcggctgctggtggatgacgcgaactcggcgcagtggcgggttccacttgccctgcagcttgttcctggtgttctgatgggtgcaggcgtactgagtctcccggagagcgtgcggtggctccttggtcgaggagaaacacatacgcatgaggcatggaacagtcttgtttgggttcgaggcagtgatcaaggaggccgcgtgggtgacgaattcgccgacatgaaacgcgctgtgcaccgcgatacagaagaatcagccgactttcacccgcgcgagcttctcctccgtccgaaccgccatcgcatcttcctcgctgtgtccctgtttatcgcgcagcaggccacaggcgcaacggcaatggcgtactttggacctcagtttttcagcattttagttaacccaaaccctcagccctccgaagcagcatcagcatcatccaattccttaactctcctcttaacaggaatctttggcgcccttaaggtcctcagctgcctatcatttatcctttttattgcagaccgcttcggccgccgaccacttctcatatttggggctctgggaatggcattctgcatgattgcaacttctgttcttgtacattcaatgcctattcaggaccaaaaatccctcatccaccatatcagcaaagtccctaacaacaatcctcctaatatacctctttattgtgatctacaacacatcctggggtccgcttccctggccgctcgtcgcagagctcttcccgacccggacacgctcaagcggagtggccctcgcagttgcaagccagtgggcgagtaacctcgtatggtcatttgcgaccccgtttatactgagggatgtgggtgcaaatacttttttgctgtttggaggcgtctgtgtgggggctgcgggattcgttagactttgtgtgccggaaacgagggggttaagccttgaggaggtgcaagggttg

SEQ ID NO: 36360 - DNA, 1071 bp, Aspergillus nidulans
tctattgccgacgaactgctcctggtcgatactcgcgccgcatggcgagacggacaggtgcgcgatctgtccgacgcggcgtacgcaagccgcagcaagacccgcgtctacagcgcgacataccgcgaggccagccagtgcgacattgtggtcatcacggccgggtccaagtacttatacggtaggtgtctggcatttcccagcatcctggctagtggtgacggtgactggacttgcatgggaacaggtcaaaccagcatggactatttgtaccgcaacaccagcattgtgcgctcaatcatcaacgagatgaaaccgttccggtccgataccgttctccttatcgtcgcgaaccccgtcgatctcatgacctcgctggcgaaggagctctcgaacctgccgtccgcgcaggtcctgggttccggcacgttcctcgattcgatccgccttcgcgggcttctggcagacgaaaccggcgtaagtacaaccttaatcccgctggccgtgcctgttggtgaacacctttttcacttctcattttttttttcatttttttgtcccacttgcacaactgccatcttgaccgctagataagaactggttgcttcttccgttgtaaaaatgtcaacaccttgaacatgccactgatcgtctagcttgcgcccaactccctggacctgtatgtcctaggcacccacggcgactcggcagtggctgcttggtcgtgcgccgcagtaggcggagtgcccctgaaggatgcactggggctggagaagcgggtcgaggagagcctcgtcgaggagtgcaagcaccgctcgcagagcattgtccgtgccaaaggagcgacgacgtttggaatcgggtcgatcgtgtgtagtataagaaaagtcggtgctgctgggcaggcacaacgtgcggccggtcagccactaccagccgcagcacgggtgctgtttcagcttgcctgctgtgctggtgaggaagggcattgtgcagacatttcccgtcccactgtcagcggcggacgaggaagggattgcgcagtcggtgggagcattgaagagtacgctt

SEQ ID NO: 36361 - DNA, 2397 bp, Aspergillus nidulans
cctacgtgacggttcaatatgtcgagccctgccaaaaagcgcaagagagacacccagcccacacgcagcatcgcgtcattcttccagggccaaacggccaagcagactgagaaatcggagcagttagcttcgctggcagacacagaacagcatctatctgacgaagctcttgctcggaagcttcaggctgaatggaataacgagcaagatttcgcgtctcccgcgactgtacctcattccgaacctaccgccgcatccccctcaccagagaaggatcgagaacagaagaaggccaaggttggagtgctctcattgcagtcatcaacaggaaccgaggacacgatatctttatctgtccctttcgatcagagccctttggtattcgattcctctaggtacgctggagagttgaaagcgcactggtcggcggagggtgggaatgcttcgtatgctcttcttactagagcattcgttcttgcaaattcaactaccagtcgtatcaagattgtcgatacattggtcaactttctccgggttctcattgaaggggatccttcgagcgtactccccgcagtatggctggcaacaaactccatttccccgccatatcacgaactcgagctcgggctcggcgggtcttcgatatctaaagccttcaagaagatctacggcctgaatagccaagggcttaaatcgttatatgataggcttggtgatgccggcgatgtggcgtttgaggcaaaaaaaaggcagagcttcaccttgatcaagcctaaaccattgagtataaaaggcgtctatcaatctctgataaagatcgctatgagcaagggcagcggaagtcaagaattgaaacaacgtatcgtggagaagcttttacaggacactcgaggtgcagaagaaagtcggtacatcgtgaggaccctcgtccagaacttgcgtatcggtgctgtaaagacgactatgcttattgcgcttgccagagccttcctagtctccaaaccagataatgcaacttttactgtgcatagtcaacacgaactagctcgcctcaagaaggaagaactcgcagaaatctatagcagcgcagaggagctggtcaaagcgtcttatgccagacatccgaattacaacgaccttgtgccctgccttctcgagatcggagtcaccgaggaacttctgctacggtgcgggttgcagcttcatatcccactgatgccaatgttgggtagcattactcgcgatctctcggaaatgttgacaaaacttcaggggcgagatttcacctgtgagtttaagtacgatggacaacgtgcccaggtacactgcgacgaggcaggcaaagtctcgatattctcccgacatctagaagaaatgacagaaaagtaccccgatcttgtgtctcttgttcctcaaatacgaggagaaggtgtttctagcttcatcctagaaggtgaagtggttgccgtcgatcaaaacggagagctccaaccttttcagattttgaccaaccgagcgaagaagaatgttgacattggggaaatcaagatcaatgtttgtctttttgcctttgatttgatgtacttgaacggcgcacccctgctggaacggtctctgcgcgagcgaagagaattgctgcgaagtctctttatggagataccgaaccgctttacatgggtcaaaagcctcgatgctacgtcagccgattccgaagccgttctggactttttcaagagtgccacagagaacaagtgcgagggtataatggtcaaggtgctcgacaatacgcttgccactaatgggtccgacagcaccaactctagcatcactgcaacgccgaaagcagaagcaaaggaaacgaagaaaggtggccgtcgaaaagctttattgtcctcgtacgagcccgacaaacgactcgaatcctggctgaaggtgaagaaagattacagcgcctcatcagaaacattggaccttatcccagtggccgggtggcatggcaacgggcgaaaggcaaaatggtggtcgccgatcctccttgctgtgcgcaaccccgaaactggaggcctccaagctgtgacaaagtgcatgtccggcttcagcgataagttttaccaagcgaataaggaaaaatacgaggaggggagtcctaatgtgatatcgcggccgagctacgtcgagtataatggtgagccggacgtgtggttcgaaccacaagaagtctgggaaatggcatttgcagatatcacgctcagcccgacttatccagctgctattggcttggtaagcgacgaacgaggtctcagccttcgctttcctcggtttctcaaagtccgagaggacaaatctatcgatgaggcctccacgtcggactaccttgcgctattgtacagaaaacag

SEQ ID NO: 36362 - DNA, 1404 bp, Aspergillus nidulans
  unsure (1)..(1404): unsure at all n locations
caacttcagcgacgtctgtctaaccggcatatccagcttatcgccatcggcggctcaatcggaacaggcctgttcatcaacatcggtatggggcttgccagaggcggcccggcaagtcttctgattgggatcatcatccactgctgctttatggcgctggttaacaactgtattgcggaaatgaccgtgttgttcccagtaagtggagggtttattcgcatggcagacaagtgggtggactcggccttgggcttcatggccgggtggaatttcttcctctatgaggccattctcatacccttcgagataaccgcccccagtattgtgctacagtactggagagatgatatcccttcggctgccgtcacagcagtgacgattgccatgtacgggtgagtgacgttaattagaagcgaggcggccggctaacctcaaatttagtgttcttaatctgctccccgttgggctttatggtgaaactgagttctggctgtcgtctggcaaggtagtcttggtgtttatcttattcggtttcacgttcttcaccatggtgggcgtcaacccccaacgcgatgcgtacggtttccggtactgggtcagtccggggccgctggcggaatggcatactggcggagaccttggtaggtttgaaggcctgctgaatgtgacctgggttggtacctttattgttgttgggccggaatacctgtccatggcggcggcggagacgcgtcatccccgggtttacgtgaagtctgcatacaaggctgtttatttccgcttcggcctcatcttcaacggcagcgctcttgcagctgggattgtgttccctacaatgatccagtcctgcaatcccttgcacgcggtgaacagagcagcagctctgcggcggcctcgccatatgtggttgctatgaagcatctggggatcagtgtcttgcccgatattgttaacgcactcatcttcacaagcattttgtcagctggtaacacgtacactttctgcgcgatgcggagtctctacggcatggcgcttgaaggcagggcacctggattcttgagaaaatgcaccaagggaggaataccaatctattgtctcggtgtcacaacgttgctctcgtgccttgcatttcttcaggaatcgagaagctcccacgttgtgctgcaatggttcgtcaacctagttacagctggctgtataatcagctttatcgtcatctgtatcacctacctacggttcttccgggcgtgcaaggtccagggcgttgaccggaagaattttccatactatgcctacctccagccatacggggcctggcttggccttttctggacggtctttgtggttctgggatatgggtactctagtttcaccccatggaatgtgggcacattctttnctact

SEQ ID NO: 36363 - DNA, 1032 bp, Aspergillus nidulans
tctgacctgaatcgcctcaatccaatccatgttgccggcacgaaaggcaaaggctcgacctccagtttcatctcctccatcctctatcaatttacgccttcgcaatcatcttcaccggtattcaacaaggtcggcctgtatacctctccccacttgcgattcgcccgcgaacgcatcagaatcaacaatgaacctctttccgaagaactgttcgctcaatacttctttgaagtgtgggaccgccttgatgacgctgcccgagcggccggggaagatccaaacaacctacagacgaagccccaatatttcaggtatctcacgctgatggccttccatacctatctgagtgagggcgtggatgcagccgttatcgaatgtggaatcggtggagaatatgattgtaccaatgtcattgaacaaccagccgccacagcgattacaagcttggggatcgaccatgttgctcttctggggaatacgattgaggagatcgcatggcacaaaggcggcatcataaaggcgaacactaaagctttcagcgcgccccaaccgccaagcgcggagaaggttttacgtgaacgtgctgccaacaagcacactgagctggaattcgtgtccagtcatcccgatctaaagaaaaatggcgatattaaactcggcctagctggtgactttcaatatggcaacgctgcgctggctgttgccactgctggagaagtccttaagaaggtagggaagctggatatcagcgctggcttcagagagcagtccctccctgcggagtttcgcaaaggtcttgaacaggcacaattagagggaagatgtcagaccaggaaggaggaaaacgtcatctggtatatagacggaggtcacacgcaggaaagcatcaagctagccggtcagtggttcgcatcacaaatcaaggcagactcttcgtcggaagcttcagcagcgaagaagctacgggtcctgatcttcaaccagcagactcgcgatagcaacgcgctggcccagtctcttcacgagaccctc

SEQ ID NO: 36364 - DNA, 1360 bp, Aspergillus nidulans
aaacatctgaggatttacaccggcatcttggaccaagataacccggcggaggatgcaccactggtctatgcttcggacattctcacgaagccgcgcttgtggaacatttacagaatgggaaatggacggaaaagcttccttctcagtgacggtgatatcctccggctttcggagagggtatatctgatttatcgctctctcgataatgcacagcacacgtattttgatcctttccaggttcatgagatgagggtgagtacttaccaatgctgttgacaagtactcatgtgttgcaggcattctcccacgaatacgttatcacgcggcgcaagcttggctctggtgcttatggacaggttcatatggcgtacaataagagtaccggacagcagttcgcttgcaaaattgttaacctcctcgcagtcaagcatcagctggccaaggtaggagaggcacgacacgagctggcatttgggaagaatattagtgcgaagatgaaggacagttatgtcaggttccagctacaggagactcttgagaaataccaccgcgaggcgaagatacttgaaaccctgcaacatgtaagtttggcttctatgtacctttcctagctaacctatgaagccgaatatcattggcttggagaaggtgtatattagtgacaataccatgtgagtttgatgtcgagaaatcaatattctgttctgatatgagtagatatatgttccaggatcttttgaccgctggagacctattctcctacatccagtacaaaggtgggagactgcctgacatcgaagcggccgttattgtgcgtcagattgtcatcgcccttgattatctccatgacagaaacatagtccatagggacttgaagcccgataatatcttgatgacggccctggccgacggatgtagagttgtgctcactgatttcggatgtgccacctttgtcgacccgatgacaaatcgaatgctgagtacggttggaacctttgagttcagcgctccgtcagtactattcgatccttggggatatcacgcactgatcttgtatagtgaggtagtgaggcagaatcgtgaaggatataccaaggccgcggatctatggtctctaggctgcttggcggccgtccttctcaccggggaacctgtgtttgataacatgcgcaatggccatgatgaaaactgccggctgaaagctatcgaagagctaaaggtgaagatgcatcgacttaatgtgggcgaccgagctcaagacttcgttttccggctacttcagcaagatgtacgcaagcgcatggatgtcaaacaagcactgcagcatatgtggttcaccaacccgtcgcacaaggccgat

SEQ ID NO: 36365 - DNA, 1488 bp, Aspergillus nidulans
ctcgccagggggtttgacgctcaggtcaacggggcagtgctctccattccttctttccggcgtgattttggcgagcactttgaaggagacttcgtagttcctgccccatggttgagcgcctttaattcgatctcatctgtcggacagttctttggcggttttctctgcagcgccgttgccgaccgagtcggccgaaggctggctttggcggttggagtgatgatctcttgcggaggcatctttggggaattattctcaaccgctagggttgcatttcttattagcaagctgattctaggagttggcctgggcttctacctaaccatcgggccgctgtactcttccgaggtgagctcgacgatcaggaaatgcgtcacaaacgccagtcactgacaaacgaaaggtctcgccagtcgttctgcgaggtattacaactgcaggggtgaatctgggcatcgtgatcggccagttactctccaacgcggccatcaagggctttggcgagcgaggcgaccggtgggcgtacaggggcccgttcgccatccaattcttcttcgtgggtatgtctatttccaacgtctaatgtctgatagagcaggctcaccaaacttgaccgcagtgttcttgggcctagggcttccattttccgtcgaatccccgtggtacctcgtccgtcataacaggatcgatgacgcgagaaatgccctgcagcgactctacggcgccggcacaaacgtcgacacgaaactcgtggctatacgaatgacagtggcccaggacctcgcagcgagagaatccaaatggtcgtatgctatccgtggcccgaatctccttcggacaaccatatcctgcggcgtctttgtttgccagcacttggtcggcatcattttcgtgctcggcttctctgcatatttcttccagctagcaggtctgcctactgagcggtcctttgaccttggagtcggcgtcactgcctgcggtgttgtgggcaccataatctcgtggttaatcgtcaatcgcctgggtcgccgcctcatcttcaactctgggatggccatcctcagcacgatcaatctcctcattgggattcttgacgtcgttccgacgagcggggctagttggacacaggctgcgctcacagtcgtctgggccttcttctaccaagtcagcattggcgccgttgcctttgtccttctcggcgaaacctcgtccccgtcgctgcgagctaagacgaccgccatggccacggcgacccaggccgtatttgggatcgtcatgaacatcgttattccctacatggtgaatcccgatgaaggcaacatgcagggcaaagtcgggtttgtctttggagggctgggcgtggttgcgacggtgctctgttacttgtatattccggatctgaaggatcggaccttcgaggaaatcgacctcatgtttgagacccgcgtggcgccacgaaatatggggagatatgtgattgagcgctag

SEQ ID NO: 36366 - DNA, 1482 bp, Aspergillus nidulans
ccttgaaacgacaacagaaggaactagagcaatcggccctcgattctggacgaccaatggctattccgatgaaccgacagagtagccataacaatactctcgagagcacagaccacagaggacatgctcctatcacagatccacactggaaccatgaagcggtcttgtaagattatcttcttatccctatactttttgtcttcaaatgttgcagtttcctgatctttgttgctatctagtgatgttttcggtgaccagtctgaaattgacgtctccgtgtatgaccgcaatgactcggaagccttcctaggccatgtgcgactctgcgtgaatcttaaggaagataacagtcgcttggacgggtggtttcccttgaaaggtcgggcagcaggggactcccgagtttccggagagattcatatggaaatgaggtttgagaagacggagaagaagcaggtcggaccaaatgactttcaaatcctgaagctgatcggcaagggaacctttggccaagtctaccaggttaagaagaaggatacacggcgaatttatgcgatgaaggtgctctcgaagaaagttatcattcagaagaaggaggttgcgcacaccgttggagaaagaaatatcctggttcgaacagctatggctgcttctccgtttatcgtcgggctcaagttctctttccaaacacccacggatctctacctggtcacggattacatgtctggaggtgagctattctggcatctccagaaagagggacggttccaggagccccgcgccaagttttacattgccgagctcatcatggctttgcaacatctacacgaccatgatatcgtataccgtgacctcaaaccggagaatattctgcttgatgccaatggtcacatcgcgctttgtgatttcggtctgtcaaaggcgaatcttacgcagaacgatacaacgaatacgttttgcggcacaacagaatatcttgccccggaggtactactcgatgaacaagggtatacgaaaatggttgatttttggtcactgggtgtcctcgtctttgagatgtgttgtggctggagtccgttctacgcggaggacacgcagcagatgtacaaaaacattgccttcggcaaggtccggttccctcgtgatgctttaagcacggaaggacgcaactttgtgaaaggcctgctcaaccggaatcccaagcaccgcctgggagcccagaatgacgcgaaagaactcatggcgcacccctttttccatgacattgactgggaggcactgggcagaaaagaggtcatcccaccgttcaaacccaagctcaagtccgacacagatacgtccaactttgacccagagtttaccaacgctcttgaaaacagtaactcgctaaatgaccgagctgcagctcttgccaatgggtttatggccgcgtcgacgccgctctctccagggatgcaagctaatttccaagggtttaccttt

SEQ ID NO: 36367 - DNA, 1423 bp, Aspergillus nidulans
tacctcgaaagcctccccggaactgtctttttcaagctataccagcagccgtccaccgctctcgctatcttcaggcgcatgctgcctgacctgggtatgtatattatgtggtcggcgattcacttcgatctcggttaatctcacacatatgacggtagcaaaatgcttcgttatggcgcttctctatttgaaggatccgcttccagcagcggacctggaaacttgggtcagatctgagagcctgaggtgagtctcctctcaatctggtgtctgcgttctttgaaaggctaacaggttatctttccttagagagcgggatagtgcgctatcaatactggcaaggttacatattctcacgaatgcgaccaaaaaaggttccgtccgcgcttacatggtcaccgatcctttcgctgcatccctccgacaagcactcacgggtgcgaaagaaacccagtcctttggttgcttcaccacataccggacgaccagactgttcccattcacgatcttgatgagtacgcgcgccgacagtgggagggtgttctcggctacatggttggaaccagtgggctagggattcaacgcgatgtgaatttgagcaaaggcgtgaagcagcttctgcaagccggacatctggtggagatcagggatcgccgtgttgagataactcaagatgggttcgcattcgtcctccaggatgtgggcacgcaggtctggcatatcttgattctttacgtcgaaagtgctgaggccatcgggatggatagcgtcgaagtgctgtctttcatattcctcctcagtagcttggaactgggcaaatcctacgaaaagaagcacttgacatcgaatcacgtccgcactctaaccgatttagcagactttggtattgtctatcaggattctcctgaggcgagccatttctaccctactcgtcttgcaaccactcttacgtccgactcaagcgccctcagcaaccccatctctggcgcactctccgatccggacggcggggattccaaccaaccgggttctggattcattatcattgaaacgaattatcgactttacgcttacacttcttcgccgcttcagatttcgcttattgcgctcttcacgacactcaagtaccgcttccctaacctggtcacgggaaaagtgacccggcagtctatccgccgggcgattgaaatgggcatcacagccgatcaaattatctcttaccttgctacccacgcacacccgcagatgcgcaaacacaatgtcgctcgctcgacatccaaccaggctggaatgccaccgtcagtccttccaccaacagttgttgaccagatccgtctttggcagctggagcgtgaccgtgtcaaagctacgagctggatttctgttcaaggattttgtcagccttgccgagtacgaggctcgg

SEQ ID NO: 36368 - DNA, 795 bp, Aspergillus nidulans
atgaaaacttgatattcgcggcggctgtgggctgtggtttactgatccccatgcagacgataccggaccatggaggccgctgcgaatcgcttacagaaggaggctaagggatacttggactcattgcgaggtacggcaattgtaaagcgagttgatgtgcggtcggtgtgctgattgttcgctcagccatgacggcttcgcagatgcgcattgcggaaacgatagatgctttctacggtgatgccggggccaaagacggcgtgagcaggagctacaaacaggctgtcgaagacctggatgccgagaccatcaaagcactggatggtccttacaggtacgattctcgtttttctgcgcagagtgtttcgtcgctgactgacatgccctaggacaaccgtgcttgatccgatatcccgcttctgtgcatacttccctgatgttaacgagtgcatcaagaagagaaacaacaagctgctcgattacgatgccatgagggccaaagtgaagcgactggtcgaaaagcccgacaaggacgctacgaagctgcctcgcactgagcgagaactcgagatggccaagcaggcgtacgaacagctgaatgaacaactatttactgaacttcctcaacttattgacttgcgtgttccgtacctcgaccccagctttgaagccctggtgaagatacaactgcgcttctgtgcggaagcatactctcgtatggctcaagtgcaacagtatctcgatgccgagacaagagaccaatacgcgcggggtgatttggataacagggtagaa

SEQ ID NO: 36369 - DNA, 855 bp, Aspergillus nidulans
gagattcgcggccgactcgccctcatcactggcgcttctggagggtgagcccaccccttcacaccatctcagtgactagggctaacatgcgcttaggataggagcggcctgcgctcgccaactcgctgagaaaggcgttcacctagcattaacatatgccagcaatctctccgcaataacctccttgacagagcaaattaaaacaacgtttccagatctgcgaatttccatccaccaagtcgacgtggcatccgcagaacaaatccaagacatgtttcttcaaatagataaagagcatggccagcgccccgatatccttgtctcaaatgctggatacggaaaacgcgtcccccaagtttgggacatcacattggaggaatttgactacactataaacgtcaaccttcgcgcctccttcatcctggtcaaaggcgatgatagaacatatgcgcaatcaacgctggggccgaatcatcttcatgtcttagatagctgcttctggtggggggataactggctgccgtatgtgctttgtttctcctgccttcaattttgaatcaacgactaagatcagtacgtgcagactacgcggcctccaaaggcggcatgacaggcatgatgaagaatctctccacacgtcttgcagagttcaatatcagcgtcaacgacgtcgcgcccgccatgatcggggacaccggtatgattcctaatgctcaggcgatcccagaagttgcggcaggtattcccataggaaggctgggtgtcccggaggaggtggctaatgtggtaactatgcttgctacaacggggtatatgacgggacaaagtttgttgttggctggagggttgaaatag

SEQ ID NO: 36370 - DNA, 1401 bp, Aspergillus nidulans
ccagttttctcacttgaagagtacgagttctcggcccaaactggctttcttcctgagactcctcctctgcggtgcttgccagaccattattacgctccctgtgagaccgttgcccaagatttggctgctagtattgaaaacggtactattcgccaggctgtcgagagtctgccgttgctcaataccacgaaactgcgcaccaagccagaatggaggagagcctatgtggtcctttcctatcttacacatgcctatgtttggggtggtgaaatccccaaggaggttggtgttttgtcctctaggcatttgatatggcttctcactattagtgtcacgctaggttctgccttctgctatctcagtgccatacctggaagtttcacgatacctagagctgccttctgtagcaacatatgcagcccttaatctctggaactggtcaacttcatcacccaacgatgacctcacctgtgccgacaatctctccgtcacattgtcatatactggaacgaaagacgaggagtggttcttcatggtctctgtcgccctggaagcgagaggagcccgggtcatcgaaatgatgctaaacaccatccaagccgtgactgtgggcgacgaccagagaatagtcgcatacctcaaccagattactgaaggatttaatgagctggctcgaattctggaacgaatgtacgagaagaaccgccctgccgttttctttcacttactccgtccgtacctcgctggaagcaagaatatggcatctgctggtcttccaaacggactgttctttgaccaaggaaacggtaagggtgaatggctccaatacagtggcgggagtaacgctcaaagctcccttatccaaacttttgacatttttttgggcgtcgagcacacagccatgggaggtcccactaagactgagcttccaaaggcaaaattgggaaagactccatacatccaggtatgccaagtcacctttctcgggctgttgtttatgagcaatcagacattaatgatctattgcaggaaatgcgaaactacatgcccggaccccaccgacgcttccttgaaatgctcactcgaaacgccaatctccgtccgtatgcgatgagctgcaagctcggctcacctgtgagagatgcttacaacaccgccgtcatggctctcggctcgttccgcgacaagcacgtacagatcgtaacgaggtacattatattggcctccaagctccctcctccagcgaacacacctgtgcggataaacctggcttcgacaacgcaaacccagatgaaggactcgactgagaaggtttccacaggcttcagcggcacaggtggaactgatttgataccctttctgaggcaaactcgtgatgacactaaggctacggcgtactat

SEQ ID NO: 36371 - DNA, 1740 bp, Aspergillus nidulans
ccggaaccacagacccagcgtacaagtgcgaatcagagcactccggatgtctcgagcaccctttcactggggacaccccatccaccactaccaagtacgggccgctcgcgctcgatggagcgagctcagacaatgccaacagagagcccagccgcctccagtagtccaacggcacccatagtccggccggctgacatctataagcggatgcgagaggagcagcaggaccgccgaccatccccggctgcgccatcgacagacgaacgcgcttcaggaggtgttacagttcttgagtcttccgagaacacagtccctcctgccgctcaagccccagagcctatttacgaagcagaacaagccagtgtcaagaaagcgagtacccccccggcagcatcgaacgaccccccggccctctcattgccagaagtgaagcgcttatccgcgttcggttctggtttcttcagtgaacccgaacgcgaccctcagaacaaccaggaaccgggagatcaaccacatcagttacatcacaatccgtctctcggcttccgctccgccgtcaaccaagcttgggatgggcgtgaaactccaagtaccgttgctgacagcatagctcgctcaaatagcgatagcacggtgggcataagtcccatcattccccgtcgcgggaataccgatgacaaaaccccgaccatccacgaagagccgaatgagaatacagaaacgccgaccgaaggcaacatggtcttcaagccagggcatcgccgggatctaagcatacccagccctggcaacagtccttctcgcaggccggtcgttgctgggcccgatgccactgcatcgtccgaactggctcaaatatcctctggatcaccagtggagtcccctctggccacgcagcctcagcagcacgtctttaacccggatatcccacaaccctctcgggaggctacgaggggtgacttgcctgcacctcttaacgttcagacaaatattgtctctaatccggctgtatcaacagacattcctgtaatcataccggcaatgagtacggaaaattctcctgaagatacggagaatgatcggttaagaaaggagattattcgttccctaagcagagagaactcaccctccgacaaccaggagaatggcacgccaccccataccagtggagagaataatctactcccgagagaatatgaggcccacagggcggcaccgcaaaccgcaacttccccagggtcagaaccgtctggaccgacatttgatactatcctggcgacatcccaagctctttcaactgggaatttaactcctcccccatcgcacgtctcccagcctaaactcaaaaaacgcttctcctgggaagaatcgtctgaagacgaggatcctgttcctgtcacacaagcccagcccgctcgaccgccaccgatgcccgggcagttccccttttcgcaagatagtgtcctcccggaatccgtggtagcgcccacgaaacaacaatcagagatagcagacgcgtcagaggagagggttggacctcctacacctgagaaacctaagcttactctcgtaccgccagtggcgatggatgctcctagcattccattgagtgaccatggccatgagcctgccctttcccagactacagagacacttgcccgggccgaagagggagactcgtccagccatatgccgccaaccctggaacgaccaacgcacacaccgcctgtgtctgacgag

SEQ ID NO: 36372 - DNA, 330 bp, Aspergillus nidulans
caggtatcctttttgagatcgggccatgggtgcaacgtcgactggaccgatcacatggactcgactccgttgctgctagcagccgaacggggccatcttgatattgtatctttcttgctggaaaagggcgctcagactaaccatacggacttagagggcaggacggcccttttctgggcctcgaaaggcggccatatgggtatcgtccgtgttctggtcgcacagggcgccgatttgaacagggctgacgagtacggacggactcctatgttggctgcagttcagcacgggcgcaccgaggtggtccagtttcttctggatgctggtgcc

SEQ ID NO: 36373 - DNA, 934 bp, Aspergillus nidulans
tcaattggttattaggaatggggaactggtgctgtccgccctgagcagggtattctcaacgtgcgcaaggaaatgggcactttcgccaacttgcgaccatgcaatttcgccgctccctcactagtagagagctctcccctccggcctgagatctgccgcggcgtcgacttcaacatcatccgtgaattgactggcggtatctacttcggtgaacgcaaggaagacgacggcagcgttcgcccttgacacggaaccctactcacgcgctgaaattgaacgcatcacccgtcttggtgcccacctcgccctgcaacacaaccctcctcttcctgtgtggagcttggacaaggccaatgtccttgctaccagccgtctctggcgtaagacggttaccgaaatcatggcgaaggagttccctcagcttaagcttgagcaccagcttatcgactccgctgccatgattatggtcaaggaccctcgcaagctgaatggtatcgtcatcaccagcaacctgttcggtgatattatatcggacgaggctagcgttatccccggatctttgggtctgcttcccagcgctagtctgagtagcattcctgatggaaagggcaaggttaacggtatttacgagcccattcacggtatgtattcctatgttattgcacctctcgaggattgatatgctgaattgattttactaggctccgcgcccgacatttccggaaagggcattgttaaccccgtcgctgcaatcctctcagtcggcctgatgatgcagtactctttcgccctcttcgaagaggctcgcgcggttgcgaccgccgtgagcaacgtcatcgaggccggtgtccgcactggtgacattggcggcaaagcttccaccaaggaagttggtgatgctgttgctgctgagctggagaagcttctcaagaaa

SEQ ID NO: 36374 - DNA, 1116 bp, Aspergillus nidulans
tcggtgttgaaggtggttgatcccaatactgcggagaacgtggatctcaggaatatccgcattgtgaagaaggttggcggaacaatcgaggacagcgagatggttgacggtctggtcctcaaccagggtgtaatcaagagcagtggtgggcccacaagaattgaaaaggcccggataggcttgatccagttccagcttagcccgcccaagcctgatgtacgcctctgcctaaaaaacttttgatccgatactgacggtttacagatggagaaccagattgttgtgaacgactaccgccagatggacaagattctgaaggaagagcgccaatatttgctcaacatggtcaagaagatccaaaagacgaagtgcaacgtccttctaatccagaagtccattctgcgtgatgctgtcacgatctttatctacacttactttcccgattaagattctccgcctcaagacattgacgtgaccagtcgagttcctgtgcagagtttggctgcatgcccgtcgccaacgtcgattcgttcacggaggacaagcttgggaccgccgatctcgtagaggaagtccaatcgtctggcgctcgctacgtcaagattaccggcatcaaggctcccgccaccacggccaaccagactgtctccatcgttgcccgcggtgccaacaacctcatccttgacgaggccgaacgctcgcttcacgacgctctttgcgtcatccgctgcttggtgaagaagcgtgcccttatcgccggtggcggtgcccccgaatcgaagtcgctaacacccttgcaaagcgcgcccgggaactgactggcacagagtccatctgctggaggcatttgccgaagccatggaagtcatccccaccactctcgctgagaatgccggtctcaactccattaaggttgtcacagacctacgacaccgccacgcccaaggccagcagaacgctggagtcagcatccgtagcggtggtgtaaaagacgatatcactgaggagaacattctgcagcctttgctggtgagcaccagtgccatcgaactggctgcggagacggttaagatgattatgagaattgatgacatcgccctttcaaggtagagggtg

SEQ ID NO: 36375 - DNA, 1540 bp, Aspergillus nidulans
catgaagccgacgacgactccatcgagaatattgccaccagctggttcgtctggcttgtctcccttacagcatctattgcgggcagtctctttggctacgataccggtatcatctccgctgtcctggtctatctgggaagcgacctcgatggacgcccagcgtctgagaacgagaaacaattgatcaccagtttatgctccggcgggtcttttgtgggcgccattattgccggtcttactgccgacaaggtatgtatgcatgcttattgtctacttcctgggttggttggtactaaccttcatctaatagtttggtcgaaagcctgccatttatgtcgggtgcgtgctatttaccgtcggcgcagtcctccaaggcgcagcatacagtatcgcgcaaatgtcagtcggacgcctaattgtcggatttggtgtggggagcgcctcgatggtagtgcctctctatattgcagaactatcacccacaaaagtccgcggcagactcatcggtctcaataacatgtccatcaccggcggccaagtcatttcttatggtatcggagcagcgttcgcgcacgttccgcatggctggcggtatatggttgggcttggaggcgtcccctcaatcatcctggcatgcctcctccccttctgccctgaatccccgcgccagctcgtctaccacggcaagacacaagaggccgaaactgtgatccgcaaaatctacaagggtgcctcggatgcccaggttgcagcaaaagttcggttgattgttagggcatgcgatgaatcacgagaactcaacaaagactccacgcgctgggccaagatcaagctcctgcattcgaacccggcgtacttccgcgcgctggtgtgcgcctgcggctttgctgtcattgcccagatgtccgggttcaatactctgatgtactactccgccacgctgtttgatcttgttggcttctcagaccccgttgcagtgggaatagttgttgcgggaaccaatttcgtcatgacgtgggtgaacatgatgcttgtcgacccccttggccgccggcgcgtcgtcctcctaaccgcctggggcatgtctgcgggcctgattgctgtagctatcgcattcaagtttatccctgtagacacctcaactctcgaactcgaaaccgataccgtcagcccacctgccattgtcgtgctcatctttatcatttggttcgttttcttctacggcgcgtccatggggaacacagcctggatgaacacagatttcttccccatggaagtccgcgcaatcgggacgatgttccagacttgctgtacctggggctcgaatataattgtatccagcacgtttctgagcatgatgcaggggataacgccgtctggcgcgttcgggttttatgccgctatctgtgggtttgggtatatcctgatttatttcttttaccctgaggtctcgggattaagtattgaggagatcagggaagtcttccaacatggatttggggtggcctattcgaggaaacttcgaaagacaaggaaggct

SEQ ID NO: 36376 - DNA, 1012 bp, Aspergillus nidulans
gaaaccatagcgggattcacggcaggcacagcaacaacactttgtctgcacccgctggatttgataaagactcgactgcaaggtacttttagtccagccactttgcccctcagggtacaacacgtctaatatcaggctgtacacagtcgaccgaacctcatcgtctcgagtcggcagtttctctccgagtcatccgcgaaatcttccacaaagagggcggactcatcgcattttaccgcgggctaacgcccaacctcatcggcaactcctccagctgggcgctctactttctattctacgacaatgtgaaggagattctagggagttggcgatcgcgctccaattcaaatggctcgcagcagcgcccggagccgctggaagcattcgattattttatcgctccgggtctgcaggtgtgtcaacaacagcagttagaaaaagcgagtcaagtaaaactaacggctatgtgtatggcataggaattataacttccatcctaaccaaccctatctgggtcatcaaaacccgcatgctcgccaccggctccatgtcgcccggcgcgtatacctccttcacagcaggcgcaatgcagatacttcgctcagagggagttcctggcttctaccgcggactggttccgtcactcttcggcgtcagtcacggcgcactgcagttcatggcttatgagaaactaaaatttcatcgagcgaacgcacattccgggggtctgcaaagaaaagagctcagcaatatggatttcttcatcatttcaagcgtctcaaaaatttttgccggctcaataacgtacccgtatcaggtgctccggtcgcggctacagacgtatgatgcttatctcgcataccggggacttcaggacgcaattgtaaagatctgggctacagagggcttgggagggttttataagggtctcgggccaaacttgtttcgtgttttgccaagcacctgggtcactttcttgatgtatgagaataccagggcatatctatcgaag

SEQ ID NO: 36377 - DNA, 809 bp, Aspergillus nidulans
gtgattattctcggagacagtggtgtcggtaaaacaagtttgatgaaccaatatgtcagttaccttttattcccaagcagggctcgtttctccgctcacaccgattccccaacaaggtcaacaagaagttcagcggaagctacaaggctacaatcggtgccgattttcttacaaaggaagttctagtcgatgaccgcctagtaacgatgcaggcacgtattcacggtaccgcatgttccattcacaaattaaccaagtggagtagatctgggataccgccgggcaagaacgattccagtcattaggagttgcattctaccggggagctgactgttgtgtccttgtttacgatgtgaataactccaagagctttgaggcacttgactagtggcgcgacgagtttctcattcaggctagtccgcgcgaccctgagagtttcccattcgtaagtcgtcatcgggccgtggttgcgctcggctaatcgtgctttctaggttgttattggaaacaaaattgatatggaggaaagcaagcggatgatctcttctaagcgagccatgacgttttgccagtcgaaaggaaacattccgtatttcgaaactagcgcaaaggaagctgtcaacgtcgaacaagcttttgaaggtatttcttttcagtagtgttacactggaacattgctgatatccgccatagtcattgctcgaagtgctttggctcaagaagaagctgaagaatacggtggcgactacactgatccgatcaacatccacgatactaccgagcgcgacggttgcgcctgctgattacgg

SEQ ID NO: 36378 - DNA, 1739 bp, Aspergillus nidulans
cccgatggtttcaccgacgatccagaccactgaggcaaccgcaatcgtgaaagtattcctagagacacattttcatactctcttatccgggctcgatgcacgaacacagcgtcgattggagctagatcagtacattgagacctttcctctcagcccagaagagtggttcgtgtcaggaaacactgggtcactcaagagcgagattatcttcgccaatatcgagtcctgaagagtcgcccgcaagacaaaacctctcgcgctggaactgcttctctcgcaggcttcgaacccctcaagatattgggaagaggaagtttcggtgtcgttcggctggtgagagagaaacgcaccgacgagcagactcagtcgggtcgagttccgcttgcccccaaaactaaccaccgtcaagcaatgacgggggtgaaaaaggatgtctttgccatgaaagttatcaggaaatcagtgatgattcggaactgccaagaggctcatctgagagctgaacgcgactttttagtcgcttctgctaaatcccgctgggtggttcctttgatcgccagctttcaggaccagaaacatctctatctggtcatggactatatggttggtggtgatttccttggcttgctgattcgacataacatactacgtgagagcattgcccggtggtatgtcgcagagatgattctgtgtattgaagaagcgcaccggcttcgctgcatccaccgtgacgtgaaacctgacaactttcttatctctgaatctggtcatctgaaaatatcagactttggtctggccttcgacggacactgggcgcacgaccagtggtactttacttatcaacgtcactccttactcaagcggttgggcatccagatcgacggtgacgctgaagaccagaaactgtcgcacgacgcaaacatacagtcccttggcacaactcgtgaggatggaagcatggaagatgactggattcaccctcccaccaacggcctcctgcactggcgtgacaagaaccaaacccgaacgatggcaagaagtgtcgtcgggacgagtcagtacatggctccagaagtcattcgcggccacccttatgacggtcgatgcgattggtggagcctcggcgtcatactatatgaggtacttactttttctctgcctttctgcttgtcgctcgtttaacatccgcatagtgcttgtatggtttcactcctttcgcttccgaggatcgtcatcagacaaaactcaagattcatgtgagtggtctccaatatagcttgttcattatgtctgggttttgctaatatagcatgaaaaagcgtcacctccagacattgtacttcccagtccaccgacccacggacaaactggtatcagcagacgcgattgatgtgataaactcccttcttcaagagaaggagttccgcttgtcttcacccaaatacaaacaaaacgacgctattagttccaagccggcaaagtgttccttctataagccggactcttcgaatccgagttatcaaggtcattacgtctaccccgatgatgcgacagatatcaaatctcaccggttttttcgtgggattaactgggagcagattcatcgcacgtctccaccttttattcctatggtcagagggtgggaagacacacggtatttcgatgacggcgaacatcctagcgaccgcgaagacgactcttctgactccgagctggatggagtccaggataaatggcat

SEQ ID NO: 36379 - DNA, 1493 bp, Aspergillus nidulans
acgtaccgctacaatgaaagcccggtttataccacttccaatggctgtcctgtaaggtatacctatgacagtgctatcaaccaggctgacaatcccaggtgatggacccgcaagcttcgcagcgagtagggcccaacggacctctcctcctgccagacttcaaccttatcgaccttctcgcccactttgaccgtgagcgcattcccgagcgagtggtccatgccaagggtgcaggcgcctacggcgagttcgaagtcaccgacgacatcagcgatatcatcgtcatcgacatgctcaagggcgtcggcaagaagactaaaacctttgtccggttctcaaccgttggaggcgaaaagggctcccctgacagtgcccgcgaccctcgaggctttgcctgcaagttctatactgaggagggcaactgggactgggtcttcaacaacacccccgtcttcttcctccgtgaccctagcaaattccccatgttcatccacacccagaagcgtaatccacagacaaacctgaaagacgccaccatgttctgggactacctttccacccaccaggaggccgttcaccaggtcatgcacctcttttcagaccgcggcactccctactcctaccgtcacatgaacggctactccggtcacacctacaaatggatcaagcccgatggcactttcaactatgtccagctgcacctcaaaacagaccagggcaacaagacgttcacggacgccgaggccacgcgcctggccgccgagaaccctgactggcacactcaggacctcttcaatgccattgcccgcggcgaatacccctcatggacctgctatgttcagaccctgtcaccagagcaagccgagaagttccgctggaacattttcgacctgaccaaggtctggccgcaatccgaagttcccctccgccgcttcggccgcttcacccttaacaagaatcccgagaactacttcgccgaagttgagcaagccgccttctctccctcccaccttgtccccggcgtcgagccctccgccgatcccgtcctccaagcccgcctcttctcttacccggacacccaccgtcaccgcctcggcacgtcgaactatcaatccattcccgtcaactgccccctgcgcgcattcacgcccttccaccgcgacggcgcaatgagcgtgaatggcaaccatggcgcgaatcccaactacccatcgaccttccggccgctgcagtacaagcccgttaaggcgtcccaggagcacgagaagtgggctggctcggtagtaaccgagcagctgcctgttactgatgaggactttgttcaggccaatgggctctggaaagtccttggtcgccagccgggacagcaggagaattttgtgggtaatgttgcgggacacctctgcaatgctcaccctagggtccgccaggcgacatatggcatgttccgccgtgtgaatgctgaccttgggaagaggattgaaaaagccact

SEQ ID NO: 36380 - DNA, 2230 bp, Aspergillus nidulans
actgaagcacctactatctgccagaccccggaatgcgtcaacgccgcttcggatattcttcgcaacttggaccccaattacgcgaatatagatccttgcacagactttgaccagtatgtttgtggcggttggaggaaccagcatgatatgcgttccgaccagggctcgatcttcgcagggacttatatggaggaggcttctcaaacgcgcctccgccatctccttgagtctactggaccgtcggaccccgctgactcaaagatattcgagaaattgaaggctggatataacgcttgttttgatgaagatgcggttaggaaccgcggaaacgagcctctggtgaaattgctgaacgacttcgagaagatatatagtcttgattcggctatgggagggactgaagccggcttgaccgattctgtgctgtatctctacaagagtggcgttcctgctcttgtgcttccgtctgtttcggtgagccttcccgtctgtatgagtatacaacattaggactaacactctcgtacagccagacgaccgtgatccggacaatgtagtgatctttttgacaccccctagaaagattggcctcccggcgagggagtactacaatgacactcagactgtgagcgactacaccgcggttgttgagacggtcctcggtgaatttgtcgggagcaagaaggggaaacagttttcgaaagacgtcgtagcattcgagtcggccttggccgatgtgacgccaactacgcaggtgcaagaggatgtcacccaatactacaacccgcgcagcattgaggaaaccgagtcacttctaccccagatcttaatatctgacattatctcggaccttgccccatcggactacgaaactaatcgtataattgtgggctctccgtcttatatgaaatcgctgtccaaaattttggcggacacgtcgagagagactatccaattcttcttcaagtggaaaatcattcaagcctattctgagcatgttgaaagtgccgagattgagccactgcgtgaattcaacaatgtgatcgctgggaaggatcctcaagccaagatggaccggtggcgcaagtgcatcaccactgtcgatgaagatctgggatggatcttgagccgattctacatcttggacgctttcccggaggagtcaaagagactcggagatcagattgtttccgatataaaggaacgcttcgtattcaccctagaccaaaccaactggatgtcatctgaagtgaggaaactcggcattcagaaagttggcaatatcgtccagaaaatcgggtacccgacaaagagccccaacgtgatggacccagccgatgtagagaaatattaccagagtctgtcaatctcgaatgatacttacttcgagaacggccttgccgtttcgagatttgtggttgagaaagaatggtccgagctaggtaagccaactaatcgagaccaatggggaatgacagcccctactgtcaatgcatactataatccccctggcaatgagatcgtattcccggccgggatcatgcagccaccagtattctacggaaaaggtgccccgttatacttgtcctacggagcgtttggagcagtgagtgggcacgaactctctcacggtaagctcaggccttctatccaatgaaatatgtaggaacttacgcatatatcaaagccttcgattctacgggacgtcattacgacgagacagggaactacacggattggtgggatgagaaaacagtgaaggcatttgaggaccgcgcacaatgcttcatcgaccagtactcgaatttcacagtccatggcaaggactctgagcttcacgtcaatggtcgcttgactcttggtgagaacatcgcggatgcagggggattgacagcggcctatcacgcctggaagaagcgcgacgaggcacatgctgaccccattctacctgggctttcatcgttcagcaaagagcaggttttcttcatctcttacgcaaattggtggtgcagcaaaacgacccctgagaaggcccaagaggctatatataatgaccctcatgcgcctaagccagcgagaattattgtaagtcgaatccgtaccctgggcactgcagttgtaatgggactgaccctaggcttgatagggtaccatggcgaattccctagaattcaaagaggcattcaattgccccaacaagcagcctacctgcaagctctggtagctgtgg

SEQ ID NO: 36381 - DNA, 854 bp, Aspergillus nidulans
atgggttgtatgagctcaaagcagctcgaagcgggggatgacaaagaagctatccagcgaaatgcgaggatagaaaagagcctgaagaacgataagaaagtgatggatcggacgatcaagattctgcttcttggtacgtacaaggttgaataaccactgcaaacatgcttatggctatcccaggtgctggtgaatcggggaaatcaaccatcattaagcaaatgcgcatcatccactcgggaggtttcccagaagatgagcgccgccaaacacgagcagtgatctattcaaacattgtggttgctttcaaagttcttctggacattatgcgaacggagaatatcgatttcgaacaagaaggcacaagagtcagtgatagtacctgcctcgtgatcatttgtatgctaaagctaatttgtaccacgcaatttagcctctagcagaattcgtggacaatctagagcccgatgtgggtgtcgaggaagcattttccgaccttcgagttcgcgatgcaatgaacgaaatgtggaaagacggcggagttcagaaggctgtctcgaagggccatgagttcgctcttcacgacaacctgaattagtaagctgggcgatgagcagttccttcgattccaaccttactgatgattatgtagcttcttccattcgctcgaccgattattcgagtccggctggcttccggacaatcaggatatgttacaggcgcgtttgcgaacaaccggtatcacagaaacactatttgaactaggccagatgaatttccggatgatggacgttggaggacagcggtcggagcgaaagaaatggattcattgcttcgagggtgtccagtgctta

SEQ ID NO: 36382 - DNA, 1600 bp, Aspergillus nidulans
gtcagcttaactgcccccaatgggcacaaatacgagcagcctattggtttatttataaacaacgagtttgttgcatccaagtctggcgagaaatttgccaccgtcaatcccaggtatgcatctctggtgatgcacggtagtagctatattctaatatacgcgctagtgatgaagaggaaatcacccaagtttatgctgctggagaagaggacatcgatatcgcagtcaaggcagcaagaaaggccctcaaagatccctcatggaagcttcttaccgcaacagaccgaggcaatctgatgctcaaattggcggacctcattgaccagaacaaggaaaccttggccgtcattgaaacatgggacaacggttggtagaatttgtcaattttatctcaacctattctctaactttcataggcaagccgtaccaggtttccctaaacgatgacctctcggaggtcgttaacacaattcgctattgtgccggatgggccgataagatccacgggcagaccattagcacaacaccggccaagtttgcatacaccctacgtcaacctattggcgttgttggccaaattatcccatggaatttccccctagctatggctgcatggaagctgggtcctgcgttggcctgcggcaacaccgttgttctaaagcctgcagagcagactccgcttagcatcttgtaccttgccaaattcattaaggaagccggttttccaccaggtgtcgtcaacattgttaatggccttggtcgtgtggcaggatctgcattggttacccatccaggcgtggataaggttgcctttactggctcgaccatgactggtaaggaaatcatgaagatggctgcaggaaccatgaagaatgtgactttggaaactggcggcaagtcacctctgcttgtttttgacgatgcagacctcgagcaggcggccaagtgggcacatatcggtatcatgtacaaccaaggacaggtctgcacggctacgtcgcgtattcttgttcacgaaaaggttcacgatgaatttatcagacttttccgcgaggccgtggcgactaccagcaaggttggagacccattctcagatgacacgttccagggcccccaggttaccaaagcccaatacgagcgtgttctttcttacatcgagagcggcaagcaggagggcgccaccctggtcgacggcggtgtcccatacaagaacgtcaaggacggcaagggtttctttattgcgcccacaatcttcacaaacgtcaaggacaacatgcgcatttaccgcgaggaagtgttcggaccgttcgtcgccattgccagattctcaactgaagaggaagccatcgacagagccaacgacacaacctatggactgggagcagccgtcttcacgaaggacattgagcgagcccaccgtgttgcatctgaaattgaggctggaatggtgtggatcaacagcagcaacgacagcgacttccgcgtgccctttggtggtgtcaagcaaagcggtatagggcgcgaactcggcgaagctggcttagaggcgtacacccaaatcaaggctgtgcacgtcaatatgggaaccaagctgtaacct

SEQ ID NO: 36383 - DNA, 3098 bp, Aspergillus nidulans
gcagtcaacaatctctccatcgacgtcaataagggtcagataatggtcctgcttggcgccaatggatcgggaaaatccaccacactggatgccattgctggattaaccaagttgtcatctggcgatatcaacatcaattatggtacagaagaaccgggttttggtctctgcccgcagaagaatgtgctttgggacaatctgactgtcaaggagcacgtcaagattttcaacagactcaaatccaccgggaaagttgatacagaagaacaaattatgcatctcctaagagactgcgatcttcagaaaaaggccaaagcacgctcaaaaacactttctggaggacagaagagaaaagtgcaactagctatgatgtttactggtggctctccaatctgttgtgtcgacgaggtctcttctggcctcgatccaatatcacgaaggaagatatggcatatcttgttggcagaaaccggctccagagcaataatcctggcggcgcaatatctcgatgattctttcttgcttgctgatcatattgccattctgtccaaaggtgttctgaaggctaagggatctagcgttgagttgaaaaaccaactaggttctggatatcgcattcatgtcttcaatgtccctggatccgaaagggcggttcaaaaacggtttagcagcatacacaaagaagtccactttgacgaaactgtttacacagttcaaaattctgctgaagctgctcagtttgtctccgagctggaacaggagggtatgatggagtatcgtgtcagcgggcctactattgaagatgtttttctaaaggtcgcgagcgaattggatttcgagccctcaagaggccgtgttcgagaaggcgagcgagcagcggatcattcctctgaagctgatgatgagaatattgagcgtcgctcgctccatcttatgactggctgccgtatcggcataattctccaggcatggtacttgtttcgcaaaagactgactatcctccgccggaaccctcttccttatcttgcggcatttatgattcctgtgatcgcagcaggcctcgtgactttgtttctcaaggggttgcgacgcaggatgctcgggagaggattcctaccgaacacctgaatctaccatcgcagatcaatgggataacttgctccttgtgattggcccatcagacaaagtgcagccagaacttctagagagcttcgtggtctcaatgaacgatcaatcagacgccgtccagtcatctagtaatgcgtcccagttttatattgtggacgactacccagacttcagcgattatataaaagccaactattccaaagtgaccccaggcggggtttaccttggggactcctcgtggcagccgaccattgcttggaaaggagataatggcaatttccctcttgctgcgcttacgcagaacgtgctagatcggtttgcaacagggatgtccattaacatcggtttcgactttttcgatattccttcaacgccggacttctacaataccttgcagcttgttgtatactttgggcttgcatgtcagtttatccggctttcttcgcactatacccaacctgttgagcggctgaggaatgtcgcgcactccagttcagcaacggggttagggcactatcattgtggctggcatatataccttcaacttgtgtcaagttgttgcatcaagcgttctggcagtcatcattttcagagccgtgactaatatctggtaccatatcgaatatctatttgccgttttcttcctctacggcttatgtggtacgttatgcgcttacctggtgtcactctttacgaaatcgcaactcgcagcgtttgctttcgcggccggttttcagtgcgttatgtttctcatctatctcatcgcgtatatgtgcgtcctgacctacgcatcaacggacaagattgactcgtacattgatataacgcactacactatcgcgatcgtttctccatccggaaaccttctcagggctttgttcgcttccttgaacgtgttttctatactctgtcgaggctctgaaggtcgagagatagcgtcctaccctggagagattggtctctacggagggcctattctttatctcattcttcagtcaatcttcctcgttgttcttcttgtatggattgaaggcggcactcctctactttcctggttacggcctaaatctaggcaacgcgacgttgaggagaaagaactcatggacagcgatatcgcggaggaaattacccgtgtatccagttcgaaagataatctccgtctgctacatgtcagtaaggcattcaagaagtttatagctgtggaagacgtcacattcggtgtcggggcaggagaggtcttcgcccttctcggacccaatggagcagggaaaacgaccaccatctccctcatccgtggcgatatacagccaacacgtaacgagggggaaatattcgtcgaaaatatctctgtcctgaagcagcgcgctgttgcccggtctcgcctcggcgtttgcccacaatttgacgcgatggaccaaatgactgttcttgaacacctcgtcttctacgcccgtattaggggcgtgccagatataaaccacaatgtcaatgaagtaatcaatgctgtcgggctcaagcaattaaggcatcgcatggcggcaaagctttccggcggaaacaaacgcaagctatccctaggcatcgcgctgatgggaaatccttctgttctgcttctagatgagccatcctccggcatggacgccgcctcaaagcgtgtgatgtggaagacactaacggccgttgcacctgggcgctccatagtcctcacaacacattcaatggaggaagcagatgctctggcccaccgcgccggtatcatggctagacgtatgctggccctgggaacaacggatgcccttcgtttgaaatatggaaatatgtaccatgtgcatatagtccatacacaagcaccacatactagcgatgaagacatggagaagatccgcggctgggtgaccgataactttccaggcgccgttatcgagcagaaaacataccacggacagctgcgtttcagtgtccccgcgggc

SEQ ID NO: 36384 - DNA, 1400 bp, Aspergillus nidulans
caggttggctggaagggaacgacagccttgatgatgaaggcccagctggggctgggcgttctgtctatcccccaggtcttcgacacagtcggcctcataccggggatccttattgtgttggcgatttctggaatgaccggctggtcaaactggatggtgggcgtcttcaagaggcgccatccagaggtgtacggaatcgatgatgttgggaggatgctatttggccggattggcttcgaagtgctgggtgcggcgtataccttgcgtgagtgatattcgccatacgctcttttacttgctaatgttcccagtttggatttttgtctcgggatctggcatgttgagcgtgtcaatcgccctcaacgccctctcctcgcacgccatctgcactgcaatctttgtggccatttgcgctgttgtcgggtttgggctttcgagtatccagaccctcgccaaaatgagctggcttgccatgggtaggtaccgcctgtatcattgttgcgggtgagtgctctactactctttgtagttctctttcctgaccggtcccagtgtccacggtaacaattgccgtcggagtccaaggccatcctcccgcaatcgacggcgtcgtacccgaggctgactacaagctgttcaacagccccagctttgctgaagccatggccgcggtctcgacggtgtgcttgagctacgccggaacgccggcgttcttcaacattgcagccgagatgaaagaccctaggctctacactcgggcccttgcaatctcccactcaatcattacggtcatctacatcgtgtgtgggacggtcgtgtactactactgcggttctcatgttgcatcgccagcgctgggctcggcaggggcgctgatcaagaagatctgttacggtatcgccctgcccggcctggtcgtttccatggtcctcctccttcatgtaaagtcctctccctcttcgaatgaaagcacgcttcgctgactctcccagctacccgctaaacagatcttcgtccgcatgctccgcggctctaaacatctcacatcccacacgctgatccattgggtagcctggttggggtcgaccttcgctgttgctctgattgcctacataatcgcgagcggcatcccagtttttagtagccttgtctcgttcgtgggcgccctgttcggaacaccgatgtgcttccagccttttgggtgtatgtggctatatgataactggggctctgggacgtcgggtaagccactaagctggtggttcaaggtctgctggagcagtttcatggttcttgccgggtgtctcttgactattgcagggacgtacgggtctattgttggtattatcgattcttataacgcctccgggggttcaagtgcatggtcttgtgccaacaat

SEQ ID NO: 36385 - DNA, 848 bp, Aspergillus nidulans
ttcatgctggaggggaaagttttcgcagtgactggaggggcacggggactgggcttgacgatggcggaggctctggttgaagctggaggagagggttcgttcccagtcatatagatcctatgagaatgttgaggatgctgaccagtgcagtgtactgcctcgacagactacccgaaccagacgacgagttttacgccgcacaaaagcgcgcgaatcctgacttcgggggcgccctccactaccgccgcatggacgtcactgacgacgctaacaccgaagctatcttggatgatattgcgagcaagaaggaccgcctcgatggactgatcgcagccgcgggcgtcaaccacgtcaaagatgcattcgacctgacgcctgagatggtcgataagctcatccacatcaactataccggcgtcttcaggagcgcggtagcagccgcgcgcgcaatgacggctcgaaaatgccccggctcaatcctccttgtggctagcatgagcggtctgatcgcgaacaagggaatggcgtcggcgatctacaactcctccaaggcagcagttgtccaattgagccgcagccttgcaatggaatggtcagaatctcgcaaggacggaacgggagggatccgcgtgaacgctctgtgtccgggacatattgagacgtcgatggcgcagatggtgatggagaaggatccggagacgagggtcatctgggaaagcgagaatatgatgaagaggctggcaaggccagaggagtttagggggattacgctgctactgatgagtgatgcgagcagcttcatgactggcagtacggttgttgtggatggagggcatacagcttggtag

SEQ ID NO: 36386 - DNA, 1610 bp, Aspergillus nidulans
caggacggattgaatggccgccaaatcgccgagccccgcggccgcacactgggcggctcttcggccatcaacctcggcatggtgatctaccccagcaagaagggcgtcgactcgtgggaagaactgggcaatccgggttggaactgggcctcactatccgagtacctgcgcaaatccgaaacgttcacgtccccaagcccgtccatccgtgacgaactctcgctgggatatatcgatgagacgctgcaaggcggcaacggccctgtgcatatctcatttggagacgggccttatcccgcgttcagcgccgcctggcccaaggtgttcgagaatcttaaccaccgactgactggtgatcccatttcaggggtgtccaagggagctttctgcaacccggcgaccatcaacccaaaggacaaaagccgaagccacgctggcgtggcatactacaataaggaggttgctaagcggcccaatctgcgggtcctcgccgatgccactgtcgcgcggatcgtactgaagatagaggcggacggctcgctcgttgcaactggcgtgcagttcactcccaaggatggagtgcagcggacggtcgccgccgctgtggaggtcgtcctttcggccggggccgtcaaagcccccagctgctggagctgtctggtattggcggcgccaaactcttggaaaagcacggcattgaggttctggtagacaacgcgaacgtcggcgagaacctgcaagagcatggattcgtgcctttcagctgggagatcgcagacggccggcaatcaggcgaacgcctccgggacccggccgtggctcagatggccatggaggcctggcagcagcattcgggtgccggtcctctcggactctgcccgttggcgtctgcctacatgacgcttccctcgctgcaggatggagagctgaaggcgctcctcaagcaatacctcgacgacgaccagtaccctcggcgtcccggctgtgaggctcagtaccacatcctgcgccagatgttggaggatgagacggagcccagcggccaatataccctcgcccccttccagatcacgccagaaaagggtccgagccctaaagggatcttcggcatgtctgagccagagtgcttcgttagtattgtctccgttctgaaccgtcccttctcgcgcggccacgtccacctggcctccagcgacccctatgcgccgcccgtctttgaccccaagttcttctcgcatcctcttgatcttgagatccatgcgaggcacactcagtggctcgagaccctggcctcgaccgaaccaatggcttctctgatcaagaaacacggtcgtcgtctgcacagcagcaaacgcgtcgatgacctggacactgcacgagagctaactcgggaccgtattgtggcccactaccacgtcacaggcaccacggccatggcaccgcgagagaacggtggggtggtggacgagcgtttgagagtgtatggcacgaagaacttgcgtgttgttgatgcaggcatcatgcccctgatcccgcggggcaatatccaggcaattgtctttgctctagcagagaaggcggctgatctgatcaaggaggatctacgggac

SEQ ID NO: 36387 - DNA, 1797 bp, Aspergillus nidulans
atggcagacgcggtgattgctggtcagcgcgtggaggccccggtcacatggaaggcgtaccttatgtgcgtgtacgcggccttcggtggtatattctgcggctacgactctggctatattaatggagttatgggcatggattatttcatccaagaatttacaggaaaggtgcgtaagatcccctgcttctgtagggccaagaatcacacgttctcctccatgtaggtcaaaagcgaaactcccgccgcgcagtttgtgatttcatcgtcgaataaatcccttatcacctctatcctgtctgcggggacgttctttggcgctattattgccggtgacctggcagactggtacggccgtcgcatcacgattatcaatggctgcggagtctttatggctggtgtggcttttcagattgcctctaccaccgtgcccatgcttgtcgtcggccgattgatcgcacgcgttggtggcggatttgtctctgcgaacatcattctgaacatgtctgagatttctccttgaaagttccctggtgctatcggatcgggctatcagttttgcatcaccattggtttgatgctggcctcctgcgtgaactatgggacggagaaccggaatgattcgggctcataccgtatcccgattgccctccaactcctctgggcgatcattcttgggataggtctgttcgtccttccagagtctccccgttattatgttcggaaaaacaatctggctgaagcagccaaaaccctcgctcgcgtgcgaggccagcccccggagtcagagtatatcacgcaagagctggcagaaatcgtggccaacaatgaatacgagatgcaggttattccccagggcggctattttgctacgtggttgaactgcttccgtggaggtctccggtctcctaacagcaaccttcgtcgtgttatccttgggacctctcttcagatgatgcaacagtgagtcgagacccaacctccttgagttctatcagtcatcagattgttggtgctctaacgcaatgcagatggactggagtgaacttcgtcttctattttggtactacgtttttccagaacgtatgctaccctgatacctcctgtgcggtgatggtggctaattttgattcagctcggtaccattgacgaccctttcctcatcagcatgatcaccacgattgtcaatgtcttttctactccgatctccttttacacgatggagaagctcggtcgtcgccctctactgctttggggcgctctgggcatggtcgtctgccaatttattgtggcgatcgctggaaccgtggatggagacaacagtaaaaccgtctcggcgcaaatctcgtttatctgcatttatatctgtaagtggtatacgcactatgaatcttgcgtctggctgatcatcattgcagttttctttgcttccacttggggccctggcgcttgggtcgttattggcgagattttcccgctgcccattcgttctcgtggcgttgcgctatcaacagcctccaactggctttggaactgcgtacgttatagctcgttgccaggatcttgggatttggcgctaacactactatagattattgcagttatcacaccgtacatggttgatatcgacaaggggaacctcaagtcccgagtgttctttatctggggatccctgtgtgcctgcgcatttgtctatgtctacttcctgattcccgagacaaaaggcctcaccctcgaacaagctgacaagatgatggacgagactcctccttgcacatctgcccaatggaagcctcac

SEQ ID NO: 36388 - DNA, 1350 bp, Aspergillus nidulans
ttcgacctctccaaatgcgcgcgcaagaatatcctgaagttgcaaccgtaccgttgcgctagagagtatgttcgtcccctaaccctccctccgcaatcggcgccgaaactaatcaatcgcaccagtgactacaaagacgatgggacaaatgtactacttgacgcgaacgagaatgcttatggaccgggtcttgcactgaactctggaggtgcccttcaagagtcagcggccaatggccactcgaccggctcatcaaagccagagattgatctcttgggattgaaccgataccctgatccgtacgtgaactatgccctccaagctctgaactctcacctttctgatcacaacggcttgaaatagccaccagcacccgctcaagcaactcttctgcaacatccgcaacacccacacccacacagacaagaccatcactcccgagaacctcttcgtcggagtcggatcagacgaagccattgacgcccttctccgcgccttctgcgttcccggtaaagacaaaattctcacctgccctcccacatacggcatgtactccgtcagcgcggacgtcaacgacgttgagattgtcaaggtcccgctagacacggacaacggattcgcgctacagcctgaaaagatcaacgccgcgctctctgccgaccccacaatcaaacttgtttatatctgctcgcccgggaatcccactgcaactcttgtctcaaagtccgacatccagaaagtgctagaacacccgacgtggaacggcgttgtcgtccttgacgaagcatacattgatttcgccccagagggatccagtcttgcagaatgggtggctgagtggccaaaccttgtcgttatgcagacactcagcaaggcattcggccttgctggaatccgattaggcgttgcattcacaagtcctgagattgctacccttttaaacagtctaaaagcaccttataacatttccagtcctactagcgcactggcaatggcggctcttgggaaccctaagaaccttgaggtcatgcgatcgtatcgctccaagattattgctcagcgcgaccgaatcctcaaggagcttccctctatccctggtattggacgttccgcggtggtactgagtcgaatttccttcttgtcgagatcctcgataagcccgcggatcaaggcgggaagcccagcaaccccgtcgcgctagcgacgtacgaggctatggctgagaaacgaggcgttgtagtgcggttccgcggaaaggagttgggttgcgagggctgtttgaggattacggttggaacagaagacgaggttacgaggttcttggaagagatcagacatgttctcggtgga

SEQ ID NO: 36389 - DNA, 610 bp, Aspergillus nidulans
acccttttagagaactacgtccatggtatttgcgccctcgctccttgctcccgggctgtacttacattcgcaagatatcttcgtcgataacgtgcatatggaactgtcgttatgggacacggctggccaagaagaatttgatcgattacgtgcactctcatatgaggatacgcatgtcataatgctgtgctttagtgtaaggtcgttgcccagcctccggcctagtggctaatacatggaaaacaggtcgacagccctgactcgttcgaaaacgtggccagtaaatggatcgaagagatctcggagaatgtgcctggagtgaaactggtcctaacagcgcttaagtgcgacttgcggaaggacgaatatatgaatgacaacccgaatgttatcacatacgagcaaggactggcaaaggcgaaggaaattggggctgtgaagtacctcggtaaggcgtcgatgctgttctggagtgagcgaccggagttggtctaatgctttcacagagtgctctgcggtccaaaaccgcggcattagggaagccttctacgaagccgccaaagttgcccttgaggtgaaggctcaaaacaccggctcgtcgcaaagccgc

SEQ ID NO: 36390 - DNA, 1208 bp, Aspergillus nidulans
ccgaaattaactgaagaccggtagatcactttgacaggcctattcttcgtcttgatcaacctctttaccgttctatactataacccaagcctggatcaggactgtccaccatgggtctatgccagttgcgccatcgggctattcttgtaccagacgtttgacgctgtagacggaatccaagcgtatgtttcatcatctgtcgtgtggaggatggaactaattcgccttatagaaggagaactaagcagagcggccctcttggcgagctttttgatcacagtaagtggagtagctgatattcttgcaaatcatgtcactgagacttgttctgcaggtgttgacgcctgcaacacggccctgggagtcttgatattcgccggagtcatgaacctcggccagacttgggctactgttctgacactttttggatgtatgttgttccggagcccagaagcagtgcgaaacctaatttcattcccatagctaccatgaccttctatgtccagacctgggatatgtattatacacaagtgttgacgttgggcatcgtctctggtcctgttgaaggggtactgacgctttgtgttgtcttcgggttcaccgcatatatgggaggcggaagtttctggcaccagcctatgttcgaaacgatcggtgttcctaaactcgagttcatccctaagcagctctatgacttgcccttcacgcagtggtatctcatttatggtgcggtcatgcttttcttcgccactggctcgagcatcgcgcatgtcatccaggttcgcaaggaacgtggtaaggattcgattggtccactcttcggtatccttcctctcgccttgacgtgggtagttgtaccggcgtacctgtacctaaacccgacaatcctcgagaactacctggttccctttgccctgtatgtcggcctggtcaacgcgtatgccgttggacgaataatatgtgcccatttggtacaccaagactttccctatttcaacattcttcttggacctcttgctttggctgttgttgacagtgccggtgcactttttggtgtctggtcgtcaactctgattggtacaatcggacagcctgctttcgttttcctatgcctgggtctgggccttggcgtctacgggagctttgtggtaagtcctgcctctacattaagcatttacaaatcgctaattgtcctagcatgatatcat

SEQ ID NO: 36391 - DNA, 1781 bp, Aspergillus nidulans
ggaaagtgtagcgcattcaccggcccggggcgtacggaccgtgactcaaccaacccaagccacaatcagcgtttctggcttccccctcaatcctcagacaccaagagccactgaatttgtcgacggactccctcccaaaagtggatggcccgtcatcggtgccgccgaaaaagcacttcagaaaaccctctgggcgtagccataaccgaaagccctcattctccgagaacgaatggaagatcacaacggctgaacagggcaatggcggcttacgcaacgccgtacgcgccgccgcggagaccgggcagcttgaagacaaggtttgggttggtacgctgggtatgccgactgatgccttgacggagtcaacaaaagccacgatatccgagaagctggagggagaatacgattgtctaatggtcgatgtcagtgacagcgatttcgacggtcattacacacatttctgcaagacaatcctctggcccgtgtttcattatcaaatccctgataacccgaagagcaaggcatatgaggaccattcgtgggtttactatgtgaagctcaaccaggtctttgcggagcgaattgcccgaaactggaggcggggcgataccatatgggtccaagactatcacttgctccttgtgccggcgatgctacggaaacttctccccgacgcgcagatcggctttttccttcatgttgctttcccgtcctctgaggtgttccggtgcctcgcaccacgcaaggagctacttgagggactgcttggggcgaacctaggggggttacagacggaagactattgtggccatttcctgcagacatgcagccgtatcctcagtgttgaagctacgaatgacgggcttcagctggaggaccgattcgtgaacgtgagaaagttcccaatcggtatcgaccccctctcttgggataagcgccgtaaagcggcagatgtcgagcagtggatcaagacgatttccgatcgttatgcaggaaagaggctcattgtggctcgcgacaagattgaccaggtgcgcggcatccggcagaagttactcagctatgagctctttctcaacactcaccccgagtggcgcgaaaaggtggtattgattcaggtggctacaagcacgacggaacagccggagctggaggccatgatttccgacattgtcatgcggatcaattctacgcactcgacgcttgcacaccaacctctggtattcttgaagcaggaccttgccttcccgcaatacctcgctttgatttctgtagcagatgcgatgatgattactagtctacgtgaaggtatgaatcttacgagccatgagtttgtttactgtcaggatggaaaatacggcgcccaaagatacggatcacttattctcagcgaattcaccggtagcgcatcggtattcggcaaccatgccctactcgtcaacccttgggactaccaccagtgtgcagacgcaatccacacagctctctcgcgcagtgaagagaaacgtcagcaggtatggacacagcttcatgaggcagtgctgcagaattcaacttcaaactgggtgaagtcgttcagtgagacgttaagtagggtctggcatgaacagtcgtcccgtgagatcatggctgttcccagactccctatgaacaagcttgaagacaggtaccggcaggcaaagcgacggctcataattttagactatgaaggtacactggcatcctggggttctccgaagagcatcatcctcaccaccccccaaagggccatcacgacg

SEQ ID NO: 36392 - DNA, 326 bp, Aspergillus nidulans
aagttgaggcatgtcttgcagaaggcgtcgatatcgaaaagcacgatgaccacggtgatacaccactgggggtagctgctaggttgggacatgggccgattgtccagtgtttgttggaagcgagggcgcaagtcaatgcaaggtctgcaggaggcaaaacggctttgatgcttgcctcgtatgcaggcttcgagggtgttgtgcaactgcttcttcaccataacgcagattgtcaagaatactccaatgaaggactgacttgtctccactacgcaacctttcggcacgccagcgcaggactcatccggctcctgactcaacacttc

SEQ ID NO: 36393 - DNA, 897 bp, Aspergillus nidulans
cctgcaacagctcgagagatgggcgcccagttctcccagttctttcccccccacccaaccttcaccagcgagaacctctcggaacagcaaggcaaagtgttcctcatcactggcggcacgtctggaattgggttggaactcgccaagattctctattgccacggcggcaaggtctacattaccgcccgcagcgaagagaaagcagaaaaggcgatccaagaaatccaagcctctgcacctaatcatcatggtgagctggactttatcatcctcgagcttgatgatctaaggagcatcaaggcttcggtagaagccttcaaagcacaagaatcgaaactggatatcctgtggaacaatgccggcgtctcccaaccgcccttgggtagcgtttccaaacaaggccatgagctccagctagccgtcaactgcttcggccccttcctcttcacgcagatgttactccctttactcgacgcggcggttgcctcgtccgtatctcctgggtcagtgagagtaatttggacaagcagtcaagtcgctgagctctcctcgccggatgaaggaatcatcatgtctgagcttaccagcccacctaaggacaatgtccgcaactacgtaaactccaagacaggaaactggctcctgtctgccgagttcgcccgacgatatgggtcccgtgggatcgtcagcgttgcgtagaaccccggagcagcaaacacgaatcttctcaaggacgcgaggctgatgaagatactctcttatcccttgctgcacagagcgggcttggctgcacatacagagctgtatgctgggtttagtcctgcgatatcgttgcaaaacaatggctgctatgtcatcccgtttggccgaatccatgatcaggtggcggacgcatta

SEQ ID NO: 36394 - DNA, 1236 bp, Aspergillus nidulans
ccagaattggactacctaaaatccctacagaatgaacagaatatcaacaaaataaaatggcgccggcgcctttgagcgttttatttcctactctcgactaatcacaaaacaatcaagctgtggaaggtgtttgataaatctctcaaagtcgttgcggaaaacaatctctctacagagcttacccctgcgggcgttggtggtggaggggcacccagagcgcctccagtgtcttttaaagattcctcagcactgaagcttccacaaatgacacatcacgacactgtcgtcgcagctgtacctagacgaacatacgctaacgcccatgcataccacattaacagcatctctgtcaacagtgacggggagacgttcattagcagtgacgatctgcgagtcaacctctggaacttgaatattcaagaccagagcttcaacattgtcgacatcaaaccagcaaacatggaagagcttacagaagtcatcaccgccgcagagtttcatcctacaagctgtaactggttcatgtacgcgagctcaaaggggaccatcaagcttgccgacatgcgacaacgggctctttgtgatacccaccacaagcgtatgtgtttttcatcgttgtcctcttctcgtgacactttcgaatcaagttctaacttgccttatgtagtgtttgagcaagaagaagacgcctcttcccgttctttcttctccgaaatcatttccccgatatctgacgtaagattctctcacgatggccggtacattgtatcacgagaatacctcaccgtcaagatttgggacgtcaacatggagcgacaacccgtgaagacaatccccattcatgaacatctccgacctcgtctatgcgatacgtacgagaacgacagcatctttgataaattcgaggtggtcttttcgggcgatgcagagaacgttatgacaggcagttacaacaataatttcatgatttatcctaccgatcccgcgaaggaaaccgagattgttttgcaggctgacaagtctgcgttcaaggcgaagaaggtcggcgtaccaacgccgatgaataagggtgccaatgggaagaagagtaactcaaggaccagcagccctgctggtcctggcagccgcatgaagaaggagacagatgcagatcaaattgattttaacaagaagatcctgcacatgagctggcatccgtttgaggatagcattgccattgctgccacaagcaacgtg

SEQ ID NO: 36395 - DNA, 845 bp, Aspergillus nidulans
gatactccgaacctccttgataactccgaaaccgtacacatctcatctcttgcgctcttgaagatgttaaggcacggtcgagcaggtgtccctatggaagtcatgggtcttatgctgggtgaattcgtggatgaatatacagtacgagtaaccgacgtctttgcgatgcctcagagcggtacaggcgtcagtgtcgaagctgttgaccctgtattccaaacaaaaatgatggacatgcttaggcaaaccggacggtaagctataaccataagatttgacagcattgtgctgagaatgcatgattcagaccggaacccgttgtcggttggtatcactcgcatcctgggtttggatgctggctctcctccgttgatatcaacactcagcaatcgttcgagcagcttactcctcgcgctgtcgctgtcgtcgtcgacccaattcagtccgtcaaaggcaaggttgtcattgacgccttccgtctcattcagccccagacggttgtcatgggtcaagagccccgacaaaccacctccaacctgggtcacctgaacaagccgtctatccaggctctgatccacggattaaacagacactactacagcattggcatcaactaccgcaagacggggcttgaggagaacatgctaatgaacctgcacaagcaagtctggaccgaagcgttgcagatgaatgactttcacgacgaatgtcagcacaatgttgaccgcatgaagcagctcgttaacttggccgagggctacgagaaacgagtgaaggaggagacggagctcactaaggaccagctgaagacaagatatgtcggaaaggttgaccccaagaagcgt

SEQ ID NO: 36396 - DNA, 2227 bp, Aspergillus nidulans
atggcttcgggaacgtcggggccggctgggcctccgctggatcccatcgaccttaatgtgtctggagatcgcagcaagagggttgcctacttctacgactcagatgtgggaaactatgcatatgtgtcggggcatcccatgaagccgcaccgtatcaggatgacgcacagcttggtaatgaactacagtctctacaagaaaatggaaatctacgtgagttttcgtccatttgtacctcgcataggaacgtactaatgctcaaccttcgcagcgtgcaaagcccgcctccaaattcgaaatgacccaatttcacaccgatgagtacatcgacttcctttctaaagttacacccgataatatggacgcattcgcgaaagaacagagcaaatacaatgttggtgatgactgccctgtgtttgacgggcttttcgagttctgcggcatcagtgctggcggtagcatggagggtgccgcccggctcaatcgtaacaagtgtgacattgctgtgaactgggctggtggccttcaccacgctaaaaagagcgaggctagtgggttttgctatgtgaacggtatgtcaaagctgttctgcggtttcaacagtacactgataaaacgttgtagatatcgttcttggcattctggagttgctccgcttcaagcagcgggttctgtatgtcgacattgatgtccatcacggcgatggtgttgaagaagcgttctacaccacagatcgcgtgatgactgtttcattccacaagtacggcgagtacttcccaggaacaggtgaattgcgcgatattggagttggacagggcaaatactatgccgtcaactttcctctccgcgacggcatcgatgatgtctcgtacaagagcattttcgagcccgtcatcaagagcgtgatggaatggtaccgtcccgaggcagttgttctccaatgcggcggtgacagtctctcgggtgatcgcctaggatgcttcaacctcagcatgcgaggccacgcgaactgtgtcaaatatgtaaaaagcttcaatctcccgacgttaattgtcggaggcggtggctataccatgcgcaacgttgctcgaacctgggcatttgagactggtatccttgtcggtgacaacctaggatctgagctcccttataacgactattacgaggtaagtacacatcctggtgtatcggtaaatatgcttacgcaagacagtactttgcaccggattacgagctggacgtccgcccgtcaaatatggataatgccaatacgagagaatatctagacaagattcgaacacaggtcgttgagaacctaaagcgaacagcttttgccccatccgtgcagatgaccgacgttcctcgcgaacctttggtagacggtatggacgacgaagccgaggccgccctcgacgatttggatgaagatgagaacaaggacaaacgctttacaaagcgacgctttgatcaatatgttgagaagcccggcgagctcagcgacagcgaggatgaagatgagaatgcggcgaacggagtcacccgcaaaccggctcacttaaaacgacgcaaccaggccaactaccgactagaccttgctgattctggagtcgaaagcggaatggctaccccacaggacgcttcatcggtggctgatgaggagatggacactggcacggatgtgaagataacagaagcgcccgggccggaacctgactctgaagcccagggaacatcgtcagcagccgagccaccatcaagggcgggaaatggatctgttgatgagccatctgagatgatcgtcgattcgaaagagccacccaggtctgttcctgtctcgcgccctgtctctcccaaaccaacagacgaggatacggctatggaggatgcagatatgcctgtgcctgaggtaaatcaggagaacacgccagaagcaagccaggcaacgcagaataagcccgcggaaggaacacctgcttcggagagcgccgtggctaagttaacgtcgcaaacaaaggcgtccttcgagagcaacgagggccggaagcagctagaaccagagacagtgaaggaggccggccttgcagcagtgacaaccgagactaaggacaagactcctgaagcacctcgagcgggggctctccccgcggtaaccgcggagcaagagacgaccaaacaaggggagcctagcgcagaagcacaacccgaagccgcaaaggagtgaggacta

SEQ ID NO: 36397 - DNA, 2789 bp, Aspergillus nidulans
cctgaagactggctcgagaccgatctcaacggtcttccttccagccagatcgagcctcgccgcaagcgtggtggctggaacgagttgaccaccgagaagaccaacttcttcgtccagtttattggttacttccgtggtcccattctttatggtgagtagcccggtctgccggtgttccatgtgaatatttctaactgaaattgctcccatctagttatggaattggctgttctccttgctgctggtcttcgtgactggattgatctcggtgttattatcggtattcttatgctcaacgctgtcgtcggttggtaccaggaaaagcaggctgccgacgttgtcgctagtttgaagggtgacattgctatgaaggctgttgtcaagcgtgatggtcaggagcaggagatccttgctcgtgaacttgttactggtgatatcgtgagttgcccaattcgtcctttccacgttctactgccacattgctaactgccatcgcctaattaggtcgtcattgaggaaggtactatcgtgcccgccgatgttcgcctcatctgcgactacgacaagcccgagacctacgagacctacaaggaatacctcgccactgccaacgatgacacccttaaggagaactatgatgatgacgacgaccatggcattgatgcccgccttggtgtttcactctttgccgtctaccagtccgccatcactggtgaatctctcgctgtcgacaagtacatggctgacacctgctactacaccactggttgcaagcgtggaaaggcctacgccatcgttactgctacggctaagcactcgtttgttggtaagaccgctgctctcgttcagggcgctcaggaccagggtcacttcaaggctgtcatggacaacatcggtacctccctgcttgttctggttatgttctggatcctcgccgcctggattggtggtttctaccgtcacctgaagatcgccactcctgagcactctgacaacactctccttcactggactttgattcttcttatcatcggtgtccccgtcggtcttcccgttgtcacaaccaccaccctcgctgtcggtgctgcttatcttgcggagcagaaggccattgtccagaagctcactgctattgagtctcttgctggtgtcgacattctctgctctgataagaccggtacccttaccgctaaccagctctctattcgtgagccctacgtcaatgaaggtgtggatgtgaactggatgatggctgttgctgctattgcttccaaccacaacgttaagaacctcgaccccatcgacaaagttacgatccttactcttcgccgctaccccaaggcgcgtgaaatccttgctcggaactgggttaccgagaagtacactcctttcgatcctgtctctaagcgtattactaccatctgtacctgcgacggtgtccgctacacctgtgctaagggtgctcccaaggctatccttgccatgtctgagtgctccccggaggaggctcagaagttccgtgagaaggcttccgaattcgctcgccgtggtttccgttctcttggtgtcgccgtccagaaggagggtgagccctggcaattgctcggcatgtaccccatgtttgaccctcctcgtgaggacactgcccacaccattgctgaagctcagcatctcggtctttccgtcaagatgttgactggtgatgctcttgccattgccaaggaaacttgcaagatgcttgctcttagcaccaaggtttacgactctgagcgtcttatccacggtggtcttgctggttctgcccagcatgacctcgttgagaaggctgatggtttcgccgaagttttccccgagcacaagtaccaggtcgtcgagatgcttcagcagcgtggtcacttgactgccatgactggtgacggtgttaacgatgctccttcccttaagaaggctgactgtggtattgctgtcgagggttccactgaagccgctcaggccgcttttatcattgtcttcctcgcccccggtcttagcaccattgttgatgctatcaagcttgctcgtcagatcttccagcgtatgaaggcgtacatccagtaccgtatcgctttgtgtatccaccttgagctttacctcgtcacctccatgatcatcatcaacgaaaccatcaaggccgaccttattgtcttcattgccctgtttgctgatttggctaccatcgccgtcgcttacgacaatgctcactttgaggctcgtcccgtcgagtggcagttgcccaagatctgggttatctccgtcgttcttggtgttctccttgctgctggtacctggatcatgcgtgcttctctcttccttgagaacggtggtatcatccagaactttggttctcctcagcctatgctcttcttggaagtctctcttactgagaactggctcatcttcgtcacccgtgtggtaagacctggccctcgtggcagctggttggtgccatcttcgttgtcgatgtcctcgccaccctcttctgtgtcttcggctggctcgccggcgactacgttgagaccagcccccccagccaggccactttctccaccaacaacgacaccgacattgtcaccgttgttgttatctgggcttactcgattggtgtcacaatcatcattgctgtggtctactacctcctcaccatcatccctgcccttgacaacctcggccgcaagaaccgctctgtcgttgacaccaaggtcgagaacctgcttaaccacctctctaagctggctatcgaacacgaagtt

SEQ ID NO: 36398 - DNA, 1051 bp, Aspergillus nidulans
cttcccctgcttctcaatgtgctcctagccagcgcagcgggcatcccttcgagccgctataggaattgccagagatcgcgcaaagcgtgccctgaaggcactctcgttgtctctgcatccgaccctaaggctgacttttcaaccgtccaagccgcagttgagtccctgccgcacgataacagcagccagacgatcctgatcctagcagggacatatacggaacaagtcaatgtcacccgtcccggcccagtcacgctgctcggccaaacagaccatgtcaccgacgcctccaagaaccaggtgacaatcaactgggcacaagccaaccatgacagcacgggccagagtgttgacaatgttttcggaagcgttttgactgtcgcacctactctgaacgcgagttacactggctctggtcccacgggattccctgtacctgaggatactccctttggctcagtcgactttcgtgcgtacaacattgattttaccaacacctgggcggactattcagacggcccggcacatgcactcagcttcagcagggctaatggcgggttctactattgcgggttctattcctaccaggatactgtaggtctgcctaacctcttgcgaaataatctgacaatcataggtctacgtaggcaaactcggcaacgcatactttcacaggagcataatagccggccaaactgacttcatctacgggttcggcacagcttggattcaatcgtctgatatcctcctccgcaactgcggcggcggcatcacagcctggaagggtaccaacacgaccttcgagaacaaatacggcgtctacatcgtcgactcatccgtgcaagctgccaatgcctcaattgccccggaaatcgtcggtgcttgccccctcggcaggccttggaatgaactacaccgctccatcttcgttcgttcctatgaggatgctagcattgatcctgaagggtacattgattgggtcgttgatggtgtaagccgtctgtcaaacaagactttcatggccgagtatcgcacctttgggccggggttc

SEQ ID NO: 36399 - DNA, 880 bp, Aspergillus nidulans
gctacgaagctaatcaagatcctgtagggcaaagtggtgttggtcaccggcggcgccaaaggcatcggccgcatgatctccgagggttacgttacgaacggtgcaactgtttacatctcgtcccgggacgcgaaggcttgtgagcaagccgtgaaggagctcaatgcgctcggcaagggcaaggcgcacgccattccggcggatttctacaaggaggaggatgtcaagaagcttgctgaggagcttgccaagcgggaaagcagtacgtgtcctaccctagcggagaaaggaagagctaatgggacttctagagctccacgtccttgtcaacaactccgggtcaaactggggtgctccctacgacgagtacccgtcttctgcatggactagggttcttacgctcaatctccaccgtgtctttgaccttacaaagctcgtgactcccctactggagaaggcagcggcgccgaacgaccctgctagaatcatcaatatcggtagtatcgatggactgagggttccggcgttggagacatttgcgtacagtgctagcaaggcgggcctgcatcatatgagccgtgttctcgcgaaccatctcgggaagaggaacattacgtatgtgctttgaaccgctgctcgattgttttgttggacgtatgggaagttactgacctagcatagatcgaacactctcgcctgcggcccgttccagagtaagatgatggctgcaacgctgaagaacttccgggagcagatcgagtctggtattccactaaaacgtatcggtacgccagaggacgttgcaggggcttgtctattcttgagtagtcgggctggtgcatatgttaatgggtcgacgatcgcagtcgacgggggtagt

SEQ ID NO: 36400 - DNA, 1063 bp, Aspergillus nidulans
acgctgtatttctgcaacctaactgttggaactccagggcagagtttgcgattaattcttgatactggtagcagcgatttatggtgcaacgccgcgaattcaacactctgttcttctccgaaagatccatgtcgcatatctggatcatttgacccaagctcgtcatcatcttattcttatatatcttctgatttcaacattacctacgcagacggaactggagccgccggggactatgccactgacacagtcagtattggtggtgcaacaattaaagacttccagtttggaatcggctacacatccagttcagcaggtatgttgagaaaatgttttgttgtatcagtagctgtaatattgatagctctcagagggcgtcttaggaatcggttatccatcaaatgaagtccaggttgctcgatacggagacgatgcttatcccaatcttcctcggttcctgatgcaaaatggatttgttcagtcgagcgcttatagcctctggctaaatgaccttgaagcgaataccggctcaatcctgtttggaggggttgatacagagaagtatcgtggcgacctgcaaactctccccattcagaccgtcaatggagagtattctgagctgataatagctctcactggcgtctcgctggatactgaagccaggaagcatacagtgtcttcaaacgcgctaccagcagctgtgctcctagactccggcagctctctatcatatctacctgactcaattgccgaaaaaatatacgatgaccttcgcatttcctatgagccgtccactggtgcaggatacgcgccatgcagtttggcccggcaaaatattaatgtgacctttacgttctcttcacccgaaatcgcggttggcattgatgaactcattatagatgccggagatcttcgtttttctaacggtgaacgcgcttgcatattcggccttgttcctgctggagataataccgctgtactaggggatacctttctgcgcagcgcatatgttgtctatgatttgacaaacaacgagatttctatcgccaaaaccaatttcaac

SEQ ID NO: 36401 - DNA, 986 bp, Aspergillus nidulans
ttcggcccctcacccatccaatacctccctaacatcactgccgcgctaggcggaaaagtcaacatctacctaaacgcgaagatgtcaacagcggcctcgctttcgggggcaacaagacccggaaacttgagtacctcgcgtccgacgccctcgctcaaaaggcagatacgttggtgtcgatcggcggcttccaaagcaaccacacgcggcaagtcgcggccgtcgcgcggaagcttggcctcgaagttgcgcttgtacaggaaaaatgggttgattgggacgacaaaaatggcgtttacgacaaggcggggaatatccagctttcgcggctgatgggcgcagacacgagactcgatatgtccggcttcgggattgaacataaattgaccctcaagaacttggaggaggaaatcagagccaggggcggaaagccatattacatccctgcaggagcatcagatcacccattgggcggcttaggcttcgccaggtgggcgtttgaggttgagatgcaggagaaggagctcggtgtattctttgacactgtgattgtgtgcgcagtaacagggagtacaatggcgggcatgattgcgggcttcaagctcgcgcagaaagtaaacgggagccgcaagcggaagatcattgggattgatgcgtcagcgacggtggagcagacatttgagcaaatattgcgcattgcaaagttcacaggtgtcaagataggtttggacgaggaggatatcacggcggaggatgtgatattagatgatcggtatcacgctggtgtgtatgggattccagatgaggcgaccattgaggcgatcaagtttggggccaggactgaggctttcattacggatcctgtgtatgaagggaagagcctgaatgggatgatggatatggtaagaaagggggaaatacaggagggggcgaatgtgctgtatgcgcaccttggggggcagttggcgctaaatgcttataccgca

SEQ ID NO: 36402 - DNA, 1825 bp, Aspergillus nidulans
tcgagatctgaaaatggcgctagagactcgctagaactcgcgtctttggcctcgtcctctcccgaatccgccctcgacctctctcgctcatcttccccctcaggcatttcgtcctcgcgcaagctatcgctagaggatgaggaccccctttcgaactccaatccacatatgacccacttgtcgtcacgaccgcgacctgatcggtcatactctatctcttccgcattcgattttgggaggaatctgtttcctctgtcccagactgccgatggctacgctcccttgggggctccaactcaaatcgatggagatggcggtggtattgatggttcgttagagcggaataagacgttgacttatatcaatggattgtccctggtagtgggactggtgatcggctcgggaatcttctcatcacctagccaagtcaacgctaatgtgggatcacctggtggtgcactgattgcctggctcgttgccggattattagcttggaccggagcagcaagttatgctgagctgggaggcgcaatccctctaaatggtggtgcccaggcttatctgtctaaaatattcggagaattggcgggattcctctttacgtggtgcgctgtcttagtgctcaagcctggcagtgcagccattatctcgatcatcttcggagaatatgtggttcgagctatattaggtgccgaagtcgaacagatcagcccttggatcaacaaaggcgttgcctttggtggacttcttgttgtcatttgtctcaactgtctctctactcggttagctgctcggattggagatttattcatgatattcaaatttgtcgcattgatcggtgtcgccattattgggattattgttgccgccactggcctgtcagcgaaggggcaggccaatcaggaatggaaaatcagctggttcgagggcacgaacatggatatttcaggttgggctatggcattgtatgcaggtctgtgggcattcgatggctgggacaatgtgggtatcgccaatacaactttcagatcggcccactgacacagcgcagacaaactacgtgacgggcgaatttaaaaacccaaatcgagacctcccgcgtgtgattcatactgcaatgccccttgttattgtttcttatctcttggccaatgtctcctacttcttcgtcctgccgcattccaccattgaagctaccaacaccattgccgtccagttcggtgacaaggtatttggcagtataggtgccttgatttttgcgcttatcgtttctgcaagctgtttcggtgctttgaatgcgactgttttcacgagcggacgcctagtctacgcagctggtaaggaaggctatcttccaacactgttcggcaacctttggacgcaaggctcgtccagcagcatgaaccggcttcaacgccagtcgtggatgagcaagttagtccgtcgggtctttggcaatgggacatggattggctacacacccattaatgcgatggcgctgaatggcatccttactttgctatatgtcatcgttggcgagttcggcacccttgtcaccttctacggcgttgcaggatacacgttctactttctcaccgtgctgggtctcatcgtgcttcgcgttcgggaaccgcagctagagcggccctataagacctggatttcgacgccaattatattctgctgtgtcagtcttttcttgctcagtcgtgccgtcatctccgaaccactacaaactctcattgtagtagcattcattgtcgctggggtccccgtttatatctggcgcatttacaagcgggacggtaagaaggcgtttcaagga

SEQ ID NO: 36403 - DNA, 2244 bp, Aspergillus nidulans
tcagctgcgctattttctgctttgaactcttcaaaagccgtaccccaaacgcttaccgaaaagatcgtacagaagtactctgtgggattgccacagggcaagttcgtcaagtctggcgactatgttactatccaaccccaccgttgcatgagtatgttcaatatccaggagctagctccaaacgaatgttggccggagttgtggctaataagatgaattctagcacatgacaacagttggccatgcgcattgaagtttatgtccattggtgcttctcgtttgcataacccggatcagattgtgatgactctcgaccatgatgtgcagaataagtctgacaagaacttgaaaaaatatcggcaaatcgaggaattcgccactcagcacggcgtggaattttaccccgctggtagaggtattggccatcagatcatgatcgaagagggatttgcctggcctggtactcttgctgtcgcgagtgactcgcacagtaacatgtacggtggtgttgggtgtctgggcactccaatcgtgagaactgacgcggctagtgtttgggcgactggtaaaacctggtggcagattccccctgtggcgaaggtgacgttcaagggcgtcttaccaccaggtgtgaccggtaaagatgttattgtcgccctttgtggtctgttcaacaaggacgatgttttgaatcatgcgattgaattcactggatctgaggagacaatgcgaagcctctcagtggatactcggttgaccatcgccaacatgacaactgagtggggggctttgtctggactcttccccattgacagcgtgctgaaggggtggctgaggggcaaggccacgacggcagccatggggcttgcggacggtcctttcaagacccgggctgctgagcgattcacgcacccgctcctagagcagctgttcgagaatccgttgactgctgataaaggcgccaaatatgccaaggagctgttcctggacctttcaagcctttctccttacgtctctggacccaactcagtcaaggtggctactcctcttaaagagcttgaggcccagaacatcaaagtggacaaagcataccttgtctcctgcacaaactctcgagcctcagatattgctgccgctgcgaaggttttcaaggaggctgccgaaaagaacggcggcaagatccccaaaatcgccgacggcgtcaagttttacatcgcggctgcgtcaattccggagcagttagcagccgagggaaatggtgattggcagacgttacttgaagctggagcaacgcagctgcccgctgggtgtggaccctgcatcggtatgggccagggtctgctggaacctggcgaagtcggtattagtgcttcgaaccgtaacttcaagggtcgcatgggtagtactgaggcgaaggcgtatctgggaagcccggaggtcgtcgctgccagcgcgctgagcggaaagctcagtgggcccggctggtaccaaacccctgaaggctggacagaagtgattcgcggtgaaggagacggcatccgcgaagaggatcgaatgctgacgaacgaagaagctctggagaagataattggtcagctggatgaccttgtggccgatggtgagaagcgttttgcttcggagaccccagcagttgaggaatccgagcaaggcctgacagagatctaccccggatttcccgaacgcgtctctggagaacttgtcttctgcgacgccgataatgtcaacacagatgggatctaccctggaaagtacacctatcaagacgacgtgccccctgagactatggcccgcgtctgcatggagaattacgatccagaattctcgaccactgctaaggaaggggatatcctggtaagcggtttcaacttcggctgtggcagctctcgagagcaagctgccactgctatcttggcgaagaagattcctttggttgtatcaggcagctttggaaacattttctcccgtaacagtattaacaatgctctgatgggcctcgaggtcccacggctggtcaaccgccttcgtgagacatttggatctggcgacaaggttctcactcgccgtactggctggactctgacctgggacgtgcggaagagccagatcgaggttcaggaaggcccgggcggacccaagtggacgcacaaggttggagagctaccaccaaacgtccaggagatcattgccaagggcggtttggagaaatgggttaagaacgccatt

SEQ ID NO: 36404 - DNA, 931 bp, Aspergillus nidulans
atcagcggcaatattacggaaactagatggaaatttggatgagaactcatcaggagaatccggagggaagacgcggaaaggtgaccttgtcctcaaccagtacgaacaagcgattgcgatggatgtggtggccccggaggacatacccgtatccttcaaggatataggcgggcttgaagatatcattgaagagctaaaggagtctgtaatatatcccctgacgatgcctcaccttttctcgtcgacatcttcacttctcacagcgccttcgggtgttctcttatacggccctcccggttgtggaaaaaccatgcttgcgaaagcgcttgcccacgaaagtggcgcatcctttatcaacctccatatttcgacattgacagagaagtggtacggtgattcgaataaactcgtcaacgcggtcttttccctagccaggaagctgcaaccgtcaattgtcttcatcgatgagatagacgcggtacttggcacaaggcggagcggcgagcatgaagcgagtggtatggtgaaagcagagttcatgacacattgggacggtctaacgtcggcaaactctttgggcgagccccagcgagttgtcgtgttgggagccacgaatcggatgcaggatatcgacgaggccattcttcgtcgcatgcctaagaaattccctgtcgaactaccaccggccgcgcagcgtttagggattctgagcctagtacttaaggatactaagattgaccgccagaacttcgacctacactacctggtcaaagcaatggcagggatgtccggtagtgatatcaaggaagcttgccgtgacgctgcaatggttccagtccgggaattcatccgacagaagacagcacagggtttgaaaattacttctgttgacccaagcgaagtccgtgggctgcggactgaggatttcttt

SEQ ID NO: 36405 - DNA, 2077 bp, Aspergillus nidulans
cttcgcagcaaaaatcgccgcccccgtccccagattagtgcgccgaaacccatatcgggcccgctaccccagaatcaccagcccgcagcttctggctctggcactgcttcgtcgggctccggatcgcgcgactatgcgtcgtcaaatcatgcgacgtcggatctagtcaagcgaagatattccacacgtttcaatcaagttcctgattttgacggcgcccctccggttccgagtgtaccgcaagttccctccgcatatgcagggcttgggcccccgcagcctagcagaaaacagtcggctgaatcctcagggcctcccgaagttgatctaactgccctacgggatccaagtttaccagttgatcgatgtgagttaccctcaatcagagctcctagcattatccgcagcctcagtactgactcttcgttctttgatatctagatgtgaccaacctgctcgcaaatgcctccgaagatgatatcagagaataccaacaggccctcagaaaggtcaagaaccgcacttcgaccgaccttcaacagaatgtgtatcaaaaccgcacccaattcatccgtatcagtcaggaggcggacaagctcaaaggagagatgaagactcttcgctctttgatggctgaactcactactgccttgggacaaacagctattggggattcgccgaaccccatgtctcctactttggatgagcgagcatcaaagcgcagcaatcgcagctccgtcgccaatctggagagcatgtggaacgttcagctccagacgttatggaaaactgtcgaaggctcacagaagttcctgcccatggttcctggtcggcatattgtgctaaaaactggaaactgggcggaacttgactctgctacttggaaaccaagacgcccggttcatctcgtgcttctaaacgatcaccttttagtcgcagccaagaagcgaaaaagagtcgaccagagtaacccgaaccaccgcggtccagtcccaactaagctgattgcggaggaatgttggccgctgcaggatattgatatgattgacctgggcgccaacttgactggatctgctcgcgaagaggccgaagatcgtggtatcacgaatgctgtctgcgttcgcgtcggctcgaagccctttacatatcgtcatgacaaacgaaatagcaccgccaagagtgaacttttggcgacattcaggaaaactgtagaggacctgcggcggactttacgctcagaaaccgaggcagctgggaagaacggcgagtctcttgggtttatgagtgccataaactccaggaactcgttgttatgttcgccgaaattggacctcagtgagaatacagacaacccccgcgacaggcctgaagtccgcattgacgttgatggaaagcaacagaacttgcgctgggtcgacagccaggtggatgaactcgacattgatatcgcgcttcagagattcgaagaagctgtctcaaacattgaccgactgcgcaaattggcccgtggcctcaaaggaaatgccgtcgcgcaggatgtaatcaacaccaaggtcgatgaacgagctgcgaaactggcaggcatactttcacggtctctggttgatactcacgggttcccagtagcgacgaaaacaaacgtcgtctggctcacccgactcggttttgaggaccaagctcgagaatcctacctcaaagctcgctccgatgtcatctccaaacgaatccggtaagcaaacactctgtccgccaaccaaccccccgcgatcactaaccacgtccaaacagcgcatgtatattcgaaggcgacctccccctctatatattccaaatatccttcgtttacttcactctcattaaaaacacaatcagcacctaccaacaatgcttcccctccgtcatgacaagcgcctgcataaaatgggctaagcaccacctcgacgctttcaacgccctcctaacgcgccaactaagcagcgtccaacgcggtgcaactgtatggcaaaattgcatcaatatcgtccacgaacaggctggcatcctggctgaagttggcgtcgattttacagacttggtt

SEQ ID NO: 36406 - DNA, 1130 bp, Aspergillus nidulans
gagcggcaccttctcctaaaactggatattgcaatgctcagcattggatgcctgggcttcttcatgaaatacctcgaccatggaaacctctcgaacgcgtacgtctcaggcatgcaagaagccctctccatgttcggcaacgaatatacctatgcacaaacaatgtacacaatcgcatttgctataatgcagatcccaagtacactgatcatccagcgtgtgcggcggagtatctggctcgcggccatggaaatctgctggggcgcgttcacgtttgcgcaggccggtctgaagtcggtatctgagctttatgcgttccgattcctggttggtccttcgaaagttcgtttttttcctcattgctttacttattggggagttggtatacaaagactgagcttgcaaaacgcgttgcgctgtttcatctgacggcgccctgggggcggcttttggcgggtatctacaggccgccgtctacgagaatctggatgcagtcatgggattgaagggtggatatggctttatattgtttgtggttgcatgactgttccggttggaatagcaacgttgttcattcttcctgacacgccgtataacacccgagtttgtttttgaacgaaaaggagagggatcttgctaaggagagggtaacgagagcgggaaaggcgccgccggtgagggttacgttaggcacaatcaagaggattctcggaagttggaagtggtatgcgtttgtgcttggatatgtggtcagtactcattcctattgccatgggctcaaggggtgttgctgatgattggcttaggtatacgggctgctgccaaatggtatcttgccttctggccagcaagtcttgcactgaaggagttcgccttcctgataattggagtccagctcatgacagcagtattgtaaggtatccaaccgctttcagtgaattgtctttaacatgcgcagctattcttgggccaacgaagtctgcgccgacaacaatgagcagcgagcggtagtgatccgcagtatgaatgggttccattatgcagtcgctgcatggctgcctattgtcatctttccgtagaccatcgcgccgtccttacgtgagtgtctagtcatttatagcatccatata

SEQ ID NO: 36407 - DNA, 1499 bp, Aspergillus nidulans
accctgaaagaccccaccctattcatcgaaagttcctacattgatgggaaatgggtaacttcgtcctcgtccagaaccttcaacgtctacgaccctgctactgaagaattcatcgggacctgtcccgagtctaatatcgacgatatcaactcagccattcgcgccgccgcaacggcattcccaaaatggcgcgctctctcgggcagacagcgcggcaggatccttcgccgatggttcgatctgattgtcgagaacaaagaggatattgggaaaatcattaccgcggagaatgggaaagcgaagggcgatgcggagggcgaggcactgttttctgcggggttctttgagtggttctctgaagaggcagcgaggatttatggcgatgtcgttccgcatagtaacccgagcagtcgggtgcaggtcctcaaggagccggttggtgtgtgtggattgattacgccgtggaattttcctatggcgatgggggcgagaaaggttgctgctgctttggcggccgggtgtacagtggtcttgaagtcggatggactgacgccgtactcgtcgaatgttttggcgctgcttgcagagagggcaggtgtgccgggtggtgtgttcaatgtggtgactgcccttgagaatacgccggcgttaggcgtggcgctgtgcgagtcggataatgtgaagaagatttcgtttactgggtcaacacgagtcggcaagttgctgatgaagcagtcaagtcatacgctgaagaagttgagcttggagcttggagggaatgcgccgtttatcgtgttcgatgacgctgacctcgagactgccgtaacaagtgccgttgcttgtaagttcaaggtgactgggcagacttgcgtgtgcgcgaacaggttttatgtacaggagggcatctacgaggccttcagtaagcgcttcgtcgaggaggtgaaaaagtgccaggttggccatggactagatcctggagtgacacacggacccttgaccaacggcatcgcgaagacgcaggaacacattcaagacgctcttaacaagggggctactgtgttacttggtggcagccgcctgccgtcccttggcaagaacttccacgaacttaccatcctcggcgacgtcgacgattccatgaaggttgctagcgaagagacattcgggcccctcgcagcgctgtccaagttcaaggcagaggatgaggttgttcgtcgtgcgaacggcgtcgaggttggtctggcatcgtacttaatcaccagtgacctgggtaaagcgcatcgggtctcagaaaagctggagttcggcatggtagccatcaacaccggggttatttccgactctgctgccccgtatgtcccagttcccgttctcacagtatgaaactaacgcctagcaggtttggtggagtcaagcattctggtatgggccgcgaaggaagcaagtacggcattgacgactatttgaacattaagacaattgtcactggcggcatccac

SEQ ID NO: 36408 - DNA, 1786 bp, Aspergillus nidulans
cctaacatcctctatatcatggcagaccagatggctgcgccccttctggccttccacgacaaggactcgcccatcaagacaccgaacctgaacaaactggcagaagagggcgttgtcttcgactcggcgtactgcaactcgccactatgcgcgccttcccggttcgtcatggtgaccggtcagttaccgtccaagatcggtgcatacgataacgccgccgacctgcccgccgatattcccacgtacgctcattacttgcgccgcgaaggttaccacactgcacttgctggcaagatgcatttctgtggtcctgaccagcttcacggctatgagcagcgcctgacttcagatatctaccccggtgattatggctggtcagtcaactgggacgagccggtaagttatgccccgaaatggattagggaaagtctggaaaaattgactggattaggatgtgcgtctcgattactaccataacatgtcctcggtcatggatgccggccccgttgtgcgcaccaaccagctcgactttgacgaggaggtcatctataagtccaagcagtacctctacgaccatgtgcgccaacgcaccgaccagcccttctgcttgactgtctccatgacccaccctcatgatccttatgctatgactaaggagttctgggacctgtacgaggatgttgagatcccgctgcccaagcacgcagccatccctcatgaccagcaggaccctcactcccagcgcatcctcaagtgcatcgacctgtggggtaaggagctgccagaggagcgcatcaagagaacgcgccgcgcttactacgcggcctgcacgtacgttgacaccaatgtcggcaagctcctcaaggtgctcgacgagaccggtttgcgcgacgacaccatcatcgtcttcactggcgatcacggtgacatgcttggcgaacgcggtctttggtataagatggcctggttcgagaactcggctcgcgtgcctttcatcgtcaacgcccccaaccggtttgctccggcccgcatctcgcagaacgtctcgaccatggatatcctgccgacctttgccgaactagttggtgcgccgctagtcaaggaacttcccctggacggagtctccttggtaccgtacctgaccggtgaagacggcgtgaagaccgacaccgtgctgggcgagtacatgggtgagggcactcaatcccccgtcgtgatgatccgccgcggccgctggaagttcgtctactccctcatcgacccgcctatgctcttcgacgtccagaacgacccgctggaaaaggtcaatctcgttgccggcctccctgacccgtcaatggcagccgcagcggacgccaaagcagcagcagccactgctttcaacaaagctgcacccgcaacgctcccaacccctgctgaatctccgcgcgcaacaccccttgcccaccgcaatgcggctcaggactaccccttcccgagcccaacacccccgcgcacccctagcccaggcaagccatccaatgtcaccgtccccgagaccacggacccatccaagctcctcgcctacttcacggaggaggttcactctctctgggatttggagagcattcggcaggatgtcttgcgctcgcagcgccgccggcgcctcgtctactctgcgctaatcaagggcacccctcacttctgggactgggagtaccgcgttgaccctagcacccaatatgtccgcaaccagggcaagggcgtgctagatgatgtggaattcatctcgcgctggccgagagtc

SEQ ID NO: 36409 - DNA, 1032 bp, Aspergillus nidulans
cgcatcccgctcggcgtcgtcgtcctgataacgccctacaaccacccgctgcttatcgcaatgaagaagatcgctgccgcgctcgcgaggcaacgtagtaattgtcaagccgtctgagctcgcaccgctctccgtcttgaagcttggtgctctattcaaggaggctggcttacccgacggcgtgctgcagattgtatccgggtacggacgagaaaccggaaagtacctctgcgagcaccctaagatctcgaaaattgaccttaccggcggaatcgcacatacagagccattgcccccgtcgcagcaatgaacatgatccccatcaccgccgagctgggcggcaaggccccagtgtgtatattcccgagtacggacgtcgaaacagcagtcaaggccgctttattcgcggggttcatcgccagtggccagacctgcgtcactggaagccggatcctcgtgcacaaagacatctacgactctttcaggtcactacttgagaagcgggttcgcgccctccgagtcggtgaccccaccgacgagaagacccagatcggctccgtcatttccgcagccgccatcgagcgctgcgaggccttcgtctcgcgcgccacagctgaaggggggactatactctgtggcgggacaagacttacgccaacgccagagaagaaaggctatttcttcgccccaacagtcatcgaaacggcctccacctccgacctagccaacaatgaggtctttgggcccgtcctcgcgctcataaaatgctcagatgaggatgagatcgtccgaatcgcaaacgggacatcgtatgcgcttggggcgtcggtgtggagcaacgactttacgcaagcgcatagtgtcgcggataagatcgaggctggaattgtctggatcaatgggcatcatctgaatgacccttcttcgccgtggggtgggtttaaggagagtggtgttggcaaggagaatggcgtcgaggcatacgagagctatacgaaggtcaagagcacggttatgaactacggagtcaag

SEQ ID NO: 36410 - DNA, 1880 bp, Aspergillus nidulans
gtgtaggaccacgagtacgatgcggtcgtcgtcggtgctggaggcgctggtctgcgtgccgcgttcggtttggcggaagctggattcaacactgcctgtgtctcgaagctcttccctactcgatctcacaccgttgctgctcagggtggtatcaacgctgctcttggaaagtaggttttggtcttaatttgtcctgtcgcatgcgcttatatgtggacagcatgcaccccgatgactggagatggcacatgtacgataccgtgaagggttccgattggcttggtgaccaggatgctattcactacatgacgagggaggcccccgctagtgtccgtgagctcgagggctacggatgccccttctcgcgtaccgaggaaggcctcatctaccagcgtgctttcggtggtcagtccaaggagttcggtaagggcggacaggcgtaccgttgctgcgccgtcgccgaccgtaccggccacgctcttctgcacaccctctacggacagtctctgcgccacaacaccaactacttcattgagtacttcgccatggatctgctgatggagaacggcgagtgccgcggtatcatcgcttacaaccaggaggatggaactctccaccgtttcaaggctcaccacacagttcttgctaccggtggatacggtcgtgcctacttcagttgtacctctgctcacacctgtaccggtgacggtatggccatggttgcccgtgccggtctccctaaccaggatctggagttcgtccagttccaccccactggtatctacggtgctggatgcttgatcacagagggtgcccgtggtgagggtggttacctgctcaactccgagggtgagcgtttcatggagcgttacgcccctaccgctaaggatctggcctcccgtgacgtcgtctcccgttccatgaccatggagatccgtgagggccgtggtgtcggtcccgaaaaggaccacatctaccttcagctcagccaccttcccgcctctctcctgcacgagcgtctccccggtatctctgagaccgcttccatctttgctggtgttgatgtgaccaagcagcccatccccgtcctgcccaccgtccactacaacatgggtggtatccccaccaagttcaccggtgaggtcctgacccaggatgagaacggcaacgacaaggttgttcccggtttgtacgcttgcggtgaagccgcctgtgtctctgtccacggtgccaaccgtctcggtgccaactccctcctggatctggtcgtcttcggtcgtgctgtttctcaccgtgtcaaggagatcgcctcccccggcaagccccacgccgagctggcctccgacgctggtgccgaatccatcaaggaccttgacactgtccgcactgctgagggccctaagtccaccttcgagatccgcaacgccatgcagaagaccatgcagaccgacgtctctgtcttccgtacccaggagagcttggatgagggtgttgagaagatcaccaaggtcgaccagttgttcgaccaggtcggtaccaaggaccgcagcatgatctggaactccgatcttgttgagactcttgagcttcgtaaccttttgacttgcgcgtaagtaccacaattcacagatacaacatggaaaccaactaatgacatcagcactcaaactgccgttgccgccgccaaccgcaaggagtcccgtggtgcccacgcccgtgaggactaccccgaccgtgacgacgagaactggatgaaacacactctcacatggcagaagaagcctcacggcaaggtcgagatcggctaccgcagcgtcgtgcacaacacccttgacgagaacgagtgcaagcctgttcctcccttcaagcgtgtctactaa

SEQ ID NO: 36411 - DNA, 1682 bp, Aspergillus nidulans
tacttcatcaaatatctcgaccagattaacataaacaatgcctttgtttctgggatgtacgttcgttgctcccaaagccctcctctgctctacaccacatgaagaaggacaaggcctgatagaacgtaggaaagaagatttgggcatgtatcaaaaccaattgaactacatgcaagccgcatggactgtgggctacgtaatcggcgagatcccgagcaatatcatgctcacaaaggttcggccgcggtattggctgcctgcgatggaggtagggctcacttatgctcttagacatgaggaggatcgctaatcactgtcaccgcttagctcctctggacagttctgacgatgtgtctctctcgctgtaataaggcatcgcagttctacgtgctgaggttctttatcggtatgcaaaacctcgatactagccagcaatgctctagccccagaatgctaatactacgtgcctgcaggcctcgccgagagcacattctaccccggcatgcagtacatcattggctcgtggtatcgaaaagacgagctggctaagaggtcatgtatcttccatacaagcagtggcatcgccagtatgttttcgggatatctgatggccggcgtgtacaatcttggtgggaggggaggctttaaggggtggcagtggtatttcgcttcccaagactttatcgctctaatcatgggatagcatgcactgacgaaggatacaggctatttatcattgacggggttatatccctcccagttgctctattgggctttgtcatcttaccagatgtgccggaaatctctaatccgtggtatttgaccaagcaagtatgtttgcccctcttcaaataggacaaggcgggactaaacaggataaaggaggtacaactctgccagaaacgaatggagctcgaaggccgcaagaacagaggaccgtacacaaaagcgaaactcaagaagatcctcacctcatggcatatctattttcttaccggactgtacatgtacgatgaccaacactgccaagagcaaagaacttatttctgacgcgcgcagaacgtttaacaacgccaatggcggccagccggtcttccaacagtacctcaaggcctcgacgaacccagtttactcggttggacagataaactcctacccaacaacaacctatgcggtgcaagtttttacaacccttgtctacgcttgtacgtcccaattcatccatccagccaagtggaagctaatccagtgcacctgcagggacgtctgactccatcctccgtggcgctcgctggcccccaatcctcgtgggcgcagtctcaaacataacatgctacacctcactagccgtctgggacattcctgatgggtggaaatggacatgttacatcatgtctggtgctgggtacggacttagcggtctgtgcatggcatgggcgcacgagatctgcagcggtgacaacgaagagcgcgctctagttgtgggctctatgaacgagatggcgtatgtgtttcaagcatggctgcctcaggtcgtttggcagcagattgatgctccccaatatagaaaggggttcattacggggacggtgatgagtgtcctcctgataattttcacgctctcaatacgcagcttgcagacgagggagaatcgaaagacgaggaggtatgttgcataccct

SEQ ID NO: 36412 - DNA, 1334 bp, Aspergillus nidulans
caccggagatataatcctcttcgtggagcctatgttctggtctctccccaccgtactaaacgtccctggcagtaggtgatgacctcccttttatctcattcaaacgcttgtcacttgaattcagcggactgcgagatgaaccatgtatactgtagcctaacctggcgacagaggcgcccaagaaacaccctccaagacaaccctgcctgactatgacgctacctgctacctttgccctggtaacaagcgcgcacagggagaccacaaccccaaatacgaaaagacttttatcttcgtcaatgactacagcgcggtcaaggaggaacaagcgccctaccacccagaagccggaaccggtacgtcatagcgagacaataccctgcatcttcatgacatccattaactgccattcagagaccgaatcattctttctgcgcgccgacccggtcaccggaaaatgctacgtgctcaccttctccgccgcccacaacctaaccctagcggacctctcaccggtcgagatcgtccccgtcatcaacgcctggacagacgtctacatcgcgcatttgtccccaagcagcccccttgccgccgccgcctccaaactcaccatttcctctggctctcctgcagcaagcctcgccaaaccaaatgaacagtaccgatacatgcagatcttcgagaacaagggcgcggcaatgggctgctcgaacccgcacccgcacggccagatctggacaaccagttctctccctgaagagctcgctgccgaactggaacagatgaagaagtatcgccgcgaacataatgggggacacatgctggccgactatgccgcgctcgagagcaagaagcaggaacgcgtagtctttgagaacgatgcattcctggtcgtttgtccctggtgggctatctggccgtttgagactatgatcattagcaagacgcacaagcgtgctcttgttgatctcgatgacaatgaaaaggcgcagcttgcggaggcgattgctgaagttactaggcggtacgataacctctttgagacacatttcccgtacagtatggggattcaccaagctcccttggaggggtctgaggaggagattgaggcgtcatatctgcatctgcatttctatccgccattattgaggagtgcaacggtgagaaagttcttggttgggtaagttcttcgaaaccattcgcaattttgtgagcgggtgttgacagggcatagttatgagttgatggctgagcctcagcgcgatatcacccccgagcaggcggccgcaaggttacggggttgtgggggtgagttatatcggaagaagttggat

SEQ ID NO: 36413 - DNA, 799 bp, Aspergillus nidulans
ctaacctgagattttctcccttcgcagaccactttcgtcaagcgccacctcactggtgaattcgagaagaagtacatcgctactcttggtgtcgaggttcaccccatcaaattcaccacggtatgccccgctgttgaccccgcttcggcccttccgccgtctcttttgtcgccccgactaacgcaggtatcagaacctgggcacaatccaattcgacgtttgggacacagctggtcaggagaagttcggtggtctgcgagatggatattatatcaacggacagtgtggtatcatcatgttcgatgttacctcccgtatcacctacaagaacgttcccaactggcaccgtacgtgctctcatgcccttttagcagaacgtcactcacaaatacataggtgatctcgtccgtgtctgcgagaacattcctattgtcctttgcggtaacaaggtcgatgttaaggagcgtaaggtgaaggccaagaccatcaccttccaccgcaagaagaacctccagtactacgacatctccgccaagtccaactataacttcgagaagcccttcctgtggcttgccaggaagctggtcggcaacgcctctttggtcagtcgattcctgggtacccgctgcatcacaacgcatactgacagaaacttttgtaggaattcgttgctgctcccgcccttgctcctcctgaggtgcaggtcgatgccaccctcatgcagcagtacagcgacgagatggccgccgccgctaaccagcccctgcccgacgaggacgacgccgacctctaaattgtc

SEQ ID NO: 36414 - DNA, 1716 bp, Aspergillus nidulans
atgtatgactttgatcctaatgccactacagattggtacgagagcgtagatctggtcaagtttatcgctgcagacaatgagttcactgaactccctgacgcggcctttccagatgtcgactcggagcaactggacccggactcggaggagagaggaaatcagtttggcggtctagaggtcctggatgtccacggaaacctgctagaacgccttccgatagggtttaggcggctgcaaaggcttcacacactcaacctctcgaacaacaaattgactatggaggatatcgatgtgattttcgagatggcgagcctccgggacctgaagctggctaaaaatcaactgcaagggcctttctcacagaagattggtcagcttgacaaattggaagttcttgatattcacgagaataccattaccgctcttcctgagacagttgaaggcctcaagcgccttcgagttttgaatgttggccaaaaccagctaacggaattgccgttcgagatcctatgcacgcttcctctgagggagattatcgcccctaaaaacaagctacagggcgtattgattccagccactgtggacaagctggactctctgcaagagctggacgtggtcggcaatgcgctcacgagtctcggagagaagttgacgttgcccgctttaaagactctagcaatcagtatgaaccgtatcaagaatctgcctaatgtctcatcttggcaagcgcttctcaaactttcagccgaggacaacagtatatctgaatttccactgggctttaccgaacttaaaaatgttcgaaacgtcgatctgactggtaacaatatttccagattagacgaaaaaattgggttgatggacaatctctttactttccgcatagcaaacaaccctcttcgcgagcgcaaattcctcaacatgaccgtggaggatatcaagcgtgatttgagaagccgatgcgaaccggaaccacaagagaccgatgatgaggaaggatctgtcgccacacagttcactcttgctccagagacaccggctcagaactcaggctggctgctaaagcctggaggcgtactcgataggtcctatactgatatgcaagagttcgatgtggaacaactggaagctatcaacccgagcgatgtcagatatttatacttgcaacacaatagcctgcgctcttttcctgtaccagcactcagcgtgcttgcggccaatctgacagatctcgacttatcacacaacccactagatatctcttcgcttaccgctaccccagtgatgcttgctagtcttcagacgctgaatctgagtgctacgggcattaccacccttgaaccactcatgaccggtctaaaagctccctcactaacctttcttgatgtttcgtcaaataacctctctgggtctctcccctatattcgacgggcatattccaaattgacaacattccttatcgcagagaaccagctggatagcttggattttgaagccgttcagggtctacaggtgctcgatgtgggaaacaatagcattagctcccttccaccacgaatcggcttgctgcgagcagctggaaacagtgccaactggggtggcggttcggctttacggcggttcgaggttgctggtaatagctttcgtgttccccggtggcagatagtggccaaaggaaccgactctatcctagagtggctgaaagaccgtatgcct

SEQ ID NO: 36415 - DNA, 609 bp, Aspergillus nidulans
ttctggggtcaaggagctgagacctcttcttcgcaggacaatgctggaaagaccactcttctctacagattaaaggtatgtttccgcagtctctgtgtatagtatacatgacttcaacttcgccgctaacactcgaatacatagatcggcgaagtcgtgactacgataccgaccatcggattcaacgtggaatcggtgacgtaccgaaatctcaacttcaacgtctgggtacgtacttcaagccactgttcgggttaatgagctccgctcatattatttgttcaggatcttggaggtcagacatctatccgtccatactggcgatgttactatgccaataccgctgcggttgtttttgtgatcgattctacagacgtcgaaagacttggtacggccgcagacgagctcgccgccatgttgaatgaagaggaactccgcgaggcagctctcctagtatttgccaacaaacaagatcaacctggtgcgaagggcgcaggagaaatttcggaagcactaaagcttggtgagctgcgggataggaactggagcattgtggcttgctcagccattgacggtaaaggtctgaacgagggcatggattggctggtg

SEQ ID NO: 36416 - DNA, 2010 bp, Aspergillus nidulans
aaagccaaagatcgtgatcgcgccatggcaatggaaaaggccaatgactcagggatagcggaaccggaggcggagatggacggtgatacaaatatggaagaagccgaagaggctgctacggaagcgataggctcaaaggtcgtcgttattcatgtcggcagccagaatctgcgcattggtttatcgagtgacgcactgccgaaaaccgtccctatggtgatagcgcgaaagtcaactaccaacgaagccgaagaccaagaggagcctcgcccaaagaggttgaagctggatgacggttccgagatggagccggagaagaagttcggcccagaggtatgtcttgatgtttgatctggtgatataaacctttggccttaaccggttgtagttctcttcgcaatatacgaccatgatggccgacctcaaaacgcacatgcgtcaaaacaagcgtcggactctgccgaactccaaggaaatggtgatcaactataaccgacggacagtaccagagacaatttcagaacacaacgatccaatgcgagtcgaatggactgaaattccagacccggcacccgaatacatcgtgggacaaccggctttacggataccggatgagtcaaagccccgctacaagctttactggccgataaaacatgggtggtgtaatgaggaagactatgataacaagagacttctgtttcttgacatctcgattatcctggaggatgcgattaagacccagctgggtctcacaagcaagaaagattggccgcaatactcctgtgtgtttgtgattccagacctcttcgacaagtcatacgtcacccagattcttgagatgctcatgagagagttctcgttcgctcgggtgtgcttcattcaggagagcttggcggctacctttggcgctggatttacctcggcctgtgtcgttgacattggcgcgcaaaagacatcaatatgttgcgtggaggaagggatgtgtgtcgaaaactcacgagtgaacctgaaatatggtggagccgatgtgaccgagctgtttatcaaaatgatgctttacgatcacttcccctatgaagagataaacctctggcgcaggtatgacttcctgctagccgaggagttgaaaaagaacgtatgcactatgaacgaagccagtgtttcagtgcaggtttttgatttccaccttcgagttgccggccaagacactcgtaagtacacgtttaaagcatacgatgaggtgcacctcgctccaatgggcattttccagccgtcgttgttcgacaactcgcggaactgaatggacggagaaagttgattgcgcgctctgtggacatctatgacggccagccgaatgacccaacatccgccgcccagtccgaaatcctaacggcacttgccccggcgtcgtctgccaaccaggtcaacggcgagtctcaaacgagtatccgggatgtgcaagctactccgagccgctcgcaacaactgaatgctctcagccgcgtgcaggaagccgaggccacccctcgctcgtctgttgcaggctctcctgggcccgaaagtaccccgcaggctggaggcgccgcaacccctgcgcccgctggacagggccaaaacacgtctcaaccccgtgctcccacgattgaggagcgagatgatatcctcccggtgtacccattagacaaggcaattctcacctcgatcatgcatgctgctcgttcagacgagcgcaagatgcgagacttcctcggtggaatcatggtcgtcggtgggggaagcctggttagtaacttccacttgtttgtagaggaacgtcttcagcttctacagccgagctttgccaaggagatcatgatcggtacgcctccaagagaccttgatccgcaagtagttgtgtggaagggcgccagcgtgttcgggaaactcagtgggacgaacgatagttggatcagccagctagagtacgaccgtctaggacaccgtctgcttgcatacaaatgcatgtgggct

SEQ ID NO: 36417 - DNA, 1546 bp, Aspergillus nidulans
  unsure (1)..(1546): unsure at all n locations
ggacagggccgttttcatccaatctccaagcttggttcgcagataagccccagcggcttagggtggattatcgttgacagcttggatactctgatgataataaatctgacgagtcaactctcggatgcgcgaaaatggcttaaccgtggcctgacttatggccaggatcaggatgtgaacacttttgagacaacaatccggatgcttggaggactcctatctgcccactatctgtcgactgtgcttcatgatgtctcgtctcaacgggactatatttatctgtccaaagccgtcgatttggcagatcggctgctcggcgcgtatgagtctagatcaggaataccgtacgccagtgtcaacattgggacccggcaaggacttccctcgcacgcagatggtggagcatcttcaactgccgaggccaccagtgttcagctagagatgaagtatctcgctcatctcactggtaaggaggttttctggcggaaagctgagcaagttatgaaggttgtcgatgatcagcaaagaccggacggcctcctacccatttttatccatccagacactggacggttcagacaccaggaaatccgtcttggcagtcgcggagattcttattacggtataccctgcgtggcaattaacgtttactagagacagaagctcatctgaatccagagtacttgattaaacaatacctacagacttctggacaggagcccgtntaccgtgaaatgtgggagnaggcgttgaccggtattcagaaacccctggttacttcgaccaagcattcgaaactccagttcattgccgagcttccacagggaattggtgggcaattatcgcccaagatggatcatctcgtttgcttcctccccggaacaatcgcactcggcgctactgaagggctaaccgagaaggaagcacgcaagctgcctagctggactccccaaaaggaacagcagatgcaactagctcgggagctcatgaagacgtgttgggcaatgtacgcggttaccgccaccggcctgtccccagaaattgcttggttcagggccgatgaagccgaccttcgatctactttcgggtcatctatacgacctccaagcaagaatgacgaagcttcgtggaaacgagaccttattattaaacctcaagacacacataacttgcagcgaccagagacggttgaaagtctgttcttaatgtaccgaataacgaacgaccctctctaccgaaaatggggctggaagattttcaaggcgtttagaatgcacacggcagtaggcgataatgggggatacacatcattacaagacgtcacaaaggttccggcaccacagcgagataatatggaaagtttttggctagtaagacaccacactcccaatccggaaaatcgttcgatgtttgcagttaagctctaaatatactgatcttgtaggccgagacattgaagtatttataccttcttttttcgccgaaggactttctaccacttagcgacgtggtttttaacacggaagctcatgtcctgcctcgtttc

SEQ ID NO: 36418 - DNA, 1271 bp, Aspergillus nidulans
ttgaatgcaccggctgggacatttttgcccaacaccaaagtccaggttggtagccaccgagtcgtcgttgagaaatacctatccgaaggtggattcgcccatgtctacgtcgtacgtctttcgcagcccgtcgatggctccgataaggcggttttgaagcgagtggccgttccagataagattgcacttgccaacatgcgcaccgaggtcgagacaatgaagaagctgaaaggccaccgccacattgtcaagtacattgactcccatgcgtcccagctcaaagccggcggatacgaagtgttccttctgatggaatactgtgcgggtggaggattgattgatttcatgaatacgcggctgcaaaaccgtttgacggaaccagagattatcaagatcttttccgatgtggccgaaggtgttgcttgtatgcattaccttaagcctcctctactgcatcgagatttgaaggtggaaaatgttctcatctctcgtcatgggaattccgttatttacaaggtctgtgatttcgggtctgctgctccgccgcgccctgccgctacctcggctgcagaaggtcgcttgattgaggacgatgtacaacgacatacaaccttacaatatcgaagtccggagatgattgacgtttatcgcaaacaaccgattgatgagaagagtgatatctgggcgctgggagtcctcctgtacaagctctgctactacaccacaccatttgaggaggttggacagatggcgattctcaatgcttcctacaagttcccttcatatcctccattttcgagccggctgaaaatgctaatctgtgagtgaccgtctagattgcatgatctccactgcgtactaatgccctacagcctcgatgcttcaggagagcgcgcaaaagcgcccaaatatataccaggttctgcgtgaagtctgccaaatgcaaggaagagaagtgccgatcaaagatgtacgcttatccaagatatccgtatatttccgcttgctgacaatgtcagatctatgcccatcgctcgacttcggaagcacgccgataccaggagctcccgccatccccaacagaagcaccgcaagtaggtgccgcattttctccgcctatccaggagactcagattagcattcctgagattgctccgatgcgtcgcgggcggccaacgagacctgatgcctctcaacacaactccgcacgtccaagtccatcgcccttccggggagcatccacagatccgttcgctgcgctggatggtaaa

SEQ ID NO: 36419 - DNA, 1196 bp, Aspergillus nidulans
cccatcaacaatgctgccgtccgggtctcacacctcaccctcgcaatccaagatcgtcccgttacacccccaggaccgaacgaggtgctcgtccaagtcatctcaacaggaatctgcgggtccgatacccacaactggaataaccctaatgtctcgagggaactaatcctcggccacgagtccgcgggtctaaggggtctaatagtggagatcgactccgaagtgaaggatagacatgtcggacagcgtatggccgttgagcccgggtttgcttgtgccacgtacggagactcacacatttccactacccttttttgcccaatattgaaagaagaaagtgtcctgacaatcaagaagatgcgttctgccttcgcgggtaacccaaacacttgcgcaaatctcaaatattgcggcctcgaccccacggatggcacgctgcagcaatatttcacctgcaaggcgcacatggccatccccattccggaggagatatcctgggaagaagcgggcgcaatccagcctcttgcgattgcggtgcagctggctagacgcgcggctctgagtgcgagtaagacggtggctatactgtacgctagccctcccacatcctattaacaatgaagtagctgctaaagtggttggtgacggtgggtgtggaccattaggcctcctcgtaattgccattgcgaaagcctacggtgtgtgcaagatcgtggtctttgatatcgagcaatcccggcttgatttcgcattgtcgtatggagaagatattggcgttctttcaccgaaaatatctgaaaatgttgaacctctgaaattcgtcttcgaatttacatcctccgtcgtaagagaacacaaccttggccacggggtcgacatctctgtcgaagccagtggcgccgactcatctgctcaaatggcacttactatcctgaaacccaggggcacatgcatccaagctgggctggggaagcgactcacaaagcccctctttttcctactgatagcgaacgagttgacgcttaggggacggtccggttcacgccgggatgttaccaggaagcgattgagcttgtacaaagtaaagagcgcatctgaagccgttgattacgaagacttttcccttgacgagggcacaggaggcgtttcgggcacagtttgagagaaggggaattaagattgtcatttttaatcag

SEQ ID NO: 36420 - DNA, 1274 bp, Aspergillus nidulans
ttgcagttgtaggcggcgatcgcgtgggccgccggtgagcccctctccattgaggacgttgaggtcgcacctcccaaggcccatgaggttcgcatccaggtccttcacactggtgtctgccacacaggtcagtgatcgaattgatgcagcgcgttggattttactgataacgacagatgcctacactctctccggaaaggaccccgaaggagcgtttcccgtcatcctcggacacgagggtgccggtattgtcgagtccgtcggtgagggtgtcacgtctgtgaagcccggtgaccacgtcattgctctctagtaggtttcgaaattaagccgagaaagcgcttggctaacaaacgcagcacccccgagtgccgagaatgcaagttctgcaagtccggcaagaccaacctctgcggcaagatccgcgctacccagggcaagggtgtcatgcccgacggcacatcccgcttcaaggcccgcggcaaggacctcctgcacttcatgggcacctccaccttctcacagtacactgttgttgccgacatctccgtcgtcgccgttaccgacaagatccctactgaccgatcgtgcctgctcggttgcggtatcacgaccggctacggtgccgccgtcgtcaccgccaaggttgaggagggctccaacatcgctgtcttcggtgctggatgtgttggtctctccgtcatgcagggtgccgtcaagaacaaggccggcaagatcatcgccgtcgacgtcaacgatgccaaggaggaatggtcccgcaagttcggtgccactgacttcgtcaacccgaccaagctcaacggccagactattcaggagaagctcattgagatgaccgacggtggctgcgactatactttcgactgcaccggaaacgttggcgttatgcgcgctgccctcgaggcctgccacaagggctggggtgagagtatcgtcattggtgtcgctgctgcaggccaggagatttccacacgacgtaagccgccaatctaattgagacttcgttgagccttctgctaactccccatgctacagcattccagctcgtcaccggtcgtgtatggcgcggctgtgctttcggtggtatcaagggccgcactcaactccctggcctggtggatgactatctggatggcaagctcaaggtggatgagttcatcacccaccgtgagcccctcgccaacatcaacactgcctttgagcagatgaaggcgggtgactgcatccgctgagatgttgacctgtcataaata

SEQ ID NO: 36421 - DNA, 549 bp, Aspergillus nidulans
gtttgggcagtactggcgtccggctcggatgacgagacagtgcggctctgggacccggcgacgggcagcctgcagcagacgctcgaaggccattcaggctgggttttgtcagtggccttctcgcccgacggccggctactggcgtctggctcgtttgataagacagtgcggctctgggacccggcgacgggcagcctgcagcagacgctccgaggccattcaaactgggttcggtcagtggccttctcgcccgacggccggctactggcgtccggctcgtttgataagacagtgcggctctgggacccggcgacgggcagcctgcagcagacgctccgaggccattcagatacggttcggtcagtggccttctcgcccgacggccggctactggcgtccggatcgtttgacaagacagtgcggctctgggacccggcgacgggcactctgcagcagaccttgattatcaagggaacagtcactgaactccaattctcccaagatggttcatatatcagcactaacctgggatcgctcaatattcaatcc

SEQ ID NO: 36422 - DNA, 2166 bp, Aspergillus nidulans
gaatgcccctacagccgccagaacgccaacattgacgccgccggccaaaacaaccgggactggtggcggaccgatctcaaactgaacatctttcgtcagcacaactcggtctctaatcccctggataagggctttgactatactgccgcgttcaatagcctcgactacttcggactgaagcgggatctggaggcactcatgacagactcccaggactggtggccggccgactttggtcactatggcggactctttatccgcatggcctggcacagtgctggaacgtatcgcgtctttgacggtcgcggcggtggcggacagggtcagcaacgcttcgctccgctcaacagctggccggataacgtcagcttggacaaggctcgtcgtctcttatggcccatcaagcagaagtacggaagcaagatctcatgggctgacttgctgattctcgccgggaatgtcgcccttgaatcaatggggttcaagacctttgggtttgccggtggccgaagtgatacctgggaagcagaccagtcggtcttctggggaggcgagaaggaatggttgggtaatgatgtccgctacttgaacggagaactcgacaacccgcttgcggcatcacacatgggtcttatttacgttaatccagaaggacccaacaagaaccccgacccggttctcgcggccaaggatatccgcatcacctttggtcgaatggccatgaatgatgaggagactgttgccctgattgctggtggacacacgttcggaaagacgcacggcgcgggccctgcaacccatctcggcaaagaaccacatggtgcgggtattgagttacaaggcctaggctgggagagcggcttcgagtctgggaccgggcgacatgctatcaccagcggtctggaggtgatctggaccaagacccctaccaagtggagcaaccagttctttgagtacctgttcaagtacgactgggagctcaccaagagtcctgctggtgcccaccagtatgtggcaaagggagtcgagcccttcatcccggatccgttcgaccccagcattaagcacccgcccaggatgctgacaactgacctgtcactccgctacgatccggagtacgagaagatctcgcgtcgtttcctcgagaacccggaccagtttgctgatgcgtttgcacgcgcctggttcaagcttactcaccgtgatgtcggtcctcgagtcctctaccaggggccagaagtaccatctgaggtcctcatttggcaggaccctgtgccgccactggaccaccccgtcatcgacaatgatgacatcgccactttgaagaaggcaatcctaaacagcgggataagccatactgatctcttttccaccgcttgggcctcagcttcgaccttccgtggaagtgacaagcgcggtggcgccaatggtgctcgcatccgtctgagcccgcaaaagaactggaaggttaacagccagccgtggctgagcgaatccctggcagcacttgaaaagattcagaagcagttcaacgacgcacagtccaccgacaagcgcgtctccttggccgatttgatcgtgcttgccggagctgcttctctggagaaggctgcccgcgatgctggccacaatgtctccgtctccttcacacccggtagaacagatgctacccaggagcagaccgatgtggactcgtttaacaacctggagcccattgccgatggcttccgcaattacggccgaggaacgcctcgtgtgctcaccgaggacttcctcattgacaaggcgcagctgctcaacctctctcctccagagctcaccgtccttatcggcggtctgcgtgtgctgaacaacaactacgaccgttccaacctcggtgtcttcaccaaacgccccggccaactcaccaacgacttcttcgtcaacctactggacatgggtgttcagtggaagccggcagatgacaccaacgaaatattcattggcagcgaccgtaagactggccaggcaagatggaaggcttctcgggcggatctcgtgtttggttctcacgctgaactgcgtgcgatctctgaggtatatggcagctctgacggagaagccaagttcgtcaaggactttgtggcagcatgagaaaaggtgtcgaacctggacgactttgatctc

SEQ ID NO: 36423 - DNA, 2302 bp, Aspergillus nidulans
atggctactagtatcaccgccggcctacaaaaggcccagcaagcagtgcaggacactgccaccaagaacaagaagattgtcgatattagccacgacacagtaaatgtccacacagaccaggagcagcgaacagattttggtgtcgcgatcaccgaccctgatcactggctgcgcgtcaccaacgagacgcactcgggcccctcgctgctagaagaccacatcgcgcgagagcgcatccatcgtttcgaccacgagcgcatccctgagcgcgttgttcatgcccgtggaacgggcgcctacggcaatttcaccctcaaggagagcatcgaagatttgacctatgctggagtgttaacggatacttcgcgcaacacccccggtgttcggtgcgtttctctactgtccagggcagccgggggagtgctgataccgttcgcgatgtctcgcgggttcgctgtcaagttctacactgacgagggaaattgggatattgtcggcaacaacatccccgtcttcttcattcaggatgccatcaagttccctgactttggtacgtgccccccaaatgaccgcgactgagtgatgctaactgcctgcagtccacgctgtcaagcccgagcctcacaacgaagtgccccaggcccagacggcccataacaatttctgggactttgtgtacttgcaccccgaagccacgcacatgttcatgtgggcgatgtctgaccgcgccatcccgcggtcctaccgtatgatgcagggtttcggtgttaacacgttctcgctggtcaacaaggagggtaagcgccactttgtcaaattccactggatccctcacctcggagtgcactcgctcgtctgggacgaggccctgaagctggcgggacaggatcccgacttccaccgcaaggacctgatggaggccatcgataacaaggcctatcccaagtgggactttgccatccaggccatccccgaggaggaccaggacaagttcgagtttgacatcttcgatgccaccaaggtctggccggaagagcaggtgcccctgcgtgtggtcggcgagctcgaactgaaccgcaacatcgacgagttcttccccgagactgaacaggtcgccttctgcactagccatatcgtgcctggtatcgacttctctgacgacccgcttctccagggccgcaacttctcatatcaggatacacaaattagtcgtctgggtgtgaactgggaagaaatacccatcaaccgacctgtctgcccgttcctcaaccataaccgggacggagctaaacgccaccgcatcaccaagggcacggtgaactattggcccaaccgcttcgaggccaaccctccagctagcgacaagggcttcaagtcgcacccagccccgattacaggccgcaagcgccgcgatctcacacccaagttcaaggaataccacaaccaggcgcagcttttctataactccctctccgaagtcgagaaggtgcacgtcaagaaggccttttccttcgagcttgaccactgtgacgacccgatcgtttacgagcggctcgcaggccagcgcctcgcagagatcgatctccccctggctcaagccgtggccgagatggtcggcgcgcccatccccacgaaggcactgcgtgataaccacggcaagacctccgtccgtctctcccagttcgacttcactcctaaggctcctggcattatcagccgtcgcattgccatcatcatcggtgacggctacgacaagatcgccttcaatggcatgaaggccgctattctcgccgcgcaagcgctccccttcgtcattggcaccaaacgctccgccatctacgcacagggcgaggataagaatagctctaagggtgtgattcccgaccacatgtatgacggcatgcgctccaccatgttcgacgcgaccttcatccccggcggctcgcacattgagactctccaaaagaacggccagattcggtactggattgccgagacattcgggcacctcaaggcgctcggtgccatgggcgaagccgcgcagctggtcaaggaagttctgggcaatgtgatgggcgtccaaattgccggtgcggactctgctgagcccgtcgaatggtatggtgttgttacagctcgtggaccagagagcgccgagagcctcagtgagggcttcaaggtgctcaaggacgccggtgatttcacaagcaagttcttttaccagatcagtcagcaccgcaactggcagcgtgagttggatggattggcttcgacggttgcgttctaatctcactgcctcggt

SEQ ID NO: 36424 - DNA, 1052 bp, Aspergillus nidulans
cgagcgaacatcctcaaagaggtccagattatgcgccagatcgatcaccctaatatcgtcaaactgatccagttttctgagtctcgccaatactattacattgtcctcgagctctgcccaggcggagaactcttccaccaaatcgtccgcctgacctactttagtgaggatctcagtcgtcatgttatcgtccaggttgccaaagcaatcgagtatctgcacgagacatcaggtgtcgtgcatcggtatgggtactcttcgtcgttatcaggagcgcagctaattttgccagtgacatcaaacccgagaacctcctcttctatcccaccgaatatgtcccatcgaaacatccaaagccgcgccaacctggcgacgaggacaaggtagacgaaggtgaattcatacccggcaaaggcgcaggcgggataggtgtgatcaagattgccgactttggtctgtccaaggtcatatgggatacccaaacaatgacaccatgcggcactgttgggtatactgctcccgagatagtaaaggatgaaagatattctaagagtgtcgacatgtgggcgctaggttgcgtcctttatactctgctttgtggatttccgcccttctacgacgagagcattcaagtccttacggaaaaggtcgctcgtggacagtatactttcttatcgccctggtgggacgacatttcaaaatctgccaaggacttgatttcccacctgctgacggtcgaccctgatgaacggtataccatcaaacaatttctggctcatccttggatccgacaatccggtgaagagacgcaagctgcttcagacgccccgccactaacgacaccggcgcccgaagctcgcaaccaggcacttgatgccattgcggcagaacttgcgccatatccgcccgcgagtgcacagctgtcagccggggaacggccaatggatttccgatctcctggtgcaattaacttgcgtgaagtctttgatgttggctacgctgttcatcgacaggaggaagagggcaagcgacgcaaagctggccgcggtttc

SEQ ID NO: 36425 - DNA, 1360 bp, Aspergillus nidulans
ttccgcaaggtgggctggttcaatgccaccgtcatcttcatcaagatcctgtttgcgaccggggtgctctcgctgccatcggccctgtatgcactcggcgctgtgggagggtccatcagcatcgtcgcctggggagccttcaacacgtactgcttcgtgatcctaggcaacttccgcctcaagcacccgcactgccactccatcgctgacatggctgaggtggccctgggtatcgtcggcaaggaagtgacaggccttctttttatcattggctacgtcctggtgacgggcagtggcatcgttggcgtgtcgaccgcgctcaatgctctgtcgcatcatgcggcgtgtaccgtctggtggtcttttctagccaccgcggtcatcattgcgactgcgtcaatccgcaagctcgaacacgtcggttggctgagctacgtcgggttcctgtctatctacatcgcagtcttcattgtcgtcgtcggcgtgacgcagcgggaccgaccagcggctgccacgggaaggtcccctacgtctgcatacgttgccatcaaccaaacccggtcgcgggtggtatggtcgcgtcgagcaccattttcgtctcttccgctgggaccagcgcgttcttacccgtcatctctgagatgcgtaacccgaaggaatacaagaagccgctgtattactgtatgagtctggtgacagcttcgtatcttgcctttgggctggtcgtctatcgctggtgcggtatgtgggttgccagcccgtcgcttggggtgtgtattattcctttattatctcttagactagtagttggctgatagtacatagagcgcgggacaaactatcaagatggtgtcttatggcgtcgccctggttggcctgatcgtcagcggcactctctacctacatgtaagcgttcgaaggaaactgactttctccattctctctaatgcatatcacaatccaccaggtcggtgcaaaatacgtcttcgttcgcatcctcggtaaaacttctcacctccagtccaacagcattatccactggggcacctggctagcttgcacaacattgctcggagcgctggcctttatcctggccgaatcgatcccaatctttaattacctcattgcactcgtcggctcagtctgttttgcgccgcttgcgatgagtcttcccggactgctctggctgtatgaccacgggcactacaggaaggagtcgcttatgcagaaggtcgtgtatttgctgcatatcggcctcgttcttcttggtgtcttcttcctggttggcgcgacgtatggagtcgtcaagcaaatcattgacgcctatgcgactggacagatcggtaagcatttgatcttt

SEQ ID NO: 36426 - DNA, 1417 bp, Aspergillus nidulans
atgacttgggtcctacgcacagtctggatcctgtggctccgcccgacatggctggtgttgggggggcagcgcatcgtgttcctcatcacatagctcgtggccgttttccttcactccacgggcagtgtcagcgtcgacgcattcctcaatatgatcgcattctattgcaaagaaggacccgactcaaaagctcttcgccgcatccaaactgctagccttgagtacctttggatgggaccgcgaggaatgcaggtaatgagtatccacgccgggcatacttgggagacagcctttgtgctgcaagcctatgccgaacggattgagcaaggtacctgaaatccaagcagccatagagcgtgcatacaagtatctggtcgagcagcagcatgtggttgactaccctgaagactcgcaatgccacttcttctcccgccttggtggctggccgttctctactcggtaccaaggcaatgtctgctccgattgcactggcgattcgctcaaatctatcttgatgatagagagggattcccgtttcacccggcttacgacagaacaccaacttcagcttgctgtggacaacctcattatggtccagaacgcaagtggcggctatagcagcttcgagccaactcgaggaagcgagctactagaatatatgaacggtacggagctgtttggtaaaatgatggttgaatatgacttcacggaatgtacctcgtcctgtattacggcactggccctttatcaccagcgcaaccccaactatcgaaccaaggcggtctgtactgccattgaccgaggcatcaaatacatattgaagcagcagcgggcagatgggagctggttgtcatcatggggtatagcgtgcacatatggagccttttttgcgttggaggctctggcaattgggggcctgaattatcagaacagccctgccgctagaaggggctgtgacttcattgtcaagcagcaactagctgacggaggatggggtgagacaatagatgtacgtttactcctctgaatcgcaagagaagggggaagcaggctaacggtatccagtccatcttgacggaatcatatacttcatcagaagcctcccatacggttcagacagcctgggtgtgcttagccttgatgcaggctcagtacccaggccaagagcccattcgcaggggcgtccagctcttgattagtcgacaacgagagaacggcgagtggaggcaagagcgcgcagtgggaagtggaatagttacttggtatattattgatgatgtgtcgctctggcagttcctttaagctaacctaacattctagtgagcttctgtaccacagctacatttactcatttcccatccgcgcacttgcgatgtacaaggcgaagtatggcgacgatgcagtcatagattaggta

SEQ ID NO: 36427 - DNA, 1669 bp, Aspergillus nidulans
atggagaattacctgcgtgtctggcgacagcaggcgaaagttcgtggccagtatgatgccgccgtattcattggagacaaagtccttgcgttgacaagtgagctcttctcgcgtttgcaccccggcaaccgattaacttcgatgcatagacagtgacgaagatgccctttggctggccgaagtacatttttcgaacaacaactacacgcgagctcttgccatcctctcccgtcaagacctcatatcgcggagcaccgcctgccgctatcttgccgcgcattgctacatcaaacaaggccagtacgagcaggccctgaccgtgctaggcgaccagaacccaacccatctaatccgcagcaacaaaagccgccgcaaaattcagcacctcaatgggcatagtcgaataacactccgcaatgccaagtcacgctatgaagatcgagaccgtgaagatgctgggaacattcgatatgaggcgggcatgtgctaccttcgagggctctgtttcgccaagcagaatgcattcgatagagcgcgcgactgctacaaggatgcggtgcggattgatgtgcagtgtttcgaagcttttgaccagctcatgaaaaactcgctcatgtcgcctgcggaagaacttgaatttcttgagtcgctggactttgactccataacaggtgccgacgcgccaatctcgcaagaagcggccgactttacgagaatgctgtacaccactcgtttatcgaaatactcctctccagcggtgcttaccgatgccactgaaacgttatccactcactacaaactggccgagaatccggacattctcctgtctcgcgcggaagctctatatacccagtgtcggtttgcggaagcgctagagttaacttcatcgattctttccacgtcccgttcctccttatcagcccagacgaccgcaggccaaaaccacctcggtcactcccccactgtatatcctctacatttggcctgtctatatgaaacgggggcaacaaatgcactgtttctcctgtctcatacgttggcagatcactcacctgaggaatcatatacctacttagccattggggtttactacctatcagtcgcaaaaattgcagaagcacggcgtttcttttccaaagcgtctttgctggatccacattccgcacccgcctggatcgggtttgctcacacttttgcagcggaaggagaacatgatcaggccattgccgcatacagtacggctgcgcgactattccaaggcagccatttgcctcagttgtttcttggcatgcagcaccttgcgttgaacaatatgtctcttgcccaagagtatctgtgtgctgcgtatgcgatgtccacgggaacagccaccggcacagttccgtcaataccctcgttgccgtcgtccgagatgtcgcccctgggcggagatccgctggtgttgaacgagctcggtgttgtgctctaccaccagaatcacttggagggcgcggtggatttattccgccaggcgctcggccttgcgacatctcttcgatgcgagccaggcgcctgggttgcgacccgatctaatctcggtcatgcattgcgtcgtttaggtcgatactctgcggcattggatgaatttgacgagtgcctacgaatcgggtctagtggtgcaagtcttggg

SEQ ID NO: 36428 - DNA, 1998 bp, Aspergillus nidulans
gctttcagacttcccagcacagctgcccggagatggaactcaacagaggagaaggtgaagggccaggtcatcggtattgacttgggtaccaccaactctgctgttgctgtcatggagggcaagacccccaagatcattgagaacgctgaaggtgagtggcgacaagcttatattccttttcaccagtactgagcgatggctaataataaaaaggtgcccgcacaacagccctccgttgtcgctttcgcccaggacggcgagcgtctcgtcggtattgccgccaagcgccaggctgttgtcaaccctgaaaacactctgttcgccaccaagcgtcttatcggtcgtaagttcaccgatgctgaggtccagcgtgatatcaaggaggtcccctacaagatcgtccagcacaccaatggtgatgcctgggttgaggctcgcggagagaagtactctcctgcccagatcggtggtttcgttctgggcaagatgaaggagaccgctgagaactacctcagcaagcccgtcaagaatgctgttgttactgtccctgcctacttcaacgactcccagcgtcaggccaccaaggacgccggtcagatcgccggtctcaacgtcctccgtgtcgttaacgaacccaccgccgctgcccttgcttacggtcttgagaaggaggctgaccgcgttgtcgccgtctacgatcttggtggtggtaccttcgatatctccgttctcgaaattcagaagggtgttttcgaggttaagtccacgaacggtgacacccaccttggtggtgaggacttcgatatcagccttgtgcgccacattgttcagcagttcaagaaggagtctggcctcgacctttccaacgaccgcatggctatccagcgtattcgtgaggctgctgagaaggccaagattgagctgtcttcttctctccagactgagatcaaccttcctttcatcactgctgatgccagcggtgctaagcacatcaacctcaagatgacccgtgctcagctcgagtctcttgttgagcctctcatcagccgcactgttgaccccgtgcgcaaggcccttaaggacgccaacctccagtccagcgaggttcaggacatcatcctcgtcggtggtatgacccgtatgcccaaggtcactgagtctgttaagtctctgttcggtcgtgagcccgctaagtccgtcaaccccgatgaggctgttgccattggtgctgcgatccagggtgctgtccttgccggtgaggttactgacgttcttctcctcgacgtcacccctctgtctctcggtattgagactctcggtggtgtcttcactcgtctgatcaaccgcaacactaccatccctaccaagaagtcgcagaccttctctactgctgctgacttccagactgccgtcgagatcaaggtcttccagggtgagcgtgagcttgtcattttcaacaagctccttggaaacttccagcttgttggcattcctcctgcccaccgtggtgtccctcagatcgaggtcaccttcgacattgacgctgactccattgtccacgtccacgcgaaggacaagtccaccaacaaggaccagtccatcaccattgcctctggctccggtctctccgacgccgagatccagtccatggttgaggatgctgagaagtatggtgctcaggacaaggagcgcaaggcggccattgaggctgccaaccgtgccgacagcgtcctgaacgacactgagaaggctctcaaggaattcgaggaccgtcttgacaaggctgaggctgagcagatccgtgagaagatcaacaccctccgtgaattcgttgccaagaaccagtctggtgaagtcgctgctaccgctgaggagctcaagcagaagaccgatgagctccagactgccagcttgaccctcttcgacaagatgcacaaggcccagtctgagcagcagcagcagcccaaccagggcgagaccggccagggtgagaacaag

SEQ ID NO: 36429 - DNA, 1453 bp, Aspergillus nidulans
ccacacctcctgagtccaaccaacctgctgctgtgcgcctgtttgatggtcggattctgctgccagacaatgaacggctacgacggctccctgttcagtggattgctcgccaataccatcttcctcgatcacttcaacggtcgagacgctggcatctgggccggtctggtttctgccatgtaccagatcggcggcgtcagtgcgcttccgttcgttggtccggccatcgacacctggggccgtcggtttggaatgttcctgggcagtttcatgatcgttcttggagcggtcgtgtccgggaccacgatcgcgaatgcaagtgtgggccaattcatgggcggccgcttcttgcttgggtttggcgtctctatcgccgctgccgctgggcctatttatgtcgttgaaaccacacatccagcgtggcgtggtatggtgactggctattgcaacaccttctggttcatcgggtctatccttgcgtctggcgctgtccggggttctatcacccttgacaataaccagtcctggctgatcccgctctggttgcagctagtcttctcaggtatcatcatctgtacttgctggatgatccctgagtcgccgcggtggctgtatgtccacggcaagcaagagaaggccgtcgaggttctgactaaatggcacggccttggcaaccgcgattctctctgggtcaaattgcagatttctgagtacgacgctcacttgaacatggacggttcggtaagtgtccaaagactggacctcgcctgatcgggccggctaacacaagctcgacttataggacaagaaattctgggactaccgcagcttattcaaccgccggagcagtatctaccgtctctgctgcaactgcttctttgccatattcgcccaatgggctggaaatggcgtgctgacctactatctagttcccgccctccgcggcgccggcttcacatccgacgtcacccaggcaaatatcaaccttgggtacgcctgcttccaattcttctgggcccttgtcggtgctgcctttgttgactcgctcggccgtcgtcctatgatgctcttgggtatggctgggtgctgtgttgtttggattgccattctatctgcgtccagtcaggtaaataactcggacggcacactcaacagcgccgcatccaacgctactctcggctttatattcatttttggcgctgccttctccttcttcattacccccctgcaggccttataccccgttgaggtcctatcatatgaaatgcgtgccaagggcatggctttctcctcgcttgcggtcaacgcagcaggactgctcaaccagttcgcatggccggtgtccttggacaacattggatggaaaacttacattgtgttcgtcgtctgggacgccatccagacagtgatcatgtacttcttcttccctgagacaaaggatcgcacggtaagt

SEQ ID NO: 36430 - DNA, 800 bp, Aspergillus nidulans
ctcaaggacaaagtcgccatcgtaaccggcggcgcccaggggatgggcaaagctacagcatccgtgttcctgcgcgcgggcgcaaaggtcgtcattgccgacatcaaagctgagcagggcgagcaggttgcgtctgagctctcatcgctcggcgaagtgcgcttcgtcaagacagacatctccaagtcagaagatgtccagaacctggttgcccagactgtaggcttctttggccgattagatgtagcgatcaacaatgccgccatgactcccgataagacggtgctcattgagacagacgaggaatattggcgccgcctggtggacgtcaacctgacggggacggcgctctgctgcaaatacgagatgcagcagatgcgcaagcagggttccaaggggtctattgtcaacattacctcgatcaatgcgtttatgccgcagccaaatatgcccgcttatacaagcacaaagcatgcactgctggggctgaccaaacatgcggccacggagggaggacccctggggatcagggtgaatgctgttgctcccggtgccatctttgtaaggctacgtttgtttatcgtcaatctcttctcagttaactaacgggctcgaagagcgagatgtccgccaaagcactcgagattatgggcacgacacacgatgaatttgcaccgaaagttagcagtctgaaccgattcggccagcctcactaggttgcgcaggcaagtctgtggcttgcgtcggacagctcgtcgtacgttaacgggattaccttgcccgttgatggagggttcttg

SEQ ID NO: 36431 - DNA, 828 bp, Aspergillus nidulans
tttagcgtcaagggcaaggttgcccttgttacaggcggcggctccggaatcggcctgatggccacgcaggcgctcgcaaagaacggcgcaaaggtctatatcaccggccgcacaagcgagaaactcaaccgtgtcgcggagctatatagcaagaacatcgacgggcagataattccgcttacggcagacgtgacggataagagctcgatcgagaaattggtcgaggagatctcgagcaatgaaaaggccttggatatcctgatcaacaacgcgggcgttagcagcgcaacgcaggatacggacaagcaaacaccggaggacttgcgcaaagcactcttcgaggacgcaagcagttccatggaggagtgggataagacttaccgcacgaacgttgtgcagtgtttctacacgacgactgccttcctccctctgctccagaaggccactgatgcccagcggggctggtcctcgactgtcatcaatatctcatctatttctggtattgtcaaggcctcgcagcaccattttgcttacaatgcaagcaaggcggctaccatccacctgaccaagatgttggcgcacgaggttgcgagctcgggactgaagattcgtatcaacaacatcgctcctggtgtctttcccagtgagatgacagcgagcgagagcgacgagaagcagaagtctgcgcttcccaaagagaagtatgaaggcaaggtcccggctggtcgaccgggcaagcatcaggacatggccgccacggtgctgtttgctgctacgaaccagtacttgaatgggcagacgatcgttgtcgatgcagggtatgtcttg

SEQ ID NO: 36432 - DNA, 2203 bp, Aspergillus nidulans
tcaaaaccgaaagataccaaatcgtcgaaaaagaaagaatcggcgtcgcaagcttcacaacagaactcggcaaacctgggatttcaccatggccaccagtccggcttctcccaaccaggtcaccccgacgtcgtctactacatccgtgaatgatattagaggcaaggcccctgaagatgcttcgcaagccggggggtttcctcctggtgagtatcctattgcgcgaagcgtaggtgtccttttcaacccgttactgacggaggttcagctactcccaccaagcaaggacaaccgatggctccaagtgtagtgatcagccctagcggaccggtacgtgcttgacgcgaagaaatcactcgcttctttgctctggatctgtcgagttcttccgtgctgactcgcatcattttgttgcagcacgctcctccgcccggtgccgccgagaccatgccaggagacctagcccctcctaggaagtcccatgtcttcgatcgcctccaaacaaccccgaaggatatgtcggagggtatacggactcccaagcgtcaacattcttctcgatttgatatttccgatcagcgccagcgagagctggagaagcttcctggctttcatgaagtgccgccgaaccgacgccaggagctctttatgcaaaagatcgaccagtgcaatatcatattcgattttaatgacccaacggcagatatgaagtctaaggagatcaagagactggctctccacgagctcctagattacatcgcaaacaaccgctcagttataaccgaaccaatgtaccctcgcgtggttgagatgttcgcaaaaaacttgttcaggccaatcccgcctccaatcacaccccaaggcgaggcatttgatccggaggaggatgaaccagtattggaagtcgcctggcctcacattcaggtcgtttatgagtttttcttgcggttcatcgaaagtcaggacttcaatacaaatatcgcaaaggcttacatcgaccatcattttgtgcttcaggtacgacatttggttttccttcagcctaacaccactgaccgtctttagttgctagagttgttcgattccgaagacccgcgggagcgcgatttcttgaagacaaccctacatcgtatttacggaaagttcttaaatttacgttcatatattcgccgatctatcaacaacgtctttttccaattcagctacgagaccgagcggttcaacggaattgcggagcttctggaaatccttggatccattatcaacggctttgcccttccacttaaggaggaacacaagttgtttttgaccagggttctacttcctttgcacaaagtcaagagcctcagcatgtaccatccacaactggcatactgtattgttcagttcctcgaaaaggactcgacattaaccgaagacgtgagatttcccagaagtcttccttgctacatttgactctaactgcgttcaggttgtgcttggtttgcttcggtactggcccaaaaccaacagtaccaaggaagttatgttcctcaatgaagtcgaagatatcttcgaagtgatggatccagccgaattcgccaaagtccaagaaccactattccagcagctggccaagtcggtcgctagcccccattttcaggttcggttaatgcggcgctctgaagatgctagccgtactgatatgtcttatgctaggttgccgagcgtgcgctttacttctggaacaatgaatatttctgcaatctggttagtgacaacgttgaggtcattctaccaatcatgttccctcccctatttgagaactcaaagggccactggaataggtatatatttcacctttcatttctatcatcacgctaaccattattgcagaaccatccacagcatggtatacaatgcgatgaagatgtttatggagatcaatcctcagctctttgacgaatgctcgcacgagtataatgaaagacagaatagcgccgagatgcgcgagaaagctcgacagaatcgatgggaaaaggtcgcggaacgagctatgcagcggcagaatggcgtcaacctgccacgtaactcaaccacagccgaaatcccgctgcagctcgatgacgtcgatgctctcactcaggaaagccagaggcgactccagtctctgaaactagatgaggccggttcgaaagatcgacggcctagagagggatctatc

SEQ ID NO: 36433 - DNA, 648 bp, Aspergillus nidulans
caaggcgtcggcaaaacctccctcgtccagcggtacgtcaaaaattcgttcaacgcgtccgccacaacttccaccgtcggtgcctctttcgtcacaaagcgcgtcctcgacagtgcgtcagataccctggtgcggctgcagatctgggacacagccggacaggagcggttccggagcatctcgcggctgtactaccggggcgcgaacgcgtgcctgctgtgctacgacatcacggacgagtccagctttaacgagatgactgggtggttgcatgagctgaagcggaatctgacgtcggacgatgagcccatcgtgatccatgttgttggcacaaagagcgatatcgtggcggacgaccccgggcgcagacgcgtgccttttgagaggacgattgcgtatatcgctgagcagctctatcccagccgtgcgtccacaccgccgccgactgcggcgccgtctgccgcatctgggttcgcgcgaacgtcgagcgcgacactcggaatgggcatgggcgttgacagtaaacggagcagcgggttctggggacaggatatcggctgggactgctgtcatgagatcagtgccaaggacggcgagggcgtcgaggaggtgttccgggtgattgcgcggaagctggtggagcagcgg

SEQ ID NO: 36434 - DNA, 1113 bp, Aspergillus nidulans
attatcgacaatggcgcgtacaacatgaaagcaggctatgcacctgactctcaacctctggatgatgaagaaatcgctctctcagcgtgtgccgccattccaaatgccattgtcaagactcgcgccaaccgaacttacgtcggtgctcaaataggcacaaatgtcacggactggaatgaaatgcttttcaggcgccctgtggagaagggctatactgtaaactgggaagcacagaaagaaatctgggagaattcattcttcgatgagaggaccgtgcggtctaaggaattacacattgcggatccagaggacgtgactatcattttcacggaggctccaaatgctttgccggcactacagaaaaatgcagatgagattataatggaagagtgggggttcgggggctatttgagatgtgttggtaagtctaaatatcttattctttattattgagtgggcatggctaaaccgttcgcgctgaatacaggcccgtcgctgaatgcctggaacgagattcaatccttatttgaagattcggtactatcacaacctcgagccgttgcctccccagccgagtgtctactggtggttgactctgggtattctcacacggttatcactccggtttatagaggcagaccacttcaacgtggaattcggcgactcgaccttggcggcaagcacttgaccaattacctcaaagagctggtatctatgaggcagtataatatggtggacgagacttatataatgaacgaagtcaaagagtcggtgtgtttcgtgagcaatgattttatccgcgacttggagcggacgtggaaagggaaccgcaaacgtggacaaccggatcccactgatggtgttgtagttgattacgtcctgccagatccgaatggaggcaaacgaggttttataggcctcatgaccctttgttaggatccaagaaaagaaagcctggtactggccggcgctagcgccgagcagctaaatgaggacgtcctagttctgggcaacgaacgtttcactgtcccagaaatcctctttaccccaagtgatattggtaaaaagacggctggtataccggatatcatcctgcagagtctctcggtgtgc

SEQ ID NO: 36435 - DNA, 1258 bp, Aspergillus nidulans
aaacgagagcaccaagatcagactggcgatagcagaccaagcaaaaaatctaaaggcacgaaagacacgaaaaaaaacactgaagtttcgccgccttattttcaatcccctgctcttgataatgttcctcaaacagaaattgataaatttctttctgaccattccatcaagataacggatgcctcagcagataaaccgtctctgcgcccaattatctcattttcattcttaccccccagcaataaagacctctacgctccgttagatggtttcgcctcgccgaccgctatccagtcggcaacatggccacttctgtttgcaggccgcgatgtcataggaattgcagagactggaagtgggaagactcttgcatttggtctaccgtgtctaaagaaggtgcttgatttgaagaccaaacaaaaatcatgcagaccacttgcagttgttatctccccgacaagagagctcgcaatgcagatttatgaccaacttgtgaagttcgcggaaaaagtggatattcaagtcgcctgcatatttggcggtgtcaagaaagacgaacagcgtgaagctttgaagtctgcagctgtggttgttgcaactcctggaaggttgaaagaccttcagaatgacggctctttggatttaggcagggtcaaatatcttgtcctagatgaagcagaccgtatgctagataaaggatttgagcaagacatcaaggatatcatctctcctatgccagtgtcaaaacgtcaaactgttatgttcacagcaacctggcctcctattgtcaggaaccttgcctctacatttatgacttctccagtcacggtcaccatcggtggtgacccgtctgcagatccacgtgcaaacagcaggattaaacaggttgtcgaagtggtaaaaccacacgagaaagagcaaagactagtgcaaattctgaacaggcatcagcgtggaactcctgataaagtgctcgccttctgcctttacaagaaggaggctatgcgggtcgagagactccttcgaaccaagggcttcaaggtagcgggtatacggttcgtctttaagccagcaagaaagatttagaagcctcgaggcctttaaatcaggtgcggccaccgttctcgttgcaactgatgtcgcggctcgcggccttgacatacctcatgtgaaactggtcgtaaatgtcacttttccgctcactgtggaggactatgttcatcgaattggccggtaaggacaaagtggctcgtcgtta

SEQ ID NO: 36436 - DNA, 1807 bp, Aspergillus nidulans
cctatcgttcaatgtgtccaagtcaagccactgccaccccaagcaaacaatcaggaacgatacagggttgttttcagcgatatatcaagctatgtgcagacaatgcttgccatccgtatgtggtaccgagcgtgaaccattagatgcaaggtttctaatgagctatcttgtatctagaagcaaatcattttgtgacggatggtctcctacgcaaaggctgttttgtgaggctcaagcaatttcaagcaaactccgttaaaggaaaaaagtagtattttacgctccagattcggagtatatgctgattattataggattcttattgttcttgacctcgaggttctcaaggaactgggagaggctgaaaagcttggcgaaccgaaacccttggagagcaaagcagaggaggaagagaagccacaacccacgacaatctccagcaatgggttctacggggccaaagctcaaaatgcaccctcgcaaatcagctcccgggctcagcatacacggcctatgcagggatctgcacctgccactatatatcccattgaggcgatttctccatatgctcataagtggacgatcaaagcgcgatgcacgagcaagtctcccataaaaactttccacggaaggagtggtgacggcacgctctttagtgtcaatctgctggatgatagtggcgaaatccgcgccaccgggtttaatgagcagtgttctgcgttgtacgatctctttcaagagggtgaggtctactacatttccagcccctgccgcgttcagattgcgaagaaacaatttacgaatctcaacaatgattatgagcttacatttgaaagagatactttggtcgagaaggtcggtgcttaaactgctgtccatcttcatattctcacactatttataggcggaagaacagaatgacgtcccacaagtgcgtttcaatttcaccactattggagacttacagtctgttgagaaggatacgacgatcgatgttataggagtgttgaaagatgttggagagaccacgcagatcgtgtcaaaaacaacaaagaagccctatgacaagcgcgaactgacattggtcgacaacacgggattctctgtgcgattgacgatctggggcacgacggcaatgaattttgctgccagcccagagtctgtggtagccttcaagggagtcaaagtctccgactttggcggaaagagcttgagtttactcagttcaggttctgtgactgtggaccccgatattgaagaagcacatagactcaaaggctggtacgatgcgcaaggtcggaatgagaattttgcttctcatgcttcatcagtcggaacgatgtccgccacgaaacgagatcaattgaaaaccatcgcccaagttcgcgaggagcagctgggcatgtcagaggagccttcctactttacactaagggcgaccgtcgtgtacataaaacaggacaacctgtgttaccccgcatgtctttcggagggttgtaataagaaggtcacagaggtcgaccccggtcagtggcgttgcgagcgttgcgacaagactcacccacgcgcagagtatcgctatataatgcttgtcaacgtcagtgatcacactggacagctttatcttaactgtttcgatgacgttggccggttgttgttgggtatgagtgcgaaccagctcatggaattgcctcagaacgacggtaaggcacttggcaacgttattcagaatgccacctgtcgcacctggactttcggatgcagagcaaagatagatcattatggggatcagcaacggtaagtctgg

SEQ ID NO: 36437 - DNA, 1583 bp, Aspergillus nidulans
tcttgccaagctaactctattgcagaactacggtcaccgcctgcctctcaagccgtttatcgagaagactgtacgcaatgttttgactctgttgtctgagaacaccctttcctcgttcacgtgtttgttctaaccacgggagttatcaggacgacgagtctggcctaaatgtctgcctctcctgctttaatggaggctgcgctggaccaagggatcatgcacgtcttgcactttgagcgtttcggccaccctctggcgttgaatatacgcaggacccgtaaaaagatccaggtactcagccaccacctagcccatgactgtggtctgacgtgctgactgggaacagcgcgaggagcctccacataagatctcaaagcttgccatcaacgcagagactgacgaagaccgttatgacacaagtacacgtgttgtctgctattcctgcggcagggacgatgttggtgagccgagtggcaaactccagtcagtcattgaaggcgtgatgcatgccacgaccttctcgaagagagaggagataaaagcctgggaacaggagtttattccctgcgagcacactactggcttgattcagcaggagtccaagcgcataaagtcacagggtaggaatattcatgaggtcttttgagtgagtctaaccaatatgagcagatctcagccagtgctcaatgtgcgacttgagacaaaatctctggctctgcttagaatgcggtaatctaggctgtggtcgcagtcaatttggaggtactggcggtaattcacatggacttgcacactttaatgcgacatcccacgccgttgccgtgaaactgggttcaataactgccgatggttcagcagatatttactgttataaatgcaacgaagaaagaatcgatcctgaccttgctacgcacctgtatcattggggcattgatttagcggggcgcgagaaaacggagaaaagtctcatggaaatgcaagttgaacaaaatctgaaatgggatttcttgatgacgactgaagatggacaggatctgacaccagtcttcggcgcaggcctgacagggttgtcgaatcttggaaacagttgctatctgtctagtgtggtccagtgcctttttgatttaccagagtttcaacgcagatattaccatcctaacgaagacccgcctctggcagaaacaccagctgctgatttcgaaacgcagctgcgaaaactggcggatggtaccctctcaggacgatactctcggccagatgataagactgtcgcctctccaaagccacaagaaatccgacaccaaaagggcttggctccatcgatgttcaagcatcttatcggtcgcgatcatcctgaattctcgactatgagacagcaggacgcctttgagttcctactgcatgttttcaagcacgtcacattgtccaagcaccctgtagggatggataatccgattgattctttcaagttcagcattgagcagcggctgcaatgtctgaagtgcagaggagttcgctacaggctcgatgaacaagacaatatctcgattccagtgcccgctcgtcgagtaccgattcagaag

SEQ ID NO: 36438 - DNA, 1465 bp, Aspergillus nidulans
cgactaccaactaaacttataagtctgacaataatagcttcttcaaatggctttgacggctctttggtcaatggtctccagtcattagacagctggatgggctttatgggacagccgtctggtacgtggttgggtctaataaatgccgtctactcgctaggcgcactggtctcaaccatctttgctgcctggtgcagtaacaggtatggtcgaaagcagtgcgtttggataggcattgcttttatcctcgctggttcaattctgggcgccgctgctcccaacgacactgtctacatagtctcccgcgctgtcatcggcgtgagctctgggatggttagcaatgcgcctcctctgttactgaatgagattgcctaccccgcccatcggagtatatcatcttgtctgttcatgattggatactactttggggccgtcatttcttcttgggttacgtttgcaactcgcacatacgcctcctcatggtcatggaggctgcctactctcctgcagatgctctgccctctggttgctattcctgggtttcttcttactcctgagagccctcggtggctgattgggcagaaccgcgtggaggaagcccgtaaggtgcttgcggatttgcacgcaagcggtgaccttaccgcacccttggtcataaaagaaattcatgagattcaagaggcgatttctacggagagagaatctgctgcgtcatcaagttattcggacatgatcacgacgcccgggaaccgtcatcgtctattgataactgtgacgattggtatcttctctcagtggtctggcaacgcgtgttgtatcctactatctggccatggtgctggatactgtcggtgtatcggcgacaaaagaccagctacttatatccggatgtctccagatctggaaccttatattcggcaccattggcgccgtactggtcgagcgggatggtaggcgtcctttgttcctgacatccgcaggtgtaatgcttgtcagttatattatcattaccgggctctcgggttcatttgcatccactggctccgcgccgatggggacagcagtaatcccgtttatcttcatttactttgcaggttacgatatagctttgtgagctcaatccttctcgtttttatcttcttttactagacccgtgatcctaatttgccgcaatagaacccctttgttggtcgcatacccctgtgagatctggccgttcgcacttcgatcccgtggtctgagtgtcgcctggttctcagcaatcggagcattgatttttaacactttcgttaaccccatcgcgctgtcagctatcgggtggaggtactatttcgtgtttgttgctatcctcatttgctacggtctcacgtcatggttcgtttaccctgagacaaaagggtataatctagaaagtatatcccatattttcgatggcaatcaccagcctggccatgattcggaaaag

SEQ ID NO: 36439 - DNA, 1498 bp, Aspergillus nidulans
gagttcattcgctctgatatcttgggaaccacctttgagaccaccagcaggtacttccccacgattggataagacgatcctcaggcaactaaccactaacaatgcagatatgcgaacttgcagcccgttggcctcggcactgcaggagttgtatggtatagtttaggaaactatcgtaatggtagtcagataacaactgatagactgctagttccgcttacgacttgatctcggaacaagtggttgcgatcaagaagatgatgaagccatttcacagcacttcggttgcgaagcggacatatcgagaagtgaaacttctgaggcatcttcgacatgataatgtgcggatccttcggggcaggccgctttggagtaggccactatgactgggacaactggcactgacctatattctccagctgatcaatatgagcgatatcttcatctcgccactagaagatgtgtacggactccctgaggctccagtttcggttgacggcagcaattgacatgacgtgacttccaggtatcttgtcaccgaactcttagggacagatctgcacagactgctcaacggaaagccactcgaaagcaaatttgcccagtacttcacctatcaaatcctggtaagacgcaacattgcaattgcatcccgcactaatctcatttccttcccggggcttactgactgacgcaaccctgctccgtcttgcctggttctggtcttactacagcgcggactgaaatacatacactcagcaggcgtaatccaccgagacctcaaaccgggaaatctcctcatcaatgagaactgtgatcttaagatctgcgattttgggctggcccgtgtccaggagccgcagatgactggttatgtttcaacaagatactaccgcgcgccggagatcatgctgacatggcaacggtatgggagcaaggttgatctgtggagtgtgggctgtattcttgcggagatgttgctgggccggccgctgtttccgggcactgaccacattaaccagttctggctgattacagacctgctaggaaatccgccggacgaggtgattgaccggataacaacgaataatgtacgtaaccccgccccggatcttcaaccctccaaccatctggagcccgctaacggaaatcgccggatagactcgtcgggtggtgaagtccatggccaaaaggaatccacggccgttgaaggaaatccttcccgccgctgaggacgctggtaagtgtgcatttgcttcctgcccccctatccggaacatccagtgaccaaaggaacctagcactaaaccttctcgacaacctcctcgtctttgaccttgaccgacgtatctccgccgagcaggggctcatgcacccttggatggccccctatcacgatcccacagatgaacccgtcgcaactgagcaattcgactggtcttttaatgacgctgatctacctttggatacgtggaaaattatgatgtacgttcaccac

SEQ ID NO: 36440 - DNA, 621 bp, Aspergillus nidulans
aagaccgtcctcatcaccggctgcagcgacaacggcatcggctccggtctagccctaactttccaagctcaggactactacgtctttgcaacggctaggaacccagccaaaatgtccaaactcgctgacctacccaacgttactcttttacccctcgatgtctgtaaaaatgaggaaatcacggctgccgtggaggcagtgaaatcccataccggcggcaccggcaaattagactacctaatcaacaacgctggccaagggcacttcatgccaatcctcgaccaggatctgaagaacgcaagagacctctatgaaagcaacgtatggggccctcttgctgtaacgcaagctttcgctccgttactcataaacgcgaacgggacagtgacattcatcacctccgtctcggggcatattaattgcccatacattggcgtatatgcagcgtcaaaacaatccctggagatcattgctgagacactccgccttgagctccagccgtttgacgtgagagtcctgtcggttgtcactggcgctgtgcagagtatggggcaggttgggcggtttgatgagtacaaactcccagaagattcaatgtacaagccaattgaggcgttcata

SEQ ID NO: 36441 - DNA, 1283 bp, Aspergillus nidulans
tttcatcctgtgcatttgatggacactttcaaggatagccggtatagggttatccgaaaactgggctacgggtccttctcgacggtgtggttggcgagagacacgaagtaagtcacacggtcaacacatatgccatggtatcggcaatagctaaggctccagacttggccgctatgttgcattaaaagtcggtcaagctgaggatcaaagctcgagtgcaccaattgaggagactcgaatatatcagctgttggcgaagaccaagtttccatcacatcctggccgtgaccactatcttcccttgctggatcaatttcggtacactggtccaaatggtacgcatcaagctcttgtttatgagcctatgagcgccagcgtcaccgaggtgaaggaggctctgttccctaacggtccgtttccgtttcagatggccaaggccatcctctggcagacgctcttagggctagatttcctgctagccaatggtgtcgtccatggcgatgtacaaccaaggaacctgctgtttaccctagaagaccttaaggacgtaccagaggatcagctggtgcaggataaggacaaatccattactctctgcgtcgacactgagctgaaggggggtgtgaaggggccggagtaccttgttccagcgcactcgttgatgcagtacctcaatatttcaaagccatttaccgtcaaagtgtctgatctaggcggctgtacgtgcccacctccctccagaaaagataggagctgaccctacagccttcctcacttcccacccgccctcagcaccgtcgccgccccttcacctccgtggtccagagacgctctttcaacgttgtatctctgctaatcaggatatgtggagctttgggtgccttatttttgagttcatcaccgggttcgcgttgttcgaccttagcgatcaccctgtgacgggtataacggacgacatgcactttatcgacatgtacaacatcctcgggtttccaaaagatgaggcattgcggaaccaacactggccaaactggcggagatttttcagatctaatggcgagccaatcgaccattttattcggagacgagaccgtgactttgatataaccggaaggccgacctcgcatacattggaagaactgctcgaagaagcggttggagaggggctctcgccagaggaaattaacataacgaagcagttgttaagaggcctgctcgagtttgaagtcgaaaagaggttcacgacgaaggatgtgctaaggcatcaatggtttgtggagcag

SEQ ID NO: 36442 - DNA, 1018 bp, Aspergillus nidulans
atcgaccacaaaacgggcaacctggttgcagtgaagattatccgcaacaagaaaagggttccaccaacaagctctaattgaggtcaaccttcttcagaagctcaaagagtgggatccgcatcgccgtcataacgtggtcaatttcacgcagagtttctactttcggggacatctgtgcatctcaactgaactgctgggtatcaacctgtacgagtttatcaaggcgcacgatttcagggggtttggtatcaagctgatccgtcgattcacgaggcaaatacttaataccctcacgcttttgcaggcgaagaaggttattcattgtgaccttaaacctgagaacattctccttgtccatcctctcagttcggagatccgggtcatcgactttgggtccagctgtttcgagaacgaaaaggtatacacgtacatccagagtcgcttctaccggtctcctgaggttatccttggtatgtcttacggcatgccaatcgacatgtggagtttgggatgcatattggcggagctttacaccggctatcccatcttccccggcgaaaacgaacaagagcagcttgcctgcatcatggaggtctttgggccgccggagaagcacttgattgagaagagcactcggaggaagctcttctttgattctctcggcaagccgagaattacagtatcgtccaaggggcggaggcgacgccctagctcaaaagagctccggcaggttttgaagtgtgacgatgaggcatttttggacttcatctcccgttgccttcgatgggatcctcaacgccgtttaactcccagcgaagctctacgacatgaattcatgacgggtcacagaatggcgcccaggccgagaccctttggaagccagtccccaggaaagcgggcgaatactttgtccacgccgacaacgggtcgacctctcccagaaccgcccggcacaagtctcaaaaatggcgccgttgtccgcagccgcgacccttcgaatccgtcgccaataaaagcg

SEQ ID NO: 36443 - DNA, 1166 bp, Aspergillus nidulans
aaaacaaaaccctcatataccaccccctcgcgccgcggcggtcaatggaccgtcctaatcctcataatctgcaccatcttctcaataaccgaatttcgcacatggctcaagggccatgagacgcaccatttcaccgtcgagaagggcgtctcgcacgatctccagctgaactttgacgccgtaatacatatgccttgcgacgcactgcatataaatatccaagatgccgccggggaccgcgtgctcgcgtcggaaatgttgaagaaggagccgacaagctggaaactctggatggataagcgcaattatcacagcagcgagtaccagacgctcagtgactccaggggagacgaagaaagggtcgcggcaatggaggaggacgtccatgcaggccatgtgcttaacgagctgaggcgcaacgggaagcggaagtttgcaaaagggcctaagcttcgacgaggcgatgtcgtggactcatgtcggatttatggcagtctggaggaaataaagtccaaggggactttcatatcacggcgcgcgggcatggatatcgggatgggagagagcatttggatcattcgggtgcgtatatttcactccctttttctggtccacggtttgaaacatgggtatagtgatgctaattgatggcgtgcaaagcattcaacttctcccatattatcacagaactctcattcggcccacattacccatccttgcacaaccccctcgacaaaacgatcgcaaccaccgaatttcactactacaaataccagtacttcctttccattgtgccaacaatctactcgcgcaaccaaaatctgcggcttgacgctctgccgtcttcctcgtccgcacggagcaacaaaaacctcatcttcacgaaccagtacgccgcaacatcacagtccgatgccatcccagaatccccctacgtgatcccgggcatctttttcaagtacaatatcgagccgataatgctgctcattagtgaagagcgcacgggtttcttgaatctgcttattcgcattgtgaatacggtttcgggcgtgcttgtcacgggaggttgggtttatcagattatgacctggcttggggagttaagaaggaggaggaggggtggggagaagagcgaaggatatttgcatgggaagttggaggaggag

SEQ ID NO: 36444 - DNA, 1557 bp, Aspergillus nidulans
caagaaaccgatcatggagcggaaacagacctccgccgcaccctgtccacccggcatctgaccatgatcgcccttggctcgtccattggcatgggcctgtggcttggaagcggtacttccttgcgcaatggcggccctgccgccctcttcatcgggtacatcctcgcggggacgatgatctggtctgtggctcatgctattggcgagatggccgttctgtatccgctgccgtctgccttcgtgcaatggagcagtatatttatcagcaaagagcttggcttcgccgtcggctgggcttactggttcagcgcgttcatcacgattgccaacgagctacaggtacggtcgcgtgtactttaatcagatgagaaactgacggcaaagggctgtgttacggtggtgagtttctggacggacgcagtcccaaccgctgcgtggatcagcatcttctggttggttatcatcttcatcaatgcgtgggccgtcaggttctttggcgaggtagaagtcgtctcctcgaccattaaattctcgtggatctttgtcgttatcatctcactcataggttggcaaccctccatacctgacgttctttgcacattgccaactcaatccaacgccagttgtctctgccggaggggcaccaaaccatgaagcagtcggctttcgctattggaatgcagagccattcaccaacggcttcaagggctttctgagcgtgatgccaacctgcatctttgcgatgtccggctccgagaatagtgcattggtcgcagccgaaacgcagaatcctcgtcggtctgttccccgggccgttggcacaatctggttgcgtctttctttgttctaccttcttggagcggtcgtcgtgaccatcaccgtttccccagaggaccctaacctgttcggcgcctcgggagctaatgcatcgccctttgtcattgcatacacgaatgccggtataccggtcttagcccatatgatgaacgccgtcatcttcatctccgtcgtctccacaggctccatctctgggtttggaggctcgcgtctgttgatggggttatcccatctcggccttgcaccgaaggtaagcagcacttccatcgcaaggatcagccaaatactgaggagcagatctttggccgcgccgacaggaaaggccgtccggttgcaggactggtagtcacgctcctcctcggtggtggattttcctatcttaatgtcagccaaagcggcgcagacgtcttttcatggttgtcgaacctcacctccctcttcaccctgttcggctggggctccatctgcgcatcccatctgcgcatgcggtacgcgtggaaaaaccagggccgatctgaagctgatctgccctggaagacgtggacttatccctatgcctcatggtggggactctcctggtgtatcctgctcatcatcgccgagttttacttgagtgtctggccgcttcatacgaaccccaacgtaacagacttttttgccaactatgtgagcatcattgttgttcttgttgtgtatctcggtgcgaggctctggtaccaa

SEQ ID NO: 36445 - DNA, 1212 bp, Aspergillus nidulans
aagcccaaggtccaaccttgccgatacaagactggaaagaccctaggagcgggctcctactcggtcgtgaaggaatgcgtacatatcgataccggacaatactatgcagctaaggtgatcaataagcgactgatggtcggtcgggaacatatggtacgctcattagggaactgttgccgcctacggtcgagtgtcgtggccggcgaagctgaaattcaagcgtcggctaaggtaatataggttcggaatgagatcgcgattttgaaacaagtgtctacacggacaccagaacatcttgacactggtggattactttgagacgatgaataactgtacgggctccggtcgaaggataagatgggctgtgaaggcgctaactgctcgctttttctgcagtatatctcgtgacggaccttgcgctaggcggagagcttttcgatcgcatctgtcgaaaagggagttactatgaatccgatgccgctgacctcgtccgcgcgatcttgtctgcggtggcatatctacacgaccacggcatcgtacatcgggaccttaagccggagaaccttcttttccgaacgcctgaggacaacgcagacttgttgattgcggacttcggcttatctcggatcatggacgaggagcagcttcatgtccttaccacgacgtgtggtacgccgggatacatggcgcccgagatttttgataaaagcggtcatggaaagcctgtgtaggttttacccttcagacccgccctagccaagcatcggcaactaactcgaatgatggcacagcgacatatgggccatcggcgttatcacttatttcatgctctgcggctacactcccttcgaccgcgaaaccaaccttgaagaagtgcaggccattgcaactgcaaacttctcatttaccccagttgagtactggcgcggcgtctcccaagaagcccgtgacttcattaagcgctgtttaacagtcaatcccaagaagcgaatgaccgcccaccaagccctccagcacccctggatcaatccgccctacgacacaacagacgacctcggttctggcgaggatctcctccccaacatcaagaagaacttcaatgcccgccgtacgctgcacaaggctatcgataccgtccgtgccatcaacaagctccgcgagaacggcggtctcatgatggatggtataatgagtgttgatcccaagcctgag

SEQ ID NO: 36446 - DNA, 1299 bp, Aspergillus nidulans
tcggcatctacactatctcggagagcgaggtcgtctctgaaatgcacgagcaatgctctctgggatgtcctgaatgatatctggcacccgcagagcaacccccatggctacgtgaccctgggcgttgccgacaacactctgatgcagcaacagctgctgttccgcgcgaacagcagtttcgaaatgtctgggcagcatcttgccctgaacgacaccatcacaggttctccccggctgaaagcagccatcgctgatattctgtcccggtatctccacccctcgaaactactcagaccgtcgcatatccttgccacgaacggggtggcatcagccatcgagcactgctcctgggccctctgcgacccgggcgacggtatcctggtgggacgcccctatttccgtgggttcagccgagacatctgtcttcggccagcggcaaggcttgtccaagtaagcttcgaaggggtggaccctctcggcatatctgcggtatcgatatacgaagaggccctgataaactccagcaagcagggctgtgcgatccgagccatcatgatctgcaacccacacaacccgctaggccgatgctactctcagtcattccttatcgagatcatgaagctctgtcaacgattcggcgtccacctgattagcgacgagatatacgcgttgtcagtttggcgggagggccaggatggggcggtctcaatgaacaaattcacatccgtcctctctatagaccatgacggcctgatcgatccgagtctggtacatgtcttatggggtgtcagcaaggacttcggagcaaacggcatgcgattaggagctgttatctcgcagggaaacagcgacatgctcgagtctatccggggtgtcgcccagtacagctcggtttccggcctggcggactgttttacaacgaacattctggaggatgaaaggttcgtaaatcagttcattgcggaaaacaacaaagcgctcgctgctacctatgagtatgttgttgcttttatggataggcacgggataccctatgccaggggatcgaacgccggcttctttgtatggtgtgacctgttaacaccatatctgaaactgcagcctgcgagttcgttcgacggcagcgaaaaggcaaaggcaataaagaacagggaactgctagacaagttgtcccggttcaaggtacatcttggggttggcgatgactttggcagtgaacagaaaggatggtcccgtattaccttttctcagtcgcagaaccagctcgataaggggttggctcgcatcataaacgccttg

SEQ ID NO: 36447 - DNA, 1795 bp, Aspergillus nidulans
ccacttcaagctttaacgaaccatcttccagctacttatcggatatgcaatccgaactttcactacgagtcgtcaaggaacccacggcgggttctcacaaagcccagtaagggcgtcaagaacgacgggtacgataacgaggacagcgattacattttgtatgtcaacgacatcctgggaagcgaagaggcagggcataagttagtaccattgtgcaacaactcccataacccagtcaagtgtctaacaactgtctaggaatcgctatctcattcttgacgtcctcggccaagggacctttgggcaagtcgttaagtgccagaatctcaagacgcaggaggtcgttgctgttaaagtaatcaagaacaagactgcgtacttcaatcagagtatgatggaggtatcagttttggatttggtaagccttcatgaaaaattatttgtatattgtgcttactttcgtcacaatagctcaacagcagatacgacaaaaacgacgaccaccatctccttcggttgaaggacacttttatacaccgtcaacatctttgtttggtatttgagctactcagcgtgaacctttacgagttgatcaagcagaatcaattccgaggcttgagtacaactcttgtgcgcgtttttgcgcagcaattgctcaacgcactgagccttctgaataaggcgcacttgattcattgcgatcttaagccggagaatattttgctgaaaaagtcagtccataattccgttggtgcatttgggtaaactaacggtgtctcttacagccttgagagccccattattaaggttattgactttgggtccgcctgtgatgaaagacaaacagtttacacatacatccagtccagattttaccgctcaccagaggtgcttctcggcttgccgtatgtaacagaaatagctcactgttattggcgatctttggctaatttctctagatactcttccgcaatcgacatgtggtctctcggttgtatagtagtcgagctgtttctgggcttgccgctattccctggatcctcagaatacaaccaggtgtgtcgcattgtggagatgctaggtttaccgcctacctggatgttggaaatgggaaagcagtctggtgaattctttgagaagactcaggacgagttcggacgaaagagttaccggctgaagagcctggagcagtattcccgggaacataacacaaaggagcaacccagcaagaaatatttccaagcatcgacactggaggaaatcattcggagttatccaatgccaaggaaaaatatgaaacaggcagagattgagagaggtaagaatcctgtactgttccttatttgacaactaacaccgctgcagaagtcaacaaccgcgttgcattcattgacttcgtccgtggtctgctgtcgatcaatccgctcgagcgctggtcgccgcaacaagcaaagctccacccgttcattacacagcaaaagttcaccgggccgtttgtccccccaatgaacttgaagtattcgtctcttaacaagaccctcccacccggtattcagcagcagcagcaagcggaactgctgagtaagcaaagggcggcacatgctcaatccgccgctcagagcgcgtacacaatgcaaatgaaccagtaccatccttcggcacatgcgcagcgccaccaccgatgtacacggggatgtatggcggacaccaacaaccggctccaccataccccacacagccgccagcatacggccaccaaatgaatcttatgcccggccaaatgccccaaacgcaa

SEQ ID NO: 36448 - DNA, 2331 bp, Aspergillus nidulans
gtcaactatgcgcggcagattcgcaatttggaaatcgcgaaacgaggctcttcgcgaccgctaactttgaccgagaaactgttatactctcaccttattacctctgagaaaaacacctgggatgtggagcgcattgaacgagggaagactatcctagagcttcgtccggaccgtgtagcttgtcatgatgccacggcatccatggccttgctccagttcatcagtgcaggccttccgcgagtcgcagtcccaacgacggtacatagcgatcacttgatcatctctaagaagggggctgaagaggatatgcatcgcgcacttggagagcatgctgaagtatacgacttcctcagcagtgcatctaggaagtatggcatcgggttctggaagccaggatcgggtattatacacactgtcattttcgagaactacgcaacgtaagcctatccctcctcgtgagtaccaattaacctaatcactcactatttccatgatcagacccggtggcctcatcatcggtacagactcacacacgccgaatgctggcggcctgggcatgctcggaattggggtcggtggcgcagatgctgttgatgctatgtccggaatgccttgggagcttgtcgctcctaaagtggtgggggtccgcttgacaggccagctacaaggctggagttctaccaaagacatcatctgcagacttgcaggtctgttgacggtgtcggggggcaaaggccgagtcatcgagttcttcggaccgggaacccagaccttgggagcgacagccatggcgactatctgcaatatgtcggcagaaataggatcgacctcttgcatcttcccatataccgacgcaatgggccgatatctggagaccacgcaacgagcccacgttattgagatggcccagagagcgaggtctgcgcttctcaacgctgatgagggcgctgacaagtactatgatcaagttattgagctagatctcagcacactggaaccgcacgtcaacggaccgttcacccctgacctggcacaccctatctcaaaattgaagactgccgtcgctgcggaagattggcctgtggacttgagccatgctatggtcggcagttgtaccaacagctcatacgaagatctcgataaaactcgtcagatcgttgcacaagcacgagcggccgggatcacaaagctcccgacaccgttccttgtcacaccgggtagtgaacagatccgtgcaacagcagaggcagatggcatactcgacgaacttcgagatgccggagccgttgttctcagcagctcatgcggtccatgcgttggatcgtgggaccgcaaagatgtcgacgtgaagggaaaggaaaagaactcggtgatctccagcttcaatcgcaattttgtcggaagacatgacagtaatccggccacacactcctttgtcaccagcccagaactagtggctgcgttcgcctatgcgggtcgcctcgatttcaaccccctgaccgatccagttaccgtgcccgggggaccgagtaaggagttgtactttagcccaccatgttatccaagagctccccatttctttcgaaatcggttcaagattccatccagaacccttcgctagatgatacagacctccctgtgcaaattcgcccagattctgaccgactgcaacttctccagccatttcctccctgtcagccggggtgcgctcatggtatggaattgctgatcaaggtaaagggagaatgcaccaccgaccacatttcccctgctggaccgtggtacaaatatcggggccatcttgagaacatctgtaacaacatgcttacgaccgccaccaatgcgttcgtaggccaaggtgaccctcgtctgcttggccacactcgccatcctataacctcaaaagtggaaggcgctccgcaggtggcacgcgatcttaagcagcggggtgtccggtggtgtatcgtaggtgatcacaactacggtgagggcagctcgcgcgagcacgcagccctcgaaccacgttatttgggcggggtggcagtcattgctcgctcattcgctcggattcacgaaaccaatctgaaaaagcaaggcatgcttcccctgacgttcgccgaccccgccacctatgagcgcattgctgaagctgatcggatcactttgattggtgttgaagaaggtgagctatgcccgggctcgtccgtgacgatgcgagtcgagcccaggcgaggagaggtctgggaagcggaactaaagcatagctaccacagcgggcagattccatggcttcgcgctgggagtgccctgaactacatcaaagccacggct

SEQ ID NO: 36449 - DNA, 1254 bp, Aspergillus nidulans
atttcattgaacttgcgagggtttttttcaggtttcgaagtttagctttataacaaatcctgcatcgcaattgctgggcttggtgagctgggtggcaacgtttcgtctatcacggactcaacggctcatttccgaaatgcttttgaaggaacctctaacgcaacagtatatggagccactaactctctcatcaacgtgatgttctcctaccagggctacgagaacgcctttaacctagtgaacgaggtcaagaaccccgtcaagacgctcaagtggagcacccctgcctcactcatcacagtcggtattctatacatgctggctaatatcgcctacgttgctgctgcgagtaagcaggagattgtcgagtccgaaatcaacgtcgccagtctcttcttccaaaaggtctttggaggtggcggtgcatctcgcgccctaaacttcttgatctgtgtcagcgctttcggtaacctgctcgttgttctcatcggacagtctcgaatgctgcgagagtgtggcaggtatatacacctcaaggattgctcccaaacaaatcacttacgtgggttttatagacaaggtgtcctaccgttcacaagattctggacctccactcgcccctttggaactccgctagggccgtactggctaaaatgggctctaacggccatcatgatcctagctcctccagccggtgacgcattcaatttcggtacgcatattaatcgcaactaaatcccattacaaaattaacattcatccagtggtcgacctgggaatctatccacaaagcatgtttaacttcttcctcgcagtcggcctcttgttcaccaggagacaccggaagcgcctcaacattcccagaacagaatggcacgcctgggatatcgtcgtctacttcgcaattcttgccaacctctatctgctcgtagcgccctggtacccgccagcaggaggtgcaaatggaggggacgtgagcttctggtatggcacgtacgtcgtcgttggaatttctctgtaaggacttttgcctccgttcttttctccttcccttcaggatacgcgactaatattatcgctagtatcggtctctgcggtgtctactattgggtctacatgaaggtattaccgcacttcgggggctaccaattccgccaaacaatcataactgggccagcgggcgagacatctcataaaatggttaaggtgcctaatgatgaacttgcgaggtgggatgaggagcatgatgctgca

SEQ ID NO: 36450 - DNA, 1717 bp, Aspergillus nidulans
gtggcccgccgactgtcaagcgtataccgaaagctagccttagaatcagaccagcagttcctcccaacccccgtttcgaagctacccagcggcctggagactggccgctacctagccattgatgtcggtggaagtaatctacgagttgcctttattgaactactcggcgatacggcagatccggatatggctcgcacatccgcgtctgagcggccactcaagaaggcacagacacagcgcgtgaagaggacccttgagaaggcatggccaatccaggaacatctgaagatggacaaagcagaggacctttttgcgtggatcggagattgtattgcggaggtagtggctgagagcctaagttcggatgcgacaaaaaatgcggtccctgaagagctggagatgggcatcactttcagtttcccgatgatgtaagtggcctcgcatagctttccgctgctcaacgtctcggaagacaatagttacactgctaacaagttgcaggcaagaatctcttgccgaagctacactcatgccgatgggcaaagggttcgccattacgtcggatctcaatcttcgaaatatactactcagtggttacgaaagacacacaagacgccctgatgatgaggaccagccgtcaacgaaacgtcggaagctttatgctttgccgaagctgaagatttctgccattaccaacgacgcggtagccactctcgcatcacttgcatatgcggtgaaatctctacccaacagccgcgttgccatgggtctcattgtaggcacggggtgcaatgccacaataccaatgaagctcagcgccttacatgaagacaaggtaaagcatgtgaggcggagcgatcctgaaacctcgggtataatagtcaacaccgaatggacgatatatggtgtcttgcctccacttaaggagctgaacataatcaccaaatgggatgctgagttggatgcaagcagtgcacgcccgggcttccaaccgttcgagtatatgacgggcggtagatatattggggaactcatccggcttatttttactgactacttgatcaacgttgctggagtgtccacggctgcattacctgcaacacttactcagggatacgccttgacgacatcttacatatcggacaaggttgcgcgtgcccgctcagacgaggaactcacagatgagctggctcactcattacctccaccaagtgatacgtggcagtgggatgctacatctgcaggagtcttacgaacagttgcccgaactgtacaaaggcgatctgcagggttggtagctgctgcagtcgtcggtctattagcatgcgcaggagagatagaattaaggttggacagccctcaaggctcaccgcaagactcgcatgctgcttcgcctgagcgcgacagcatcacgaccctttccgctcagctcaaatctgaggggtcggcttcaaatggattccgggggccgatagttcctataatttcgcctacacctgcggattggcagtctggtccagaggagcttgtcgtcgcctgcactggtggcataatccagcactaccccaacttcaaagagatgtgccagcagactatcgaccggcttattatgcgtactgggcctcagaagagcgggaagtcggtctttttgcgtgaagcatcagatggcggtgttattggcgccggtgttctcgcagggatggtcggaaatcgttga

SEQ ID NO: 36451 - DNA, 1378 bp, Aspergillus nidulans
atggggtcgtgtttcagttcagaatcagcaggagatgtggaacagaagaagagaagccaggcaatcgaccggaaactagaagaggactcaaggcgtctacggcgagagtgcaagatcctgctactcggtacgctacaggtcccttcattttcccggcaatcggcctgcgataggtcgcaaggtcttctcaaaagctaacctgcccttcttgataggatctggagaaagcggtaaatcaacgattgtgaagcagatgaaaatcattcatcagaacggatatacggtcgaagagctggcgctgtatcgactcacagtctacaaaaatctccttgaatgcgcgaaagctttaataggagcctaccaccagtttaacctcgaacctacaagccagaaagtccgcgacaatatcgagtttctcgccaattacaacattgacccagatcccaatatacctctagatcccgcggtaggggatgccataacctatatctggaatgatccgtgcacatcaacagcactagaaagacagaatgagttctacttgatggattcggcgccttagtgaggattcctcgagcttgtccttgtataagcatgctgaacaagttttagtttctttgaggaagcgaagcgcataacgtcaccagattatataccaaacgttaatgatgtgctgcgcgcaagaaccaagacgacgggtatctatgagacacgctttacgatgggccaattaagcattcagtaaggaattcccctgccgggagttattgatcactactaataatttgctacagcatgtttgaatgttggcggccaacgcagcgagaggaaaaagtggattcactgtttctaaaatgtcacgtctattatcttctgcgtggcattaagcgaatacgatcaagtactattggaagagggaaaccaggtaggttgcgccctcaacagtgttttggctcacgctaaacttctggcagaaccgaatgatggagagtctggtactctttgactccgtcgtcaactctcgatggttcatgcgaacaagtatcatccttttcctgaacaaggtggatcttttccgacaaaagttacctcgctccccgttgagcaactactttccagattactcagggggcaacgatgtgaaccgagccgcgaaatatctcctctggaggtttaatcaggtcaacagggcgcacctgaacttataccctcagtaagtcttacgcgaatgacctttccccaattcctggataatctaataatctggaaaagcttgacacaagctaccgatacaacgaatatccgactagtatttgccgccgtaaaggagaccattctgcaaaatgctttgaaagactcggggatcctgtaaacgaca

SEQ ID NO: 36452 - DNA, 2037 bp, Aspergillus nidulans
aagcatgaactcgtacgccacgtcgaaaccacgctggcacgctcgctgtacaattgtgatgaactgtatgtcccttgcctcttcttctctcgtgatttgaactctgaccagacttagtgctgcatactctggaactgctctggctttccgagaccggttgatcattgaatggaacaaaacccaacagaggcaaactttaaacgaccagaaacgggtctactgtaatacagaacggctgactttatggattctacgctgacaaaataaatagatctgtcactcgaattcctgatgggcagaaccctcgataacgcgatgctcaatgtaggcatgaaggacgttgcgagaggtaggagccgagtatttactgtggaaactctattgctaagccatgcacagagggtctgagcgatctgggtttccgtattgaggacgtggttagccaggagcacgacgccgcccttggtaatggtggtctgggacgtctggcagcatgccttctcgacagcctcgcaactctcaactaccctgcctggggttatggactgcgttatagatacggaatcttcaagcaggagattgtagacggataccaagttgaaattcctgattactggcttgatttcaatccatgggagtttcctcgacatgagattaccgtcgacatccaattctacggctgggtgaggacctatgaggatgagaacgggaagactgtgcactcatggcaggacggtgaaacggtgcaagctgtggcgtatgatgtcccaattccaggatacggcacgcgtaccacaaataatctacgtctttggtcaagcaaagcagctagcggcgaattcgactttcagaagttcaatgccggtgactatgaaagtgcagtagcagatcagcaacgcgctgaaacaatttccgccgtcctttacccgaatgataatctggacaggggcaaagagctgcggctaaagcaacagtacttttggtgcgcagcctcccttcacgacattgtaagaaggtttaagaagacaggtcgtccatggagcgagttctcggatcaggttgccattcagctcaatgatactcatccaacattggctattgtcgaactgcatcgcatcctcattgatattgaaggccttgattgggatgtatcctgggagatcgtgaccaacacattcggctacactaaccataccgtctaccagaagctctcgagaagtggtcggtgcccctactgcaaaacctccttccacgtcacatgcaactcatcttcgagatcaacctgtacttcttgcaattcgtggagaagaaatttcccgatgaccgcgagattctctcgagagtgtctataattgaggagtctcatccgaagatggtcagaatggcccatgttgcggtcattggctcccacaaagtcaacggcgtcgccgagttgcactcggaccttatccagtccactatattcagagattttgtcgcgatctacggcccagacaagtttacgaatgtcaccaacggggtaaccccacgccgctggctccatcaggcaaaccctaggctgtccgacctaattgcctccaagcttggaggctacgatttcttgaccgacctaactctcctagaccagctagaagattacgcagacgataaggatttccagagagaatgggtagagatcaagacctcgaacaagctccggcttgctaagcacatcaaggaaacgaccggatatagtgtgaacccaaactctctgttcgacgtccaggtgaaacgcatccacgagtacaaacgccaacaactcaacatctttggtgtcatcaaccgctacctgaagataaagtccatgtctggtgaggagaagaagaaggtccagcctcgcgtctccatcttcggcggcaaagcggccccaggttactggatggctaaaacaataatccacctcataaacgaggtttcagtagttgttaacaatgatccagatgttggagatcttctgaaagttatcttcatcgaagactacaatgtcagcaaggcgga

SEQ ID NO: 36453 - DNA, 1530 bp, Aspergillus nidulans
atgaccatgtccaggtcctcacgatcttccgtccttgccctagctcttgccacgggttctctcgtcgccgccggtccctgcgacatctactcgtccggcggcaccccgtgtatcgcagcgcacagtaccacgcgcgccctctacagctcctacaacggcccgctgtatcaggtgcagcgcgcctcagatggtaccacgaccaccatcaccccactctctgccggcggggtcgcagacgcctcggcgcaggacgccttctgcgagaacacgacctgcctcatcaccatcatctacgaccagtcaggcaatgggaacgatctgacccaagctccgccgggtgggtttaacggccccgacgtgggcgggtacgataaccttgcgggagctatcggagcccctgttactctgaacgggaagaaggcgtatggagtgttcgtctcaccgggcactgggtacaggaataacgaggccattgggacagcgacgggtgatgagcccgagggaatgtacgctgttcttgatgggacccattataacgacgggtgctgctttgactatggcaacgcggagaccagcagtctcgataccggcaacgggcacatggaggctatctactacggcaccaacacagcctggggctatggcgcaggcaatggaccatggatcatggccgatctcgagaatggactgttctccggtcagagctctgactacaacgccggtgacccgagcatttcctaccgcttcgtcacagcgatccttaagggcggcccgaacttatgggctcttcgcggtggcaatgccgcatccggctcgctgtcgacgtactacaatggaattcgcccaaccgatgcttcaggctataaccccatgagcaaggagggtgcgatcatccttggaattggcggcgacaacagcgttagcgcgcaggggaccttctacgagggcgccatgacggacgggtatccagacgacgcaacggagaactctgtccaggctgatatcgttgcggccaaatatgctactacttcactcatcagcgggccggcgttgaccgtcggtgacacggtctcattgaaggttaccacgtccggctatgatacgcggtacatcgcccacaccggcagcaccattaacactcaggtcgtctcctcctctagctcgagtaccctgaagcagcaggctagctggaccgtccgcaccgggctggccagtactgcggccgcgaatgggtgcgttagcttcgagtccgtcgacacccccggcagctatattcgacactcgaattttgcgcttttgcttaatgcaaacgacgggaccaagctgttctctgaggacgctaccttttgtccccaggacagtttcaatgacgacgggaccaactcgatccggtcctggaactacccgacccgctattggaggcactatgagaacgtgctctatgtggcgagcaatgggggagtcaatactttcgatgccgccactgccttcactgacgatgtcagttgggtcgttgctgacggctttgcc

SEQ ID NO: 36454 - DNA, 1473 bp, Aspergillus nidulans
atgacctccaacggtaccaacggcagtgctactgcataccatgcctcgtctactcaagaggccatccaggctgagaacgactttgctgcccacaattaccatcctcttcccgtcgtttttgcgcgcgctcaagggacatccgtttgggatccagaaggccggcactacctcgacttcctctccgcatactccgccgtcaaccaaggtcactgccatcccaagctagttgcggccctcgtcgaccaggcctcccgtctgacgctgagctcgcgggccttctataacgatgtattccctaagtttgccgagatggtcacaaagtactttgggttcgacatggtcctccccatgaacaccggtgcggaggcagtcgagaccggtatcaagatcgcccgcaagtggggttataaggtcaagggcatccccgagaatgaggcgatcatcctcagtgcggaaaacaattttcacggccgaactgtaagtgcgcgccagctctgggctgccgtctttggtgacatgcgactgaccttaccagatggctgccatttctttgtcctccgaccccgagtctagagagaactatggcccgtacgttcccaacatcggctgcaccatcccagggacagaaaagccgatcacctacaacgataaagctgcgctgcgcgaagctttcgagaaggccggctccaacctcgccgccttcctcgtcgagcctatccaaggcgaggcgggtatcatcgtccccgatgacgattatctgcagctggccagatcgctgtgtgaccagcataatgtgctgctgatttgcgatgaaatccagaccggtattgcgcggacaggaaagctgctctgccacgagtggagcggaatcaaaccagatatggttttgctgggcaaagcgatctctggtggcatgtaccccgtgtcctgcgtgctaggacggaaggatgttatgctcacggttgagcccggaacccacggctcaacctacggaggcaaccctcttgcctgcgctgttgccatccgcgctcttgaggttgttcaggaggagaacatggtggaacgcgctgagaagcttggccaggccttccgcagcggcttggaagccatccagaacccgatcattcagacggttcgtggaaagggcctgctcaatgcgattgtcatcgacgagttcaagaccaacggacacactgcatgggatctctgcatgctgatgaaggaaaagggtcttctggtaggtatcaaccctccgttcattcgaccaacgctaactcggccaaggccaaacccacccatcagaacatcatccgtctagcaccgcctctcgtcattaccgaggaagaaatcgcaaaggcgctggaaatcatcaaggccgccgtggctgagctgccgaatctcaagggtgctgcggaagataaggtcgtccctccgccagagaagaaggtgaagattactctcgagaactagaca

SEQ ID NO: 36455 - DNA, 828 bp, Aspergillus nidulans
atgttatccatattgagaaaagcgaggctaaaggataaggagatgcgaatcctgatgctgtacaatccactttgaccagaaatcttggggaaggtcgctaatcagcagtagagggctggacaatgcgggcaagacgaccatcgtcaaacgaataatgaaagaagatgtcacgactgtaagcccaacgctgggatttatcatcaaaacaatagattttgaagggtattttctggctgtttaccgtttttgttcataatcactgactgtctctagataccgattgaatatttgtaaggagcccgacagtgtggccacccagccgctaacgcttgcccaggggacgtcggagggcaaaaaacactccgttcatattggaaaaactactttgaaaagacagacactttagtttgggtagtagatgccacggaccgactgagaattggtgattgtcgcgacgaacttgctggtcttttactagaagaagtaagctgatgcccgcccggaaaacttttatcgactggcgttctcgatgagcttaccacaaccgagcagcgtttaatgggcgcgagccttctggtatttctgaacaaaactgatgtggaaggatgtatgacccaagacgaggtcaggaaggtgggttgcttttttttccccattgatctgttcaaggatccggggtctttctgactctccgtgcagaacctcgctttagattcgatcaagactcataagtggactatactgccttgtagcgcgatgacaggggcgaatcttcatgagggtctgaattggattgtgcaggatgcaaaggacaggttattcctatac

SEQ ID NO: 36456 - DNA, 851 bp, Aspergillus nidulans
gatattccagatcttgcggggaaggttgtgctcgttacggggggttagtatcgccaatagatccagtccacgtaagaatttggtgttaataaggggcaggaaatactggtctcgggaaagaaacgatccggcaaatcatcaagcacaatccggagcaggtcttcttggccgcgcggtccgaagaaaaggcgcagaacgcaataagggagcttgagtctacagcccccaatatcaaaatcacctggcttcccctcgacctcgcctctacgaaatcaattcacgatgcagcagagactttcagagcacatgcctcgcgcctcgacatcctgatcctgaacgcaggcgtcatgtcccttccaccaggcgagacagatctcgggcacgagatccagctagggacgaatcatacggggcactttttgctcacgaaattgctgttaccggttctactcgagaccgcgcagaagccggattctgacgttcgcgttatttccctctcttccatcggccataacttagctccagattttgagaccatactccaccaagatgagttgaaaaagtgcaatactaacgcgcggtatggagcatcgaaggccgcaaatatcatctttgctgccgaactggcccgtcgttacccctcgcttacagcggtctctgtgcacccgggcattatcgtgacggagctttatgccgccacgagcgcgagcaacccgatcgctgccttagcagtcaagcttttgggattgatcgcgacgaaagttgagcagggtgcgtggaatcaactctgggctgcggttggtgcaaagaaaggagagctggttaatggggcgtactatactccagttggc

SEQ ID NO: 36457 - DNA, 1446 bp, Aspergillus nidulans
acatcgttagttgactataagaaaccagaagaactgcaggacatcctgcagttggatctcccggagcaaggcaccggccaaaccggcctggtcagtgtccttcgcaaggtgctccgctactccgtcaatacctggcaccaaggcttcctagacaagctgtatgcgtcgaccaatgcgcctggagttgcatcagagctcatactcgcagcgctgaacacaaacgtccacgtctaccaggtctcgcctgcgttatccgttatcgagaagcatactggtaagcggctgcgtgcgctgtttgggctcaatggaccgcgagccggcggaatctctgtacagggcgggtctgcttcgaatacaacatccattgtcattgcgcgcaacaatctataccccaatacgaagacagacggtaacggtgactacaagtttgtcctcttcactagcgcgcacgggcactatagcattgaaaaagcggctcagatgctagggctgggaagcagcgcggcctggtcagttccaatcgataaggaaggacgcatgattccatctgagctggagaagctggtccagaaggcattgagcgagaatcggactcctttttatgtcaatgcaacagccggaactacggtcttgggatcctttgatcccttcgatgacattgcagcaatctgtaaaaaatacaacctgtggctgcatatcgacggttcctggggcggctcattcgccttctcccggcgtcaaagacacaagcttgccggtgcggagaaggcaaacagtattgccatcaatcctcacaagatgcttggagttccagtgacttgttccttcctactagcctcggacctgcgccagttccaccgcgccaacactcttcctgctggctatcttttccacaacaacgatgatgaagacgcagttccagttgaaaatggcattggaggattctcagaattaaactccgattcccctgaaatctgggacctcgctgatctaaccctccaatgtggccggcgcgccgactctcttaaacttttcctcagctggacatattacggcacagctggctacgagcgccaaatcgataacgcctgcgacactgccgcgtacctcgcaaccataatccaggaccacccggacttcatcctcgtcagccagaaccccactccctgcttgcaggtctgcttttactacggccctaacgggaagctcttgcaccctcgcggagacagcatcgtctcggatgagaaccaacgcgcgaaggctaatagcaaggtcactgagcagatcacgcatgcaattgtagggcgcgggtttatggtagattatgcgccgcctagcggggatgagaaggcggttggtgatggcaagttcttccggtgtgtcattaatgtccagacaacgagggagacggttgaggggcttgtgagagcgattgaggaagttggg

SEQ ID NO: 36458 - DNA, 1631 bp, Aspergillus nidulans
ctgactgggtcacgacaatcaatctaggtgtttgagggtacttcaggtatcgatgtcaagaaggtacattgcctcggcagctttctatattgttttggagtggaagggaacatcgctgatcttgactactctgctagaccaaagtcgagttcaccaaccatagcttaaagctgggtgtctctgaggacatgctcggtcgtgtcttcgatggttccggtcgtgctattgacaagggtcctaaggtgttggcggaagattacctcgatatcaacggtcagcctattaacccgtactcgagagtgagccagccgatgccaaatcattgaagacgactgtcgctgatagaatgttggataggtgtacccggaagaaatgatttccaccggtatatccgctatcgatacgatgaactccattgcccgtggacagaagatccccatcttctccgcctccggtctcccacacaatgagattgctgctcagatttgtcgtcaggctggcctggtcaagcggccgactaaggatgtccacgacggtcacgaagataacttctccattgtcttcgctgccatgggtgttaacatggaaactagccgttttttcacacgcgatttcgaggagaacggcagtatggaacgagtaaccctcttcctgaacttggcgaatgacccaacgtaagccctactttttatacagtcagagtatccaatggctgattgggtatactacagaattgagcgtatcatcacacctcgtctggcattgaccactgctgagtactatgcgtaccaactggagaagcacgttttggttatcatgactgacctgtcggcctactgtgatgctcttcgtgaagtctcagctgctcgagaagaagtccctggtcgccgtggttaccctggttacatgtacactgacttgtcaaccatttacaaacgtgctggacgagtgcaaggccgaaacggctcgatcacccagatccctattttgaccatgcctaacgacggtaagctaggccaccgtacgcgtacctacaatcactaataacttggtacagatattacacatccaatccccgatctgacaggatatatcactgagggccagattttcatcgatcgtcaactgtacaacaagggcatctaccctccgatcaacgtccttccctctctctcccgtctgatgaagtccgccattggcaaaggtcgtactcgtgacgatcactccgacgtgtccaaccagctgtacgccaagtacgctattggacgagatgctggttcgttcctctttcttatttcatcttaactctcacacaacaattgatcaaactaatccctctcaaaccagccgccatgaaagctgtcgtcggagaagaagccctttcctccgaagacaagctctctctcgagttcctggaaaagttcgaacgtaccttcatcaaccagtccgcatacgagtctcgctccatcttcgaatccctcgacatcgcctggaacctcctccgcatctatcctccccaccttctcaatcgtatccccaagcgtgttctcgacgagttttatgctcgctcaggccgcaaaatccctaataaggatacccgggacaactcggtccctgaacagggacagtct

SEQ ID NO: 36459 - DNA, 993 bp, Aspergillus nidulans
atgttgcaccatttcgggtccgaggaacagaaacgcacactgatacccgcccgactctgcggtgaattccgaacgacattcggcctcaccgaacccgatcacggtagcgacgcgacgttcatgtcgaccgttgcccagcgcaagcgcaacagtgacggtgtggaaggatgggagatcaacggggccaagaaatggcagacgggggcgcaccactgtacgcatatgatcatcttcgcgcggacgagcggtgaatcgggatcggcgcgcggtataacagcgttccttgtcccagcccacaccaaagggatcgaggttacgagctacgagtggacgttcaatatgccgacggaccatgcgactgtgaccctgaatggcgtctttgtcccccacagcgccatcctagggaagctggataacggcctcgcaattgcgcagacgttcgttcatgagaaccgcatccgacaagcggcgagttcgtgcggcgccgcaaaatactgtcttgacagggcgattgagcgtgcgaattcgagaaccatctggggcgaggggcggaagttgtctgagcaccagggcattcagttcccagttgtggagctcatgacccaagtcgagatgttaaggctgctgattctgcgcacgagcgtgcggatggacgatattgtgtctgagtgtgagaagacgggcggtaaggatgtgccctgggtccggattgaaaaggagttgagcggggaggttgccatgtgcaattactgggccaatcggttggcgtgtcaggcggcagaccgggcgattcaggtacgtactctccttctgagtctctattggctgtgaataaacgcgctgaccaagttgttgcgagtttagattcatggcggcgacggctactcaagacattaccccttcgagcacatctaccggcatttcagaagatatcgtattacggaggggtcagaggagatccagatacgtaaggtggcagcttacttgtttggt

SEQ ID NO: 36460 - DNA, 1342 bp, Aspergillus nidulans
aatatgtgaagccagcaatcaggtctacctaagtttctacagtcctaccctatcaccatggtcaaaattgcactcctcggtgctgccggccagatcggcacaccactgagccttctctgcaaggcagtaagatcccagacggtattccttccgatagcccggcacgcacgctaacgtcagctgtctcagagtgacctctttgctgagattagcctgtacgatattgtgcatgtgccaggtattgccacggacctgatgcacattgacactagggcaagggtgacgggtcatctgccggacgactctggtctcaagaaggccctcactggcgccgatattgtcgtggtaactgccggtattgcgaggaagcctggaatgaccagagatggtaggttcatgcagcagtctacgagtgtgtgaccggttattgacgcgagaaacagatctattcaaggtagatttctaccaccctttctatttttccttctccctctccattctcctttttgtctattaatttttcttcgtgaagaagaaaggattgtacgacttatatctaaccagcgcagacaaacgcgagtatcatccgggacatctttgccgaaattgcagcgacatgcccgaacgcagtaagctgtgtagtcactaacccggtcaactccacactccccgttgcagcggaaacgctcaagaaggcaggtgtcttcgagccaactcgtctgttcggtataacgacgcttgacgtcgtgcgcgcctcaacctttgccgcacacgccttggacagcaacagcgacccaaaagccttcaaggtacctgtcatcggtggccatagcggcgcaacaatcctgccactctacagtcaagcggagcctccggtgaacctggataaggagaccctggctgcagtcatccaccgtgagtacacactactgtctacaccatctctcttgttcttcaaaagtcccatgcttacctaacccctaaaccaggtgtgcaattcggcggtgacgagattgtcaagtccaaacagggcgcgggtagcgcaacaacatgcatggcgtacgccggcttccggttcgtcaaagccattgtcgctgccatgaacggtgaatccgtaacagaggaggcctacgtctacctccccggtattgcagggggccaggaaattgcacaggagctgggcgttgattacttcgccctcaaggtcaccttgggccgcacaggcgctaaccaggtcttgcccattggggagatatctgagaacgagagtacactgctgaaggttgctatcaatgatttgaaggccaacatcgtcactggggtgtcattcatggcggcttga

SEQ ID NO: 36461 - DNA, 1645 bp, Aspergillus nidulans
gacctcttcgtcgacctcgttgcgccaaacggtactcactactcacaacccacaggactctttatcaacaacgccttcgttgcgtccagtggccagacaatcacctcactcgacccagcgttggttcacctgccataatcagtttgaatgatgactaacgcaaaggtaggacggacaaaccgatcgctaccgtccatgctgccagcgccgaagatgtcgaccgcgcagtgatcgcagccagagcggctctggtgcacccatcgtggaagaagttgccgggcaccgagcgtggccagctcatggctcgtctggccgatcttatggagaaaaacaaagagctgtttgcgaccatagacgcttgggacaacggtagggctagccagttttacgctttctcctcttttccctcttttccgtttctcaagtactctcactcactgagaagtcaggcaaaccgtaccacatcgcgctcagcgaggatctcgtggaggcgatcgggactattcgatactacagcggctgggcggataagacgtttggacagacaatcagcacgacgccagcgaagtttgcatataccatccgacagcctgttggtgtagttggccagatcatcccgtggaactatcctctctccatggcctgctggaagctagggccggcgctcgcttgcgggaacacggtcgtgctcaagcctgctgaacagacaccgctgagcgtccttgtgttgggcagcctgatcaaggaggctggctttccacccggggttgtgaatattgtgaatgggtatggtcgcgacgcggagcggctctagcaggccacccgctcatcgacaaaattgcgtttacggggtcgaccgtaacagcacgcgagatcatgaagctcgatggggagactgtgtagaacataaccatagatactggcggaaaatcaccccttagggagttacctggcgctgacctggagcatgctgttaagtggtcgcactttggtatcatgtccaaccagggacagatgtgcaccgccacttcccgaatctacgtccatcaagatatattccagctgttcctgtccaaattcaaggccgcggttgagacgacttccaaaatcggcgaccaatgggacgaatctacctttcaggggccgcagattacacgcgcccagtacgaccggatcctttcctatatcgagaccgcgaagaaaggcggtatggccgtagtcaccggcggctcagcacatgcgccttcgagcgagaagaacaaggacggctatttcatccaaccgactgtgttcaccggcaccgatgactcgcatgctatcgtccgtgaagaggtctttggcccggttgtggtgatcctacccttcgcgtccgaagaggaagccatcaggcgtgcaaatgacacaacatacggacttggggcggcagttttcacgtgcgatctggaacgtgcgcatcgtgttgctgctgagatagaagctggcatggtctgggtcaacagcagtcaggactgtgatccccgggtgccttttgggggcgtcaagcagagcggtattgggcgtgaactgggcgaggcgggcctggaggcttatacacaggttaaggcctgtgcatgtgaacatgggcaacaagctttagaacagaaca

SEQ ID NO: 36462 - DNA, 1059 bp, Aspergillus nidulans
accgctgcgaagttcattgagactgaggcctcttcctctactgcgacctctacatccactaccgtgagcgtgccctcgagcaccacttctcagccggccgccagctcctccagtgcttccactgccactggattggatgctcccttccccgatggtgagcttgactgcagcactttcccctcggactacggtgccgtgcctctcgactaccttggtcttgacggctggtctggtatccagtatgtgaccctggttggcgagattataagcgacatcatcaccgccgtcaccggtgacagctgcactagcggagccatgtgctcgtacgcttgcccacctggttaccagaagtctcagtggccctctacccagggctccactggccagtccgttggtggtcttcagtgcaagttcggcaagctgtacctgaccaaccctgacctttccgacaagctttgcattaagggtgttggtggtgtcaaggccaagaacactctgagcgaccacgttgctgtgtgccgtactgactatcctggtgagtgatacccgtcagcaaatgcgagttgtgcttatggctaaccataaacaggaaccgaatctgagactatccccatcagccttaacagtggcgagaccaaggaagtgacttgccctgatggtgccacctactacaagtgggagggcaagaccacttctgctcagtactatgtcaaccctgccggtacctcgcaggaggagggttgccaatggggtgatggcagcaagcccatcggcaactgggccccgatcaaccttggtgttggcgagaacaacggcaaatggctttctatcttccagaactctcccaccaccaccgagaagctcgactttaacatcaagatccagggtgacaaccttagcggttcctgcaaatacgaagatggctccttcatctctgacactggctccaacgactctggctgcacggtaagctttcatgatctgattcgtccactgaaactgaggctaaattatttacaggtgcaagttatgtccggtgacgctaccttcgtcttctac

SEQ ID NO: 36463 - DNA, 802 bp, Aspergillus nidulans
cctcctgccgttgcagttgaagagaagaccgagaaggccaacggcgacatcgtcacggtcttccacgacccagagaacttcaacgtaaagcatcccctgatgcacgaatggactctttggttcacaaagcctcctagtggaaaggtagagcgcgcctccctccgaccgcgcaaagtctttcgcttacgttggcttatattagggcgacaactggaacgatctgctgaaggaggttgtgaccttcaactctgtagaggaattctggggcatttatgtatgtcgattctgtctgattttccaaactcgcgtctccctaatggctctctttgcttagaacaacataactccgacctctgaactaggccttaaggcagactaccaccttttcaagaaaggtgttcgccccgagtgggaagacccgcagaacaagcacggcggcaagtggtcattctcgttcaaggataagcgatcggtccctattgatgatctttggctgcacgcacagctggcggccatcggcgaaaccctcgagaatgatggcgataatgaagtcatgggtgtcgttgtgaacgtgcgtaagggtttttaccgtgtcggtctctggacacggactgttggcaaaacccttcccggtgacaagagcggacgcacacccgctcagggtaaggaagtgcttgagtcaatcggccgccgcttcaaggaagtactccgtcttggtccaaatgacagtgttgaattctcgggacacacggatagcgcccacagtggcagcacaagagccaaggccaaatacactgtttaa

SEQ ID NO: 36464 - DNA, 2334 bp, Aspergillus nidulans
gacggacgcaaagagcgcgtgcaattcgacaagatcacggcccgtgtatcaaggctttgttacggccttgatcctgagcatgtcgatgctgctgctatcactcagaaggtcatctctggtgtctaccaaggtgtcaccacggtggaacttgacaacctggtatggccaccgacgacccattgcactgttctatgctaatatcattcttcgaaggctgctgagactgcggcgtacatgaccgtcactcatccagactatgctatcctcgccgctcgtatcgcggtttcaaacctccacaagcaaactaagaaacaattctccctcgtcatctcagatctctaccactacgtcaacccaaagaataaaaagcccgcacccatgatatcaaaagaaacatacgagattgttatgaaacatgcagaagagcttaactctgccattgtgtacgaccgcgacttcaactacaacttcttcggcttcaagactcttgaaaggtcatatctcctgcgacttgatggaaagattgccgaacgccctcagcatttgctgatgcgtgtcgctgttggaatccacggcaacgatattgagcgggctatcgagacctacaatctcatgtcccagaaatacttcacacatgcgtctccgactctgttcaatgcaggcaccccccaacctcagctggcctcttgcttcttggtcgatatgaaggaggacagcattgacggtatctacgacactctgaaaacatgtgccatgatttccaagactgctggtggcattggattaaatgttcaccgcattcgtgccactggctcttacattgccggtaccaatggatcttccaacggtatcgttcctatgctccgtgtgttcaataacaccgctaggtacgtcgaccagggaggaaacaagcgtccgggtgcctttgccatctacttggagccttggcacgctgatgtctttgagttcctggaccttcgcaagaaccacggaaaggaggaagtgcgagctcgtgacctattttatgctctctggactccagatctgtttatgaagcgagttgaggcgaatggtgactggactctcttctgtcccaacgaggctcccggtctggccgatgtatatggagacgagttcgacgctctctatgaacagtacgagaaggaaggccgcggtcgccgaactatcaaggctcagaaactctggtacgccatcctggaggcccagactgagaccggaaacccgttcatgctgtacaaggatgcctgcaacaagaaaagcaaccagaagaacctgggaaccatccgcagctctaacctttgcactgaaatcattgagtacaccgctcctgatgaggtagctgtttgcaacttggcctcccttgccctccctaccttcgtcgatgcttctcgcggtgaatacgactttggcaaactgcatgaagttgtgcaggtcttggttcgtaacttgaacaagatcatcgacatcaactactaccctgtacccgaggccaagaaaagcaacttccgccaccgcccgattgctcttggtgtcaacggtttggctgatgcattcctcgccttgcgtctgcctttcgattcggctgaagccaaacagttgaacattcagatctttgagactatttaccacgctgcactgacggcttcttcgaatcttgctaaggaggacggaccatatgagagctacgaaggctctcctgtttcccaaggtatcctgcagtacgacatgtgggagcgtactcctactgatctgtgggattgggatgccctcaaggccaagattgcccagactggtgttcgcaacagtctactggttgcccctatgcctactgccagtaccagtcaaatcttgggcttcaacgagtgctttgagccttacacttcgaatatctactctcgccgtgttcttgcgggtgagttccaggtcgtcaatccttggctgcttaaggatcttgtcgaccttggtctttggtccgacaacatgaagaaccgcattattgcagagggcggttccgtgcagaacatccccaacattcccgatgacatcaaggctctttacaagacggtgtgggagatttctcagcgacgaatcctggaaatggctgcggaccgtggcgcctacattgatcagtctcagtctctcaacattcatcttaaggaacccactatgggcaagatcaccagtatgcactttgccgggtggaagatgggcttgaaaaccggaatgtactatctccgcacaatggctgcgtccgctcctattcaattcactgtcgaccaggagcaactcatggttgccgacaccaacgttgca

SEQ ID NO: 36465 - DNA, 684 bp, Aspergillus nidulans
tatactgataatggaggctcggtcctaggcataacgggaaaggatttcgctgtccttgctggcgacacccgttcgacttccgggtacaacattaactctcgctacgttccgaaggttttcaagattggaggagaagatgaaaccggaaaaggcgctcacatcctcctgtcagtggtgggcttcgctgcagatggcctagctctcaaggagagactggatgcagttgtgaagatgtataagtaccaacacgggaaacccatgagtgtgagagcatgtgcgcagcgactatcaaccattctctaccagaagaggttctttccatactacgtgcaggcaatcctggccggcttagacgaagagggcaagggggcgctgtacggttacgacccggtaggctcatatgaacgggaacagtgcaggtctgctggagccgcgtctagcttaattatgccgttcctggacaaccaggtcaacttgaagaaccagtatattcctggaagtggagagggacacgctctagaagctaggaaacctgagccgatgtcaagagagacggtggaacaacttgtgcgagatgcgtttacaagcgcggtggagagacatattgaggttggagatggcctacagatgctggttattactgcagatgggatagaggaggtctatcaccccttgaagaaggat

SEQ ID NO: 36466 - DNA, 1419 bp, Aspergillus nidulans
gacactccggtcttcgcggtcaagttcattaacaaagactacgccgctcgccatggcaaaataagtccacgacaattgctcatggaagctacagtacacaaacatatcggcgaccataataacatcatatctttcttccagaccggagaggatggcgcatggcgatggattgcaatggagctagcagacggaggggaccttttcgataaaatcgaggcggacgaaggcgtcagcgaggatataggacatgtctatttcacccagcttataagtgcggtaggatatatgcactcaaagggcgtcggacatcgagatatcaaaccggaaaatatcctcttgaccgcggatggaaacctgaagatcgcagatttcggtctcgcaacgctatttgagtacaaagggggcacgaaactgtccaccaccttctgtggtagccctccatacatcgcgccagaggttatcacctgtagctctcgaaatcagactaaagggcccggataccgccctgacgtggcagacatctggtcgtgtggcattgtcctttttgtccttctcgccggaaatacaccttgggatagcccgacagaggatagctatgaatttcacgaatatgttatgactaacgcccgcacatctgacgaattgtggcagaaattgcccaccgcaactctctcattactgcgcggcatgctgaacattgacgcccaggctaggttttctctagaagatgtccggcggcatccctggttcacgcgccagaacaaacacctcgccccagacggcagactgcgagaccctatcaaggttgcaccgtctatgtttgagtctcttcatattgactagtctcaatccgcctcccgccccttgaaaggcgggagtttcgggccagatcgaatggacgtggatattggcgacgatctaggtgccgagcataggatttcatccacgcagccagaagtaccgagaggcgacatgctaatcgactgggacacgccgcatctcacggacgtcttctcctcgagccaaccaacgaacaacccacgcccaccatccagcagcctcacgcccgaaatcctcgaagacgagccctcgttttcacagttctcacaacggccatctgtgcccatgagccgaactcagaacgcccagcgcttccacgatatcgttccctcccgctccctcacccgcttcttttcgacgtgggaactcaagctcctcgtcccgcttatctgcgaggcgctacatcgccttggtgtcccggttcccgctgttcctgccgtatcgcccggtgacaattcggctatgattagagtgatcacgagagatggcagaatgtgtcctcttcatggaaaggtgcttgttgaatgtgtttccgagggcctcttcgagattgagttcatgaaaggaaagggggatcct

SEQ ID NO: 36467 - DNA, 759 bp, Aspergillus nidulans
tcctccaaacccgtcctcgccgtcatcggcgttggtcccgggatcggcgaagcggtctcccaccatttcgcgtccaaaggcttcgtcgtcgcgctgatcgcccgaacagaatccaagttggagaaggtccaaaaaaccatcaatgacgacgtcggcacgaccgcatcaaagtactacgtggccgatgcccgctctgaatcgtcgcttcaatccgcttttgccgcgataaaggccgaccttggccccgtcgacgtgctaatctacaacgccggctcgagacgcttcaccccgcgcaacattctcgaaacctccagtgaagaattcgagaatttcacgcgcatcaaccttttcggcgccttcttcgcgacaaaatgcgttctgcctgatatgctggccaaatccagcggaacgatcatcttcacgggcgcaacggggtcgatccgcggcaatgcgggcgtctcgtcattttcaccaggcaagtttggactccggtcgttatcgcaaatcatcgcgcgcgagtttcagagtagcggtatccatgctgcgcatttgattgttgatgggcccgtcgagagtgacattgttggtgggtttgtgaggaggcggtgggagcgagagggggagcagggacggaagaaggtggaagaaaaggatctgtatctgatgcagccaaaggaattggcggagatttattggtttttatatagccagccgaggagcacgtggacgcaggagctggatgtaaggagtatgaaagaa

SEQ ID NO: 36468 - DNA, 607 bp, Aspergillus nidulans
gaccaattcgacgactatcgagaatcaacaatcggtgccgcattcctgacacaaaccatttcgctggatgaaagtacaacagtgaaatttgagatctgggataccgccgggcaagaaagatacaagtccttgctcccatgtactaccggaatgcgaactgtgctgtcgttgtatatgatatcactcaagctgtatgccttcggacatgatctcctatcgctcaagatacttgctaatactcgggaatccacaatagtcatcgctagacaaagccaaatcatgggtcaaggaattacaacgccaggcaaacgaaaatattgtcatcgccctcgcaggcaacaagcttgatcttgttaccgagaaccccgacaagagggctatccccactgctgatgctgaagcatatgcgcgcgaagccggtcttcttttcttcgagacttccgctaaaacgtcttcaaatgtgcgcgaactcttcacagccatcgcaaagaagcttccacttgatcaagctggaccccgaaacatgcgaacagcacctcgccctggtgtagatctccgaccggaagcaccgggaacccaaagtggcggagcgtgtaattgttagagc

SEQ ID NO: 36469 - DNA, 2428 bp, Aspergillus nidulans
atgactatccccgaagaggtcgatatcatcatctgcggcggaggcagctcgggatgcgtccctgccggccgtctcgccaacctcgaccataacctgtctgtgctattgattgaggctggcgagagtaatctgaataacccatggtaggagtgctcttcactcgaggctccgtgtgaagatgagctcattactgacaagcccagggtctaccgtcccggtatctaccccgtcaacatgaagctcgactccaagacggcctcattctactactcccggccatctgagcatctggacgggcgtcaggctgttgttccctgcgcgaacatcttgggtggtggtagctccattaatttcatggtattaccagcccatattgccctaaatgatagtgcccccgctaacgtatcagatgtacacccgagcttcagcctctgactacgacgacttccaggccaaaggctggacgaccgaggagctgctgcctctaatgaaaaaacatgagacctaccagcgggcctgtaataacccagagatccatggctttgagggacccatcaaggtttcattcggcaactatacctacccgatagcgcaggacttcctgcgcgccgctgagtcccagggcattcctgttaccgacgacctccaggatctgaagactgggtatgtgatctcattacaggtgccgtaccatactgatagcatgatagccacggagcggagcactggctgaagtggatcaaccgcgataccggtacgtctggtgttaattccaatctaccctttatcatactaacaccagttaggaagacgcagcgatgcagcccacgcctatgtgcacagcacgcgtgccaaatactccaacttgcatttgcaatgcaacaccaaagtcgacaaggtcatcatcgaagacggccgtgccgtcggagtcgtcaccgttccaaccaagcccctcgacggcaaagagccaccgcgtcgcatcttccgagcgcgcaagcagattatcgtcagcggcggtaccctttcttcacccttgatcctgcaacgatccggaattggggactcggagaagctccgccgcgcgggagtcaagcccatcgtgcacctgcccggcgttggccgcaacttccaggaccactaccttacgttctccacatacagagccaagccagatgtcgagacgtttgatgacttccttcgcggagacccgaaggtccagaagagagtgttccaggagtggaacatcaaaggaaccggaccgttatccacgaacggtatcgaggctggtgtgaagattcgaccaactcagaaagagctcgaggagttcaagaaatggccgacccctgattttgtcgatggctgggagacatactttaagaataagccggataagcctgttatgcactactctgttatttctgggtatgcagcccttcttgcagttccattctcatatttcctgcactgctaacaacgtactctgaaacagctggttcggtgaccacatgctcatgccccccggcaagtttttcactatgttccatttcctcgagtatcccttctcccggggcagcacacacatcacaagcccagacccctacgcggccccagacttcgacgccggcttcatgaacgacaagcgtgacatggccgccatggtctgggggtacatcaagtcgcgcgagacagcacggcgcatgtcctcgtatgccggcgaggtgacaagcatgcacccgcactttgcgtacgattcaaaggcgcgcgcggaggacatggatctcgcgacgacgaaggcatatgcgggaccgaatcatctttctgcgggcattcagcacggtacgctttatctcctttcttttatttccctctctcggagtccgtgggtatgctaacgaatgcatcaccggcaggctcctggtctcacccactaacccccggtaaacaacccagcccaacaaccctcagctccaaccgattcgaggcccgcagcgaactcgagtattctaaagaagacattgcacatatcgagaaatggggtacgcaatcgtccactattccttctattcctcatactaacattgacgtcccggttgttccagttcaacgccacgtcgaaacaacctggcactctctgggcacatgcagcatggccccgcgcgagggaaacaacattgcgccccacggcggcgtcgtcgacgagcggctgaacgtgcatggcgttaaaggactgaaggtctgcgacttgtctatctgccccgataacgtgggctgcaatacatttagcacggcgctacttattggagagaaatgcgctgtcctcactgctgaggatctagggtatagtggggatgcactgaagatggaggttccagagtaccatgctcctggagagtttttgaatcttgctaggttgtagggtcttccagtg

SEQ ID NO: 36470 - DNA, 963 bp, Aspergillus nidulans
atgactacaaacagcactggcaacggcggcgctgtcggacaagagaatatcaacactgatatcgtcacactctctcgattcttcacggaagaacaaaccaaggtccccgaggccactggtgacttcacgtgagtgtctcttgaatcttggatctggaaaactgcggctaacatgcttgaaacaagactcctctgccacgcgctccaattctccttcaaatccatcgcctactatattcgtcgtgcctcgttaatcaacctgaccggtctcgccggttcctcaaacacaaccggtgatgaccagaaaaagctggacgttattggaaatgacctcttcgtgtccgctatgcgcacatccggcaaatgccgcatcctcgtctccgaggaggaggaagaagcgatcatctttgacgaacaccccaatgcccgctacgctgtagtctgcgatcccattgacggctcttccaaccttgacgatgacgtctcggtcggtaccatctttggcatcttcaggctccctgacgacatcctcggccctgggaagaaggtcacagccaaggacgtgctcctcccaggtaccgaaatggttgccgcgggcttcaccatgtacggcgcctcagcccaactcgtcatcacgatgaagaacggcggcgtcaatggattcactctcgagaactctctgggcgagttcatcctcacacaccccaacatgaagttgccccccagccgcgcgatctactccgtcaacgagggtaacagcatgtactgggacgactggtgcaacgcctactttgactctcttaagcgtcccggtgagggcaagaagccctacagcgcgcgttatatcggttccatggttgcagacgcttaccgtactctgctctacggtggagtcttcgcttacccggccgactcgaagagccccaagggcaagctgcgtatcctgtacgagtgtgcgcccatg

SEQ ID NO: 36471 - DNA, 1439 bp, Aspergillus nidulans
cccgttgacccgcaagatgatgtcccaatagcagaggggcgtgtttgggtggacgggtgctttgactttagtcaccatggtagggaatcgatcatccccgattcttgtatgatacgacctaatcatatacccgtaggacacgcaggagctatgcttcaagcccgtagactaggagacgaacttctagtcggagtacattctgacgaggcaatcctggaaaacaaagggcctacggtcatgtctttagaggagcggttggttattgccacatcctattcgttcggggagctgatattagtcaaggatcgctgcggtagaagcatgtcgctgggcgacaaagtgtattcctcatgctccgtacgtgacgtccctgccctgggtatcgcactacggttgcaagtacgtcgtacatggagacgatattacctctgatagcaatgggaatgactgctatcgatttgtcaaggctgctggtcgcttcaaggtagtcaaaagaacccccggtatctccaccacggatctcgttggccgcatgcttctttgtacaaagggccattttgtcaagagcgtgaaaggcatgctctctgggaaggaaggctctggtaacgaagaagagcgcgcacaatatgcgttataccttcaggaaaggctcaaggattacgccactgacgagaccggcctgcaacctggctctcaggtctgggtttgggaaggctcgaacgctgcaaaacttgaggcttcgcttgacgagtctgggagcttcgataagcttgttagtggaaagccgcccaggccgggccagcggattgtctatgttgatggagggtttgaccttttctcttccggccatattgaatttcttcgccaagttctagcaattgaggaatctgatggcagacaacgcggctggtatgaccaagaacagagagagcaaagggtaaagacccacggagaagattttggcaccagcttacgtggtggctggcgttcatgacgacgatgtaataaaccattggaaaggtttaattatcctatcatgaacatatttgagaggggcctatgcgttcttcaatgtcaagtaagcatccatcctttccattacgggttggtctgacaatttctagtacgtacacgccgtaatcttctctgctccattttcaccaagtcagccatatttagagacaatgcctttgggcgttcccgacgtcgtctaccacggtccgactacctttatcccactcacctatgatccatatgctgctcccaaacgaatgggtatatttcgcgaaacgaccgatcacgcttttcaacatgtgaacgctggcgaaatagttgaacggatccttaagagcagagaggcttacgaagcgagacagcgcgccaagttgcagaaggcagtgatcgaggatcaagccaagtcaagagaagcggcatgaccc

SEQ ID NO: 36472 - DNA, 2226 bp, Aspergillus nidulans
aactatcaggaccaacaaggtgaaaccgcgttgcacgttgcggctcgctttgaccatgaaaagtgcgcccgcattctgctcaagggtaacgatgttcagaaagcagacaccgaacttgctgaaagcacttactcttggaccccgcttttcatcgcctgcgttgatggctcattaagtgttgtcgaggccctaattgaagctggtgccgaccttgaaaggttggattcatctggctggactgcaaaggaacacgcggccctgcgtggacatcttgacgtggccagatgtcttgcgaaggtgactcctgaacctgagctttccgaagaacctgctttgactgttcccactgcctctggttctactacttcgggtcccttgtcgtcacagcctcaatcatcgctgatggagaaaaaatcgaacggagggagcgctgcagggagttctccctcccggaatcctgaacctgttaagtcatttggacatcggtatctcaccgacgaggccatgatcctagtcagtttgggcaccatggacactcgaaagcacgtccacgccgtgaaccttgaccgtattcctatggagcaccgtcacgctactcagctggacactgctctgtctatcgtcgtctctgcgaatggggcgcacggagaacccgaaatcatcgatcttactgtgcaagagaacatctcaactgaaccaattgtattccatgcagcagacccaactaaggttaggctgctattcgaccttgatcctacgtactcaggctcgaaggaccaaatagtggggcgaggtgttgccttgctgtccagcgtgaggccgagtgtgggatcgcaccgtactaaccttcaaggcgactctactgtacctatcgttgctgctaataccttggaagtgatcggttccattacattcaacttcctggtcattacacctttcaagcacccgaacatgtccatcaacagggagcagacctactggaggagtatgtcgtcaacaatggtcatcggacatcgcggcttgggcaagaattttgctactcgaaattcattgcaacttggcgagaataccatacagtccttcatcgcagctgcgaacctgggcgcttcatacgttgaatttgatattcagctcacaaaggatcacgttccagtcatttaccatgatttcctcgtcagcgaaacaggtattgacgctcctgttcacaccttgacgctcgaacagttcctccaactcggcgagcgaggcacgactcgaacacctgggtctcctggccagattgccatcggaggtactgaacgaagcaagacccctcccttgcctcctcgccatagatcaatgtctgtgggcggtacagagagcgatatttctgaactcaacgaaagaattaagcatacccgcgatttcaagaaaaaggggttcaaaggaaatagcagaggcaatcatattcaagccccttttgctactctggaagagctgttcaagaaactgcctcagaacgttgggttcaacatggagttgagtaagtctatccatttccaggtatatttatggttcggccgctaatcaaaggctgaagaatatcccatgctctacgagagtgaagaggaggagatggatacatatgctgttgagctgaattccttcgtcgacactgtcctcgagaaggtatatacgttgggccagggccggaacatgatcttctcgagcttcaaccctgatatttgcttgcttttgtccttcaagcagccgtcaattcccgtccttttcctgacagattccggatccagccctattggagatatccgagctagcagtttacaagaggcgatccgtttcgcctctcgatggaatttgctcggcgtggtgacgcaggcagaatgccttgtgctctgcccgcgtctcatccgcgttgttaaagagtccggtctcgtctgcgtatcctatggcacatccaacaacgatcctcacaaggtcaaggtaagcttctgagcacaccgtggcttctggacctctctaacatcattttagctccaagccgccgaaggaatcgatgcggtaatcgtcgactctgtcttagccatccggaaaggtctcaccgagcatgaaggcaaaaacagtttcacaccaggacctactccacacgctagtccacttagccaaccgactatcaatgccgctctcaaggatgctcacaggattccggttctgaataataatacagag

SEQ ID NO: 36473 - DNA, 2249 bp, Aspergillus nidulans
aactacacccgaacaatctacacccgcgatgcttacgggacgccccaaggccagaatctgtacggggtcgacccgatctatttcgatcaccggcaggacggcactcacggtgtgttcctgctcaactccaacggtatggacatcttcatcaacaacgagagcggccgttcctcgagtacaacatcatcggcggcgttttcgactttacttcatcgcccgacaatccccgcaagatgtggccaggcagtatgctgaaattgtccagccgcccctgatggttccatactggggactcggtttccaccagtgcaggtacggctaccaggatgtctacgaggtggccgctgtcaccgccaactactccgtccacgatatcccactggagaccatctggactgatatcgactacatggaccgtcggcgcatcttcacgctcgatcccgaacgattcccaccagagctggtcaaagaccttgtggacactcttcacgcgcgagatcagcattacattgtcatggttgatccggctgtctactacagcgagccaaacccggcgcttgacgccggtctgaagtacgatgcgttcatgaaggaactgaacggcactcattaccagggtgtcgtttgggccggtcccagttacttccctgactggtttcacccgaacgctcaggaatactggacggagcagttcctcaacttcttcgacggcgtcaacggcccggacattgatgccctgtggatcgacatgaatgagcccgccaacttttataaccgcccctacccaggcaacaacaccaccccggaggagtttgccgaggcgaatgacaacccccctgagccaccggccgtgagggacgggccagatgcccctatccccgggttcccggatagtctccagccaaacttcgcttctggccagacaaacgagaagcgcgcagttgtcaccgtcgaacgtcgggctcggtctcaatcgcaccgacagctcggcgctggccgctggcggtctgcagtccgccactggccgcgagacccaaaggctggctggcagcacggccgcaaatccggctctggctgcggcccccacgagtgcagaggtctgcccaaccgcgagctcatcaggccgccgtatatgattcagaacggcgccggcccaacgctggcggacaacactgcggacacggatatcgtgcaaagcggcggatacgtccagtacgacacgcacagcctttacggcgcgatgatgtccactcattcgcacaatgccatgcgggctagacgtcccgatgaccgcgcattggtgatcaccaggagcacatttgccggctctggaaaggatgtctcgcactggcttggaggtaaggaattcctgcaatctaaatttgcggcaagggggaacagctgctgactagccctacttttctctgcagataacatctccgattggctttcataccgactgtccatctcccagattctccagttcgcctcgctctaccagatccccgttgtcggccctgatgtctgcggcttcggtggaaacgtaactgagaccctctgtgccaggtacgatcgccctaactcgacagcatcttacgtgcctgctaacatagtctctactagatgggctaccctcggctccttctacactttcttccgcaaccacgccgagatctttgccaatccccaagagttctaccggtggccgatcgtcgccgaagcggcccgcaacggcattgccattcgataccagctgcgtaagtctgcgttcaccattagatcccaacataattaacattgagtccgccaatctagtcgactacatttacacagccatctacaagcagacccaaactggcacaccatcccttaaaccgctcttcttcaactaccccttcgaccaaaacacttacggcatcgatctccagttcttctatggccccggcatccttgtctctccggtcacggaggaaaacagcaccagtgtttcctactaccttcccgacgacatcttctatgaatggggaactggcaagcccgtccgcggacacggcgagtacgtctccgccgaagtcggcgtcacccatatcacggtgcactataagggcggtctcgtctatccacagcggatcgagagcgcgaacaccacaactgcgctgcgccagaagggattcaatatcgtcattgcaccgggcttggatggctctgctcatggagagctttaccttgacgatggcctgtcgcaggtg

SEQ ID NO: 36474 - DNA, 2865 bp, Aspergillus nidulans
aaaagcgtccgaatagatgaacttgatccgttctctgtcgaggctcaagaccagatggcactgcgggcgcccgggctggctgatgataccgaggggcctctaagctcgaagaccgccgagacatcccttcctcgattcacggctctcacagttactattgaatttattgtcgaaaacatacgagatgggatacagtttgttggagtggaaaacggggacaagcgctatccacacgcttatacgacaaactctcttgatcacggcaccgggtgtccgctcttcccttgcgttgatgatccttcttcacgatgcacttgggaaatagcgatcagatgcccgtgtactcttggcgatgtgtttgaacgcaaacctctagaccagtcagttagtgggaccgggactcgcctaagatcaaaccacgatcggcttgccccagatgatgaagccctagacttgtccgtcgtctgttctggggagctgacggatgacattgttgattcaaaagattccagcaagaagactgtctcgtttgcttcctactctcctctctccgcacggcagattgggtttgctgttggtccttttgagtacgtcaacctcgctgacttccgggaaagtgaccaagacgagcagcttggtcaaaacgccatcccactgcatgcgttctgccttccgggtagaggcgatgaagttcgcaacacttgctttcctatggcaaaggctatcgactttttctcaatgacttacggatcatacccgttttcaagctataaaatgtgcttcgttgatgatgcgccggaagacacattgccaacagcatgcttttcgatatgcagcagccgtcttctgtttccagaggagataattgacccaatgtacgactctactcgtgccatcactcacgctctagctgctcaatggatcggtgtcaatatcgtgccaaaggaaccggctgatacttgggtaacggttggcgttgcctggtacatcacagacacgttcatgcgcaaactttgcgggaataatgaatatcgttttcggctgaaattgatgtcagaccgagtgtgtgacctggattatgagcgtccatcggtgtatgatatgggaaacatcttgagcatagacccatcagaggccaaatttattgcgctcaaagcgccgttagttctcttcatcctcgatcgacgcctcactaaagccagcgggaaagcaaccatgtcgcggattatctctcgtcttttcctgaatgctcgtatgggagaactaccgaatggggctgtcacgtcctcagttttccaaaagacgtgtgagcgtttgggacacgcaaaactggatacctttttcaaccaatggatttatggtgctggttgcccccggttccaagccacgcagagattcaacaagaagaaattggtggtggaaatgatgatcaaacaggttcagtcagatcagccgaccgctcgcgatctagaacgggatgcgtttatgcgcgacgtcaaagaagaaattcgaaatgtttacgccggtacaatacaacctgtttttaccggctcaatgacgatcaggattcacgatgctgacggcacaccatatgaacacatcgtggagatcaaagaaggtgtcacgaaatttgacataccctatatacgaaatataaacgactgaaaagaaataagcgacagaaagagcgtgctgctgctgtcattggtgctgatgggaacgcggaagtgcaggaggacattctgctatactgtcttggggatgtattgcagagcgaggaggagatgcagcaatggcgacttgctgactggagcaaagaggatgaagaacgaatgggtcaagaatcttatgaatggattcgcatggatgcagattttgaatggatctgcaagctttcgttggttatgccaggatacatgtacctttcacagctccagcaagatcgagatgtggtagctcaattggaggtaagtcggcacatccctttgtcattttccctgcttacccttcatagtccctacagtacatggccgcgcaacgcgaacaccctctgatctctacgatctttcttcgaacgttaatggaccgacgatatttctatggaattcgggtggcggcggctcgtgctttagtgaaacatgccaaagaagaaatcaactggctagggctatttcatctcgagaaagcttttcaagagctattctgcctgccgggatctcctatgactcggtcaaataacttctcagatagggccgcgtatgtccttcagctagtcattcccgaggcaatttccaaagtgcgcgacgtcagtggtaagactcccatgagggtgaagcggtttctttatgacaagctgaagttcaacgacaactccaataatgaggtaagcaagtctaccttgtatgtttttatgcatatactcacactgatgaagtactcggacaacttaaacgtggccacattgatgaagtccatatgtcacgccatgcttgaaagagttgagtcccgtactgatgacctgaacaattttgatatggacgccgttctagaagctctagccgaagaacagctggagaaggacgctattgcggaaatcgaccgatataggagaatggacgagtggtcaagctctttccagagcctctactcccgcgcggctctatattgccgaatgcagctgatgcaagctaaaatagctgaagtcgacgttatgcaatttctaccctacacgcgggtaggcacttatgacctccttcgcctggacgctttagaatgcccccgcccagctggacatcttcaaaagccccgaaagaaaacggtggttcattttcaccatgtcaaatgacccgtccagatgggtccgtc

SEQ ID NO: 36475 - DNA, 988 bp, Aspergillus nidulans
gcacccgccttgacaaaccatcagacgatcagttttggaccccgaagaaccaacgaaacctaatctccagtttctcaagcaacacttctatcgggaggtcgccttaccgaggaccaggcgctatggattatacaggcgggtactcaaatcctgaagtcggagcccaacctgctggaaatggacgcgcccataactgtgtgcggtgatgttcacgggcagtactacgatctgatgaagctgtttgaggtgggaggagaccctgctgagacgcgttatcttttcctgggcgactatgtcgatcgaggctacttcagtattgaggtgagttccctgcctctaatcactcggcctgtctgaccttttcagtgtgtcctgtacctatgggcactgaagatctggtatccgaatacactctggttgcttcgcggcaaccacgaatgtcgacacttgacagattattttactttcaagttggaatgtaagcataaatatagcgagcgcatctatgaagcctgcattgagtcgttttgcgcgctgccgctggcggcggttatgaataagcagttcctctgtattcacggtggtttgagccctgaactgcacactttagaagacatcaaatcggtatgttacgcgatgctgaatacttcaacagggtcaggctaacctgcctagatcgatcgattcagagaacccccaactcacgggctcatgtgcgatatcctctgggccgatcctttggaggacttcggtcaagagaagactggcgactactttattcataatagcgttcgagggtgctcctactttttctcataccctgccgcgtgtgctttcctcgagaagaacaacttgctctcagtcattcgagctcacgaggctcaggacgggtataccgcatgtacgtacgacgtgtaagccagggtatcgtggaatagagttccttatcctctcactcaacttcttagaattggtccccttctcctcc

SEQ ID NO: 36476 - DNA, 1031 bp, Aspergillus nidulans
ctagccgaccaagtcgccatcatcaccggcgcaggccaaggcattggtgcagaagcagcgcgcctattcgcaaacgagggcgcaaaggtcgtgattgctgatatcgacggcggtactcacccctcctattccattccatctcaaacaaacaaggaaatggccaggctaatgattatgtagaaaaggccaacgctgtcgccaacgccatcaactccgcctcacctaatcgcgctattgccgtcgttggcgacatccttaacgacaagtacatcacgactcttgttgaaaaggccgccgaattcgggaacggcaagatccacattatcgtcaataatgcgggttttacgtgggatggagttattcacaaggtaagcacacctctcgtactcgtagcatgcttcacaaagcgtcggactgttgctgatgcgtgtttaaatggaatggtgtagatcacagataaacaatgggacaccatgattgcggtgcacaacacagcgccgttcaaactcattcgcgcggcagcaaagtacttccgcgtcaaggacggggagccacgtgtgattatcaacatctcgagtacgagcgggattcacgggaatgcgtaagtgccacctccaccaccaccaagccgtcctcttaagttagtgtgattgacactaattatgcgcagcgggcaagcaaactacgcccttgccaaagcgggcgttgtgggcctgacacgtacaatcgcaaaggaatggggtccgcaattcggcgtccgctcgaataccattgcgttcgggttcgtgcagacacgtctgaccgctgcgaaggagaagggggcgttcattaccacgcccgacggaacgaaggttgcccttggtatacccgggcagcagcttggggcgaaggagggcgcgaaggatgggaagccggcgtatccggatattccgttaggcaggccggcgagtcctgaggaggcggcgaggagtgagcttgctgtggccagtccgttgtttagttatgttaacggagagacaattcgggtactg

SEQ ID NO: 36477 - DNA, 2980 bp, Aspergillus nidulans
aaatgtttggctccacaaaggttttgtagggcccgtggcaacattcttctcccatatcgtgaaccatcttgtccgcgctaggcacaaggaagtccaactacacccagagtcctcgcttggtgataccgttctagaatgctataactgtggcaccaagaatgtctttctcctcggattcatcaccgccaagtccgacaccgttgtagtgctcttatgtcgtcagccttgcgccgccatgccatcttccaaggacatgaactgggatacctcgcgctggcagccccttattgaggatcgttcgttcttgacatggctggtggctgccccgtccgatcaagagcaacttcgggctcgtcacctgagcccacaaatgattgctaaactagaggaaatgtggaaggaaaactcgcaggcgacaattgctgatctagaaaaggccacagctgtcgatgatgaacctgcaccggtccttttgcgctatgacgacgcattccagtaccagaacatcttcggcccgcttgttaaaatcgaggcagactacgatcgcaaactgaaggagtcacaatcacaggatggcttaattgtccgctgggatcttggtcttaacaacaagcatttggctagtttcatcctgccgaagctcgaacttggagatgtgaaattggccgttggagacgagatgcgcctgaaatacaccggcgagttgcgaccaaagtgggaaggtgtaggatacgttatcaagatccctaataaccagtctgacgaagttactattgaattgcgggcaaagggagatcacaagtcggtgcccacggaatgtacgcataacttcacagccgattatgtttggaagtcgacctctttcgaccgcatgcagcttgcaatgaagaccttcgctgttgatgagatgagcgtctcgggttacattttccatcgcctattgggtcacgaagtcgcagctgcgccgatgaaaacacagatgccgaaaaagttcagcgttcctggacttcctgagctcaacggcagtcagatcaatgcagtaaaaagtgtgctacagcggcctctgagtctgattcaaggtcctcccggtactggaaagacagtcacttcagccaccattatctatcaccttgccaagctcaacggaggccaggttttagtttgtgcgccctctaacgttgccgttgaccaactttgcgagcgtatccacagaactggcctcaagactgtccgcgtaaccgccaaatcccgtgaggatgttgagtctcctgttggcttcttgtccctgcatgagcaagtccgtcttaatgacagcaatatcgagctcatcaaactcaaccagctcaagagtgaacttggggaattgtcaagtcaggacgagaagcgtctgaagcaactcactagggcggccgagcgtgaaattttgaacaatgccgacgtcatttgctgtacctgtgtcggtgctggcgaccctcgcctggcaaagctcaagttccgcactgttctgattgatgagtctactcagtctgctgaacccgagtgtatgattccgttagttttgggatgcaagcaggtcgtccttgtcggtgaccaccagcagctcggtcctgttatcatgaataagaaggcagcgaaggcggggcttaaccagtctcttttcgagcgacttgtcatcctgggttgctcgcctattcgcctgaacgtccagtaccgtatgcacccatgtctttcagaattcccctccaacatgttttacgaggggtccttgcagaacggtattacttcatttgatcgccttcgtcgcgaggttgatttcccttggcctatcttagatagccccatgatgttctggtcgaatctcggaaatgaggagatttcggcatctggaacatcttacctcaaccgtaccgaggcagcgaatgtagaaaagatcgttacccgcttctttaaagctggcgtacagccaaaggacattggtattatcacaccttatgagggacagcgcagttatattgtcagctctatgcaggctactggtacgttcaaaaaggagcattataaggagattgaggttgcatcggtggatgctttccagggtcgcgagaaagattttattattctttcttgcgtacgctccaacgaccatcaaggaattggtttcttgagtgatcctcgccgtctaaatgttgcgcttactcgtgccaaatacggtctggttatcctgggtaatccgaaggtgctatccaagcatcctctctggaattgtctcctgcagcacttcaaggaacgacacactcttgtcgaagggccattatcgaatctacaggaatctctcatccagttcagccgtcctaagcaggcctaccgcggacctcaacgattccagatggcctacaaccacgtttccaacgttactagtggtttcatgaacggaaggaatggtcatcggaacgagttccacgacaccggctcggttgttggctacatccccgatgatgtgtcttctgtccattcctcagcacttggcggcgttgggattccatccggatatcctcctatgttccagcaattcgcagattcgtggccttctttgcctggtgcccgtcgagccaatggcaacagaggaaaaggcgcgcctagcattgctggggattcggtcgcagccacggagtctgatattactggaagtatcattgacggaaagggtcctgagcagggtggcgtcagccttgctggattgagcatcaacgatatgaccaaacagcccagtctaagtcagtctgatcgactgaagcgttacgtagaatccggagctcgtgatccttacaagccgggtgcccccgatagcggtagcatttttggaggaagttctgccagcattcgtgttacacgcggaatacccggccatattcatgatgacgacgatgcccggagcgtgtccacagctttcgctagtcaggtggggggcaattacgattga

SEQ ID NO: 36478 - DNA, 1684 bp, Aspergillus nidulans
ccaagcaagaccgagatcgcaccgctcagggcagccaagtacccgtttggcaacatcgtggacgctcttcgacatgctgctgctcataccgatgagggcattatagtataccacccaaacagcatcagcacctcatcacctccacagacagtctcctacaaagatctgctgcatcaggcagaggcgaatgccaccagactgttgcagcagaagctatgtagccccaagtccattgtcctcgttcactttgagtccgcactggacagcatcgtatggtactggtctgtccttctggctgggggcatacctgccctcaccgggcatgggatgttcagccagaacccggcagatagagagaggcatctgcgtcatctgtccgagacgctcaattcaccggtctgtctgacccggcctgccctcttggccccctttgaagagcagacagcggatgaccggatcaaagctcgaacagtggatgagatcctcgcagctcccgaaattgcggacgttgctgacgcacctctgcctgccctaaccccgtcttcgaccgatatgcttgccctcatgctgacctccgggagcagcgggcaacgcaaaagctgtccctctgacccatcaacagctccttgcggccttcaggggcaagtccaccgcggccagcctccgcttcccccgcagcccgttcctctcctgggtgcacatggaccacgtcgccaatctagtccactgccatatcttcgccatcgtgtccggcatatcacagattcaagtccctgctccggatcttctcatcaacccggctcagcttcttaacctgataagcagacaccgcgtctcgcgcacgttcatgccgaacttcctctgcgccaagttgcggcgacagctggagtcggggagtccagagtatatcctggaccccggcctcaaccttgagacgctctatattgataccggtggtgaggcgaacgtcacagaggtttgtattgcactccaatccctcctcagccggtacggggctcccgacaacgttttcaagccctccttcggtatgaccgaaaccgtggccggatgtatcttcaactcgcactgcccaagctatgatcacgcccagcgccatgagttcgcctgtctcgggaaaccgatgcctggagtgcgaatgcgggtgacacggcttgacactccgagcgaagaggcagcccccggtgagcgcggcagcctcgaagtaaccggggaagttgtctttaaaggttactacaataatcctgccgccacagcagaggcgttcaccagcgatggatggttccggacgggggatctggcgttcattgacagcaacggcaatctgcacctcgacgggcgcacgaaggagatgatcaacatcaatggagtcaaatacctcccgtacgaactggatgctgctctcgagcaggcgcagatcccaggcgcaacacctagttacttctgcacgttcagcagccgcgatgcaaccatggataccgaggtcgtggttgtgctctaccttccatcttatgtggagagcgatgacgaagccaggttcagcacgcaaagcagcatcatccgtgtcgtggccatgcacacgcggtcccggccgcgcgtagtgccgctgcgtccgcaggatatgccaaagagcacgctgggaaaactgtcgcgcgcaaaactgaag

SEQ ID NO: 36479 - DNA, 1444 bp, Aspergillus nidulans
gaggaggacttctggactcgaaatggtctgaatttcaagtccttccagcggcgccctgcccacgttgtcgagctcaaccggtccatgaaaacgcgccatatgcatatgattgccattggcggttctattggtatgctctatgcttgaggccccaaagccgctctaacggtcgcaggtgctggttttttcgtcggctctggtggtgcgctcagtacgggagggcctgcttccttgctcctggatttctcgatcatcggtattatgattttcaacgttggtaggtctttctctcgagtattcttcctgttggtgtgctgaccgttcagtctacgctcttggtgaacttgctgtgatgtaccccatttccggtggtttctacacttactcgacccgcttcatcgatccttcctggggctttgccatgggctggaattacgtctttcaatgggccatcatcgtcccgctggaactgacggttgccggtctcactattgactattggcaagtcgatgttagcgtcgccgtctggatcacagtctttttaatcgctatcatcatcgtcaacatttttggtgcgctcggatatgccgaagaagagttcttgtcttcgtgccttaaactcggcgccattatcgtcttcatgatcatcgctttggtcctggtttgcggtggtggcccgtcggatggtatgtacaatgaatactggggtgcacgactctggtacgatcccggcgccttccgcaacggcttcaagggcttctgctctgtcttcgtcactgcggccttctctttcagcggaacggaactggtcggtctggccgccgccgagtcgaagatcccaccaaatcctgccgggcgccatcaagcaagtcttctggcgatcaccctgtatgtccccccttgctgcaagcgcccgccatgacgcgccatatctgacagtattcttctagcttctacattgttggtctcttctttgtcggcctcctggtgcgctctgataacgaacgcctcctcggcagcggtcttatcgacaccagacgtcgccctttgtcattctggcttacgatgcaggcttgaagggatacgatcacttcatgaacgtcattattttaatatccgtcctatccatcggtgtctccggtgtttacggctcttcccgtacccttaccgcgctcgccgagcagggtacgctcccaagtttttcgcctatgttgatcgctccggccgccctctctggtccgtgctgattaccatcctgttcggtgttcttggatacgtcaacgtcagctcgtctggtgaggaagtttttgcctggcttcaggctttgtccggtctagccgctctcttcacctggggttccatctgcttggcacacatccgtttccgcagagcgtgggcttacaatggccgctctctcgacgagatcctttagcactggctgccg

SEQ ID NO: 36480 - DNA, 1442 bp, Aspergillus nidulans
gagcacctcatgacagtccggccagccctgcgcgcgtacccctaggccgtgatctggtcacttacaatacccatgtccataatcatgaaaggctacgacactgctctgatcggcagtttttatgcgcaccctgagttcaaagtatcagtttggaaaggaatacgcacacggccatgaggttcctgggggagtggcaatctgccctgggtgctgggggaaacgcggactgcattatcggggcatttttgaatgggtatcttgttaatcgttatgggatcaagaaggtttttataggcggcttgctttttatgtgtggttttatatttgtatcttttcttggaaagtcggtcagggcgcaggtcgctggccaggttctctgtggtaagctccatgtccttccaaacttcaaaaacgattatgccaaccatggtactgtaagtataccttggggcatctttgcgactatagggcctgcgtactcttcggaacctttccccatggccctccgcccgtacctgactgcctacacaaacatgtgccttgcaatcggacagtttatcctcatgggcgtcatgcaaaccctcgttaatcggccagacgagtggtcctatcgcattccctacgccgtgccatggatttggccggcactgttatgcgtgattgcaatctccatgcccgagtcgccgtggtggcaggtccggcatatgtagcggcagaaaagacagtccaggaattgatggcaaagagcgagaaacacaatgcgcgccaggttgtcgccaaatctgtggcggacagagatcgcctgtgtcatctttgccggacaggctctctcgggctcgcagtttgcatattcgcgaacttatctctttgaacaggcggggatgagcgcaaattattcctacaagcttgcgctgggcggggcggccatcgccttcatagggactgtcttgtcttggttcttgatgaaaggcttcgggaggcgctctatgtacctcggtggggtggcgatgatgtgcgtctacctcttcaatattgggatactggatctagtgcgggagatggccggtgtaaaatgggcgcagtcatcgttgtgcattatctggctgtttacctactttctgagcgtcggaccgctgggatggtccattgcgccggaggtatcctcgacgaggcttcgttctaagacgatcgtgctggcgcagaacacgtactatatcgccattgtggttgcgaatgtcattgagccgtactttataaatcccaccgcttggaactggctaggcaagaccgacttcttctggttcggcactggactcgccacgttgatttggggtttctttaggcttacagagacgaaaggcaggacgtttgaagagctcgatatcatgtttgctgccaaggtgctgacgagaaggttcaaagcgtatcatgtcgatctatac

SEQ ID NO: 36481 - DNA, 463 bp, Aspergillus nidulans
agatagctcactcgcgagtatcaaaacatccagaaaaatcccccacccttcattatcgctcacccgtcagagtccaacatacttgagtaagtcaaacccacaggcgaagagaagcgaactaacggactatgatattaggtggcattatatcctcactgggccccctgggaccccatacgagaatggacaatactggggcacattgatgttcccccccgaatatccatttgcccctcctgctatccgcatgcacactccaagcggtcgattccagccgtcctcccgactctgtctaagcatcagcgattttcacccaaagtcattcaatccggcgtgggaagtttctacaatcctcatcggcctactttcctttatgactagcgaggaaatgactactgggagcgtgagcgcaacggaagcggaaaggcgtgttctcgctgcgcgctctagatggtggaactct

SEQ ID NO: 36482 - DNA, 2080 bp, Aspergillus nidulans
ccccaaaacaaccaaactaccccctgagaaaaaaacggcccccgtccccagaattcctcacgaaagaaacaacgaccaagtcttttaacatttctataggcggcgagtgggatcaagatgagcgggaacagaatctggagagtctttttgagaccttcgtatctcgtattagccaacaagggcaggagagctcaggcctcaaggatgcgctcgaagtttacaaatcaagaggtaggtgatcacgaggttgggcgagaatagtgctcacacggtttgattacagttggtgagcttgaagaagcaaagagcgaacagacggaacagaacatacgcctcaaggtggaactggatgtcagcaaatcacgcctcgcggaggcagaggatgccctgaaaaatgcccagcgagatcatgaaatcgcgatagatgagctcatgtctcggcagcgcgcggagtgtgaatctgtgagatatgagagccagaagagcttagacgcccttaaggcacaacacgaatccgaacttaaggagctaagaagacaatttgaacgtgagctggaagatgagaaatgtgcgcgggtccgggaattgaaccagcttcactcaaagactgctctcgacgcccagctatcgcagatcgaacttgataagacaataaaggaactcgcggcaactcgggaggatctccaatcgctgcggaccgaactcgatcgggaacgaaagaacaccaataacctcagacagaacctggataccgccgcttctaacagcgttacattggagtccaccattagtgcgcttaaggcaaggatcgagttcctagagtcaggaagggaagaacaatctgaagcttttgaacggttgaaccagcaaatgatggatgctatggcggagaccaatgcagccaaagagaaactcagaagggaagaaacactccggcgcaaattacacaatcaggtgcaggagctcaagggcaacatccgcgtattctgccgtgtccgacctacgttagaaaatgaaggtgcatcggacgcggctcaattcacatatccggacgagggtgaagactccaaagaaatcaatattatcggaccagaggagaagagcagttttggaacagtgacgaggaagaaccacaatttctcctttgaccatgtcttcgggccgtcagcccaaaacagcgatgttttcgacgaaatcagccagcttgtgcaaagtgccctcgatgggtacaatgtttgtattttctgctacggtcagactggtagcggcaagactcacacaatgtcctcgctagacggcatgattcccagggcagtacatcaaatttacgagacagccacgagcctcgaggaaaagggctggagatacacaatggaaggcaactttgtggaagtttacaatgaaaatttgaacgaccttttgggtaaagccgaggagttggacaagaagaagcttgaaatccgacacgacatgcagaggggcaagacgaccatcacggacgccaccactgtgcaactcgaatcgccagagatggtcgaatctcttctcaaaagagcggcagccaaccgatcagtagcggctacgaaggcgaacgaacgctcctcccgctcccactcaatcttcattctcaaattgatcggagaaaactatataaccggtgaacgcagtgaaggaaccttgaacttggtagacttggccggttctgagagattaagccacagcggtgcgacaggagaccgactgaaggaaacgcaaaatatcaaccgcagtctaagctgcctgggggatgtaattgcagctttgggacagggcaagaaagatggccatatcccataccgaaacagcaaggtacgctcctttgtacaaactaccgtcgttcattctaacataactatagttgacatatctactccaattctcgctgggtgggaattcgaagactctcatgtttgtcatggtcagcccattacaagcccatctctccgagactttgacgagtctaaaattcgccacgaaggtacacaacactcacattggaaccgcgaagaaacagacccgtgtccgtgatgtttagactcca

SEQ ID NO: 36483 - DNA, 768 bp, Aspergillus nidulans
agctccagcgtcgagccatcctgatgctttaacagccctggggggtcagtcttgctcacccaattctgggactatgatccgtccgccggtccagcggattcttggactcttcacggcctttggtgcgcatattaaatccaccccctcatctctctccagcctcgctgataatggtgctttgccacaggccagataactgcgacggcacatacgaggagttgtacgactcgtcacgcgagtactccaacatcacagacatcatcaaggaattcggcagaagtgatcttctctcgtacatgaacgagtactggatggactacagcggagacgatgagtctttctgggagcatgagtggaacaagcacggtacttactttgcttctctatcaatatgaaaaaagaaaaagaaaaactttgtactaatctgtaacaggaacttgcataaacaccatcgaaccgacctgctataccgactacaccccgcaagaggaagttgtcgactacctccaaaaagccgtcgacctgttcaagacgctggacacctacaaagctcttgctgccgcaaacatcaccccttcctctagtgcaacttacacgctagacgaaatccactccgccctctcagacattcacgatggctttgcgccgtatgttggctgtgatggcgacaatctgaacgaggcctggtacttctactatgtccggggtaacttgattacgggagattttgaccctgctgagaagcgttagttaccttgatgtcctttg

SEQ ID NO: 36484 - DNA, 1366 bp, Aspergillus nidulans
cgccctttaagagaagcccaggactgatcatattataggttgaagcggcctttgacgtacgcagaaaaggtactgtacaaccacctcgatgatgagtttgatggaaacatcgtccgtggccagacgcagctacgatccaaaccagtccgcatcgcttgtcaagacgcaactgctcagatggcgctcattcagtttgtgtctgcaggcctagacacagccgcagtgccacgaccgtccactgcgaccatctaattgtcagccgggaaggggaagaatcagatctctcccgggccttggagacccatcgggaagtctacgacttcatgaaaagtgcatgccagaagtacaagatgggggtttggaggccaggagtaggaatcattcatcctggaaaactacgcttaccccgccggcatgatggtcgagacagattcgcatacaccgaatgctggcggaatgggcatgattaccattggagttggaggagctgatgctgttgatgtcatggctggtttgccgctagagactgccccaaggatattgggtgtgcgacttcacggcgagttgtcgcgctgggcatcgccgaaagacatatcaacgaacttgcagggataatttcagtaaagggaagcacaggatcgatcattgagtattttggtctcggagcgcagacaatttcagcgactgggatggctacagtgtgcaatatgggggctgaatccggagctacgacttccatatttccctacacggcctccatggcagagtacttgcgagccaaccggcgtcctgacatggctgctgcggtagagacaattgcatatgagctccggtccgatgagggcgccgaatacgaccagattattgatattgatctctcatcactggagccgcatatcgatggccccttcacgcctgatctgtcaacgcccatctcaaaatttgggtcagcagttatagacaatgagtggccgtcgacactgaccgccggccttattggatcctgcacgaactcttcttttcatgacctcagccgcgcagcgagtctcgcccaataagctttggatgctggcatgaagccaacaacgcagttactgctgtcccctggcagtttgcagaccctaaacacattggaggaggcgggaataatgcaggtgtttgagaaagcaggtgctatcatgttacccaatgcttgcgggccgtgctgtggctcgtgggatcgtaccgatatacagaaagtgagcctcacgtagagtctcaaagtgtattctggcactgacaagcgcagggaacaaagaactctatcatcacctcatatagccgtaatttctcaggcctccactattggcagcccgttgagttgctg

SEQ ID NO: 36485 - DNA, 1885 bp, Aspergillus nidulans
tattccaatgtttcagtgtatgagatggaggtgaatggagtcgcagttatgaagcgacgctctgatggttggctgaatgctacccagattttaaaagttgctggtgtggtcaaggcgcggaggacaaagactttagagaaggaaatcgcggctggtgagcatgagaaggttcagggcggctatggtaaataccagggaacgtgggtgaattaccaaaggggtgtggagctatgtcgcgaataccacgttgaagagttgctacggcccttattggaatatgacatgaaccctaatggcacggcagcttctggtcaggacagtttggatactccaacaaaggagcaggcaatggcggcacaaaggaaacggctttatagtggaatggaaaaccggagcatgtctcaacctcagcaggggacgttctttcaaaacatatcccgcaccgcagcgaccgccgtcaatgccatgagcaaggctcgtttcgagtctcctgcggcaagaggcggcgacagcagacggctgagtgtcatacggaaaccgtcacaacagatgggcagtcaagatgctcagcccccctttgggagccaacaaagcttttatagtgccgcttctgacagtggattcgcgagcaatattccaacaaatggccgatatgcaccgcaagatgccatgagcttcgaacaggaagaacctatggagccgccccgcaagcgcattcgttcatcgcaggctttcagtcttcccattgacggcacatcgatgtcgatgagtgaacccacacctacggagccaaatgattcattttaccaagacatggagcccttgcatcatattgatgaaggcagacatggtctcgatcctcttccaccagccaccactcctgaaagatttcagaaaatgaagctaatcatgaccttgtttttggataaaacaactaaagatttctcaacacacccggcattaattcagctgtcaggcgaggacttggaagttccacttgacgagtatcgaaataatgctttacattgggcggctatgcttgctcgtatgccacttgtgtatgcgcttgtcaaaaaaggcgtaaacattgcccggctaaatggggcgggtgaaactgcattacagaaagctgtcggcacacggaacaatcttgactacaggagcttcccgcgattgctacaagtcttggctccgactattgacatggttgaccgaagtgggcgaacaatattgcatcatattgcagttatggcggctactggacatggtggtcatgtgtctgcaaaacactaccttgaggcgctgctcgaattcatagttcgccatggcggtacctcattgaaccaacagtcaaatggcactgcaagccaaccgggaatgccgctttctaatgaggtcattaccttaggtcggttcatctcagaaattgtcaatctccgagatgatcaaggagatacagcacttaatctagcgggacgtgcacgctctgttctggtcccacaactgttgaaggtgggtgcggatcctcacattcctaatcactccggtcttcgaccagcggactatggtgttggcgtggacatggtagatggtagctctcaaccagctgggggtcggagcaacacctttctcgctcagttggcaaagacaaggaaagaaatcctggaaggtatgcgcaacgtcattccactcaaatccacctactgacttcgtcccagcaacaacggctcaagtcacggctattgttcaggagacattaggaacattcgataaagagctggccgctagcttgacgagcaagcaagagaagtttgatcactggcatgccaagatcccagagtcggcgaaggcacgacaaatcgagcagaagcaattggatgagcta

SEQ ID NO: 36486 - DNA, 2889 bp, Aspergillus nidulans
gataaactgaagcgcttttgtaccttcagcgccagtatatacgactgtgcttggctatcgatgatcaatcgccgcgaaaatgagcagattttgtggctgtttccgcaatgtttcgactacgtgttatctcaacaactcaaagatggtgcttggccatctcctgcgtctactgtagacggcattcttaatacttcggccgcgctgctttgtctccttgatcgtcgccggttgactcaggatagtcgtctctctagcagaatcaatgctgccgcgagcagcctgcagcgactcctagaagcctgggatctggacgggactgatcaggtagggtttgaggtgattgttcccggtctacttcgccagatttcccactttggcatcacctttaaattcagttgtcagtgtcgactcgaagcattacgcgctgcaaaactggagaaactgcggcctgatatgctttattctgggtaccaggcaacaatactccattcagcagaggctctcatcgaaaccattgacatggatcggataacccagcactgcactgaagacacaggaattctaggatcaccggctgcaacttcagcatacctcaaacatgcttcgggatgggatggccgtgccgagtcatatcttcgaaaactacttgcgtctgccgaccgtgaacaaggtggaattcccagtgggtttccgaccgctatatacgagctgtcgtgggtgagactaactggctagctctctttacgatcaataaagtccaaactaactatttggccaggctctctcaactgtatttctggcagtcgggccgacaacaccttgcgacattgtactcctttcaccggtcaaggaatacttgcatgagactttggcgaagaacggggtggctggattcgctccgggtatcttggccggtgccgacgacacagcgagagtgttattgaccctggagctgctgggtactgaggtctgactatctacccccttatgaagcattgtaggaagggcatattttgcacaacctacgagcatgagcggaatccaagcttcagtgcgaactgcaacgtattacttgcactggatgaatccagtcacgcactgcagcatattgataccatcgaagaggtagctgcgtacctgatagagtgctggaaagcaggaagcatcaaagacagatggaactcgtcccctcgttactctaatatgctacttgtactagcgcttactcggctctttctccggtatgacaagggagacttccacgggccattgcaagtctcgttgtcgagggatatcatcatatgcctgtctcagatcctctcacgaacgttgattgaacagcacccggacgggtcctgggactcgtctttagaggtgactgcctactctgtgcttacaatctctcggatgatgcttttgccctacgtcgataagctgaaaattgaccacattgccccagcgctgcggcgaggctgcggatatctgatagatcatcagcacgatcccgtccaaccacgacgcgaagattatgtgtggattgagaaagtatcgtatgtgtcttccttcctccgcaaggtgtacaccgttgcagccatccatgcatctcgcaagcaatctccctgctcggaaagactcgtctcattattccaacccttgcctacaacgcacgaacttaaggtccttctgctggccactcctctctgtaaagagtccccagtgccttttatggaccttgcactgttggaagcgcattattggtctcagctgttgcgcgaaaaaagttccatgatctttaagagcccaatatcatctgatggtcaaaaactattccacctgattcctctcatcttcacgtcctgtaatcagcgcgccgggcttgttctttccacaaacacgctctggaacatgatccatttctcgctgctcgtttaccaggtggatgcattgatggaatctactgccatacgtatgtccgacgcggaacttgatgaggtcctattacgtttggatcgcagttgcagtctcgcacgcaccgctttccagctaccccagcgagtctcgaatggctcaagcgcccaaacagcaggtgtgcaaccggacgatctcaagactatacctttgaacaaaagccgagtcgagaatctcatgcatctgctacttccattcatcaaccacgtccttggccacccgcaagtcctgcaagctcccgttgaaattcagagagagctcgccgacgagctgtaccgctttctcttagctcatgtcgaacatattcgggcaaacctaacgcgaacaaggataaatacactgtccgccagcagtggccaccagctccgccaacttacatattaccgctgggttcattccatcgggtcagcggacaccagctgtcccctcgcagcagttttcttcttgtgcctaatcagcaagcacgggagcttttgcttccagcacccgaaggcacagtaccttagtcgaaccgtggctcaccatttatctgtgatctgtagacagtataacgactacggctcggctgttcgcgatcacgaagaagggaatctcaacagtcttgattttctcgattttcaacaagaggcacaggcaaatggtgcagtatctgagctcaggacgtcaaacagtgtttgcccttccgtctcagatacgcagctgttcccacgagctgcatgcacgtcgcagagtgcaaaagatagccttatggaagtcgctgagtttgagcggagctgtatggagctagccctgcagcgactggaagatgccgcatgtacacttgacgcgctcaagcaatttagggtgtttgtcgatgtcacagatctgtttgggcatgtttatatcttgaaggacttgacaggtaaagttcatccggccgcg

SEQ ID NO: 36487 - DNA, 1789 bp, Aspergillus nidulans
cgtggtcagtccttggacccaccctccaagatcgacgaacttcttcctctttacgtcgagctcctcaccaagctcaaggaggctggtgttgaggacgttcagatcgatgagcctgtcctcgtctttgaccttccccttaagtctaagaacgctttcaagcctgcctacgagaagcttggctcccttggtgcccaggctcctcgtctggtcctcgctacctacttcggtgacattgtccacaacatcgatgtcctccctgctcttcacaacatttacggtattcacattgatcttgtccgcaaccctgagcagctcgactctgttatcggcgctcttggtcccaagcaggtcctctctgctggtgttgttgacggccgtaacatctggaagactaacttcaaggctgccattgagaaggttgagcttgctattcagaagcttggcaaggaccgtgtgattgtttccacctccagctctcttctccacgttccccacactcttgccagcgagaagaacctcgaccctgaagttcaggactggttcagctttgctgtcgagaagaccagcgaagttgttgtcatcgccaaggctgtcaccgagggccccgctgctgtccgtgagcagcttgaggccaacgccaagtctgtgcaggctcgtgcctcttccaagcgtaccaacgaccctaaggtcaaggagcgccaggctgccgtcacccctgagcagcacaaccgcaagtcccccttccctgtccgtatcgccgagcagaccaagtccattaagcttcctcttttccctaccaccaccatcggatctttccctcagaccaaggagatccgtatccagcgaaacaagttcaccaagggcgagatcactgctgaggagtacgagaagttcattgagaaggagattgccgaagttgtcaagatccaggaggagctcggccttgacgttctggttcatggtgagcccgagcgtaacgacatggttcagtacttcggtgagcgtcttaccggttacgttttcactacccacgcttgggttcagagttacggatcccgttgcgtgcgtcccccgattatcgtcggtgacatctctcgtccagctcccatgactgtcaaggagtccaagtacgctgtctcgatttcatccaagcccatgaagggtatgcttactggacccatcacctgtctccgctggtccttccctcgtgacgatgtccaccagtctgtgcaggctcagcagctggctctggctctgcgcgacgaagttgttgacctcgaggcggccggtgtcaaggttatccaggtcgacgagcccgctcttcgtgagggtcttcctctccgtgctggcaaggagcgtgaggactacctccagtgggccgttgctgccttccgtctgtccactagcggtgtgtctgacggcactcagattcactcccacttctgttactcggagttccaggacttctttccacgccatcgccgcgttggatgctgacgttttgtccatcgagaacagcaagtctgatgccaagctgctcaaggtctttatcgacgaggcttacccccgccacatcggtcctggtgtctacgacatccactctccccgtgtccccagcgagcaggagatcaaggaccgtgttgaggagatgcttgcgtacctgcgccctgagcagctctggatcaaccctgactgtggtctgaagacccgccagtggcccgagaccaaggctgctctctccaacttggtccaggcggccaagtacttccgtgagaagtacgccaaataa

SEQ ID NO: 36488 - DNA, 3238 bp, Aspergillus nidulans
gagcgagaagttgcactatacaaccgaatcaatgcgcggaaagctgagcttgctgcacttcccgcaaacattgctgcatggaactcgggccaaagtgatgtcgctactggcgacgactctttgaagctgaaggctctgatcgagtacagaatgctcaatcttttgcctaaacagaggctcctccgcaaacaaatccagcatgagatgtttcattatgacaatcttggcatgactgccaatcgtgctactcatcggcgtatgaagaagcaatcgttgcgcgaacgccggatcactgagaaacttgagaagcagcaacgtgatgcccgcgaatcaagagaaaagaggaaacaggatgtccatctccaagcgatagtcaatcacggtgcggaacttcgggaaacggcaagccagcaacgccaacgcgctggaaaacttggtcgtatgatgcttcaacaccaccagcacatggaacgtgaggagcaaaggcgcgttgaacgaactgctaagcaacgtcttcaggctttgaaggccaacgatgaagagacctacttgaagcttctcggacaagccaaagattctcggatttctcatcttcttaaccagactgacggtttcctcaaacagcttgccgcgtctgttagacaacaacagcgtaaccaagctgaacgatatggtgaggacacgatttcgatgatgatgatgacgaagacatcgcatccggcagcgacgaggaaggcgagggccgccgaaagatcgactactacgctgttgctcaccgtataaagaagagataaccgaacaaccttctattcttgttggtggtaccttgaaggagtatcagatgaagggtctgcaatggatgatttcgctctacaacaacaatcttaacggcattctggccgacgaaatgggtcttggaaaaacgatccagaccattagtttaatcacgcatattattgagagaaagaggaacaatggcccgtttttggtcattgtccctctgagcactctgacgaactggaaccttgaatttgaaaaatgggcgccgtccgtgtcgagaattgtctacaaaggcccgccaaatgctcgaaaacaacagcagcaaaacattcgctggggaaattttcaggttctattaacgacttacgagtacatcatcaaggaccgccctattctgagcaagataaagtggacacatatgatcgtggacgagggtcatcgcatgaagaacacacagtctaagcttagtagcactctttcgcagtactacaccagccgttaccgattgattttgacgggtaccccattacaaaacaatctccctgaactgtgggcgctcttgaacttcgttttgccaaatatcttcaaatcagtgaagtcatttgacgaatggttcaacacgccatttgctaataccggtggtcaagaccgcatggatttgactgaagaagaacagctccttgtcattcgtcgtctacacaaggtccttcgaccattcttgctccgacgtctgaagaaggatgtcgaaaaagacctgcctgacaagcaggagagagttatcaaatgccgcttctctgccttacaagcaaagctcaacaagcaacttgctacacacaataagatggttgttagtgatggcaagggaggcaaagttggtatgcgtggcctcagtaacatgctgatgcaattgaggaagctctgcaatcatccctttgtgtttgagcaggtggaagatcaagtaaaccctgggcgaggcacaaatgatctaatctggcgtaccgctggaaagtttgaactgctcgatagaatcctcccaaagttcaaggccaccggccaccgtgttttgatgtttttccaaatgactcagatcatgaacatcatggaggattttcttcgtcttcgtgggatgaagtacttgcgtcttgacggttctacaaaatccgatgaccgatcagacttgctgaagctcttcaatgccccagactctgagtatttctgcttcttgctctcaacacgtgctggtggtctcggcttaaatctgcaaaccgctgatactgtcatcattttcgattccgactggaatcctcaccaggatctccaagcccaagatcgtgcgcaccgtatcggtcagaagaacgaggtcagaatcttgcgactcatcacctctaattctgtcgaagagaagattttggagcgagctcaatttaaactcgacatccaccgcaaggtcattcaagcgggaaaattcgataacaagtctaccaacgaagaacgagatgcactcttgcgtactctgctcgagactgctgaggctacagatcaagccggagaccaggatgagatggatgatgatgacctgaacaacataatggctcgatcagacgaggaattggcggttttccagcgcatggatagggaacggcagaagacgtgtccatacggccctggccacaagctgccccgtctgatgggcgagagtgaactcccagagatctacgtgactgaagagaaccccgtcgcggaagaagctgctgagatagagctttctggtcacggtgctcgcgagcgtaagattactcgctacgacgacggcctcacagaagagcaatggcttatggcggtggatgccgatgacgacaccatcgaggatgcgattgcacggaaagaggcgagggttgagaagcgtcgttccaacaaggagaagcgtggtcgtaaggcgcaaggcgacgagtcgtcgcccgagccatcacgagagacgtctgaaacaccccaacccaagaagcgtggtcgcagagggccggctccaaagcgtaaagcagaggagctagctgaggagacacctcagccaaagcgcaagaggggcagacaagccaagcctgtcgaaacgttgagtccagatgaccgggccgctttacaacagatcctcaacaatgtctaccaagccttaatggacatggagcaggagttaccagccgactcctccgatagcgaggatggacctgtcacacgttccattatcgagccatttatgaagccaccaccaaagtcgcagtatcctgactattacatgatcatccagaatccaatcgctatggacatgatcaagaagaagatcaaccgcgaagaatatcagagtctgagagacttccggaatgatatcggtctcctttgccagaacgcgcgaacgtacaacgaagatggtagcatcctgttccaggacgctaacgacattgaggta

SEQ ID NO: 36489 - DNA, 2298 bp, Aspergillus nidulans
tccgtcctatccgttctcctggtcagcgtcgcccaggccgcggccgctccatggagaccgcgcgagcctagagccgccggatcgaagcgcttgacattcaacgaaactgtgattagtgcggcgctgtcgccttcttcgatctcggtgcaatggatcgcgactgagaacgacggggattatgtgtaccaggaggaggatggaagcatcaagattgagagcattgtcaccaaccgatcgcagacaatcgttccagccgagaagatacctgccgatgcatacagctattggattagcccggacctgtccgcggtgctgtgggccacgaattatactaagcagtaccgccactcgttcttcgccgattactacatccaggacgtcgagacgttggagacggtgccgcttgtggaggatatggttggagatattcaatatgcggaatggagcccaagcggcgattccatcgcgttcgttcgcggcaacaacttatggacttggtctgacgggactgtcacggctatcaccaaagacggtgggccggacatgttccatggcgtgcctgactggatctatgaggaggagattctgggggaccggtttgcgctctggttctcgcccgattccgagctcctggcattcttgactttcaacgagactggcgtacccaccttcaccgtccagtactttatggacaaccaggaaattgcgcctccatatccccgcgagctcgacatcagataccccaaagtgtccgaaacaaatccgacggtcaagttaaatatccttcagctcagcgacaacaccgtatcgaccattccaatcgatgtgtttgacccgagcgagttgatcgttggggaagtcgcctgggtgactgatacgcacactgagctggccgtcaaggcttttaaccgtgtgcaggatgaatcgaaggtcgtcatcgtagagaccgcttctggcgagaccaagatcgcgcacgagcgtgacgggaccgacggttggttggataacttgctttcaatctcatacgttggtcctttggctttgggctcgggggatgcatcatccgcttattatgtcgatctttcggaccactccggctggacacacttgtatctcttctcaacttcaggcggcgatcctatccccttgacggagggagagtgggaggttacgtccatcgtgagcattgaccaggagcgggagctgttttactatctctcaacccagcatcatagcacggagcgacacctttactcggtgtcgtatcggacctttgagattacgccgctcgtggacgataccgttgaagcctactggagcgtttcgttttctgcaaaggccggatattacattctaacgtacgcgggtcccagtgtgccgtaccaggagctgtactctgtgaaccaaacagccccactgcgtactctcaccagcaacgcagccctgatcgagaagctggaggaatacgcgttgcccaacattagctatttcgaactggagattccaagtggtgagaagctcaatgtgatgcaacggttgcccgtcgggttttccccggataagaaatatcccgtactattcactccatacggcggtccaggagctcaggaagtcagcaagagatggcagtcactggatttcaacgcgtacattgcatccgaccccgagcttgagtatgtgacctggacggtcgacaaccgcggaaccggctaccggggccgcgagtttcgctctctggtggctaagcagctcggaaagctcgaggcagaggatcaggtctacgctgcaaagcaggccgccaaacttgactgggttgactccgagcatatcgccatctggggttggagttacggcggttatctcactgggaaggtcctggaaaccgacagcggtgccttctcgcttggtttactgaccgcgcctgtttcagactggcggttatacgactcgatgtatactgaacgatacatgaagacactttcgacaaacgcggagggctataacacgaccgcgatccgtcacacggacggcttcaagaacgttgaaggcgggttcctaatccagcacggcaccggcgatgacaacgtccatttccagaacgcggcggcgctgggggatacactgatcggaaacggggtgacgccggagaaaatgcaggtgcagtggtttacagactcggatcatagcatccgttataacggagggaacgtgtttctgtacagacagctggcgcaaaggctgtacaaagagaagaaccgagcgaagaaggagcagcaccagtggagcaagaggagccag

SEQ ID NO: 36490 - DNA, 1970 bp, Aspergillus nidulans
ccttttctcgtcgggaagccactgagcctggccatcacggccacagccggtagcggttttttgctgtgagtataaccattcgttaaggcttcgccattaacagctcagattcggatacgaccaaggtgtcatgtcgggtctcctgaccggcgatgcttttgtccgggtatttcctgagattgacacaaccgtgggaggacatgggaactcctcgttgcagggaacagtgtatgttctcctccatatggtctgttgaattgaaggccatgactgaccgtgaagacagggttgcaatctatgagattgttcgtacgggatccaagcgtccgcacacactgacagtagacagggctgcttctttggcgcgatcatgtccctccttgttggcgagcggctcggccgacggtggtgtatcatggcgggttcagtgatcctttctattggcgcggtgctccaggccacctcgtatggcattccgcagatgatcgttgggcgtattgtggcaggggtcgggaatgggctcaacacgagcactatacgtaggtttatccagagatagcgagagcactgggcgcttaggtgctgacggaggcagccgtgtggcattcagagctgagcaaagcgtctagtagggggaaaggggttcgttcgtttgctggttgcttattgatggacgatgctgattcccgcagcttgcaatcgagctggtcatcaacatttttggcgtgatgacggcgtactgggtcggtgcgtaagggcatctcctttcttctgctaggttgttggccgctcatctgatatactaactaataccagactacggcatgagctacgtcaacaatgagtcccagttccgctttcctcttgccctgcagatcctctttgccatagtcaccttcctaggtgtcctcgttctgcccgagtctcctcgctgggtgagtagccaccgtccatccatgcatcaacagcgttgacgagccagctcatcgcccatgaccgccacgccgacgcccgtcaggtcctctggtctgtccagcccaatgcccgattcatcaaccaagacgaccccgtaatcaacatggagatggcggagatcactcagaccatggctgaagagcggcaagcggccgcagagggctcttttaaaaggctcctcacggacggaccgcagcggttccggcatcggacactgttggctatgggcggccagatgatgcagcaactgtcgggcgtgaacctcattacctactataacaccgtgatctttgagcagtcggtcggcatgacgcataacctggctctattgcttgctgggttcaatggagtcgcgtactttttgtcggcatttgtgcctgtttggaccattgaccggtatttgtctaacctgcctcctcctgttctgcctatcctgttaccctgaaagctgatcaatacagactcggccgtcgcaaactgatgctctttgctgctgctgggcagtgcgcctgcatggctatcctggctggcaccgtctatgacggtggtttctcggccggtattgtggccactgtgatgctcttcctgttcaactttttcttcggagtgggaatgctcgccgtcccgtggctgcgtatgctcttgttttatagctccagatccctaattaagactgactgtttttctatagtcccagccgaatatgctccgttggccatccgaactcgcaccgctgcgttggcgacggcaacaaattgtacaatccgactattgcccgttccaggtcattttccaggctaatattaatagggatcttcaccttccttgtcgtcgaaatcactccagtcagcatttccagcatcggctaccgcacatacatttactttgccgtcttcaacttttgctttctgccgatcatttacttcctctacccagagacacgtaatctcaccctcgaacagatcgaccgcctcttcacgggcgagaaggtgcgg

SEQ ID NO: 36491 - DNA, 2379 bp, Aspergillus nidulans
aagagtgtcccttgaaattcttgttgcagtcgctggggcttctgtggcacgacagaggagttctgcgaggaaacagatgatgaggagtcaagctgccagagtaattgtggtcaacctgagcgagacacatgcgatagtcgctgggagacacgccggattgcttattatgagacctgggccgataccagagaatgcgacgcctttcgaccggaggatatcccggtgaaggcattgacgcatttgaacattgcgtttgcgggaatcgaagactcggaaatcaccattgacagctctgagatgatctcgaggattgtcaagctgaagaggcgcaatcgatccttgaaggtctttatcgctgttggagggtgggcgttcagcgatcctggtattcccattgacccccatgaaagagcacagagaagctgatggttgcagggccaacgagaaccgcatggtccgatatggcctcgacctcggacaaccggcaaaagtttatcaacagtcttatggaccttttcgagacacacgggcttgacggcgtagaccttgactgggagtaccctgtggctggtaagtattagggttaagtatattcgctgaagggcttgtctaacgagatatttaggtgaccgcggtggaaaagacgaggactacgaaaactatgtctccctagtacgagaaatgaatgaagccttccagaagcgcaatccgtcatgggatatatcgatggctatcccagctagttactggtatctgcagcactttgatgtatcggcaatggagaaagaagtgagctggttcaacctcatgaggtaagttctgcctttcctgtaccatcccaagaatgctgactttacactgcagttacgatatgcgcggtaaatgggatcaatttaacgagtggacaggtccatatgtctttggacacacgaatgtcactgaaatcgaaattggagtagacctcttgcggcggaataatattaatctctacaaagtcagcctaggaatgggtttctatggtcggaccttcacgctgtctgatcccggatgctcggagcccggctgtgaattcagtgatgctggccttcgtggggagtgctctggcgagtctgggattctcaccttcaaaggtacacttgcattcaagtagagtagactgtctgctaatctactgatatagaaatcatggcccgccaaaagcggctaaaccaaaaggtgatcaagtacgatgaagactcgggggtcaagtacatggtctacgacgaaaaccagtggattacctacgatgatgaagagagcttcgagaagaagcgagaaatgctcgacaacgagtgctttgggggtgtcatgatctgggctattgatcaagacactaatgactttcaagccctaactggccttctgggcgactgggtgactgacgagctcctcgaaggaggcgaactgagcgatgaggagaaagaagacctggttgatgaaatgggcggactgacgggcgatggctgctatgtcaccagtgggtgtgttggtggtgagccaacgatcgagggtaaccccgagtgcaggaaaggggatgttgtggttgccctagtgcattcgcccacagaatcctaccaggaactctacggagccctttctcatactgcagatacctgcggactaggtcaatataaacgggtttgctgtcccgctgacagtcccgccgtgaactgccagacagttggtgcgcctgagggcgactcgactaagtgtactggcggcgaggccgaattgacttgtgggaatgggcggtatgagctgatcactgatcgttatgtggacgccgtgggccagaaaaagtgctcaagcggtgcaatctcagtctgctgcgatgcggcacctgagctgcagaagtgtcactggtctccctgcacggttttccatacttgctcggacggttatgcccagccgattgctactaggggcgacttctgcgaagaaggagaagctcagaacttttgctgtgaacttgacggtaaggccaccccagggaacaggaaataggtcgggaagctaaaaagcacagctgctctgaaaaactgcgactgggtcccagaggtcgagagctacgagcaagatggcgacattacccttatcaacatgcctacaatgtcggaatgctcgaagagaggatgcccctctacccagttcaccgccgcaaaagctaagttgcctaatagacgtgctggaacatgggctccatgtgactactatttccccggtatcagacatcgcttgtgctgtgaccccaaaccagacagggatttaccgtttgatctcgggaagatatttcctaatcctattgaagaggacgtgatatatcggtatacagataactat

SEQ ID NO: 36492 - DNA, 1118 bp, Aspergillus nidulans
tttgccgttggagtaggacgtcggctgcaaatatggcacaccccggagaccccaaccgtcggtggggacggggagatcgactttgctccctttgtcttgcatcgtgaccttgccggccacttcgacgaagtccagcatatcgaatggtcgagtgactcccgatttcttctgaccgcttcgaaagacttgacggcacgggtatggagcttggatcccgaggacggtttcgagcccacaactctttccggtcatcgacaaggtgtaagagcagcctttttttcagccgatcaagaaagtgtaagtgacccgatcaacaatgtggcactcttgttctaatacaacctagatttacacagtcagccgagactgcgccctcttccgatgggagtatgtctccaaaaaagaccctgacacgatggaggatgtggcggaaccgcgctggaggattgttaagaaggatttcttccaacagcctcatgcaacagttaaatgcgcggcattccatgcggcttccaacctgctcgtcgttggtttctccaacggactatttggtctttacgagctcccagagttcaatacaattcacctcttaaggtaagtggcatatgcattgcgtactggcattgacgctaaacgaatttccagtatctcacaaagtaatattgatgttgtatccatcaacaaaaccggcgagtggttggcgtttggttcctcgaaattcgggcaattattggtctgggaatggcagtcggagtcatacatcctgaaacaacaaggccatctagattcgatgaatgcccttgcctactcccctgatggccagagaatagtcaccgctgccgacgacggcaagatcaaagtttgggatgtcaagtcagggttctgtcttgtgacattcacagaacacaccagtggagtaacggcctgtcaattttcgaagaaaggaaatgttctgtttacctcatcgctggatgggtctgtgagggcatgggatcttattcggtaccggaatttccgacgtttacggcgccgtctcgcctttcattctcctctcttgcagttgatccagcggagaagtgatttgcgcggggtcccagattcgttcgataccacgtatg

SEQ ID NO: 36493 - DNA, 1528 bp, Aspergillus nidulans
aagaccgtggcctggtgctttgctttggcttcgggcataatcctgtatggatatgaccttgctattgtgggatctgtatcctctatgcctgagttccagtgcgtacgctccaatgttctactccatcgccaacgatccgcccattctaacatcctcaagaaaagacttcggccgtcgcttagacggcaaactcatcattccagccctctggcttgcgctatggaatatcgcaaacccaatcggtggcgtactcggctctatcgcaggagggtacatccaggaccgtgtaggacggcgcggatctctcaccatcgcgagcgtcgtatcagccataggtgtcgccgtggcctacatctcggatctcccaagcgagatcaatggccgcagatccataatctttgttgcgaaacttgtccaggggttcgccgttaatcaggttatgtgtactacccaaacatacatgtctgaggtccttcctcctatactccgtggcccgatcctcggcctctttcctacctttatcctaatgggccagctgatcgggagcataatcatctatgctatggctgccagacgcgggccagaaggctacaagctctgctttgtgtccgagtggccattctctgttctcccgttcgtggtctccttcttgatgccagagagcccgacatacctcatccgagagaatcgtcttgacgaggcccgcagatgccaggagcagctctcatattcgacagaggaagcagatatggtctttcaacaatgccgtttctccatcgagctagagaagaaagccaaaggctctgtgccggggtattccgattgcttcaagggcaccaatcgccgccgaacaatggtcgttttattcgcctgcctcctcccacagctcttcggaatatcgctgctcgccagaggcagctatttcatgcaagttgtcggcatgaacgcgcacaccagcctcatcttcctccaggtaggtgtcgggctaggcctcgtcgctaacgtgggtagcatgatcacagtagccaagtttgggcgccgccctctcactctcttcggtctgatcgcttgcacaatcctttggatggggatgggcattgcgggttgtttccctggaactgcgactgtctggtatgtggcctccccatagatcaaatcaggtccttcagaaaacgcggactcaactggctgatcctctaaaccaattaggtacacccagatgaccatactttttgtagtaacgcttaccggtctaactatctggcctgcctcatacgccttcggcgccgaggcgtcctctctgcaactccgagctaaaacgcagggtctgggctggctggtcaattgtctctcgaatggtatccttggcatcgtgctgccttacatttttaatgacgatgagggggcgctaggcgcgaagaccgggtttgtctacatggggttttgcatcctttccctggccgcggcatggaggattgttcctgagatgaaggataagaccgccatggaaattgatcaggtgtttaca

SEQ ID NO: 36494 - DNA, 785 bp, Aspergillus nidulans
caagtcgcaattgttacgggggctggatcaggcttcggctacggctccgcaaagaagttcgccgaggagggagcagaggttattgccgccgacatttcagaaaaaaatggccaggcagttgcagcagagctgggtagcaagttcatctacacagatgtgactcggcgagatgattggcaagcgcttctccaagctacgctggacgaatataagacactcgatattgtggtcaacaatgcgggcgcaacatactctaacaaacctactctcgaagttacggatgctgatttcgacctctgcgtgaatgtcaatgctaagggtcgatatacctgtccaccagtggtatcgtgccatactttgtagaacacaatcggccaggatgctttatccaggtctcatcaactgctggcctacgcccacgcccggtttgacgtggtacaatgcatccacagctgctggtagcaatgctaccaaggctttgggctgctgagtctgggccccagagataaggttcctctgtgtgtgcccggttgttgggagcagtggcatgtaagtgacctcattcccgcagttcttaaggtcatttttgtatcaagtataacatccttcctaggacacatctcttcctagggaagccggacaccgaggaaaatagggctgcgtttgtgtcgactataccactaggccgtccttcgacgccagcagacgttgcgaatacttgtagtttcctcgcaagtgatgaagcggggtttatcacaggagtcgagctggaggtatgcattatc

SEQ ID NO: 36495 - DNA, 731 bp, Aspergillus nidulans
tctccgcaaggccggatatttcaagtagaatatgcgcaggaggcagtgaaacagggttccgtcgtggttggactggtcaataagacacatgccgtgctggttggcctcaaggttcggaatcccatcaactccagtaaccatccccacggacgaaatgaaccactcctaacatcggaatgtgtctttagagaaacgccgaagagctctcctcatatcagaagaaaatcatcgaagtcgattcgcacatgggcgtcgctatcgccggtcttgcatcagacgcccgcgtgctctccaactacatgaagcaacagtgtctcggctcccgaatgacctacggccgccccatgcctgtgaaccgcattgtctctcagattgccgaccgtgctcaaacgaacacgcaacagtatggaaagcggccatacggtgttggtttgcttgttgctggggtggatgaagctggtcctcatctattcgagtttcagccttccggcatgactcaggagatgctggcctgcgctattggagcacggtcccaaatggcgcggacctacctggagcgcaacctagacaagcttcaggagtccagtcgggatgagctcatcacccatggcctaagagctcttaaggagactttgtctcaggacaaggagctgacagtagacaatacgtctgtcggtgtggtgggtcttgcggacactgggaaggttgagagtttcaagctctacgaggga

SEQ ID NO: 36496 - DNA, 1835 bp, Aspergillus nidulans
tttcgtttcgtccacctagtcatcatcttcctacctgtcatcctgacggcgcctacgatatggcttggaaggcgcatcaagaataacgacggggctcgcacaggcaccttgtggtggtatagttttcttgttagggccatggagcgcgcaggtcctgcttttatcaaggtaaatacttttgactatattattcaaaacctgctgacttcgtagcttgggcaatgggccgcatcacgtactgatattttccctcccgaaatgtgcgaaatcatgtcgtcattacactcgaatgctcccggccattcgttacatgaaacaaagcggataatagaaaaggcgttcagtggaatgccctttgaggatatcttcgaggaattcaacgaggaacctttgggagtgggcgccatcgcacaagtgtacaaggcgaagctcaagccgaatctggctaatcttgcagataaccagctaacctgtgagcctcagaacctaaggggcaagctcagaaaaaacgttgacgccttggtcaagagcacccccaggcgagttccgtcctcatacgttgcagtcaaagtactgcatcctcgcgttgagcgactaatccgcagggacctgcgtatcatgagtttctttgcttctttgcttaatgcggttccaaccatgcactggctgtcgttccctgatgaggttgctcagttcggtgagatgatgaagctacaactcgatctgcggattgaggccacaaacttgaaaatcttccgcgagaagttcagatcccgtaccacagcttggttcccgtatccgtatttggattatagcacccgcgaggtgcttattgaggaattcgcccagggcatacctctgtccacctttctggaaaagggaggaggtgtgtaccagcatgagattgcaaacgaaggcttggatgcttttctacatatgctcttgattgataattttgtgcatgcggaccttcatccagggaacatcatggttcgtttctatcagcctagcgagcttgatttgtctctccgcaagaagggccgcgcagatgaagcaccgactcttaaggaggtcgatgttgcagacgccatactcgcccggttgctgccacatgcagatgattcccaaaagtgggaaagggctctagaagagctcaacgcagaaggctaccgaccgcagctccttttcattgacacagggttagtacacagctgaatgacaccaaccgcgcgaacttcttagccctcttccgagctgtcgccgaattcgacggccaccgccctggtgaactcatggttgagcggtgtcgtcagccagaggaagtcatcgacccagacatattcgctttgagaatgcaaaatttagtcctcggcgtcaaatcacggacatttgcacttgggaacatcaagatcggcgatattcttagcgaagtgctatctatggtccggcgacaccacgtccgcttggaaggggactttgtcaacgtcgtcatctccattctcctcctcgaaggcattggccggagcatggatcctgatctcgatctctttaagaggttagcgccgatattccctgccttgctgctcgaaatcatcgagctgccacccgctcaaaaccccctcttttggtaatccgcagaactgactcacttttccagtgcccttcccatcttacggaaactcggttccaatgccactttcctaaagacaattcggtcgggcgacacctcaatgcttcgcgtctgggttggtcttgaagctcgtggcttacttagggcgagcattgagagtgtggagaattgtgtgaagtatgatttactgtcgcctaatgtctag

SEQ ID NO: 36497 - DNA, 1687 bp, Aspergillus nidulans
cgtctcatccaggagcaagagcgccagttgagtctgtgggctacagtgaagttgcatcctcgagccgtgctggcctgtacgtttcagtctgtcattctctgaggacagagctaaatatacccaggtagcgtggcctttgctgcaggcgcaatgtttggatacgatcagatctccaacggttctacgattgcgatgcctgcattcatgatgtactacggtgatcataacgagtcaggactgtacctcccatcgatctggacgtcgctgtggacgtcgatgacgtccttgctacaggctgtcggggccatctgcgtgggtatgatctcggacagattcggccggaagtggccaggagtcatggcaggaattctctctattgttggcactgttgttctatattatgcgaaaagcaggggtgcactccttgcggggaagatggtttgtgggttggcacttggagctgggatggcaatcgggacgacgtatgcgtccgaggtgagttccgcagctgtcgaaacgttgggtttctagaaatggtgctgataatatcaggttgcgcccttgaaactccgcgtgccgattcagacgattctcgtcgtctttattgtcttcatgcagggactggcgatggggatcgtgaggatattcgttcctaacactgatgagcaagccttccggaacgtttttgctatacagtgggctgtaggtgggatctttgcggtcacatgcttgtttgctcccgagtacgtttgccttaacagtcagaatgcttgatacttactatcttaggtctcccgtctatttgatcaactccggccgcgttgacgcagcggaaaaagtcatgaagaagctctacagctccaaattcagcatcgacgaccgcctggcgtacctcgtcaaaaccatctccgaagagcaagagcagcagcgcatctccgcgggctcatatctcgactgcctcagaggatcaaatctcaagcgaacacttactgtcatgttcctctacagcaccgcgaaccttggcggcgccgctttcctgtcacagtccatctacttccttctcacactcgggctgccatcagtgcacatatttgacatctccatcggcgggttcgctctagccatcatagtcatcctactaacaggctttatcggcaagttccttagctggcgaaggatgcttctcatgggctgcctcatcaacctggctttcctcggcgtcatcggctgcctctactacgcctgtggcatgggtccatcctgggccattgcggttctcatgtatgtccacccttccttgcaactctacggctactaacagagcgataacaggaacattcttatctccatccaaacaagtctaatgcaggccgacggctggcccatcgccgccgagatctactcgaacagactacgtgtcaagtcgctatcaatcggcgtcttggcccaaaccctctcgacctgggtcatgacattcacagtgccttatatgtacaacgttgactctggggacttgggcgcccgcacggcgttcccctttgcaggtatcacagtgcttcttgttataggcgcatacttccttgatcctgatacgacgggcctgtcgacggaggagattgatcggctgtacgaggataaggtcagcccgagaaggttcagttcttttgtcacgcatgatgtgccgcgt

SEQ ID NO: 36498 - DNA, 817 bp, Aspergillus nidulans
ggtcgagtcaatgaacgaccacacttcaagctaaccgaaaaaacgccagtcgttgcccatcctcgacggtgacaacggcttcgggttcgttgttgccactcgcggcatggccgaagcgatcaagcgggctgagatatatggcattggaatggtcagtgtcaatcactctaaccactttggtatggcggcaacctacgtgctccaggcattgcaggccaacatgatctcccttgtcttcaccagctcggcgaagcagatgcctccatttggaggaaaagagaccccccttggcatcgcgccattcgcggcgggggccccttccaacagggaagttccgtatatcctcgatatagccccttctgtagttgccaaggggaaaatccgccgggctgcgggcgcggcgagtccatcccgcttggctgggccctagacgcaaatgggaacccgactacagacgccaatgtcgcctcaacggaagtatggctctgatcggcggaccaaagggttaggctctggaattgctatcttgatggatatcatgtccagtgttttgacagtcgcggggttcggcgggcaggttggcgatcggtacaaggatgcgaagccgcaggatgccggccattgcttcattgcgatcaagccagatgtgtgcttcagtgtcgacgacttaaaggcacgcatggacacattagtgcagagggtgcatggggttatcccggcgccggggttctccgaagtcctattccctggcgagccagagcagcggctgtgcctgcagcgccgaagagagggcatcccgtacgcggacgcagagagg

SEQ ID NO: 36499 - DNA, 1093 bp, Aspergillus nidulans
atgcctcctacgatccgcgtcatcggctctctaaacgccgacatggtctccgtaacgccacgcttcccagacgcgggcgaaacaatcacctcttcttcatatttcacaagtgcaggcgggaaaggcgcaaaccaagccgttgcgtgtgggcgactctcgcgttcgcagccgcaatcctcctctttctcgacaagcataaacactggcgacgtgaacgtcgaaatggttggcgcagtgggaggactagacggccacttttccgcacttctcaagcccaccctggagaaatccggtgtcgatacgtcacgcgtgaaggttgtggaagacgcatatacaggtgtggccgttataattgtggactcatccgccggcggcgagaacaggatcttgttttcgccgggcgcaaattactcggggatgcaggccgacccgtcagttgttggcatggcgcttgcggagccagctccggatgtcattgtcatgcagggcgagattcccaccgagacgacggtcgcgattctccgcgagatcgcgcggtggaaggaacagcagcgcgcggatgggaagagggggattgatgctggcccggacgtgatgtttaaccctgcgcctgcgccgcctggaggcttaccggaggatgtgtacaagggcgttgaccaccttatcatgaacgagacggaggctgagctcatgacaccggacgaggacgtgctgctgcgcgttccgggcattgaaagcgcgcaggacgggaaggagaaggttgcgcggtacttccatagcctcggcgtaagatatgtgattgttacgctgggggcgaagggggtgtggtatagtgctgcggatccggatactctaggggaccgggtcgtgaatgaggtccctgctgcgaaagtgagcagggtgcttgatacgacggcggcgggcgatactttcgtgggagcctatgcagttcaggctgcaagatggcgtgagggaaggcgccgggaaggaaaggctgggaaggaccttgacgctgaggagaagaagcataggtacaaaaatgtcatggatgaggcgatgggtgtggccacgagggcttcggcaagaggcgtag

SEQ ID NO: 36500 - DNA, 2569 bp, Aspergillus nidulans
tatctcttctggcgctcatgttacaatgctgggattggatggttacttcacaaccagtctcaccacaagactcttgtccgatgggctgaaaagtctcagatctttgtgaacccagctacgggcaagaacccctatccccagttataccatttgatcaagcgcgactgagagatcaaaatctccaaggactattccttcgaggaggcgccgcttgagtataacacctggcttgtctttagacgccttgtggacctgatcttgatgtgcgactttgcctcttactgcctctttgcaatagcctgtagtcgccaccctgctaacgaaagcgtgctgatgactgtcattcgatggacatccggcatcgctttagtcctgttcaatctctgggtcaaactagacgcgcaccgggtagtcaaagactatgcttggtactggggtgatttcttctacctcatcgaccaagagttgacctttgacggggtttttgagatggcaccccatcccatgtattccgttgggtatgccggatactacggtatttcgctgatggcggcaagctataaagtgctgttcatctctattatcgcccatgcagcccaattcgcgttcctcgtgttggttgagaacccacatattgacaaaacgtacaatcctcctccacctcggaaacgtactatcacagagcatgacgcagcgtctcagcgatcgcagtctccggatactccaaacgcgccatccgtgtccgaagaaaatgtccccaacgcgacaacattcagcagcccacctccggcagttcacaacctactcgggttccacaatctagacctgcatagaatcacggatacttcttctatcctcgtccagttcctcatgttttctctgactgttctgacgccttcgacgccctggtatcagttccttttcgtggctaatgcggccatctggaggctctggtactcagtcggcatcggctatcttctcaacagacagtccaattgtaaatcgtggacccggcactttgtcaagtacggcgaaacgcctcatgaggcatggaaccaatggaaaggcacgtatcacctaagtatggttatgtgctacgctagcttcatttctgctgtatggaagatgtacaccctgccgtccaactggggctatggtcttgccatcctgcgtcacgtgcttggagctgggcttatctcgctgcaaatctggacctcagtgagcatttacgagtcactcggcgagtttggctggttttacggggacttctttttcgatgaatcccctaagttgacctacaatggcatctatcgcttcctcaacaatcctgagcgcgtcttagggctcgcaggagtttggggtgcggttctcataacggccagcggaacagtcgcatttctcgcctttttgagccatatccttagcctgggcttcattcagttcgtggagcgaccccacatgcagaaactgtatggccgaagcttgcgtcaggatgcaggtctcgtgaaaagcctgaagcggtccttgccgccgtcgctcagacaactgcatggaagcgtggacaagatatttgacgaatcatacgaatttattgaagaaatcatcgatactgcgcgaccaaaactcgccgcaggtaaatacattcgttcgagacacaacggcacttttccagaaatatcctgcccgtgtcaccatctcacgcattgatgccgacttagccggatacgacctacgagattactcgcttactgttgaagcaagccagttgcctctagacgaaggtgaccttagcaaagagggtgataacgctcgcacacctctcgatcgccgcggtgacttggaaaacctggttttcccatacggcacaccagtaaaggtcaagtggactgcaccgctcaaccatagcaagaaggattggattggtctttacaaggtcaccgacaatacttctagagaggtgacccgcgtatcttcacaaggaagatgggtggccgtcaacgagggcttctacgataacctcacctgcgagcggggcatcctcatcagcgatgtggtcgtatccacgtcccaaggcgataacggggagaagcatgatatcgcaactggcgaggttgttttctctggcgacaagcttttctggactcaaggtgtatttgaattccgctaccaccacaatggtaagcacaatgtcatggccatttcacgaccatttgaagtccggatcccccgcttcgaagaggaagatcacttcgacatgtcccaaacggcagtcgaaacgagccttctgcctgtgatccagaactgctttgaccgggatccggaaatcgcacctgaaactccggaagagcagtacggtagtttggttgagcgagatggtaaatttgccaaacgggttgtttttgctgttcatcaaatgtgcgtaccatcatcctctcgtatactaaacgatactaacatgcttaaccctaggttcggcgtcgaattcgcccctgaggtcgtccgctcagatggcaacgtccgcaacctcgcctggaggatctgcaacgcaaagagggtcttggtaagccgt

SEQ ID NO: 36501 - DNA, 795 bp, Aspergillus nidulans
ccccgcacaacagttggatggaaaggtctgatcaacgaccctgatattgacgagtcctaccagatcaacaagggtctccgcgtgtcccgcaagctctacgccgacctcacaggcatgggcatgcctattgccagcgagatgctcgacaccatctccccgcagtacatggctgacctgatttccctcggtgccattggtgcccgcaccaccgagtcgcaactgcaccgtgagcttgcctccggtctcagtttccccatcggttacaagaatggcactgacggcaacctgaccgttgccattgacgcgatcggcgctgctgcccacccccaccgcttccttggtgtcaccaagcaaggtcttgcggccattaccaagaccgccggtaaccctcacggcttcgtgattatgcgtggaggaaacaagggcacaaattacgaccgcgagagcatccagggggcccgcgaagcccttcgcggcaagaagcagcgtgaggttctcatggttgactgctcacatggcaactccaagaaaaaccaccgtaaccagcctctcgttgccaaggaggtcgctgaccaactccgtgagggccaggatgccatcattggtgtcatgattgaatccaacatcaacgagggtaaccagaaggttccccctgagggtccctccggtctcaagaagggtgtcagtatcaccgatgcctgcattgactgggagaccaccgtcactgtgttggaggacctcgccgatgccgtccgtgccaggcgcgccgtcaagtcaaaagccaacggtactgct

SEQ ID NO: 36502 - DNA, 1048 bp, Aspergillus nidulans
gtgaacttgaatcagtttcggctacttcgagttgtcgggaaaggtgctttcggcaaagtccgtatagtggagaaaaaggatacgggcttaacttttgctttgaagtatattcggaaagaggaaggtgcgtacttctctagacgaattttttttattctttttatcatcgctgaccggttattctcgctgcagttgtccgctcggaaagtgtacggaatattattcgagaacggcgaatgctggaacatctcaaccatccctttctttgtaatttgcgatacagcttccaggatatagagtacatgtgtgtttttacctccggtgatattcgaaccgttgctgactttacaagctacattgtggtcgatttaatgaatggtggtgatctgcgattccatatctcgcgaaaatgctttacagaagaagcagtgaggttttggctcgctgagcttggttgcgctctgagatacattcactcgcagggcatcattcatcgagatgtcaagccggacaatgtgctactagactcggaaggacacgttcaccttgcagactttgtaagttctccacatgatgtctagatatggactggctctgactcgcggcagaacgtggcgtccgactttagacctggaaagcctctcacgagtaagtcaggtacactcgcatatctcgctccggaagtgtacgagggaggaggatatttttttgaagtcgattggtggtcattgggggttacattttacgaatgcatctacaacaagagaccctttgaaggccggtctcaagacaccctcagcgagaacatcaaaagggcccaaccgaagtactacgttaccaacgccgccgtatccattccgggttgcgcgccatgtcggccttgatggagaaggaccgaagcaaacggattggcgcggttagttttgagagctttacctcacatcagtttttcgcagacatcgactttgaggcactagaacgaaaagaagtgcccccggtattccggccatccagcgacaagacgaacttcgatgctacgtatgacctg

SEQ ID NO: 36503 - DNA, 1158 bp, Aspergillus nidulans
gatttgcgtgtcggtaataaataccgcattggccgtaagatcggaagcggtagtttcggtgacatctatctcggtgcgtttgtcagcggatggtcggatgtgaggatattactaacctgtgtaaaggtaccaacatcatttctggcgaggaaattgccatcaagctcgaaagcgtcaaggctaaacatcctcaactcgaatatgaagcccgtgtctacaagtctctcgccgggggggttggtattccatttgttcgctggttcggtactgaatgtgattacaacgccatggtgatcgatctcctcggacccagtttggaggatctcttcaacttttgcaaccggaaattttccctcaagaccgtgcttctccttgccgaccaacttatctcccgtattgagtacatccacgcgaagtccttcatccaccgtgatatcaagcccgacaacttcctgatgggtatcggtaagcgcggaaaccaggtcaacgtcattgatttcggtctggccaagaagtaccgcgacccgaagacgcacttccacattccctaccgcgagaacaagaacttgaccggaacggcccgctacgccagtatcaacacccatctgggtgtggagcagtcccgccgggatgacatggagtccctaggttacgttatgctgtacttctgccgtggcaccctcccctggcaaggtcttaaagctgctaccaagaagcagaagtacgaccgtattatggagaaaaagatgacgacccccactgaggttctctgccgtggattcccaaatgagttctccatctacctcaactacactcgctccttgcgtttcgacgacaagccggactactcctacctccgcaagatattccgtgatttgtttgtccgcgaatcgttccaatacgactacgtttttgactggaccgtttacaagtaccagaagaacgctgcgatgatgtccgacgccaagaaggacaaggaggccgaggagcaggcacgtcgccagggtgcgactatgcctctaactacctctggtgccgccaagcctggtgctatctccagccagcgtcgcaagatcatggaacgtggagccctcgacaacaccccggacaccaaccgtgctgtgggagggagcgacaggatgtgagtatctaaaacct

SEQ ID NO: 36504 - DNA, 897 bp, Aspergillus nidulans
gaggatcctggcgagccatccgaaaccacaccggccagtagtgacattgaaacacacaccaaaactcggcctggattgcacttaaatacgaagcccgatgaagagttgatgaaaccaccagtgctaggcaaactgcaggatcctgctggtggatataaaaccaatccgccacctgtgggccgtccggtgcgagtatatgctgacggagtctttgatttgtttcacgtggggtgcgtatatagcctagcattttgacttgggataagtcggctccattggtacatgctaattcgttttcgacagtcatatgcgacagcttgagcaagccaagaaggctttccctgacgtttaccttatagttggggtgaccggagataaggagactcacgagcggaaaggtcttacagttctaagcggcgcagagcgagccgagagtgttcgtcactgcaaatgggttgacgaggttttcccaaactgcccgtggattgttactccagaattcatggaagagcataagattgactatgttgcgcacgacgacttgccgtacggggccgcggagggagacgatatatatgcccccatcaaggcccaaggaaagttcctggttactcaacggacggaaggtgtgagtactacgggtgttattacaaggtttgtttgtcttcgtccacccgtaatttccgtactgacgtttgtagaattgttcgcgactacgaccgttacatctctcgacaattcaaacgtggtgcatcgagacaggaactaaatgtttcatggctgaagaagaacgaattggagatcaagcggcacgtgtcggagctccgcgacagcatcatgaccaattggacgaacactggccaggaactgagtcgagagctgcgccaactgtggaac

SEQ ID NO: 36505 - DNA, 1155 bp, Aspergillus nidulans
aaattcgaaggatggatgggtctagacaagaatgccgccgatggcaacatggtctggcaggagtttgagcccaaggaatgggaggaaacagatgtcgatatcaagatcacgcactgcggtatctgcgggtctgatttacatactctccgaagtggctgggtgagtggactcaagtttgattaccaaggaggcatctctaaaggggggtatcggaggatgcagacaggggagcaatatataaaagagtccattactaacttgttcacacagaggcccgctctttatccgtgctgtgtaggtcacgagattgttggtactgccgtccgtgttggatccaaggccgtcgggggcatcaaattaggagaccgcgttggtgtcggtgcgcagagcgacgcttgtgtgggccgattcggcgactgccccgagtgtgcaatgggctgggagaactactgctcgcacaaatttgtctctacctacaacagcgtccatttcaatgggggaaagtcctatggtggatatgccctgtacaaccgctgtccttcccactttgtggtcaagatcccggatgccgtaccctctgctgaggccgctccaatgctttgtggtggtgtcacgctctatagcccattgaagcataacaactgtgggcctggaaagcgtgttggtattatcggcgtcggaggtcttgggcacttcggcgtgctctttgccaaggctctgggcgctgataaggttgttgctatctcacgtaagaacggtaagagtgaggatgcactgaagatgggcgctgatcagtatattgctaccgatgatgagccggactgggctacaaaatacgctcgttctttggacttgattgtatgcaccgtgtcctcgactaaggtatgcacctatcaaattgatgctagttcctgtgcagagacattgactttaaacaagatgcccttggccgaatacgtgggcctgcttgcaacgaacggcagcttcgttcaagttggactaccggaagacggagtgctcaatgcacctgtggcaaacttaaggcgccgccttaagatggaaagctctctcgttggaagtcccaatgaaatcagggaaatgtttgccttagttgcggagaaaggcatcaagccatggattgaaacggtcccgatg

SEQ ID NO: 36506 - DNA, 825 bp, Aspergillus nidulans
tcgcaaacaatcggagtcgagttctcatctagaattgtgaagctgggcaccgggccccgacggacaagaattaaattgcaactatgggatacggcagggacggagaggtttcgatcggtgtcgaggtcgtactatcgcggagctgcaggtgctattctcatttatgatgttgcatcatacgcatcgttcaactcccttccgacctttatgatggatgcgcgggcccttacatctccctaccttactgtcattctcgcggggaacaaaacagacctcacgcaagacgactaccatgaggatggcatgcgccgccccatcaccccctccagcacttcaagcccgcaatcttcactcccgtatgactccacggctggctcgtttcgttcgagcaattttggtactgcaaccagaatgacggccacgtatgcctcgcatggtcgcgaagtcagtatggaagaagcttcgcaatgggctgccaggtctaatatacccgccgttgtcgaggtctcagctctcacgggggacggtgtggaagagctcttccagcgattagcgcgcatcatcctcaccaagattgaactcggtgaaatcgatcccgatgacccacaaagcggtattcagtacggggacggcagtccctatggtcacggcacgagcgatgcttcaagcatcaaaagccaaatgactatcgaagacaatgccgtacagcttcatagaaggaatacaagacgacgaggcggcagtaactggagggcaagcatgaacgagtgggaagatgttttccgtgtgagcggatcacataacaggaaaagttcaggctgttgc

SEQ ID NO: 36507 - DNA, 2061 bp, Aspergillus nidulans
aagcctgttccggatgaccctaacgaggtcgaaatcgtcaacgccaatttctcgctcgcttacggtggtatgcttctgctatcgcacacgaaccttcgtctccttaagggacaccgctatggtctttgcggacgtaacggagctggaaagtcgacgctcatgcgtagcattgccaatgacaagctcgagggtttccctccccccgaccaggtccggacctgcttcgtcgagcacaaccagggagaagatgctgatctgaccatcttcgagtatgtcaagaaagaccctaagattgccgccgagggtgatgagcatattcgcaacgttttgctcgagttcggcttcaccgacgggcccgaaggacgccagtcgcaggccgtgggctctttgtctggaggttggaagatgaagctggctttggcccgtgcaatgcttctgaaggcggatgtgctcttgcttgatgaacctactaaccatcttgacgttgcaaacgtcaagtggctgcaggaatacctcaagaagcacactgagattaccagtttgattgtctctcacgactctggtttctggacgaagtgtgcacagatatctaccactacgagcagaagaaactggtttgctacaagggacacctggctgagtatgttaacctttatgtcactctacaccatcagttgctaactattgattgcgcagtttcgtcaaggtcaagcctgaagcgaagagttactacactctctcggcttccaatattcagttcaagttcccgccgcctggtattctttccggtatcaaatccaacacccgctcgattttgcgaatgacagactgctcctacacctaccctggtgccagtaagccctcgctgaccggcgcatctctgtcgctcactctgtcgtctcgtgttgccatcattggtggtaacggtgcgggtaaatcgacgttcatcaagatgttgaccggcgaaactatcccccaaaccggaaaggtggagaagcaccccaacttgcgtatcggttacatcaaacaacacgcgttggaacacgtcgagatgcacttggaaaagactcccagccagtacttgcaatggcggtacgctaacggagatgaccgcgaggtcttcctcaagcagacccgtatcctcactgaggaggacaaggcacagctggagaagcctgtcgatcttggagacggcgccggtccccgccggattgaagcacttattggtcgacagaagtggaagaagtctttccaatacgaagtgtatgttccccaatccataccctttagctcaccttatttgtgcatactgacacattcaggaaatgggttggcctccttcccaaacacaacaccatgatctcgcgcgagactcttcttgagttaggtttctttaagatggtgcaggaattcgatgaccacgaggcctcgcgtgaaggccttggtttccgtgttctcgagcctaagactatcgctaagcacttcgagaacgttggcctcgaccccgaaatcgccaaccacaacgaaatttccggtctctctggtggtcagaaggttaaagtcgtccttgctggagcgatgtggaacaacccgcacctgcttgtgctcgacgagcccactaacttcttggaccgcgactctctaggtggtcttgcggttgccattcgcgatttcaagggtggtgttgtcatgatttctcacaacgaagaattcgttggcgccctgtgccccgagcaaattcacattgccgacggcaagatcgttgctcgcacaaataccgccatctctctggatcgctttgaagacagcgcttcatccactccccagcccggcagcacggccgccagctccgtggccaacagcgccgccgcctcagccgtcaactccggcgccgaggaccagggcgagctcaagttcaaggccaggaagaagaagaagatgacccgtgcgcagctgaaagagcgtgaggctcggcgccgtcttcgccacattgaatggctcaacagtcctaagggaactcccaagcctcccgataccgatgatgaggctgaatagatgctg

SEQ ID NO: 36508 - DNA, 695 bp, Aspergillus nidulans
tacatgtcctggttaggaaaaaatttaattggccacccatgctccccgacctatcgccggtcaccatcagattggtcgggtcatatgtcccaggcaaatgtgcccaggttgcccccaagggcattgataacgctcggtatgtgtacaagtatgcctatggtctatgtaaggccccaaaggtccagctcgtgtgcaaaagggttctgaactttatgtacgtaccgggacatttgtctcacatgctttttaagacattgaagaactcccctgcgcgccgtggtcgaaagacacggcgcagataagaagctttccccgtcaccaaggtcatcatcgccgaaggcaaagaggatattactatcaaggtgtccgatgaaggtggtggcattccgcggtctgcgatccctcttgtctggacctatatgtataccacagtggagcaaacacccaacctcgacccggactttgacaagagcgacttcaaagcgcctatggcaggatttggatatggtttgcccattagtcgcctgtatgcgcgatactttggcggtgacttgaagttaatcagtatggaagggtatgtgcttctcaatgattgttatatggcattgcaacttacatgatccaggtacgggacggacgtctaccttcaccttaaccgcctatcatcgagttcggaacccctccaatgacaatta

SEQ ID NO: 36509 - DNA, 2592 bp, Aspergillus nidulans
ggaatccttgagcgagttgaatgttataacttgatgtgtcatgaccacttccaagtggagctcggtcctttgatcaacttcatcgtggggaagaatggcagcggcaagagtgcggtcttgacagctataacactatgtttgggtgggaaagcgtcaaccactaatcgaggccagagtctcaaaagctttattaaggaaggtaaagagtaagtttttcctcctcaggaggttcttcgtttctgactcttaaaagatccgctactatcattgtgcggattaaaaatcaaggcgacggggcctacctgcctgacgatcttggaaagtcaatcatagtggagcgtcatttttctaaaagtggcgcgagcagcttcaagataaaagcagataatgggcgcatcttctccaccaagaggactgaacttgatgctattattgaccacttcactttgcaatttgagaacccgatgaatgttctgtcgcaagatatggctcgccaatttcttagttcgtccagccccgctgaaaagtacaagttctttgtgaaaggtgttcagctagaacaacttgatcaggattaccggctaatagaagagtacggtgaccaaatcgaggagaaaatcaaaagcaaacaacaagacgtctcagtcctaaagaatcgccgggatgcagctgaaagaaaactggagatgtccgaccagcaggaaaacctccgggagcggcagagaaaactacgaagacaagcagcctgggctcaagtagaggagcaagaaagggtatgaagcctaattttactactcaagtctccagactaatttagacagattagggactctttgatagcggaaatttctagcttggacagcaagatatccgaggttgaggccgaagttgcgagatgtgatgccgcgattcgagaggtggaggcagaagctattactgcagcccaatactgcagagaggcgtctgctaaggttgacaatgcccaaaatgagaggaacgacatcgaagccaggtggaacgaagctctgaatgaacggcatgagcttcaggtattgtttatgtcctcccggcaccagtgaacatctattaatctccatctaaggctgagcaacgtcgaataagagaacatgtaagagaagcaaatgcaaggattcagcaactgcaacatcaggtcgatgaagagacacggcggctggctgacctccatggtggcggctattcaaggaagttggatgaacttgagcgagctaaacaagatgccatggaagtccggaagcagattgatgaactcgagcagaatgcatctcaacttagtgacgatataagagcggccgagagtcaggaaaaggcagcgtatcagcccgttgcccaagctagacgtgatcttgaggaagcaaacagcctactacataatcttaacagggaaggtagtggcagaaattcagggtttcctgaaaggatgtcagctcttcttaaagcaattcagcaaaaccgatcgttcactgagacacctgttgaacctattggaaacttcgtgactctgctcaaaccagagtggtcatctattctagaaagttcatttggggcaacgttgaatggattcattgtcacctcgaaacgcgatctaagtatcctatccgaaatcatgcaccgagtcagctggtcaggctttgcgtacatcgcccccttccgtctctgctgctaatgatgcaacagtccgacgccaattttcattggcagcggtggtagtataaatacttcccagcacgagccagatcaacaattcaatacggttttacgagttcttcaggtaggcctataatcagtatccatatgatacgggactaacatcaaggaacaagtttgataacgagttagttcgtcgacaattggttatcaaccacggtatagagcagaaccttcttatcgagaatctcgaagaggcgtcgtctgtgctatttgacggtgaaaggccgagaaacgctaaacggtgcttttgtatcaacaaaagcgacagacgtcgaggtattcttctttcctacagtagaaatggggagccaagtcaggcccctgtgtcagtttattctggtagcccaaggatgaaatcggatcgggattcgcaaatcaggtaagaatcactgttcccagtccagcatagtattgcggatgcaagttaatcttgtagggtgcacgcgaggcggtagcgaatctcagacaagttctaaacgctcgagaagaagaactgcgctctgcccagtctcacctcaccgctgtaggcaggctttcgaacggaacgaaaggaagaaaaattttcttgtcattgaaagccagagaaaggatgaccgtattgaagagctagaagaatcccttcagaaagagggtagtcaggacggagatcttgaaatacttcaagcgtctctgcgagaagctcaagaggaaaagcttacgcatgagggttctctcgacgatgctgcgaacgccatgacagagatgatgcaaaacttgaaaaggatcaagaaagaactggcgactaaggatgctgagattgctcggttgaaagatgagctcagagtcgctgagagtgagcaatac

SEQ ID NO: 36510 - DNA, 1432 bp, Aspergillus nidulans
ttctcaacagccccctacgtcccccccgacgccattttcgccctaacagccgaatataacgccgcccctcgccagtcagggccaatatgggccagagtacctaccgcggcaactatgggctcccctgggtcctgccttctgtacagcaagctcgacgtggttttaatgagaaagggctggtgcacgaatatctgccgatcctaaggctgaaggggttgagggagggggctgcgaggttagtctttggggaaggatataccgctatgcagagaagctggcaacatcccaagccatctctgggacaggatcgctacaccttgcgggatatctgatcagatactgcacgttgagggaaaagggtggagcagcagacgcagacgcagcctcagacgcagtagccgcacggaaggtttacatccccagcacgacatggtcaaatcaccgcctccttttctcatcgctcggcttcacggtcggtcaattcaattactacaacaacgccaccagatccctcaatatagactcgtaccttgcggctctacgctccgcagaccatgggtcggtggtgcttctgcacgcctgtgcgcataatcccaccagcctggacccatatatcgagcaatggaagcagatatgggacatcatcaaagagcgtcgactattccccatcttcgatgccgcgtatctaggccttaactctggggattatgataaagatgcctgggcgatacggtatttcgttaacgagcaaaaagtagagtgtgcagtctgtctgagctttgcgaagaatataggactttacggtaccgatcctctttatccctcttctgactcgtgttgaaatctagaggccggctaacagagccaggcgagggcgttggacgcataattctacagccgaccccgttttcgcagtcagtgctcgaatcgctgcagcgttcagagatctcgaacctgcccgcattcagagcaaagatagcagaggcaattatgtctgatgacatgctcaaaaatgtctggcttgaggatctgaagactttgagtgggcgaattgcggagatgaggagggcgttctcgacgggctgaccggatacgctatgtgtctgatgtctactgagattttcaaatggcttttgcaagtacggtttgctgagtaggaaactgactgcgactgctgcagcatccgctaacagttgggactatctggttagacagtcggggatgtttggattcttggggctggagaggcaggttgttagaatactcaagggtgagtcgcgtctgccattcgttgacggttgttagactaataacataagacgaatatcacatctacatggccgagaactcgcgaatatcgagtgctgggttggattcagggatcgttgactatgtggcacggtcgatcggagaggttctactgagaatgtag

SEQ ID NO: 36511 - DNA, 907 bp, Aspergillus nidulans
aatcagcatgtcaccaaggcctttgacctgaccggcaaagtcgccgccgttactggaggggctcgcggtataggccttgaggtctctcgtggcctagcagaggctggtgccaatgtacgcctttctttttcttgtatcgcgtagtttgctgatgagcttaggtggctatcatttataactcttcccccactgcgattgagacggccgcagaaatcgcagcggcaaacaacgttacagcccgcgcctacagagcgaatgtaactgaccaagcagagatcgagaaaacagttcagcagatcaagaaagactttggacatctggacatcatcgttgtcaactctggtattacctccaatattccagcagaggattacagtgtcgaggaatggcggaagatcatgggcgtcaacctcgatggcgccttctactctgcccaggctgcagcgaagattttcaaggaacaaggtcggggcaatgtgatattcactgcgtctgttagtgcgacattagtcaatgttcctcagaagcaggctgcggtccgttccctccatggttcatacggacacgactgatatggagcagtacaacgcatccaaggcggccgtggtccaactagcacgatgcctgtctgtagaatgggtcgacttctgtcgcgtcaattgcatctcgccgggcttcatcgagacagagatactcgatgctcatccgcaggaatggagagcgaagtggcacagcatgattccagcgcacggagtggcacaggcttatgagctgaagggagtatgtatttcacgagattgagctgcaaaagctaacattacaggcgtatgtcttttgtgcgtcggacgcctcgagttacatgaccggcgcggatattgtgatcgatggtggatacacccttccctag

SEQ ID NO: 36512 - DNA, 873 bp, Aspergillus nidulans
ttcaaactcaacactggcgccaccattcccgccctgggcttcggcacatggcaagacgccgacgcccaggaaacagctgtactggaagccctcagggccgggtacagacatatcgacactgcgcgcgtctacggtactgaagccgcagttggccgtgcgatcaagaaatctggcatcccgcgtaaccagatcttcctgactaccaagatctggaacaacaagcaccacccagacgacgtggcacaggcactgcaagattctctcaacgacctggatcaggattacgtcgacctgctgctcatccactggcccgtcgcctttaagcgcgggacggagcagttcccgaaaactgaagacggaaaaccggctgtcgcggatacagattatcttgacacctacaaagctttggagaagctactcagcacgggcaaggtcaaagctatcggggtctcaaactttagcaaggctgagatggagcggatcctggcgaacgcgactgtccctcccgccgtgcaccagctggagggccatccctggctgcagcagcgggagttcgcggagtggcataagaaacacggtatccatatcacgcattactcgccctttggaaaccagaacgaggtctatagtcgagagggcacgatcggccggctgattgaggatccagtgctggtggagattggcaaaaagtataacaagtctgcagcgcaggtggcgcttgcttggggtgtcactgagggtcactcagtattgcccaaatcgaaaacaccagagcggatcaaggcaaacctcgagggtgacttcaagcttgaagaggaagatttgaagaagattcgcggcattgatcgcaagctgaggttcaatgatagcagc

SEQ ID NO: 36513 - DNA, 2727 bp, Aspergillus nidulans
  unsure (1)..(2727): unsure at all n locations
cctgctgctgctctggtcttatttatacagaaaccagggggaggtctgagattctgtgttgactactgcgccttaaatactattaccaagaaagattaatatcctctgccccttatccacaagacactgaaccagattggacgggctaagtggtttaccaaactggatgtttcagctgccttccacaaaatctggattgccaaaggccaggagtggatgacagcttttcgtacgagatatggcctttttgaatggcttgttacaccatttggcctggcaaatgcccccagcactttccagaagtacattaactaggcgctctgtgaatacttggacgagttttgctctgcctatgttgatgatatcttagtcttcactaatagaagccgtgaactccatagggagcatgtataaaaggtcctagtcaagcttaataaagcagggctgttcctagatatcaacaagtacgagtttgaacgcaaggaaaccaagtacctagggtttatcgtacgagctggagaaggtatgtcaatggacccagagaagatcaaggccattaaagaatgggaagcacctacaactgtcaaaggcgtacgaggatttatcgggtttgcaaacttctaccatcaattcatacctgatttttcatctctaacgcgacccctaattgaactgaccaaaaaggatgcccggttctgttggacggaagagtgccagcagagcttcggacgattaaaggaatgcttcataacagagcctgtccttgctccatttgacccagattgagagactatagtggaaacagactcgtccggccatataactggggggacactatcacagtatgacttggagggtaatctctacccttgtgcctacttctctaaacgccactcccctgcagagagtaactatgagatctatgacaaagagttactggctgttgtacagtgcctggaagcctgggatactaaactctgcttagtatctaaatttaaagttcttactaaccataagaatctggaatacttctatttaccaaggaagctgtcagaataatacatataatagagcctcttcttaagcagatttaacttcaaattccactactggaagggctctgagaatgaacatgctaatactctctcttaacatgaccaagactctccaaaaggaaataatgattggttagagtcatgtacaatgcagttataccaagaaaaatacagggnggaagtaatagacattccctatccaaaagccactatcttacctattgcaccccaaggaggggtccccagcctggcagaagcccagtcaggtgatgacgagtacatggaaatacggaagctcgtacgagagggggctaggaaactcccaccaaggctactgctcaaggtttccatgtcagaatgcagcattgacgcgcaggacaatctcctattctgaggacaaagatgggtcccctgcaacaaacccttgcgtacaagcctgatccagacagcccacgactccgccctaatcagtcaccccggacgagaacagacctatttggtggtgagccgaacctacttctggccaaatatgtccaaagatatacgccaatttgtacagaactgtgacacctgcggccgagcaaaaatatggaaggaacagaaaaagggactcctaaaactattaccaatcccagaacatccatggcaatatatcacactggacttcattacagacctgccaaatagtaatggctgtacagtgattctagtcctgactgactgactgacaaaaggagtaatccttgaatctatggccaaaatgacttctcaagaggttgcttggaccctcgtacgaaccctgatacgacgccacggaataccgcagacaatggtctctgataggggcagtcaatttgttagtagagtatagaagcagatctgccagctgttagggattaaacaattgctatcaactgccttctatccccagacagacagggctacagagcaagcaaatactgtagtagagacatacctttgcttgtatatttgctatgatcagggagattaggacaagctcatccctattgcagaactggctatcaatactcgtacaagctctgctactggggtgtcccctttttacctaacccatggctatgacctctcactatttggccttactgaggacttaccagagcaatctgccgatcagagccccatccagatcagggaaaatattgcttgtatgatcaaagaagccatggactgggccaaagcatctctagcttactcacaacaagaagctgaacaccaggcaaataagaagtgagccccagcacctacctataagccaggtgacaaagtatggctgaacctttggaatattcgtacggaaagacccagcaagaaactagactggaagaatacaaaatatacagttacaaagttgataggcatacatgccctacagttgaatactccaccaggaatacacccagtattttatgttgaccttgtacaactggcagataataacaagctccccttgcaagtccaggatgactcccaacccccacctatcttggtaaataacaaagaagaatattatattgactccgtactagataaacagtggaagaagataggaagaggaggctgttgggaatatctggttaaatagactggatgggctaaacccacatgggaaccagcccatgaacttgaagaa

SEQ ID NO: 36514 - DNA, 1278 bp, Aspergillus nidulans
cctaaagccatgttgatctcagatcttgaatcgacaaagtatcccgaaggaggactggaagcatggcttatagtgctcggagcatggtgcgccatggtcccctcgatgggcctgctcaacagcctgggcacattgcacgcatggacaagcagctaccaattgaccgattactccgagtctgagattggttggatatatggcgcctatgccttctttctctacgttgcgggcgctcaaaccgggcctatctttgactgctacgggccgttatatgttgtcgtgccgggatcaatagggatggttgcgtctctcctctgtttcagcttcagtactggtgcgtcctctacttccgacttgaatatttggcatgaggcagttgctgatcccgtctcagagtactaccaaatcttcctctccttcagcgtccttgggggcctctcagcttgtaccctcttcaacccggccatctcagtgatcggacactggttcaatattcgccgtggcctagcgaccggcatcgcctgcaccgctggcggcctaggaggcgttgcattcccactgatcatcatgtacgcggccccgaagatcgggttcgggtgggcgatccgcatcatcgccatattgtcggcagtcctcctaatggtcgcctgccttctgatgcgcactcgtctccctcgacctagcggaaagtcggctgcgattgacttcagggccctcagggacgccagatatgccagcacaaccgccgccgtcttcctggtcgaattcgccgtcttcgtcccgattacatacatcagcagctatgcgctgcatgcgggcatcgataccacgctatcctacgctcttattccgctcctgaatgccggtgctgtgcccggtcggttcctgcccggcctcgtagccgacagactgggccggttcaatgtgatgatcgccacatcccttctctgctcgatcctcaccctcgcgctctggatccctgtcgacgccagtccggccggagtaatctgctacgcgatcctgtttggcttttcaagcggcgccgctatcagcctcactcccgtgtgcatatcgcaggtctgcaaggtcgaagagtacgggcagcggaatggaacgacctttaccattgcaagcgtcggcaacctgacgggtatcccgatcgcaggtgccatcctcgtcgctaataatggacagcacgacgcgctcattggctttggcggagggatgtatttccctacgaccgtggcgtctgtcgttgccaggggcctttgtgtcggg

SEQ ID NO: 36515 - DNA, 657 bp, Aspergillus nidulans
atagatggcggtgcctgcgttgccatggtcggcaaggactgcgtcgcaatcgcctgcgatctccgcctcggaatgcaagccctgaccgtctccaacaactttcctaagatcttcaactatgcccccggaacatatctcggtcttaccggtcttgctaccgatgtttctaccgtttcagacctcttccgcctaaaagtgaacatgtaccgcctccgcgaagaacggcacatcgcaccgcagaccctcgccaatctcgtcagctcaacgctttatgagagacgcttcggagcttactttgtaagccctgttattgctggaatcaacaacacaacggggaagccttttatttgcggcttcgatagcatcgggtgtatcgatttcgccaaggatttcatcgtgagcggaacggcgagcgatcagttgtttggtacttgcgagggcttgtgggagccggatatggtgcgcacatttgatctattataatctcttgaccggctgactgacctcatcgtgtagtctcccgaagatctgttcgagacaatctcgcaggcacttctcagcgccgttgacagagatgccctgtctggttggggtgcacaggtatacatcatagagaaggacaaggtgactcagcgactactaaagggacgacaagac

SEQ ID NO: 36516 - DNA, 1489 bp, Aspergillus nidulans
gccgaaatggtcacatatttaccgatctcatcaccctttatccgtttcgccggacgttacgttgacgatgcttttggagttgctgccggctacaattttttcgtcttcgaagctgccatggttcctatggaagttactggtaaggactacttactgccagaatgagttagagctaatgtggcccagcatgcagcttgctcatccattactggaccaacaagatccctctggcagcaatattcgctatcgtacttgttctttttgcgtgcgtcttccgcggcgaaacctgcgttttttgtcctaacttctcttaagtttctcaacgtctttgcggtaaaatggtatggagaatccgaattctggctcgcttccagtacggtcttgctcagcgtaggcttgatcttgtttactttcatcacactgctgggtggcaatccactcaacgaccgtttcggatttcggtattggaacgagcccggatcgtctgcacaacactacaaagaagggaacctgggaagatggctggggtctctcgcctgcttgatcaatgccagcttcacgatcgcagggccggactacatctctatggctgccggtgaatccggagatccccaaaggcacctccctagggcgcataatgatatgctctaccggactactgcattcttcatatcggcagcactatatttggggatccttgacccgtacaatgacaaaaccatggctgacgcctttgacaacgaggaacctggagcggcggcatccccttatgtgattgcaatggaccggctcggcattcccgttctgccgcatattgttaacgccatgattcttctggcggttttcagtgcaggaaacagctatgtttattgcggcagcaggaccttgtacgggcttgcccttgacgcaaagccccgcgcgttttcaccaggtgcacaaaatccggtgtccccatctactgcgtggctactgtcctccttattgggcttatttctttcctccaagtctccaacagcgcgtcagtagtgctgaactggatcattagcttggtatgctgctcatcctgggacttgcaagaggtcataatctaacaaagctacaggtaactgcgtcacagctcatcaacttctccgtcattacttttacttatactcgtttccggaaagccctcattgcgcagggtatctcccgtgacaccctcccttacaaaagtctcggccagccgtacgtcgcgtacattgctctagtatcaacaataattatggcgtttgttgggggctacgaggtcttcctaccgggcaattgggacgtaccaacttttctcttctcgtatacgatgattggcgtctttcctgtgatttacgttgggtggaaaatcatccaccggacttcggttcgaaagcctgaggaagtcgacctctttacaggagtcgatgagatcgaggagtatacgaggaactatagaccagagcaagcgaggtatgttgat

SEQ ID NO: 36517 - DNA, 1257 bp, Aspergillus nidulans
atggcctcggatgcgggcaagggagacttgggcaagatgctcgacacctatggcaatgagttcaagatccccgactacaccatcaaggatatccgtgatgccattccgtcccactgctacaaccggtctgctatcaggagtctgtcctatgtcttccgtgatctcgccgtcctcgcttccgtcttctacgtcttccacaaatacgtgaccccggagaccgtcccttcgtacccggcgcgtgttgcgctgtggactctctacactgtcgtccagggtctgttcggtaccggtatttgggttcttgctcacgagtgtggacaccaggcgttctttacttccaaggagctcaacgacactgttggctggatcctgcattcagctctgctggtcccctatttctcgtggaagatctctcacggcaagcaccacaaggccaccggtaacctggctcgtgacatggtcttcgtccccaagacccgcgaggtgtacgcctcccgcatcaagaagaccatctacgacctgaacgaggtgatggaggagacccccttggccactgccacccactccatcctgcagcagctgttcggctggcccttgtacctgctcaccaacgttaccggtcacgacaaccacgagcgccagcctgaaggccgcggcaagggcaagcgtaacggctacttcaccggcgtcaaccacttcaaccccaacagccctctgttcgaggccaaggacgccaagctcatcattctgagtgatatcggcctcgccatcaccgccagcatcctgtacctgatcggctccaagttcggctggatgaacttgctcgtctggtacggtatcccctacctctgggtgaaccactggcttgttgccatcacctacctccagcacaccgaccccactctcccccactaccagcccgagtcctggaccttcgcccgcggtgccgctgccaccattgaccgcgagttcggcttcatcggccgtcacattctccacggcatcatcgagacccacgtcctccaccactacgtcagcaccatccccttctaccacgccgacgaggccagcgaggctatcaagaaggtcatgggctcgcactaccgcagcgaggcacacaccggtcctctgggcttcctcaaggctctctggaccagcgcccgtgtctgccactgggtcgagcccaccgaaggcaccaagggcgagaacgctggtgtcttgttcttccgcaacaccaacggcatcggtgttcctccc

SEQ ID NO: 36518 - DNA, 2801 bp, Aspergillus nidulans
tgtatcggctatatacgcctacgacattgctaacatttgcgtcgcatagagctgttgaaagcatatcgagcggcccattctcgcgttttatcgattgaaccttttgaagccgccttgcgggagaacacgccattgacctcaattgcggatcccaaggcgctgaccgaatacttcaaccagatttctctcaaaggagacctagtagcggaggagctcaagcgggtcacaactgaaagggacgagttcaagaacaaattggaaacagctgtgaaatccgagaaggccgcgcgggaagagctggatcgtctcaaacaaaccgctagtggcgaagagcaatcaaatgatagcaaagatgccacttcaaaaccagagcagtctcacaaggaaatcaaacaggaggccgaggagttcttttcctttgacaacgagattcctcggctggagtccgagttgaaggagaagcaggaagaagttgagagtctcaaagcccagaccgaaaccttgaagcgggatttatcagttgcacgtgagtcgactgagggtatggttcataacctcgaatctgccacccgagagcttgcagagttgcgtgacttcaaggataaacaagaagcggagatgaaaaatctcaagatctcaaagcaaagtgagattgacgaaatcaaatccaagcttgaagcgtcagaaaccgccgtggccgagaccaatgcagaagtagagaagcttagcgcggagctgaagcagaaggcagctgaaattgaacagctacaggcacaagccagtaaaccggaagatgctgaccagcaggcagagttggcgataaaattagagcaagttaagcaggaaaaggaggccaatgagaagcggcttggggtactacaaggtctagtggatactcttcgaacccagctcaaagaaactcaggatacgatgtcgggtcttaaggcaaatatggaccagaaaactgaagattttgagaagctgaagaaggtcattgacttccttgacgggaacttggaggataatgtgaaatggcaggaatccaaggaaaaggtcgctaacggtcaggaagttaatttcgaagaactacaacagacactggccccagcatatggctcagaggcagcaaacgagaagcttgaaaccacaccgcagcctgccaacgccactgctgccacgggagctggaaaaaagaagagcaagaagaagaagaagggcggcaaagctggggaggacaacagtaagctcacagaaactgctactccggaaaccgctccggcagtgtctcagccagccgagtcgagttcagccctagctgagcttgagaagaaaattgcggaccttgagcaacaactcagggagaaggaacaagccatcgaacgacttgattccaggctgaagggcgaagaagatttgaaggaggaaatagagtctttgcgtgatgacctccttaatatcggccaggaacatgtcgaagccaaagacaaaatcaaggagcttgtggcggaaaaggcagctttagaagggaccatttccaaactggaggcagagattacggatcttcgctcgaataacgccgcaaagtcggcggattctgagaaagctcataatgatttgaaggatgaatacgagagtctcaaagtaaaattcacgacaatcgaaacagaactctctgctgcacagcaactggctactacaaggttcaaagatataacagatttgcgcgagtccatccaaaagatccaaccggaactcaagaagttgaggggcgaaagcgcggaactcaggtcaactaaagatgagctgaagagcaagactgctgagctgagaactttggaaagcaagcatgacgatttgcaagcggaagtcaaggcactgaagacttcgatctccgatcgcgaaacggaagtgaagactctcaatcaaaagatcaagcaagagctggatagccgattgaaagcggaagaaagcctgacggttgctcagtccgatctccgctatattgagagcaggaagcaagaagccatcgagggtaaacagaaggtcttgtcggaactctcaaacgttcaagacgagctgaaaacagcgcgggcacgactacgagaatacgagcagcaaacatctcaacttaacaaggagcttgaaggattgcgggacgaaattcagctaagacagctcaacattctagcgcgcaaagtctcatgaacagcatgcgtgaccaggcatccgagctcggcatgcagatgaaagaagctcgggaacgatgcgagagtctagaagaggaactagcagatgcacatcgtcttcttagcgaacggactcgcgaaggggaaaccatgaggcgcctacttaacgacatcgaaggccgggccgaggcgaaagcccgcgacttcaaagagagaatggaggcagccattgaagaacgggaccgtgccgaagacgaagcaagcgctcagggtcgacgtcgagcacgcgagctagaagacctcaaagcgaagctccgggacttggagaaggccctacgaagtgcagaagaggacaaggaagagttggagcattcccaaaaagactggaaacgcaaacgggaccaccttgaggcacaggctgagacagcagttcaggagctccacgacgttcaacaagccatggctcggttacgcgaggctttggatgagagcgagaaaaacgtccgtgacctggagaaagagaaggctgaattacgtcgctcagtagagcagacgaactcgcgattagagaaaatacgcaagtcaaatatgctctccgaagacagccgctttgga

SEQ ID NO: 36519 - DNA, 1246 bp, Aspergillus nidulans
atggctgacgctctaaaggccgagggcaacaaagccttcgctgctaaggactaccctactgccgtgtacgtttaccccgctttggagaggcaagcttggacaagcagctgatcagagcagtgagaagttcactcaggcaatcgagctcgactccaacaaccacgtcctgtactccaaccgctctgccgtctacgctgcccaacaggaatacgaaaaggcgctcgccgacgccgagaaggctgtcgagatcaagccagactggtccaagggccaccagcgcaagggagctgcctaccgtggaattggagatctatgtttgtaccccagcccatcattttgtctatactgtgctgacgtatatagtggctgcccacgatgcgtacgaagaagcactcaagctcgaaccaggcaacacacaagcccagagcggtctggatgccgtgaagcgagccatcaacgccgaggcccaggctgacggtgtcaccggtgatcccatgggcggtctcagcaacatcttcaacgatcctcaactgttccagaaactcgccagcaaccccaagacctccgccctccttgccgacggcgacttcatgaacaagctcaagaaactccagcagaacccgaacagcattggtgaggagatcaaggacccgcgtttcttgcaggttatgagcgtgctgcttggcattgacatgaactttggcgctcctccccagggcggtccctccggcgccgctgcggaagccgaagaagacgtaccgatgcctgacgcccgcccgtcccctccgaagaaggagcccgaacctgagcccgagcctgaggatgaggagactatcgccaagaagaaggcacaggaggccggtgatgctgagaagaagattggtaacgacttctacaagaagaagcagtttgacgaggccattgagcactacaccaaggcatgggagctgaacaaggacgtcacatacttgaacaacattggtgcggccaagttcgaaaagggcgacctccagggtgccattgagacatgcaagaacgctattgaggaaggacgtgaacaccgcgcggactttaagctcattgccaaggctttcacacgtatcggtactgcctatgagaagctaggagacctcgacaaggccattgagaactacaacaagtcgctcaccgaacaccgaacccctgatgcccttactaagaaacgaaacgccgagaaggcccgcgacaaggccaagaaggaggccta

SEQ ID NO: 36520 - DNA, 1232 bp, Aspergillus nidulans
gtaccaatgacattatcaacgtcatccctaacatcaattacgatttccaccggaagtaccagcacttgtactgactatagccagataacgtctgctgttgcatcgtgtacgagggcaccgtgctgtctaacgtcgctgtacccaatgaatccgcaatcgacctgtctaacctgcaaatgggaactacagtcacgtttggtggactgacaacatttggcttcacgaattcctcatcattcgatccaataaacattggaggaaaggatatcaccatcaccacaacagaaggcagtgtgattgacgggaatggccaggcttattgggacggcttgggttctaatgggggtgtgccaaagccctaccatttcatcgtagtcagtaaatgacgggaaacccagtagtttgagaggctatatgttcaaaactggccggttcatctcttctcaatcagcagttgctcgaatctcatctcccaaaatatggttctgaacagcacggctggaaatgaaccgaatgctcgaaacagtggtttagttgcagtgcacgactccgacggcttcgatgtcagcagttcttacaatatcaccatgcggcgcaattcggtatacaatcaggataattgcgtggccatcaccagcgggacaacatgactgtttcggaaatgcagtgcagcggaggacacgggttgtccattggttcagttggggggaaatccaacgtcactaatatcctggtatgattcatagctctcagcactaatgatatcatgtactaacaaaatgctagttcacaaactcagctgttattttcaaccagcgctaccggttggctgacttctgtgcttcaacttggtggtctcgtcggttccctatctgcgggtatccttggagaggtcttgaatggcgcccggatcaagaccagctacaacacaaccggattcgtatcgaatgtgaattactctaacatcgcagtaaataacatcactatttctggtattgatcttccaacagttttatctgaatggagggcctacaggaattccatcgtccggtgtgattgtggagaatattttgtcgcagaatgtaacagggtggatagctttatcggggcaagactactacattctgtgcggcacagattcctactccaacctggctttcgaggacgtgtatattactgggggcggagtgcctagtagttgtaactatgatgtgacagggtgttcgtgatgg

SEQ ID NO: 36521 - DNA, 862 bp, Aspergillus nidulans
attacgtctgccagtgaattcaaccaagtcgtcttcaaggagtatgccaacgcgcctctggctcgcaagtttacctctctcttccccggtctcggttatgccgcaggttacaaggtcggtagaacaaaaaggtggctttggttaccattggctcacaaaacaccacaggttcttcagcgtatttacaagtacggtggtcagccgttcgctcgcgactacctggcgaagcaccacggtgccgactttgataaggcttttggaaagggcactggaaaggctatcatgcacgccacggccggtagtttaatcggcattggtgaaatcgtcctgcttcctctcgacgtgctcaagatcaagcgtcagacaaacccagaggctttccgtggtcgcggccttttcaagatcatctccgatgaaggtatggggctttaccgtggcgctggctggactgcggctcgcaacgcccctggatcattcgctgtacgttgtttcctctcgcaaaatgttatcacgctaacgatgacagcttttcggtggatctgctttcgccaaggaatacatctacagtctgcaggactacaacaaagcttcgtgggcccagaacttcgtcgcctccgtctgcggtgccagcgcctccctcatcgtctccgctcccctcgacgtgattaaaacccgtattcagaaccgcaacttcgagaaccccgagtctggcttccgtattgtctccaacatgatgaagaatgaaggccccactgctttcttcaagggtttgacgcctaagctgttgatgactggacccaagcttgttttcagcttctggctggctcagacgttgattcctgcctttggccagatcgtataa

SEQ ID NO: 36522 - DNA, 1618 bp, Aspergillus nidulans
atggctacgaattctttccgaaaactcactttttcaggagcctcccgtctgggtggttgtcgccgtctcccactaacctgcagacaacttcgattcgcctccgacagcggagccgcagcggcaactacaaaagcaacggccgaatcagcagccgagtcagctagtataaacgtcaaagaggcacccaaaaaggccggacggggcctgcggcgcacggtcctgggaacgtcgttggcgctgacgctgctggttggatatgtctacgggacggacacccgggcgagtgtgcatcggtacggtgttgtgccgctgattagagcattgtatcctgatgcggaagatgcgcatcatattggtgtcgatactttaaagatgctgtataagtatggtctgcatccaagggaacggggggatccggatggagatggggcgctggcgacagaggtgggtggtcttttattgtgatggaagttaaggccctaatacttatggcggataggtctttgggtatacactgtcaaacccaattggcatatcgggcggcctggacaagcatgctgagatccctgatccgctgttcgcgatcggtcctgccattgtcgaagtcgggggtacgacacccttaccacaggatggtaacccgcgtcctcgcgtattccgacttccatcacagagagcgatgataaaccggtacggcctcaactccaaaggcgcagatcacatggcagctatcttggagcaacgagtacgcgattttgcctacgcaaacggatttggggcatacgatgcggctaagcagcgtgtattggacggcgaagctggtgtgccaccaggtagtcttcagcctggtaagcttttagctgtccaagtggcaaagaacaaggccactcctgacggcgacattgaagccatcaagcgcgactatgtgtattgcgtggaccgtgtggccaaatacgctgatattcttgttgtgaatgtatcgagccccaacacacccggtctccgtgaccttcaagccactgccccgctcacagctatcttgagtgctgtcgttggcgcggcaaagagcgtgaaccgcaagaccaaaccatatgttatggtcaaggtcagtccggatgaagactcagatgaacaagtctctggtatctgcgacgccgtccgagcatccggtgtcgacggagtgattgtcggaaacacaacaaaccgtcgccccgaccctataccccaaggttacactcttccggccaaggagcaggcaacgttgaaagaaaccggcgggtattcaggtccacagctgttcgatcgcacagtggcccttgtggctcggtaccgctccatgctggatgcggagtcggaaacggccggatccgccaaggattcagcagcgaccatagcgcaaacagagccaggctcggaaaacgttcctcctgtggaagcgccaagcggactgccgcgcaaagttatcttcgcttcgggtggtatcaccaacgggaagcaggctcacgctgttttagacacaggggcatctgttgccatgatgtacaccggtgtggtctatggtggcgtcggcactgtcactcgagtgaagcaagaacttcgaacggcgaaaaaggagtga

SEQ ID NO: 36523 - DNA, 1360 bp, Aspergillus nidulans
cacgaacttggaggcaagcgcgctattgaggataagaacattggtccccttgtcaagaccctctatgaacagatgcattcagtgcactcgttgtgttcggttcatgaacgacgttgctggcgcccccgaacttggaaccaccggtagagggaacgatatgcaaattggtacctatctagagcagaatttggatacagagctctctggaaacatcattgatctttgccccgttggcgcgctgacctccaaaccgtatgccttccgcgcgcgtccctgggagctgaagcataccgagtcgattgatgtacatgacgctctgggctccaacgtccggatagatacccgtggaatggaagtgatgcgtgtcctgccaagactcaacgatgatatcaacgaggaatggattaacgacaaatctcgttttgcatgcgatggcctcaagactcaacgactcaccactcctttgattcgacaggaagggaagtttgttcctgcaacgtgggagcaagctctgaccgagattgcatcggcataccaaaagcttcaactgaaagagaacgaattcaaagccatttctggtcaccttgtggacgcggaaaccatggttgcgatgaaggacttggctaacaagcttggctctgataatcttgccttggatcagcccggtggtagctcgccaatcgcccacggcgtcgatatccgctcaaattacctcttcaactctaagatctacggcatcgaagaggcggacgccatccttttggtcgcgacgaaccctcgccacgaagcttccgttctcaacgctcgcattcgcaagcagtaccttcgctctgatctcgaaatcggtctcgtcggggaagctttcgaaagcacatttgactttgaacaccttggttcagacgttgctgctctgaaggccgccctgtcagggaactttggcacaaagctggcttccgccaagcgacccatgattattgtcggcagtgctgcggccgaacataaggattcgaaagcaatctttgaggcggttggtagctttgtggagaagcacgccagcaacttcaacacaccagagtggcaaggttataatgttcttcagcgcgcagcatcgcgtgctgcggcatacgaaatcggcttcacgaccccctctcctgaggtagcacaaacaacgcctaagatggtttggctacttggtgcagatgagattaaccaatcggaaattcctcgcaaagcgtttgtcatttaccaagtacatcacggtgatcgtggggctcaaatcgcgcatgttgttctcccaggaagtgcgtatacccagaagtcaagagactatataaacacggcgggacgcgtacaagtcact

SEQ ID NO: 36524 - DNA, 1159 bp, Aspergillus nidulans
gacaaaatggagtttaacacctccaaggaggtcaccgttgctcccactttcgaggatatgcacctgaaggaaagccttctccgtggtatctacgcatacggatacgagtccccatcagctgttcagtcccgcgcgatcgtccagatctgcaaaggtcgcgatacaatcgctcaagcgcagtccggtaccggtaaaacggcgactttctcgatcagcgctctgcaagtcattgatacagttgttcgcgaaactcaaggtatgcaagaaaacgactgttgcttttcatctctaacgttgggtagcacttgttctctctcccacccgtgaacttgcgactcagattcagtcggtcatcatggcccttggtgactacatgaacgttcaatgtcacgcttgtattggaggcacaaatatcggtgaagacattcgcaagctcgattacggtcaacacgttgtttctggcacacccggccgtgtcgccgatatgatccggagacgtcacctgcgcacgcgtcatatcaagatgttggtccttgatgaagctgacgaactcctcaaccgcggatttcgagaacagatttacgatgtctaccgttatctccccccagccacgcaagttgttgtcgtatccgctacgctcccctacgatgtgcttgatatgacgaccaaattcatgacagaccccgtccgtgtcctcgtcaagcgtgatgaattgacgctcgaaggcatcaagcaatacttcatcgctgtcgagaaggaagaatggaagttcgatactctatgcgacttgtacgatactttaactatcacacaagccgtcatcttctgcaacacccgtagaaaggtcgactggctcacggacaagatgcgcgaagccaacttcacagtatcaagcatgcatggagagatgccacaaaaggaacgagacagcatcatgcaggacttccgtcagggtaactcgcgagtgcttatctccactgacgtttgggcgcgtggtatagatgtccagcaagtttctcttgtcatcaactacgatctccccaccaaccgtgaaaactacatccaccgcatcggtcgaagcggtcgattcggtcgcaagggtgttgctataaactttgttacgagtgatgacgtgcgtatcctacgcgatattgaatta

SEQ ID NO: 36525 - DNA, 1904 bp, Aspergillus nidulans
  unsure (1)..(1904): unsure at all n locations
ctcagtgttactgatgccgtgaacgatgataactctacaatctccctctccaacaacaccatggacacccttgggctcttcagaggcgacacagtcacagtccgaggcaaaaagcgcaaggagactgttttgattgtgcttgccgatgatgatctcgatgatggaagcgcccgcatcaacagggtcgtcaggcataacttgcgcgtaaagcacggtgatatcatcacagttcacccttgccctgatattaaatatgtgagtttcctcgaaaataagggacgtgaatagcggctaactgctcttccccgtccacaggctaagcgtatcgccgttctccccattgccgacaccgtcgagggcctcacaggttctctttttgatgtctaccttgctccttacttccgagatgggtaccgacccgtgaagcaaggcgatctcttcacagtaagaggtggcatgcgacaagttgagttcaaggttgtcgaggtggatcccccagagttcggtatcgttgctccggacactatcattcacagtgagggggagcccatccagcgtgaggatgaggagaacaacttaaacgaagttggctacgatgacatcggtggatgccgaaaacagatggctcagatccgtgaattggtcgagctgccgcttcgtcaccctcaactcttcaagtccatcggtatcaagcctcctcgtggtatccttatgtacggtcctcccggtactggtaagacgcttatggctcgtgctgtggccaacgagactggcgctttcttcttcttgattaacggtcctgagatcatgtccaagatggctggtgaatctgagtcgaaccttcgcaaggctttcgaagaagctgagaagaattcgcctgctatcatctttatcgatgaaatagactcgatcgcacctaagcgtgagaagaccaacggagaggttgagcgccgtgttgtctcccagcttctgactcttatggatggtatgaaggcgcgctctaacgtcgtcgtcatggccgccaccaaccgtcctaactctatcgaccccgctcttcgccgcttcggccgtttcgaccgtgaagtcgacattggcattcctgaccctaccggccgtcttgaaattctttcgatccacaccaagaacatgaagcttggagaggatgtcgacttagagaccatcgctgctgagactcatggttacgtcggttccgatcttgcttcgctctgttccgaggctgccatgcagcagatccgtgaaaagatggatctgatcgatctcgacgaagataccattgatgggaaggtctggactcactggtgttaccatgagaacntccgtaatgcccttggcgtttccaacccctctgctctccgcagggttgccgttgcgaggtccccaatgttcgctggaaggatattggtggtttggagaaggtcaagcgcgaacttatcgagagcgtccagtaccctgtcgatcatcccgagaagttccagaagttcggtctgtcaccttctcgcggtgttttgttctatggtcctcctggtactggtaagaccatgcttgcaaaggccgtcgccaacgagtgcgccgcaaacttcatatccgttaagggccctgaattgctgagcatgtggtttggtgagtctgagagcaacattcgtgacattttcgacaaggctcgtgctgctgctccctgtgttgtgttcctcgatgaactggactccatcgccaaatctcgtggcggctccgtcggagatgctgggggtgcttccgaccgtgtcgtcaaccagcttctgactggtaagttatattaattcgtcctatcttatcgaagataaattaacataagttcagaaatggacggaatgacctcgaagaagaacgttttcgtcgttggtccc

SEQ ID NO: 36526 - DNA, 1116 bp, Aspergillus nidulans
aattacgcctctccacgcgctggatcggcgcatcccacgccatccaagaccccgcgtaatcaacatgggccaaatctcaacgttcgctcagagctctacagcctatctcccatccgttatgacagccaacggatacttgagacgcctcgcaaacagccgcgctacgtgaacaaagtaccctacaaggttctcgatgccccagacttgcaggacgatttttacctgaatttggttgattgggggagtagtaatgttctaggcgttggcttaggaaactcggtgtacatgtggaactcacaaactgggagggttacgaaattgtgtgagcttaaggatgacacagtcacgagcgtcagttggatacaaagggtaagccgacgtcttatgaatgtctgggagcttatgttgataaacatctagggtacgcacctttcaattggtacggggaaaggtatggtgcaaatatgggatgcagagcgctgtcgccgcctacggaccatgattgggcacaccaatcgcgtaggggcgttggcttggaacgatcatattctgacatccggctctcgggatcggcatatttttcatcgtgacgtgcggtctcctgaccagtatcttcgtcgactttctggtcataagcaggaagtgtgtgggctcaggtggaacacggaagatggtcaactggcatcagggggcaacgacaataagctcctggtttgggacaaattgaacgagacccctctttatcgcttctcagaccataccgcggccgtgaaggctatcacatggtcaccccatcaacaccacttactcgcatccgggggaggtactgctgatcgaacgattaagttttggaacacggcgacgggttctcttatcaaggaggttgataccgggagccaagtctgtaacctggcatggtcgaagaattctgatgaaattatcagtacgcatggctatagtcagaaccaaattgtcatctggaagtatcctcgtatggagcagattgtgtcgcttacgggccatacttttcgtgtgctctatctagccatgagccccgacggccagacagtggtaacgggtgccggcgacgagaccctacggttctggaagatattc

SEQ ID NO: 36527 - DNA, 1535 bp, Aspergillus nidulans
accaatgcctcgtctatctcagatgaagggcgcgtcaatgcgctcctgatcctcgcatgcatcgcgtttggatctgcctcgtttgtctttggattcgacgacaaggtcatttcgccattggcagccttgactgcatttgtaagaccgcctacaccagccctttctattgacgagcactcacaatcgcaggtgcaagacttccagggccccaatcccgttgacggcacgctggtcctgacggcacgcaatcagaacctggtcttctctgttcccctcgtcggctccatcgtcggtggcgtacagcgtctcctctgaacaacttccttggccgcaaatggccgcttatcggtgcatacgtcgtctccattggtggcgggttcctgcaactcttcgcgaagaacctcgctcagtttgttatcggccggttcctcaacgccattactatcggtgtcgccaatgcaaccgccccgttgtacctttccgaggttgtacccccatccatgcgcggccgcagcgtgacctcgatcaatattctctctctgctagctggcgtgatctcgacaatcatagtcaacgagaccaaagatctggacggacaccttcagtacatgatcccgcttgccatccaatgcgcgcttcccgtcgtgatcctcgtggcaaccgtcttcctccctgaaagcccgcagtggctcgtttccaaaggccgcatggaagaagcacaccgtaatctgcggaagctccgcggttccaaaatgtccgacgccaccgtcgctgaggaactccgcgtcatgcaactctgcgaggagaatgagcgcgccctctcagccaacgtccggttctgggagatctttaaccgcgagaacctccagcgtactctcaccgcagggtccttctactccttcaaccagatctccggtatcatcctctccaccacatacacgaccgtctttctcacccagctcggcgtcggcgacgcattcaccttcaccgtcattgcatcctgctgtacgcttgctgggacgctggccgcgccgctcgtcatcgaccgctttggtcgccgtccaacagcttttgtcggcatgtccgtcctccttctcatcgacatcacagctggcagcctcgcctttaacaccggctccgaatcctttgtgctaggaatcgccgcgcttggattcatattcaacttcttttggggtgccggcttctactcgctgtctgcgttgatgccgtctgagatcgcgacaccgaagctccgcaaccataccatggcgtatacaatcgcgtgcgcgcagaccacggcggtgatcacgacctttgctgtgccgcagttgacgtcggcggatgcggcggggctgggcgcgaaaacgtatctggtgtttgccggatgtatggcttttgtgctagtttttgtgtacttttttatgcctgagacgaagggccggacattcgcggaggtggatgagatgtatgacgctggaattccgatgtggaagtggcgcaattataagactgcgacggcggcgaggatcggtggg

SEQ ID NO: 36528 - DNA, 2788 bp, Aspergillus nidulans
ctcggtggtctcggttccggctttgcgaacaaccccgaggagttgaagaacttggcctcacgttccttgactctctccccccagattttggttgagaagtctcttcgtggctggaaggaggtcgagtacgaagtcgtccgtgatgcttccaacaactgcattactgtctgtaacatggagaacttcgatcccctgggaatccacactggtgacagtatcgtcgttgcgccgagtcagactctgtccgatgaggagtaccatatgctccgtaccgccgccatcaaaattgtccgccatcttggtgttgttggtgaatgtaacgtccagtacgctctgcaacctgatggactcgactaccgtgtcattgaagtcaacgctcgtctttcccgctcctcggctcttgcctccaaggccaccggttaccctcttgcctataccgctgcgaagatcggtctgggacacactttgcctgagctccccaacgctgttaccaagaccacaaccgcaaacttcgagcccagcttggactacatcgttaccaagattcctcgttgggacctgagcaagttccagcacgttaaccgtgatattggcagtgctatgaagtccgttggtgaggtcatggctatcggccgtaccttcgaggaatcgttccagaaggctatccgccaggtcgatcctcgcttcgttggattccagggtgacaagttcgagaacctggatgaggtcttgaagaaccctaccgaccgccgctggttggctgtcggccaggctatgcttcacgaaaactactctgtggacaaggttcacgagctgaccaagatcgataagtggttcttgtacaagctccagaacatcgttgacaaccacaacgaactcaaggaaattggcagcctcttcggtgtcaacaaggagctgatgctgaagtccaagaagcttggtttctctgacaagcagattgctcagctcgttggtgcgtctgaagatgatgtccgtgcccgcaggaaggggtttggcatcagaccttgggtgaagaagattgatacactggctgctgagttccctgctgacaccaattatctctacaccacgtacaacgctacttcccacgatgttacctttgatgaccatggaaccatcattcttggaagcggcgtgtaccgtattggttgctctgtcgaatttgactggtgtgccgtcaacgccactctttctctcaggaacatgggcaagaagactgttatgattaattacaaccctgaaacctactccaccgacttcgacactgctgacaagctgtactttgaagaactcagctacgagcgtgtcatggatatctatgagctcgagagcgccagcggggtggttgtctccgtcggtggccagcttcctcagaacatcgccctccggctacaggaaaccggcggtgccaatgtcctcggtactaaccccaaggacattgacaacgctgaggatcgccacaagttctctcagatcctggacagcattggtgttgatcagcctgcttggaaggagctcacctctgttgctgaggctgagcgcttcgctgaggctgttggctaccctgtgttggttcgtcccagttacgtcctctccggtgctgccatgagtgttatccacagccaggatgagctgaaggagaagctcctgaacgccagtgccgtttctcccgatcaccctgttgttatcaccaagttcattgaaggtgcccaggaaattgatgttgatgccgttgcctccaatggaaagcttcttctgcacgccatcagtgaacacgttgagccagccggtgtccattctggtgacgccacccttgtccttccccccgcttccctggagaagcccgtgatgagccgtgttaaggaaatcgctgagaaggttgccaaagcatggaacatcacggtcccttcaacatgcagatcatcaaggccgaccaggagggtgccgagccccagctcaaggtcattgagtgcaacctccgtgcttctcgctctttccccttcgtcagcaaggttcttggaaccaacttcattgacgtcgctaccaaggcccttgttggccgtgatgtccctgagcctgtcgaccttatggaagtcaagcgtgactaccttgccactaaggttcctcaattctcttggacccgtctcgctggtgctgatcctttcctcggcgtcgagatggccagtactggagaaatcgcttgctttggtaaggacgttgttgaggcctactgggcttccctgcagtccaccatgaacttccgcgtgcctgagcctggtgagggtatcctgctgggcggtgatatcaccaaccctgctctggcccagattgttgacctcctccaccctctgggcttcaaattcttcgctgccagtcctgaagttaaggctcacatcgagtctgcaaccaaggagcacacccctgtccaggtgatcgagtttcccaagaaggacaagcgtgcccttcgtgaggtcttccagaagtacgacatccggggctgcttcaaccttgccaagactcgcggcaagacccttctcgacgaggactatgttatgcgccgaaacgcagtcgactttggtgtccctctcttcatggaaaccaaggtaaggcaccacacttcaggtaaatgagatcttgagctaatcaacttcactagactgcccaactattcgctcaagccatgaaccagaagctccctcgtcctgagggcattccctccgaagtccggacctggtccaacttcgttggcggcaagcttctgtaaacg

SEQ ID NO: 36529 - DNA, 668 bp, Aspergillus nidulans
  unsure (1)..(668): unsure at all n locations
ttgtccactgccaaaatgaccactctccactccttctaccccctgggcgtcgaaatcccccattacattgccaatgaactcagtactcctactctgctcgccatatttggaacggcctgtacaatagtgttctctgtgactacctctctcgccaaaaaagccaactcgcagatctcaaattctgagctctacaagactctctggtttgccctgtgtaggttcctcacagctaagcagaagcgcaaccctaatagagaaaaaaacaggcggctctattcatcttgtcctagaaggctactacgccctcaacttcctcactctcgcctcgtccagccacccgctcgctcagctctggaaggaatacgccctgtcggactctcgctatctcaccccgaactctntcgtgatgtgcatggaagtccatcaccgcattgttctggggccctctttctttcctcctagctggatttatagcgaccaaccatccgtantggcatccgctgcagattatcatctcgttaggccagctctacggcgacgtgctatactacgggacttgtgcgtttgagttcctagtcaacggattggagttttcccgaccggagaggtactacttctggggatatttcatgcttctaaatatgttttggattgatatcccgcttggt

SEQ ID NO: 36530 - DNA, 889 bp, Aspergillus nidulans
cgtgcgcctttcattgtccccgcgctaaaaaaacacaccgccacggtgataatggcccatggcttgggcgacaggttggttccgtcccaaaatggtaaacgagtggctgattgattgtttttaatagcggtgcaggatggtatgccagagccttcacgaatggcgcttgaaatcatgaatcgagttctaatgagacggtcgaacagggtctctctcgcccacaactggcgccgacgaggcttgtttgaagaagtgaccttcatcttcccaaatgcgcccatgattccgattacagtggtacgtttgacgcaagcttttttcacggctcaaagacctaggcttgaggttgagacgctgctgacctgaaatttttcggatagaacttcggaatgtcaatgcctggttggtacgacatcaccaaactcggtcgtgatgtgagtccttcccttctcattcccctctatggcaaacagcagctgatagaatagcaatacagctcgatttccaagaagccgtcaagaaccaagatgaagccggcatccttaagtctcgcgattacttcaactccctgattaaagagcaaatggaccaaggcatcaagccgtcacgaatcgtcctcggagggttctcgcagggaggcgccatgtccctgttctcaggtataactggacaggagaagcttggtggtgtctttggcctttcatgctacatgctcctcagtgaccgtatcaagaactatatcccggaaaacttcccgaacaagaagacgccattcttccttgcgcacggcacagaagatgatattgtgccgcatgagtttggcaagcgctcggccgagatggctaaggaattgggactggaagatgtcacctttaactcatacaagtga

SEQ ID NO: 36531 - DNA, 1795 bp, Aspergillus nidulans
ctgtcccttgatagtctcggtacgatggcagtctccaatacgctagccgcccggggtggcgccctctctccgagccagacaacatcgcaaatggccacgaccacagttagtgtggggggaatgacatgcggcgcatgtacttctgccgttgagggcgctttcaacggcgtcaaaggtgccggtgaagtctccgtgagtttgatgatgagcagggccgccatccaccacgatcccactctcctccctccaggtaaagtcgccgagattattgaagactgcggctttgatgcgactgtgatctccaccgacagttcgtcgattccgtcgcggagcgccagcgatcatggagcatctgaggcgaatgtcgtgacaacaacactggccgttgcaggaatgacttgcggggcctgcacctctgcagtggaaagcgggctggcagagaaccccggtgtacgatccgtcaatgtctcgctgctatcagagcgagcggtgattgagcatgatctgtcgacggtctccgctgagcagcttgccgagatagtggaggatcgtggctttggcgcaagggtcttagaaacctcgacatcccgggctggtcctcgcggatccgagtctacggatccctcgtctcagtcaatgaccactaccgttgctatcgagggtatgacatgcggcgcatgtacgtcaagtgtacaggcggcgtttgacggcgtggaaggtgtgattcaattcaacatcagcttgctcgccgaacgagcaatcatcacccataatcctcaaatacttccatctcggaaaattgtcgagatcatcgaagatgccggcttcgatgccaaggtcgtttctgaggtccaggcgcttggtcagaagggcgggccgactcaggtcacgcttgacgttcatggcttacgagatgctaattctgctgcagccctggaggactccttaatgcaaaagccggggataatctcagcgtcagtaacacttgccacctctcggctggttgtctcgtacgacacctctatggtcgggatccgtacaattgttgccgtcattgaagctgctggctgcaatgctttactagcggattctgatgacaagaacacgcagctagagtctttggcgaagacgaaagaggtcttggagtggagacgcgccttcctgttctcactatcctcgccaatccatgtgttcgtgatagacatgattcttccgatgtacctaccaacgttcaattttggcggtatccgaatcattccgggtctttacctcggcgactccgtgtgtctattactcacaattcctgtgcaattcggtatcggtaaacgcttctacatcacaagctataagtccttacggcaccgtgccccaaccatggatgttctcgttatgcttggcacttcagcagccttcttctacagtgttttcaccatgattgtagccatcgttattgaccctcaccaaagacccaacactgtctttgacacaagtactatgctcatcaccttcataacccttggtcggtggcttgagaacagggccaagggtcaaacgtccgctgctctttctcggcttatgtccctcgcaccatcaatgacgaccatttacgatgacccgatagccgccgagaagatggtagaagaatgggataaagttgacggccaagagcaaaaaacggctacaaacgaaatgtccaccgtctcacaaaaaatcatccccactgaactcattgaagtgggcgacattgtcgttctccatcccggcgacaaggttcctgctgatggagttgtcattc

SEQ ID NO: 36532 - DNA, 1236 bp, Aspergillus nidulans
cagcctctatcccttttgctcaaggcatccccctttattgacgagctcgccctttacgatgttgtcaacacccccggtgttgccgctgacctctcccacatttcttctgttgctgtacgtcacgcctacatagaagcagtaatctaatggactaactcaaagacagaaaatctcaggttacctgcccaaggaagatggcctgaaaaacgccttgactggcactgacattgtcgttatcccagctggaattcctcgtcagtacaatatgatttattggtctatatctccacaatattagtggcactaatgttgtctggtttttaggtaagcctggtatgactcgtgatgaccttttcaagatcaacgctggcattgtccgtgaccttgtcaagggcattgccgaatacagccccaaggctttcatcttgatcatttcaaaccccgtcaactccaccgtacccattgctgccgaaatcctcaaagccgctggcgtctttgacccggcgcgtctctttggcgttacaactttagatgttgtccgcgcagaaaccttcacccaggagttctccggccagaaggacccatccgcagtgactgtccctgttgttggtggtcactccggcgaaactattgtccccctcttcagcaaggtttctcctgccttccagattccggcagacaaatacgatgcgcttgtcaaccgtgggtattcctgtaaaagtctaagcaataatgttacgtcttactgatcttcgtataggcgtccagttcggtggcgacgaggtcgtcaaagccaaggacggcgccggctctgccaccctttccatggctttcgctggcttcaggtctggcatcctgtgtgttttgggccgccgcttttaatgctaactcctatacaggtttgcagagagcgtgatcaaagcctccaagggccagtctggcattgtcgagccaagctacgtctacctaccaggtgtgcctggtggcgcggatattgccaaggctaccggcgttaactttttctcgactcctgtcgaacttggagtgagtatttggaattgaggtccctaggtgtctgaattaatgctaacaacacaatagccgaatggtgttcaaaaggccataaacattctcgacggtattacagatgctgagaaaaagctccttgatacggctatcaagggtctcaagggcaacattgacaagggcgtcgaattcgctcagagtcccccacca

SEQ ID NO: 36533 - DNA, 1089 bp, Aspergillus nidulans
ggtgtcgtcaatacatggggtgtttatcagacctactacgagcaaaaccagctatcagacatttcgtcctcgtccatcgcctgggtcggttccttacagtctttccttctcatgctgttcggcgtcgtaacggggccactttttgatgctggatatttccgcctgcttcttggattcggtacgatcatgttgccgtttggtttcatgatggtcagtatttcatccaagttctggcatttcatcctggctcaaggggtctgtgttggtttagcctgcgggtgcctgttcgtcccggcagttgcgatcttgccccaatacttccgcaaaagaagaggactcgccaacggcattgcagccacggggagcagtattggtggtgtcatctacccgatcatgttcaacgaactgcagaaaaaggctggctttcactgggcgacgcgcgcagtaggcttcctcgctttcggaacctgcttgatatccttttccctcatgcgcatgcgcttcctccctactgagaagcggaagcttatccaactgggcgccttcaaggagcccatcttcgtccttttctccatcggcatgttcatgggcttcttgggcttttacaatttccttttctatgtccagtcttacgccattgagaccggtattgtcgacggcaaccttggcttctatcttcttgcgatgctcaacgcgggttccacatttggtcggattgcgcccaacttcctggctgaccacacgggacccttgaacatgctcatccccgcagtttcaatcaccgccatcctctctttcgtctggattggtgttcacactgtccccggtatcattgtactgtccgttctctacggaatattctccggtggctttgtctcccttccccctgtagtcatggcatctattaccaaggacatgcgcgaactcggcacccgcatgggaatggtcttcgccatcacttctgttggactgttaattgggacacccatcggcggtgctatcatgagtaatacgcataagtatttgggtgtccagctctttacgggctgcgccattaccgttgctgctgctattttcctgggcgtcaga

SEQ ID NO: 36534 - DNA, 3183 bp, Aspergillus nidulans
gatgatgcggacttcattcgacagaatcctgatctgtacgggcttcgtcgcagtggacgagctcgcacgacgcgtcgggtagccgaatcgtcgtcggagtcagagtccgatgacgtggcgcctcgctctaagcgtcggcgccctctcgcctcacagatttcgaaagctcctacaccgtccgcaacgcaatcaacgttctctgatgactcagatagtgatgagtacggcggtagtcgtgcccgcgcgagcaaggcgaaacgtcggcgactgcttcaagcgtccgcgaacaacgttccttcccatgccgaggttcgcttctcgaccaggaatgctgccaaggtttcgaactacaatgaagatgacgatgactcgatgtttgaagatgatgcagatgatttaacacctaattactgggtgaacacagtagaagatgatcgacctgcgatagacattgtgcttaatcatcgtcctaagcctggcgtcgatccgagcgacccagacattgatcgtcatcagttcgaattctatataaaatggcaagagaagtctcactaccacgcgacgtgggagacaactgagagcttggccaactgccggagtacacgtcggcttgacaattatgttcggaaggttctcgccgaagacctgcgcttgaattatgacgaaggtgtaccccctgaggaccgagagaagtggaaccttgaccgcgaaagagatgtcgatgctatcgaggaccacaagatcgtggagcgtgtaattgcaatgcgcgaaggagaagacggcactgaatacttggtgaaatggaagcgcctattctacgattcctgtacatgggagagtgaggagttgattagtaacatcgctcaacgtgagatagaccgttttctagatcgatcgtcccggccacccgtttcagacaagaaggagtcccatcccagttctcgcaaacctttcgagccaatcaagggaacaccaagctttttacacaatggtcaactcaaggagttccaagtgaaaggtgtcaacttcatggctttcaactgggtgaagaaccgcaatgttgtcctggcagatgaaatgggcttggggaaaacggtgcagactgtcgcttttatcagctggctccgtcatgtcagacgtcagcagggtccgttcgttgtcgttgttcctctatctaccatgccatcatgggcggaaacttttgacaattggtctcctgaccttaactacgtcgtctataacgggaacgaagcgtctcgtaacgtccttaaagagtacgagctgatggtggacggcaatcctcgacgaccaaagttcaacgtactcctgacgacctatgagtatgtcttagtggattcatccttcctcagtcaattcaactggcagttcatggcagtagatgaggctcatcgactgaaaaaccgtgattcacaactatatatcaaacttcaagagttcaattctcccgcccgcctcctcatcaccggtacccctatccaaaataacttagccgaactttcggccctcttggatttcttaaatcctgggttggtcaatgttgatgccgatatggaccttaattcagaggcagcgtcagagaaactcgccgagttgaccaaggctatctcacctttcatgtacgccggacgaagaccaaggttgagtccgaccttccgcctaagacggagaaaattattcgcgtcgagctttctgatgttcagttagaatactataagaacattcttacgaagaattacgctgcgttgaacgaaggcaccaagggtcaaaagcaatcgctcctcaacatcatgatggagttgaagaaagcaagcaaccatcctttcatgttccctagtgcggaaaccaagatattggaaggaagcactcgccgtgaagatgtgttgcgagctttaatcactagcagcggcaaaatgatgctcctcgatcaacttctcgctaagttgaagcgcgatgggcaccgtgttctgattttcagccaaatggtaaagatgctggatatcctgggtgattacatggagtaccgtggctacacttatcagcgacttgatggcacaataccttcagcatcgcgtcgccttgctattgagcattacaatgccccggatagcagtgattttgcgttcatcctctctacgcgggcgggtggtctcggaattaaccttatgactgcggatactgtgatcctgtttgactctgattggaaccctcaagcagaccttcaggcaatggcaagggcacaccgtatcggtcagacaaagcctgtcagtgtttatcgcctcgtctccaaagataccgtggaagaggaagtgatcgagagagcacggaacaagcttcttcttgagttcatcaccattcagcgaggtgttacagataaggaagcctccgagattcagaacaagatggctcgaggaggcatcacgctcggcgagcctaactctaccgatgacatctctcgaatcctcaagcgccgcggccagagaatgttcgagcagaccggcaaccaggcgaagttggaacagcttgatattgattcagtgctcgctaatgctgaattgcatcaaactgaacaggctgagggcattcaagcagacggtggcgaagagttcctcaaagcatttgattacgtcgacatcaaggttgacgatctcacatgggacgacatcatacccaaggaacagcttgaggagattaaggcagaagagaagaagaaagccgacgagaaatacctagcagacgtcattgaacagaatcgaccgcgcaagcgcattgttgcaggtgatgagcgagatacccgtgccgaaagaaaagctaagcgacaagcacgggtccaggtcagtatgaacgatgatgatggagatgactcggaaccaaatgcgaaagcggatccgaagcgcccgctagtggagaaggaatatcgtcacctccttcgagcctttctacgttatggtgatattgaggaccgagaagaggaagttattcgagaagcgcgtctaacagaacgcgatagggacactgttaaaagtgcactgcgtgagattaccgataaggctgcggagttggttagagaggatgttgcacgactggaggctctcgaaaatgccggcaaggttctcaccaaaaaggagagaaaagccgtgctgtttgaccttcacggtgtaaagc

SEQ ID NO: 36535 - DNA, 1035 bp, Aspergillus nidulans
cacgaggagacggttgacaggtgttggtagcgaaaagatgagctggaatactggctcacagagcacctgcgacttaatggagtctactggggcttgacggctttgcatctccttggatgtcctgatggcttgccgcgcgacaatgctgtcgactttgtcctctcgtgccagcaagagaatggtggcttcggcgctgcaccgggccatgatgcgcatcttctgtatacagtctctgcggtgcagattctggtgactttggatgctgttgacgagttggagaagcgcggattgggcggcaagctgaaagtcggttcctgtaaatatagcccttatcacttcggagagggttaaagaacgcatggctaagtgttttcagtcatcgcagggctgcaggacaaggagactggctctttcatgggcgacgagtggggcgagttggatacaaggtttctttatggggcgctcaacgccttgtctctcctgggactattagacttggtagatgtcgccaaggctgtctcgtatgtccagcgatgcgagaatcttgatggagggtacggagtcacccccggtgcggaatcgcacgccggtcaagtctttacctgcgtaggagcactggccatcgctgggcggttggacctagtcgacaaagaccggctgggaggttggcttagcgagcgacagctcgaccatggcggactcaatggacggccggagaaactcgcagatgcttgttacagctggtgggttggggcgagcttggccatgattggcaagctcaactggattgacgggtccaagctcgctgcctatattttgcgctgtcaggtttgttactccattctagcgctagtgcttttggctaaccctccttaggatccagaggctggtggctttgctgatcgtcctggcaatgccgttgacgtctttcatacgcatttcgcgattgccggcttgagccttctggggtacgagggcgttgaggaagtagaccctgtctagtgagtcaacgacatcccaaccgcacagttccgt

SEQ ID NO: 36536 - DNA, 1359 bp, Aspergillus nidulans
ccgcatccactacttttcgccatgcttcctccgattcccatcccggcagagtatggtatctcgccagacaccggcttccttccttcggagccccctctggagcatttacctgatccatattacgccaaatgggaatggattgtggcaaacattcaggccctcctgctcagcaggagaatgaggagagtagttgacaacatgccaattctatcaacctcatatcttcaagctgagcccgaatggaggagggcctattcgattttagggtttatccttcatggctatgtatgggggggatctacgccggcggaagtaagtggcccaaccccgatgatgatccatgcttggcattggcagtccctgcttgacggtccgtgctaaccataccagaggataccacctcagttgactgttcctctcttcgaagtatgcgaccatcttgacctacctccagtcgccacttacgctggcttggttctttggaactttaagccgattttttctgacgagcctatggatgacctggataacctcgcctgtatcaacaccataaccgggaccctggacgaacaatggttctacctcgtgtccgtcgccatcgaagcccgcggtggcccggcgatatcactcgtactccaagccattgctgcgcgggtcggaaacaccgccgtcgttatagaatacttgcaagctcttgcagagatgattgatgagatcggagccgtactggaaaggatgtatgagcataacgacccttacgttttctacaataagatcaggccttacttggcaggaagtaagaacatggccgatgcgggcttgccgaatggcctactctatgatgatggcaagaagccggagtaccgtcagtacggaggagggagtaatgctcagagttcgttgattcagttcctcgacattgctctaggaatcgaacatcgacccactggagagactcgccctagctcgtcagagaatggtggcgtcgctgcaggcccacgtcacggtttcatccaggagatgcgttcctacatgccaggtcctcatcggaagttcctagaacacatgggcgcggtcgccaacatccgagagtacgtggaggcccggcgctccaataaacctctcagccttgcctacgacgcatgtttgtcaatgctgcaatcaatgcggactaagcacatccaaatggtgtcgcgatacatcatcactccgtcgcaaaaggcacgcgagaagccctcgcgcccggcgagcttgaatcttgccaccgctcgccacagcgagaagcccgatggcagcaaactacggggcacaggcggcactgcattgatcccgttcctcaagcaggctcgaaacgagacg

SEQ ID NO: 36537 - DNA, 850 bp, Aspergillus nidulans
agcatcaagaggcctaaccctcccctccctgacagcgtattcgccatgttctccatgaaaggcagagtcgctattatcactggtggttccggcggaatcgggtatgaagttgcgcgcgcccttgccgaagctggcgccgacatcgccctctggtacaactcttccccggccgagaagttagcagagacactggtgaaggattttggggtccgggccaaggcgtataaagtggccgtgcaggtgtttgagcaggtccaggccgccataaatgccgttgtggccgacttcggcgggctggacgttatgattgcgaatgcgggcattccgtccaaggcaggtggactcgacgacagactcgaggactggcaccgggtcgtggatgtggacttctcgggcgcgtactactgtgcgcgtgttgcgggcgagatcttcaggaagcaggggcatggcaatctcatcttcacagcaagcatgagcgggcatgctgtcaacgtgccgcagcagcaggtatgtatcctcttcgtctcatcctggccagaacttttgagatgctcacaatttctgttaggcctgctacaacgcctgcaaagcgggcattatccacctcgccaaatcgctcgccgtcgaatgggccgactttgcccgggtcaacagcgtcagtcctgggtatatcgacacggccattagtggagactgtccgtttgagatgaaagaggcgtggtatggacttacgccgttgaagagggatgcggatccacgagagctcaagggggtgtatctgtacctggcgagcgatgcaagcacatatacgacgggggctgatattgtcgttgacgggggatatacgtgt

SEQ ID NO: 36538 - DNA, 1314 bp, Aspergillus nidulans
gcgcagcagcggtacgaaactagtcgcccaaggtcgaaggcccagcatcagcgcgctacatcgcacctcccgggtggaaatacccgatcggtgctgcacgcaacgcctttcccactatgcatgcaagctggcaaaggtaatcgattggttgatgtggacggatatgagtaagtgatttctcgaccgcctccagtccaactctgctaagtcaggccaggtacatcgactgtatgggcgatatgaccgcctgcctctatggccattcccacccggtgattatggagactgtggattcgaccatgaaaagtattgggatgaacctcggttcttcaacttcagcagaggctcatttcgccgaagcactatgcgaccgattcgcctccattgaccacattcgcttctgtacctcgggtacggaagctaatctctacgctttgagcgtagcacggcaatccaccaaccgtacgaaagttattgtttttgaaggtgcatatcacggcggtgtattgtcattttcccacggcattgcgccgaataatgtggacaaggacgactggattcttgggcaatacaatgacatcgatggggcagtgcaattgattaccgaaaacaaggacattgccgccgcggttgtggttgagggggtgcaaggcgctggcgggtgtataccgggatctgccggtttcctccatgctatacaagatgctgcaagagagaatggcattatcttcatacttgacgaggtcatgacttcgcgtttggcgccgggcggactacaatctatcctgctgcatccggaccacggcacccccctcaaaccagatttgaccacttttgggaaatggattggcgggggcctgagtatcggtgcgttcggtgggcgacgagacctgatgtcggtttatgatccgcgcacatcgatcatccaccattccgggacattcaataacagcacacttgctatgaacgttgggtgcaagggtctgaccctcggtgtacacccccgaagcatgtactagcctgaacaaccttggcgacgaactccgcagtggcttgcaggagctagcaaagggcacgaaaatggttgtaaccgggttgggtgcagtgatgaatatccactttgttcgggcgagcggatcgagagtcgttgcgagaacaagcgatctagaggtcaactcaggcagcgtagaggaagccctgcgagacctcctctggttctacctgatcgagcgcgggttctggatcgctcgtcggggaatgatcagcctgatcttgggaactggcgtagaggaggtggagcagttgaagggtgtc

SEQ ID NO: 36539 - DNA, 2207 bp, Aspergillus nidulans
atgccgcagctaggaccggcagatactcatttgaccccgaatgaggcaatgtcgcagttggtgggagtaacgagttcatggatcgacctgtgttctcccgacccactaatcgcagacctgtcacgccaagtttttatgctcgaagtagcctatgccgccttctgtggcattggctatcttttgattccaggaccaaagttgcatcataaaggaatgcattcggatggagtgatgtactatgcacgggcgattcaagatgcacttagtctcggcccatacatccagtttcatatctggttagacatggtcgacatcaggatctcgaattagacgagatgggtgatcttgcacctcttgctcgggaggaattttttgacaccgaaatagagcagccaaagatagacctttttggtacttgggatgcctgggatgctattagaagaacttgtaaataccactccaggcttttcgtaggtaagaaaataatatctgacctttcttcgattctgataatcgtggctaagatacctgctagctctctctttaccgaagcaccttccaccgatggctgttcagtcaagatggcattctgagccagtccacttgtttaccatcgactcgaacacgttcatcaaaaatcagaaaggatatccagtcctaagtaaagctcaccaggcactgatttccaggttcatgcgtctccgcaccgctccatggatcttgctttgcgatgttggacctataccaggtgtagagacggacaatgcgtccagtctccctggctctgaataccctagtcttgcacaggctgcggcttcaatcaaaaagcatcatgaccctactccgcatctgtcatacatgagaaatcttcaatcacgtcagcctccccgaactgccattgagagattcggcactggctaccaagactacctgcaagcgccactgcagcccttaactgtcaatctggaaagtatcacatacgaagtctttgagaaggaccctatcaaatacgaatggtatgagcgcgcgatcgcgaaggctttaagcgattgggtagaacaaaaaaagcccacgtcaaacccggatggccgtgtggtcgttgcagtagttggtgccggaagaggtcctttggtgactagggctctcaaagcaagcgctcagtcgggtgttgagattgacttgtgggttgtggagaagaacccaaatgcatttgtccttctccagcgtcacaacgagaatctatggggcggaaaggccagccttgtgcactccgatatgcgtgcttggaaaggaccgcgcgtacggaaaagcaccaccttgtcgacagaacccgtcggacagtctctgggtattgaaggccaatttctctacactcctgaccctaaccaaaaaactgcagattcccctagcctggacgctattgagtttgaggactccaaaatcgatattgttgtttctgagcttctaggttctttcggggacaatgaactctcgcccgaatgtctagacggcgtcaaccatctgctgaatccagtacacggcatctcaatcccagcatcttacacggcacatctcacgcctatctcagcgccaaaactccatgcggatgtcacgaaccagtcaatcacaaaccctgcagcacctgaaacgccttatgtggtcatgttacatgctatagactacctttctactaaccaatccgacgccagcgcaggtaaccccgctaggtcttcagttgcgacagttccatatgaaccaactacaccatttgtccaaacagcctggtctttctcccatcctaatcgagatatacctcctcagccggcttcaacgtcgatgatatccaatgcacacaatgtgcgccggactcgtttaacgttcccggtcccaaatcgtggagtttgccacggccttgcaggctacttcgaaacagtcctgtaccgcgatgtggaactgtccaccaacccggtcactatggacagcaagagcgcgaacatgatcagttggttcccgatctactttccgctcaaggtaaggcgccctggatgaggctgaaaaggtgtcgatatctaactagtgcctagacacctctaaatgtccccgacaatggcgaaattgtcgcgacaatgtaccgacagaccgatgaccgaaaagtgtggtacgagtggatggtggaagttttcgctttggagggtggctcagaacca

SEQ ID NO: 36540 - DNA, 1279 bp, Aspergillus nidulans
attcctcaaccgaaaggcctcccagtgctgggcaacctgttttctctcgactctaaaaatccctggggttccttcaacaagctcgcggccgcatcgccctctaaccgtccgatcttcaaaatcagcattctcggccatgatatcgtcttcgtgacttccgcagctttactcgaagaaatctgcgacgagacgcgttttcgaaaatgcgtgacggggccgatcgtccagatccgcgacgcagtccacgactcgctgtttacggcttaccactctgagagtgagatttggggagtcgcgcaccggattatgaagcctcttgtttcgccagaggagtgtgaaggtgtcttcaacgagatgagagagacgaccgatgatttgataaagaagtggacggcgtcatcgaagcagcgcgtcaatgtgtgcaatgatctggatcggagtaacacgaagcgaatatgcttgccttctttcaccagaaggtgtctatcatgaacggcaccgagccagccgtgatcgcctcctgccagaatgcgacaatggaggctgtgaacgcactcgcgcccgacattccttacatggcttatgggtcaccagacgcgctacgattccgacatcaagatcatgcgcaattacggcgcagagctcgtccgacaacgccgcgacgacataccccgacggcggacccaaggacatgctgcatgccctcctccacggcgtcgacagtgaaacgggcaaaaagctgtccgagagccaagtcctcgacgagatcattaacatcttcatcggcagcgcaacgcgcgccaacctcctctcctttgggctatattatctcgccaccaacccagacgtcgtcacaaaagctcgcgaggaactcgacgccgttgttggttccggccccttcgagcacgcccacctgtctcaaatcccctacaccgagggcatccttcgcgaatcattgcgactcagcgccacagcaccaggcttcaacatcgagccgatcccgtcgccgggcaatgagcccgtccttctcgccggcggcgaataccaagtcccgcgtacgcaacctctcatcgcgctgctgaccgccgtcaaccgggacccggaggtcttcgaagaccccgaatccttcaaacccgagcgcatggtcggtgagaaatacgatgctcttccgtcaggcgtgaaaaaaggcttcggaaatggcaagcggcagtgtttcgggacacggtatgcgtgaggaaaggagtcttttggtgctggcgcggttattaaagaagtgatt

SEQ ID NO: 36541 - DNA, 1023 bp, Aspergillus nidulans
ttgagtggttcctcgaagcactatggtcccaacgtcaattcccactacccagttgaaagacggaacttcaattcctgtggtaagtagacacagtcctcactagtaccccttttactaacttgaacccagattggatatggaaccggcactgcttggttcaaaaagaaaggagatactagcatcaatcgtgacttggtcgaatcgatcaaaacggccatcaggttaggatatcatcacttggatagtgccgaggtttacggcactgagcgggaattgggcgttgcgattaaagagtgtggtgtcccgcgagagcaattattcgtgacaaccaaggtgaaccagaacattgcgaatgttcccaaggctctagaagacagcctagagaagctccagttaagctatgttgatctgtacgtgttactcctctcatcgctgttccataaattgaccatgaaccgtcgttgtttccagatacttgatccaccagcctttcttcgccgaatctccaactgagcttcaggatgcatgggcggctatggagaaagtgaaggaagcaggcaaagcccgagcgattggagtgtcaactttctagagagcccttagaaacgattttggattcagcgaggattctggcagcaatcaatcagatcgaatctctcctttatgcgcagcatggctctctcgtcccagtaccacgagaggaagggtatcgcggtagccagttatgggccactcacgccggttactcgagccaaagggggtccgttggatccgttgctgtcggaactggctggcaagtatggcgttggcgaaggagagattcttctgagatggtccctttaccgtggcgccgtagccatcactaccagtggaaaggaatctcgcctaagcacatacctaaatgttttcaaattccaattaacacatgaagaagtgctcaaaatctcccggattggcgatcaaaagcattataggggcttttggtctgacaaattcgcggccgatgatcggtcatagccagga

SEQ ID NO: 36542 - DNA, 2147 bp, Aspergillus nidulans
caaggcacagaactgctgactcaggagcgtgcccagtcaaacattgacgtagacacgctcggcgacctcctgcacacgaaagaagcactcaagaagcaagacgagatcttgtcggtgctgaaatccgaaaaggtcttcgacaagtcgcgcaaccatgtccttggacgtactgagaagatccagcttgcgttggcgcggggaaagagactgcagcagttgaagaaagcacacaattggtcagacgaggatgtgcatgttgcgaatgatttggtgtctgaaccaacgccttacggtttgcatgcgtcgatgttcttggtatgttacccttggtaaccgcagttgggcggtgggagaatcccagttggctaatagttggctcgctggttaggtgacacttcgcgaacaaggaacaccggaacaacataagctgttttacgagagggcgagaaactacgagattattggatgctatgcacagacggaactgggacacggatcgaacgtgcgtgggctggagacaacggctacctgggatccttcggatcagacattcatcatccattcgccgaccctgacggcgtccaagtggtggatcgggtcgctgggacggacggcgaaccatgcggtggtgatggcgcagctgtacattgggggcaagaactacgggccacacccgtttgttgttcagatccgggatatggagacgcatcagccgctggagaatgtctatgtcggtgatattgggccaaagtttggttataagtgagtgttctgggttctctggtgggatgttgctgactggtgccagtaccatggacaacgggttccttcttttcaacaagttgaagatcccccatgtcaacatgttagcgcggtttgcgcaggttgacaaagccacgaacaagtacatccgccccgcctcgccatcacttatgtacggaaccatgacctgggtgcgctcgaatattgtcctgcaagctggcggtgtcctcgctcgcggcgtgaccattgctgtccgctactgcgctgttcggagacagttccaagaccgtgacgccaaggccaatgccgaagagaaccaagtcctgaattacaagatggtccagatccgacttcttccgttgctcgccgctatgtatgctctgcacttcactggccgcggcatgatgcgcttgtacgaggagaaccaggaacgaatgacaggtgccgctcaggcagaccaagagaagcggggtgcgggcccagagcagctccgcgcgggctctgatctccttgccgacttgcacgccacatcgtgtggtctcaaggccctggctagtacaaccgccggtgaaggtctcgaagtctgccgtcgtgcctgcggtggccacggctacagcaactacagcggtattggcccgtggtacgcagattacctgccgaccctgacttgggagggcgacaactacatgctcactcagcaggttgcgcgatatgtacgtcccccttccaccaccacttatctcattactaatatttcgtagctcctcaaatccgctcgcgccgtcctcgctggcaaaggcaccgccaacgacacctcgcgcattctgcaagcgtaccttgcccgccgcgacaagggcgcctcgttcgacattcttggcaacgacgccgacattgtcgcggccttcgcttggcggacggcccacctcacattcgagactctcaagtaccgagacgttgagaagcgctcgtggaacagtctgcttatcaacttctggcgtctttccaccgctctatcacagtacctcgtcgtgaagaacttttacgaagccgtcaactcgcccgaaatcagatcctcccttgacaaggacacagcatctaccctccgatctctcttccgcctccacgccctgcacactctcgaccgcgaagcctccgagttcttctcctccgctgccgtgacggtacggcagatcggcctcactcagacaagtgaggttccgaagctccttgatgagattcggccgcatgcggtgagactcgttgattcttggaagattcccgattggcagctcgacagcgcgctcggacgcagcgacggcgacgtctatcccgatctgttcaagagggcgagcatgcagaacccggttaacgatctggtgtttgat

SEQ ID NO: 36543 - DNA, 1010 bp, Aspergillus nidulans
aataacgcctactcctcgggaatgaaagaggacctcaatttgtatggaaacgagtactcgctcttcggctccttctacaatatcggctacatgctctttgagattcccagcatgatgataatgtcgcggcccaaatttgcgcgctatttcctgccgaccatggaagtgtgctggtccgtcctcacattcgcacaatcccggctccgcaatcaccacgatatctacggtcttcggtttcttcttggtgtccttgagacccccgtgtccagcggtaccatgtatatcctttcctcctggtacaggggcgacgagctcttcaagcgcgcaggtgtctggttcgtctcgagcaatctcggctccttcgcaggcgggtatctacaagccgcagcgcacgagacgctagacggtgtccatgggatggccgggtggcggtggctattcattatcgatgggtgcatcagcttgccaattgccctgggaagtttcttcttcttacctggtctgccgcacggggagaaagtgtggtggttgacggacgctgatcataggcctctgtgttcagaggatgcggaacgagggtgtgagggaaagccggaaaattgggaaacgcatgctcaggagagtgtttacccattggcacttctatatcgcagtctttacgtacatcttgttagtgggccgtctccctacctagcatgtgcacaggtaggtaaaaactgtttgttgcagtgactaacgattcaaccagcttccaatgcacctcctacgttgccggccagatgatcctctggttaaaagaccaggcagatcgatatggtacctggacagtgtctcagatcaatatgattccgacgggcgtacaggctgtttctgtgtttgccggtgtactggcgacatctctggtcatggtatatccgccctgggctgtcatgggcgttgttgcctccgtcctgctcttctcgaatgtctgccttttggtctgggatattccgctgggactgaaatgtgag

SEQ ID NO: 36544 - DNA, 1971 bp, Aspergillus nidulans
caggattcgttggcggatatgctttctgtcctcggaatgacgtacggggacgaagagaaactcgaaacgctcaaataccgacttctcaccaaatcggatgacctcggttcctggggccacgaatacgtcaggcacctggcgttggagatcggccaggaatatcagaacagagtaaacgacgaaaaggaagtagacgatctgatcaaactcgcggtttcgcttgttccatatttccttagacacaatgcagaagccgatgccgttgatcttatgagcgaacttgagattatagaggagattcctcagttcgtggatgagaacacatattcaagggtttgcttgtatatggtcagcatggtgcctctccttacctaccccgaggaccaccagttcctccggacggcacacgaaatctacgttcgttacaaggagctcacgaaagctattgtgctcgctatccgcctaaacgatgttgacctcatcaagagtgaccttgaagcgacgtcggatcggtcgctcaagaaacagatggctttcctagtttctaggcaacaaatatggctcgatgacttgggcgatgacgagcaggacgagactttcatggagtgtctgaacaacacctcgatcccaaagcatttcaagtcgcttgggaaggaactgaacatcctcgacccaattatgccggaagacatctacaaaacccacttagaaagcagccgaggagcaggcctcaccaatgtcgactctgccagacataatcttgcaagtgcctttgtcaatgcattcgcaaatgccggttttggcaacgatgagatgatgattgtcgaaggtgacaagggttcttgggtttggaagacaaaggatgatggcatgttgtctaccaccgcctcaatgggtatgctcctgcaccgagatgtcgacactggtttggacaaaattgataagtacacgtacgcctccgaggatcagatcaaggccggtgctttattgtctattggaatactcaattcaggcgtgcgccttgattctgaccccgcgttggcccttctgtgtgacaacgagaacttggaggcaaagaatattcccatgagagttgccacaatcatgggccttggtttagcgtacgccgggtccaacaagcaggaaattcttgacgctttactgcctatcgtggaagatgtatctctcgatatgcaactctccgcaatggcggctgtctcacttggtcttgtctttgttgggtcatcgaatcaccaagtcagtgaggcaatcgctaccaccctcatggacgaggagcgccagaagcagcttaaggataaatggactcgcttcatggctcttggtctagcgcttttgtacttcggtcgccaggaagaagttgatgtgatcctcgacatcctcaaggctgtcgatcatcctatggcgaagcctacgtccgtcctcgcctccgtctgtgcttgggcaggtaccggcaccgttctgaagctgcaggagcttctccacatctgcaacgatgtcattgaggaaagtgatgagaagcagggtgaagagcttgtgcaatcttacgccgtgctaggtctgtcgttgattgcgatgggagaagatgttggtcaggatatgattcttcgacagttcggccatctcatgcactacggcgctagcatcattcgaaaggcggttcctcttgctatgggtcttatcagcccaagtaaccctcagatgaaggtgtacgacactttatcgaggtgcagtcacgacaatgataatgatgttgccattaatgccattttcgccatgggtctctgtggtgccggtgcgaagaactcgcgttaggcgcatctatagaggcacctgaccagttactaccatctacaccagaactctttattagtggtgcgtatcgctcatggactactgcacatgggcatgggcactatggcactaacaccaatctagaccgacccacaggtt

SEQ ID NO: 36545 - DNA, 1025 bp, Aspergillus nidulans
aggcccgttgttcttcacataggcaaacccataaagtaccatcagcacttctacagcaatgactttctggctcgattccacgtcatccagaacgacgttctcgatattccttcattcattcaagctctgaaagagaaacggtccgttgcataagcccttcaccttgcttgtaccttgctgacctctgcagctacggcgatttcgtcgtcaccttccggccgcactttcagtcgggaggagagatgggtaagtgggatgatgaactcatcgagttgctgccatcttcagttcgcatttttgcatctgtcgggctggattcaactgggcggacgtcgaggcccttggacgccgagggatctggtacgcgaatggcgccagcgcgtccgatgaagcagtctcagatacaactctctacatgatcctgtcggtctttaggaacttcactcggacgcagctggctgcacgaacagccgaccccgagatttttacggcatctcacaagctcatcgcatcgatctcgcataatccgcgcggacatattctcggcctcgtgggactcggcaatatcagcaagaaggtagcagtgaaagcgcaacctctgggaatgtctgtgcattactacgacgtggtcaccagagccagaacgtcgaacgggctctagatgtcacttaccatgatacgcgggagagcctcctggaggtgtcggactgcgtgtcgctacatataccgttgaatcagtacgcaaagcacctaatcaaccgcgatactctgaagattatgaagcccggtgctagctgatcaataccgctcttggctaggtcgttgacgaagaggctctgattgaggccctcgagactggttcgccatccgctgctggcctcgacgttcactaccatgagccgcaggtctccccgaggctcgcggccatggacgccgtcaccctgatcacccatattgccggaggtgcgttgaacacccgcatcaactttgagctcaattccatggagaacattctcgcgactgtg

SEQ ID NO: 36546 - DNA, 4015 bp, Aspergillus nidulans
gggctggaccttgccagtgtccgttcctcgtttcgtggagacgttttgtacaatgatgagctcgatactcacctggcgcatctaactgtgggggagactctgacatttgcttctcgtgctcgctctgtacgacacgtaccgggggccttcagccgcaggcagctggacacagcacgccgcgatgtcatgatggccactttcggcttgaatcatacaatcgatactcgcgttggagatgacttcgtgcgtggagtcagcggaggagagcgcaagcgagtcagtattgcggaagcatctctcgccggggcgaaattccagtgttgggataattctacgcgcgggctcgacagcgctaatgccattaacttctgcagcagtttacgccttcaagcagaccttcttgatgtaacctctgtggttaccttgtaccaagcaccgcaggcggcctacgatgtaaggctaccaaaattaagtttatttcggtaccaactcttgctgataaaattcgtctcatttctattagctctttgatcgagtgaccttaatctatgagggaaggcaaatattctttggtcatataaccgaagcaaaaggttatttcgagaaactgggcttttttggtgagttcttgagcgtgaatgagtcgtgtgccttcaggtcgctaacatctttcaaagctccttctagacaaacaatcccggattttctcacgtctatgacgagtgcggaggagcgacgtgtgagacctgggttcgaggaatcagcgcctcgctcaccggatgagttcgcagaacgatggcggctaagcgatgaaaggaggaagctactggatgagctggcatcatacgagcagaaacaccccccagaggtgcgaatggcggagtacgaccggtccaggcgagctgaacaggctcagcagcagcgcgccaagtctgcttataccatatcataccctcagcaagtttctctgactctttggcgggcttaccgaagactgctagctgatcctggtttcacaatcgcctccttgctcttcaacgtcgtgatggcgcttatattgggtagcatgttctacaatctcaagccagatacctctagcttctattaccgtggagggattatctacttttcgctccttttcaatgcatttgcaagtcagctcgaggtgattccgtctaagctcaatttttcggtacggtgggacagcttttctaacctaactggaatataggttctgactatctatgccgagcgcccagttgttgagaagcagaatcgctatgccttctatcaccagtctgctcaggcgattgcgagctacctgatggatctaccctacaagatcatcaatatgtttgttttcaacattctcatttacttcatggcgaatctgaggcgagaagcgggtgctttcttcttcttttgtctcaccacacttctcagcactttagttcaatcagccgtctttcgcacattggcctgcattactcggacttccgagcaggctatgatcccaagcgccattttaagtcttgggctcatgatatacacgggatttacaacgccgccggggtatatgccgggatggtcgcggtggatggcgtatatcaaccccctatggtacggttttgaggctttgatggcgaacgaattccatgaacgggacttcccatgtgctagcatggtgcctaccggacaaggatacgctaacctcccatcggcatcacaaatatgctctgttgtgggctctgaagttggctcggcccttgtcaatggggatagctacatcagcaagtcgtttgactattggaacgtacacaaatggaggttagtgaattccaaaaacacgattgatacagaaggacagtgcactaacgggtctcgctcgaataggaatattgggattctctgcggatttctagcaatctttttccctacttatgtgcttgccgccgaacttgccaagccacctaagacacgcggtgaaatactggtattcggtcgtggcaaaggattccatagaagggaacagcccttggatgctgagagtcaagaaaaggatcgtccagtagtggcagataaaacgcacggttcactgcagtctgacacgattattgctgggaaggacgtgttccactgggaggatctctgctatgatatcaaagtcaagggtgggacccgccgtcttctagaccatattgatggctgggtcaaaccgggggtatctactatcctcatggtaagaactatcactataaaagggatatggagctaagcgtcgccttcctagggtgtatctggcgcaggtaaaacgacactcctagacgttctggcaacccgtgtcaccaccggtgttgtgactggccaagcaatggtgaacggaaaaccgacagatccgtctttccagcataaggttggctatgttcaacaacaagatctccatctgagcaccatgacggtccgcgaagctctacagttcagtgctgtccttcggcaatccgccgaaatacccaaatctgaaaaactagcctatgttgagcaagttattgacacactggaaatgcgagaatttgcggatgccgttataggtgttcctggagagggcctcaatgtcgagcagcgcaaacgcctaacaattggtgtagaactggccgctaagcctcagctcttagtcttcttcgacgaacctacctcggggttggattcgcagacctcatgggtcatttcagagcttatcaagaagctcaccaatagtggtcaggcagttctctgcacaattcatcaaccatctgccattctgtttaaccaatttgatcggctgcttctgattgcaccaggaggaaagaccgtatacttcggcggtgagttcttttgtctacctctgatcaatggctgatctgataatattcagatctaggccagggtggcctcaaccctgatacaatatttcaaaaattggggcccctccctggccaaccgaaagcaaacccaaagagtggatgcttggggtttcgaacccgcctgctatggctcaaaagggcttaattggcatcaaatatggttggctcctcccgagtatcaggcagttaaagctaagcttggtcaccttcgaaatcttcgtacattaggatctacacgcggagagggtcttaaggttgaaaacagctctcagcaccaggagttcgtggcttccttctggacacagttcagccaagtcttgcaacgtacctggaagcatttttggcgatcaccgacttacatctggtctaaaattatactggtcgtcctttctgtacgtggaactcgtcgtcagctctctgcaagggactaatcatattttgactatcagtctctttacttagggttcagtttcaatgtcaacaattcgatacaagggcttcagaatcaactatgggccatctttatgttgctcattttgttcatcaacattactgagcaaataatgcccatgatacaaaccccaacgagcgctatacgaggcgcgtgagcggccttcgattatttatcgatggacaagtaagactttgcccgtcacttgaggctttctgcatattttaacttacctcttgaagcatacctactctccaatatcctcattgagctcgtctggcagactctcatggcagtcttactgtacttctgctggtattaccctgtgggcttcgtccagaacaccacctccgatgaccaagctatccgtggtttcgccgtatttctattcctatgggtttatctactatttaccagcacgatggcgcacttcgccatcttctggataaaccttccggaaaccgctggcgtgcttaccagtcttttatggatgctgtgcatcttgttttgcgggcgagtaaaaactcaacatgctgatttcatcgtatgctaaccagaaaacagagtgggagtatccatggccgatctacccaaattttggaccttcatgtatcgtgtgtcccccgcaacatatctggttgggggcataaatgccacccccagc

SEQ ID NO: 36547 - DNA, 3488 bp, Aspergillus nidulans
atgtctttgcctcagcggccggggaagacttccccgcgaagagaagagacgtcggccttccgagagccttcgcgcagacgacggcgcgaatctgacagtctaagtaacaatgaccccacgagtccacggcatcacagacatcaccgttcgcatagttcacgacaccaacatgatatagacgaggagcgggctgaagagggtgggataaggcgaaagaggagtttggttaagccagaaagaggtcgcatggatccgagtcacccaaattacctttaccgccaaaaaacccaaaacatgcccacgtacaatccaatgacaggtaacgaaccgctgatacatgaagagggagaagcggagacaaacagtacaccgagtatggattcgaagcgcaaagatgccctgtacggtgcgcatgggaatgtcaacaagcccatggagcgggtcccgacaagacaccgatcgaagaagaggaagggctccagaaaaatctccaaacgcgaggcggcggcggagaagagaaggcggaaagccatggagcaggtgcgacctcccagcttatggacaacatactgttcagtgatcacattttgggcgcccgacttcgtcttgaagtgctttgggatgccgcaaaaagcccaacgaagcgcgtggcgggaaaagatcggtctcatcagtataatcctgatgatcgcggcatttgtcggtttcctcacgttcggtttcacggctactgtatgcggaactcctcccacgcgattgaaaatcaatgagatcggcagcggctacatgatattccacggtcaagcatatgatctgaccaagtcaacgcatcctgcggccgcgggtataccggacatgaccaatgtcctttatgacctgccgcacaagtatggaggccaagatggaagctttttcttccaggaggtaaacggagcttgcaaggggttaatcacgcggaccgagaattctgatattcccactaattccaacggtgaccttgcctggtatttcccatgccatgctttcaaccaggatggctcatccgagcccaacacgacggtctcttattacaatggctgggcttgccatacatctgggtcagcccgtaagtctttttacagcttgaaaaactcgggtgatgtctatttcacctgggaagatacaaagaacacaagtcggaaacttgcagtctactctgggaatgtgcttgatctaaaccttctgaactggttcgacgatacccaggtgaattacccaacgaaattcaaggaccttcgtgataatgatgatatacgcggagttgatctcacatattacttccaaaccggcgaggacaagcaaatcggcaaatgtttgtctcaaataatcaaggttgggagtatcgacaccgacacagtgggctgcatcgcctcccaggttgttttgtatgtgtctctgatcttcatcctgtctatcgtcattgtcaagtttgcctttgcgcttctttttcagtggttccttgctccaagatttgcggcacagaagactagcatgggcgcggtcgactcgaaggctcggaatcaacagattgaggattggtcaaatgacatctaccgacctggtcctcgtcttgcggaccccgttccaggtgatcgaatgagcaaaagggccagtttcctgccgaccacttcgcgcttctctagcccgtatacagtgagcaacggtggaaagcagaaaccccaatgggtaaccatggcaagccagaattctaccactcgattggttccccctgccagcggcactactccgtccatatacaggcagagtcacaacggtagcggcaacgtgagtgtggataactcacgggttaacccatctgctagcagaacaagcttggttcaggattcacgttattcgactgttataccggactctgagggcattgggtcggccggctacgtgcatgagcttgttgtccctcaaccaccccctgactggcagccctatggctttcctctggctcatgcaatgtgcttggttacctgctactcggagggtgaagaaggtattcgcacgacattggactctattgcgttaacggactacccgaacagccataaatccatagtcgtgatttgtgacggtatcatcaagggtaaaggtgaagagttttccacacccgatatgttctccgcatgatgcgggatcctatcatccctcggaaaaagtcgaggcattttcgtatgtagctgtcgctaccggttccaagcgccataacatggacgaaggtctatgccggattttacgactacggagaacactccatcatccctgtcgagaagcagcagcgcgttccgatgatgatcattgtgaaatgtggcacgccggcagaagcaactgctgcaaagcccggtaacagaggaaagagagacagccagattattctcatgtctttcttgcagaaggtcatgtttgacgagagaatgaccgagctagagtatgaaatgttcaacgggctcttgcacgtaactggtattccgccagatttctatgaggttgtgctcatggtcgacgcggataccaaagttttcccggacagtttgacgcatatgatctccgcaatggtcaaggaccccgaggtgatgggcctgtgtggtgagacaaagattgcaaacaagactgatagctgggtgaccatgatccaagtctttgagtgcgtacttatcctctcatcatgtccagtcgggcgctaatagtgttacaggtactttgtttctcaccaccagtcgaaagcattcgaatcggtgttcggtggtgttacctgtctcccagggtgtttctcaatgtatcgaatcaaagcacctaagggtggccagaactactgggtgccgattcttgcgaaccctgatatcgtcgaacattactcggaaaacgtcgtggacaccttgcacaagaagaacttgctgcttctgggtgaggatcgttatctgtccactctcatgcttcgaacgttccctaagcgcaagcaaatattcgttcctcaagctgtttgtaagacagtggtgcccgacaagttcatggtgctcttatcccaacgacgtcgctggatcaacagtacagtccacaacctcatggagctggtcttggttcgagacctgtgcggtacgttctgcttcagtatgcagttcgtcatcttcgttgagctggtcggaactgtcgtactccccgccgccatttctttcaccatctacgtcgttgtttcttcaatcatcaaacagcctgtccaaatcatcccgctggtcttgctcgcccttattcttggacttcctggagtcctggtcgttgtgacggctcaccgacttgtctatgtcttgtggatgcttgtatacctcatttcgctgccaatctggaacttcgtcctccctacgtacgcatactggaaattcgacaacttcagttggggcgatactcgaaagaccgctggtagaaggacaaggggcgttctcccc

SEQ ID NO: 36548 - DNA, 674 bp, Aspergillus nidulans
gtcacacttattgtaccgtttgcgtacctcagcgttctaatcggctcccttgcaactttctcatccctctaccgcaagcgcaaggccagtacgtctcgtcaaatactctcaaacaaattcgatcaaatcactaaccgcatcccccacaaacaggaaaggccacatccctagaaccatggtttccgtcacatctacaacgagacatctacttttcccttctgcaccttgacccgcccgcctcagcaacagagaagaaggtcgcggtccccgagtcggtcctcaaggcggcgctactccgccgcgctcaagaagacattcgccgcgtcatgacccttcgcagtcagaagcaggctctttccgtacttcttcagcggggaagtgtgggcgacgacctttggcagaggtttctgcgggcggagaaggagatggaggatgaagtgcgggatgttgttactgaggtaatcgcccttttcgctttttctcggaattttattcagtagatgggatatgctgacgttactgatgaacaggcaaacgcgtacgcccccaactggggccaggtaatcttccagtcggcaaacgaaatggttaacaacgagattgtacgcgagcggttagataaacaccagaagaaacttgatgaggagaaggcttggtgggagaagaagaaggct

SEQ ID NO: 36549 - DNA, 3111 bp, Aspergillus nidulans
  unsure (1)..(3111): unsure at all n locations
gtgggagacattgtccgcgtcgagtccgaacagcctttcccggccgacttggttctcttggcctcttcggaaccagagggtttatgttatattgagacggctaaccttgacggcgagacaaacctcaaaatcaaacaagctattccggaaacatcgcacctggtcagcccggctgacctcagtcggctcagcggacgcattcgctccgagcaaccaaacagtagtctgtatacgtacgaggcgactttgacaatgcatgctggtggaggagaaagggagcttccgttagcgccggaccagcttatgctccgaggagctacgcttcgaaacacgccatggattcatggcgttgttgtttttaccggccacgagacgaaactgatgcgaaatgccactgcgactccgatcaagcgtactgcagtggagcgtatggtcaatatccagatcttgatgttggtcagcattcttgttgcattaagtgtggtcagttcggtaggcgacttgatcatccgccagactgaaaaggataagcttacctacctcgactacggcagcaccaaccctgggaagcagttcatcatggacatcttcacgtactgggtgctctactcgaatctggtccctatttcgctctttgtcaccatcgaaattgtcaaatactcgcaagcctttctgatcaattccgacctggacatctactacgacgttacggataccccggctacatgcagaacatcatcgttggttgaagaactaggtcaaattgaatttattcttctcggacaagactggtactttgacgtgcaacatgatggagttcaaggagtgtacgataggcggcattcagtacggagaggatgtggccgaagacaggcgggctaccgttgaggacggagttgaggtgggcgtgcacgattttaaaaagctgcgccagaacctagagtctcatcccaccaaagatgcgatacatcacttcttgacgcttctcgctacttgccacaccgtcattcccgagcgatccgaagcggaccccgataaaatcaaatatcaagcggcatctccagacgaaggagctcttgttgaaggtgctgctcggatgggttacaagtttagcaacagaaagcctagatctgttattatcacagtggcgggacaggagtacgagtatgagctattggcagtttgtgaattcaactccacaagaaagcgcatgtccacgatcttccgttgtcccgatgggcgaatccgcatctacatcaagggtgctgatacagttatcctcgagcgtctacaccaagacaaccctatcgttgaagggacactgcaacatcttgaggaatatgcgtcggacggtcttcggaccctctgtctggccatgcgcgaaattcctgaggatgaattccagcaatggtatcagatatttgacaaagccgcaacaacagtcggcggtaaccgtgcagaagagctcgacaaagctgccgagcttattgagaaagatttctaccttcttggtgccaccgccattgaggacagattgcaggatggtgtgccggatactattcacactctgcaaactgccggcatcaagatctgggtcctgactggtgacagacaggagactgccatcaacatcggcatgtcctgcaagttgatctctgaggacatgactcttctgattgtcaacgaagacagtgctgaggcgaccagagataacttgacgaagaagctccaagctgtccagagtcagactgaagccgaacaaatggcccttattatagacggcaggtctttgacgtttgcactagagaaggacatggaaaagctgttccttgaccttgcggtgctgtgcaaggccgttgtttgctggtatgtttctcactcgcttcccgaaagaaaggcgctaacagttgcagtcgtgtctcgccccttcaaaaagctcttgtcgtcaaacttgtcaagcgtcatctcaagtcgttgcttttggctattggcgatggtgccaacgacgtgtccatgatccaagcggctcacgttggtgtcggtatcagcggtgtagaaggtttgcaggcagcaagatctgctgatgtttctatcgctcaatttcgttatcttcgcaaactgcttcttgtgcatggtgcttggagttatcatcgaatcagtcgtgtcattctgtactctttctacaagaatattgcgctttacatgacgcagttttgggtaagtctactacttgttcgaattgtctcaagctaatgttcccagtactccttccaaaatgcattctctggtgaagttatctacgaatcatggacactatcattttacaacgttttcttcacagtccttcctccattcgccatgggtatttgcgatcaattcatctctgctcgtctcctagaccggtatccccagctatatcagcttgggcagaagggactgttcttcaagcgccacagcttctggtcgtggatcgccaatggattttaccattctctgctactgtatatcgtctctcaactgattttcctctatgatctcccacaagccgacggcaaggttgccggccattgggtctggggctcggcgctgtacaccgccgttctggccaccgttcttggaaaggcggcactgatcaccaatatctggacgaaatacacgttcatcgctattcctggctcgatgattatttggctcgcgtttcttccggcctatggatatgcagcaccggctattgggttctcggaagaatactacggcactatcccccggctttttacctccccgatcttctatntgatggccattgttcttccttgcatctgtcttttccgcgattacgcctggaagtacgccaagcgcatgtactaccctcagcattaccaccacgtccaagagatccagaaatacaacgtccaggattaccggccccgcatggaacagttccaaaaggcaatccggaaggtgcgccaggtgcagcgcatgcgcaagcaacgaggttacgcgttcagtcaggccgacgagggcggacagatgcgtgttgtcaatgcttatgataccacgaggggaagagggcgatacggagaaatgaccagctcgcgaaatttggtttga

SEQ ID NO: 36550 - DNA, 2068 bp, Aspergillus nidulans
ctaccagttcatacaatatatcgggtacaggctgcccttccgcgccctatcgcgtactcttcttgcattccagcttggccatcgtactctgatccttcgtcatctgtcatgaatatcagcatatcaaagtttgcgtcatttctgatagccaccgacctgctgggcggagcttttcaggcagagacattcgactacgttgtcgttggcggaggaacagctggcgtaaccctggcggttcgtcttgcagaagcctcgcatagtgtcgctctcatagaagccgggacatactacgaagacagctggccgttcgctgctattcccggcgcagatgtcatccctgtgggatcagatcctgatgccaagtttggtgcggattgggggtttgtcacagcaccgcaagctggtgcagatgggcgcaggatacattttgcgaggggaaagtgtgtaggggatcgtgagtctgcctaatgcaagttgagaacaggattggaatgctgatagtggagagaagctctgcgtctaattttatggtatatcaaaggttcgtttcttgcttgaatgtgactttaggtatgtgacagcatggtttaacgttccgcaggccgacaaaagactccatgcacatgtgggcagaagctgtgaacgacaccagttacacattcgagaatacccttccattttatttacggactgtcactttcacccccacctgataagagctcaaggacggccaacgcgagtgtccagtacaatgcggaatcctttggcgcatctggcgggccgctccaggtctcatattccagcttcgtccagtccttttccacctggatgaaacgtggaatggctgccatcggattgtctgagagcaacgatttcaacaatggccgactcatcggataccagtactgtgcatcgacaataaaacccggcgacaaaacccgcaacagttcccaagcagccttcctttagaaaggcaaggctttaccggacaatttgacagtgcacacccagcgcctcgcaaagcggatcctcttcgatgagcacaagagcgcaattggcgtagaagtagcaaacggctttggttacctttcaaacataacggcatccagggagtcatcatctcggccggcgctttccaatatccccagctccttatggtctctggtattggacctgcggagcagctggcgaaacatgggattgaggttatatctgacttgcaagtcggacaaaatatgtgggatcaccccttctttgcgctgagctaccgggtaaatgtagaaacgcttaccagggccgccaacgacctcctctacctcggtaccaccttcctcgactatacgacgaagcatacggggcccttgacgaatcctgttgctgatttcattgcgtttgagaagattccttcgtctcaccgtacggctttctcggctgagacagagaagcatcttgcgggattcccggaggattggcctgaggttgaggtatgtggctgcatgaccaccctacaatcacatttacatcgaaccaagactgaagccatccagtacatgtccggcgcagggtacgttggatcattcactgggctcatgagcacccagccaaaggacggctaccagtacggctccatcctcggtatcctgatcacacctacctcaggcggtaatatcaccctcacttcagcagatacttccgaccccccgtcattaatcctaactggctagcaacggaagcggatcaagaggccgcaatcgccatcttcaagtgcatccgtgacatcttcgccagtgacgggatggctcccgtgattctaggcgacgagtattatccgggtaatgggacgcaagctgatgcggagatccttcggttcatccagaagaatgttatgacactttggcatccatcttgtacgaataagatggggacgaaggatgatccgtctgccgttcttgatagtaaggcgagggtgtttggggtcggggggcttagggttgcgaatgcgagttcatttccgtttctgccgccagggcacccgcagagtacagtttgtgagttaccttgccgttgt

SEQ ID NO: 36551 - DNA, 1718 bp, Aspergillus nidulans
atgggcaaaggaaagatctgtgtcgccttcagcggtggtctcgacaccagcgttatctgttagtctttccggttctgtcaattgattccccgcgtgctccaagctgatcgagaacacacagtgaaatggctcatcgatgagggctacgaggttgtcgctttcagtaagtaacatcttcaattggaacttgattgtctgctctgatactaacaaattatcagctgccgatgttggccaggaaggtaaagcgatcactttgaaatgcccaccgctacttgcgctctgacactcccgccttctagaggacttcgccgccatcaaggagaaagctctgaagctcggtgccgtcaaggccgaagttgtcgatcttcgccgtacgtgtttcgaaaaactgctaaatttcacaaagaaatagaattaacgcagtggtaaacaggcgagtttgttgaggaactctgcttccccgccattgcttgcaacgccatttacgagaacgtctacctcctcggtacctctctggctcgtcccgtcattgctcgtgctcagatcgaagttgctaaggttagccttctaatctgcaatttatttctctaagcattgacttaccaattgtaaacagcgggaaggatgctttgctgtctcccacggttgtaccggcaagggtaacgatcaggtccgtttcgagctcgccttctacgctctacagcccgacatcaaggtcatcgctccttggcgtgacccccgtttctacgagcgcttcgccggtcgcaacgatctcctcgcctacgccgctgagaagggtatccccgtcacttccaccaaggccaagccctggagtatggacgaaaatctggcccactgctcttatgaggctggtatcctggaggaccctgacatcactcctcccaccgacatgtggaagcttactgtcgacccccttgccgctcccgacaagcccgaggatttcaccgtccacttcgagaagggtctccccgttaagctcgagtacaccgagaacggccagcagaagactgctacggacgctgttgacatcttcttgactgccaacgccatcgctcgccgtaacggtatcggccgtatcgacattgtgagcctgctctaaattgattgggtcgagcctgaggctaatatatactaggttgagaaccgtttcatcggtatcaagtctcgcggctgctacgagacccctggtctcacctgcctgcgctccgcacacgtgtaagtgaagcttgtgcgttttccgtcggataaatctaacctgccgttcatagtgaccttgagggtcttgtgctcgaccgtgaggttcgtgctctgcgtgaccagttcgttactatcaactactccaaggtttgttcagcccttacatagctcagtcagtgttgcttacgatccgctagctcctttacaacggtctctacttctctccggagcgtgagttccttgagcaggccatccctgcctcccagaagtcggtcaacggcaaggttcgctgccgcgcctacaagggcaacatgatcatcctcggccgttcctctgagaccgagaagctgtacgatatgtccgagtccagcatggacgagattggtgactttgctcccaccgagactaccggattcattggcgtgtctgccatccgtctgaagaagtacggtcagatgaagcaggccgctggcgagaagctgtaagatgtgatatcg

SEQ ID NO: 36552 - DNA, 827 bp, Aspergillus nidulans
tacgatgaggagcaggtccgtcttatggatgaggtctgcatcgtcttggatgacgatgataagccgattgggagcgctagcaagaaaacatgttcgtgtccttccctccaacccctcaacccctcccttccccgctatcataactcataatccctaattataatggaagcattgtattgccgtcgccgatctaatattaaaattgtgcaggccatttaatgacaaacatcgatcgcggcctcctacatcgcgccttctccgtttttctcttcgactcccagaaccgcctccttctacaacagcgtgcctccgagaaaatcacctttccggacatgtggacgaatacctgctgctcgcacccgctagggatccctggtgaaacggggtcgcagctggacgcggcgatcctgggtgtaaacgcgcagcgcagaggaagttaaaccacgagctggggattaagccggaggaggtccctattgagaaatttgagttcttcacaaggattcattataaggcgccgagtgatgggaagtggggagagcatgagagtaagcagtacccggggtgatttcgggccggattggctggttggtgtacagtggctaacaaaacgctccttgctagttgactatatcctctttatccaggcggacgtcgttctcgagccaaatctcaacgaagtccgcgacacgcgatatgtgtctgcggacgagctgaaggagatgttcaagcagaccaatctgaaattcacaccgtggttcaagctcatctgcaactcgatgctgtttgagtggtggagccaccttggttctccttcactggatcag

SEQ ID NO: 36553 - DNA, 1312 bp, Aspergillus nidulans
acaagttccgccccgtctactgtcttcccgcggagccatgtcggtttcgatagcatcacgtctcagatcgaacggaagctgctgaagcgcggcttccagttcaatgtcatgtgtgttggtaagagccatctatctccttccagctggcccgatgtgcttgatactaagcccatgaacaggacagacaggtcttgggaaatccactctgattaacactatcttcgcctcgcacctcatcgactcgaaaggtcgcttgacccctaacgaacccgtacggtcgaccacagagattcaaactgtttcccatagtaggtggacgttccgtaccatcaggaacttcattctttaacggacctacagtcattgaggagaatggcgtccgtcttagactcaacatcgtggacactcccggatatggtgaccaagtcaataatgacagatggtataagactacacctgttgcttcttgacttcattctggctaacatgtcactagttgggacccaattgtgaaatatatcaaggaccagcactcggcatacctccgcaaagagcttactgcgcagcgtgaccgctacatccaagatacccgcattcactgctgtctgtttttcatccagccctccggccatgcgtgagtttagaagacctatcggcatgtgttgtgtacacgtagctaattacttatttgcttctgaaaagtctgaaacctattgatatcgtcgttctgaagaagctgtccgacgttgtcaatgtcgtgcctgtgatcgccaaagccgattcgctcaccctcgaagaacgccaggcgttcaaggagcgaattaaggaggagtttgccttccacaacctcaagatgtacccgtacgacaatgatgagcttgacgatgaggaacgtgctgtaaatgcccgcattaaggtatgaatttccctggcgtctaattgaggtatctcggtctaatgatattaggacatcattccttttgccgttgttggaagtgagaagactatcgtcgtgaacggccaacctgtccgtgggcgtcaaaaccgctggggtgtcatcaatgtggaggatgagagccactgcgaatttgtttcactgcggaacttccttacccgtacccatcttcaagatcttatcgaaacgacaagccagatccattacgagaccttccgtgccaagcagcttctggcattgaaggagagcagcgctgcgggcggtcacactagcggcagccggccgattagtccctccgctgacagggaactaagccgcaactcgcagcgtgtcacgatgaacggctactagctgggc

SEQ ID NO: 36554 - DNA, 348 bp, Aspergillus nidulans
caaaaccgataggattcggccaacatctagaccaccgactcccaacctcaatctaacctacaagaagaacaaaaacctgatccaaacgccctcatcaaatcccagtacgataacgatcccctactgaaatcatatattccatccgccccctcggaacgcatcatgcgcgctctcctcgcggaacctccactctcgtataatgcatcacgcgcgggtccgcccttaacgggaaaggcgccccgaaagttctgctgtatatgcgggtattgggggaagattcggtgtcgaaattgtcaccagcgaacttgtgggatcgagtgttataagacgcacgaggattcaaggtgc

SEQ ID NO: 36555 - DNA, 1195 bp, Aspergillus nidulans
cctaccctcgccatggtacccattccacgagcttgtcgtcttgtcggcctctatggccgtcgaagctactcgacggccccgagcccgtcaacccgcctgaacctcccaatagactacaaatcgacgcctctccttcaccacaccccatcctccctcgcgaactccctgaacctcccaccctccagtacgtccaagtcaatgaacctctatacagcaatcaacgccgcactccgcaccgccctttccaaatcggacaaggtcatgctcttcggcgaggatgtcgctttcggcggcgtgttccggtgctcgatggatctgcagacggaatttggatcagagagagtcttcaacacaccactgacagaacaagggattattggttttgcgatcggggccgcggcagaggggatgaaacccgttgcggagatccagttcgcagactacgtctttcctgcgttcgatcagattgtcaatgaggcggcgaagtttcggtatcgggaaggagcgacgggggggaatgctggtgggctagtaattagaatgccttgtggtgctgtaggacacggagctttgtgagtttcaatgtaacgggcgaggatacgagaggctaatgaccctgcaggtaccactcgcaatcgcccgaggcgctctttgctcacattcccggtctccaagttgttatcccccgttcaccgtcacaagccaagggtcttctccttgcgtcaatcttcgaaagcaaaaacccagttgtgtttatggagccgaagtgctctatcgggcggcagtggaacacgtccctagtgaatactacacgatccctcttaacaaggcggaggtgatcaaacccggcaatgatgttactatcatttcgtatggacaaccattatatctctgctcggcagccatagcggccgccgagaagaatctaggcgcaagcgtcgagcttattgacttacggaccatttacccttgggaccgacagactgtgctggacagcgtcaacaagacgggacgggctattgtcgtgcatgagagtatggtgaactttggtgtcggtgccgaagtcgctgctactatccaaactggcgcgttcttgagactggaagctccagttcaacgagtggcaggatggagcacgcataccgggttgacatacgagaagctgattcttcctgatgttacaagtgagtataat

SEQ ID NO: 36556 - DNA, 1644 bp, Aspergillus nidulans
ttgtcgcctcgccagctcaatgtcgccgtccaggtcttctcgctcatctgcatcttcttcgagggttacgaccaaggtgttatgggcggcgttaacgccgcgccgtactatgtcaccgaagtcggaatcggcaagccggatggcactgtgactgacactacccatcaaggaggcattgtcagtatctactaccttggctgtatctttggctgtttcgctggaggctggctggctgatcgcattgggcgtatcaatggactgtttatcggtgccgtcttcgcggtcattggaggtgctctccaggcagcgattcaaagctcagatttcatgctcgtcgccagagtcgtgacgggcgttggcactggaggtacgtatctcatctctccctacgcactgctagttatgggcctgtgctgatcgaacagcgctgactggcattacgccggttctggtatcagaaacctcgtctgccgaccaccgtggcggattcttgggctatgttttcattgccaactgtatgttcctcgcctgaatttccccttgttctcgacgcaccgcatactgatcctgcagacctgggaatctcggttgcgtactggctatcgttcggcttggccttcatcaataacggatactctgatatcaggtggcggttcctgcttgccttccagtgcgttccagcgatcttgctggtcttcttcatcaagatgctccctgattctccgcgatactatgcctctgttggtcgtaatgaggaggcccgtgatatgttgacaaggctgcgaagccacaaagcaagtcaggccgagatcgagcaggagtacatggagattgtagccgtggcccaagacagcaagcccagttcgccgatccagtttatcaagatcttgataggcaagagcgggcggccgggaagcaatctcagccgacgggcctggttgtgtgtgtggcttcagattatggcttcgtggaccggtatcacggtatgagaatcctacccggtcgtatcgttctagctaaaccgcgtcaggctgtcacggcatactcgcccactctcctcagtcaagctggatacagcagcctgacccaaaacggcctcgcaggaggtctcaacacgattggtattgttggaaccatcatcagcgcgcagatcgtggaccgaatcggtcgaagaatgtgcttgatgctcggtgctctgagtctcttcatcgttgaagttatcgtaagtttgccccttttatcagaatagacccttactgatccgctaaggccggctctgtctatgaagcctcccttcacaacccagaaaaagcggctgactacgcgcccgctgcagtcgcaatgctcttcctgttcaaccttgcctatgcctcgacttggggcaccgtggcattcctcgttccaaccgagatattcccgtctgacctccgtgcccagggcaacgggttcggcattaccgggtgggccattggcgtcgggatgaccaccttggtgaacccgatcatgtttgccagcctgaaaagccgaagctacttccttttggccgggttcaatctcctgtggattccgatcgtgtatctgttctaccctgagacccgtaaccggtcgctcgagtccattgacgctttgttctcgacgccaagt

SEQ ID NO: 36557 - DNA, 952 bp, Aspergillus nidulans
atgccagccaagatgcattccaactacccctccgattcggagactgcggaactaagagactctactgagtcgggctatgtcagtggtggctcaagtgaagagtatctaccagagattgtcttcaccaaacctcatcttcagttcctcaaccgacaacttcaattccttgaaccccaaggtcagctcttccacattttcagttcaagacaacgacgcctaacccctcttgcagatgtcctcagatggtgtgtcacttcgctacctcacctgtatcagaccaccgcctttggtcttactggtcttgtgatcatggatatgctttccaaactgtccatccctcgccctcaaatggtcaacctcatcttcctcgacactctgcaccacttccccgagacattgaaacttgtcgacaatgtccgcaagaggtacccgctacagcacatccatgtctacaagccccagggtgttgagaccgaagaggagtttgctaagaagcacggtgaacgcctgtgggaaaaggatgaccagctgtacgactggattgccaaggtcgagcctgctcaacgtgcctaccgtgagctcaacgttcacgcagtcctcaccggacgccgccgcagccaaggaggcaagcgtggagacctggacattattgaggtggacgaagccggcctcattaagatcaaccctctcgccaactggacctttgaccaggtcaagcagtatgtcaaggagaatgatatcccctacaacgagttactcgacaagggctacaagagcgttggtgactatcactctacatcccccgtcaaggagaacgaagacgaacgatcaggccgctggaagggccaggcgaaaaccgagtgtggtatccacaaccctcggtcaaagtacgcccagtacttgatggatatggaacgcaagcgacaggaggaagctttgtctcaagcgttgc

SEQ ID NO: 36558 - DNA, 1443 bp, Aspergillus nidulans
atggcttttttcacggtcgctctttcgctttattacttgctatcgaggtgagatctctacaatatctgtctgcttagttgaattggtacttatctgtacagagtctctactcaggccccagtggtccagaatcattcatgcaatacggcggacggtggatatcaatgcttccccaatgtctctcatgtttggggtcagtactcgccgtacttctccatcgagcaggagtcagctatctctgaggacgtgcctcatggctgtgaggttacctttgtgcaggtgctctcgcggcatggggctaggtatccgacagagtcgaagagtaaggcgtactcggggttgattgaagcaatccagaagaatgctacctctttttggggacagtatgcttttctggagagttataactataccctcggcgcggatgacttgactatcttcggcgagaaccagatggttgattcgggtgccaagttctaccgacggtataagaatctcgccaggaaaaatactccttttatccgtgcatcagggtctgaccgtgtcgttgcgtctgcggagaagttcattaatggatttcgcaaggctcagctccacgaccatggctccaaacgtgctacgccagttgtcaatgtgattatccctgaaatcgatgggtttaacaacaccctggaccatagcacgtgcgtatcttttgagaatgatgagcgggcggatgaaattgaagccaatttcacggcaattatgggacctccgatccgcaaacgtctggaaaatgacctccctggcatcaaacttacaaacgagaatgtaatatatttgatggatatgtgctctttcgacaccatggcgcgcaccgcccacggaaccgagctgtctccattttgtgccatcttcactgaaaaggagtggctgcagtacgactaccttcaatctctatcaaagtactacggctacggtgccggaagcccccttggcccagctcagggaattggcttcaccaacgagctgattgcccgactaacgcaatcgcccgtccaggacaacacaagcaccaaccacactctagactcgaacccagccacatttccgctcgacaggaagctctacgccgacttctcccacgacaatagcatgatatcgatattcttcgccatgggtctgtacaacggcacccagccgctgtcaatggattccgtggagtcgatccaggagatggacggttacgcggcgtcttggactgttccgtttggtgcgagggcttactttgagcttatgcagtgcgagaagaaggagccgcttgtgcgggtattagtgaatgatcgcgttgttcctcttcatggctgcgcagttgacaagtttggacggtgcactttggacgattgggtagagggcttgaattttgcaaggagcggcgggaactggaagacttgttttacccta

SEQ ID NO: 36559 - DNA, 663 bp, Aspergillus nidulans
ctcctcgccggaactggtgcccaagtcctcctcaccggccgtagccagcctcccatcgattccgccaaagaccagcttggtgacaaggcccacgttgtgcaatgtgacatcacctctttatccaatatcgagaagcttgttgaagagtccaagttcgtgttcgccgaccaaatcgacttcctcttcatcaacgccgggtacgcatgccttgagcccgtggcggcagtcaccgaagagtcctttcaccgaacaataaacaccaacgtctttggcgcattcttcgttgctcagaaattcatccctcttatccgtgacggcggcgcaatcgttttcactagctcagtatctaccaagcacggcttccccggtttggcggcatactccgcgtcgaaggccgctgtctcttcgctcgtgcagacgctggctgccgagctggtggaccgccagattagggtcaatgcagtgtgccctggattcatcaagacgccgaccatgggtgtgtctggcgtgacgccagcagacctggttgcatttggagaagagggtgagaagctcactccacttgctaggaatgggactcccgaagaggtggccaaagctgctgtctttcttgcatttgatgcgacatttaccacgggcactgaccttgcagttgatgggggt

SEQ ID NO: 36560 - DNA, 1369 bp, Aspergillus nidulans
ttgcagcaaaataattaacggcgactgttgtaggttgacccgtcggcctccgaggcccagctgagaagcgcttacaagaagggtgccctcaagtaccaccctggtaagtgaccatatagacgagagcgaagtggagcgatcggtatcctaacgtgctttgtgcagacaagaaccccaacaacccagaggccgctgaaacattcaaggaaatgtccaaggcgtacgaagttctctccgatcctcagaagcgtaacatctacgaccaacttggtgaagagggtcttgaaggcggtggcggtgccggtggaatgggcgcggaggatctcttcgcccagttcttcggcggcggcggtggtttcggcggcatgttcggcggtggtatgcgggatcagggccccaagaaggctcgcaccattcaccacgtccacaaggtcaacctggaagatatctaccgcggcaaagtatccaagttggctctccagaagtccgtcatctgtcctacttgcgacggtcgtggtggtaaggagggcgctgtcaagacatgtgctggctgtaacggttccggtatgaagacgatgatgcgccagatgggtcccatgattcagcgcttccagactgtctgtcccgactgcaatggtgaaggagagaatatccgtgacaaggaccgctgccgcaactgccatggtaagaagactgttgtcgagcgcaaggtccttcacgtccacgttgatcgtggtgtcaagaatggccacaagatcgagttccgcggtgaaggtgaccagcttcctggcgtcatgcctggtgatgttgttttcgagattgagcagaagccccacccccgattccagcgcaaggatgacgaccttttctaccatgccgaaattgacctccttactgcgcttgctggcggaacaatcaacattgagcaccttgacgaccggtggttgtctgtaacaatcgcccctggcgaggttatcacacctggtaagtccttttcttttcgcgcgcgctccgcgcgaaactctcgtggtaccaacgtaacgcaattataggtgtcatcaaggttatcaagggccagggtatgccgtcgtaccgccaccacgatcacggtaacctctacatccagttcgacgtcaagttccccgaaaaccacgaacttagaaacctcgaacttttggagcaggttctgcctccccgacaggagacaaacaggcctcctgcggacgctatggtggaagactttgatttggaggaggttgataacagcgagcgctcacaagcacgcgctcacggggcggccagcatggacgaggatgacgatgacgttcctcctggcgctgagcgggtgcaatgcgcttctcagtaatct

SEQ ID NO: 36561 - DNA, 896 bp, Aspergillus nidulans
ccgcaatcccagccctagaagcaccgcacaatctcgagcctgtcatcgcagccaacaccgacatcaaagcaaacaataaacccagcctcgacaaagagtactcaagctcgatgcacccgaagcaaaacatccaatctttcggcatctcctactctccctacaatgccgacaatacctgcaagtcccaggagcaggtaaatatggacattgacagattaacccactacgccttcgtccgcatctacggtgccgactgtgaccaagccaaaaaggtaatcaccgccgcccgccgccataacctccaagtcttagcaggcgtttacgacctccacaacctctacggaaacctcaagaccatcatcgacgctgcaagaccagatctctccaccctccacaccatctcaatcggcaatgaactcctcagccgcggtcagaattctgccggggaagtcactgccgccgtcgaaaacgcccgcgcctacctccgcacattaggctacactggccccgtcgtcacaattgacacattctccaaggtcctcgagcaccctgaactctgctatgtgtccgactactgcgccgccaactgtcacgccttctttgatgcaacacaatcccctgaaactgcaggctcctacgtcgctgacgtctcgcgccgtctttccgaggtgtctaacggaaaacgcacgcttatcactgagtccggctggccgcataaagggcaaagcaacgggaaagctgtgccgtctaaggagaaccagcagaaggccattgagagcctgcgtaagacgttctgggataaccatagtgatcttgtactatttagtgcgtttgatgatatgtggaaggtcgacaatcaatggacctttggggcggaaaaatattggggcattgaa

SEQ ID NO: 36562 - DNA, 1327 bp, Aspergillus nidulans
gtcgatacggaaaccatgctgcaattttaccaacgcctgttccctttccgctacttatttcagtggcttaaccatgggattgtcccctctcccgacttcgggaaccgagagttcgctctgacacttcaaaacgatgcttatttacgatatcagtcgtacccaaccgcggatctgtaagttggcgcgcacgaagttactttggatgatattctaacatttgcaatgtaggtttcgcaaagatattctcaagatgaacccctcccgtttcgaaatcgggcccgtttacaataggaacccgcgagatagaaagacactcggcagcggacaactaaaacccctcgccaaagaactcgtttttgatatcgatttaacagattatgacgacattcgtacctgctgtacaaaggcgaacatctgcgcgaaatgctgggcattcgtgacaatggccatcaaggtcgtcgacacggctctacgacaagacttcggcttccaacatattctatgggtttactcaggacgtcgtggtgctcacgcctgggtctgtgattctcgcgcacggaatctctcagatgaccggcgtcgaggcatcgcagggtacctcgaccttgtcaggggaggcacaaacagcggcaagcgcgtcaatctcaaacgaccgctccacccccacatgacccgcagtctggagatcttaaagccatacttcgtgcaaaccaccttagtagaccaagataccttcgccagcccagagcaagagcaacgccttctctcccttctccccgataaggggctcaatgactccttgcgccggaaatgggaatcagcccccgaccgctctagcacaaacaagtgggctgacattgatgctcttgcaaaggccggtaaaagctctactcttaaccccgctaccctacgcgaggccaaacaagatatcgttctcgagtacacatacccacgtctcgattccgaggtcagcaagaagatgatccacttgctcaagagcccattcgtcattcacccgggcaccgggcgagtttgtgttcctattgacattcgtaatgtcgagaagttcgatcctctctccgtacctactgtctctcaattgctctcagagatagactcctgggactcagaccatcctagtagtggcgccgcggagactgcagaaggcgaagggagcgctcctaacgcctctgacgctggaggcacccgtaaattacaggactatgagaagacaagcctgaaaccgtacattgactacttccgttcgttcattgcgggccttaacaaggaggagcgcaatgggaagcgagagcgtcacgaggatagt

SEQ ID NO: 36563 - DNA, 1576 bp, Aspergillus nidulans
gcggacccaacaaaccacatcacaaaagcccaggcacgcacgataaccaagcgcctcgcccacgtattccggtctgaatttggtattggtgcagacggccccggtaaagatgctgttatgtgtatttcggcgaatcaagttcttttgcctgccgtgttctgcggtatcatcggagcagggggtgtctacacagcggcatcgacggcgcttacggcttcagaagtctcaaagcagctaaggcagtccaggagtaaagtgattgttgcgtgtccggagaatagggccaaggcgcgggacgctgcgcgggaatgtggtataccaccggatagggtgttggtactagagagtatggggcaccggcggcttttatgccaaggtaatttcgggaggaattacctgcaagcaacggcagagctggattgggagcggattgcggatattgatgcgctggaaaataccaccatctgcctgctctattcatctgggacaactggtccgcccaaaggggttatgttgtctcacatgaatcttgtttccgaagccctattcactcagttggtgttgcgggactctaaagaagggaagccacatctgaacgttccctatcgaacagtcggacacctccccacagcccatattgcagggtgtctgggatgtttcatcacacccgcggttgccggagggacagtgtactggatgcccaggtttaatatcgatgagttcattgactattgtaagaagtatgcagtgaccttcttgtcaacggccccgccggtttaccatggaattgtgcggagtgaccgcgtgacagatcagttcaagacccttgtccgggccgagtcaggtgcagcgcccctgagcttagagcttcaagagcaagcggaaaagatgctgggatgcaccatcagtcagcgttggggaatgaccgaatccactggaagcgtgactaccatgccctggggacaatccgacaataccgggggtatcagtccgttactacccaatatgaggttacggctcgttgatgaacggatgagagacgttagaagtggagacgagggcgagatcctgctcaaagggccgatgatcacgaaaggttatttcgaaaacccggaagcaactgcagaagccttcacaacagatggctggtacaagactggagatatcggagtctataaagatggaaaaataatcatggttgaccggaaaaaggtaagcacataagcatcaccatcgaagtgaactgctaaccctcgcccaggagctcatcaagtacaaaggattgcaggtctctccggtagagatagaaggattccttctcacacatcccggcgttgcagatgttgccgtggtcggcgcacgcgatccagaggctccaggtaacgagctacctcgggcatatgttgtgatcaaggctggaagcagtgtctctgaggcagagttaaaagagtacgtcaagtccaatctggcaggccacaagcagctccggggtggagttgtattcatagacgagatacccaaaagtgcatcaggaaagatcctaagaaggatactgcgggaccaagcaagaagctcg

SEQ ID NO: 36564 - DNA, 522 bp, Aspergillus nidulans
gctcttgtgcattacgactatgagaaagcagaggataacgaggtagacctgagggagggtgaattcgtcaccgaaatcgaaatggtcgacaaagattggtggttgggatcgaacgcccaaggggaaagaggactttttcctagtaactatgttgagctccttgaagatggtcgtcagagccgcgccgagtccgatacccggcctgctgatgcccatgaatctgaggcactagccgatcctactccaacctcaggctctcacgttaagcccactgccaaggctctttatgattatgaggcggccgaggataatgaactcagctttcctgagggggctgaaatcataaacattgtaagtcaacaactcccacccagtcttttatccacagttctcaccaaatactctgttcctcgggttaaaataattaattatcttgttctacaataggaattccccgatgatgactggtggctaggtgaattccgtggcaaaacagggctttttccggcgaactatgtccag

SEQ ID NO: 36565 - DNA, 1513 bp, Aspergillus nidulans
aaaaagacgcaattcgcgacgccgactttcaagcagcaggactatccctatcggctgaacttctacgatacaccacccactgcagagattacgcttgagcagtttgaacaatgggctattgacagactgaaaagtgcgaacctagatctttatttttgtatgacttgctgttgactgtgatagtcctcgccgaaatcgaggcatgctcctatcgaaacaagaccgctgccgagacaacggcgcacatcacgcctcttctccagaagttcctacccctctcagcgaacacatcgtctccaaaaggtgccgcagatccccgaatcaagaatgaacggcaaaaagaccattattcgcactttattctccgtctggctttttcagccaccgaagatcttcgtcgccggttcgcacgagcagagactatgctcttcaggttccgctttcaggcagatgactctcgagaacgacgcgcatttatcgatagtctgaacctcgactgggaatctgtaggtgaagatgagagacgcgaactatccgagtatctggtcgccgcgacgccaggtctgcgtcgctccgatgaagacacatggtacaaagtggattgggaaagagtaccagaactcgtcgaaagacgctctgtttttctgtccaaagggaaagcatatgttccggaaagagagcagctaagtatgatcatcgctgagttcactgcgcgacttgaacgtgccttagaggtatgtgaattcagtttgcaattgagtacgaacattgagctgataactactagctcacaagtagagctttgccccgcctcgatgaggatgatcgcctctcccccattctgaaccacctatctaagaacttcggaagtgcggagtccgtgtacacagaaggcgaaggcttcgtggatggcgctccaattaccgccgccagcattgatcctctttcacaacatttcccgctctgtatgcgtagcctccacatgtccctgcgcaagaacaaccatctgaaacattttggtcggctccagtacactctgtttctcaagggaattggtctatcccttgaagagtgtattctgttttggcgccaatcgttcaagggcttcaccgatgaggagttcaactcccgttacaagtacaacgttcgccacgcctatggtgatgtcggtggagatatcaaccgaaggggtcgcggctacccaccatattcatgtcaaaaaattcttagcgatacaaaccctggagcaggacagacgcatggttgtccgtatcgccacttttccgttgataacctaatcggacttctccaatctaccggcgtgaacgacaaggacttgttgcgcggagtacgcgaagatgtcgagaagactcgttatcacattgcctgcaaccgagtattcgaatatacacacaaagccgaaatcaagagagccaaggaagacggctcagcgggtgaaatcgaacttgataccattgttcaccctaacacttacttcaagcgcagttatctc

SEQ ID NO: 36566 - DNA, 1534 bp, Aspergillus nidulans
ttccttagcaacgagttcgtgccgtcaaaggcgagcacatggtatgacttgtatgacacggctagcaatagcctcgtcagccgtgtgccccagagtaccgatgaggaactccgcgccgctgtcgaagcggcccagaaggctttccctgcatggagggctacgagtattatggctaggcagcagattatgtttaagttcgtgaacttaatccgtgccaactgagaaaagtttgcctgcgtcgcattactctcgagcagggcaagacactttgctgatgccaagggtgatgtcctccgtggtctgcaggtcgctgaaactgcctgtggcattaccacgcagatcaccggtgaggttctggaagttgccaaggacatggagaccaggagctacagggagcccttgggagttgttgctgctatctgccctttcagtatgttttcccgcacgcgtctttttatggcaaacgctaatgagtctagactttcccgctatgatccccctctggtgtattcctattgctactatcaccggtaacactatggtgatgaagccctccgagcgtgaccctggagcggccatgatcctcgccgagttggccagggaagccggcttccctcccggtgttattaacatcatccacggatctgccaagaccgtcgacttcatcctggatgcccccgaaatcaaggccatcagctttgttgacggtaaccgtgctggagagtacatctacactcgcgggtccgccaatggtaagcgtgtgcaggccaaccttggggccaagaatcacgctgccgtgcttcccgacgcaaacaagaaccagaccatcaatgctattgttggagctgctttcggcgctgcaggtcagcgctgcatggctctgagcacactggtcacagttggtgaaaccaaagagtggctgccagagatggcagagcgtgccaaggcgctgaatgtcaatggaggcttcgaagagggcgctgacctcggccccgtcatcagtcctgagagcaagaagcgtatcgaggatctgatcgctagtgcagaagaggagggcgccaccatcctcctagatggaagaggttacaagcctgaaaagtaccccaatggcaatttcattggtcccaccattatcaccggcgtcaccccagggatgaagtgctacaagcaggagattttcggccccgtccttgtctgccttgaagttgagaccctagatgacgcgatcgagctcatcaataagaacgaatatggcaacggtgccgcgatcttcacccgctccggccctacagcctccagattccagaaggatattgaagccggccaggttggaatcaacgttcccatccccgttcctcttcctatgttctccttcactggtaacaagaagagtattgccggtggtggtgccaacactttctatggcaagcctggtctccagttctacacccagcagaagacagtgacgagcttgtggcgcgctgaggatgccgtcagtactaaggctcatgttgtgatgcctacacactcataa

SEQ ID NO: 36567 - DNA, 2678 bp, Aspergillus nidulans
ttaccaccttacattgaggaacttctcatcctcatcaacttcccttctcgtttgatccaagagattatccgcgttcggctatcctacgcacggaatatgaaggacccggcacaacaatcccccatcctggttgaccagatgattacacagttccagattctgatgagagctgccgtagatatcaagcaacggtatcttgatatcgcccgaccggaaccgggctgggatcttccaccctgcatcgacgaaagctttgatagtgtcgtgctcgatgctctgcgatactactttcggctactcaattggaagttgcaagcaaacaagaacacgttcaaagaggcggaaattctggagcaggaatgggatttctgtaacgaaatcggtcgtcagcttgatagcggtgatattgaagttgcggagcagtttaggtaaggccaacactgtcccacatagtgctattatgctaacttttacagtgtcttgactgctagggctatccatcgcttgctgattcattttgagcgcgagctgcacgtccaggaggatgaagacccggcggagctggataaacgatttaaaggtatcctggattcaactcgtattcggcaacggaagctttaccgattctctcggtttttgcgccaattgtttgaaaacgcctctgaatataatcttccggcggacatctcatgggacttcttcgaagccctgtttgtatcggatcactttcttatcaaatccaatgcgtcctccgctcagaagggtgtttattactttgcgcatcctgcgctctggaaccgtccagatgagattgcggctattctcggaacatcattccgtgaagaagaggtcgggaaagagctcacccatgtgccatacgtgcttgctgtacgtcctgaaaagccgttatcctgggcgggcaaagagatgcaggttgagctggttgagcaacccaccgacttgcggcttgggaagctgcgccttatcgttgagggatcacagcagcgcctagtcaacgcgaggcttgaactaactcacttgaccggcattcaactcgacatggccattgagcaacgtgcaaaccttagtcgtgtcaacgccgaactcaataggattaagaagatatcgttcaaactctccatgactattatggacagcgtcgcgattcttagaagacagttaagggagaaaggcgtggaaaacaccgaactcattcaggcatcgtacgccttcgcgacagaattcggtaaacgttcatcgaacgttgatcctaaccgacgtgcaatgaacagtgctagactggcagagttatctttagactgggtctcgttcatctgtgatgattgtgatgctgctgatcggaagaccttcaagtgggccgtggctgcccttgagtttgcgatggccataacgtctagcagacatcttctttcaatggacgatgcacattttgcacgattgcggcagaaagtggcgggctgtatgtcgcttcttatctctcactttgatatcatgggcgcacggtcttcacgtgcagcccaggctgagaagcaacgtatggatgaaagcgctcgttcctggaagattggcgctggccgaatccttactgacgaggaagccatgaggctcgttcgtgagcagcgtctcataagcttgaatgccatcgaggaaggtcgggttgaggcagatgccaaacgtcaggctctaggaagggttcttgaaggaacaaatgaggctgataaatctctcgcggtgttatcttcgtcggcgacgaacgtaacattacgttggcagcagggtcagtacatcggaggtggtacatttgggtctgtctacgctgcgatcaatctggacagcaattacctcatggcagttaaggagattcgtttgcaagacccacagcttattcctaagatctcgcaacaaatccgtgacgagatgggtgtcttagaagtcttggatcatcccaacatcgtgtcataccatggcattgaagtccatcgcgacaaggtgtacatcttcatggaatactgctccggtggatccctcgccaccctccttgagcatggccgtgtcgaggacgagacggttatcatggtttatgcgctccaacttctagaaggtttagcgtatctccatcaatccggaatcgtgcaccgcgacatcaagcccgaaaatattctgcttgaccacaacggcattatcaagcacgtagatttcggagcagcccagatttatgctcgtcacgggaaaactttttctgcctatggacgccctcggccaccggaggaataaagatggcattaaccctaaagacaaccaggtcgcacccaaccggggcaagaaccagaaaaccatgaccggaactcccatgtatatgtccccggaagtcattcgcggcgacaccagcaagctcgtacaccgccagggcgccgatcgatatctggtctttgggctgtgttatcctggaaatggccacgggccgtcgtccctggttgagcctggacaacgagtgggctatcatatacaatatcgcccagcgcaatcagccagcgctagcgtctcgcgatcaactcatcgatttgggcctcgatttccgtcgtctctgttatgaatgtgatcctatgaaacggccaaccgcggcggaactgctccagcacgaatggattgtctcgatc

SEQ ID NO: 36568 - DNA, 1555 bp, Aspergillus nidulans
tcaatgacggcccctcatggtctacaatcttctggaagcgtaaagtcaaagaggggctcgcgacccagtgcggggactactagccagagaagctcaaagacccattcattactgagcgttggagctgctgtcccaggcacagacatggaagcctcaccttcccagagcagaagctcatctgctgaaggatcttactcgacaagcgcgaccacatttgatgagggtgagccggcttcaactaagtcaaaggaaaccaagggaaatgtcatagtcagcgtaagggtacggccaaatgttggtggtgagagctcggcgaaccccgagtggatagtggatgctcgtcgaggtctacttgtatataatgggaaagagggcggtgattactactatggtaagacccctgtcctgtgagatctctgcgccagctaactgattgctagataacgttttctcggcaatggaaaataacgctcgagtctacgactcggctgccaagcgtttggtaaggagggtgatggaagggtaccacggcacagtctttgcttatggtatgaccggaactggtaaaaccttttctatgcagggaaccgcaacatctcccggggtgatccccttggccatcacggacatattctcatttatcagagaaaccccacatagggagtttttacttcgcgtcagctatctcgaaatctacaacgagaagattcacgacctcctttcagcgtccactgggtcttcttcagaggacatcaaattacgcgaagatagcaaacggggtgtctacgcaactcctttaaaggaggaaattgtgcagagtccgacacagctcctccgcgttattgcgaggggtgatcatgcaaggaggacaggcagcactcagtttaatgctcgcagctcgcgaagtcatgcagtggttcagattgttgtcgaaagtagggagcgagtacctaccggcacaacccaggacaggagatctggtctagccccgggcggggttcgagtatcaacactgagcctcatcgatcttgcaggatctgagcgagcggcagatgacaaagaacgacgaactgagggcgcacatattaacaagagccttctcactctgggaaatatcatctccaggctgtcagaaaccaaaggcaagacagctgctgacaaagatggcaaacatctgccttttcgtgacagtaaactcacgaggttgctgcagccagctctctctggcaattcgctggtcagtattctttgtaccgttcaactgagcagcttggttgcatcagagactctgaacaccttgaagtttgctgctcgagccaaaaacaatattgttagccatgccaaaagggcagaagaggcgtttggtggcggcggtggtgatgcaggcagccgcgtgctacttgaacgttaccgtatggaaattcaagacctgggttgtcagcttgaaaaccaaacgaaagcccaggccgagaaagagcttaagctggaaaaaaagaagttagatcaggaggctcaagagcgccacgaagagcagatgctcgaaatgcagctagct

SEQ ID NO: 36569 - DNA, 159 bp, Aspergillus nidulans
cgcgccatgtatgattatgatgccgatgatcacacaagtctgagtttccgacaaggagatgtcattcaggttctcaaccagctcgaaactggctggtgggacggtgttatcaatggcaacgttcggggctggtttcccagtaactactgcgctgtcatt

SEQ ID NO: 36570 - DNA, 2295 bp, Aspergillus nidulans
tctttggccaaggacggtgtccgtgtcggtgttgttaatgttcgcgtttaccgtcccttcgtcgaggaggagttcttgagggtccttcctaagtctgtgaagactgttggcgtcctcggccaggtcgccaacgaacaggctgtgcaagagccaggcgtccgttccactctttacgaggacgttcttgcggccgttacatttgccaccgaccgcgagcaggcgccttcttgcatcgacatcaagtacgctcgttctcagcgctgggacttgatcaacattgccgcttccttccagcttgtgtcagacaagcctattgtgcaggtggacagcactgttgagcctcttcagctcttggaccctgcgactgtccaggagttcacattctgggatgttgacacttccgccgctgtcgacgtcgccaccattatctcacagaccttagccgctgattcggcgagcaacatcaccaccagcaaggcgtttgacaacctgattcagggaggtgttgttcgtgtggacattcgcaagagctcaaagactttggatgctccatacccggtcaatgcagctgacactgcatacatcggtaacgttaagttgcttagcgaactcgatattctctcttcagtcaagaacaacggcaaggtccttttgaacgttgccggtattaagggtgacgagctggagaagaagctccctgccgccttcaagcaggccattgcggagcgcggaattggtcttcaccgctttgatgcgtctgttatcgaggaacctgctcttgagcccctggctttgcaggtcgctttcttgcacgtggctctccctgccattgaggagtctgctgtcaagaagctcgctgccatctccggcaatgccgattctctggacaaggtcagcaaggatctggagaagaccctcctacaagccgaaatccccgagtcatggaagtcccctgaggagggtgctgaggtagctcaactcgtcaaggacttgaagcctaacagctttgtacctttcgacaaggacgagagtgagcctgctactttcctcaaggactggcaaactgttgcaaagggtctggcgttcaaggaagcctatggtgcgcagaatgcacttcgccctgacttacctacgaagacctttactgttcacgtcaaggagaaccgccgcctcacccctgttacttatgatcgtaacatcttccacatcgagttcgacctgggtgactctggcctcacctacgacatcggtgaagccctgggcgtgcactgcgagaacgaccccgaggacgttttggaattcattaagttctacggtcttaacgccgacgatgtcgtcgaggttcctagccgtgaagatcccaccgttctcgagaaccgcactgtctaccaggctcttatgcagaacgtcgacatcttcggtcgtcctcctaagcgattctacgaggcgctcgctgagtttgcctccgacgagaaggagaagaaggacctcctcacccttggtggccccgaaggagcggtcgaattcaagcggcgtgccgaagtcgacaccgtcacctacgctgacattctgctcgagtacccctccgcccaccctgacttccacgacctcgtccgcatcgtctccccattgaagcgccgcgagtactccattgcctcatgccaaaaggtcacgcctaatatcgtcgccctcatgattgtcgtcgtcaactgggtggacccccgcggtcgcgaccgcttcggtatttccacccgctatcttagccgcctccagcccggcaccccggtcactgtcagcgtcaaatccagcgtcatgaagcttccccccaagtccacccagcccatcatcatggctggtctgggtaccggtcttgctcccttccgcgctttcgtgcagcaccgcgctctcgagaaggcgcagggcaaggaaatcggctccgttctgctctacatgggctcgcgccaccagcgtgaggaatactgctatggtgaggaatgggaggcttaccaggaagctggcgttattactcttctcggttgtgctttctcccgtgaccagccgcagaagatctacatccaggaccgcatgcgcgagaccataccagagatcgtgcaggcttacatccgcgaggagggatccttctacctctgcggccctacttggcccgttccggatgttacggctgtgcttgaggaggctattgccattgaagccaagaacactggcaaaaagattgagcctcggaaggagattgagaagttgaaggatgaggagagatatgtgcttgaggtttat

SEQ ID NO: 36571 - DNA, 899 bp, Aspergillus nidulans
atgcgacggttaacgcagaacgccgactctgttgtcagcctatggtgcttggctcactgtcgtcctttatgctctctcatcgcccatcttgtcctagataacgccgcattgtcgagaattgtcgcggacagattacacgtgcaagacccttccttccagcagacgaaccgcctcgcatgtctcttatataacggtgctgaaggtcctttgctgacgatctgtaggtgtctactgtcatgtctgcctccatcaccacgctccgatacctcggtcatatgcataatgacctcgtcgggcatatcgcatccctcattcccacgccgcgcagccatttcctactcacctcatacacgccttttacgggagataatatcgatcaggccaagacggtccgaaaaacaaccgttctggatgtcatgcgccgtctgctgcagcccaagaaccggatggtctcgatcaaccccagcaagtccagctgctacattagtatcctcaacataattcagggtgaggcggacccaacggacgtgcacaaatcgctgctccgtattcgcgaacgacgcctagcgtcgtttataccttggggtcctgctagtattcaggtggccttaacgaaaaaatctccatacattcaaaacacacaccgagtcagtggcttgatgctggcaaaccacacctctgttgccacattatttaagcgaatcgttcaacaatacgaccgtctgcgaaaacgaaatgctttcctagaacaatacaagaaggaagctccattccaagacggcctcgatgaatttgatgaagctcgcgcagtggtaatggatcttgttggggagtatgaggcggcagaacgagaaaactacctcgacccagatgcgggaaaggatgaagttggagtataa

SEQ ID NO: 36572 - DNA, 1326 bp, Aspergillus nidulans
cagatctttgcggacgatgttattgaggagaaaggagagaatgcacgtctctcggccttcgtcggcgccatcgccgtcggagatctcgttaagagcacattaggtcccaagggcatggacaagattttacaatcagcgttagtggcggatgtgcggatcgcggggttagcagactgactgtgtgcaggtccaccggagaaatactcgttacaaacgacggtgccacgatcctcaaagccattgcccttgataacgccgctgcaaaagtactagtcaacatttccaaggtccaggatgacgaagttggtgatgggacaacctccgtgacggtgttggccgccgagctgctgcgggaagccgaaaagcttgtcaaccgcaagattcacccacagactatcatcgaaggataccgtattgccagccgtgctgccctcgatgctctcgacaaggttgctgttgaccgcagtgacgacatggagaagttccgcaaagacctccactcgattgcccgcactaccctcagctctaaggtcctggcccaggaccgcgaccagttcgctgctcttgcctgcgatgccgttcttcgacttcggggctcaaccgacttgagccacatccagatcatcaaaaaagccggcggaaagctcagtgactcttacctcgacgagggtttcattcttgataagaagattggtgtcaaccaaccgaagcgcctggaaaatgctaagattcttgttgcaaacacagcgatggacacagataaggtgaagatcttcggagcgcgcgtgaaggtcgagtcaacagggaagttggcggaattggagaaggcagagcgtgagaagatgaaggccaaggttgagcggatcaaggcacacgggatcaactgctttgtcaaccgacaactcatttacaactggcccgaacagctgttcaccgaggctggtatcatgtcaatcgagcacgccgactttgacggcattgagcgactggcgctggttaccggtggagagatcgccttgactttcgaccaccccgaccaggtcaagctggggtcttgtgacctgatcgaggaggtcattattggcgaagataccctcatcaaattctccggcgtagctgctggccaagcttgcacaatcgttctccgtggcgccacagagcaacttcttgaccaagccgagcgttcgcttcacgatgctttggcagtactgtcttagaccgtcaaggatccccgagtgacttttgtggggggtgcccaagatggtcatgttcaaggttgccagcatgttttccaaacaccacggtagaagaaccttgtgtcatttg

SEQ ID NO: 36573 - DNA, 1899 bp, Aspergillus nidulans
actctcggcgagctcctaacccttcagagcctgcaatatggagactacgagtgtcttgtctttccctggaccggcgcgcgatggacatacgcagatctgaacgatgaagcggatcgcgttgcgcgcggcatgttggcgatggggatcaaaaagggggaccgggtaggcatcatggcggggaactgcgagcagtatatctcgattttctttgctgcggcgcgggttggtgcgattctcgtggtgctcaataatacatacacaccgagcgagctgtattatgcgttggatcataccggtactgactcctggttttctaatttttttttcttaaatggaactcagaatactgatcatgtttaagattgtcggttattatttttgaccccccgcatcaacaagcactctctcgaagacgtcctcgcggagctgggtccacacccaaaggcatccggaacatccaaagccctcgaagagatcgtcgtcattcgcggcacatacaaggacttcaccacctatgcgcaggtcatcgagcgcggcctcccgcttcctccaaacactctccccgagcgtgagagccagttacagaccgaagatgtctgcaatcttcagttcacgagtggctcaacggggaacccaaaggccgccatgttgacgcatcagtatgtgcccgatcatcaaccacccccggaccccaaacccaatggaaggtaactgacttgtgcgtccagcaacctagtaaacaactcgcgcttcatcggcgatcgcatgaacctcacctccttcgacatcctctgctgcccgcctcctctcttccactgcttcggcctggtcctcggcatgctggccgtcgtaacgcacgggtccaagatcatcttcccgagcgagacctttgaccccctcgcaacattgcacgccatttccgacgagaaatgcacagccctgcacggcgttcccaccatgtttgaggcgattctctcgttcgataaaccgcccaacttcgactgctccaatctccgcacgggtatcatcgccggcgcacccgtgccgcgacctctcatgaaacgcctgttcgaggagctgaatatgagacagtataccagcagctacggtatttctcccggtcatcttaaaccgtacaaagcccgactgatcaattgtacaggcctaacagaagcatcgcccacctgcttcaacgcccttacaacagacagcattgaaacgcgccttcagacagtcggaaaggtcatgccgcacgctaaagccaaaatcatcgatgcgaacggcgccattgtccccgtcggcacccgcggcgagctttgcatggccggctaccaattgacgaagggatactggaataacccagagaagaccgccgagacactggtcacggacgaagagggaacggtctggctcaagacgggcgatgaggcggttttcactcccgagggatactgtactataacggggcggttcaaggatatcatcattcggggtatgcactcctccccttcctctcccatcatcccccacccaaaccttgtattcaggggataatgctgacgatggtcgtgtctaggcggtgaaaacatctacccgcttgaaatcgaagagcggctcacggcgcatccctctatttccctttcatctgtgattgggatccaggattcaaaatacggcgaggtcgtgggcgcattcatcgcccttgcggagggcgctaagaggccgtctgacgatgagctacgggcgtggacgcgcgagaccctggggaggcataaggcgcctcagcatgtgttcgtgtttggggaggagggtgtcgacgccacggttcccgtgacggggagcgggaaagtcagaaaggtggatctgaggaagattgcggcggtggttttggagagacgg

SEQ ID NO: 36574 - DNA, 1265 bp, Aspergillus nidulans
gatggttggaacttgtattaccacctgggcgggtatgggccttggatcgagaaacttgacggtcctacacaggacatcaaaccaccagctggatgccatgttgaccaagtgcatatggtagtgtctacctccaatgcatttcactagtatattttctaaccgcagaataaatggcgcgccatggggaaagataccctacaaagaatgccggaagccgtgggttacgcattgattttactgggttgcgacgtatccaaatatctaactgcttctccaggccatcttgaccttctcgagcgaattaaggaagcaaacgtcaccctcaatggctcgttatcgtttcttaacaattgggattatttcaccagtactccggaggaagactttgatcaattaaccagaactggtccttactcgggcatgctaggtgcatttacaaccggaacgcgcctcttaacgcggtaccatcatctcctatcttcccagtccaacttcacgttctgggcaagcgattgccagcgcgtcattcaaacagcccagtatttcgcgctcgggctacttggcttgaactggggggacattgggagagccaagctcgaaatcattccagagacattcgaccgacgagcggatacactgacgcccggtgacacgtgcctgagataccttgaggacactgagaatggccacgataaaggaatgaacatgctcgctcttttccagcagtcgtatgctccagctatagcggaacgactgctattcgagcaggggaattcggccctaagagctctgacgaatatggacattttcagcatgcaggagatgtgtggcttcgaaaccctcgtacgaggctcgagtccatggtgtgatgtattcagccgcgaagactgggagaacttcgaatacgcccgcgatctcgtgcactactatagagctggcccgggaaacccgtacgctggtgcaatgggatggctgtggctgaatgctacagcaggccttctacaggaagggccaaaagctggaccactgttttttagcttgtaagtttgattataccctacatctctctgagggttcatagttaacgcgtgctggctagcgtccacgacggagatatcgcccctttcctggaagcactggatatcttgaaggatccgaaatatgaccccgaacttcctgctacgtacagggcggatgaccgcgtatggaaaacctcgtcggttttgccgatgggcggtcgcattatccttgaaggcattacctgc

SEQ ID NO: 36575 - DNA, 1579 bp, Aspergillus nidulans
gacgtcgaacaacaaaggcttggaaataaagaagcgagtgttccagaaatggactcgaactccgatatgtgggccattgatgagaaggctgagaagaagctcatcaggaagatggacctgtacattctcccttttgtggtcctcttgtatctctttagctttctggatagaggtatgctctccggccatgtgcacgctaacccgctaactttacatcacgtgcagtcaacattggaaacgctcgattatatggtctggaggaggatctgggcttggttggtgaccagtatcaggtcgcagtgtcgattctattcgtcacctactgtgtgcgtattgaacccgtcttgatccgatgacctgcatctaaccattaatggccgacagctttttgaggtaccctcaaacctcgtcataaaaaagcgttacaccatcacgttatattgcggccatagcaatcatctggggcgttatagcaactttgacgggtataacccagaattatggcggactcatcgcctgtcggctgctgcttggagttgtcgaagctggtctttttcctggcctgatgacgtacttgaccctcttttatagcaagcacgaaatcgccttgcgaacaggttaccttttcagtagcgcagcgcttgctggcgcatgtggaggtctccttgcttatgcgattggtttcatggacggcgtcagtggacttaagggctggcgatggatcatgatcattgaaggcatccccaccgtcattatcggcatcgcaacctggttctttctcgcggatgatcctgagacggcttactatctcaatgccgaagaaagagcattagttgtcaagtgccgcagtcggcactttggccacaccgcatccgcccaaaaatttcactgggcagacgtcaaagaaggcgcactggactggaggatttacgccttttgtatagcgcaatttggcgttgacactatgctctacggatacagcacctttttgcctaccatcattaagggactaggggactggtccgtgcccgaagttcaagccctgacaataccctgctacgcactaggcgccgtcgcatacttgatcgttgcatggttcagtgaccgtacccaacgtcgcggcctattcatctgcgtcttcgcggcgatttcagtagttgggtacggtatactcatttccgactcctcgtctggagtgcattactttggcgcgcttcttgttgcactgggtctttacgtcgcggtcgggctacctttggcctggttgcctacgactcttccccgctatgcgaaacgtacattcgccaccggcctgcaacttacatttggcaatgtcagtggggtgatgtcgccgtttctctacaaaaccgaggaggggcctcgttatgtgcgcggcaacgccgtgactttggcgttggttggctttgcagggataatctatgggatcatgtgggcttattatctgtggaagaacaagcgtagagaacagggttttgaagacgagaaggctgctggaaagacggatgaggaaattgaagagatgggcgatatgagtcctcgatatcggtatgctgtatag

SEQ ID NO: 36576 - DNA, 930 bp, Aspergillus nidulans
ttccgtcctgcgacctttgctcgttcgtatgcgacggtcgagtctgctcacgcgagaggcatttcgacatcagcactggcgcatgcgtcgggtactgactggatgtgttggaccccctaccccacatgaagaagacccaggtctaccgatgaaccccgattgccctccgagaagcgaaagatgcatacctacgaattggacctgaagaagaccggacctatgatgctgaacgcgttcatccgcatcaagaacgaaatcgaccccaccgtgccttccgacaaagttgccgtgagggtatgtgcggtagctgcgcgatgaacatcgacggagtcaacacccttgcttgcttgtgtacgtggccgtcagaacgatagcagccttgatatgcagcaggagttaacaatggcaggccgtattcctactgacgccaccaaggaatcccgcatctacccgttgccacacacctacgtcgtcaaggatctcgttcccgatttgacccagatctacaagcagtacaagtcgatcaagccttacctgcagcgcgataccaagaccgaagatgtaaggactttcgattcggttaaggtgtgaaatgactgaccattccagggccttgagaaccgccagagccccgaggaccgcaagaagctggacggtctgtacgagtgcattctctgcttctgctgctcaacctcctgcccgtcgtactggtggaacagcgaggagtacctcggccctgccatcctcctccagtcctaccgatggttggccgattcgcgtgaccagaagaccgccgagcgcaagcacgccattgacaacagcatgagcgtgtaccgttgccacactatccttaactgcacacggacctgccccaagggtctgaaccctgcccgggctatttccgagatcaagaagatgttggctgctcac

SEQ ID NO: 36577 - DNA, 2058 bp, Aspergillus nidulans
tgtgatgaatgccgtttacgcaagtccagagtatttcattcctttagagttattttaccttggcatgagcctaaccggtagtagtgctctaaagagaaacctacttgcgcgcagtgcaagcagctggacaaagaatgcaaatatagcccaaagataacaagaagccctctaacacggcagtacgtctgcatctgaactgtcacccctcgactatcatcttctcttatgccggtattaactcttgcttcaggcacttgacgtatgtcgaagaccgcttgcaggcatttgaatccgccttaggacggctatttcccggtggcgatctggacgccacagtgcgttctttattgcaggatcaagatcccctctcgaaggagcgctcttcatccaagtcttcctctagacattccacgccggcaaagaccgaagcagatcggcatgagtcagcaccagaagctttgccccagcaagccgatgggtttgactgggctgagaaccggattaccctcggagacctgacagacgggatggcagccctgtcaatcaaaccggaaggcgcaggctactttggtattcgctctatccccactcgcttttccacttaatgctgatcatccttcctaggagcgtcttcaagcgttgtaccgcttcgggcattgcttaaacatgggttcgacctcaatataccgtccggatcgtccaaacgcgtggataattcggacagggttccactgaaatcgcagcttttgaacatcgcgccttctggtgttattgaacaagcattcatggatgcattcttcaacaactatcatatgagctatccatttgtgcatgaggccactttcagggcgcagttccacgagcagcttccccgacctcatggaccagcatggcaaattctgctcaacacaattctcgctctaggggcttggtgcatcggagacgacaattctgacctcgatatcacgttctaccaagaggccagaagcaggttacagcaaatgtctgtgtttgaagccggcaatctcactcttgtccaggctttgctattcttgagtaattacgctcagaaacggaataagccaaacacaggctggaatttcttgggtttagctgtcaggatgtcgatgagtctcggactacataaagagtttcacggatggaaaatcagccttttgcaacgcgaggtccgtagaagactgtggtggggcgtctatatcttcgatagtggcgctgcgaagacatttggccgtcctatccttctaccggaagatagcgttatggatgtaaagcatgttctcaacattcatgacgaagcgctcacctcgacgaccacggttgtgcctcccgaggttaatgagccaactttgtacacgggaatgcttgcgcaggctaaattccacatactcacaaacagtgtctaccaacgtcttatatccgggccgaaccccacaccagaggagacccttagccttcagaaaccgatggaggaatggtataatagtctacccgattatatcaaaaatccggctcccggttcaatgtcagacaatttcgctctagtccgcagtcgactattgtggcgggattggaacttgagaatcctcatttaccgcccgatccttctaagatgggcttcgaaacgatggacgccgaatacgcccaccgagccagaagacccttacgaggctgagtgccggatgctctgcttccgcaatgccaaactgactatatcctccatcaccgatttcgtgaacaattatccgtgcaccagggttggtgcatggtatatgctgtgcgttcccctattttaccaccaattaattctctagatgtgacctcaactaacactcgctccctcgctacagttacttcctcttccaagcaggtttaatcccaatcatcctcctgatgacagatccaactagcgcagaagccccaagctggattcaggagatcgaagcaactaaagccctactcatgtacccttcattgagcaacaacaaccttgccggtcgttgtctcgacgtaatatatcgactttgcgcccctgtatat

SEQ ID NO: 36578 - DNA, 1184 bp, Aspergillus nidulans
tctcctcatttggaccttctcctctaacaatgtttaggcgacaaggtgcaccgcccgccgatatgggtgatgcgacaaggtatgctactctccatttctcctcaagctccttctgtgctcaatacaccatatatagacgaatggtcaactaacagttttgactcttgtagccggtcgctacctccctgaataccatgaagccaagggcaaccgcgatttcttcgaatgctgccgcgaccccgaaattgcctcaacgatcaccatccaacccgtcgaccggtatgagggtctcattgatgctgcaatcatcttctcggacattttagtcatcccgcaagcaatgggcatgacggtagagatggttgacaagaaaggccctcatttccccgagcccctccgctccccaaccgatggtcaatacgagaaggtcatggcgcgcgacgtcgatgtcaaggctgaattagattacgtgtacaaggctattacgcttacgcgaacgaagctgaatggacgggtgccgctaatcggattctgcggtgcgccctggacgctgctttgctacatggttgagggtggcggtagtaagatgtttatccagaccaagacatggatctataagtacccgaaggagtcgcaggcgctgctgcagaagatcgccgagatctgtgttgaatacttggcgctccaggttgctgcgggtgcccagctcgttcaggtgtttgactcatgggctggggagctgtcgccggcgtccttccaggacttctcactcccctatctgagacacatctcggcgaacctgccgcgccggttaaaagagatgggacttgaacccgtgccgatgacagtattcgcgaagggagcgtggtatgctctcgaggacctttgcgagtccggatacaatgtagtcgggctagactggctacatgacccggccgaggccttcaagattgccaacggacgggttacaatccaaggcaacgcggaccctggtgttctctacggaggccgcgaggctatcaaacaggctgtggagactatggttgctgggttcaagaagggcaagcaaggatggattgccaacttgggtcacggtatgctctttattcgtttatatcatgcagatgctaatttcctaggcgtcactccttttgtcaatccggatgacctcaaaatctactttg

SEQ ID NO: 36579 - DNA, 605 bp, Aspergillus nidulans
ggccaatttctcgaatccgtgtctccgtatgtctgggcgaatattggtattgcaatgtgcattggactatcagtagtgggcgctgcatggtatgatatgactcaataaacggcgaggtcgaggtttctgacgaccatctccaggggtatcttcctgaccggctcatcgattgtcggtggaggtgtcaaggctcccagaatccgaaccaagaacctgatttcgatcattttctgcgaagtcgtcgctatctacggtgttattatggctattgtcttctcctcgaagctcaacctcgcaaccggcgacgaaattcattcacccagcagttactacaccggctatgcgcttttctggggaggaatcactgttggcgcctgcaacctgatttgcggtatctccgttggtataaacggtagcggtgctgctctggccgacgccgctgatcccagcttgttagttccgcctcttcttgcatttccggtgggcagcgactaatgttttacaggttcgttaagattcttgtcgtcgaaatctttagctctgtcctgggcatgtttggtcttatcgtcggtctcttggtccagggcaaggccaccgagtttgga

SEQ ID NO: 36580 - DNA, 525 bp, Aspergillus nidulans
acagtgggaaagacgtctttgatcaccagattcatgtatgattcgttcgacaacacataccaggccacaattggaattgacttcttgtcgaaggttagtagaactcgctctgcttaaggacaattagctggctcatccagagcattatggcgattgcgctccatggaaatgctaacatctggtgttgtagacgatgtatcttgaagaccgcacagttcgactccaactttgggacaccgccgggcaggagcggttccggtccctgatcccttcctacatccgtgactccagcgtagcagtggttgtctacgatatctcaaatgcgaaatccttccaaaacactcggaaatggatcgaccatgtgcgcggtgagcgtggaaacgatgttattatcgtacttgttggcaacaagaccgacctgagccataagcgagaagttaccacagcccagggtgaagaagaggccaagaagaaaggactgatgtttatcgaaactagtacgaaggattggccataatgtcaagc

SEQ ID NO: 36581 - DNA, 1859 bp, Aspergillus nidulans
gaagggcacccaaggttctctttcaacaagcgacagctaccagcggacgcaactggtgtcaagaaattcaagactcccaatggtgtgaccatccgatacaaggagcctggtaaagagggtgtctgtgagacgacccctggtgtcaactcttactctggatacgttgatctatcgcctgagtctcacaccttcttttacttcttcgaagctcgtcatgacccggcaaacgctcctatcactctgtggctgaatggtggccccggaagtgattcgcttatcgggctttttgaaggtttgtactgcctgactgggttacaagaagttgatgtactgatgggcttcttgtagaactgggaccgtgcgctatcagcgagaacctgacgacctacgtcaacccatactcgtggaatgaagtctccaaccttttgttcatctcgcagccattgggagtcggtatgaaggaattgtgtcttgtttagtcgtgcagcttctcactgggccataggattttcgtatgcggaaacagaggaagggtcgctcaatcccgtcaccggtgtggtcgaggatagttctttcgctggcgtccagggtcgctatcccaaaatcaacgctaccctgaccggtaatttctccaacaacgtgcattgtcctagtttagagctaaagctgtactagataccaccgagctcgccgcgaaggccacttgggaagtcgtgcagggctttctcggtggtctacctcagttggacagcactatcaagtccaaagactttaatttatggactgagagttacggaggacactacggtcccgcattcttcaatcacttttacgagcagaaccaaaaaattcgcaacggaaccattgatggtatcgagctcaacttcaactcactgggaattatcaatggtatcatcgatgaggggattcaggtacgggatagacaagccgctcagcaatatctctctgactagaaactaggcacctttctaccctgagtttgcggtgcacaacacctacggcatcaaagccgtgagtactgtcttttcagcaaatggacgacataacttacaagctgaaaacaggttaacgagacagtctacaactacatgaaatttgccaacgagatgggcaacggatgccaggatcagattgccctctgcaaagcaacaaaccgttcttcttttgccgactatgctctctgctcggaggcaactaacatgtgcagagataacgttggtacgtacttctacctgagactctgggaaagtaatcagctgattatcttccacagagggactcctactacaggctacgagcaactcgaggcgtatatgacattcgccacccgcacaatgtaagccgttgatcctaatccaggttctctatactaacataggaaaaggacccaacacccccgaacctcttcgtccccttcctccagcaagactgggtcatgaatgcttcttggcgtgaacatcaactacacctcttccaataacgaaatttactatgccttccagcaaaccggtgatttcgtttggcccaacttcatcgaggatctcgaggaaatcctcacctacccagtccgcgtcagtctgatctatggcgacgcagactacatctgcaactggttcggaggccaagccgtctccctcgccgtcaagtacccgcattccaagcagttccaggccgccggatacacgcctcttcttgttgatggcgtggagtacggagagactcgagagtatggcaatttctccttctcccgtgtctatgaggccggccacgaggttccttactatcagcctgctgcgtcgctgcagctttttaaccgcactttgtttgggtgggatatt

SEQ ID NO: 36582 - DNA, 1759 bp, Aspergillus nidulans
tcctacgcgcttggcaacgtggcgccgaacattcaggccttttcagacgcttcgctgctgcgacgaagatcctggggacgatcgagcgagagtcaccgctgaaccccatgtctacagaggtggcaaactaaccagcgtgagaggtgagatcgagctgcggaatatccgccatgcgtatccatcacgaccagaggtgatggtcatggatcaattcaacctacgcattcccgctggcaagacgactgcctttgttgggccatcagggtcagggaaaagcacgattatcgggttgctggagcggttctacaagcccgttgccggggctgttctgctagacgggcacgatatcgagtccttgaatctgcagtggctgcgtcagcagatcgcccttgtcggccaagagccgcagctattcacagcgacaatctacgagaatatcaagtacggcctgataggctccgactttgagaaggagtctgaaagggagattcgcgcccgggtcgtcaaggccgccagggttgcttacgcgcgcgatttcatcaacaagttgcccgacgggtacgaaacgaatatcggcagcctggcactctctggcggccagaagcagacgatcgccattgcacggacgatcgtcaaggaaccgaagatcctgctacttgactaggcgacctgtgcgctagacacaaagtccgcgggcctggtgcatgctgcactgaaccgtgctgcagaggggcgcactacgactgacattgcccatccactgtcgacgatcaataacactcataatgtccgcctgatgaaaggcggcaggatcggagagcgacgaacgcactggctgtggctacacaagaacggggtgtatgcaaggcttgtccaggcgcagagtatgaaagaatgcggcgactatgattatgggcgtgataaagagcttggcatcctgtggcttgaggaggatgactctgacctcaatgactacggcaccgacgggggcgatggcacagatatgcaggctcggctgtggaagcgcgagagtgccatgttccctggcacggccgggccaaagtcgagacgattctcgctctggacgctggtcaagttcatcgccagcttcaacaagaaagagaagtacattatgggtttagggctgacgctctcgctcttcgctggaggcgtgcagccggcacagtcggtcctgctggcaaaggccgtcaacgccatctcgactcctgtcagccagccggagaagctgcgacatgatacaaacttctgggcctctatgttcctcatgacaggtctggtgactatatttctgtttggcacccagggcacgctgttcgcgttcagcgccgagaagctcatccgaagagcccgaagcagcacattccgcgtcctgctgggccaagatattactttcttcgatgaagaggataacaccgccggcactttgacgtccatgctggcgaccgagatcaaaaacctcgccgggatcagcggcgcaacgctggggaccctgctcatcgtgaccgtcaacctgtttggctccctgatcgtcgcctacgccctgggctggaagctagccctcgtctgctcatcggccgtcccattactcctgctctcagggttcctgcgcacctggatcctcagccgattccaggcgcgcggccgcactgtctaccaaaagtctgccagcgacgtcagcgaacgcgtcacggccatccgcaccgtcgtctccctgacgatggagcaggtcatctcaacg

SEQ ID NO: 36583 - DNA, 1016 bp, Aspergillus nidulans
gacttgactgggaacgacgagtatgcccgcttgagccagagagctgaagactaccttctccacccggagccagcgcagtacgaaccgttccctggattgattggaagcgcagtcaatattgccgacggcaagctcgccaatggtcacatcagctggaatggtggcgcagactcgtactacgagtacctgatcaagatgtacgtctacgatcccgaacgctttggcctctaccgggaccgctgggtcgcagctgccgagtcgagcatcaaccatctggcttcgcacccgtccacccgcccagacgtgactttcttggccacttacaacgaggagcatcagctgggcctgaccagccaacacctgacctgcttcgacggtggaagctttctgcttggtgggacattgctggaccgccaggactttgtcgacttcggccttgaccttgtcgccggctgccacgagacgtacaactcgactctgacgggcatcggccctgagcagttcagctgggaccctaacggtgtgcccgacagccagaaggagctgttcgagcgcgcaggcttctacatcaacagcggccaatacattcttcgtcccgaagtcatcgagagcttctactatgcatggcgcgtcacaggtgatggaacggtacgttcactcagcgctgcttccgtaggaagaccatactgaccgctttagtaccgcgaatgggtgtggaacgccttcaccaacatcaacaagtactgccgcactgcgaccggtttcgcggggctggagaacgtcaatgcagcgaacggcggaggccggatcgacaaccaggagagtttcatgttcgcagaggtgctgaagtattcgtttttgacttttgctcctggtacgtttccctagttctggttcacctgtggagaatattactgactgcagcagaggacgactggcaggtgcagaagggcagtggaaatacgtttgtctataacaccgaggcgcacccgtttaaggtgtatacgcctcagtag

SEQ ID NO: 36584 - DNA, 1379 bp, Aspergillus nidulans
atggcgccctccgcaatcgaccctccgacctcaacatctctgccctcctctatctctagctatcgtggctatgaccacgttcattggtatgtcggcaatgccaaacaagccgcctcatactacatcacccgcatgggtttcaagcgcatcgcctaccgcggcctggagacaaactcccgcgccatctgctcccacgtcattcgtaacggcgacattacatttgtactcacttcgcccctccgctcgctagaccaaatatcccggttcacacctgaagagcaagacctcctgagagagatccaccaccatctcgagcagcacggggacgcggtcaaggacgttgcgtttgaggtcgactctgtcgatgcggtgttcaatgcagcggtggcgaacggagccaaggttgtgaaaggcttgacaacagtggaggatgagaatgggaaagtgacgatggcaacaatccaaacgtacgggcagactacacatacgcttattgaacgaggcgcgtatagaggaactttcttgcccgggtacagagtcgaaacaagcctcgaagacccgatttcggctttgttaccgggtgtcctgttgaaccgaattgaccactgcgttggtaaccaggattggaatgagatggataagatttgtgaatagtatgtcctctccctgactaaaaaaaatatgtacagaggctaatgagagcagctacgaaaaagctcttggattccaccgattctggtccgttgacgataagcagatctgcacgtaagtcacctttaaggcaaatgtcacagccacgatgctaattcgcagcagcgagttttccgccctaaagagtattgtcatggcctcccccaatgatatcgtcaaaatgcccatcaatgagcccgccaaaggcaaaaagcaatcacagattgaagagtatgtcgatttttacaacggcgccggagtacagcacattgccctcctaacagacgacatcatccgcgacatcacgaatcttaaggcgcgcggcgtggagtttatcaaggtccctgatacatattatgaggacatcaagattagactgaagaaggctggattaactctacatgaggactttgagacaatccgggctttggatatcttgattgatttcgacgagaatgggtatttgttgcaattgtttacaaaggtaaccacccactctcacatgaacctacctatatgcaaggtaacggaaagctgaccgatgaaacgagcaccttatggaccgtcctacagtgtttattgaaatcattcaacgacacaacttttctggattcggagctggaaattttaagtcattgtttgaggctattgagagggagcaggcgctgcgaggcaatcttgtgtaaact

SEQ ID NO: 36585 - DNA, 364 bp, Aspergillus nidulans
actctctcggctaatcggtttcttcaacgccagcgcatgcaaaccgatccccccgcaggagtctcagcatccccggtggccgataatgtgatgacctggtattttctcctgataattattgtatcgagaggcttctaatcaggtcgctaggaacgccgttattattggtcccgccgataccccgtttgaggatggcacattcaggttggtcatgcatttcgaggaacaatacccaaacaacgctcccggcgtcaagttcatcagccagatgttccatcccaacgtctacggcacaggagagctctgtctcgatatccttcaaaaccgctggagtcccacttatgatgtcgcagcgatcctcacc

SEQ ID NO: 36586 - DNA, 1686 bp, Aspergillus nidulans
ggggagcttgtcgcgcttatgggcccctcgggctgcggcaaaacaacgcttctgaacgtcctcgcacgtcgtgctgcatcatcgggcgctaaatcctccggacattgttatgtcaatggtggcgaggttgataacgcaacgtttggcagaattacttcgtatgttgagcaggaggatgcactaatagggagtttaactgtgcgagagacgttgaagtttgcagcggatttatcgttaccggggtatgtgatttccgttacaacttagaactgactaatgattctctcaatgtttaggttcgtaagcaggtcagagcgtgttgagaggatacacacccttctcgaatctttcggtatccagaaccaggcctctacgcttgtcgggacaccgattaggaagggcatcagcggcggacagaagaggcgagtcagtgttgccagtcagctcatcacctgtcccaaaatactgtttctcgacgagcccacgagcggacttgactcaactgcgagctatgaagttatttcgtatgttaggaagctggcgcgggctaataaggttggttaaatgcttttgctggccagtgcaatactaacttgcgaagctcatcatcatagctagcatccatcagccatcgacggcgacattccaactgtttgataagctcttgctcctttccagtggaaaaacctgttactatggccctgttaagcaggttccatcgtactttggaagtattggatatcccatccctccccagacaaatccagccgagttcattctcgacatcgtcagctcagactttatgtcagaaaaaaattccatgaggaatgatgtggaggcaattcagtctgcctggtcgcaatctccagaaagcagtcggcttaagcagcagagaactgagttcgctgagaaagggagcaggagggttgtcgtggatgaggccagtcgccctggtctgttgagtatcaccatatcactcttgcatcgcttgctcatcaagagctatcgcgatgtcgtagcgtacggcatccgtatagtcatgtatatgggtacgttcagcagccacataatatttaaatatattaacatgtgcaggtttggcgatcatgatgggtactgtctggctacgtttggggacggagcaggagtatatccagcctttcatcaatgcaattgtgcgttggcagccctacccttagtacaactcagctaacaagtatccagttctttggatcagccttcatgagttttatggccgtcgcctacgtcccagcgtaccttgaagaccgcgcaactttcacaaaagagcgcgcaaatggtctttacggcgctcttccatttattatctcaaacttcattattggtcttccattcctctgtacgtctgctcagcgcccacaaatccccagacctatccgtctgtccacccaaagtcctcctcgctaacacagaaaccctatagtcctgatttcaatcctcttctccatcgtctcttactggctctccaatttccgccctagcgccccagccttcttcacctgggtaatgtggctttttctcgacctcgttgcagccgaatccctcgtcgtccttgtgacgtctatattcccgaacttcgtgatagcacttgccctcgttgcattcgccaatggtctctggatgagcgtgggtgggttcctggtgtcg

SEQ ID NO: 36587 - DNA, 1724 bp, Aspergillus nidulans
aaaggttacttttagtgggaaccttaagaggacaccttgcgggactttaacccgctgtatcagcaccgacatgaggccaatttcttcggacgcgggcgtctggcgggcttcggtgacgatgtggccgattcagtggcaaagaagtatgctaaagcgctggaggaccgagatcgcgaagcgggaagtattcgggcgagggagatcttggagatggagcggaggcggcgagaggagagtacgcggaaccagttggacaagcattggagcgagaagaagctggagcatatgcgcgagcgagactggcgtatcttcaaagaagacttcaatatcgcgaccaagggtggaagcgtaccaaacccgatgagatcatgggacgagtctggcctgccgaagcggcttctggagcttgttgatcgaagttgggtacaaagagccaactccgattcagcgagctgcgatccctattcgcaatgcagtcgcgcgatcttatcggtgttgccgtgactgggtctggtaagactgcagcgtttcttctccctctgctatgttatattgcagagttgccgcggatagacgagtttgagtggcgcaagaacgacggaccgtacgcaattgttcttgcgccgacccgtgaattggcccagcaaattgagattgaagccaagaagttcacggagccacttggttttaatgttgtcagtatcgttggtggtcactcgttcgaggagcaggcatacagtttgcggaacggtgctgagatcattattgctacacctggtcgtctagtcgactgcatcgagcgccgcatgttggtacttagccagtgttgctacgttattatggatgaagccgatcgtatgatcgaccttggttttgaggagccggttaataagattcttgacgcgcttccggtcaccaatgagaagcccgacacagaggaagcagaggattcatcggccataacccgacatctgggctcaaaggaccgctcccgccagacccatgatgtacacagctaccatgcccactgcggtagagcgcattgctcgaaagtacctccggcgaccagcgattgtcaccattgaaagcgccggtgaagctgtgtacactgtcgaacagcgcgtcgagatgttcgccggcgaagataagcgcaagaaacgcctcgaccagatcttatcgtctggcgccttcaaacaaccgatcatcgtctttgtcaatatcaagcgcacctgcgactcaattgcgcgcgacattaaacaatggggcttttcttctgttacactgcacggaagcaaaacacaggaacagcgtgagaccgccctggcttctgttcgcaacggctcgacggacgtcctggtcgctacggatctggctggacgtggtatcgatgtgccagacgtcagtctcgttatcaacttcaacatggctacctcgattgagagctacactcaccgtatcggtcgtactggtcgtgctgggaagagtggtgtggctatcacattcttgggtaacgaggatgccgacgtcatgtacgtttcttccctccttgcttactatacgactatgctaactgtcacaggtacgatctcaagcaaatgcttatcaagtcgcccatttcccgggtgccggaggaattgcgcaagcacgaggccgctcaatcgaagcccacacgcggagcgggaaagaagatcgaggaggcttctggtttcgctggtaaagggggt

SEQ ID NO: 36588 - DNA, 1321 bp, Aspergillus nidulans
ggtcttggacagtccaagatgagcttctgtgatgaccgtgaggtacgtttggattctgccaataaaaaaatttggctgagcctaacttgctgctgtgtagatatttactctattgctctcaccaccctttcctccctcatgaagaaatacaacattgaccccaactccgtcggtcgattggaagtcggtactgagactctgctggacaagtccaagtccgtcaagtccgtcctcatgcagctttttgccccccacggaaacaccaacatcgagggtgtcgacaccgtcaatgcttgctacggaggaaccaacgctctgttcaacagcatcaactgggtggagtcgtctgcctgggacggcagagacgccgtcgtcgtttgtggtgacattgctctttatgccaagggcgccgctcggcccactggtggtgccggctgtgtggccatgctgatcggtcccgacgctcctatcatctttgagcccggtctccgtgcttcttaccttacccacgcatacgacttttacaagcccgatctcactagcgagtaccccgttgttgacggccacttctcccttcgttgctacaccgaggccgttgatgcctgctacaaggcctacggtgcccgtgagaagacactgaaggagaagacccaaaatggcaccaacggtgtcactcacgacgagtctaagaccgctctcgaccgtttcgactatgtcctcttccacgcccctacttgcaagctcgtgcagaagtcctacgctcgcatgctctacaacgactacctcgccaaccccactcacccctcattcgctgaagttgcccctgagctgcgtgacctcgactacgaaacctctctgactgacaagaatgtcgagaagactttcatgggtctgaccaagaagcgtttcgccgagcgcgtgcgccctggtcttgacgttgccaccctgtgcggtaacatgtacaccgctaccgtctacgctggtctctgctctctgctcagcaatctcaccttcgaccccagccagcccaagcacataggcttcttctcctacgacagtggtcatgccagctctctgttcagcgccaagattgttgacgacgtttcctacattgttgaaaagctgaacctgcacaagcgtcttgagtcccgcacagtcttgtctcccacggactatgaagccatgtgcgagctccgcgagcacgcccacttggccaaggacttcaagccctctggcaaccccgacacactcttccccggcacatactacgctcaccgagattgatggtatgttccgtcgcaagtacgaaacaaaggcatga

SEQ ID NO: 36589 - DNA, 1059 bp, Aspergillus nidulans
atgtcctccacaacacactccccaatccccccaacaatgaaatcctggctctactccagcacacaaccctcagtaatcagcaacctctcattcactgcctcagccccttcccctcccctccccagctatgcaaaccagctcctcatcaaagtcttcaccacatccctcaaccccgccgaccacaaagtcccccaacatgctacgattcccttcacgggtggcagaacactgatctgcggtctccccgcttcaccgggtctcgacttcgcaggaaagatcgtgtcagtacatccgaaaaataggacggagtttgaacccgggcaattggtatacggatgtcttgcgagacctcgcacattcggtacaacgggggagtatatccttgcggatgcgaacgatgttgcgcatttaccggaaggcgtcagtgtggatgatgcggcatgtttgggtgttgccgtgaggaccgcgtaccagagtttgaagaactatcttgatttgagcaaattcgagggcgggagcggaccgagagtcttcataaacggcggtagcggtggatgtggtgtgttcgcgattcaaattgcgaagatgctaggctgtcaagttacgacgacctgctcgggtcgaaatattgagctagtcagagatctcggtgcggacgagatcatcgactatacaaccaccaatgtcaccgaaaccctaaagaccaagggcttagtctacgaccatgtcatcgaccatatcggcctccctgggaatctgtatgctgaatgccaccatttcctcaagccatcgggggtctgggtgcaggttggtgcggggagtatcctcactgcattttggagggcgatcacgccgcggtttctcggaggcggacggaggtggtttgttccgctcatgatggcgaatagcaaggaggatctggtggaggtcggaaatctgcttaaagagggaaagcttcgaactgttaaggatgggaatcgggtttgggaatttggggatgttaagaaggcgtatgagttgctggcgagcgggagggcaagggggaagattgttatcaga

SEQ ID NO: 36590 - DNA, 1739 bp, Aspergillus nidulans
atgcgagctctcggcctggtcggccttgttggcgtcgccaatgccgtctgtccgtatatgacaggcgagctcggccgtcgcgataccaaccccgatgctaccgaggccactgaggaatttctgtccgagtactaccttgacgacacggactcgtacctgacgactgacgtcggcggcccaattgaggaccagcagagtctcaaggccggtgcgcgcgggtctaccctgctggaagactttatcttccgtcagaagatccagcgattcgaccacgagcgggtgagtgactgaggactcttcaattgtcgattgaaacgttggatgctgactgcgcaggtccccgagcgtgccgtccatgctcggggtgcaggtgcccacggtgtcttcacctcgtacggcgacttctccaacatcaccgccgcctccttcctctctgctgagggtaaggagacccccgtcttcgtccggttctcgaccgtcgccggcagtcgtggcagttctgacctcgcccgcgatgtccacggtttcgccacccgcttttacactgacgagggcaactttgatatcgtcggtaacaacattcccgtctttttcatccaggatgccatccagttccccgacctgatccacgccgtcaagcccaagggcgatcgtgaaatcccgcaggctgccacggcccatgacgccgcctgggatttcttcagccagcagccctcgactcttcacaccctgctctgggccatggccggtcacggtatcccgcgttcgttccgccacgtcgatgggttcggtgtgcacactttccggctcgtcacggaggatggctccaccaagctcgtcaagttccactggaagaccctgcaaggtttggcaagtatggtctgggaggaagctcagcaaatttctggcaagaaccccgactacatgcgccaggatctgttcgagtcgattgaggctggccggtaccctgagtgggaggtatggtaccccttatttctactacatagcgaagatgtttactgaccggacagcttaacgtgcaaatcatggacgaggaggaccagttgcgctttggcttcgaccttttcgaccctaccaagattgtccctgaggaatacgtcccattgaccccgctgggcaagatgaccctcaaccgcaacccccgcaactactttgccgagactgagcaggtcatggtaggcttcctcctcccccttctgtatccctctctttgccgtttctaacagtaacagttccaacccggccacgtcgtgcgtggtgttgacttcaccgaggatccccttcttcaggtaggcggcgagcgacaaacttttttgtcttttttacctaagctgactcgaagcagggacgtcttttcagctaccttgacacccagctcaaccgcaatggtggcccgaactttgagcagttgcccatcaaccagccgcgcgttgctattcacaacaacaaccgtgacggtgctggccagatgttcattccgctgaaccccgatgcgtacagccccaacacgctgaagggatcaaccctcaaacaggccaaccagactgcgggtcgcggattctttactgctcctgaccgtactgccaacggcaatcttgtgcgtgccaagagctccaccttcgatgatgcttggtcgcagccccggcttttctggaactctcttcttcccgccgagaagcagttcgtggtcaacgccattcgcttcgccaccgccggtg

SEQ ID NO: 36591 - DNA, 3211 bp, Aspergillus nidulans
cagtctgtctttacattgctacctttgctggcccagctccctagcggaggggcgagccttccaaataatcatgggcgcgttgagaactgtgtgagaaaccatgatggaattcacaagttcaggcactccaacaacacctaccagtccatgtttccgggagtgacgtgggacgaggaccagtgggttttgacaactagctctctcgaccaaggtcattaccagtctcgcggttcagttgcgaatggctacatcggcatcagtgtctccagcgtcggcccgttcttcgaactcgatctgccggttgctggcgatgtgatcaacggctggccgctctattcgcgacggcagtcgttcgctactatttctggttttttcgacatacaggcagaaacgaacggatcaaacttcccgtggatgaaccaatacggcggtgaaagcgtgattagcggcgtgcctcactggagcggtctcattcttgatctaggcgacgacgactatcttgattcaactgtggataatgtgacgcttagcgatttcaagtccagctatgacttcaaagcgggtgtcttatcgtggtcgtatacctggactccagccggcgacaaaggatcctatgcaatcacgtatcgactgttcgcaaacaaattgaatgtcaatcaagctgtagtggatatggagataacaccttcgcaggatggtcacgcgacaatcgtcaacgtattggacggatactccgctgttcggacagattttgtggagtcccaggaagatgacggcgctatatattctgcggtccgaccgtggggtatccctgatgtctcagcttacttctatgcaaacattactggctcgaagcatgtcgatttgtcgtctcgcagacttattcatggtaagccctatgtgagcgccaacgagtcgtccatcgcacaggcggccgatgtcatctttgtggccaatgagaaagttcgcatcaccaagttcgtcggtgctgcgtcgacggatgcattcccagaccctcaagcgacggctaagcgcgcagtgtcggaagccttagatgctggttatcagcgttctctgcgctcccatgtccaagagtgggctagtatcatgcatgaggactcggtcgatcgctacgtcaaccctaccaccggaaagctccccgacgacgacaacatcattaactcagccattattgccgttgcaaacacctactacttgctgcaaaacacagtcggcaaaaatgctatccgagcagcacaggatgcaccactcaacgtcaacagcttttccgtaggcggcctggtttctgactcctatgctggattggtcttctgggatgccgacgtctggatgcagcctggactcgtcgcctcccatccggaggctgcccaagctgtcacgaactacaggacgaagttgtaccctcaggcgaagaagaatattgagacgacatacaccggctccaaaaacgcgacatacattgacccatctgctgcgatttacccgtggacaagcggccgcttcggtaactgcacgggcaccggggcctgctgggattaccagtaccacttaaatggcgacattggactgtctctgatatatcaatgggtggtgagcggcgataccaacaccttccgagagaagcactttccgatctacgattcagtcgctgcgctttacggcagcatcgtggaacgaaatggaagttactggactctgacaaacatgacggatcctgtaagttttacggcttttgcaatgcaatctgcgccactaaccatcgtaggacgagtatgcgaaccacatcgacgctggtgggtttactatgccgatgatttccgaaacgctcgagtacgccaatcaattccgccagcagttcggcctcgagcccaacgagacgtggaccgaaatttcggagaatgtcttggtgctccgggagaatggagtgacgctcgaatacacgaccatgaacggaactgcagcagtgaagcaggctgatattgtactcgtcacctatcctttggctacgacaactacactgccgaaaccgcccttactgatctagactactatgcaaaccggcagtccgctgatggtcctgcgatgacctgggccatcttttccattgccgctggtgccgtttcgccttcgggatgctcggcgtacacctaccatcagtactcgtacgccccttatgcacgggcgccgttcttccagctatccgagcagatgctggataacgccagcataaacggcggcacccatccggcttacccgttcctgactggtcatggcggcgccaatcaagtcgtcctcttcggttatctaggtcttcggctacttcccgatgatgccatccacattgaaccaaacctgccaccgcagattccctacgtgaagtaccgaaccttctactggcgcggatggcccatctcggcccagtcgaactacacacataccgtgctccagcgttcacagagcgcaccgctggacacggccgaccgccggtttgcaaacacctccatcccggtgtttgttggcttggccgacaacgcaacgttgcaccatcttcccccacatggaccctgactgtccgcaacgagagatcggcaccaataacacggtcgaggtcaaccttatccagtgcagtccggtgtcttccaccgtcgcgtttgaacaaggccagttgccgatctcggttgtcgatggcaccgcgtcgacgcgctggcagcccagctcatccaatgctagtgcggtcactgtcaacctcggctccacgactggtcggtcagtccaaaccgtggcgtctggattccacttcgactgggcggccgcaccacccgttaacgcaagcgtgatcttccacgatacccccctgtcggatcctgtggcggcattgagctctccaggacctcatgttcggattgtggcgaacctgaccaacatcgaacagtcgggaccatacgacccagaggccacggatcttaatgaaatcaagatccccgttgggaatactacgaggatcgagcttgctcaggaggttccggttgggcggtacgcgacattggtaatctcagggaaccaggccctggcccaggcggacggagaagatcacgtgggcgcgaccgtggccgagtgggcgatcctcggcccaaagtcgggcagcccgcgacgccggatccagcctgtgcctctactgtaatgtagaata

SEQ ID NO: 36592 - DNA, 940 bp, Aspergillus nidulans
atgcgccatgcctgctccactttcggcttcttctacctcgtcggccatggaatccccgaggaagaccgcctgcagattctaaaatgtaccaaacggtatttcgatctccccatggaggagaaaatggagacttggattgggaaggccatcggccggtctttccgtgggtatgaaccgccagctctccaggtgcatcaggagggcctcctccccgatacgaaggaggtaggtgctcgtcgacctggtaatcagaacgggatactgatcgtaaaagggatttattctcggtcgcgagacgcctgcagatgcgccggaggctggcacattccacactggacctaaccagtggcccaagaccctgccggacgaagagttccgagttcccataatgagataccatgcaaagatgatcgaaatggtcaaagtgattctcaaaatactggccctcgggcttccggcagaatggaattgtccatcggatgtgtttgatgagctgaccattaatccatcggcgccactgcgtctgctgtactatgctccccagcctgtcaaacatgagaaccaatttggcggtatggcttcaattaatttctttacacccgctgtatgctgtgaaaactgatcagagatccagtgggtgcccatactgactttggcaatgtctcggtgcttctccaggaagaagactcagaggggctggaagtcttctatccgccaactcaaacctgggttcccgtcccagccaaaccacattcctatgtgatcaacatgggggatatgatgcagaaatggaccgcaggatactacagaagcgcgctccacagggtcgtcaatagcaatacaaaacctcggtacagcgcgccgttcttcatgaatgggaatctggatgtcaagtgctatgccctggacggatctggagaagtaactaccattggagaac

SEQ ID NO: 36593 - DNA, 789 bp, Aspergillus nidulans
aggtgtgttgtggtcggtgatggtgctgtcgggaagacctgtctcctgatctcatacacaacgaacaaattcccttcagaatatgtgcccaccgtgttcgataactatgctgtgactgtcatgtaagtggatttttgtgttttcgccgtgacaccccggttcgattttcgcaggcttcctgcttctactcgctctgcgatgcgtaaagaatattcctcgcccggtttttttgtccgaacgtcgggtctaatactaccgatacttctttcaactttactgatcgcggttttatggaacaggatcggcgatgagccctacactctaggattatttgatactgctggtcaagaagattatgaccgacttcgtcctctctcatacccgcagacagatgtattccttgtctgcttttctgtgacctcccccgcatctttcgagaacgtgcgcgaaaagtggttccccgaagttcaccaccactgccccggcgtcccatgcctgattgttgggacacaagtcgatctccgggatgaccccgccgttcgcgacaagctggctcggcaaaagatgcaaccgattcgcaaagaagacggtgaccgcatggccaaggatctgggcgccgtgaaatatgtcgaatgctccgcattgacccaatacaagctcaaggatgtctttgacgaggtgggtttgtcctaagtttcgctcagggctcgtgattgactaaaaccgtctcaggctattgttgcggcactcgaaccggcccctaagaagaggtcgaggtgcgttctgcta

SEQ ID NO: 36594 - DNA, 1096 bp, Aspergillus nidulans
caaatgtagtggtctttctccggacatgccagctttgcgcacttgaagcccgtcaaatgtctggtcgagccggatgagaagtacgacattgccatcatcggtgcgcctttcgacaccgcggtcagctaccgcccaggtaaatcaactctccaatatataactagctacgtttctatactaatgcgcagcaggagctcgctttggtccgcgcgcaatccgcgccgccagcgcccgccaaatggctgggacatcctacaacacccgcgcagggataaacccatacagctcatgggcgacgatcaaagactgcggcgacatccccattaccccattcgacaacgggctcgctgagcgccaaatgtacgaggcctttctggaactcggcacccgcagccccgtcacgcccgcctcatctgagtatggcagcaagggcatctccgcgggcaagagcaagctcgtcacgctgggaggcgaccatagcgttgcgctccctgcccttcgagcgttgtatcagatttatcagaagcctattactgtcctgcacttcgacgcgcacctggacacctggaacccagtgcgatactcggcgtactggcagtcggagcagtcggcattcaaccatggcagctttttccacaaggcgagtcgtgaggggctaatttgcaactcgacctctgcacatgcgggtctgcggacaagacttaccggtatcgatgacagcgattacacggcccccggaacgccggagcaagggttcatgcgtattcacgctgacgatatcgatgagcttggtggacccatgggtgtcgtcaacaaaattatggagcgtattggcctcgatttggaccagcctgtttatctctctgtggacattgacgtacttgacccttctactgcgccaggcactgggacacccgagcccggtggctggacaacccgtgagttcatccgcattctgcgggggattgagaagttgaacatagttggcgcggatatcgtcgaagtatctccaagctatgataacaagggtgagacgactgccctcgccgctgcgcaggtggcgtatgagatcatcactagcatggtcaagaacggt

SEQ ID NO: 36595 - DNA, 1417 bp, Aspergillus nidulans
agtggccaatactgaactactacttatactacaggggttcgtcgaacttggaagcggctgcttgatggccattgtgggatcgttaacattagacatcgggatgctcgatatgcagacttgccctgtgagattgccgcggttgttccgagcggtgctcgcgcggaggggagatggacggcatccgaatggttgagtaaagatgtatgtctcacgccaggtcaatattgggtatggtgtgagaagctgattaaatggtgacaggatgagcgcaagatggcacgattcgcccagtatgcaatggctgctgcggaagaggccctggaggatgcagagtggaagccaaaggctgaagatcagttagaagcaacaggagtctgtctgggatctggaattggcaattttgatgagatttatgatgcagtggtagcgtacgacacaaaaggctacaaaaaactgtctcctttgttcgtaccgaagttgttgatcaatcttggggctgggcatatatccatgaagtatggctttatgggccctaaccattcagcaactaccgcttgtacgacgggtgcccattctattggcgatgctgctcgttttattgcttgcggagatgcggatgtcatgcttgccggcggggcggagtcttgtattcacccacttgctattggaggcttcgcaagggcacgaagtctagcaacggcgtacaatgaccgtcctgagaagtcttcgcggccgtttgatgctgaccgtgatggcttcgtggtcggcgagggtgctgggatagtgattttagaggtgactcacccggagctagcacaaaaccttggtactgaccctactttttaggaactagagcatgctaaggcacgaggtgctcgtatatatgctgaggtgaaaggctacggttgttcaggagacgcccaccatatgacagcccccaaggcgaacggtggaggcgctctgctagcaatgaaaaaagccctaaagaacgcttgtctcgagccctcagctgtcgactatattaacgcccatgcaacttcgactgtcatcggcgacgctgctgaaaatgccgcaatcaaggctctcctccttggccccgggggtaaacagaaagcggctgatgtgaatgtcagcagtaccaagggagccataggacatctactaggaggagcgggagccgtcgaggctctatttactgtccttgctattcatgaggttggtcttacgttttgattttgtggtaccgctaattgccttctagaatgttatgccacctaccattaacctggatcgtctgaatgacggtttcgactttaattacgcgcccaatgaggctcaggagcgccgtattgatctagcgttgacgaatagcttcggatttggggggacgaatagcagtctttgcttctcgaagcac

SEQ ID NO: 36596 - DNA, 1021 bp, Aspergillus nidulans
  unsure (1)..(1021): unsure at all n locations
tatttagcacactggctcgcagtcgaaggcgtacaaccgtctataccgcaaaacccgacggccgcagattcgcgtaatcttgaactaatgtccaagggcccgaacgccaacgctacgctggcggctatgagcgggaatggaaacgtcgcggttaagccgctggtcaagcatgtcctgtctaaggagctacagctctactttgagaaagtctgcaatgcattcctggacgagtcgagcgagaagtatcggacatcggggtatgcgagcttgcgcgaagatccaggtttgcaccagcttgtcccctatttcgtccaatttatatcggaaaaggtcacgcatggcttgaagganttttttgttttgacgcaggtcatgcatatggctgaggcattggtacaaaataagtctctttatgtggatcctatgtatgacttctcctcaacttatatttctcagttatactgacgaacagcagatcgcctcactggtccctcccatcctcacctgcttaattggccgtcagcttggtggcaccgccgacctttccgaacaattcgccctccgcgatctcgctgctgccctccttggcctcattgcaaccaaatactctcattcctcacacactctcaaaccccgtctcgcccgctcctgcctgaaaaccctcctcgacccctccaagcccttcggcgctcactacggcgccatcatcggcctccacgccgtcggtggatctgaagccgtccgcgtcctcataatacctaatctacctatttatgggaatctactgaaggatggtcttgctgatgatagtgcacgacgccctgaggcggaaaaggtcctgggcttgctgctgggtattctgacagctctgaaagaggaaaagcctgtgctgacgaatgggcatgggcctgggatggttagtgaggatattaagaggaggctagagggcaaattgggcgcgttcgtggcggagaaggtcgcggagttgggggacgcgagagttgcgcatgctattttggga

SEQ ID NO: 36597 - DNA, 1886 bp, Aspergillus nidulans
gactgcataagtatctcccttttgcgtcctcgagactactctcttctttcctcttcccttatcttcctctattcatcagttttctctccctcagctggcttccgttcgtcaagatgaagcttcccatcctttttttctctactatcttcctcgtccttgcgcaagcagccactcttcccccactctaccatatttaccgaagcctcaactctacctccaacaacaacaccaactatgcccataacaataccaccggcagaggccccggctatagccccggtcccatctccgatcctagttctggtcaaagagaatatcgctcaatggcatacttcgtaaactgggtacgtccccggctatcatttctccttccccagtaccgccttctaacgctattccaccataaataggcaatctacgcccgtcaccacaatccacaagacctcccagtctcccacctaacacacatcctgtacgccttcgccaacgtgcgccccgaaactggggaagtctatctcagcgacacgtactcagacatagagaagcactatcctaccgattcatggaatgaccagggaaacgacaacgtctacggctgcgtgaagcagctctttttgcttaagcagcagaatcggcacctcaaggtcctcctcagtgttggcggttggacatactcgaagaatttcgcgcggatggcagctacagaagaggggaggagattgtttgcgaaatctgcggtagagctgatgggggatctgggtatggatggggttgatgttgattgggaggtgagctttgcttgcctaagacatgaagttgggcagaatgagggctgatatgaccggatgcctgcagtatccagaaaatgacgatcaggctagtgactttgttgagttgctgcgcgagacaagagaagtatgcctaccaataatctcttctacgtatcagtcctaagtaggcaatgctcacaagctgaacccaggaactcgaccgatatgctgccgacaacgacagcgacaagcccttcctcctgagtgttgcgtcgccagcaggtgcgtcattcttccctcctatttctcagtaaccctaagttccataccctaatctccccttacaaaacgaccaactgacagagccaggcccaagcaaatacaccaccctgcacctctcctccatggaccgttatcttgacttctggaatctaatggcctatgactacagcggtagctgggatacaatcacaggacacaatgcgaatctcttcgcgtcaagacaaaaccccgcctcgacacccttcaacacccacaccggcggtaaccgcttacctagccgctggaatccctgcgtcaaaaatcaatttgggtatgcctctctacggccggtctttcacacacaccgacgggccggggacggagttcgagggtgtggggtatgaggggagctttgaggcgggcgtgtgggattataaggcgttgccaaaacccggggcggaggttgtggaggttgaggagattgccgcgagtttcagctacgacgaagacaagaaggaagttattagttatgataatgtgggtgttgtacggcacaagggggtgtatcttatgcgtttgggtatgggaggtgggatgtggtgggagtccagtggggatcgggaggtggggagtggggggagtttgattgagacggtaagtttgcccttctatcgtcttctctacttggccttggtacacatggtttggaagacaaagggtggatgctaatatgacggttgggtgcagttggtcgacactctcggtggggtgaatgccctcgacaagtccgagaaccagctggagtatccggcgtcgaggtttgagaatctgcggaatggatttacttgaaagctt

SEQ ID NO: 36598 - DNA, 1171 bp, Aspergillus nidulans
cagaagaagaaacaaacttttatcacccgcacaatatggacttttgttatgattgccggcttcttcattgccatgttctcgggccatatatacatcattggtcttgttaccgctgttcagatcatctcgttcaaggaagtcattgctattgcgaacgtgccaagcaaagagaagaacatccgttttaccaagtcgttgaactggtacttcttgggaaccagcatgtactttttgtacggtgaaagcgtcatctattacttcaagcacattcttctggtcgacagagtgttactgcccttggcgtctcatcaccggttcatcagtttcgttctctggattatgggtatgttccacttgtatgaaggtattgctcatgctaatctcgataggcttcgttttcttcgttgcatctttgcaaaaaggccactaccgtttccagttcactcagttcgcttggacccatatggcattgtatttgatcgtcgtccaagctcatttcgtcatgaacaacatcctggagggtatgatctggttcttcctcccggcttctcttgtgatcacgaacgacatcttcgcctatgtctgcggtatcactttcggccggacgcagttgattcaactctctcctaagaagactgtcgagggattcctgggcgcctgggtttgcaccattatttttggctacttcatgaccaatatcttgatgcgctacaaatactttatctgccctgttaacgatctcggatcgaacgttctgacgggtttggagtgtgaccctaacccagtcttcgtccctcaagcattcgagattccggaatggaccggattcggcaggacattttacgttgccccgatgcaatttcacatccttctgttcgccacatttgcctcgctggttgctccttttggaggcttctttgcctccggtcttaagcgctccttcaagatcaaggactttggcgagtcaatcccgggccacggcggcattacggaccgcatggactgccagttcattatgggcttcttcgcgtacatgtactaccacagcttcattgccgttttcaaggcgagtgtgggcgacatcattgaggccgccatcaatggcttgacggttgatgaacagctggaggtgctccgcggcctgagcaaatatctatataaccagggagca

SEQ ID NO: 36599 - DNA, 1059 bp, Aspergillus nidulans
ggcttgatcagtacatatggcgccttccaagagttctaccaaacggtacttctccccgatcaatccccctcctccatttcctgggtaggaagcctccaagccacgctcgtggtcatggttggagttgtatctggaccattggtcgatcttgggtaccttcgccctctcattatctcggggagcttccttgttgtatttggcatgatgatgactagtctggctacccaatactatcaagtgatccttgcccagggattttgtgtcggcattggtggcggcattgcatacattccagcactggtcgtgatttcgatgtatttcactacgaagcgtccgattgccattggctgtgcatcaatcggatccagcgtaggcagtgtggttttcccaatcatgtttcgccagctccagccgaagatcggcttcccgtggacggttcgctgcatcgctttcatcaatatgttcctcgctgtcattacctgcacgatgctatgccgccgcccgggcgaaaaggtcggagcccgcagcctgatcgactggaaagctctcaaagatatcccgtttatgttgctatcggtatcgatgttgctcgtcatgctcggctattggatcccgctattctacgtcccgtcttacgcccgaactgtgctgaatacaacaaccagcctttctttctacgtggtatccattattaacggcgcgtcggcgttcggacgaaccgttccatatttattgggatcgcgagtgaaacccattggcattctcattagctgcgtggcgggttcggcaattgccatgttcacatggattgcggcgaccaatatccctggcttcatcgtttggtcttgctactggggtttcttgacgggggtgctagtgactgcgccaacatcgattgtttcgcatccttccctttgcccggatttgaagatgctcgggactcggatggggatgatgtgggggatcagctcgctcgggtcgttggctgggacacccattgccggagccttagtagatctcactgaagcccaatttctgcgcgctcaggtattcgcaggc

SEQ ID NO: 36600 - DNA, 1593 bp, Aspergillus nidulans
cttgaaaaccatttgggaccggttgagtcggtggtattctcaccggatggcaagcaactagtgtccggctcttatgatgacaccgtcaagatctgggaccctgccacgggcgagctgctgcagaacaaggatggccattctggaacagtcgagtcattggccttctcaccagatggcaagctactagcatccggctcctatgacaacaccatcgatctctgggactctcccacaggcgagctactgcagacttttgaaggccatcctcattcaatttggtcagtggccttcgcaccagacggcaaggaactagcatccgcctccgatgacagcaccatcaagatctgggaccttgctacgggcgagctgcaacagacccttgacagccattctcaatcagttcggtcagtggcattctcgccagatggcaagctattggcatccagctcccttgacagcaccatcaaagtctggaaccccgcaacgggcgagctgcagcagagccttgaaggccgatccggttgggttaaatcggtggccttttcaccagatggcaagaaattagcatctggctctgagaaaaacaccgtcaaactctggaaccctgccacgggcgagctgctgcagactcttgaaggtcattctcagtcagtgcggtcagtggccttctcaccagatggcaagcaactagcatccagctctagtgacaccaccatcaagctctggaactccaccacgggcgagctgcagcagacctttaaaggccatgatctttggattcgggcagtagcattctcaccagatggcaagcatctagtatccggctctgacgataacaccataaagctctgggaccttgctacgagcgagctgcagcaaagccttgaggaccattctcgcagtgttcatgcagtagccttctcaccagatgacaagcaactggcatccagctcacttgacagcaccatcaagctgtgggactccgccacgggcgagctgcagcggactcttgaaggccattcccaaggagttcggtcagtgaccttctcaccggatggcaagttactagcatccaactcttatgacggcaccatcaaactctggaaccccttaacgggcgagctgcagcagactcttacgggccgatctgattgggttgactcggtggcatttccccagatggaaagcaactagcatctggctattatgacagcaccatcaagctctgggattccgccacaggcgagctgttgcagacccttgaaggccattctgaccgtattcaatcggtggtattctcaccagatggcaagctactagcctccggctcctacgaacaaaccggccaggttttgggatcccgccacgggcgagctgctgcagatcttcgaaggccattctaaatgggttgagtcggtggccttctcaccagatggcaagctactagcatccagctcttatggcgaaactataaagctttgggaccctgtcacaggtgagctgctgcagacccttaatgaccctgatgaatcagctgggtcagttgccttctcgccggacggaaatcgactagcatccgtcgatattttcgac

SEQ ID NO: 36601 - DNA, 883 bp, Aspergillus nidulans
atgtcgctcgccggaaaagtcgctctcatcactggtgcctcgaaaggcatcggcagagcgacagcgcagcgcctggctagcgaaggcgccagcctggttatcaactacaacaccgacgccgcctctgcccaggcgctcgtggacgaaatcggccaggaccgcgctctcgcggtgcaggcagatgcctcgaaactggcagacattgatcgcctggtggacgcggccgtggccaagttcggcaagatcgacatcctcatccccaatgccggtatcctgcctatgcgcgatctggagcacaccaccgaggaggactttgactttacctataatctgatggtcaagggaccatactttctcgcccaggtgggttcatgatttgcttattcttgttcattccaatcttgttctattttatgctgcttttgttctatttttactcctttcattgtggtccacgagttggttgtattctttatgttatttggatatcctggctcgtgtctaacaggcacagaaagcagcaaaacacatccccgctggtggacgcatcatcctcgtctcgaccggtgtgaccgtgctctccaacattgccccagcatatctcctctacgcctccgccaaagcagccgtcgagcagatggcccgcgtgatggccaaggacctcgcacgcaatgggatcctcgtcaattgcgtcgcaccaggccctacgactacagggctcttcctgaacggcaagtcagaccagatgctcaagatggtcgcgggattcagcccgttcaaccgcatcggtgagccggaagagattgcaaatgcggtatacttcctctgtagtaaagacagcagctgggtttcgggacagaccctcagggtcaacgggggaatg

SEQ ID NO: 36602 - DNA, 824 bp, Aspergillus nidulans
gtctacaagggccggaattgccaaacaggggagatggtggcgctgaaggagattcacctcgactcggaagaagggacgccatctacggcgattcgcgagatttctctaatgaaggaactgcaccacgataacatcctttcgctatacgacgtcgtgcacaccgagaataagctcatgctagtattcgagtacatggaccaggacctgaattattatatggacacaccacgcaaatcatggtcaacttgagcccgcgatagtcaagtcattcgcttttcagcttctgcggggtatcgcgttttgccacgataatcggatactccaccgcgatctcaaaccccagaatctgcttatcaactccaagggccaactcaaactcgccgatttcggccttgcgcgcgcgttcggaattccagtcaacacattctctaatgaggtagttacgctctggtaccgcgcaccagacgtgctcctcggcagccgcacctataatacgacaatcgatatctggtcgatcggttgcatcattgcggagatgttcactgggcgcgcgttgttttctaggcacgacgaatgaggaccagcttcagaagattttccgcgtcatgggcacgccttctgagcgtacttggcctggagtttctcagtttccggaatacaaaagtgattttcccgtttaccctcctcaggacctgcgacaagtcgtccctaggattgatccatacggtctcgacctactccggtgtatgttgcgccttcaaccggatttacgaatcagtgccgtcgatgcgctgcgacatccttggtttaatgatgttcctggg

SEQ ID NO: 36603 - DNA, 1285 bp, Aspergillus nidulans
aaggattacaggtacatcaagctccaagaagaatacatcaaagatgagcaaaggtttgcctgccgccgcgggttcgcaaagccgcttactgatttgattaaataggagcttgaagagggagctagttcgtgcacaggaggaaatcaagcggatacagagcgtacccttggtgataggccagttcatggaagcgatcgaccagaagtacgacagtcatactcgttgttaaggctcaggctaatgttggtcccagcaccggcattgtacagtcgtcgaccggctcgaactacgttgtccgcattctttccacccttgatcgcgaaaagctgaagccatcatcctccgttgccctgcatcgccattccaatgcccttgtggatattctacccccggaggcggactcttcaatcgccatgctaggcgaaaacgagaaaccggatgttacatatgcggacgttggtggtcttgatatgcagaaacaggaaatcagagaagccgttgaacttcctttgacgcactttgacctctacaaacaaattggtatgttttcctctgtgtactacaacgccagtttccagttctgattgtctttctccgtttaggtattgaccctccccgtggtgttctcttatacggccctccgggtaccggaaaaactatgctggtcaaggctgttgcaaacagcaccactgctagcttcattcgggtgaacggctcggaattcgtgcagaagtatctcggagagggacctcgcatggttcgcgatgtcttcagaatggcgcgggagaactcaccggcaattatattcatcgatgaaatcgatgccattgctacaaaacgtttcgatgcacaaactggtgctgatcgcgaggttcagcgtattctcctggaacttctgaaccagatggacggtttcgagcagactagcaatgtgaaggtcatcatggccactaaccgagcagataccctggatccagccttgcttcgacccgggcgtctggatcgaaagattgagttcccctctctccgggataggagggaacgccgactgattttctccacgattgcctctaaaatgtccttatctcctgaggtagatctcgactcgcttattgtgcgaaacgagcctttgtctggtgctgtcattgcagcaattatgcaagaagccggtcttcgcgcagttcgcaagaaccgatacaatatcatccagtcagaccttgaagacgcttactcagcccaggttaagaccggacaggaggccgacaggtatgtttttctcacatca

SEQ ID NO: 36604 - DNA, 1890 bp, Aspergillus nidulans
ggcaccgatgcttcgcaaggaaagggccagatcctctctaatatcaatgcctgcgtggccgttcagtccacagtgaagagcactctcggaccatatggaggtgacttgttacttgttgatagcaacggcaagcagacaatcacaaacgatggcgctacagtcatgaaggttcgcttgctattggttggtgtaagacacaaggaaaagtttgctgacgggctttctgctgtatagctgctagatatcgtgcacccggccgccagaattcttaccgatattgctcgctctcaagatgccgaagttggagatggaacaacatcagtcgtggtcctcgcgggtgagattcttaaggaggttcgggagttggttgaacagggtgtgagcgcgcaaactattgtcaagggtctacgaacctcgagtgcgatggccgtcaataaagtaaaggaaattgccgtggacatgattgacgctgctggaagcgaggagaagaagattgagactctgcggcggctggctgcaaccgccatgaacagcaaactgatcaagcggaactcggactttttcacgaaaagtgagtaatctggctgtcgacctgaatgcgttgggcacggtaataactaacctctactagtggttgtggatgcggttctctcgctcgaccaagacgatctgaatgagaagttgattggggttaaaaaggtcactggcggtggtctgcaggactctctcttcgtcaatggagtggcattcaaaaagacattctcctacgccggtttcgaacaacagcccaagtcctttaagaacccgaagatcgtgtgtttgaatgtggagttggaactgaagagtgaaaaggacaacgccgaggttcgagtagagcaagtgtccgagtaccaggccatcgtcgatgcggagtggcagatcatctacaacaagctcgaggctatctacaaatcaggggccaaggtcgttctcagcaaactgcctattggtgacttggctacacagtacgtctacgctgacgcctccctgggtgcttaattctaacgttcatcctagatactttgcggaccgcgacgtcttctgtgctggtcgtgttgcgtcagatgatatggaccgtgtgtgccaggcgactggtgctgccgttcagtccacatgcagcgatatccaggaccgccacctgggtacctgcggctcgtttgaggagcgccagattggtggggagcggtacaacctgttttccgagtgccccaaggcgaaaacggtgcacccttgtgctgcgcggtgaagcagagcagttcattgctgaagttgaacgaagtctgctcgacgccatcatgattgttaagcgtgcactgcgcaacacaaccatcgttgcgggtggtggtgccacagaactggagctgtctggctacctccatcggtatgccgaccaaaacggtgccctacaagcagcaggccgttgtgaaggcgtttgccaaggctctggaggttattccccgacagctgtgcgacaatgcaggctttgacgctacggacatcctgaaccgtctccgggtggaacatcacaagggcaacacgtgggctggtgtggactttgaccacgaaggcgtccgggacaacatggccgcttttgtctgggaacctagcctggtcaaggtcaacgccatccaagcggccgtcgaggccgcttgtctgattctgagcgttgacgagactatcagtgagtcctcctagcatgtactaactcttctgagaaacaaatcgctgacatctaccacagagaaccaagaatttgctgcgcctcaggcaccttcgcgcggcctgcccccaggtgctgcacagcgggctctgggtggaggccgtggccgtggtatgcccagacggtagatt

SEQ ID NO: 36605 - DNA, 5839 bp, Aspergillus nidulans
atgtcgggctacccacaaggttcgggctatcagcacggcaactacgatgatggctatgaccatcagggtcatggcgatgcttactatcaagatgaccaccatgctcaagctggttattatgataaccaagactatggggatggctactacgatagagggtaacttccctttattctaaagacatgcctcgcatttgtgctgattttttttttagtggctacggggatcatggctaccagcatgatggctactacgatgcgggccaccacgatgactactacggcgatcagtattacgcccagggaggtcaaggcagaggacgacatggtcgtgactccgaggaagagtcggagacctttagtgatttcactatgaggtctgaaacagcccgtgctgccgacatggactactatgggcgcggggacgaacggtacaacagttacactgatagccagtacggacacggaggctacggttaccgccccccttcttcgcaggtgtcgtacggtggtaaccggtcttctggagcgtcgacaccagtgtatggaatggattacggcaatggcttgcctgcaggccagcgatcccgagagccataccctgcctgggcttccgatggccaagttccggtttcaaaggaggagatcgaagacattttcattgaccttgtcaacaaattcggttttcagcgggacagcatgcgcaacatgtacgaccatctaatgacccagttggactcccgtgcctcccgcatgactcctaaccaggcgctcctctcccttcatgcggactacattggtggtgacaatgccaactaccgccgttggtacttcgccgcccatttagatctcgacgatgcggttggttttgccaacatgaaactgggtaaagcagaccgcaaaacaagaaaagctcgtaaggctgcgaagaagaaggcacaagaaaatccagaggacgtcgaaggaacgctcgaggcgctggaaggcgacaatagcctagaggccgctgaatacaggtggaagacacggatgaaccgtatgtctcagcatgaaagggtgcgccaattggcactgtacctactctgttggggcgaggccaaccaagtccggtttttgcccgaggctctttgctttatcttcaaatgtgccgacgacttttacaactcgcccgagtgccagaaccgagtggaacctgttgaagagttcacatatctcaatgagatcatcactcctctgtatcagtattgccgtgaccagggttatgagattttggatggcaagtatgttcgccgtgagcgtgatcataaccagatcattggatatgatgacatgaatcagctcttctggtacccagagggaattgagcgtatcgtgctggaggacaagacccgcctcgttgacattcccactgcagaaaggtggaccaagctcaaggaggtgaactggaagaaggtcttcttcaagacttacaaggagacacgttcctggttccatctggttacaaacttcaaccgtatctgggtcatccatctgggtgctttctggtttttcaccgcgtataacgcccctaccatttacactaagaactacagacagcagctcaacaacaaaccaccaggagcttactactggtctgctgttggttttggtggagctttggtctcattcatccagatcatggcgactatctttgaatggatgtatgttcctcgacgttgggcgggtgctcagcatcttaccaaacgcctgctcttcttgctcttggttttcgtcatcaacctggcccctggtgttgttgtcttcggattttcatcggtgcttcctggcaaggttccgcttgtcgttggtatcgtccatttcttcatcgccctcgccacatttttcttcttctccatcatgccacttggtggcttatttggcagttacctgaagaaacacggccgccagtacgttgccagtcagacgttcactgccagttttccgaggctgaaaggaaatgatatgtggatgtcatatggactttgggtctgtgtttttggtgcgaaattggccgagtcatacttcttcttgaccttgtccatcaaagatcccattcggtacttatcgccataccacgttcaccaatgcgcgggtgtcaagtacattggagacaagatctgctactaccagccccagattcttcttggactaatgttctttatggatctgacgctcttcttcctcgacagttatctctggtacattatttgcaacaccattttctcagtcgctagatcgttctaccttggtgtctctatttggtctccctggcgaaacatcttttcgcgtctcccgaaacgtatctactcaaaagtccttgcgaccacggatatggagatcaagtacaagccaaaggttttgatctcacaagtttggaacgcaataattatctccatgtacagggagcaccttctcgccatcgaccacgtccagaagctactctatcatcaagtgccgtccgagcaagaaggcaagcgaacccttcgagcacccaccttcttcgtttcccaggaagaccagtcattcaagactgaatttttcccacgtggtagcgaagcagagcgccgtatttcgttctttgcccagtcgctgtccaccccgatgcctgagccgctgcctgttgacaacatgcctaccttcaccgttttgattcctcattacagcgaaaagatccttctctctttgcgtgagatcattcgcgaggatgagccttactcccgtgtgactctcctggagtacttgaagcagcttcatccccatgagtgggactgtttcgttaaggacactaagattctggcggacgagacctctcagttcaatggagactacgaaaagaacgagaaggacgcggccaagagcaagattgatgacttgccattctactgtatcggtttcaagtctgctgctcccgagtacacgcttcgcacccgtatttggtcctcgctgcgttcgcaaactctttacagaactgtatccgggatgatgaactatagcagagctatcaagctcctctaccgtgtggagaacccggaagtcgtccagatgttcggtggtaattctgagaagctggaacatgagctcgagaggatggcccgtcgcaagttcaagatctgtgtttcaatgcagcggtatgccaaattcacaaaagaagaacgtgagaacacagagttcctcctccgagcctaccccgacctgcagattgcctatctcgatgaggaacctccagccaacgagggtgaagagccgcgtctctactctgctttgattgatggacactgtgagctgctcgagaatggcatgcggaagcccaagttcaggatccagctctccggaaacccgatccttggtgacggcaagtctgacaaccaaaaccactcgatcattttctaccgcggtgaatacattcaggtcattgatgccaaccaagacaactatctcgaagagtgcttgaaaatccgaagcgttcttgctgagtttgaggaattgaccaccgacaatgtctcgccttacactcctggcgttgcctcttcctctgaagctcctgttgctatccttggtgcccgtgaatacattttctcagagaacattggtgtacttggtgacgttgccgccggtaaagaacagacatttggtaccctgtttgctcgtactcttgctcagattggcggaaagctccattatggtcaccctgatttcctgaatggtatcttcatgactaccagaggtggtatctccaaggctcaaaaaggtctacaccttaacgaggatatctacgctggtatgaacgccatggttcgtggtggccgcatcaagcactgcgagtacttccagtgtggtaagggtcgtgatcttggtttcggttccattcttaatttcaccactaagattggcactggtatgggtgagcaaatgctatcaagagagtactactacttgggtactcaactgccactcgaccgattcctgtccttttactatgctcaccctggattccacatcaacaacatgtttattatgttgtctgtgcaaatgttcatgattgttctgatcaacctgggggccctgaagcacgaaaccatcaactgcaactacaactccgacctgcccattaccgatccacttatgccaacgttctgcgcgcctctcactcctatcatcaactgggtcaaccgctgtgttatttcgattttcatcgttttcttcatttcgtttgttcctttggctgttcaagaattgactgaaagaggactctggcgtatggcaacgcgtctggccaaacatttcggatctttctccttcatgttcgaggtgtttgtttgtcaaatctattccaacgctgtgcaccaaaacttgtctttcggtggagcgcgctacatcgctaccggtcgtggtttcgcaactgctcgtatcccattcggcgttctgtactctcggtttgcgggaccttcaatttacaccggtttccgtctgctgatcatgctgctcttctcaacctcaactacctggactgcctctctcatttggttctgggtctctcttctcgccctttgcatctccccattccttttcaaccctcaccagtttgcctggaacgacttcttcatcgattaccgtgactacatccgatggctttcgcgcggtaactctcgctcacacgcatcctcatggattggcttctgccgtttgtcgcgtactcggatcactggttacaagcgcaagcttctcggtgtgccgtcggagaaaggatcaggtgacgttcccagagctcgtattaccaacattttcttcagcgaaattgtcgctcctctaggccttcgtgctggtaccctcgttcccttcccttacatcaattttggactggtgtgagcgctgatgtggacgggggcaatgacccctcacgatgccattttgcgtattgccattgtagcatttggacctattggtatcaatgccggtgttgctgctgttttctttggtatggcatgctgcatgggtcccatcctgagcatgtgctgcaagaagttcggtgctgtgttggcggctattgcccacgcgattgctgtgatcatcttgcttgtcatctttgaagtcatgttcttcctcgaacactggtcttggccccggtgcgtcatgggcatgatcgccatggctgccattcaacgtttcgtctacaaacttattatcgcgctcgctcttacccgagagttcaagcatgaccagtcgaacatcgcatggtggactggaaaatggtacaacatgggttggcactctctctctcaaccgggccgagagttcctctgcaagatcacggagttgggctatttctcagcagacttcgtcattggtcatctcctattgttcattatgctgcccgctctttgtgttccttacattgacaagtttcactcagtcattctcttttggctccgcccaaggtaagacccctcatttactcggttgtggattcctaatctctaacactcaaatctagtcggcaaattcgccctccaatctactcgcttaagcagtccaagcttcgtaagcgacgtgtggtccgtttcgctattctgtatttcgccatgcttatcctgttcctcgttctccttattgcacccctcattgccagaaatcaggatctgaacctgaaaatgagtggcatccttcttgagctcatgcagcctctcgacagcaacaacaacgacactatgaccagctataccggctcgggtgtccccaagggcatggagcctattgcgtgcccgtcatcgtaccttacgaacttaaacaactaaaggctgtct

SEQ ID NO: 36606 - DNA, 912 bp, Aspergillus nidulans
cctattgattacatttgtgggatgccttccaaaggggttcggtcagcactgatagacgccttcaactactggctaaaggtggaggaagcaaagttagaaaacgtgaaagaactcggcggtttttttcacaatgcataattaattctagacgatattgaagattgctcccccaaacgacgaggtcaaccagcaacacatgtcctgttcggccactcgcaagcaatcaatagcgctaactacatgtttattcaagcagtgcgagcgacacgcagctttcacaatccagaagccatggatatactccttgaagagttggaaaatctctatcttggccaaagctgggacctgcagtggaaatataatctcacttgtccatctatcgacgactacacgaatatgatagacaacaaaacgggtggaatgtttagacttttgctaaggctacttcagaatgaagctggccctggaggaggttatggatgcgaccaggcaccgggactctccctcctcttggaccggctaacaacccaattcggccgtttcttccaaatccgcgacgactacatgaatctccgtaacagttcatacgcgcagcaaaaagggtgctgtgaggacctagacgagggaaaattctcttatccaattgtttactgcgcggcgaaatatccggacttcaaggtactcatcagtggtgttttccggcaacggcccgcttcagctacaatgaatgtgcagccgttaccggcagagataaagcaatatgttgttgagtttctaagctgaagagaaactttccagcactgtcgaaatcatctaattcatttagagcgcttgatagtgaagacaattggcgagattgaggatgtgacacaggataccaaccctgtgctaaggctgcttttggaagactta

SEQ ID NO: 36607 - DNA, 5116 bp, Aspergillus nidulans
ggcaaatctacactgcaaaatgaaattctaggagacttgggcatagagttcggttccacgcctgaaaagccagaagacacccctctagatgagttaggtgcatctatgcaagccacattcagcgggcaactaggcaagcaatcttcctcgctgattgctcgtcttgtctcgtccaaaatgcctggaggtttcaatatcacggctgttcgcaaatatctggagacaaggtggggcttgggtcctggccgacaggatggcgtcttacttctcgcccttactatggaacccgcctcacgtatcggttctgagcccgacgccaaggtgttccttgatgatgttgcgaataaatacgctgccaactcaggcatcagcctcaatgtcccgacggcttctggagacggtggagcaagtgcaggaggaatgctcatggaccccgccgctattgacgctctgaccaaggatcaacgtgctttgttcaagcagcaactggagataatcgcccgttacttgaagatggatctccgagacggtcaaaaggcttttgttgcttcacaagaaacccagaaaaccctgcaggcgcacgtcgatttatggcaagcagaacacggtgacttttatgcctcgggaattgaaccttcctttgaccctctaaaggctcgtgtttacgactcctcttggaactgggctcgtcaagatgctctgagcatgtactacgacatcattttcggaagactcaaggtcgttgatcgtgaaattgtcagccagtgtatccgcatcatgatccgctcgaaccctcttcttcttgaattcatgcaataccacatcgacaactgcccaaccgaacgcggtgaaacctatcagcttgccaaggaacttggtgagcagcttattgagaactgtaaagaagttcttggtgtctctccggtgtacaaggatgttgccgtacctaccggtcctcagaccacgatcgatgctcgcggaaacatcgaataccaggaggttcctcgtgccagcgctcgcaagttagagcactacgtgaaacaaatggcggaaggcggccccatctccgaatatagcaaccgggctaaagttcagaacgatttgagaagcgtctacaaattgatccggagacaacaccgcttgtctaaatcctcccagttgcaattcaatgcactttataaggacgttgttcgggctctcagtatgaatgaaaaccagatcatgccgcaggagaacggcagtacgaagaagcctggccgcaacggctccgtacgcaacggaagccctcgcgccgggaaagtcgaaacgatacctttcctgcatcttaagaagaagaacgaacacggctgggattacagcaagaagctcactggtatttatctagatgtgctggagtctgctgcccggtccggcctcacattccagggtaagaacgttttgatgaccggtgctggagctggttccattggagcagaagttcttcaaggattgatcagtggcggtgctaaggttattgtaaccacgagtcggtattcccgcgaagtgactgagtactaccaggccatgtatgccagatacggtgcacgtggttcgcagcttgttgtggtgcctttcaaccaaggcagcaagcaagatgtggaggccttggtcgactacatctatgatacaaagaagggcctgggctgggatctggacttcattgttccatttgctgcaattccggaaaatggacgagaaattgattctatcgactcgaagtcagagctcgctcatcgcatcatgttgactaatcttctcagacttttgggtagtgtcaaggcgcagaagcaggccaatggtttcgagacacgaccagcccaagtcattctcccgctgtctccaaaccatggtaccttcggtaatgacggactttattcagaatccaagctcgctttggaaacactcttcaaccgctggtactccgagaactggagcaactacctcaccatttgcggtgcggttattggatggacgcgcggtacgggcttgatgagcggtaacaacatggtcgccgaagagttgagaaactgggcgttcggaccttctcgcagcaggagatggcattcaacttgctcggcctcatggctcctgcaattgtaaacctttgccaacttgatcctgtctgggcagacctgaacggcgggcttcaattcatccctgatctgaaagatcttatgactcggcttaggacggagataatggagacgagtgatgttcgcagagcggttatcaaggaaaccgccattgaaaacaaggttgtgaatggagaggacagtgaagtcctatacaagaaagtcatcgcagaacctcgcgcgaacatcaaattccagttcccgaacttgccgacttgggatgaggacatcaaacctctcaacgaaaaccttaaaggcatggtcaatttggacaaagtcgtcgttgtcacagggttttctgaagttggaccatggggtaactcccgtactcgctgggaaatggaggctagcggcaagttctctctggagggttgcgtggaaatggcttggattatgggtctcatcagacatcataatggacctatcaaaggcaaaacctattctggctgggttgattcgaagactggggagccagtggatgacaaggatgtcaaagccaagtacgaaaaatacattcttgagcattccggtattcgcctaatcgagcccgaactcttcaaaggatatgatcccaagaagaagcaactgcttcaggagattgtcattgaggaagatcttgagccatttgaagcctcaaaagagaccgctgaagagttcaagcgggagcacggagagaaagtagaaatatttgaggttctcgagtccggcgagtacaccgtccgcctgaagaagggtgccacccttctcatccccaaagcactccagttcgaccgtttggttgctggtcaggttcctaccggttgggatgcaaggagatacggtatcccggaggacattatcgagcaagttgatcctgtgaccctctttgtccttgtctgcactgctgaagccatgctctccgccggtgttacggatccttacgaattctacaagtatgtccatttgtctgaggttggtaactgcattggatctggtatcggaggtacacatgccctccgaggcatgtacaaggatcggtacctagacaagcctctgcagaaagacattctccaagaatccttcatcaatacgatgagtgcttgggtgaacatgttgcttttgtcttctacgggtcctattaaaacacctgttggtgcttgcgctaccgctgtggaatccgtcgacattgggtacgagacgatcgtggaaggcaaggcgagagtctgcttcgtcggtggttttgatgacttccaggaagagggctcctatgagttcgccaatatgaaagctaccagcaatgctgaagacgaattcgcccatggtcgcacccctcaggaaatgtccagacccactactaccactcgtgcaggctttatggaatctcaaggttgcggtatgcagctcatcatgagtgcccagctcgcccttgacatgggtgtacccatctacggaatcatcgccctcaccacgactgccactgacaagattggtcgttctgtgcctgcacccggtcaaggtgtcctgaccacggcacgcgaaaaccccggcaagttcccgtcgcccttgctggacatcaaataccgccgcagacaactcgaactgcgcaagaggcagattagagaatggcaggagtcggagcttttgtatcttcaggaggaggcagaggcaattaaagctcagaaccccgcggactttgttgtcgaagagtacttgcaagagcgagctcagcatatcaaccgcgaagccatccgacaagaaaaggatgcccaattcagccttggtaacaacttctggaaacaagactcgcgtattgctccccttcgtggcgcccttgccacatggggtctcactgtggacgatatcggtgttgcatcgttccacggtacttccactgttgcgaatgacaagaacgaatctgatgttatttgccaacaaatgaagcatctcggacgcaagaagggcaacgcacttcttggaattttccagaaataccttaccggccatccaaagggtgcagctggcgcttggatgttcaacgggtgtctgcaagtcctggacagcggcctggttccaggcaaccgtaacgccgacaatgtcgacaaggttatggagaagttcgattacatcgtttatcctagccgcagtatccagaccgacggtatcaaagctttctctgttacttcgtttggtttcggtcagaagggtgctcaggtcattggtattcatccgaaatacctgtatgccactctagatcgcgcacaattcgaagcatacagagccaaggtcgagactagacagaagaaggcataccgctacttccacaacggcctggtcaacaatagcatcttcgttgccaaaagcatagctcctatgaagcgaaacttcaaagcaaggtcttcatgaatcccgattaccgtgtggccgcagacaggaagctttcagagttagactatccacctaagccccctgttgctactgacgcaggatctgaaagtaccaaggctgtgattgagtccctggcgaaggctcacgccaccgagaactcgaaaatcggcgtcgatgttgagtctatcgatagcatcaatatctcaaatgagactttcattgagaggaattttacggccagcgaacaacaatactgccagaatgccccgtcgccgcagtcatcgtttgcgggaagatggagcgcaaaagaggctgtcttcaagtccttgggtgtctgcagtaaaggtgctggggctcccttgaaagacatcgaaatcgagaatgactctaacggggcgcctactgttaaggtaagatcactcaacatgtttcatgttcagttttacatttgagctaacgatttctagctccatggtgttgcggccgaagctgctaaagaagctggtgtgaagcatatcagtgtcagcatcagccacagtgacatgcaggctgtcgcagtggcaatctcacagttctaatgt

SEQ ID NO: 36608 - DNA, 1024 bp, Aspergillus nidulans
ctagagggccattcagattggattgaaacagttaccttctcaccagacggccggctactggcatctggctctaatgatacaaccatcaagctctgggatcctgccagcggtggtctcaaacagacgttggagggccattcaagttcagtacagtcagtggccttctcaccgaatggccagctgctggcatctggctctagtgatacaaccatcaagctctggaattctgccagcgatagcctcaagcatactatggagggccattcagatagggttgaatcggtggccttttcaccaaatggccaggtcctggcatcatgctctgaaaataacgaccaagctctggaatcctgccattggcagtctcaagcacacgatagagggccattcagattgggctctgtctgtagctttttcaccagatggtcagctccttttatctgggtctgctgagaagaccatcaaactctgggattctgccacttgtggcctcaagcacactttagggggccattcaaattgggttctgccattggtcttctcaccagacggtcggctactggcatctggctctaatgatgcaaccatcaagctctgggatcctcccagcggtagcctcaagcataccctagagggccattcgaataaaatcgagtccttggcattctcaccaaatggccagctgctggcatctggctctagtgacgcaaccattaagctctgggatactgccactggtagcttcaggcacactctaaagggccattcagatatggttttatcagtggtcttctcaccagacagccagctcctggaatctggctctggtgataatactatcaagctctgggatcctgccactggcattctcaaacatagtatgagaactcctggcattgttaggagcattgaattctccatagagctgcctcagcttattaccaacctgggaacttttagtattcaagcctggcatacaggctacccatcaagatcttctggaaaaaagactgcagtctctgta

SEQ ID NO: 36609 - DNA, 570 bp, Aspergillus nidulans
atagatgaacccggctttgtcgatctgctagtcaaacggtatcccaacggaaaggcaagcacgcatttgcatagcttgaagccaggcgacaacctttttatcctcgcatccattcccggtttcaattggaccccaaataagttttcccatgtctacctcatcgccggcggcgctgggataacgccaatctaccagctcgcgcagggcatcctcgacaatccggcggacaagaccaagatcaccgtgatattcggcgtcaatacggagaaggatatgcttctgcgcgaggagtttgatgcgtatcaacgggcgtatcctgaccggatcgatgttctctataccgtcagtcggccgggcagcgagttcaggccggctccaaacgtgcgatcaggttatgtgacaaggcaggtccttgcggaggtcatggggggccctgacgaggccgatacgaagatatttgtttgcggaccgcccgcaatggagaaggcgctggttgggggcggatttggccagggccagccagggattttgcagcagctgggctatccgagagataggatctaccggttt

SEQ ID NO: 36610 - DNA, 816 bp, Aspergillus nidulans
ctcaaatctcaacccgacgaggacaccactacaggcatcaaggcccttctcgcacacgaagcttctcctacattccccgcgaagatatggcataaatgcggtccgaagggtgtcaacgagcatgctcagaagttgatggacctatggctcgagaagaacccccatttgcgccatgagctcctcaccgacgagagcgccgaccaatacgtccgagagaactatgcggattggccggacgtgctcgaaacatatatggccctgcaagtgcccattctcaaagccgattttcttcgcgtcctcattctatacgccgacggcggtatctggagcgatctcgatgtccaagacgaagttcctgtgtcggagtgtattcctgcaacgtctaccgaggatacggaggaccccgtaaacgtggggggcggcataaagttcgacggatggcagttcaccagctggaccattatggccaagccgcatctcctacacttcaagaatgtcatcgagtatgtcgtgaaacagctcaagacaacggcaattgaaaaccatgtcagtctgtcacaagtcacgaaagccatggtcggggaggtagtggctgtcaccggcccgcaggctattacgatggcgttgcttcaaagcgtctctgaggagaccggtcaggatatcacgaaacaacacatccgccagctgaaagagccgaagctcctcggtgatatcttggtcctaccacaagccgcctttgcagcgctgcaaggtggcaatccgacggatcagggcccatacctagtatcacatcagtatgccgggtcgtggaagaac

SEQ ID NO: 36611 - DNA, 1486 bp, Aspergillus nidulans
gctctactcagcgagcggggcgtcagcactggcgactttgtcgctgtctttactaccaactcaccagagatggtcgcgattatttatgctctttcaaaacttggagccgttgctgctcttataaatattaacctgcgaggtatgaacttactagtttcttatatgatcgaggctcacagatctgaatgcagatgatacattcgcccactgtcttaatgtctccggctctaagctcattatctctacgccggatctcgcacaatttgtgtgctcagacatgcctcacctgtcatttaacatctcttcttttgacggtatctctacggcgtcagatctgatcacacccgcggacttgcagcagtactcctcttccaatctaacagctgcaaagagaacccccgcggatctatcagctcttatatatacgtcaggaactaccggaaaaccgaaggcatgcgccatccgcaatatgatgactctgataacatccacccctcattctcaagatgtcaagcacccgtcgagatacttccctctacgaatctactgctcgctcccgcttttccatggtacagcctacttcaccggactgtgtgcttccgtgggctatgcaggcacactctgcatccgccgcaaattctctgcttccaaattctggaaggacgtccacgactcaagagctactcggattctttatattggagagctgtgcagataccttatggctacgcctgcttctccctatgatcagaaccatgcctgcattgtcgcttctggcaatggcctgcgaggggatatttgggaacgcttccgcgagcggttcaatgttcctgagattcgcgagttctaccgctcaaccgagggtgttgcgaaatacgacaacttcgggtttggatcgtggggagccggcaaggtcgggttctcaggcccaattaagcggtttttcgaggatgataccgtcatcgtgaaatatgatccggatacagagatgccctatcgggatcctaaaacggggttctgcgttagggtgagagtcggcgaggaaggagaggcgattggccgtgtcagaaaccgcggcttactcacagagtacttgaagaatgaagaagcgactgagaagaagctcctccgggacgtatttgagaagggggacctctttcaacgtacgggtgatttgtttgtacaagactcggatgggtggattaaattccaagaccgggtgggagacacattccgctggaagggcgagaacgtcagtgcgggtgaaattcgagaccacatttctgccattcctggagtttacgacgccgttgtgtacggcgtcagactcggagcttatgatggacaggctggcgccgcgggtatcacgctcgaggagcacaccgaggctgctgccaatgagtttatgggtaagctccgtgcggagctgaagaagaagggtgttccatcctacgctattccacggcttgttcgactgacagagaag

SEQ ID NO: 36612 - DNA, 1541 bp, Aspergillus nidulans
atgtcatcaccccagcagcgactctcttctatttcaaaccagctctcgggctcgagtgctgccgcctccagggagaaactgttggccaagaaccctgacgatgtggtatgtttacttcgtattatgggagaattctatgtctcacgctttgggggcaggtaatcacgctcgctgttcgaacgccgctcaccaaggcgagaaagggtggtctcaaggacactcgtcttgatgacctgcttatctcgttactgacggtatgttgggaaatctcgcacccgccaggtctgcttgtatagtctaatgggtggaatagagtgtgcgtgaaaggtccaagctggatccgaatctcgtcgaagatgtctgcgtcggcaacactctctgccctggccaggcatatgttgcgcgctctgccgtgctcgcagcaggattccctataacaaccgctgcatcagttgccaaccgtttctgctcttctggattgctggcgattcagaacatcgcaaaccagatcattgccggctcaattgatatcggaattgcagtaggtgctgagagcatgagcaccaatgccgacggtggcgcaccggacctgtccgaggcgatcttgtcgcaccccatcgcgtcgcaaaacacgcaacccatgggccagacatccgagaatgtggccggtcagttcggtatcgcccgcgagcagcacgatcaattcgctgccaaaagctatcagaaggcggagcgtgcccagaaggcgggatggttcgaggacgagatcgtccccgtcaagacgcagatcaaggaccccaagactggcgaaatcaaatccatcatcgttgatagggatgacggtatccgctatggcacaacagctgagtctctggggaagattcgctctgcgttccctcagtggaagccaagcaacactactggtggaaatgccagtcaaatcactgatggtgcagcggcgcttgtgctcatgaagcgatctcgtgcacaggagcttggccagcctattctaggcaagtttgccggagcaaccgttgttggtttggaacccaggatcatgggaattggccctacctatgccattcccaagattctctcgaagttcggtttgaccaacaatgaagtcgacatttttgaaatcaatgaggcgtttgcatcaatggtacatagtccccttgttgttgtgtgcgggggaaaccactaatactcgacagggcgtttactgcgttcagaaacttggtttggatgaggctaaggttaaccctcgtggtggtgctatgtaaggcgtcagctccctgtaagaagattgttggctgactattatagtgccttcggtcatcccctcggtgccacaggcgctcgacaggttgtgactgccctatccgagttgcgacgaacgaacaaaagggtagccgtcacctccatgtgtgttggaacagtaagcactatcttctcagaaatgcatcaaccattcactaacggtctcgttgtagggcatgggtatggctggtatctttgtttccgaacattagctgcatgat

SEQ ID NO: 36613 - DNA, 352 bp, Aspergillus nidulans
cacgtcacaggccctccggattcccagcggaatttcctcgtcgttgacgcaaagacagagaactcaactatcgaaaacgcattccagaacttcacacaggaacgaaacgatatcgctgtcctcctgatcaatcaacatgtatgcttattagtcgattgcttgtcctcaagtatttcccacacggcttgcaatatactaactaccagcacagatcgcagagcgcatccgacacgtcatcgattcttactccgaagccttccctgccgtccttgagattccaagcaaagaccacccatatgatcctgagaaagacagcgtattgaagcgagttcgtcgattattcggtgaatag

SEQ ID NO: 36614 - DNA, 639 bp, Aspergillus nidulans
gcatggctctaccttctggcggtgttgattaacgccgtcaacctgttcttgcaggtcttcttcactatcatgtacagtgatcttgaatggtaagcatttatttacacctcaaatccagctgctcttctaagcaatcaaagcgcaaccgggcgctggaggaagttcttcatggtttccgctaatctggtgctgcagtgactacatcaaccctatcgacctctgcaaccgtctcaacgcgtacatcatccccgaagctggtgtccacgctttccttaccttcctcttcgtgataaacggctactggctcgccattgccctaaatctgccgctgttggcatttaatgccaagaagtgcgttccttccagcccgagtctgacgacgagtctgcgcgcattagagttgggttctgactcccttactttgcaggatctacgacaaccagcacctccttgatgcgaccgagatcttccgcaagctcaacgtacacaagaaggttagacttaccatttacgtcataaggcggggaatcacggacactgacctccgagctctaggaatcctttatcaagcttggtttccacctcttgatgttcttcttctacctctacagcatgattgtggccctcatccgcgacgag

SEQ ID NO: 36615 - DNA, 1279 bp, Aspergillus nidulans
aacactcttttggttgccgtagcggctggtaccgcgatggctgcaccccagctcaagaagcgcgccggttttacgtgtacggcgtcaaccttctccagcttgttgaggtagcttgctgatctaggcagtttttggagtcaccgaggctggcgctgagttcggcgagaaaagtattcctggtgtttgggtatgcctagaggtccatctggatgcgacctaggctgacgaacgcaaatgcagggcactgactacaccttccccgatactgaatccatcttgaccctcatctcgaagggtttcaacactttccgcattcccttccttatggagcgtctgacgcctgagatgacgggctctttcgacgaaggatacctgaaaaatctgacttcggtacgtccatggctctgttcgtcgatgtaagacttcttctaacgaatcaggtcgtcaatgcagtcaccgatgcaggagcatgggccatcgttgacgcccaaaactttggccgattgtacgcccctggtttaccctacagaagcatctactaatagacccagcaacggcgagatcataagcagcgcctccgacttccagacttggtggaagaacgtagcggccgagttcgcggacaataagaacgtcattttcgataccagtatgtcattcctattcgttaggcggtcatgttttatttctcttgtatattactctctgcatgggtcttaaagctaacacgtctggggcagacaacgaattccacgacatggaccagaccctcgtgctggatctcaaccaagccgccatcaacggcatccgcgcagccggcgccacctcgcaatacatcttcgtcgagggtaactcgtacaccggcgcctggacatggacggacaacaatgacaacctgaaatccctcaccgacccgcaggacaagatcgtctacgaaatgcaccagtacctcgatactgacggctccggaacacacgagacctgtgtttcggagacaatcggcgccgagagggttgaatccgcgacgcagtggctgaaagacaacggcaaactcggtgtcattggtgaatttgcgggcggcaataacgagatatgccgcgcagcggtcaagagtctactggatgcgctgaaggagaacgatgatgtttggctcggtgcgctttggtgggctgctgggccttggtgggaagactatatgttcagcatggagccgacggatggcattgcgtatacggggatgctcagtacgttggaggcgtacatgaattaagttatctga

SEQ ID NO: 36616 - DNA, 924 bp, Aspergillus nidulans
agtgtggccttttcacccgacagtaggcagatcgcagcaggctttaaagatggcaaaatctttatttgggatgctgcgggcactcttcagaagacgctagagcgccatccaggggcaattatgtctatcgccttctcaccagacgtcaagcagcttgttacatgctctactgattcgacaatcaagcgttgggatattaccataggtggcgttcaggaagctgtaggccactcaaagcatgttacaactatggtcctttcaccagacggcaaggtgattgcgtcaggctctgctgacaagactatcaagctttgggatgctgcaacgggcgatctccagaaaaccctaacagggcatctagacacagtagagaaggtggtcttttcactagacaacaggcagatcgtctcctgctcctccgaggcagtcaaaatctgggatgctgccacaggtaaggtccagaactcatttgagagcgatgacgtgttcacaattgtggctgtctcacctgacggcaagcacatcgcatcaggccattgtaacggcaggattaagctctgggatatggccacaggcagtctcctaaagacaatggcgggctacagaagcaaatttgattccctggtgacaacagaggttttcgatatccaactccaagaagcgatcttcaatacccaaatcacggggctggttttctctcctgatgccaagctaattttatcaacgtccactgatagagccattaagctgtgggatgctgcaacaggagacctccagaagagactaccatgccattcagacagcatcattactgatgctttttcacgcagctcaggctatccaaactggatcttttcagtggccttttcatcagacggtcagcatatcgcggcagcctctgctgataaaaccatccgggtctgg

SEQ ID NO: 36617 - DNA, 1147 bp, Aspergillus nidulans
tttgcagggaagatccttcaggatgacaagacggttgagttctacaacatcgaggaaaagggatttatcgtgtgcatggtttctaaggtataagcttttcaagtttttctttgatacaaccgtactaactacgagattcctcagcccaaaactcagccgtcctcgcaaagtccgtcaacaccagctaaatcagtgacttcaactcccgcgccccctcctgctcccgctccgtccacaaacacatctacaacagccacctctggccccgttccggcaaccccttcgcccgcttcatctggggctgcccagtcctctgctagcactttcaacgatccttcagcgctgttgactggctcgcaaagtgaagaagtaatcaaccagatgatgagcatgggctttgagcgggagcaaatcaaccgtgctatgagggcggcgttcttcaacccagaccgggcaattgaatatctgctgaatgtgagtcttgtcgtgtttcaattcacgtaacagttactgatctctgcctttgcaatcaagggcattccggaaaatatccagcaggagcaacaacaaagatcagccgctaccacccctgccgctcctcaagccgccgctgctagcggagctccacctgctacctctggagaagacgagccggtcaacctctttgaggctgctgctcaggctggtgaaggtcgcggcggcgctggcggtgcgtctggtggcgaaccccagtcactcgacttcttacgcaatcatccagctttccagcaacttcgccagctagtccaacagcaacctcagatgctggaacctatccttcagcaagttggtcaggtaacccccagattgcccagctcattggccaaaacgaggaagctttccttcaattgttgagcgaagaggacgatgctgcacttcctccgggcacaacccagattcacgttacggaagaggagcgagacgccatcgaacgggtatgctttcgattccttggccgttctttttctcttagctgacttagccctagctctgccgactcggatttccgcgagacctagttattcaagcctatttcgcctgcgataagaacgaagagctcgcggcaaactacctgtttgagaattctgacgacggtgacgatgcatga

SEQ ID NO: 36618 - DNA, 2578 bp, Aspergillus nidulans
ctggaaatcgacacctcgaaggttcccgaggccaggcgtccaaaggccgccacttttaaattcctccaggccgccatccaagaaatggcgtttcctcagcaagaatgctttctcataacagacttgtacggcgagaacacaatcggattcaccaaggtcataaagatggtaaatcgggttctggacatcctagagattcaaggccagctgaagaaaccgtccgataccgccatggccgcgccagcagcaggaaggaagctcaccaagcgggaacacatcttgaaggagttgctagaaacagagcgcgactatgttcaccatctccagaacttgcaagcgctcaagaaggagttggaggatactggagctctcaccggtgatgccagtcatcaaatcttcttgaatttgaacaacctgcttgatttctcccagcggtttctcatcagactcgaacaacactatgcgcgaccagaagaacagcaaaattggggtgaattgttcatccaacacgaagaagctttccgccagtacgagccatttatcgcaaaccagatgcgctgtgataagacctgtcagaaggaatgggacaaaattcaggctgcgccgcgctcccccgatctccaacagatggtcgcgcaacctgcaacactcaatggtttcttcgtgaagccattccagcgcttgaccaagtatcctctgatgctatctgttagtatctctgagtagctacttgaatttgattcgatactgattatccgttaccaggaactgcgtaagcagatcgaggacccagaccttcaagccgacatttcgcgcgccatcgactctatccagtccgtcctagatgccgccaacgacgccattgacaaggagcaacttgccgctgcattcgttgaactggacgaacgtgttgatgactggaaagccctgaagattgagacattcggtgaactgctatgatttggcacgttgacggtaatcaagatcgacaacaataaagattcagaaagataggtgagcaaatgttacactccacagtccgacttgcgatgacagcttgttaatatgtccgcgattacagtaccacatctatctctttgaacgaatcctgctttgctgcaaggacataaaccctaacaagcagaaatcaagattggtcggcggtagtaaagataagccgaataccagcaagggcaagccccggctcgtgctgaaaggccgcatctacatggcgaacgtcaccgatatcgtctggcttcaaaaaccaggtaagccgaagttcattagcagtgcgaaccacctcatggtaacaaggatttgctaggctcttatcgcattcagatcttctggaaaggggaccctggtgtggtggataactttattatccgctatcagaatgaagatacaatgcggaaatggtacaaggacatcaatacacaacgggagatacaagcggagcaacgcagtgctcgcaataccggcacatccgattccgaatttacctacatgaaatctttgagcaacatcccaaacccttaccagcaagaatatgatgttgaagagcagtccacgaaagaagcagctttcttctccgaatttcctatgagtcgcaatgcttcgagtacaagtctccgaacccgatctgcgacaggtggaagtggtagctctggtcctccactttccactagccgaccccgttacccagcaatgcctgactcgactttgtcagtacacacacagttccctggtggaagtatgtcgccaggagagagaaatggcaactcttacttctctcctaccgagtccgccaggtcgagctcacaatcggtggatacccttacaatcgccaggtaacccccgtcaccccatggggcgacgacaataacccatacacagcccctgccctctctcgcgccacatctagggacggttctaactcgggttattttaatggcgcaccaccgaatgggcgcagtgctcaacgcccgtccctgcctccaatgtcaggtagtaaccaatcatcgaacagcgcgtcccagaggatgcgtccgcgagcagcccggacattcaccatcacaatcctgaatcgcgtcggtacatgggtgttcacacaatgcaaacagttgacaatgtgcccgttccacctattcctgctcatatggccaacatgaaggcgcccgtcaatcggagccagaataactccccgactaatcaatctcttcccattcgaacgaatacttctcacgccttccatgagcctcagtactccgacgggcgagcggccgcgcctctttcagatcagccaacttctccattaagccacgaacccgaggaggagccgttcatgccgacccaattgaaggccaaagtcaactttgacgagaactatgtaacactggttatttccagcaatatcggattccgtacgcttaccgaccgggttgacgccaaactcgccagattcaccaaccgctcaattggcagcaagacggtccgtttacgttaccaagacgaggacggcgactttgtgacaatcgacagcgacgaggccgttcaactcgccttcgtggaatggaaa

SEQ ID NO: 36619 - DNA, 1299 bp, Aspergillus nidulans
ttcatcaacaacgagttcgtgaagggcgttgagggcaagaccttccaggtcatcaacccctccaacgagaaggtcatcacctccgtccacgaagccaccgagaaggatgttgatgtcgccgtcgctgctgcccgtgctgcctttgaggggccatggcgccaggtcaccccctctgagcgtggcattttgatcaacaagctggcggatctgatggagcgtgatatcgacaccctcgccgctatcgagtctctcgacaacggcaaggctttcaccatggccaaggtcgatcttgccaactccattggttgcttgcgatactacgctggctgggcggacaagattcacggtcagaccattgacaccaaccccgagactcttacctacacccgccacgagcccgttggtgtttgcggtcagatcatcccctggaacttcccccttctgatgtggtcctggaagattggacccgctgttgccgctggtaacactgttgtcctcaagaccgccgagcagacccctctctccgccctttacgctgctaagctgatcaaggaggctggattccccgctggtgtgatcaacgtcatctctggctttggccgtaccgctggtgctgccatctccagccacatggacattgacaaggttgccttcactggctctactcttgttggacgtaccatcctgcaggccgctgctaagagcaacctgaagaaggtcactcttgagctcggtggcaagtctcccaacatcgtctttgatgatgctgacattgacaacgccatttcctgggccaactttggtatcttcttcaaccacggccagtgctgctgtgctggatcccgtatcctggtccaggagggcatctacgacaagttcgtcgcccgcttcaaggagcgtgcccagaagaacaaggtcggaaaccccttcgagcaggacaccttccagggtccccaggtttcccagctccagttcgaccgtatcatggagtacatcaaccacggcaagaaggctggtgctaccgtcgccaccggtggtgaccgccacggcaacgagggttacttcatccagcctactgtcttcacagacgtcacttccgacatgaagattgcccaggaggagatcttcggtcctgtcgtcactatccagaagttcaaggatgaggctgaggctatcaagatcggcaactcgaccgactacggtacgtctatcttttctggtctttgccgatattttgttgctaacatacgcacaggtcttgctgctgccgtgcacacaaagaacgtcaacaccgccatt

SEQ ID NO: 36620 - DNA, 1253 bp, Aspergillus nidulans
tctgagaaccaactgatggtccgcgacgccatctcaggcatctgcgccggctttccaaatacctactggcaggaatgcgaccagctcgagcgcgacccgaaagaatttcacgcggcgcttgcaaaggctgggtggttgggaatcgccctgccagaggagcacgggggcgcgggactcggtatgacgcgcgtaaaacaccagcaacatatacctattgcgagaccaagactgactcagaaaaaggcatctctgaagcgacgattatgatgcagacaatcacgcagtccggcgctggaatggccggtgcgcagtccatccacgcaaacgtgtacgcaacgcaaccgctcgcgaaattcggcaacgaacaacagctcaccgagacgatcccgaacattatcaatggcaaatggcgaacgtgttttggtgttactgagccaaataccgggcttgagacactggcattacagacgcgggccgagctcaacagcaccgggacgcactactccatcaccggccagaagatctggatcacatgcgcacaggtagcgaggaagatgatcctgctggcgcggacaaaaccaagagaagaggtttccaagccgacgcaggggttgagcatgttctgcatcgacattgacaagaacgagcccggactggagctgaagaagatcaagaaaatgggcggtcgtgctgtggatgcgaacgaggtcttctttgacaagtaccaagtccctgcttcgacgctcatcggccgcgaaaacgagggtttccggatgatcctacacggtatgaatgccgagcgatgtcttctcgccggcgaagctcttggattggggtatgtcgctctcgaacgagcggcggagtacgcgaacacccggcatgtgtttggccgcgccatcggcaaaaaccaggccatcgcgcatccgcttgctgatgtctacatgaaactcgaggcggcaaagctggccacataccacgcggccaggttgtatgatgcctcgcggacagatgagtccatccccgcgcatagtgttggagtggcggcgaacagcgcaaaataccttgctgcggaggcagcctttacggcgtgtgagagggcggtcttaacgcatggaggcatgggctatgcaatggagtacgacgttgagcgatggctgagagagtgcctagttcccaggatcgcgccggtcagtcgtgagatgatcctgaactacgtgagtgagaaggtgctggggctaccgaggagctactag

SEQ ID NO: 36621 - DNA, 1855 bp, Aspergillus nidulans
cggcctccgtttgtctgcgcaattaccggaaagtcatactcgactaaggtactggttgatcgagtagagttcttgtcgcggtcacttgcgcaagagctgggatggtcgccgaacgacgggggagccggaggataaagttgtcggtatctacagctggaatacggtcggtgacactcgtttgcattgctcttcctttgctataagctgatgaagaaaaaaaaatagcttgacttttttgctctctgctgggccgtccatcgtctcaatgggatctgtctcccgctccatccgtttagtatcgtccccgaggtcgtagcgcacatgaaaagagcaaaatgtagagtcatattcacctgtcagtctcttgttgcaaacactttggaagctgccagggagctgtctattcccggagacaagatctataccacggcattacccgaagcgtatcttcagaatcccgagccgattgaccagttcaagtcggtagatcaactgattgctgagggtgagaagttgcagcgacttccaccattacagtgggagaaaggccgcgcaaaaatacaggtcgcatactactgcgctaccagtggaacatcagggaagcaggtcggtggctcttctcgggaatggagatgatggctgacgggcaattgtagaaactggccaaaatcacacactacaacttcattgccaatgtcatgcaagtgtgcatgcacgagagctatgctaagaatggccgtaacgagatcgcattcggcgcgattccgttgacccatggatatggactgaacattgggcacatcatggtctaccgcggagacacctacgttatctgcccccggttcgatatgcagttgatgctcaagacaattgagcgtttccgcgtcgaaagactatacgtggtttgtattctcaggcctaggaatgcaagccaaactaattgcgcaggttcccccaatccttgcggcattagcagcgaaccccttccttcttgacctccacgacctctcatccgtccaagcgaccgtcactggtgctgcagcactcgatcgtagtatcgccgcgaaactgaataaactgcgacccacgtggaaaatcaaccatgcatacggtattgtcaataaccctagcgctagctaacggctaatatgagacaaataggcctcaccgaaaccggtgtggtagcaactctcacaagcccacacgatgtctggcacggctcctctggttccctccttccaagtttcgagatccgactcgtcaagcccgacggtacagacgcagagggcctcgacgagcccggcgaagtccacttcaactcccccagttgtttcctcgggtacgtcggcgacgacgagtccaacaagaacaccttcgacgaaaaggggtggcttaagtccggagacatcggtgtttttcgcaaatcgcctaacggacacgctcacctgttcattctcgaacgcatcaaggatatgatcaaagtcaaggtacgtcgtttcttgaatggaattttaaatatatgagcaaggtcaacttaatgaatacaaaacagggcgaacaagtcctcccacgggacatcgagtccgtccttctttcgcacccagccgtaatcgatgcagctgttatcggcgttccggacgagctctctggcgagcgtgcgaaagcgtacatcgtgcgctcgaagaccgtgatggaagatctggacgaggatgatctggctgacgagattgacgaatttgtgcagggaaagctgcatgaatcgcactggcttcacgatcgaattgtgttcctggagaagttgccaaagagtgagagtgggaaagtgttgaagaaggatttgaaggccatgaactaa

SEQ ID NO: 36622 - DNA, 1118 bp, Aspergillus nidulans
aacaatgcatccttgctgagtcataagcagacctttgatatgtacctggcgaatgtgaagaagacggatgatcctgccgttcagtatgaatttgccgttttcatggtcaacgccatgctagaaatgccggacgatgtattggaaggcggcaagccgtcaatctcagttgagaaaggcaaaacttccaacgacattactcgctcccatctcttgaaagaggccaaatcgattttgcagggactagccaaccgcagttatccttttgctcagtactacctagcggacggctatgcctcgggcttattcagtaaagggaaagaggattacgaccgcgccttcccgcttttcgtagctgcaagcaagcatggccatgtcgaagcatgctaccgaactgctttatgttacgaatttggatggggactagggttgaggcttcaagagcccaacagttctatcgtcaggcggcctcgaaaaatcacccaggcgctatgctccgaatggctaaggcctgtcttgcaggagacatgggattgggcaagcgctatcgagaaggtatcaagtggttaaagcgagcggcggaatcatccgatgctcaatacaactcggcgccttacgagcttggactccttcacgaaaccggttacggagatgatgtctttgtcgatccgtcttatgccgctcagctcttcaccaagtcggctgatctaggtcatgtagaggcctgctaccgtcttggggatgcttatgagcacggaaagctgaattgcccaaaggatcccgccctaagcattcacttttacactggagctgcgcaaggcggtcatccacttgcaatgatggcgcagtgcgaatggtacttggtcggtgcagagcctgtgctggaaaaggatgagttcgaggcgtacgaatgggccaagcaggctgctgagctcggtgagttgtctgacactgtttataataattccggctaatgtaaaacaggtcttgcaaaagcacaatatgctgtaggttacttcacggagatgggtattggatgtcgacgtgatcccttggaggccaacgtctggtacgtcaaagcggccgaccagggagataccagagcggtgcaccggatcgca

SEQ ID NO: 36623 - DNA, 1082 bp, Aspergillus nidulans
ttagctggtggtggagccggtatgatggaggctcttgtatgccatcctttgggtacggaacatccaatccagtcgcacaagcgtaaacattaacaaatagtctagacaccattaaggtccgcatgcaactctcgcggcggtccacggcacctggtgtaagttcccaaactctttatgggtcggagcgcagttactcatttgattgcaggtcaagcctcgtggtttcgtgaaaaccggtgtcgagattgtcaagaaggaaaccgcactcggtctgtacaagggtctcggagccgtcttgggcggtatcatccccaagatggccatccgattcacctcctacgagcaatacaagcagttgcttgcggataagaacaccggtgctgtctccagcaaagctacattcctcggtacgccaacactagtcctaatcgcgcattatacagttcgcgtagatgcagttcgatactaacgagtaatgaacagccggtctcgccgcaggtgtaacggaagccgtcgccgtcgtgaaccccatggaagtcattaagatccgcctgcaagcgcaacaccactccctcgccgacccccttgacgctcccaaataccgctccgcccctcacgctctcttcaccgtcatcaaggaagaaggatttatggccctctaccgcggtgtctccctgactgctctccgccagggtacaaaccaagccgccaacttcacagcctacacggaacttaaggccttcctgcaacgcagccagcccgaatacagcaactctcagctccctagctatcagacaaccgttatcggtctgatttctggtgctgtcggccccttctccaatgcacccatcgacactatcaagactcgtctgcagaagacgagagctgagcctggtcagagcgccgtgaacagaattatgacgatcgccaaggacatgttcaagcaggagggtgctagtgcgttctacaagggtatcacgcctcgtgtcatgcgtgttgcacccggacaggccgtcacgttcacagtgtacgaattcttgaaggggaagctggaggcgtcgaactgggcgtttgtgggcgga

SEQ ID NO: 36624 - DNA, 1334 bp, Aspergillus nidulans
atgaagaacgtggttcgccggaagctaaccggctatgttggtttcgccaaccttcccaaccaatggcaccgcaagagtgtccgcaagggattcaacttcaatgtgatggttgtcggtgagttgcacatcaggcgaagcgaaaaggagtccatttcactaacgatctcgctaggtgaatccggactcggaaagtctacgcttgtgaacacccttttcaatacttctctttaccctccgaaggagcgcgcgggacctagtcacgacatcatacccaagaccgtctcgattcaatccatcagcgcggacatcgaggagaatggtgtccgccttcgtttaaccgtcgttgacacccctggattcggcgactttgtcaacaacgacgattcctggcgccccattgtggaaaacattgagcagagatacgatgcttacctcgaggctgaaaacaaggtcaaccgtacgaacatcattgataaccgcatccacgcctgtgtttacttcatccagcccaccggtcactctctaaagccgcttgatatcgaggttatgcgcaggttacacaccaaggtcaaccttatccctgtgatcgctaaggctgatactctgacggatgatgaaatctccatgtttaagaagcgggtatgaatatgcaaagtccaatattttgagaacttcagttctaacaagattatccctagattctcgccgatatccagcaccactcgattcaaatcttcgaagggcctcgctacgaacttgacgacgaagagactatcgcagaaaaccaagaaatcatgtcgaaggttccttttgccgttgtcggtgccaactcagaggttgctacatccgatggccgcaaggtccgtggccgtagctacccctggggtatcattgaggtcgacaacgaggagcactgcgacttcgtcaagctgcgccagatgcttattcgcacccacatggaagagctcaaggagcacactaacaaccatctgtacgagaactaccgctccgacaagcttactcagatgggtgtcgcccaagacccaagcgtgttcaaggaagtcaaccctgctgtgaagcaagaagaggagcgtgctctgcacgaacagaagcttgccaagatggaggcagaaatgaagatggtcttccaacagaaggtagcagagaaggaaagcaaactgaaacagagcgaagacgaattatacgctcgacatcgtgagatgaaagaacaactggatcgccaacgcgcagagttagaagagaagaaagcccgcctcgagagtggacggccactcgaagaaaagggaaagaggaagggattctctcttcgttaa

SEQ ID NO: 36625 - DNA, 1113 bp, Aspergillus nidulans
catattgaggtagacccggagcacaacggacatctttttttctggcactatcaaaatcggcacattgcaaatcgccagcgaacaataatctggttgaatgggggacccggctgcagctccatggatggcgcgctgatggagattggcccgtaccgtctgaaagataacgaaactctagaatataacgagggatcatgggacgagttcgcaaatcttctctttgttgatcagcctgttggaaccggtttcagcttcgccaataccaatagctatctgcatgagctagatgaaatggctgcccaattcatcactttcttggagaaatggttcgccgtgtttcccgagtacgagcgagatgatgtatgtccgaacttagatgtctgtcttatgatgtcttctaagctgacttgcgggacctgacagatctacatcgctggcgaatcatatgcgggccaatatattccatacattgcaaaagctattcaggatcgaaacaaagacatccacgaaaagcaatctagcagtgcgcgttggaatcttcgcggtcttcttattggcaatggttggatatcgccggcggaacaatatccggcgtatttgagctttgcctatgaagaaggtcttgttgaggaaggtagcaagcttggaaaagagcttgaaactttactctctatctgcaagtctaagatggaaactggacctaaaatatccataacggactgtgaagctgttttgaataagcttctggacaagactgtggattcgaacaaccaatgcatcaatatgtacgatattcggctcagggacggttcttgtggtacgacctggccaccagacttggtggatgtgaagccatatttacatacctatgaggtgattcaagcattgaatatcagcccagagaaagagtcaggctgggacgaatgtgacggcaatgtgggggccgcatttcggccgcaaaaatccgaaccatcagtcaaattgctccccggcttgctcgagtcgggtatcgaaatcctcctcttcagcggcgataaagatctaatttgcaatcacgtcgggactgagcaacttattagcaacatgaagtgggcaggtggtactggctttgaa

SEQ ID NO: 36626 - DNA, 1235 bp, Aspergillus nidulans
aaaacccccaacgacatcgtcctcctctccgccgtccggtcacctataacccgcgccttcaaaggcggtttccgtgactcgcacccagaggacctcctaattccaatcctccaggcctcacttcagcgtgccaatatctccccagacagcgtcaatgacgtgctcatcggcaatgtccttgcagaactcggcttcgccaagacgggtcgtaccgcactcaatgccgcgggctttaatcctacaaagactacattccacaccgtcaatcgacagtgcagtagtagtctgcaggcgattacgcatattgcgcacgcgatcgcagtagggcagatcgaggtcgggattgccgggggcgtggagagcatgagcaggaattacaatccggctcggggcattccaagagacgtgagtccgttgttgaaagagtgtggagtgaaagaggcgaccgattgccttttgccgatgctggtgacgagtgagaatgttgcaaagaggtacggggtcggtaggacggagcaggatcagtttgcagcagagagccagagaaaggctgtggttgcgcaggaggagggtaggtttagcgagatcgtgccggttagggcaaggaggcttagctcggagacggagaatgagacgtttgagtttgtcgatagggatgatggggttaggcagggggtgactgttgagaagttggcggcgttgaagccggttctggaagggggtgcttctaccgccgggaactcgtatgtcttcttgcctatgccactgttctatgctaatacgtagtcttcagctcccaaatttccgatggcgcttccataacgattcttgccagccgcgcctgggctgaatcccacggtctaaggcctattgcccgttttgccggaacccaggtggccggctgtgcccctgacgagatgggcatcgggcccatcgacgctatcaagaggctgtacaagcacagcggggtctcacagagcgatgtggatatttttgagctgaacgaggcgtttgcgagccagagtatccattgtatcagggagctaggcattgatatggccaaggtaaatccgaacggaggagcgattgcactgggccacccgatcggcgcgacaggggccagacagacggctacgttgttggcagagctggcgaggtcagataaggaggttggggtggtgagtatgtgtgctagtacgggaatgggggttgcaagtttgttcatccgggagtag

SEQ ID NO: 36627 - DNA, 1036 bp, Aspergillus nidulans
tccgatgagattgtctggcaggttataaaccagcaattttgctcatacaaactcaagtatgtgccaaccgttgagctaatctttcatcatcagaaactccctttcaattagttcagctttctgaaacccatagactaatgattttcttaccatcaggacaacaaaaggtcaaaatttctgccgcaatgaatacaacgtgactggtctatgcaaccggcagtcttgcccgctggcaaactctcgctacgccacaatccggtcagaccccgagacaggcgctatgtacctttatatgaagactatcgaacgcgcacacatgcccagcaaattatgggagcggattcgactgtcatcgaactacgcaaaggctctcgaacaggtcgactcgcgactgatttactggccgaaattcttgattcacaagtgcaagcagcgtcttacgcgactgacccaggtggcaatccgtatgaagaagcttgcgcgggaggaagaacggttgggagaaagggttgtgccgaagttggcgcccaagatccgacgcagggaggagacgagggagcgcaaagctgagagcgcggcgaaggttgagcgggcgattgagcgtgagcttattgaacggttgcgcagtggagcctatggtgatcagccattaaatgtggatgagtcgatctggaaaaaggtgcttcgtggtctggaaaggtccggtgagggcgagagagatgaggacatggatgatggggagcttgaggaggaagaggatgaagagggtgtcggggaggttgagtacgttagtgatctagaggaggatgaagatttggaagacctggaagactggcttggcaatgattcgggcgcctctagcgatgattattccgacgaggatgaggaggatagtgatgaggcgagtgggtctgaggatgatggggaggaggagcaaaagaagacgaagcctggctccaagaggaagtttgctgctccgccgccaaagcctaggaagaagggtcccagagtagagatcgagtacgagactgagggc

SEQ ID NO: 36628 - DNA, 1114 bp, Aspergillus nidulans
ccacccccaaaacaatctgaggatggacgggaccaatggccctcccgcgcagccttccttctcgctgcgatgggcggatgcgcaggacagggaaacttgatccggtacccgtcagtcgtatacaacaactacgggctgcagtggtttataccgtacttcttagcgatcttcttcgttgccatccccgcgcttatcctcgagatcagcattggtcaggcctaccgcggcggaacagtgatcgcattcaacaatatcaatcgccgtcttaaaggtgtgggcattggacctattctggtgagcttcatcgtcacgcagtatttcacggtgaatctggcctggattatgaattacttccggaatagttttcggtctccacttccttgggagggccgaatcgaggagttttacatgggcgatgtaatccacaatgttgatcctgtgggcggggagttgagtacggacggcaaacacgttctttcgtacacggagtaccccggcgtccggcttttgggggaaacagttggctggagtgccttcatctggtttctcatctggggtgtccatttttcgagccgtgggcctaaccggccgagtcgtctactggacaatgggcctccccatcgtcacgacaatcatcttcgttggccgctctctatcccttgaaaacgcgtctgagggcgtcaagttactctgggcaacctggcgcggcggacaactcgcctcgggaaccgtctggcaaacagccgtgggccaggttttcttctcgacgggtatcggattcggctatttcacctcttatgcgtcctacaacgcgaaacacagcaacgcggttatggacgcactgcttatatgtgggagtaacgtgctctttgagaattttgccgcatttgcggttttcggtgtggttggatacctacaccgctggccggaggatggtgtgcgactcggtgcatttgtggtaggtttcttgacgcttcctgaggcggttctgcatatgcctgggtcgaacttctgggctatcttgctgttcttcaccctcgttgtgttagggtttagttctgcattcgtcatgcttgatgccgtggctacacttgtcgttgatagcgggcttaag

SEQ ID NO: 36629 - DNA, 2158 bp, Aspergillus nidulans
ttttccctggtgcatcaaaaccgtgctcagaagctgctcgcttacctgggtgatgttgccgtgaacggtagcagcattaagggtcagattggtgaacccaaactcaagggcgacattatcaagcccactctccacgatgctgctggcaagcccatcgacgtctcctccccatgcactaagggctggaagcagattctcgaccaggagggtccagaggcttgggcgaaggcggtgcgtgccaacaagggatgcttgattatggacaccacctggcgtgatgctcaccagtccctgctcgccacccgtgtccgtaccattgacctgttgaacattgcccatgagacaagtcatgctctctccaacgcttacagtcttgagtgctggggaggtgccactttcgacgtcgccatgcggttcctctacgaggacccgtgggaccgtctgcgtaagtgcgcaaggctgttcctaacattcccttccagatgctgctccgtggtgccaacggagttgcctactcctcccttcctgataatgccatctaccacttctgtaagcaagccaagaggtgcggtgttgacatcttccgtgttttcgatgctcttaacgacatcgatcagctcgaggttggtataaaggcggttcacgccgctggcggtgttgtcgaagccactgtctgctacagcggtgacatgctaaacccctccaagaagtataacctggaatactacctcaaattggttgataagatcgttgctctcaagccccatgtcctcggaattaaggatatggctggtgtactgaagccccaggctgctcgccttctcattggtagtatccgtgagcgctaccccgacctccctattcacgtccacactcatgactctgccggtactggtgtggcgtccatgattgcctgcgcccaggcaggtgctgatgctgttgacgcggccactgatagcctttctggaatgacctctcagcccagcattggtgccatccttgcttctcttgagggcactgagcaggaccccggtcttgacagcgctcaagttcgggctcttgacagctactgggcccagctccgtctgctttactcgccttttgaagctggtctcaccgggcctgacccttgaagtctacgagcactaatttcctggtggtcagtagaccaatcttatcttccaggctagccagctcggtctaggccagcaatggggcgagaccaataaagcctacgaggtctgcaacgacctgattggcgacattgtcaaggtgactcctacctacaggccgtgggcagatcggctcaattcatcgtggtcaacaaattgacgcctgaagatgtatcaaccgcgcaggtgagcttgatttccctggctctgtccatgagttcctcgaaggtctcatgggccagccgtacggcggtttcaccgagcctttgcgttccaaggccctccgtgaccgccgcaagctcgacaagcgccctggtcttttcctggagcccctggacttggcgaagataaaaaatgaccttcgtgagaagtacggctccgccaccgaatacgacgtggctagttacgctatgtaccctaaggtctttgaagactacaagaagttcgtccagaagtacggagacctttctgttcttcctacccgcttcttcctggccaagcctgagattggcgaggaattccatgtcgaactcgaaaagggtaaggtactgatcctcaagctgcttgccatcggtcctctttccgaccagactggccagcgtgaggtcttctacgaagtcaacggagaggttcgtcaagtctccgtcgacgataaaaaggcgtccgtcgagaacattgcccgccctaaggccgatgtcaccgacagcagccaggtcggtgctcctatgagcggtgttgtagtcgaaatccgtgtccacgagggctccgaggtcaagaagggtgacccgattgctgttctcagcgccatgaaaatggtatgtttgtgtctttccattagagttctaggctcttcgctaatcatgcactaggaaatggtcatatccgctccgcacagcggcaaggtgtctggattgctggttaaagagggcgactctgttgatgggcaggatctcatctgcaagattgccaaggcttaataatgaaaa

SEQ ID NO: 36630 - DNA, 1969 bp, Aspergillus nidulans
aagggctcctcgagctctgaagatgcccagctcggtgctgtcttctccgtctccggccccgttgtggtcgccgagaacatgatcggatgtgccatgtacgagttggtgagtgacactagtttatgcagtgcctttctgggctatcgctcaagctgctgccatcggtgaagctcttctacgcgggctttgttgcttaccatcgatgattagtgccgagtcggtcatgatcagctagtcggagaggttattcgtattgatgcggataaggctactatccaagtctacgaagaaacaggtactgcctccgcctattatgatatgtcatcaatctgacaatactgttcttagccggtctaacggtcggtgatcccgtcatgcgaactggcaagcccttatccgtcgagctcggccccggtttgatggaaacgatctatgacggtattcagcgacccctcaaagccatttccgacgaatcgggtagtatttatattccccgcggtattaaagtcaatgcgctggatcgcaagaagaaatgggacttcaagcccggcaagtacaaggtcggcgaccacattacaggcggtgatatttggggtaccgttttcgagaacagcttgttgaacgaccacaaaatcctccttcctccccgcgcaaaaggtacgatcacccggatagcggaagccggtagctacactgttgaagaacaactgctggagattgaattcaacggtgtcaagaccacacatgggatgatgcacacctggcctgtccgtgtccccaggccggtcaacgagaagcagtccgccgactcgccgttcattgttggccagcgtgtgctagactctctattccctagtgttttgggcggtaccgtctgcattcccggtgcctttggttgcggcaagactgtcatctctcaaagtgtgtccaaattctcgaacagtgatgtcattgtctatgtcggatgtggtgagcgtggtaatgagatggctgaagtgttgatggatttcccagaggtatgctcattaaacgttgccgaatatcgccaatactaacgtgcttgtagctcagcatcgacattggtggccgcaaggagcctatcatgaaacgtacatgcctgatcgccaacacctctaacatgcctgttgctgcccgtgaagcgtccatttacaccggcatcaccattgcggagtactttcgtgaccagggcaagaacgtggccatgatggcagactctagttcccgatgggccgaggctctgcgtgagctttctggtcgtctaggagagatgccggctgaccaaggtttccctgcctaccttggcgccaagctcgcctctttctacgaacgcgctggtaagagtactgctctgggaagccccgagcgagagggaagtgttagcatcgtcgccgccgtcagtccgcccggtggtgatttctcagaccctgtcactaccagtacgatgagtatcgtccaggtcttctggggtctggacaagaaattggcccagcgcaagcacttcccttcaatcaacacaggtatctcttacagcaaatacaccccggtgctcgaccgttactacgagaagcaccaccccgagttccctcgtctgcgtgagcaagtccgagagctgctctccaaatctgaagatcttgatcaggtcgtacagctagtcggaaaggctgcgcttggtgactccgacaagatcacattggatgtggccgctatggtgaaggatgacttccttcagcagaacggatatagtgactacgaccagttctgtcctctttggaagacggagtatatgatgaaggcattcatgggctaccacgatgaagcacagaaggcgatcgcccaaggccagagctggcccaaggttcgtgacgccaccaccgacattcaaacctccttgcgaaacatgaaatttgaagttccggataaccaggaggaggtgtctgcgaaggtgagg

SEQ ID NO: 36631 - DNA, 1348 bp, Aspergillus nidulans
cctgaccccggtgccgactccgtctccgcagcttttgtcaacgagcgcgcgccgtaccttgtccctacctacgtccgcccggccccgatcatggttaagggacaggggtgttatttgtgggatatggagaacagacggtacctcgatctcacagcaggaattgccgtgaactccctcggtcactgcgatcccgagatctccaagatcatcgccgagcaggtgcgcacgctagtctcatactatacatacaaatatcagaagtgctgacgggttaattaggccgaaacccttctccatgcctccaacctgtatcacaatgcctgggttggcgctctcagcaaagacctcatcatccttacgcgcgagtcgggagccatgcgcgacgctgcccaagttttcatcgccaactccggcaccgaggccaacgaggccgccatcaagttcgcccgtaagaccggacgcgcccgcgatccttccggcgcaaagcacgaaatcgtttccttccacaactccttccacggccgtacaatgggcgccctctccgcgaccccgaacccgaaataccagactcccttctcacccatgctccccgggttcaaatacggcaagtacaacgatgttgcccagctgaaagatctcgtgaccgagaagacctgtggtgtgattgtcgagcccatccagggcgaaggtggtgtcaacgttgcaacacccgagttcctctctgcccttcgcaagcgctgcgacgacgtcggcgccgtcctgatcttcgacgagatccagtgtggtctttctcgcaccggcagcttctgggcccacgcccatccgtctctcgtcccgtcctccggcgaagctgcacaccctgacatcctcaccaccgccaaagccctcggcaacggcatccccatcggcgcaaccatcgtttctggaaagactgttgcggacaacatcaaggccggcgaccacggcaccacttttggcggcaaccctctcgcctgccgtgtagcccaccatatcatccaccgcctggcctcgcctgagctacagaaatccgtccaggataagtccgccatcctggtcgctggcttccaggcgctgcagcagaaataccctgatcttgtctctgaggtgcgcggccgcggcctcattcttggcctgcagctgtcgaaagacttctccgccagggctggtgagattgtcactgccgcgcgggaacggggcatgctcatcattacagctggagagggatgtctgcggttttgttcctccattgacgattacagaggagcagctgaagactgcgctaaggattctggagcaggcttttgatgccgtgaaagcttaagctagc

SEQ ID NO: 36632 - DNA, 1452 bp, Aspergillus nidulans
gaacgggacactaaaggcggcacaaggtttactggatgtaccagtatccgcgaattcgagttcttaggcaaactgggtgagggcacctttgggtgagtgccttcgatcccttctctgaatattgttgacatggtactcctcaccagagaagtctataaagcgagggctaaaagagatggctccatcgtcgcgctgaaaaagatcctcatgcataatgaacgagatggcgtgagcttcatcgattccctttaaaagaagtaggcagctatctgatcgtcaaagttcccaatcacagcccttcgggagatcaagctactgaaaatgttgtcccacaccaacatcatgcagctcagagaaatggccgtggagcgaagtaaaggtacatcgcttattatacctcatgatgaaaaaatctgactcgagaaaaggagagggtcgcaagaagcccagcatgtatatggttttcccttacatggaacacgacctatcaggacttctagaaaatccggaagttcatttctcagaggctcaaatcaagtgttatatgattcaacttctcgagggattaaaatatttacacggggtattgctgtgttcaggcaacatatggggattcttttttctgacctagtacagaattgtatcctacaccgcgacatgaaaggctagtccgcctgtatattgaaggacgttcttggctgacccagcgcagctgccaatctacttataagcaaccaaggtattctgcagattgccgacttcggactggcacgtcctttcgatgaagcgccccctcagccaggcaaaggggcgggcgaggccaaaagagactataccacattagtcgtgactcgatggtatcgtcctccagaactgcttcttcagcttcgacgttatacttctgcgatagatatgtggggtgttgggtaaatcgcactccaatcctatttgtcctctttctaacacttacagttgcgttttcggtgaaatgttcaaaggaaagccgattcttgctggtaacagtgaccttaatcaggcacaacttatattcagccttgtgggtacgcctacggaagagaatatgccaggatggagctctcttccaggttgcgaaggcgtcaagcatttcggcaacagaccagggaatctcgcagaagtattcaaagagtaagccacctccgatcagctgtctccataggattcgtaattaaatctctgacatattatagtcaaggtcctatggccatatctttgcttacagagctcttgaagctagactggcgaaaaagagtgaatgcgattgatgcgctgaaacatccttatttctcgacaccgccactcccagcacgtccaggcgaccttccgagttttgaggactctcatgaacttgatagacgaagattccgtggacagcgggctgctatgcccccggcacctgctggaggctcggtg

SEQ ID NO: 36633 - DNA, 1597 bp, Aspergillus nidulans
  unsure (1)..(1597): unsure at all n locations
gcatactggctaggatcaatgagacctgcggagctcccgaagacttccacaacaaaactatatgaactagaacctccgcggcacgatgtttcaccgtcaaacctgcaagccgcgtgggcggattttgttgagattataggaaaggagaatgtctctacggagcatgcagatctaacctcgcatgcaggctccgactggtcctcctataaaaccaaggaaggcgagaaaccgttccttgttctttacccgtcaagtacggaggaagtttctcgtatcatgaaggtatgccatcaacgcctcatacccgtgacaccgtactcgggcggaacaagtctagaggggcactttgctcccacgagaggcggggtgtgcattganttcggtcgtatgaatcgcatcctggcattacacaaaagtgatcgngatggtgtagtgcaacccgcacttggctgggaggaactgaatgaagagttggctggggagggccttttttttccttcggactccgcccctggcgccatgataggtggcatggtgggcaccggctgttcgggaacaaatgcctataagtacggaactatgcgagactgggttctctcgatgaccgttgttcttgcggacgggacgatcatcaagacgaagcagcgtccgcgaaaatcgagcgccggctacgatctgacgcgtttgttcattggtagcgagggcacgctagggctgatcacagaagccacattgaagctaacagttaagcccaagagccagagtgttgctgttgcaagctttccttcagtccatagcgcagctctgtgtgtcacccgagtcgtggaggaaggaatccccgttgcaggcgtcgagattctggatgatgtgcaaatgaaatgcatcaatgccagcggaaccacatccaggcaatggaaggaagcacccacgatcttcttcaagttcgccgggacaccaaacggcgtcaaagagcaaatcggattagttcaaaagctcgcatcttcatcccaggccaaaagcttcgaatttgcgcgaggtgatgaggagatgcgctctctctggagtgctcgcaaagaggctctctggagtgtcatggctatgaggcgaggtccagaggaccatgtatggacgacagatgtggcagttcctatgagcaggcttcctgacattattgaagctacaaagcaagacatgacgcagagtgggctactagctggcatttgtggccatgtcggggatggaaatttccatggtaagttaaccataaaaactcagggcagtgctgacttggttagcaatcattttgtggaatgatgcggaaaggcagaccgcagagggtgttgtccaccgcatggtaaagcgagctgttgagatggaaggcactgtgactggggaacatggtgttggcctaataaaacgagactaccttccgcatgaactgggggagtcaacggtggacgctatgcgacgggtaagctgctttcctctttcgcaaccatggctgctaatgttgttcgtacagcttaaactggctctggatccccttcgcctactgaattgtgacaaggttatccgagttgagcagccaaagcccggg

SEQ ID NO: 36634 - DNA, 2205 bp, Aspergillus nidulans
aagatgtatggggctcactcttccggtagcagccacgatgctggtcagcccagcttcgagcataaagaaaagcccaaaacccgtcacatctacgatgtcgaaggactggaccgcagcaagctgaatgcaatctttgagaatccactcgctggtgttcctcgcgacgagctctttgaagatgtcgaccgattctgccagaaccatggcctgatggagtacaaggagctttttcgttaaggtgcacttatctcgcaaaatccggcagtggctgaaacattggccgagttgactgaggaggaacgcgaggctttacagcgcgagacaactcacaaatggtcacagccttggatgctgtatttcatgaggagtacgtcaagctcaaactagctatgtagagtgactaaagatcgggacagcgatgtgctccatggccgcagccgtgcagggtatggacgagaccgccaacaacggtgcagtcgttatctatcctagggttgatcctttaacttctgtttttttttgcttacaaagactaataataccagctactcggtatcgaatctccccgattctctgatatgatgcaagactatatcaccggtctcgtcgtcggcgccccgtacctagcctgcgcaatcatcggctgctggctgaccgagccgatgaatcgatactttgcgcgacgaggaacgatcttcatctcctgtgttatcgccgccgtggcctccgtctgggaaggtgtagccaactcctgggtcaacctcttccttgcccgctttgttctcggcctcggcattggttccaagtcctcaacagtgccggtctatgcggccgagtgttcaccggcacctattcgcggcgcgctggtcatgcagtggcaaatgtaagtaccacgaatagttaggatgcctgaccattctaacgtaatctaggtggacggcattcggaatcatgttgggcaacatcatgggcgtcgcattcatgggcgtggaggaagacctaagctggcggcttatgctcggtagcaccgtggttctcccaatcatcgtttgcttccaggtctacttctgcccggaatcaccccgctggctgattgagcacaacaagatacccaaggccttcaagtccttccgcgttctgcgcaacaccgacctccaagccgcccgcgatctgtactacgcgtatgttggcgtccaactcgagcgcgagatcaacaaagggaagaacttcttcaccatgttcctagagctattcactgtcccgcgtaatcggcgcgccacgctagccagctggatcgtcatgtttttgcagcagttctgcggcgtgaacgtgattgcttactactctaccagcatatttttgaattcgggatacacggtacaagaagccctgcttgcgtctatggggacgggcattttgaactgggtttttgccatcccggcctttctcaccatagacacatggggccgacggaacctcttgctcttcacattcccgtttctttccatatggctcctgtgggcgggtttctcgttttggatcgagtcgaacatccccactagtcgtaaacgagtggccatggtcacgacgggaatgtacctcttcgaggtcttttactcgcctggcgaggggcccgtgccgtttacctactccgccgaggcgttcccgctgcatgtccgggaggtcggcatgtcttgggcgacagccacaacgtggtgcttcaatttcattctgtcatttacttggccgatgctggagcgggcgtttaaaccgcagggtgcattcggctggtacgccgcttggtgtttgattggatggtggctggttttgctgtttgtgccagaaacaaaaggtacctccatcaccattactgaccttatcctcacaaatgagtacattctgacacacttagaactcacccttgaggaactcgaccgcgtcttctcggtgaaaacgcgccgccacgcaaggtaccagctccgaaacgccgtctggcatttccgcacctgggtgcttcggcacaaactcgagccgatgcctaaattgtatgaggagccggattcgccgaccacgccgtcaccaccggatgtggaggtggagcccaaagtgcgctcagagaatgtggagaatgtcggtgcatagctgggcaagaccagcacgaaacagaggaggacagaatcactaacagggcggggtcggccctgg

SEQ ID NO: 36635 - DNA, 2160 bp, Aspergillus nidulans
gcacacttgctcggagaggagctttatcggaaacttggagaatacttgtcgcgccatcttgagtgggtccacggagaatcgatgggtcatacggatgaagctctactttcattttatattcgggaatggcaaaggtatacgaccgctgccaaatatataaaccatctcttcagatacctgaaccgccactgggtcaagcgagaaatcgatgaagggaaaaagaacgtatatgatgtgtatactcaacacttggtaaagtggaaggaggatttcttcctcaaggtgcatgaaaaggtcatgggcgcggttcttaagcttgtcgaaaagcaacggaatggggagaccattgagcaatcgcggattaagagcattgttgattcatttgtctctctcggacttgatgaaactgaccccacgaagtccacccttgaaatttaccgctattacttccaacggcctttcctcgaagctaccaggatctattatgaggatgagtcgcgtcagtttgtggcgggacaccagcgttgtggagtacataaagaaagcagaaatccgtctcgaagaggagaaagcacgtgttggactctatttgaacaacgatatttcaaaagatctaaccagcacctgtttggatgtacttgtcactgcgcactcggagctcctccgtgacgaattccaaccgctgctcgacaacgaacgtcaagatgatctcgcccggatgtaccggcttttgtcacgaatcaaagatgggctggaccctcttcgcacaaaattcgaagcacacgtaaggagggctggtttgtctgcagttgagaaggttgctgctgaaggtgactccttcgagcccaagatgtacgtcgatgcattgctgtcggtgcacaccagataccacagtctcgtcaaggaagctttcaatggcgagtccgaatttgtccgctcgcttgacaacgcttgtcgcgagtttgtaaatcgcaacaagatctgcaagtccgggtctacgaagacaccagaattactagccaagtacacggattctctgctgaagaggggatcaaaagctgcggaggagtcagagctggaggagatgttggtacagatcatgaccgtcttcaagtacattgaagacaaggatgtcttccaaaaattctactccaagatgcttgctaagcgactagtccatgtgagctcagtatctgatgacgccgagactagcatgatcagcaaactcaaggaggcgtgtggttttgagtacacgaacaagttgcagcggatgttccaggatatccagatttcaaaggatctgaactcaagctacaaggactggcttgagaaatctttcttggatgatgatgaccgaaagaagcttgtggactcgcacttccaaattctcgggaccggtttctggccactcacggccccttcaacttctttccttgctccgcctgaaattgtcaaaacttctgagcgttttcagaagttctattgcgataagcataacggtcgaaagctaacctggctctggcagctgtgtaagggcgagctcaaggccaattacatcaagaacaccaaggtcccatacactttccttgtgtctacgtaccaaatgggcatcctccttctcttcaacgagagcgacacgttgacatactctgatatacaaaaggccactactctcacacctgaaatccttgatccaaacctgagcattttcttaaaggccaaggtccttaacattagtcctgaaggatctaaacccgggccagactcgaccttctccctgaactacaacttcaaaaataagaagatcaaggtcaatctcaacatccaaattaggtccgagcagaaggtcgagacggatgacacacataagacaatcgaggaagaccgcaagctcttgctccaggtatgtcttcttgccttgtctacccaagtgattgtactatacttacttactatcctttgtaacagtccgcaatcgtcagaatcatgaaatccaggaagaagatgaagcacgtacagcttgtgcaggaagtaattcaccaggtcaaatcacgcttccccccccaagtacccgacatcaagaagaacatcgaagcattgatggagaaggattacatcgagcgtctggacggcgatgaaatcgcttacattgcatgattt

SEQ ID NO: 36636 - DNA, 1832 bp, Aspergillus nidulans
atgagctacgcgcacgtcaaaccccccagcgagatccaccgggcctggtggaaagaaagctctgtgtaccagatctggccggcatcgttcaaggactctaatgatgacggtattggcgacattcctggcatcatctcgaagctcgactacattcgtgaccttggtgtcgatattgtctggctctgtccgtcttacaagtctccccaggtagacatgggatacgacattgcggactactacagtattgcagacgaatatggtacggtcgcagatgtcgaaaagctgatcaagggctgccacgacaggggcatgaagctccttatggacttggtcgtgaaccacaccagtgataagcatgaatggttcaagaaatcacgcagctcaaaggataacgagtttcgcgattggtatgtctggaagccccccgctacgacgagaatgggaatcgtcaacctccaacaattggggtatcgcacttccaaggttcttatcttccagtcttcactctcttagatagtgttaacactgagcagaaagcgcctgggaattcgatgaggcgacaggagagtattatcttcatctatacgccgtcgaacaacctgacttaaactgggagaaccccgccgtgagaaaggcagtgcatgatatcgtgcgtttctggctcgacaaaggagctgatggcttccgcatggacgtcatcaactttatcagtaaggatcaggcgttccccgacgcaccggaacaggacaaggatgccgtatggcagtggggtgacaagtactacgcaaacggtcctcggctccatgagtatctgcagggtattgggaagatacttaaggaatacgacacctttagcgtcggggaaatgccttttgtaaaggataccaatgaagtgctgaaagcggttcgctacgaccgcaacgaaatcaacatgatcttcaattttgagcacgtcgacattgaccatggcccctggggcaacaaattcaagcctggcggctggaaactcactgatctcaaggcctttttcgagcgctggcaagttttcatgtacgacaacggcggctggaacgctttgtattgggaaaaccacgaccaaccccgatcgattgaccgctatgtcaacccccctcaggctctccgaccagcggccggaaagatgttggctaccatactagccttgcacgcgggctctccgttcatttaccagggccaggagataggaatgggaaatgttcctattgaatggggaatggaagaatacaaagacatcgactgtctgaaccattggaaagggtatgtttttttctctcttgaaatggaacaacattaactctggtaggttgctggaaaccagaccaacggacaccgaggtacagaaaattgccagacaggaataccggaagaaatcccgagacaacgctcgcactccagtgcagtggtcctcagaacccaatgccggattcaccgggccgaacgttaagccttggatgtctgtcaatccagagtacactcgagttaatgcagcggaccaagtcaaggaccccaactctttgtaccattactgggcatcagtcctgcacctcaggaaaacctacctcgatatctttgtctatggaaattacgagcttgtggatcgtgatagtcaggaggtttacgcctacacccgggcatgccacacctccaaggctctggtattggcgaactggactgaccgtggattgacgtggaacgcggcagcacacaaggctgatcagttcgagcaagtgctgctagacacttatgagtccccaaacgcagcgcagggaaggttttcaggtggtcaatggacc

SEQ ID NO: 36637 - DNA, 924 bp, Aspergillus nidulans
aagaaacccgccctcgagggggacagggtgctcgtcaaagtctcccactcaggtgtctgcggcaccgacctccactacaaggccgccgacatggtgcttgggcacgagggtgtgggatacgttgaggaagtcgggccggatgtcaaggacctgaagaagggcgaccgggtcggctggggctacgagcacgactgctgcggtcgctgcaagcactgtctgtctggcttcgagaccttctgccccgagcgcgcaatgtacggttttgcagacctggatcagggctcgttcgccagccatgcggtctggcgcgaagcgttcctgttcaagctcccggacgggctcgataacgagtcggctgcgcccctgatgtgcggcggatcgaccgtgtacaacgccctggtgggcgccgaggtcacgcccacagataccgtcggcatcgtgggaatcggcgggctaggccatctagccatccagttcgctgcgaagatgggttgctacgtgatcgttttcagcgggaccgactcaaagaaggaggaagccatgaagctgggcgcgaaggaatttgtcgcaacaaaggacgccaaggagctcaagaccagtcgcaaacttaacaatctgatcgtcacgacgagttttctgccggaatgggaactgttcctgaacgtcctcgacaaccgcgcgaccatcagcccgctgacggtctcagataagccctttacaatccccaatcaggagatgctcgtcaagggactgcgcgtgcagggcggcatcgtggcggcgcgccaggtgcaccgcgaaatgttgcagtttgcagctttccatggggtaaagccgatcgtgatgcggtatccgatgaatgagaaagggatcaacgagtgcatgaagacgctagaggaagggaagatgcggtaccggggtgtattg

SEQ ID NO: 36638 - DNA, 1685 bp, Aspergillus nidulans
atcgtgttacgttctaacgatgtcatgattagtgtcccgccgtcacgatctgggtcctcgtcctccgaagaagaaatcgaaactaccgccgaggaggaagattcagaagactactgcaagggtggttaccacccggtccagatcggcgaactctacaataatgggcggtatgtagtcgtgcgcaaattgggatggggtcacttttcgaccgtctggctctctcgcgacacaacaacggggaaacacgtcgcgctcaaagtcgtccgatcggctgctcattataccgaaactgccatcgacgagatcaaattgttaaaccgcatcgtccaggccaatccctctcacccaggccgaaaacatgtcgtcagtctgttggattctttcgagcacaagggaccccacggtgttcatgtttgtatggtatttgaagtcctgggcgaaaatcttttgggcctcatcaaaaaatggaatcacaggggaattcctatgcccctggtgaagcagattaccaaacaggtgcttttgggtctagattatctgcaccgcgaatgcggaattatccacaccgatttgaaaccggagaacgttctgatcgaaatcggcgacgtggagcaaatcgtcaagacctatgtcaaagaggaagcgaagaaggagcaaaaagaggacaaccgcaacggtcggcggaggcgcaggacgttgatcaccgggagtcagccattgcctagtcctctcaacaccactttcgaattcaaacacagctcgcaaaattcccacagcagtcttagccaggttattaatgagtcgccaggttagaactttcaaatctcggagaattgaactatgctgattggacaggcacatcagaagccccttccatgcgacagttgcttggcatcaaggatgaggatgagcaacaaaagcaacgagaaaaaactgcgtacgtagagcggcttttggagggaacttcactaacagatgacagcgacctgttggaacgagaggtttctgggatttcgcttgacaagccctcaagcgatgaagatattgactgcggcattatttccgtgaagattgcggatttgggtaatgcatgctgggtgggccaccactttacaaatgacattcagacacgccaataccgttcgcccgaagtcattttgggatccaaatggggtgctagcaccgacatctggagcatggcttgcatggtaagttttgccccaattttccatggcgataactaactcgcgtaggtttttgaactaatcaccggtgactacctgtttgatcctcaatcaggtactcggtacggcaaagatgacgatcacatagcccaagttattgagttgctcgggccattccctaaatctttatgtctctcgggtcggtggtcacaagagatattcaatcgcaaaggcgagctgcgcaatattcaccgactccgccactggtcgttacctgatgtactacgggagaagtatcacttctcagtggcacaagccaaggccattagcgatttcctcctgccgatgctagaagtgctaccggaacgacgggccaatgccggcggaatggcatctcatgaatggatgaaggatacgcgaggaatgcaggaggtcgacttgggcttgacgcccggcagtcgaggcgagggtatcgagggatgggcgacggaggtgaagcga

SEQ ID NO: 36639 - DNA, 1418 bp, Aspergillus nidulans
acagttgccaatatgttcaataagctgtcggggcagcccgagagctacgagaagaagtatgcccacccatcactttgcctccttcgccaatgactaaccgttgtgtctttgcaggtcgctgtatcgatttggacgaaccctcggtgctggaacatatggtatcgtccgcgaagcagactgttcttccgggaaggttgcggtaaagattatcctgaagcgcaacgttcgggtaacgagcgcatggtctatgacgagctggatctgctgcaaaagctgaaccaccctcacattgttcacttcgtcgattggtttgagtctaaagtgtgtatctgtgcttgctttcgatgaagaggcccgagactgacggctactaggataaattctacattgtcacacaattagccactggtggcgagcttttcgatagaatttgcgagtacggcaagttcacagagaaggatgcgtcacaaaccatccgccaggtgctcgatgccgtcaactacctacatcaacgcaatatcgtccaccgaggtttgtttctcccatgattcccttttcagtcaaagggttttgaccaatgttcgtcatcagacttaaaaccagaaaaccttctttaccttacccgtgatctggactcgcaactagtcctcgccgactttggaatcgcaaagatgttggataacccagccgaagtgctgaccagcatggcggggtcattcggttatgccgctccctaggtcatgctcaagcaaggacatggcaaagctgtggacatctggtcgctcggtgtcatcacatacaccctgctatgcggatactcgcccttccgatccgagaacctggccgatctcatcgaggagtgccgctccgggcgcgttgtcttccacgagcgctactggaaggatgtctccaaagatgctaaggatttcattctcagcttgctgcaggtggatccggcgcagcggcccacgtccgaggaagccctgaagcacccctggttgaagggtgaatctgccagcgaccgcgacttgctacccgagatccgcgcgtacattgctcgctctcgcctcaagcgaggtattgagatcatcaagcttgcgaaccgcatcgaagcgctcaagatgcaagaagaagatgaagaagacattcccagtgcagttgacgtacaggcttcggaagcgtctgacaagtccggtctatcaccgttccctgctctttcaacagagaacagcaacacacaccctgcatcaaccggtaatggagaatcaggcggtactaagaagcgcagcttaagcaagattgcgcgaggtgctatcttccgtgaggtcgtcctcgccaaggtgcgcgagatgaaggaaaacgaggagcgagaaaaggtcgaacgcgaagctcgcgagcgggctcactcatgaaacctc

SEQ ID NO: 36640 - DNA, 471 bp, Aspergillus nidulans
tctgtcactgctgtagcggctcacggcagtatagcagcaattggaggagacgattcgactgttcagatttgcgacattgctggaacttccttaacgcccaaacatgatttcaaggcgtcgcgcgacgtggtatcggctatggcattttcgccagatggttccaaattagctattggtgactcgcgcggtcgcgtgctagtctacaaggtggcggacggcagcttggtgaatgatcgttggactgcacacacgtctcggataacctctattgcatggaacgacaacggcgctcacatcgtcagcggagcgttagataccaatattttcgtttggagcttgacaaatccaggcgactggctgcaagtgtccaatgctcacaaagagggtgttaatggcgtggcatggattgctgggggctccaaggttgcctccgctggggccgatgcggcggtcaaggtatggaaggttgaa

SEQ ID NO: 36641 - DNA, 795 bp, Aspergillus nidulans
ggtctcccagccggatctaaagaaacaatccacgggctaaacacctacctgactggaaaccgcaccaccccttatgcaatagtagtcatgtattctgatgtctttggcctgtccctccccaataataaactcatcgccgatgcctacgccaaatccggcgagtggctcgactacctccctgatttcttcaagggggatcgtgtcccgctatcaatggccgagcacctcatccccgttgatgcaacgaagcagtctgttttccggaagtatacggggctgttggccagtataccttctttcttcaactggcagaataggcaccgccaggggccgacagatgccatctgtatggagttcctacgcgctttgaggagagagaggaaggggatgaagattggaatggtaggcttttgttgggttggagagtatgcaattggagccgggctggaagagaatatgatcgacattgatggtgcgcgagtaccgcttgtcgatgcgctcgtggcgcttcatccgagtcacttggctatcccggatgatgacaaaacgctggttgttcctgtatcccttgggtggagggctgaggatagtttggttgacttcaagcagatgaatatggtgaagggtgtgcatgcagataacaaggcatctggacgtgaggtcccggggattgcgcatcacgagtataagcctggccgccatggtttcgcagtacgaggcaacccggatgacccacaggaaaggaaatatctggaggactcggttacgcaggttctgacctggtttggacgatgg

SEQ ID NO: 36642 - DNA, 642 bp, Aspergillus nidulans
aaatgttgtatttccggcttcacctggtctggcacaccgacgggccgcaccggcaaggttgctaacaacgacgtctacatcgccggcgatggcacggacgtcgcaatcctcttcatcgccggcctcttcggctggacattccccaatgtccggctcctcgccgaccacttcgcacgtgaaatcggcgctaccatcttcgttcctgactacttcggcggcgaagtgctggacttcgacctcctcgcggccgaaaaatttgaccaggtcgacctcaaggggtttattgctcgcaatggccgcgagcagcgtgagggcgagatattcgagactgcacgcgcactcaagcgggacctgggcttcaagaaggtgggcgcagtaggatactgctatggcggatgggcgtcgttacgactcggtgcgaagtaacatgcggaacagggaaagcccttgatcgattgcatttcgatcgggcatccttcattgctgacgaagaaagatatcgatgaggtttctgtgcctgtacaggttctggcgccggaaatcgaccctatgtactcggccgaaaccaagagctatacgtttgagacactgcagcggctcaataaaccgtttgactaccggcatttccctggtgttgcccat

SEQ ID NO: 36643 - DNA, 1019 bp, Aspergillus nidulans
tacaaagtcactcgaggtcttctggaccgcttcggccccaagcgcgttatcgatacacctatcacggaagctggcttttgcggtctggcggtcggagctgctctcgctggattacacccaattgtaagtcatccttcgatgcaggcgcaggctcagaagaagcccgcaggacattgctaacaagggcgtcttaaccagtgtgaattcatgactttcaacttcgcaatgcaggctatcgatcaaatatcaactctgcagccaagacgcactacatgtccggcggcattcagccttgcaacatcaccttccgtggtcccaacggttttgctgctggtgttgctgcacagcactctcaggattactccgcttggtacggcagtattcctggtttgaaggtcgtggctccctggagcgctgaggacgctaagggtctcatgaaggcagctattcgtgacccaaaccccgtcgctgtccttgagaacgagtatgtgaatcacctcaaaatcactccatcgaagcgtatcacaactaatcgtgtccagacttctatacggccaggccttccccatgtctgaggctgcacagaaggacgattcgtcctccctattggcaaggccaagatcgagcgtcccggcaaggacctgacaatcgtctctctctctcgctgcgttggacagtccctcaacgctgctgctgaactgaaacagaaatatggtgtcgaagctgaggttattaacctccgttccgtcaagcctcttgacgttgagacgatcattcagtctctgaagaagaccggccgcctgatgtgcgtcgagtctggtttccctatgttcggtgtttcctccgaaattctcgctctgtccatggaatacgggttcgactacctgacagctcctgccgttcgtgttactggtgctgaggtacccactccttacgctgtgggattggagactatgagctttccccaagaggacaccattgttggccaggctgccaagcttctccgattgtaaattttc

SEQ ID NO: 36644 - DNA, 1461 bp, Aspergillus nidulans
gcattcgaaaatgcttccaccagtgttgccgcctcccagatgcgtaatgccctgaacgctctcgctgagactgtccccgatcctaacgagcgcaaacgattcgaggccgagatggacaacttctttgctcttttccgcagattccttaatgataaggccaagggtaacgtcgtcaattgggaccgtatcgcccctccccagccctcacaggtcgtcaactatgacgacattggcaaggaatcgtctgtcgagttccttaacaagctcgctgtcgtcaagctcaacggtggtctcggtacctccatgggttgcgtcggtcccaagtccgtcatcgaggtccgtgagggcatgtccttcctggatctgtccgtccgtcagatcgagcacttgaaccgcacttacaatgtcaacgtcccctttgtcttgatgaactcgttcaacaccgaccaggacacacaatccatcatcaagaagtaccagggccacaacgtcgacatcattaccttcaaccagtctcggtaccccagaatcatcaaggactcgcttctgcctgcgcccaagtccttcgatgctcctctgcaggactggtacccccctggtcacggtgacgtctttgaatcactgtacaactccggcaccctcgacaagctcttggagcgcggcgtcgaatatattttcctgtccaacgccgacaacctgggcgctgttgttgatacccgcatcctgcagcacatgatcgacaccaaggctgaatatatcatggaattgaccgacaagaccaaggccgatgtcaagggtggtactatcatcgactatgagggcaaggtccgtctccttgaaatcgcccaggtgcccaaggagcacgtcaacgagttcaagtccatcaagaagttcaagtacttcaacactaataacatctggatgaaccttcgcgccattaagcgtgttgtcgaggagaacgagctcgaaatggagattattgccaacgagaagtccatccctgcagacaagaagggtgaggccgaccaggccatctaccagcttgagactgctgttggtgccgccatccgtcacttcaagaacgcccacggtgtcaacgttccccgtcgccgcttccttcccgtcaagacttgctccgacttgctgctggtcaagtccgacctctaccgcctcgagcacggtcagctcgtcatggaccctaaccgatttggcggtgtccccgtcatcaagctcggctcagacttcaagaaggtttctgacttccagaagcgcattcccagcattccccgtatcgtggagctggaccatctcaccatcactggagccgtcaatctgggccgcaacgtgaccctgaaaggtacggtaatcattgtagctacagaaggcagcacgatcgacattcccccaggttctgtactggaaaactgtgttgtacagggcagtcttcgcattctcgagcat

SEQ ID NO: 36645 - DNA, 1207 bp, Aspergillus nidulans
acaatcacaaaactccgcccgatcgccatcgagaaaatccaggcagtgcatgagtgggtcgagacgagatgtatccccgcacaggggatcatgaaagctcagctggccaaagaccgctggaagatgccaccactgatgcgacatctacgtgaagaagccaaacaacgtggactatttaatctttttctgccgaaggagtttgaagaatcccctggcctcacgaacctagagtaggcgtgctgtgccgagatcatggggaaggtgtactgggcgggccagacgatgaactgccacgcgcccgagaccgggaacattgagttgctggccaagtactgtaatgagcagcagaaagagcagtggctcaagccgctgcttcgaggtgaattcgcgtccgcttactcgatgacggagccagatgtggcctcgtcggacgcgaccaagatcgctatcagcatccgccgcgagggggacgagtatatgatcaacgggcgcaaactcttcgccaccaaatggaatcctgaggtgaagttgtatatcctgatgggatgcaccgacccaaacaaccctaacccgcggcggcgccattctatgctcctgatcccgagtgacacgcccggcttccggatgcgacagaatctgtcaatcatgggccacgactgcgcacccgagagccatggagagtacgtctatgacaatgtgcgcattcccgtctcgaatgtggttctcggcgaggggggggcgtttgagatcgctcaaggccggctagggccaggacgcattcaccactgtatgcgactgatcgggcaagccgagctggcgttcgattacgcgctagtccgtgcaacagatgagcggaagaaaccgcgaggcaagctcatctggcaatttgacagtaatatcgagcggatcgcgcagatgcgactgaaattggatgccctgcgcctggtcgtgttcaatgcagccgacacgatggacgctctgggcaacaaaagcggccgatacgtgatcgcacaaagcaagatcctggtgcctatcgcagtggccaagattgttgacgaatgcatgcagctctacgggggcagggtttgacccagcataccccttgcccgagatctggacctacgcccggttcgtccgcgtcgccgatgggcctgatgctgcccaccgcatcaggtcgggcgagaccagttgaagacggcgggcagcg

SEQ ID NO: 36646 - DNA, 803 bp, Aspergillus nidulans
ctcgaaggacatatcgcgctcatctccgggtcaagccaagggttcggacggggtatcttcgagacattccttcgcgagggagccctggtgctaggcctggacctgcaagccatcgacggtcaagtagagggctttcctgagaaccgcgcctaccagatcacagccaatgtcgccgaggaggagacttggaagagagcggtaactggccttgacccgtgtggttgtgcagctctaactatgtataccagctggaaaccagtatcgcaagattcgggaaagcgccgtcgatcgtccatcacaatgctggctggccgtacccgaacaaatctggtctagatgtgacagttgaagaatttgaccgtctgtttaatgtcaacgtgcgcagtatctacctggcctcgaaagtcctcgtgccggaaatgaagaagaatggtcccgggtcgacgattgtaatctcgagcgagaacgccatccggccaggagccacgcagacctggtacaacgcaactaaggccggtgtctcgtcagccaccaagtcgatggccttggagttcgcccgagaccagctgcgcttcaacaccatctgccctacgtccgggaacacgccgctgttgaacaagtttgccggtattagcgatgggcctgtaccaccggagattatcaaggccaagtgcgaggcaatccctataggacgacttgttgagccgtcagatgtcgccaacgtggcacttttccttgcggagcccgcgagctcaatcatcagcggtgttgagattctggtagacggtgcacgatgcgtgtag

SEQ ID NO: 36647 - DNA, 772 bp, Aspergillus nidulans
atgaagctgcttgctctttccctggcctcgttggcctccgctgccaccatcactcgccgtgccgacttctgcggccaatgggacactgccacggcgggtaacttcatcgtatacaacaatctctggggtcaggacaatgccgatagtggctcgcaatgcactggtgtggactccgccaatggcaacagtgtctcatggcatacgacctggagctggtctggaggctcctccagtgttaaaagctacgcgaatgctgcgtatcagttcacggcgacccagttgagcagtctgagctcgatcccgtctacctgggaatggcagtaagtcatgtaaacttcgtctccggcttttagcggttattaatgcggtcaacaggtactctacgaccgatgtcgttgccaacgttgcctacgatctcttcacgagctccagcattggcggagactctgagtacgagatcatgatctggctggccgctctgggcggtgcgggccctatctcctcgaccggctcttccatcgcaacggtaacccttggcggagtcacctggaacctgtattccggccccaacggaagcatgcaggtgtacagcttcgtcgcatcatccaccactgagagcttctcggccgatctgatggactttatcaattacctcgtggagaaccaaggcctgtcgaacagccagtacctgactcacgtgcaggccggtaccgagccattcactggctccgacgccaccttgactgtttcctcttactcagtctctgtctca

SEQ ID NO: 36648 - DNA, 929 bp, Aspergillus nidulans
atggactcgctcactactcatcctgccactgcccaacaggctcgtgccttcacttctccctcgtcgctgtctttccctggcggcactgccttccctggtggtgctgacctgacaccgccttccgataaggatgcgaatatggccactaatggtcagagcgcgaatggaaatgtgaatggccagcagcagggagcaaatgccgctaacggcaatggggtgatgcccgctactccagctgcgacccctggtgccagcgctccagggagtggtatcgtgcctaccttgcagtgagtatactctgttgtcatctttctggtccaccagaatactgaacaaagactactcttgaagaaacattgtcgctacagtcaaccttgattgtcgtcttgatctcaagactattgcgctgcacgccagaaatgcggaatacaaccctaaggtattattttccacacctccctgagtggattaaatcagggtacagtgtggctgaactggttttcctctagcgtttcgcggccgttatcatgcgtattcgggaacccaagacgactgcgttgatcttcgcctctggcaagatggtggttactggtgccaagtcggaagacgattccaagttggcttcgaggaagtacgctcgtatcatccagaagttgggcttcaatgccaagttcacagatttcaaaatccagaacattgtggggtcctgcgatatcaaatttccaattcgtttggaaggtctggcgagtcgtcaccacaacttcagttcctacgaaccggagctgttcccaggtcttatttaccgtatgatgaagccaaagatcgtcctcttgatcttcgtcagcggaaaaattgtcctgaccggagccaaagtccgtgaagagatctatcaggctttcgaactcatctaccctgtgctctctggtaag

SEQ ID NO: 36649 - DNA, 3092 bp, Aspergillus nidulans
cgcgtaattgtgactactagccgtttctcatccagcgtggtccgcaagtaccaggacttgtatacacaggttggttctcgcgggtctgagctggtcgttgtgcccttcaaccaagccagcgtgcaggatgtcaccgcgctagtcaactacatctatgacgcccagggcggcctgcattgggatctcgatcatatcctgcctttcgcggctatgccggaaaatggccgaacaattgaaaagatcgacccacattccgaattggcccatcgaaccatgatggtcaacaccgtgcgcctgctcggtgctgtcaaggctcgtaaagaagcccagggctcgcgcacgcgaccaacccaggtcatcctgcctctctcccccaaccacggagttttcggtggagacggtctgtatagtgagtccaaactgggtctggaggcactcttcaaccgttggcactcggaagactggtccgactacctttccgtctgtggtgccgtgatcggctggaccaggggaacaggtctcatgagcgggaataaccttgtagcggaaggcatcgaggagctaggatgtcgaaccttctcccagcaggagatggcgcagtgcctcctctgccttatgttcaacacaatgtgcagtctttgcgaggaggcgcccctctatgccgacttatctggccgcatgggcgcggtgcagaacctcagacagaaggtgcaggactgcgcacagagatcaatgagacagcgaacacgcgcagagctctcctggaggagctggcgatggaagccagatgctctgaggggccaacgcccactattgactctgaacccgcgaaagctacggccacccccacccttacagctcacgttcgtctggactttcccccgacagtcgactacaatcaggagattaagcccctcacggccgaccttcagggcatggtcgacctcgaccgtgttgtcgtagtgaccgggtttggggagatcggaccatggggcaacgcacgcacgcggtgggagatggaagcctacggagagttctcacttgaaggctgcgttgaaatggcctggttgcatgggtctaatccggtatgagaacagttcatcaccgggctgggtggacgcaaagacaaacgagcgcgtccacgaccatgaggtcaagcacaaatatgaagagcatattctgtcccacacgggtattcgtctcattgagcctgaccggttcggtgcgaactaccaccccgagcacaagcagctgctgcacgaagtgctcatccaggaggacttccccgagttggaggtgcccgaagctaccgcgcagcaaatgaaactggaacacgggaataaggtggacattatccccgacccagaagggggtgatcagtgccgcgtggttctgaagaaaggggcaaagttgatggtccccaaggcgctgcgactagatcggatggttatcgggcagattcccacgggctgggatgcgcgcaaatacggaatcccagaggatgtgatctcgcaggtggacccggttaccttgtacatgctagcctgctcgattgaagcactgctctcttcgggaatcactgacccctatgagatttaccggtatatccatgtctctgaagctggaaactgcgttggctcctccctgggtggcttcaactcgctccagcagatgtatcgcggccggtacatggagaaggaagtccaaaaggatatcctgcaagagacattcgtcaacaccatcggcgcctggatgaacatgcttcttatgtcttctgccggcccaattcgcactcccgttggcgcctgcgcaaccgcaatcgagtccgtcgagctaggatacgacacgctgatcagtggaaaggcaaaattctgcttcgttggtggcggcgatgatttcggcgaggaggtcctctatgaattcgccaacatgaaagcaaccgccaacacggtcgatgagttcgagcagggccgcgaggcctccgagatgtctcgccccgctgcaagcacgcgcaacggcttcatggaatcccacggctgcggtgttcagatcctcacaaccgcaagactagccatcgagatgggcctgcctgtacgcggcgtgatcgcctttgtggagacatccagcgacaaggcgagtcggtcagtccctgcgcctggaagggggatcctttccaaggcccgtgaggtgcgatcctcctcgccctcctcttcgctcatttcctcgccactgctcaatatttcgatacccgcaagcgcctggactttcgcaagaagcagatcgagttcgcgcgagaaactgccctcgaggagctacagcttgaaattgcccacgttgaggaatccgaagtcgaggattatatccgcgagcgaacggcacagattaatgccgaagctcaaaaggatctcagaaacgcccagtaccaccttggcaatgccttctggcaaaacgatcccagcatagcacccctgcgtggagcattagccgtttggggtcttactattgatgacctcgacgtggcctcctttcacgggacatcaacgaagctgaacgagaaaaacgagtgcagtctcatccaggcacaactctctcacctcggtcgcgcaaaagggaatgtcatcctcggcgtcttccagaaatatttaactggacaccccaaaggcgcagccggagcatggatgctcaacggcgctctgcaaatcctggacacagggatcgtaccggggaaccgcaacctcgacaacgtggaggccgaattacaaaagaacgagcaaattgcctttttaaatcggtccttggacacaggccgtggcagcatgcgcgcggtcagcgtcacttctttcggattcggacagaaaggcgcacagactattgtcgtgcatcccaagtatttatttgcgacgctggaggagcaggaatatgaggagtacctggacaagcgtgcgaagaggcagaagaaagccgattcgttcttctatcgggggttggcttccaacaggcttttcgagctgaagactgccccgccgtgggcaccgcagaaggagctggagacgctgctagatcccacggttagattttaggcgggggaatga

SEQ ID NO: 36650 - DNA, 847 bp, Aspergillus nidulans
gatcccttcgaaagatcaaggttaccagacatatagagccgccggaagttgctagggaagaaggccataattactggcggtgactccggcatcggtcgtgcggtcgcaattctgtttgcgatggagggtgcttcaagtttaataacctatttgccagaggaggaggaggacgcacaggaaacaaagagacgggttgaggaagccggccagaagtgctaccttctagccacagacctacgcaggaaggagaactgcaagaaggttgttgagacggcattagagaagctaggaggaattgacatcttggtaaacaatgcgggaacgcagacgatgcttcctgatatcagtgacttggatgagtgagtatcaagatctaacaaggacgacacattgtgctgatgatgatttctattccaggtcccaatgggaaagcacattcgacacaaacattcatcctgtcttttatctctccaagtacactatgccacatctcaagtccggttcatccatcatcaactgcgcttcggtaaacccttacatcggtcgacctgaccttctcgactacacttcgaccaaaggggcgatggtcgcgttcacgcgcggtctgtcaaaccagcaatgcagcaaaggcattcgtgttaacgcagtatgccccgggcccgtctggacccctctaattccagcaacgatgaccactgaggcaatcgagcaattcagcggcacgccgatgggtcgtgcaggacagcctagcgagatcgcaacttgctttgtttttctcgctagtcaggatagtagttttatctctgggcagtgcttgcacccgaacggaggagttgttctcaatggt

SEQ ID NO: 36651 - DNA, 1857 bp, Aspergillus nidulans
acggaaccttccactgatggtgtcttcagagaaaacgatgcccggcctgaaaaggacgcggcgaatgatgtccttgaaggacctccggtactgcccccaatgccacaagagccgtctcttgcagacgcttttgagccggtgaaggacactgggcctcgcactaaccagggtccggaaacacctaaatcaagccatcgacaaccgacttctgccgtttcgactccgcctcaagccacgcagtattcacctgagcagccttctccggggaaggaacttactttgttcctccagtatcggagcaaaatcaagaaatacgtgctttcagaaggtgcttctggtttgaccatcgggagacttcagttggcgttcatagaaaaatttgcatggaatacgcacaacaatggtgctgatctaccggaaatctacattcaagatccaatttcaggtatcaggcacgagttggaggatttgagtgacgtcaaagatcgctctgttctcgtcctaaacgtcgacgcccttgatgaagtcaaaaagcattttgatgatgagctcggtggtgtacgccgcctacttgagggtgttaaaggagcattggatggacagggaaacatgatgcagcgcgtctcagatcggcaagtggaggctgtgaaggagatcgcccgccttgccgccgcacctgctgtctctagccgtggcgcccctgccactggagaggtgcgacgcggtcccatttctggcagtgccagtcaaatggcagaactgtcaagcctgcgacgagatctggcggtgctgcgacaaacatacaccgacttctcggcggatattgcgagctcgatgggtgcgatacgggccaaagcggataccgtcaaatcttcagctgtcgaagcttctgtgccgtcttacgaaggggatgcaggccgggcgcgtgtcaaccttgggaagaaggagctcgctgaagagtctgaacggcttgttgcgcgagtcgatgacctacaggatctgattgaggatctacggaaagacgtggtcagccgaggagtacggccgcttcctagacagctggagactgtgggtaaagatatcagcgccgttacaaaagagatcaagaagatgcaagaattcctcaagcgagagaaaccaatttggaccaagatctgggagaaggagctgcagcttgtttgtgaggaacgtgaccagctcaccatgcaggaagatcttgcagctgatctgcaggatgatctggaaaaagcagcccagacgtttgctctcgtcgagcaagcaaccaagcagcaggccatgcaaaacggcaacagcggccctacactgcgaaatacctcgcgtaatgtggtgattgacccggcagtggatcctatgaaagcaaaggacagtgtgttgggcgaagttcgcgctctccagcccaaccatgaatcccggcttgaggctatcgaacgagctgaaaaagcccggcagaaggagctcgaaactcgccgtgtcgatctattccagaaggaactgggcacctttgttcaggagggaaagctgaagaagagtggcggtttcgaggaagccgaacgtcttcgtcgggctaaagacgagcgcaatcgcaaggagatgtggaatatagctcaagcccgtgcagctgagattgaaaaagctgaagcggaagcggctgcagcttccacgccctctgcagcagaaccatactccgacgacgcggctcttgagagaaccgaagcaccggagtcgcctaaagggaaggctccagtgtctgacggtgacgtgggcgaggagaagaaggatgaagaagcgccagccgagagccaggacaaccaggaaagccataaaacagaccccgag

SEQ ID NO: 36652 - DNA, 731 bp, Aspergillus nidulans
gctgaacggattttaatgaacgagttcaaggctctctctcaagagccgtgggtcaacgttgagcttcaaaacgacgacatcttcagatggacgatcgggcttatcgtgctgaatccagattcgttattttacggaggttacttcaaggcatccatgaagtttccaacgaactacccgtattcgccaccgggtacgcttttttgcccttgagtgctcagacctgccatttactaacaatgctcgtagagttccgctttcaccgacccctctatcacccgaacatctacaccgacggcaagctctgcatctccatcctccactcgcccggcgaagatgaaatgtccggtgaactcgcgtctgaacgctggtcgcccgcccaacgcgttgagtccgtactgatttctatactttcccttctcgacgacgcggaagtctcctcgccggccaacgtagacgcttcggttctcctccgcaaggattttgaagcctacaaagaacgtgtacgaaagtgcgtggaggattcgaaggctgacattcccgagggattcgaaatgccgacacacgagagcacgatcaggagtgccccgaagcaggtgaaggacgatgactcggacttttgggccgagagtgacgtggacgatgatatgtttggagggagtggaagtgaccaggaggaggttgactcggatgcgtttgagcagggcgatgactcgatgagtgatgacgagtga

SEQ ID NO: 36653 - DNA, 537 bp, Aspergillus nidulans
caccgagatctaaagccgcagaacttattgatcaataagaaagggcaattaaagctgggtgatttcggacttgctcgcgcattcggcattcccgtggacacattttcaaatgaagtcgtaacgctttggtatcgtgctcctgacgtccttctcggcagcaggacatataatacaagtatcgatatctggtcggctggctgtatcatggcagagctatatacaggccgccccttgtttccgggaacaaccaatgaggaccaactgcagaagattttccgcctgatggggacaccctctgaacgctcttggccagggatctcccagctgccggagtacagggccaatttccacgtatacgcaacacaggaccttggcctcatccttccccaaattgacccgctcggtctcgatctgttaaaccgaatgctgcaactccgaccggagatgcgaattgacgcccatggcgctctgcagcatccatggttccatgaccttccgcagctccaggcacagttgcagcaacagcaaatggccgga

SEQ ID NO: 36654 - DNA, 991 bp, Aspergillus nidulans
gaagacaagactcacatcaacatcgtcgttatcggccacgtcgattccggcaagtccaccactactggtaagacttcctcgcatccgaccgtccttgaccaaacactcacaaacaacaggtcacttgatctacaagtgcggtggtattgaccagcgtaccattgagaagttcgagaaggaagccgccgaactcggtaagggttccttcaagtacgcttgggttcttgacaagctcaagtccgagcgtgagcgtggtatcaccatcgatatcgctctctggaagttccagacccccaagtatgaggttaccgtcattggtatgtatatatgatcctgtacaacgtaactccatctaacaattcaactagacgcccccggtcaccgtgacttcatcaagaacatgatcactggtacctcccaggctgactgcgctatccttatcatcgcttccggtactggtgaattcgaggctggtatctccaaggatggccagacccgtgagcacgctctgctcgctttcaccctcggtgtccgtcagctcattgttgccctcaacaagatggacacctgccagtggtctgaggcccgttacaacgaaatcgtcaaggagacttccggtttcatcaagaaggtcggctacaaccccaaggccgttgccttcgttcccatctccggtttccacggtgacaacatgctcgaaccctccgccaactgcccctggtacaagggttgggagaaggagaccaaggccggcaaggtcactggtaagaccctccttgaggccatcgacgctattgagcctcctgttcgtccctccaacatgcccctccgtcttcccctccaggatgtctacaagatctctggtatcggaactgtccctgtcggccgtgtcgagactggtgttatcacccccggtatggtggtcaccttcgctcccgccaacgtcaccactgaagtcaagtccgttgagatgcaccaccagcagctcagg

SEQ ID NO: 36655 - DNA, 1782 bp, Aspergillus nidulans
atgtcggtccagaccgtttccatccagcccttcggcgaccagaagcccggaacgtacgtcaatgcactctgttttcctgttgacgtgtctctaacagcggtttttcagctctggcctgcgaaagaaggtcaagatcttccagcaagagaactacaccgagtccttccttaccagtatcttcctctcgatccctgagggcgctcaggacgctttcctcgtcattggtggcgatggtcgctactacaactccgacgtcattcagaagatcgccaagatcggtgccgcctatggtgtgaagaagctcatcgtaggccagaacggcatcctcagtaccccggctgccagcaatctcattcgcaagaggaaggccaccggtggcattctcttgacggctagtcataatcctggcggtacgacactcctagacaccgagtgaacttctcagctgactggataggccccgataacgactttggtatcaagtacaatctcaccaatggcgcgcccgccccggaacaggtcaccaataagatctacgaggtctcgaagtccctcacctcctacaagtacatcgacctccccgaggttgacaccaccacagtcggcacccgcagctatggccccctcgaggtggaagttgtccactcgaccgaggactacgtctccatgatgaaggagatctttgacttcgacctcatccgcagcttcctcaagaagcaccccgatttcaaggtcctcttcgacggcatgcacggtgtaacaggcccctacggcatcgatatcttcgtcaacgagctcggccttccctccagcagcaccatgaactgcatccccaagcccgatttcggcggcggtcacccagaccctaacctcgtgtacgcgcacgagctcgtcgaggccgtcgacaagaacggcatccacttcggcgccgcttctgacggtgacggtgaccgcaacatgatctacggcgccaacaccttcgtctcccctggcgactctctcgccatcatcgctcaccacgcaaagcttatcccctggttccaaaagcacggcgttgacggcctcgcccgctctatgcccacctccggcgccgtggaccgcgtcgccaaggcccagggcctgcagagctacgaagtcccgacaggttggaagttcttctgcaacctcttcgacaacaagaagatgtccatctgcggcgaagagagcttcggtaccggctccaaccatatccgtgagaaggacggtgtctgggctattgtcgcatggttgaatgtcatcgccggcgtcgccgagcagaagcccaacgaaacacctagcattgcttcgatccaggctgagttctgggaaactgacggccgcactttcttcactcgctacgactacgagaacgtcgattccgacggcgcgaacaaacttattgccgcgctgagcgagaaggctgtcgacaacaagagctcatttgttggcagcaccatctctggccgaaaggtcgttgactctggcaacttcgcctacactgatcttgacggcagcgttaccaagaaccagggtttgtatgttaagttcgatgacggcagccgtctggttgtgcgtctgtccgggacgggaagcagtggtgctaccatccggctgtacgtcgagaaatatgagggcgataagagcaagtaccagatggctacgcaagattacctcaaggataatgttgggttggcgctggaattgctcaagtttaaggagtttgttggccgcgaggagccggatgtgaagacttaggtttagcca

SEQ ID NO: 36656 - DNA, 690 bp, Aspergillus nidulans
atgtctacaaattcagacctcagagtgacactctacacctactttcgctcctcgtgctccgcgcgccttcgtatcgccctcgcccttaggtcaatctcctatacctcagtccctatcaacctgctgaagggcgagcagtcgagcacaaaaaacacggccgtaaacccatcggccaccgttcccacgctcatcatcgagcatgtagaccggagccagtctccaataacaataacccagtccctcgcagcgctcgaatacctggatgaagcattccccgacaatcccaacccactccttccacctatttctaacccgcaacaacgcgcgctcgtgaggtctctagcatcaattatagcctgcgacattcagccagtcacgaacctacggattcttcagcgcgttgcaccattcggcgtcgaccgggccgcctggtcaaaggatctcattgaagctgggtttgcggcgtatgaggctattgctagagactctgctggagtattcagtgttggcgatacaatcacgatggcggatgtttgtttgatccccgctgtttggggcgcagagagagcgggggtaaatctgggacagtatcctacaattaaaagggttgcggaggccctggagaaggagaatgcagttaaggaggggcattggagaacccagcaggatacaccaacggaattcaggtgt

SEQ ID NO: 36657 - DNA, 992 bp, Aspergillus nidulans
ctagtgcctaagcctatctctacgcagccatttactcttcttacctcctatctgcccttcacgaatgaggcccagagacaatggtggctcgactcgggctccttgttctcccggttcctccaagcctcacagtacacaaccggccaacaatacaaacacctgctcttcttccaccgctacctcctcccttttctcggcacctatccaccaacctggttcagcattgtcagccgacaggggctcgcaattgaatatagccttaatttccaggcgtcaggcaatcccgttattcggagtgcatttgaaccgttgagttacgcgtccgggaaggatgctgcggatcccttgaacaagcgacctacagaggacttgcttgcagggttggtggagcaagggttggagggattcgatatgacactcttcgatcatgttcgggatacaatcttcatttcggacgaggagacggctgcccttgaaaacccagatgcctatgggatcaagacgcatactgctctaggattcgatatgaagggggacaacacggtggtcaagtgctatatgcatccgcggtggaagagtcttgcaacgggggttccggttgccaagctgatacgagattcgcttgagcggatcaaggaccagttcgattgtgaacaggcgctcgaactggttgatgagtatatggaggatagtggatcgtgggatttaaggacgttcattgcgtgggactgtgtgcctttggcccagacgcgactcaaaatttacggcatcatcaacgaggtctcgctgggcaaagttgaggaactgtggacgatgggtggccggctcaacgacgagacgactctcgagggactctcgctccttcggcgcctttgcacctactggaggtcaataaggatgaccggctgttttcgaagggggacgaggagaaactcgagtatggcccaacagtcgacggcttcctgccactattctggaactatgagatctgg

SEQ ID NO: 36658 - DNA, 659 bp, Aspergillus nidulans
atctccaaggaccgcattcgcattaagatcgcctcaacctgggagggtatccaggccgctcacatcctgcagtcccagcacggcatcaactgcaacctgactcttatgttctctcttgttcaggctattgctgctgctgaggctggtgccttcctcatctctcctttcgtcggccgtatcctcgattggtacaaggccgctcacaagcgcgacttctcgaaggaggaggatcccggtgtcaagtctgtccagagcatcttcaactactacaagaagttcggctacaagaccatcgttatgggtgcctctttccgtaatgtcggtgagatcaccgagctcgccggttgcgactacttgaccatctccgtacgttgccacccttcaactataatttttgagggcgtatcactgacgaaccacagcccggtctccttgaggagctctacaactccaaggacgccgttcccaagaagctcgacgctgcctccgccaccaccctcgacatcaccaagcgcagctacctcaacgacgaggccctgttccgcttcgacttcaacgaggaggctatggccgtcgagaaactccgtgagggtatctccaagttcgccgccgacgctgtcacccttaaggacatcctgaagcagaaggtccaggcgtag

SEQ ID NO: 36659 - DNA, 1137 bp, Aspergillus nidulans
gactggttcaagagctataaagtgagaggaaattgtcccgcccgtgaaaaaaatggatgctctggccgccaccgtctcttaaaacacggttcgtaagtagcgcccagctatcttgacgtagttgccagggggttgctaatttaggtccacccaagcttcgtcgactgccctggtcacgacattcttatgagtaccatgttgtcaggtgccgctgtcatggatgctgctcttttgcttatcgctggaaacgaaacctgtcctcagccccagacttcggagcatttggctgctattgaaatcatgaagcttagccacatcattatccttcaaaacaaggtcgatttgatgagggaagatggagcgttgcagcattaccagtcgatcttgaaatttatccgtggtaccgttgccgacggctctcccatcattcccatctccgctcagctcaagtacaacatcgatgccgtcaacgagtatctggtttcgcacatccccgtgccagtccgcgatttcacggcatctcctcacatgattgttatccggtctttcgacgtgaacaagcctggtgcagagattgatgagctaaagggtggtgtggctggtggttccattttgactggtgtcctcaagttgaacgatgaaatcgaaattcgaccaggtctcgtcactaaggacgagaacggcaagatccagtgtcgccctatcttctcgcgggttgtgtctttgtttgccgaacacaacgacctgaaattcgctgtccccggtggattgatcggtgttggtactcgtgttgaccctactctttgccgtgccgatcgcctggttggtttcgtcctcggtcaccgtgggcgccttcccgctatctacacagagctagaggtcaattactttttgctgcgccgacttttgggtgtcaagactgccgacggcaagcaggccaaggtcgccaagctggctaagaacgaggttctcatggttaatatcggctctacagctaccggtgcgaaggtggtcggtgtcaaggctgatgctgctaagctgagcttgactagcccagcctgtactgaggttggcgagaagattgccattagtcgaagaattgagaagcactggcgtttgattggttgggccaacatt

SEQ ID NO: 36660 - DNA, 2959 bp, Aspergillus nidulans
gaccactctcgccgctccctgcttctgctcctggccctgactccgacgtcctggccacttctttcaccccgcccggccacaggctctcgcactcgcacacgcactctagagctcagagtcagcgtcagcttttcccaggaatgtcctatcccaaccccaactcggaagccggtagtggcggcggcagtataacttcctggcagaaacgtcaggcagggggattgcgtcggtggcccactcgcagagttgatttgatcaaggggagggtcttgagcgtcgactatccggttccgagtgcgatcttgaactcagtcgagccgcagtatcgtgactcggcgagcagttcggaggaatttacccatctgcgatgtatgtgatgtctttgatcaacaagatggggaattgacagggtctgactgatgatggaaatgtttagatacggctgctacctgcgacccggacgacttcacgctccgcaatgggtacaatctccgcgcctccatgtacaatcggtatacggagttgcttattgccatcacatactataatgaagacaaggtcctcacggcacggacgcttcacggagtcatgcaaaatatccgggatattgtcaacttgaagaaaacacagttctggaataagggagggccggcatggcagaagatcgtggtctgcctggtgttcgatggaatcagtccgtgcgataaggagaccctggacgtgctggcgacggtggggatctaccaagacggaattatgaaacatgatatcgatgggaaagagacaacggcgcatattgtgagacggcaccgaaacccttgatgaagcgcctccagctaacttgcccagttcgaatacaccacgcagctatcaatcacgccttcactccaactcgtgcgcccccagcgtgatgacccaacgaacctgcctccagtgcagatgatcttttgtctgaaacagaagaacagcaagaagatcaattctcaccgctggctcttcaacgctttcggccgtatcctgaacccggaggtctgtgtccttattgatgccggcacaaaaccaggtcataaatccctcctggctctctgggaagccttttataacaacaagaaccttggcggcgcctgcggcgaaatccatgccctactcgggcctcgctgggagaagctcgcgaatccactggttgcagctcaaaatttcgagtataaaatctcaaacatcctcgataaaccgcttgaaagtatgtttgggtatgtgagcgtcttgcccggcgcgttttccgcctatcgttacagggctattatgggaaggccgctggaacagtactttcatggagaccatacgccaccaaagagattgggaaagaccgccattgaagggatgaatatttttaagaagaatatgtttctggccgaggatcgcatcttgtgctttgagcttgtcgccgaggcagggcagaaatggacattgagttatgtgaaggcgtcgaaaggagagacagatgttccagagggtacgtaccgtcctttcagagctaataaaatactaattatgttgtgcacagcaccacccgagttcctaagtcaacgacgcagatggctcaatggatcgtttgcagcgagcttgtactcggtgatgcactttgcacgtatctacaagagcgggcataacatggtcagactcttctttttgcacgttcaattgttatacaatgtttgtcagctcatcatgacgtggttctcactcggtatgccgctcctctcttcgttggtatctgtatattgacaactgctagcgtcgtactggctcactacctcggtcatcatggatattgtcgggacacccagcgcaacgaacaaatacaaaggttggccgtttggaaatgaagtctcgcctattttcaacaatgttgtcaaagtcctgtatctcgtctttctcatgcaccagttcttccttgccttgggcaatcgtccaaaggggtatgttttctaacatcgtttacctgtaagattgggttaacaaatatagctcgcaattcgcctacatcctgtccttcctatacttctctctcgtgcaaatatatatcctcatcctctctttctaccttgtcgcccaagccttttccggtggcaacatcgacctcgacttcgaccatggcgtcggcggcttcttcgcctcatttttcacctccaccaccggcctggtcctagtcgcccttgcctcaacctacggtacctattttatcggcagtatcctctactgcgatccgtggcatctgatcacctcttcctgggcatatttcattggcatgccgagcacaatcaacatcctcaacgtctacgcgttctgtaactggcacgatgtttcttggggaacgaaaggatccgacaacgcagctgcatcgctcccatccgcgcaaacaaagaaagctcccggtggtggagatggtgacgcaaaggggaccttcgtcgaagagctcgacaagccgcaagctgacatcgataccgagttcgaattcacggtccgccgcgcgcttgccgagtacaaggaacctgagcctgataaaacggtctccctggacgacagctacaagacgttccgcacgaacctggtgcttacttgggcgttgagtaactcgttgctggcgctgttgattaataacgccggggttagtacgttgtgtttgacggtgagtcccgcctcccttcttcaaacctcacccggtcctttccgggattagctccttcactacggtttacggttgagcatggttttggtatgtggtggagtctggctgactgtgtttttcttgcagacgacatcaacggtccggacggcgtggtactttaagtgtctgctctgggcaacgtcaggactgtcgatcttcaggttcgctggggcgctgtatttcctggcgaagacgggggtgctgtgttgctttgtgagaagatgatgctta

SEQ ID NO: 36661 - DNA, 2811 bp, Aspergillus nidulans
ctcctgccaaaatgcttcgaatacatcgtgcggacccagctagaggatggcagttgggagacctacgcctccgacgtcgacggtatcctcaacaccgcagcctccttactggccctcgagacccatgcagaaagccggattgccagcaccgaccctcccgtggaagaaatgaaggagcgaatcggacgggcacgcgcggccctctcacgacaactgcaagcgtggagtgtaaaagacactgttcacgttggctttgaaatcattttgcccgcgcttctgcggctcctgcgcgagaaagggcacgagtttgaatttgacgggcgcgccgagctcgaccggctgaatcgcatcaagctctccaagttcaggccggagtacctgtactccgccagaaccaccgcgctgcactcgcttgaggcgtttgtgggcatgatcgactttgataaagtggcgcaccagaaggtcaatggctctttcatgttctcgccatcgtccacggccgcctttctcatgttttcctcctcctgggacgacgagtgcgaacagtacttgcggttggtgctacagaatggcgccggagggggcactggaggaatgccgagcgcgtatccttcaaagtatttcgaggtctcgtgggtaaggggacagcttgctcgactagaatcaaagctgactgaacttcaggcccttaccacgctcttggacaatggatattctacaggcgatctcggtatcgaagacaccgacagcctcggcgagatgcttcgcgatgcgttggtcaaaggaggaggtattgtaggatttggtacgatcccacaacatggctctatcactctccctcacgtagctaaccattctgttgtatagctccgtcgatccaggcagacgccgacgataccgccaaatcgcttattgcggtctccttgttggacaaaccagtctcggcccagggactaatagatgcattcgagggcccgatgcacttccgcacctatcacggcgagagagatcccagcttcactgcaaacagcaatgtattgcttgcgctgttgaatacgcccgatgcggccactgtgtcgccccagatcgaaaaagcagcggcctttctgtgtgatgtctggtggacggccgacagtgagattggggataaatgggtatcacttcttttcgcaacagaaatggaaatagcagagcgctgactctctcagaacctctccccgtactatccatccatgctcatggctgaggcgtttgggaagctctgcaaggtatgggcaaatgcgagaccatagtcgatttccagtcagtttatcaaagatcaagtatcggtctgcctgaatcaggcattggttcgcactctacagactcagaacgagaacggatcctggggatcgcactcccacgaagagacggcatatgctattctgaccatcgctcacgcatgccagttgcccgtggtgaatcagctgtggacgaatgtgcagctggctgtgtctcgaggccgcaagttcctgcaaaacagcgcaggcgacaaagcggagtatctgtgggtagagaaggtgacatacagatcaattctcctcagtaagagctatgtcctcgccgcgctgaaggtgtccttcgaacgttcttatccagcctgtctggcgaatctgttcatcgtcagcaagaagcgtgtcatcgagttctcacgcttccactccatgcttcccctgttttcgagcatggaactctggaaggtccgcgctgccatcgtcgaaggatacctgctcctgccacagctgcgcgaccgacgtcttgccgtcttctctcgcacgggcatggaagaagacaagtattttgagtacattccgttcacctggaccctgtgcaataaccgcaggaacaccttcctctccacgaaaacccttgtcgagatgatggtgatttcgttcctcaactaccaagccgatgaatttatggaagcggtagtcggcagactgaacagcagccagagatccatgacccggtcctgcatcgacgagatcttccgcgacctcaaggacaaaccggagctgaatgacgcaatccaggcccagtctggtccaagaaacgcagacgcaaacggtcacaggatcctaccgcaagccaaacgcatcaagatggggtcacaactcccaagcgacgtgagccgcgtccttagcgccttcgtccaccacgtcatggaccatcccagcgtgaaggccgccgcgcccctcgagtacgagcgcgtcaagaacgagcttcaggtcttcctgctgtcgcacatagagcaggccgacgacaacggccgcttcgccgcccaactggagtccacccgcgacgacttcgagaccgcccgctccagcttctaccgctgggtgtcttccacctcgtccgaccacacctcctgcccctactcgtttgccttctaccagtgcctgctggggttcgagcaggcgtcccacaacgccgcgtgctttcagacctgcgaagagaagtatgtggctgaagcaatgtgccgccatctcgccgtgatgtgccgcatgtacaacgattacggatcgcttgcccgtgaccgcgacgagaagaatctcaactgcgtcaactttcccgagtttgcccaggccgggccaaaatcagatgcggttcggcagaagcagctgttctctctcgctgagtttgagcggtccaacatgaagcggggcttggaggtcttgacagagatggcggcgcaggatagggccaagatgaggatgctggagaaggtgcagatgttttgcgacgtgactgatgtgtacgggcagatttacg

SEQ ID NO: 36662 - DNA, 723 bp, Aspergillus nidulans
ggaaacagattcttcaacatggacgagatcagggaccggtcatccccctatcctcagatgctgccttctgcgacacaatttgccgaaagtatgaccaagatgggtcttcatccggacgatattctggtagtctacgatgcgctggaggtcggactctattcgtcacctcgtgtggcctgggcatgtcgccactttggccaacgagacgtccatgttttgaataacttccctcgttatgttgcagaagggttacctctttccactggacccttatcgaccctgcctcctgccgccctggagtatccaataaaaaacccagattccaaggaagtgatatcatacgacgagctacgcggtcttctcctatctgataagaaatcagatattcagatcatcgacgccagaatccccggtcgattctcaggcgccgaaccagagatgaacccggccctgcggtctggacatatgccgtcggcactgaatgtgccgcttgcatctatcatggacaaggacaaggtcatattgccggctgaagagctcaaggcacgtttccaggcggccggggtagatgggcaattgcctgtggtgttgacgtgcaactctggagtaactgcggctgcgctcgacctcgctttgcagctaagtggatacaggatggagcgacgactgtacgatggcagctggatggagtggacgagaagaacgcaggatgagggtctggta

SEQ ID NO: 36663 - DNA, 1611 bp, Aspergillus nidulans
ctgcaggttatgacggttctctgatgaacggcctcgaggccctggacgactggaaaaggtgtaagtgaaccacgcgtaattgttcagctacgctttaaagcttacggaccgttaacagcatataatcatcccgagggagcgacgcttggtttactggcagcgtccatgtccattggctcgatacttgccatccctgtggttccctacgtcgctgacctgttcggccgtcggtttggagtcgtgcttggctgtatgattatgatcggtggcgtggctatggtttcgattggatacaagatcgcgctatttgtcgttgggcgcatcatcctgggatttgggctgggaattgcccaggtcagtgcactggagattgatggcgagcgcggtgactgactgggatttaggaatgctcgcctctacttgtcactgaacttgtccacccgcagcatcgagccatctacagtaccatctacaactcgctgtggtacgtgggtagcttgattggtgcctgcgttgcccttggtatgttgccgcgttgtctgtagcccggatgcctattaacagtgctaggaacgaacaacatcaaaggaaacgactggtcgtggcgtgtgccctgtcttcttcagggtgtgccctcagtatgccaactgattttcatctggtatgtggcttcactcgttgcttggagatcaaactgacctggcccaggtttgtgccagaatcacctcgctggcttatctccaaaggcaaatcagagaaggcaaagaagatattggcctacgtccatgcacaaggcgacgaggacgacgaactggtcaacgtggaattcgacgagatccagcaaaccatcgcgctcgagaagcaactcgaaggcagcggctggtctgagctgtggtcgactcctggcaacagacaccgatctatcattcttatctccatcggcttcttttcccagtggtccggaaacggcatcgtatcctacttcttgccaaaggtctgtcatcgtatctcagccagaacccaagaccagcagagaactaacgccaacaggtcctcgagcttatcggcatcaccgacagtcacaaggtcctcacgatcaacagcgtcctcaacgccgtgaacgtcgtctccgcaacgggtatctgtttcttcgttgacaagctaggacgccgcaagctcttcctcacatctgtcacttgcatgctcctctgcttcatctcaaccaccatcgcccttgcccgcttcccccatggtcccggcggcgcagatgaccacgccggcaacgcggtgattgtattcatcttcctgtattacatctcatacaacatcggtttcagcggtcttctggtctcatactcgtccgagatcctgccgtaccgtctccgcgcaaagggtctgacactgatgttcttctgtgtggctctcagtcttctgttcaaccagtacgtcaacccgattgcgctgctggatatcggctggaagtactacattgtatactgtgtctggctgctctttgagctgtttgttgtgtggaagtactatgttgagacgaagaacaccccgctcgaggagattgtcaagttcttcgacggtgaccaggcggtccttggt

SEQ ID NO: 36664 - DNA, 1984 bp, Aspergillus nidulans
atggccgcaagctcttccctcgaccacttgtccaaccgtatgaagctggagtggcactccaagctgaatactgagatggtgccggcgaagaacttgcgccgtacatccatcatctgtaccatcggtatgttcagcgcctgatctgcgaatcgccaattttgaatattgcggttctgactgacgtcgcgctcactaggtcccaagacaaactccgttgagaaaatcaatgccctccgcagaggtacggcgacttaatgatcacaatcgtgcttgaagctgacaccatcggtagccggtctcaatgtcgttcgcatgaacttttctcacggttcatacgaggtaattctttctcgcatttgcacttggacttcgtctgatgcagtctgacacatattagtaccaccaatcagttatcgaccacgctcgggaagccgaaaagcagcagctggccgccccgttgccattgctctggacaccgtgagttcggcccgtttggaaccgtcgcgttgcagatctgactcaagtttagaaaggacccgagatccgtaccggaaacaccgtaggtgacaaggacatcccaatcaaggctggccatgagatgaacatcagcaccgatgagcaatatgccaccgcatccgacgaccagaacatgtaggtttcgtgatcttttgagtatgtgtcaaggcgactaacttggcgtctgtaggtatgtcgattacaagaacatcaccaaggtgatttctgccggcaagctcatctatgtcgatgacggtatcctttcatttgaggttcttgaagttgtagatgacaagaccctgcgcgtccgatgccttaacaacggcaacatctcttcccgcaagggtgtcaaccttcccggtaccgacgtagacttgcccgctctttcagagaaggacatcagcgatctgaagtttggtgtcaagaacaaggtcgacatggttttcgcttccttcatccgtcgtggcagcgacatccgccacatccgtgaggtgttgggtgaagagggccgagagattcagatcatcgccaagattgagaaccaacaaggtgtcaacaatttcgacgagattctggaagagaccgacggtgtcatggtcgcccgtggtgaccttggtatcgagatccccgctcccaaggtgttcatcgcccagaagatgatgatcgccaagtgtaacatcaagggcaagcccgtcatttgtgccactcagatgcttgagtccatgacatataaccctcgtcccactcgtgctgaggtgtccgatgtggccaacgctgttctcgacggtgccgactgtgtcatgctttctggagagactgccaagggtaactacccttgcgaggctgtcacgatgatgtctgagacctgcctcctcgccgaggttgccattcctcacttcaacgtcttcgacgagctgcgaaacctggcccctcgtcccaccgacactgttgaatccatcgccatggctgctgtgagtgccagtcttgaactgaacgccggcgccattgtggtcctcaccactaggtacgttctcttccgggacttttgatccaacatcgctgacaacgccatagtggaaacactgcccgtatgatctccaagtaccgccccgtttgccccatcatcatggtttctcgcaaccctgctgctacaagggtaagtcctgtgctgctgaatattcggacgcgttggctgactttcatagtactcccacctgtaccgtggtgtctggcccttctacttccccgagaagaagcccgacttcaacgtcaagatctggcaggaggatgtcgaccgtcgcctcaagtggggtatcaaccacggtctcaagctcggtatcatcaacaagggcgacaacatcgtctgtgttcagggtggcgcggcggtatgggccacactaacactgtccgtgtggtccctgctgaggagaacctcggactttctgagtaaatccattcaaaagaatgg

SEQ ID NO: 36665 - DNA, 1899 bp, Aspergillus nidulans
ttctcaacgctcggtggattgctttttggctatgaccagggagtcatcagtggtgtcattaccatggagtccttcggggctcggttccctcacatcttcacagacagtggatttaaaggctggtttgtgtcaacgctcttgttgggtgagtagccgtgtgtttacttactttcataattctctttattttccttatttcccccatattttttttcccccccgttttacttcatttcctacattcagtttcatgttttgtacaaaactgacattcccagccgcatggtttggatcgcttatcaatgggccaattgccgacaggctcgggcgaaagatgtcgattaacctggcggtcgtcatcttcatagtgggatctgccatccagtgcgctgcagtcaacgtcgggatgctctttgctggcagagcggtagctggtttggctgtcggcatgctcaccatggtcgtgccgctgtatatctctgaggtatcgattcctgagatccgtggtggactcgtggttgttcaacagcgttagtttgattatccttcccagaaccagccggaaccccaagctgactgtttgtagtctctgtcaccatcggtatcctggtcagttactggatcgactatggctccaactacatcggcggcgctcgctgcgcgccgaacgtcccctacgctggcagttcctttgatccctataccgacgtcccggcaggtggctgtacaggacagtctgaggcatcctggcgtctgccgctcgctgtacagatcgcgcccgcaatcatactcggtgctggaatgctcttctttcccgactcgcctcgatggcttttgatgaaggagcgcgatgacgaggcgctgtctgcgctctcgagactgcgacggcaggctcgcgatgctcctgttctgcgaaacgagtacctggagattcgcgcgtcgatcatgcttgagaatagtttcgcgcgcgagaactttccgaacctttctggtatcaggcttcatgctgctcaggtatgatctgcttatgagcacggccggtgatgatatggtgctgacctattttcgcagtatctttccttcctcacaacctgggcgcgcttcagacgtttagctatcggctgctgcgttatgttcttccagcagttcatgggctgcaatggtatgtatccatccggaatatgccctttatctaattttatctaatttatatcctcacctggccagccataatttactatgccccaaccatattcagccagctcggactcgatggcaacacgtcttcgctccttgcgaccggggtctacggcatcgtcaactgcctcagcactctaccagccctcttcttcatcgataaggtcggccgccgcgtgctcctgatggctggcgccactggcacttgtatctccctcgttattgtgggagcgattgtcggggcgtatggtgccagcctcgtggaccacaaggccgctggctgggctgggattgcgtttatttatatctatgacgtgaacttctcttattcctttggtaggtcattgagtctcgtttagatatcaggcagagcataaagagggaaaaaaactgactactactgtatagcgcccatcgggtgggttctcccctccgaaatctttaacctctctatccggtcaaaggccatttccatcacgacctctgcgacttggatgtgcaacttgtgagttttacactttctgaaagaaaaatatcaccgtctggcaagcttcttatacctttgttcgcagtattatcgggctcgtcacaccagacatgctggactcgatctcctggggcacgtacattttcttcgcggcattttgtcttctcgcgctcgcattcacgttcttcttcattcctgagacccgtggcaaggta

SEQ ID NO: 36666 - DNA, 1943 bp, Aspergillus nidulans
ctgtcggaatgggtgcttgacgctgtctcctcgatggggttcacccgcatgacaccggtccaagcatcggccattcctctatttatggctcacaaggatgttgtcgttgaggctgtcactgggagcggaaagactctttcattcttgattccagtagtggagaagttgttgcgccttgaagagcccatcaagaagcatcatgtcggcgccatcatcgtttctccaacaaggtatttggcttaaagcaggtcgagctaatggagatgtccatgctgactcttcgcagagaactccgttcgcagatctacaacgttttgacatccctactcgcgttccatcccgcttcggcggctgtgataaacacttccgaaaccgaagacgttccccggcctaaacactcttcctccgttcttagagtcgttccgcagctcctgcttggaggctcgacctcgcctgcagaagatctgagcacctttttgaagcgctctccgaacctcttggtggctactccgggtagacttctcgagttgctttcctccccgcacgtttactgcccacaatcgtcctttgagatgcttgtcttagatgaagcggacaggttgttggatcttggcttcaaggaaacactgcagaacattttgcgccgacttccgaaacaaaggcggacggggcttttcagtgctagtgtaagcgaagctgttgatcagattgtccgcgtcggcctgcgtaatcctgtcaaggtcgtggtcaaggtcaagggggcgtcgggagttgatgacaagcgtacccccgccaggttggcacttctttacccttctatactctcatatacttatttgatgcagccttcaaatgacctatttgactcaaccaccaaccggtaaatttccagcactaaagcacattcttaattcagtgcaaccgacgccctccaaatcaatattcttcgtgtcaacttgctcaggtgtcgactacttatctgtcatcctcccgttgatacttggcaacgatttccagttaatacctcttcacggaaaacaccctgcaaacgtgcgtcaaaagaatttcaaccgtttcgttaacgctcacaacccggccatccttctcaccacagacgtcgcttcccgcgggctggacattccgtcggtggacctcgtcgttcagatagaccctccttcggacccaaagaccttcattcatcgatgcggtcgtgccggcagagcggtcgtagaggtcttagtgtggttctgctccatccgggcagggaagaagattacgtctccttcctagaagtacggaagaccccagttgcgccttttccgcaccccatcactgtttccgacgccgaagccgccgccgctacagaaactgctcggaaagtagtaaaggcagaccgcgcaatccatgaccgcggccaaaaggcctttgttagttggctaaggagctacagcaaacatcaagcaagcagcattttccgcgtcgcgacctggactgggagggcctagggaaagcgtggggactactgaagctgccgaagatgcccgaattgaaaaatttcaagggagacaaaactcttggtgtccaaatggattgggatacgtacgcatacaaggataagcagcgcgaggaagcgtcgcttagagctcctacaagagatggcggaatctggccaacaacaaacaacgaacaagaagcgtccgaacgagactgtggcctggagcaacaatgctgagaacagaaacaagaaggccaaacggcgcgacatgaaacaggtgcggcaggagaggaagcggtgggagaagatgacggaggaagagaagaagaaggctctcgagacagagcagatgctcgagcaaattagggcaaaaaatgaagagcaaaggcggctgaaacgcgcagctgctaaagcggacaaggacgcagaggaaggtggagacgaggaa

SEQ ID NO: 36667 - DNA, 1502 bp, Aspergillus nidulans
atggtccatcttaaaaccctcgccggcagcgctgtctttgcctcgctggccaccgcggccgtcctcccccgtcaaagcgccagcctaaatgatctttttgtcgcggccggcaaatcctactttggcacttgctccgaccaggcgctgctgcagaactcgcagaacgaggccattgtggcgtcgcagttcggagtgatcaccccggagaacagcatgaaatgggacgcgcttgaacgtgggtctttccttcagagacggtagattttggcagggctgacggaaatgtgggaacagcgtctcaggggaactttggctggtctggagccgactaccttgtatgttccttggctgtcggggtcgattatttcggctcagccggtgctgaccaggtttaggtcgactacgcgacgcagcataacaagaaggttcgcggacatacgctcggtaggccagctcccacccgtctcaacgtcggggtcactgaccgatccagtctggcactcccagctcccctcttgggtctcgtccatcggcgatgcgaacacactcagatccgtcatgacgaaccacatcaatgaggtcgtcggccggtacaagggcaagatcatgcactgggtatgcctcaccagaacccattcccgccataaacaaagaaagaatgcatgagagagagatcgccttactgagatgagtgcaggacgtcgtcaacgagatcttcaacgaagatggcaccttccgcaacagcgtcttctacaacctcctgggcgaggactttgtgcggattgcgttcgagactgcgcgcgccgcggaccctgatgcgaagctgtacatcaacgactacaagtgagtcaccctgctgctgcttaggaccagctctgatagcggattagcctggactctgcgagctacgccaagacgcaggcgatggcgagctacgtgaagaagtggttggcggagggcgtgcctatcgatggaatcggtgagtggaccttggtctacagtatagcgcaactcgactgacgatcttccaggctcccaggcccactacaggtacgctcggcggtcgtctggctgaccaagtactaacgtatcgcagctcaagccactggtccagcactgaagccgcaggataagttttttccgcccttggatgcactgccgtcacactgacaaccccaaacagcgctgtcctctctcgctaacacgggcgtctccgaggttgccatcaccgagcttgatattgcgggcgcagcctcgtccgactacctgaacgtaagtagtccgatccactggccttccggctcgggctaacgagaatgccgtagttgctcaacgcctgcctcaacgagcagaaatgcgtgggcatcaccgtctggggagtgtccgacaaggactcgtggcgcgcgtccgacagccccttgctgtttgacggcaactaccagcccaaggatgcctataacgcaatcgtcaacgctctgtcttaggcattgtcctggatttgg

SEQ ID NO: 36668 - DNA, 1583 bp, Aspergillus nidulans
caacgctacccagagcgcttctctgaaaatgttcacaaacgtggaaaagctgcgaaggagttggtcaacgtattctttcacgagaatatcgagcgtgcgcgtgatcgcaacatgcggtgggtttttgctactgagcgccgtatttctctaaaaagaattttgctaactggagttataactgtacagttcggcggagctcgacaagatgatgcgcgaccccaacatttcacaagatgcaaaggtgaaggaggcggaaatggttggaaagaaagagtcgacattccttcgcttccttcggacaccagaaactcctgccaacttccaaaccatcaagattattggaaagggtgcttttggtgaagttaagctggtgcagaggaagtctgataacaagatctatgcgcttaagtcgctgatcaaatcagagatgtttaagaaagatcagctcgcccacgttcgtgctgaacgtgatattctagctgactcgaaggacaacccttggcttgtcaagctccatgcttcattccaggatcccgcatacctatacctcctgatggagttcttacctggaggtgatttgatgaccatgcttattaagtacgaaatattctctgaagatatcacacgcttctacatggcggaaattgtgatggcgattgaggcggttcacaagctgggtttccttcaccggtgagaataacaatcctggtctctcgtaccatatacagcgtgctaatatacttgtactatagagatattaaacctgacaacatccttctcgatcgtggcggtcacgtcaagctgaccgatttcggtctctcaactggaggcaagaaaactcacgacaactcatactatcagaacctgttgaagaattcaacatccaaggataagaaccgaaactctggatacttcaacgatgctatcaacttgacagtatcgaaccgtgggcagatcaacacctggagaaaatctcgcagggctatggcttactccactgtcggaacacctgactacattgcacccgaaatttttaatggtcaaggatacacctatctttgcgactggtggtccgtcggtgccatcatgtttgaatgtctcgtgggctggcctccattctgcgccgaggatacgaccgacacctatcgcaagattgtgaactggagggaatgcctatatttccccgaagaattgacactgtctcgtgaatcggagggtctgattcgaaggtatgttatgtcagcaatccatttgagctgcttgtctaaccggagatcagcttcctatgtgacgcagaacaccgcatcggcaacgaaggtggccaatacggaggtgctacacagatcaaaaatcacccattcttccgcggggtagtatgggatcaactgcgcaaaatccgggcaccgttcgaacccagactgacgtcaaatatcgacgtatcatatttcccgattgacgagattcctcaggaggataccagcgccattcaccgcgcccaggcacgtgccatgccggatgagcagaatgctgagatgagcctgccttttatcggatacacatacaaagcattcaacgccttccag

SEQ ID NO: 36669 - DNA, 1364 bp, Aspergillus nidulans
gccttgctgtcctgtatccacggccgcccagatattcaagcatgagagtgtctctgccgtcgcatacaggataagtacttagatatataagcaaagatataccaagggcttgattgcgcgcgtccacaccgtcgtgcttgccacaatggtgtttgatactctcaatgctccccagccgtatcaagagcattatccaccccggtggaacgtacaccactcgtcctccccgcttccaaatggacactctatcattccaaatggacactctatcattccaaatggtaaaactgccgtagcagtgaccaatggagcagataaccaacatcagcataaaggcaaggaggaagaaatcatctccgcacctgtgcactatatctcgaccctcccaggcaaagacattcgcggtaaactcatctcggccttcaacgagtggttccaaatcccagatgagcagttggagatcatcaagcgagcggttgggctacttcacgtggcttcattgctgtaggctctttcaccctcacccaccaaaccatccagttcagacagattgacaatttgtgtacgcgcagaatcgacgatatcgaagactactccaaactccgccggggcttccctgtcgcacacagcatcttcggcattccgcagacaatcaactctgctaactacgcctacttccaagcacagaacgaggtgctgaaattgcgcagatgcgagaaagccttacgtatctttacagaggagcttctgcggctgcacagaggccagggaatggatctctactggagggattccctcacctgccccagtgaagaggagtacctggacatggtggcaaacaagacgggcgggctttttcggctcgccattaagcttattcagttggaaagtgacgttgatgagttcgtgcgcctcttgagtttcttccattattttagacaagagctgaacagacttgattacggcgcagggactgcgtccccctagtggacctgctaggtataatcttccagatccgagacgactaccagaatctgcagagcgaccagtatgccaaaaacaagggatttggcgaggacatcacagagggcaagttctcgtacccgattgtccatagtattcgaagtagcagtcgtactggtgtcgggagcgacagcagtctgcaactgctgagcattttgcgccagaagacggaggacgaagccgtcaagaaatatactattcagatccttgagaagacaggcagttttgagtttacgaggcagaagttgagggatttgacagcgagggctagggatatgcttactgaactgagggagaggtcgggggctggagcgggggctgcggggttgcttggcatattg

SEQ ID NO: 36670 - DNA, 1431 bp, Aspergillus nidulans
tctccttccaccacaaccagctccaggagcttctccaacccatcgacgacgccagatcagaagagaatcaagatgcagcggaaacaatcgtctccattggctccggcctttatggtgtccgccccgggaaaggttattgtgtacggcgagcatgccgtcgtgcacggcaaggccgcaatggccgcagccatctctctccgctcatatctccttgtcaccactctcagcaagtcgcagcgcacgatcactctgaatttccgcgatacaaacttgaatcacacttgggatatcgatcaattgccctgggatcttttccaccacccgtcaaagaagaagtattactacgacctcgtcaccactcttgatcaggagctctacgatgcgattcagccccacgtcgaagatatttccccagatgcccccgaggagatgcgcaaaatccacaagcgatccgcgagcgcgtttctctaccttttcctttcactaggctctccacagagcgcgggcgccatctacaccctgcgatctacaattccgatcggtgctggtttagggagcagtgcgagtgtctgcgtatgcatgagcgctgcgctacttgtccagatccgaacccttgccggtcctcaccccgatcaacccccagatgaagcagaggtccagattgagcggatcaatcgctgggcctttgtcggtgagatgtgcattcacggaaaccccagcggggtagacaacacggtgtccgcgggcggaaaagccgtgattttcagacggggagattattccaagccgccctccgtcacctccctgcccaccttcccggaactcccgctgctccttgtcgacacgcgacagggccgctccactgccgttgaagtcgctaaagtgggagctttgcgaaaagaatggccagtggtaaccgaatcgatccttgatgcgattgacaatgtaaccgcatccgccgagaaagttatccgagaacctaaccctgagggcttgtctgagaaaactcttcagcaattaggcaccctgatccggatcaaccatggctttcttgtctctcttggcgtatcccatccgcgactagaacgaatccgcgagctcgtggattacgccgacattggctggacgaagttgaccggcgctggcggtggtggctgtgcgattaccttgttgcgccctgacctaaatgatgattctctccgccaacttaagagtcaacttcaggacgagaactttggcatatacgagactacccttggcggtgacggagtgggcgtgctttggcctgctgtcctccgcaacggaaccgacgaagaaggcggcgaggagattgaccagcaaaagtttgaaaatgccgtcggcaccgagggtattgagcgtcttgttggcgttggtgtccaggagaaacgcgagggctggaagttctggaag

SEQ ID NO: 36671 - DNA, 1374 bp, Aspergillus nidulans
atcgaaatcattttctccaagcccttaaccctgaagaacatgcttgcaatgtcagagaagatccgcgagcagtttagggcgggtctagaatctagccccatcaatatgttgccttcttataaccatgctctacctactggactcgagcaagggacatttctcgcccttgacgttggcggctcaacgatgcgagtggctctgattgaactttgcgggcaaggaaaaatggaagtccttcgtgtatcctcgtcactgattgacaatgatgtcaaattgctagaggggacttcattctttgactggatggccgagaagattgaagagatgctacgcgaggtgggcaccaactacggacgtgaagaagctccattatccatgggattgtcatggtctttcccaatcgagcagacttcgatcagcagtggactggtgatccatatgggtaaagggtttcggtgctctatgggaaccgttgggcaggaattagggtccctcatcgtccaatcgtgtcagaaacgcggtctcaatgtccgcgtggacgcgattgtgaacgacagctctgccgcattgctttcgcgagcctacgtcgaccccacaacccgtatgtctctcattcttgggaccgggacgaatgtggccatacatttccccgttcacgctattgggctcggaaagtttggcaagaggccacaaggctggttcgactacgctaagcatgtcatcatcaacagcgagatgagcatgtttgggggtggagttctgccaatgacacggtgggacgacatactcaaccgcacccacctcaggccagactaccagccactggagtacatggccacggggcgctacctcggcgagattgtccgactcatcattgttgacgcagttgagactgcccaactgttcggcggagaactgcctcattcaatgcgggatgcgtattcattagatactagcatcgttgcctttatcgaagccgacacatcgcccttcctaacagcatcagccgcacttctccagaaagaacacacaatgtctaggccgccatccccggaggacctacggtttctcctgcgagtatgccgaaccatctccaaacgagcagctgggtatctcgccactgctatccacagcatgtggtgcctgcgaaatgaagccgaaatctcccaggggcctccgtcgccttctttcaaggggcctcgggacgttaccgtcacggagagcgggagcaactctgactgcctgtccattgcatgcgacggcagcgtcatcaataaatatcccggtttcagagatcgctgccaagcgtatctggaccaattgacgcaggagacaaatacgtccaaggtatcccagatttcagaggaaggctca

SEQ ID NO: 36672 - DNA, 2646 bp, Aspergillus nidulans
ggactatacgaaacgttgggggtggatcctgagcctggttccggaatgccgttggactgggtggaaggatgtgccatttgtgttgctatagtgattgtggtcatggtcggctcgctcaacgattaccagaaggagagggcgttcgtcaagctcaacaaaaagaaagaggatcgcgaagtcacggttatacgatcaggaaaggcagtcagattatccgtacacgaggtgttggtcggcgatattttacatttggaacctggagacttggttcctgtggatggaatattcatcgacgggcacaacgttaagtgcgacgagtcttcagctactggcgagtcagaccagctcaagaagacaggtggggagcaagtgatgcgattactggagcaaggacataccaaacaacaggatatggacccgtttattatctccggtagcaaagtcctcgaaggtgtcgggacttgtctcgtcacatctgtcggggtgaattcgagctatggcaaaatccttatggcaatgcgtcaagatatggagccgaccccgttgcagaaaaagctggatcggcttgcgagcgcgattgcaaagctaggagcaagctctgccatctttcttttcctgatccttctcttccgctttcttggaggattgtccggcaacgatcgtagcggtacggaaaaggcatcccaggttactgatattctcatcgttgccattacggtaattgtcgttgctgtccctgaaggcctgccattggcagtcactcttgcgctagcattcgccacgacgaggatggtgaaactcaacaaccttgttcgcgtgctaaaatcctgtgagacaatgggcaacgcaacgacagtgtgttctgacaaaactggtaccttgacaacaaacaaaatgacagtggtgaccggcacattcggagacgaggacttcgacgacaagaaccagaccggaaaaacacgccggtcagctgcatttgccagttcgcttagcccacaacagaaatgcatgatcatcgagtcagtcgcgatcaactctactgcatttgagggcgaggagaacggggttccaggatttgttggctcaaagactgagacagctttgctagggtttgcccgcaatgtcctaggtatgggcccactagctgaagtacgagccaacgcgacagtcgtgcagttaatgccttttgactctggaaggaaatgcatgggcgctgttatcaggttgtcagataacaagtacaggttcctcgtcaaaggtgcctcggaaattctcctgagatacagctcgtttgtttggaggccgagcggtccggttgacttggtgtcgagtgagcgggaacgcctcgaacaagtgatccttgactacgcgaagcagtcacttcgcactattgctctggtctcccgggagttttcagaatggccaccgagacatgcggttgaccctgatgatccatctcaggctgatctcggtctgcttttgcaggacatgtccttcattggcgttgttggtatccaggatcccatccggcctggagttccggaagctgtcgccaagtgtcatcatgctggtgtcgctgttaggatggtgacaggtgataatatggttaccgcaaaagccattgcaactgactgtggcatctacactggaggaattgtcatggagggtccgcactttcgtacgctgtctgatgccgagttcgatgaggtcctcccgcagttgcaggtattggcccgttcctccccagaggacaagagaatccttgtcaccaaattaagggctttaggtgaaatcgttgcagtgacaggagatggaacgaacgacggtcctgcgctcaaagctgccaacatcggattttccatgggtatcgcagggacggaggtggctaaggaggcttcagctattgtgcttatggacgacaacttctccagtattctcacggctttgatgtggggacgtgccgtaaatgatgccgtgcgcaagtttctccagtttcaaatcactgtcaacattacggccgtgcttttaaccttcatctcctctgtggcggacagtgagatgcggtcggttctgaccgcggtgcaactcctttggatcaaccttattatgtaagtctcttcggtattccttataacaagtattattaacccgatcagggactctctcgccgctcttgcgttggcgacggatccgcccacagaggagattctcaatcgtaagcccatcaaaggtggcgccccgctaatttcaatcacaatgtggaagatgatcattgggcaatccatcttccagctcattgtaacacttactctgcactttgggcctcgccaaaacttcctcgactattccgatgacgtccgccgctcaatcgtcttcaacacctttgtgtggatgcagatcttcaacgagtttaacaaccgtcgccttgacaacaggttcaatatttttaccggcctgcaccggaactggttttttatcgggatcaactgtatcatggttggttgtcagatagtgattgccttttatggtggtgcggcattcagcattgttcaaatccatgatgaacaatgggctatctgcattcttgtggctgccatttcgctgccgtgggctgtcgttgttaggctcttcccggatgcttggttc

SEQ ID NO: 36673 - DNA, 1484 bp, Aspergillus nidulans
cgccaggaacagggaatgagcctctggcagggtctccgtctttatcccaaggccgttgcctggtccgttctgttatcctcgaccctgatcatggaaggctacgatctcgccctgctcggttccctgtacgcgtccccggcattcaaccaaaggtacggtgtccaggccgccaatggcgattggggcgtccctgcctcctggcaatcggcgctatccaacggtgctcgcgtcggcgaggtgatcggtctgatcatcagcggtttcgtctctgagcgcctcggctatcggtggacgatgatatacgccctcatcgccatgaatgctgtcatcttcctcttcttcttcgccgtcaacgtccaaatgcttctctccgcagagatcctggccggtataccttggggcatctttcagacccttccagctgcctacgcaagcgaggtttgccccgtcgtcctccgcccctaccttaccacctacatcaatatgtgctgggtcatgggccaatttatcgccgccggcgtcaatcgcggctcctttcagcgcatggaccaatggtcctaccgcgtccctttcgctgtgcaatgggcctggcccctccccatccttaccggcatcctcttcgctccagagtccccctggtggcacgtccgtcgcggcgatatcgcgagggcgaagcacgccctgcaacgcctcacctctccgcaagatgcctccttcgacgcggacgctacaatcgccatgattcagcacaccaacgaactcgaaaaatccctgtctgccggtacaagctacctcgactgcttccgcggcgttaaccgccgccgcaccgagatcgtctgtggcatttgcatcgggcagacactcagcggccagaacataatgggctacttcgcatacttctgcgtgcaggctggcctacccgagatccattccttcaacctctcgcttggccagtaggcccttggtgtcctgggcaccatcggctcttggttcatgaggtccgagatgggccgccgcacaatcccacctcctgggcttgtcgttgctcttcactctcctcattatcaggggcagtctttcctttgcgccggactccaacaacgcccgcgaaatgggcaatcggggccatgctcatggttttcacattagtctacgatatcagcatcgggcccgtgacatattccctcgtctcggagctctcgtcgacgcgtctaaaggcgaaaaccatcaacctggcccgcgcagggtacaatatcagcaacatagtcgtcaacgtgctgacgaactaccagctcaacgactctgcttgggcctggggcgcgcgctcagcgtacttctgggccggcacctgccttctttgtctgtgctggtcagcgatgcgtgtcccggagccaaagggccgcacgtatgaagagctggatctcctgtttgagcagagagttccggcatggaggttcaagaagactgcggtagatccgtaccag

SEQ ID NO: 36674 - DNA, 1732 bp, Aspergillus nidulans
caggtctacccggcatctttcaaagactctaatggcgatggatggggcgatattcctggggtcattgaaaaagtgccctacttacattcactcggcgtggacgtcgtctggctctcgcccatgtacgattcgccgatgctcgacatgggttacgacgtctccgactacgagaatgttctaccagcgtatggcacggtcgtagatgttgagaagctggtagaggaatgccacaagtatgggatgagactcatacttgaccttgtgatcaaccacaccagcgaccagcacaagtggtttctggaaagccgcagcagcaaggacaaccctaaacgcgactggtatttctgcggccgccacggtacgataaacagggcaatcggatgcctccgagcaactatcagggggtattctgcagggagtacatgttcgttcactctttccgactgctggacacgcgctgattcgcacagggacgtgggatgagcacacgcaggagtattacctccatctatacgctaaagaacaacctgacctcaactgggataatctagaaacccgcaaggcgatctatgacagcgctgtccggttctggctcgaccgcggcgtcgacggcttccgggtcgacactgtaaacaagtacagcaagtatactgactttccggacgccccgatcacagacccaaagagctacatccagccagccatcggtatgtggtgcaacggtccccgcatccacgagttcattcgtgagatgtacgatgaagctctcgagccctacggagacgtcgtcaccgtcggcgagctcgccaataccccggatccggctcacgtcttgagatacgtgggcgcttcagccaagcaactaagcatggtatttcacctcgacatcggacacatcggcatgggtagcctggaggacaaatacgtcctgcagccatggaagctgacggaaatgaagtccattgtggccaaatggcagaccttcattgaaggcaccgacggctggaccacagctttctgcgagaaccatgataacggccggtccgtttcgcggtttgcgtccgacgcgccagaacaccgcgagcgttcggccaagatgctcgcgctgatgatggtcgccatgaccggcacgctcttcctctaccaggggcaggagatcggcatgatcaacgcgccccgtgactggccgatcgacgagtacaaggacatcgagggtctggggtactaccgcgaggcgcaggctcaggtcgccagcggtgttgacccaatgcgggaagagcgtatcatggacgggttgcgcgttcttgcgcgcgatcattcgcggctcccaatgcagtgggatgattctcctgaagcgggctttaccactggggtgccgtggatgcgcacgcatgatctgtaccgggaaattaatgtgaagaagcaagagggagatccagacagcgtgctgtccttctggaagaaggtgctgcttctgcggaagagataccgtcatctgttcatccacggggcgtttgaggttctcgatttcgacaacctggacacattttgttttatcaagtccagaggagaggagcgggcgctcgtggtgctgaacttttcggcgggggagcagccctttacacaggcagagatggcagccgacatggaattgctggtggggaattatgctgaagctgaattgtgtgagaagctgaggccatatgaaggacgaatatatatcagaagtgaa

SEQ ID NO: 36675 - DNA, 372 bp, Aspergillus nidulans
ctcgccagtcttaaggtaaacgctcggcggtgcgtgcgccagtttcctgacttcccgtcccccggcatcctcttcgaagatatccttcccatcttctccgatcactccacccacgaagccctcgttcgctgccttgagctccacatcctagaaactcttgcggatgagaagcccgatgttatcgtcgcctagaggcccgaggattcctcatgggccctagcctcgctctaaaactcggcgccggttttgtccctgttcgcaagcggggcaagcttccgggtccatgcgagacgcagggctacgagaaggaatatggtcaggacttcttccagatgcagtccgatgctatcaagcctggccagaaggtgatcg

SEQ ID NO: 36676 - DNA, 997 bp, Aspergillus nidulans
gcgaccctgcgtgaaatcgaaggccgtctcaagtccatcaagaacatcaagaagatcaccaataccatgaaggtcattgcctctacccgtttgacccgcgcccagaaggccatggacgactcccgtgcctacggtcagacctccaacaccctcttcgaacaggctgagaccaaggcccttgaggacaagaagaccctgctcgtggttgctagctccgacaagggtctctgcggtggtattcactccggtcttagcaaggccgctcgccgcgctctcgaggccaaccccaactctgaccttgtggttctcggcgagaaggccaaggcccaactttctcgtaccaaccccaacgccatcgtcctcagctttgccaacgtctgcaaggatatccccaccttcgctgacgcccaggctgttgccgaccaaattgctctgctccctaccgactatgccagcgttaaggtcatctacaacaagttcgtcaacgctcagagctacgagcccgatactgtcgaggcttactctgaggaggccatcactcagtcccgttagttccggtttccattccagaagctcttcagtactgattgttgtagccaacttctctgcgtacgaggctgatgaggaaacactctccaacctccgcgagtacgctcttgctaacagcctgttctgggctatggctgaaggccacgcctgtgaaatctcggtaagtttgtgtttacgatacgtttagccaataatactaattcaataacaggctcgtcgcaatgctatggaggcaagtattctcgaagaacgtgtggtggagatataattaaactaacccttttccagaacgcctccaagaacgctggtgaaatgattgacaagtgagtatcagcaaaattctgcggccgtaacagtgttctaattccattgcaggttccagattctgtacaaccgtcagcgtcaagccgccattaccggtgaattggtcgagattattcaccgtgcc

SEQ ID NO: 36677 - DNA, 1804 bp, Aspergillus nidulans
tcagaccacaccgcggagcctaggccacgacttcgcgatgatcggcacggtaccagatgcgcgggagaagttgtcgccgcgagaaacgatgtctgtggcgtgggtgttgcctatgacagtcggattgctggaatccgaatcttgtccggacctattgacgacaccgacgaggctagcgccatcaactatgcttatcaggaaaacgatatttactcgtgctcttggggtcctcctgacgacggcgctacgatggatgctcccggtatcctcgtcagtcgggcaattgtcaatggtgtccagaagggtcgtgatggaaaaggttcgatttttgtctttgcagctggcaatggggcagcttctggtgacaactgcaactttgacggctataccaatagcatttacagcatcacagtgggagcgattgaccgagagggacagcatccccaatattcagagtcctgctccgcccagcttgtggttgcttacagtagtggaatttcggatgcaatctccaccactgatgttggtacagaccggtgctactccgtccacgggggtacatctgccgctggccgttggttggaggcgccatatctcttgctttgagtgttcgtcccgaactcacgtggcgcgacgcccagtacattgtactcgagactgcagttccagtccacgaggatgatggaagctggcaagtcaccaagtccggaagaaaattcagccacgattggggatatggcaaaatcgatgtatatagtctcgtgcaaaaagccaagacctgggagctggtgaaaccgcaagcgtggtatcactcaccgtggttgagagtacagcacgaggttccgcagggcgacaaaggtgtcgctgcgtcctgggaagtgaccgagcagatgatgaaagatgccaatctcgagaaactcgagcacgtcaccgtgaccatgaacgtgaatcacacacgccgtggtgatttgagcgtggaactgcgcagccctgaaggcatagtcagccacctcagcacaccaagaaagaatgataacgcagaggtcggatacattgactggacgttcatgacagttgctcactggtatgtaccttctcacacgcagcacctaattctcattaactcataaccaggggtgaatctggcgttggcacatggaccgttattgttaaagactctactgtcaatgacaacgtcggagaattcatcgattggcgactcaatctctggggtatggccgttgatggtgccaagcaaaagttgcaccctctaccggacgaacatgacgatgatcatagcattgaggatgctattgttgttaccactagcgttcagccagcacccaccgccacagaagctccagttaaaccctcacataccgttgatcgtcctgtgaaggtcgagcttacttggacaggctctgcttccgaaactgaaaccccaacgcccaccccgaccccggcctcggacagcttccttccctctttcttcccaacctttggtgcctccaagcacacgcaagtctggatctacgctgcgattagttcgatcatcgtcttctgcattgggcttggaatttacttccacgtccagcgacgtagacgtcttcgcaacgaccgtgacgattacgacttcgaaatgatcgaggacgaggatgaggcgaaggccatgaatgggtcgtcccgtcgccgtggtggtgaactctacaacgccttcgctggagaaagcgaagaggaacccctattcagtgatgaggatgatgataaaccgtaccgagaccagacgacaggtgctgagctgagg

SEQ ID NO: 36678 - DNA, 961 bp, Aspergillus nidulans
caggtgattagagagccgtatgactacatcgctgggatcccaggcaaagagatccgccgaaagctcttggaggccttcaaccactggtacaaagttgacgaacagtcgtgccaggctattgcaaccactgttggtatggcacacaatgcatccctgctgtatgttgcatccagtctctggctcaatcgcgttttcacgagctaataagcactccacagcatcgacgatattcaagacagttccaagctccgaagaggtgttccatgcgcacatgaagtgtttggcatcgcccagaccattaactccgccaactatgtctactttctggcgcaaaaccagctgtttagactgcggacgtggccccaggcaatttcggtattcaacgaagaaatggtcaatttgcaccgcggtcaaggcatggagctattctggcgggataacctgctgcctccgtccatggatgactatctgcagatgatcgctaacaagacaggtggactgtttcggatgatagtgcggctgctccagacaagcagcagacaggtcattgacgtcgagcagttggtggatgttcttgggctttactttcagatcctcgacgactacaagaatatcagagaagagaaggttcgtcttcgtcgaaccagatcgagaactaaagaagactgactacttcgcactagatggccgcccagaaagggttcttcgaagacctgacggagggcaaattctcgttccccatttgccatgcaatcggagaaggggccaagaacagaactgctctgctccatatgttgaggctcaaaacggatgacatgaagatcaagcaagaagcagtctgcatactggacaatgctggcagtttagattacacgcgagaggtgctttacgggctggacaggaaggctcgcagtctgcttcgggagttcaagactccgaaccctttcatggaggctctttt

SEQ ID NO: 36679 - DNA, 932 bp, Aspergillus nidulans
atcgacctggacgagtgcattgagaggctgtatagaaaggagctgctggcggactctgtgattgaagccatatgcgccaaggcgaaagaactgttgatgaaggagagcaatgtggttcacatcgcggcccccgttacggtagtaggagacattcacgggcaatttttcgacatgattgagatttttaagattggcggattctgcccaaatacgaactacctgttccttggttcgttccagcatacctagaatgcggacttctctaaccagttctgtcttactatacaggcgactacgttgaccgcggcctcttcagcgtcgagaccatctctctactcgtctgcctcaaacttcgttacccgtcgcgcgtgcaccttatccgtgggaaccacgagtcacgcggcgtcacccaatcttacggtttctacaccgagtgcgcccgcaagtacggtaatgccaacgtctggcactactttacagacatgttcgacttcctcaccctcgctgtcgtcattaatgaccagatcttttgcgtccacgggggcctttccccctccattcactcaatagaccagatcaaaatcatcgaccgcttccgcgagatcccgcacgagggacccatggctgaccttgtttggtcggaccccgatacggagcgcgacgagttttccctctcgccgcgcggtgcgggatatacctttggagcgcaggtcgttcggaaattcctcgaggttaatagtatgtctcatatcctgcgcgctcatcaattgtgccaggaggggtaccaggttctttatgatgatcggttgagtacggtttggagcgcgccgaattactgctaccggtgtggaaaccttgcgagtgtgctcgaagttagtgatactggagagaggtttttcaatatctttgatgcagcacctgagaatgatatc

SEQ ID NO: 36680 - DNA, 588 bp, Aspergillus nidulans
tccctcggcctaaacaccggcgagcccaccggagaccccaacgacccccgaacatgtatcatcaaaaccctagcgcttgaagttcaaggccgtccggatgttgttatcgatgtctctgccccgggcgcgctcgagaagctgaaggacaagcccttcactatcaaggagggcgcccacttccgcattaaggtgacctttgaggtccaccacgatgttctgagcggcctcaagtacctccaggttgtcaagcgcaagggtatccgggttagcaaggatcaggagatgcttgtaagtttgggagaatagcgaaggccatgtcaggacaggtttatagaatgtgctaactggtattagggaagttatgcgccatgcactacaggaaagccaatttacgagaagaagtgtaagtcttttctttctcctatggagcgcctccaatactgactcttgcatctttcagtccaagaagaggaggccccctcggggatgatggctcgcggccactacaacgcggaatcgaagtttatcgacgacgatgacaaagtgcatctccacttccactggtccttcgacattgcgaaggactgg

SEQ ID NO: 36681 - DNA, 1400 bp, Aspergillus nidulans
catgttggaaactatacactgggcagattaataggaaaaggttccttcggcaaagtctatctcgcctcgcataaacttaccaaccactcaaaggtacctgcagagctatccaccaagccgtcacggtttatgctgatcatgtttaggtcgtgctgaagtcgtcggacaaggaggatacaaacctggcacgagagattcatcatcatcgtcaattccttcatccccatattgcgcgcctttacgaagtaatcgtgactgaaaagcttgtttggctggttctcgaatattgccctggtatgagctgccttgcgcgaccatatgcttgatgtactacaacagctaggtgatgaactgtataattatcttttgcggatatggccgttgcccattgacaaagtcaaaaagatatttactcagcttgttggggccgtgtcatacgttcacagcaagcagtgcgttcaccgtgacctaaagctagagaatatcttacttgacaagcacgagaatgtgaagctttgcgatttcggattcaccagggaatacgagggaaaagcaagctatcttcagactttctgcggcaccgtgtgctacagcgcccccgaaatgctcaaggccgagaaatacgctggcgaaaaggtggatgtctggagcttaggcattattctttatgcgcttattgcaggagagctcccttacgacgatgacgacgaccaggttaccaaagcgcggattttgaacgaagaaccgaaatttaatgacaaattccccgacgacgccaaggcgctcataaacctgctcctttctaagcggcctcttctccggcctagtttggacgaagttctcgcccacccattcctatccgagtatgctgctgaacagctagcaattctgaagcttcctcggccgccgcccttttcgacatctctagagaaaaccactctacatcgaatgaaaagcgcgggaatcaatattgacgatgttgtagatagtgtcatggctcagcgctgtgacgcgcttgccggttggtgggctcttctaatagagaaggagcagcggaaagaagcgaagagagaaagaaaacgacgagagcgggatgcagaagcaaagaatattcgccgtctaagcgcagcgagcagtcgcttggaaaaaatctcggctgcgctagttgaggtggacgaagagggctattcgaccgctcccttacatgaacgtggtcgaagggatcgccggagtctaccctcccagcttgccgtccctgaattaccaatgctcccggagccacctctacaatctcacaatctcaccacaccaccgcctcctcctccagtcgacaaagactcaattcgctcccacagctccacccgccgtctccctcccgcgccgccacccaaggatcgaag

SEQ ID NO: 36682 - DNA, 2147 bp, Aspergillus nidulans
cgtacacaccttcgaaccgattatgtgcgaccatgtccatcgttacgcatcctccctcgcgcgcggttaccctcactctcaacgaatattgccgcccctctatccagctctagcatcagaaactatgctagtggtcgaccgcaccctcccggtgggacgcatcggatgaatctgggcggcgagccggagaaggcagcattggaacagtatggcgtcgacttgacggccaaagccaaagccggcaagttggacccagtcatcggaagagactcagagattcatcggacaatccaagtgctatcgcggcggaccaagaacaatcctgtcctcatcggtgccgctggtactggaaaaaccgctgttttggaagggttggcgcaaagaatcgtgcaaggcgatgttccggagagcatcaaaggcaagcgcgtcattgctcttgaccttggatcacttattgctggagcaaaatttagaggtgactttgaagaacgattgaagtccgtcctcaaagaagttgaggaagctcaaggcggcgtcatcctgttcattgacgaacttcacactcttctcggacttgggaaagcagaaggaagtattgatgcgagcaatctgctgaagccagcactctcgcgtggcgaacttcaatgctgtggtgccaccaccttaaatgaataccgattgattgaaaaagacgttgctttggcaaggcggttccagcctattcaagtcggcgagccttctgtcgccgctactatctccattttacgtggtatcaaggacaaatacgaggtacaccatggtgtacgtattacggatggtgccttggttgctgctgcaacttatagcaaccggtacattaccgaccgattcctgcctgacaaggccatcgacctagtagacgaagccgcgtctgctttgcgtctgcagcaggagtctaagccagatatcatccgagagttggaccgtgatatcaccaccattcaaattgagctcgaatctcttcgcaaagaaacggacatcagcagtcgcgagagacgcgagaaacttgaagaagacctgaaagctaaacgggaggagtccagaaaattgacagaaatttgggaaaaggagaaggcggaaatcgagagtctcaaacgtactaaagaagagctagaacgcacccggtttgaactggagcaagcgcaaagagaaggaaactttgctaaggcaggagaactacgatactccaagatcccatcccttgaagcaaaactgccaaaggaaggagatgagcaaaaggatccacagtcaactcttatccatgactcggtcaccgctgatgacattggtgccgttgtttcacgaacaactggtatcccagtcagcaagctgatggctggagaagttgagaaactgatacacatggaagatacccttcggcagtctgttcgcggtcaggacgaagcgctgtcggctgtcgctaacgcagtccgtatgcaaagagcaggacttagtggcgaaaaccggccgctcgcgtctttcatgtttcttggtcctaccggtgttggtaagactgagctttgcaagaaaatggccgagttccgtttctcgacggagaccgccgttgtacgattcgacattagcgagtttcaagagaaacataccatcagccgcttaattggctctcctgctggatatgtcggctacgacgacgctggtcagctcactgaagctgtcagacggaagccgtatgccgttcttttgtttgacgaattcgagaaggctcatcgggatatctccgctctattgcttcaggttctagatgaaggcttcctcacagacgcgcagggtcacaaagtcgatttccggaatactcttattgttcttacgtctaaccttggcgccgaccttcttattggcgctgatcccattcattcgtccaaggcctcgactgatggggaaatcactccggagcttaaaaaggccgtcatggatgtcgttcagcaagcctatccgcctgagtttcttaaccgcatcgatgaattcattgttttcaagagactttcacgggaggctctgagggatattgttgatatcagaatcaaagagcttcagtcaagattggatgaccgcgtatgaccctccagttgacgatgagaacaagactg

SEQ ID NO: 36683 - DNA, 1637 bp, Aspergillus nidulans
atgctttctactctaaaagtcgccagccgccaggctgcctcgcgcaatgctagcgtgcgctccgtgtttgccggtgccagatgtgcttccacctggtccaatgttccccagggtcctcctgtaaggctttgacgcatcgagattcatcaaaacgatgcatttttttttctgacattgcggctcgtttaggacgctatccttggtatcaccgaggcctacaaggccgacagtttcaaggaaaagatcaacctgggtgttggtgcctaccgtaaggaaccccaatcgagctctaaaacgttctttttgtcagatcttcggcttgtcttgatagccgtgtctgccaacctgcaattataaacagtcgctgatctatgctcttttacaccaggtgacgaccagggtaagccctacgttctgccctccgtccgcgccgccgaggacaaggttgttgcatcgcgtttcgataaggaatatgctggaatcaccggtatcccctcgttcaccaaggctgccgcgcagctggcctacggagcggactctcccgttttgaaggaggaccgtctcgtgatcacccagtccatctctggtaccggtgctctgaggatcggcggcgctttccttcagcgtttctatcccggcgcaaagaagatctatctccctactcccagctgggccaaccacaacgctgtcttcaaggactcgggcttggaggttgagaagtaccgctactacaacaaggacaccatcggcctcgactttgagggtctcgtcgaggacctcaaggctgctcccaacaacagcatcatccttctccatgcttgcgctcacaaccccaccggtgtcgaccctacccaggaccagtggcgccagattagcaacgtaatgaaggagaagggccactttgccttcttcgacatggcttaccagggcttcgccagtggaaacgccgataccgacgcctttgcgcctcgacacttcgttgagcagggccacaacatcgctctgtgccaaagtttcgccaagaacatggtaggctcagttatctggttgcctcaaggcatgcgcgttaactcaatttgcagggactctacggtgagcgtgtcggtgctttctctctcgtctgcgaatccgccgaggagaagaagcgtgtcgactctcagatcaagatcctcattcgtcccttctactccaaccctcccgtgcacggtgctcgtgtcgcctcgactatcatgaatgaccctgcgcttaacaagcaatggctcggcgaggttaagggcatggctgaccgcatcattgagatgcgtgctcttctcaagaagaacctggaagagcttggcagcaagcacgactggacgcacatcaccagccaggtacgtagttctgtggaatcaaagaagcgcatcaatactaacattcacagatcggcatgtttgcttacactggtctcaagcccgagcagatggaggctcttgccaaggaggtacgcaccacgtcttaaccacaatgtctcatctgtctctaacgcataatagcactccgtctacgccaccaaggacggccgtatctcagtggctggtatcactacgggcaacgtcaagcgccttgccgaatccatctacaaggtgactggttaaatc

SEQ ID NO: 36684 - DNA, 902 bp, Aspergillus nidulans
gagcgtcccaaggttttcacaggcggagaccagggatgggtgaacctcaagctctctgacattgagattctgagccacaacaccaagaggctgcgcttcgaatttcccgacaaggaggctgtctccggtctccacatcgcctgtgagttctccgagcgcacgtattatggctagatgaacttacagcactatccagctgctcttttgaccaagtattctccccccgatggctcgaatccagatatccgccctacactcccactagcgatgaaggtacgctactgatacaccactcgtctggcgctggcgtcatttgctaactgaccattacagatcagcccggttacctcgagcttgttgtcaaacgctaccctaacggcccgatgtctgagcatctgcacaacatgaatgtcgaccagcgtctggacttcaagggacctcttcccaaatacccctgggaagccaacaagcataagcacatctgcttggtcgctggtggaactggaatcaccccaatgtaccagctagctcgcgagatcttcaagaaccccgaggacaagaccaaggtcactctcgtctttggaaacgtcagtgaggaagacatcctcctgaagagggagttcgaggacttggagaacacatacccccagcgattccgcgcattctacgttcttgacaaccctcccgagggctggaccggcggcaagggctacatcaccaaggagcttctgaagactgtcctccccgagccgaaggaggagaacatcaagatttttgtctgcggtcctcctggcatgtacaaggccatcagcgggcccaaggtcagccctaaggaccagggcgagcttaccggtatcctgaaggagctgggttacagcaaggaccaggtctacaagttctga

SEQ ID NO: 36685 - DNA, 506 bp, Aspergillus nidulans
gctcagacaacaaaaaacagtgtggtgatcaaggtcgggatggtcggagatgcacagattgggaaaacgagtttgatggtcaaatatgttgaggggagctgggacgaggattatattcagactctgggtgagttttgcggcctcttcgttgccggtggttgctgattgctccaggcgtgaattttatggaaaaaacaatttcgatccggaatacggagatcactttctccatctgggatttgggaggccagcgagagttcgtcaacatgctcccgctcgtgtgtaacgatgcggtcgctatacttttcatgttcgacctcacccgcaagagcactctaaattccatcaaggaatggtaccgacaaggccgtggctttaacaaaactgccatccccttcctcgtaggtaccaagtacgaccacttcgtcaactttcctcgggaagatcaggaggagatttcgattcaggtatgtgcagccgccgccgctggctcttctcggctctga

SEQ ID NO: 36686 - DNA, 1047 bp, Aspergillus nidulans
tccgctttaggtccctctgaatgtcgcagtacgcttctcgtcttccaggaatggagcattgtattcggcattgtgatttcgtattggaccagttttggcacacgatacatggccggtgaatggtcctggcgtctccccttcctcctccaaattatgcccctattcaacctagctgccgggataatggtcctctcattctcgcctcgctggcttgcctccaagggccggaacaaggaagcactgcagagtttcagcaggctgcgcaggttgcccataaccgacaggcgcgtccgccaggagtacatggacagccaagccgaactgagttttcaccaccagatcaacgcagaaagactccctgacctacaaggagggagaataaagaacgcaatcctgcgcgaaatggcttcttgggagactgctttcgaaaacgaacctggcgccgcatccacattgccattatgattcctttcttccagcagttttccgggatcaatgcgctgatttattactcgccgacttttgagacaatgggatttgacttaagcatccagctgatcatgtctggggtcctgaactctttacagcttgtcgggtgcacgagcacagtatggacgatggataccctgggccgacgtaaacttctgttcgccggctcggtcagcgaaaccatctcacacaatatcattgctgctttggtcggcaggtacagctccaactgggcgtcgcatcagaccgcgggctgggtcagcgcggctttcttgttggtgtatatggttgcctttggcgccgcctggggaccggtgggcttggcgataccctccggtatgctaacatgtgctatcctccaacttgtctattcacatctgatccgtagattcattagagatcttcccttcttctctccgcgccaagggcgtcgccatcgccacgtgctcaaactggctgaacaacttcatcatcgggcttatcacgctgccgctcatcgagaggacgggatacggcacctacgtcttcttcgccgtcttctgtggcataatggattca

SEQ ID NO: 36687 - DNA, 1175 bp, Aspergillus nidulans
ggtctcatccccggtgacggtatcggacgggaggtcatcccggtaagtcggatatgagtgcagacaagcggtgcaaacgagaccgatactgaactgctcacgtaggccggtagacggatcctggaagctcttccggcctccctgaacctgaaattcaactttgttgacctcgatgccggttacgactgcttcaagcggaccggtaccgctctgcccgacaagaccgtcgaggtcctgaagaaggagtgtgacggtgctctgtttggtgcagtcaggtgagctgcacgagcttgtatttgcttattggacagacctaaacttctcttggcagctctccctccaccaaggtcgccggctactcctcccccatcgtcgccctccgcaagaagctcgacctctttgcgaatgtccgccctgtcaagaccaccgccggcaccagcgccggcaagcccatcgacctcgtcatcgtccgcgagaacactgaggacctctacgtgaaggaagaaagcaccgaggagacccccaatggcaaggttgcccgcgccatcaagcagatctccgagcgcgcatcctcccgcatcgccaccattgctggtgaaatcgccctgcgccgccaaaacatccgcgatggagccgctgcctcgggcctccgcaccaagcccatggtcactatcactcacaagtccaacgtcctctcccagacggacggtctcttccgtgagactgcccgtgccgcccttgccgcgcagaagttctcctccgtcgaagttgaggagcagattgttgactccatggtctacaagctcttccgccagcctgagtactacgatgttattgttgcgcctaacctctacggtgacatcctgtctgacggtgctgctgccctggttggcagtctgggtctcgtgcctagcgccaacgtcggtgacaactttgccattggtgagccctgccacggtagtgcgcccgatatcgagggcaagaacattgccaatcccattgccactctgcgcagcgttgctctcatgcttgagttcttgggcgaggagcaggccgccgctaaaatctacgctgctgttgacggcaaccttgatgagggcaagtacctgtctcccgacatgggtggcaaggctaccaccaccgaggttttggaagatgtgctcaagagactgtaa

SEQ ID NO: 36688 - DNA, 633 bp, Aspergillus nidulans
accggtagatgctaatctacgtagccggtcttcggggtccttggatgcaccagcgccatcgtgttcacgacctttggagcagcctatgggacggctaaggccggcgtcggcgtctgctcgtcgggggtcctgcgacctgaactgatcgtcaaacgtcctctacccctgccctctggctgaccatatcagatatctataagctaatacgttccagatatcgtgcctgtcgttatggccggaatcctcgcatctacggtctggtggtctcggtccagattgccaacaatcttgcccaagaggtcgctctctatacgagtctgctccagctgggtgctggtctggcggtagggctttgcgggctggctgcagggtaattaaggtcgagtctttcctgggtgatcgtgtctaatggatgttaggcttgcgattggaattgtcagtgatgcaggcgtcagaggagcagcccagcagccgagactctacgtgggcatgatcctcgttttgatctttgctgaggttttaggtaagtaaattcagttgcatcaatacgaggagggctgataaagctgccgtggcatggcaggcttgtacggcttgattgtcgctcttctgatgaacgccagggctggggtt

SEQ ID NO: 36689 - DNA, 797 bp, Aspergillus nidulans
ttctccttgaaaggccgaacggcgctggttacaggtggtgggcgaggatgcgggcttgcgtttgcgcgggggctcgctgaagccggtgcagacgtggcagtcttcgacatcatcgatccacggccagagtttcacgcgattgagaaggactataatgttcggacggcgtattacaagtgagaactcccgtctccgcggaaccatttgtacgaagctaacgacgcagggtcgacgtctcctctcaggattccttgaaagacggctttgcgcagttccaacaagacttcgacggcaagctggacatttgcgttccctgcgcagggataaaccgccatacctgcttccttggttttacctacgaagaacaccacgatctgctgtcgatcaacgtgttgggactctactttaccgctcaatatgcagcgaagcagatgatagccaacggcacgcatcacggcagcattatcctggtcgccagcatggccagttacgtcgcagtgcgcgaccagaactgctcggcgtactgtggcacaaagggtgcagtgcgcgcaatgtgtcctgctatcgccaaagagttgacggagtatgggatcagggtcaactcaatcagtccggggtacgtgaatacggagatgacagcggcgttttcgcatttggtggaagggtggaaggcggagacgatcaacaagaggatcgcggagcccgaggatatcatgggtgcttgtgtgttcttggcgagcgatgccagtagttatatgacggggcaggatatcgtcgttgatgggggagtgactaga

SEQ ID NO: 36690 - DNA, 1755 bp, Aspergillus nidulans
aagaccactcttcttgtggcacccctcagcaccgttaacaattgggtttcgcaagtcaaagaacatctgcgagatggcgcacttacgtcgtatgttttccatggttcatctcgaactacgagcgtggatgaattgtctaaatatgatttggtgatcacgacgtatagtatcgttctaagtgagctttctggccgcggctcgaggcgagcagggtcaagcccgctgaccaaaatgaacatgtttcgcattgttttagatgaggcccatacgattcgggagcaaagcgcggcccaaacgcaggcaatttttcggttgaatgcgcagcgtcgttggtcagtaactggcacgccaattcagaaccggttagatgatttgctttcggtcaccaaattcctaggaatctatccgtatgatgataggagtcgattcaatatgcatattctaagccggttcaagacaggcgatgcaactgttctcgcaagtctgcgcgtcttggtagactcatttacgctccgccgagtcaaggataagatcgatctgccagcgcgacacgacaagattgtgatgcttgaattcagtgagtcagaggcacagctgcacgagttcttccgcaaggaatcaaacgtgatgatgcgggtgattgcaggagaagataagagcaaaatgaagggtcgcatgtaccaccacattttgaaggccatgatgattctccgtcagattagcgcacacggcaaggagcttctggatagtgatgaacgagcgcggattaagggcttaagcgtgcacgatgccatcgaccttgaagagggacctagcgctgacgctgtcgctactgacaagaaggcgtacgaaatgttcaccctaatgcaagaatcatcagccgatatgtgtgccatctgcagcaaacgtttggaggagccaaatccagacgcaaacggttcatccgttcctggaaaagttgacattatcgccttcatactgccttgttttgatgttctctgtccagaatgcttctccggtaggaagcaggtgttcaacaacagagtcggagaccaggattctttcgacgtcaaatgtgatgtttgcgaaggctggatttcagcatcgtactcggcgatcacggccgccggtctacaggattacttgatggaacaagcgcgagaaaaacaaactcgaaagcaagccaaagtcttaggcgagtacgaaggtccgcacactaaaaccaaagcactattatcgcatctcctcgcgacggcagaagagagcgcaaagctgcccgagggcgaagccccaattaagagcgttgtcttttctgcctggacctctcatctcgacctaattgaaattgcgctccgagaccagggattaacgggatacacccggctcgacggaacaatgagcttaccagcgcgcaacaaagcgctcgataacttccgcgatgacaataataccactattctcctcgcgactatcggagctggaggggtgggcctcaacctcaccgccgcgtcgcacgtttacatcatggagccgcaatataacccggcggccgtggcgcaggcaatcgaccgcgtgcaccggctcggacagacgcgcgaggtcacgactgtgcaatttatcatgaaggacagcattgaggagaagatcgccgagctggcgaagaagaagcagcaattggctgatatgagtctgaatcggggaaagctggataaggccgaggttcaggaacagcgaatgagggaataccgcagtttg

SEQ ID NO: 36691 - DNA, 1209 bp, Aspergillus nidulans
gttggcgcctcgacgcgctcactgcatgcagacgatgtgctaaatgtcgtcactgatgttgcgcctcctattcatgttgcgaccaccttacgctattccgatgacccggccaagttgatgccggcggcagatctcaatggggtaagtatcccgaaaatcattccttttcagaggttaaccgcgcagaccctcgaggagcaatcgtcatatatctactcgcgtctcactgcgccaactactacccgattcgaagccattctttcgtctctcctcaacggccaaaccatcagttactcatcggggctgtcggcattccatgcggctctcacccttctaaaccctcgtaggatctcgatcggcaaaggatatcatggatgccacggtgtgattgacattttcaaccgtctgaatggacttcagaagctggatttggattgcccagccgaacagctggaggctggggatgtcatacacttggaaactccagtcaatcctgaggggacctctttcaatattgagcaatatgccaagaaagcacactctcgaggagcttatctgatagttgacggaacttttgccccgccgcctctgcaagacccgttcaaatttggtgctgacctggtgctgcactctggatccaaatactttggagggcacagcgatgtcttgtgcggagttctggccacgcagaacaaggactgggcgcagcaattgctcagagaccgcgttttccttggtggtgtcatgggcaatctggagggctggctcggcgtccggagtttgcggactctggaggttcgtgtgcaacggctgagccagaacgcaacgaatttggtcttgtggcttcacaacgcgctgcagactccaagccccgcacccggcagcgatgaagaggcgacgcagaaagtgctggagcaggttttccactccagccttcaaaaggacgacgagtcctggctcctgaagcagatgccgaacgggttcgggcctgtcttctcgatcaccatgagagaagaagactatgcgcgccacttgccaagcaagcttgccctgttccagcacgcgaccagtctgggtggcgtagagtcgttgattgaatggcggacaatgtcggacaagacggtggaccgacggttgctgcgagttagcattgggttggagaactgggaggatttgaagcgggatctggtgaatgcttttagagcactg

SEQ ID NO: 36692 - DNA, 1780 bp, Aspergillus nidulans
gtccttgcgacccaagcgattgcaaatgtagtcaagagctctttcggcccctcaggcctggacaagatgatggtcgacgagatcggtgtatgcttgttacggaccccgcaatctatggctatacctttaacgagtgctaggatgtcacggttacaaacgatggcgccactattttgagcctgttggatatcgagcatcctgctggcaaaattcttgtggatctagcccaacaacaggatagggaggtgcgtaccgtccataattaatgtatcaaagcacttgtgctgaatcttccaggtcggtgacggtaccacttccgtcgtcctcattgccgcagaactcctccgacgaggaaacgaattgatgaagaatcgcattcaccccacaactatcatcaacggatacagactagcgcttcgggaggctgtgaaatatatgaatgagaacatcgccacgaaggttgaccatttgggcaaggacagcttggttaacattgccaaaacgtccatgtctagcaagatcatcggggctgatgccgacttctttgcgaacttgtgcgtcgatgcaatgctgctggtcaagaccacaaaccagaagaacgaagtcaaataccccgtcaaggcagtcaatctgcttaaggcccatgggaagagtggaacagagtcagtccttgttaacggctatgctctcaactgcaccgttgcctcccaagccatgaagactaggataacagacgcgaagatagcctgccttgacatgaacctgcagaaggagagaatgaagctcggcgttcaaatcacagttgacgatcctgaccagctggaaaagatccgtgaaagggaatccggcattgttattgaacgtgtggagaagattctcaagtctggagccaacgttatcctcactaccaagggcattgatgacatggttctcaagctcttcgttgagaagggtgccatggctgtccggagatgcaagaaggaagacttaagacgtatcgcgaaggctactggagctacgttggtgagcacgctctccgatctgaacggcgatgagaaatttgaggcctcctacctgggtcacgcagatgaggttgttcaggagcggatatccgacgacgaatgcatcctcgtcaagggtaccaaggttcacacttcagcgtccatcatcctgcgaggccccaatgatttcagcttagatgaaatggagcgttcagtccacgactccctctgcgccgttaagcgaacattggaaagcggtagcattgttcccggaggcggtgctgtcgagacagctcttcacatgtaccttgaagagttcgccgtcacagtggtacgtaatatggcccccgccagttctcattcattctgacaaaaccctatagggctcccgcgagcaattggctattggcgaatttgctcaatccctccttatcgttcccaagactctagccgtcaacgcagcgaaagactcttccgagcttgtcgcacaactccgcaagagacacgccttgtctcagcgcgtccaggaaggcgaagctaatgagaaagagaaggccgtcgctaagaagaaggaataccgaaactatggtcttgacttgacaaagggccgtgtccacgactgcctcaaggctggtgtcttggagcctagcatgggtaagctcaagcagcttaagagtgcggttgaggcttgcattgccatcatgcgcattgacactatgatcaagctggaccccgaacgcaaggaagatgatggacatggccacgaccactaaagtaat

SEQ ID NO: 36693 - DNA, 826 bp, Aspergillus nidulans
gactcggccatcatgtacggcaatgagaaagcctgtgggcgcgcaattgctgcctcggggattgatcgctcacagatatttttcactaccaagattccgccagactcgatggggtataatgccacgaaacgggctatcgactcgagtctacggactgcagagcaggaatacttcgacctgtgggttgcgccgacctaactcaaagaatcccctcagctaataggcatgtagaatcctccttcacgccccttacggcggcaaagaagcccgacggggctcatggaaagcgcttgttgaggcccagagagccggaaagacaaagtcaattggtgtgtctaactatggtatccaccatctcgacgagcttgaagcatacatccagtccagtggcgatgacggtgtgagagaaagtaagattgatgttgggcagtatgagttacatccatggctcgatcggtcggaaattgtcgagtggttgcagaaaagaaatattattgtccaggcttattcaccgctagcgcatgggacgaggatgcgagagccattgttgaagaagttggggtacaagtatggaaaatcgccagcgcagattatgattcgatggggattgcagaaggttagtgtcctctgctctcgaattcgtttagctccatagaagactgtcttgatactgactgttccagggctttgttcctcttcccaagcagtcactcctagcgcatccaggaaataccgaggtgtcgactttgaattggacgaggaggatatgaagtccttgcatacaggggagtattcgccaacagactgggatcctactcttgattat

SEQ ID NO: 36694 - DNA, 732 bp, Aspergillus nidulans
ggtcaattcttcgatttactggaaatcttccggctgaacggattcccttccgacactcatgcgtacttgttcaatggcgactttgtggatcgtggctcgtggtctactgagattgccctcctcttgtacgcctacaagtggctgcggccaaacggcatcttcctgaaccgtggaaatcacgaaacggacgatatgaacaaggtatatggtttcgaaggtgaatgccgcgccaaatacaatgagacaatgttcaaggtcttctccgagtccttctcagcgctacctcttgccaccctgattggcaacaagtaccttgtcctccacggtggtttattctccgacgacaagacgacgctggacgatatccgaaagctcaaccgccacaaccagaagcaacccggtcagcaagggttgatgatggagatgctatggacggatccccagacagagcctggtcgcggacccagcaagcgaggtgttggtctccagttcggtccagatgtcacaaagcgcttctgcgagaacaacgggctggaagctatcatccgctcgcacgaggtgcgcatgaacgggtacgaggttgagcacgatggacggtgtatcaccgttttctctgctccgaaatactgcgatacgacagagaacaagggtgctttcatcaagatcggaccagagctcaagctcgaataccaggttttcgaggcggtgcctcacccagatatcaagccgatg

SEQ ID NO: 36695 - DNA, 2148 bp, Aspergillus nidulans
  unsure (1)..(2148): unsure at all n locations
cgtatgttcatcgacccaacgtctggcaaccccaggaaattccttatcgatgtcgactctactcttcatagtctgcttgagagagaggattcggacaggaacatgcagatcaccatcgaggatgttggccctaaggtgcgtactggctttatgatagtcataggacaagcagtactgaccttgattctaggttttctccttagggacagctgcatcccatggttacaacaggttcgacgtgcgaggcacatatatgctgtcgaacctcctccaagaattaacaattgctaaagattatgggcgtaaacagattgtccttgatgaggaacgtctttccgagaatcctgtctctcggctttcccgacttatcaagaactctttctggaactctctaactagaagaattgacgggcgtaatatcgaggtggctggaagggatcccaaggattggactgacgatcctcggccgcgtatttatgttccacccggtgctcccgaacagttggagtactacaggagaaatcgcgaagagaagcctgaactgcgtcttgatgttcaggaatnggctgcngaaatcacaccgngatatgtgcgagacttgaatgagaagcccgggctgctcgcattggccatggaggagaaatacgatgaaaagaccgggaagaccgacttcgctggagttcccttcgtggtcccaggagggcgattcaacgagctttacgggtgggatagctacatggaatcgctggggcttctggctagcaacagggtcgaccttgccaaagccatggtgataaatttctgcttctgcattaagcattatggaaagattctcaacgccaaccggtcgtactatctgacacgatcccaaccacctttcctaactgatatggctttacgtgtgtacgaccgcatccagaatgaaccaggcgccatggatttccttcgccacgcaattctagcagccatcaaggagtactacagtgtttggatggctgagccgcgtctagaccctgtgtcgggcctgtcaagataccgctcaccgggtattggagtacctcctgagacggaggcctctcacttcctccatcttctcaccccgtatgccgagaaacatggtatggaattcaaagagtttgtccaggcctacaactacggcaaagtcaaggagccggaactggacgaatacttcatgcacgacagagctgttagagaatctggacacgacaccagttaccgtttggagagagtctgcggcaatcttgccactgttgacctgaactctctcttatacaagtatgaggtcgatattgcgcgagtaatacgcgtctacttcaaggacaagctcgagattccggtcgagttccgaacaccagccaccaaggatatccaaagcgaatcatcatctgtgtgggaccgccgggcgcgcagaagaaagatgaggatggacacctacctctgggatgaagaaaagggaatgtactttgattacgacacggtcaaacaagaacggaccaactatgagagcgccacgactctctgggcaatgtgggctgggcttgtcacgccacgccaggcttctgcaatgatcaccaaggcacttccccgcttcgaggagtttggtggaattgtctcgggcacctgaagagtctcgtggtgctgttggactaaaccgacctactcggcagtgggattacccatacggatgggcgccgcagcagatgctcgcgtggaccgggttcgcccgttacggatatcaggaagaggccgagcgacttgcatacaagtggctctacatgatcactaaggcgttcgttgacttcaacggcgtcgtcgtcgagaaatacgatgtgacccgacccattgaccctcaccgcgttgatgccgagtatggcaaccagggcgtcgacttcaagggcgcccctcgcgaagggtatgctcccactgtttccatatttgactgttgtatgctaactatcgccaactaggttcggttgggtcaatgcaagctacgtttacggcctggaaatgctcaacgcccatcagcgacgtgctcttggtgcggtcactccatgggagacgtacagcaaggctgtttctgcgcagggtagtgacaccgttcttgaaaacagatctgagtgattgagt

SEQ ID NO: 36696 - DNA, 4035 bp, Aspergillus nidulans
tggtcccatggactgggagcccactgttgctgctgtccagcagcgtcgccgagctactgacaaccaacaaaggacccagcgtacaatgaccggacggcgcgctcagtttgtctccaactctgagctccaaagacgacgtgaggagggaacatgcctccgttgtggaagtaaaggccacctcgtccgagaccttctgcctcctctacgccctcgtccgactgtggctgctacacaaatggttaacaacgtggaagaggaaccagaggagtcggaaaacgaataacccctgtacgaagtcatggacaggggtacccaggtagagctactcaactaagactatggaaagactttaaacgctctcacatgcactcccaaccttttaaactagaggccattgtgaaccatatcaagctggcttgtacgctggtagatacaggctgtcttgcctatagagccatcagtcaagaatttgtacaatggaacaagataccaaccattcctatcaagccgctcccagtggatggtattggtggagacctggtcataaccaggatcgtacgagcacgactggatattggaggtcatagtgaagaggggtcatacctttatgtcctaccatatctactaggatatgaccttatcctcggcaacccctggctcaagcgccatgatggcaggctagagcctaaaagaaaccgactatatctacgtacgaccaagacacgcctatataacactattacacacccacccaaacccctaagcctacaaagtcttactgccgcagcatttcaagctataaagagacaggcaacaaaaactggttcaaagacaacaatatttgcagcctcgctaagagacattgaaaaggcacttaaccccaaaacaccaacagacccccgtatgaagcttcctccggaatatatggatttccttaacctctttgaacctgacaacgcaaaatcgttgccaccccatcggggagagggcattgaccacaagatcgagctcgtacgaaccaatggaaaggagcctgagataccttgggggcccctctacaacatgtctcgggaggagttggtcgtattaaggaaggaactaactgaactgttagacaagaactttaatagagtaagcagctcacctgctgctgctccggtcttatttgtacggaaaccagggggaggtctgagattctgtgttgactaccgcgccttaaatgctattaccaagaaagatcgatatcctctgccccttatccacgagacactgaaccagatcggacgggctaagtggtttaccaaactggatgtttcagctgccttccacaaaatccggattgccaaaggccaggagtggatgacagcttttcgtacgagatatggcctttttgaatggcttgttacaccatttggcctggcaaatgcccccagcactttccagaagtacattaactgggcgctccgtgaatacttggacgagttttgctctgcctatgttgatgatatcttggtcttcactgatggaagccgtgaactccatagggagcacgtacgaaaggtcctagtcaagcttaataaagcagggctgttcctagacatcaacaagtgcgagtttgaacgcaaggaaaccaagtacctagggtttatcgtacgagctggagaaggtgtgtcaatggacccagagaagatcaaggccattaaagaatgggaagcacctacaaccgtcaaaggcgtacgaggatttatcgggtttgcaaacttctaccgtcaattcatacctgatttttcatctctaacgcgacccctaattgaactgaccaaaaaggatgcccggttctgttggacggaagagtgccagcagagcttcgtacgattaaaggaatgcttcatgacagagcctgtccttgctccatttgacccagatcgagagactatagtggaaacagactcgtccggccatacaactggggggacactatcacagtatgacttggagggtaatctccacccttgtgcctacttctctaaacgccactcccctgcagggagtaactatgagatctatgacaaagagttactggctgttgtacggtgcctggaagcctgggatgctgaattccgctcagtatctaaatttaaagttcttactgaccataagaatctggaatacttctattcaccaaggaagctgtcagaacgacacgtacgatggagcctcttcttaagcagatttaacttcaaattctactaccggaagggctctgagaatgaacgtgccgacgctctctctcgacgtgaccaagactctccaaaaggaaatgatgatcggttagagtcacgtacgatgcagttattacaagaaaaacacaggggggaagcaatagacattccctatccaaaagccaccatcttacctattgcaccccaaggaggggtccccacctgggcagaagcccagtcaggtgatgacgagtacatggaaatacggaagctcgtacgagagggggctaggaaactcccaccaaggctactgctcaaggtttccatgtcagaatgcagcattgacgcgcaagacaatctcctattccgaggacgaagatgggtcccccgcaacgaacccttgcgtacaagcctgatcaagacagcccacgactccgccctaatcggtcaccccggacgagaacagacctatttggtggtgagccgaacctacttctggccaaatatgtccaaagatatacgccgatttgtacggaactgtgacacctgcggccgagcaaaaacatggaaggaacagaaaaagggactcctaaaaccattaccaatcccagaacgtccatggcaacatatcacactggactttattacggacctgccaaatagtaatggctgtacggtgattctagtcctgactgaccgactgacaaaaggagtaatccttgaatctatggccaaaacgacttctcaagaggttgcttggaccctcgtacgaaccctgatacgacgccacggaataccgcagacaatggtctctgataggggcagtcaatgtgttagtggagtatggaagcggatctgccagctgttagggattaaacgattgctatcaaccgccttccatccccagacagacggggctacagagcgagcaaatgctgtagtggagacataccttcgctcgtacgtttgctatgatcagggagattgggacaagctcatccctattgcagaactggctatcaatgctcgtacaagctctgctactggggtgtcccctttttacctaacccatggctacgacctctcaccatttggccttactgaggacttaccagagcaatctgccgatcagagccccatccagatcggggaaaatattgctcgtacgatcaaagaagccatggactgggccaaagcatctctagcttactcacaacaagaagccgaacgccaggcaaacaagaagcgagccccagcacctacctataaaccaggtgacaaagtatggctgaaccttcggaatattcgtacggaaagacccagcaagaaactagactggaagaatgcaaaatatacagtcacaaagttgataggcacacatgccctacagttgaatactccaccaggaatacacccagtatttcatgttgacctcgtacgactggcagataatgacaagctcccctcgcaagtccaggatgactcccaacccccacctatcttggtaaataacgaagaagaatattatgttgactccgtactagataaacggtggaagaagataggaagaggaggccgttgggaatatctggttaaatggactggatgggctaaacctacatgggaaccagcccacgaacttgaagaaacagaggctgcacaagcctatgaattacaacaggaacaacagaaagaagaccatcccaacccagaacccacagaacaagaaaagagaacaggctcgcgcagaaccagatcgtacgacaagattaatcctccagttcctcaattggagcacggggaagctctgcaa

SEQ ID NO: 36697 - DNA, 332 bp, Aspergillus nidulans
atcgtgaccattgttatggctggcatcctaggcatctacggcctggtggtctcggtgctgattgccaacaacctcgcgcagacggtcgctctgtacacgagtctgcttcagctgggcgccggcctggcggttgggctttgcgggctggctgctgggtaaggaaagccagctgagccgtccttttccagttagctgttggctgttggctgattaatgtcaggtttgcaattgggatcgtcggcgatgcaggcgtgagggggaccgcgcagcagccaagactttacgtgggcatgatccttgttctgatctttgctgaggtcttgggtatgtaa

SEQ ID NO: 36698 - DNA, 2101 bp, Aspergillus nidulans
ttcatcgcgcctctcgcgttctttggatccgcccacgcccaggaagatgattcagtgcaggaaaactatggaacggttattggtattgatttgggaacaacttactcgtatgtcaattgaggcgaatagaaatctgagccaaagttaactggcgcagttgtgttggtgtgatgcagaacggaaaagtcgaaattctcgtcaacgaccaaggaaaccgaatcactccttcctacgtcgcctttacagatgaggagcgtctggtcggtgatgctgcgaagaaccaatacgccgccaatcccaagaggacaatctttgatatcaagtgagttttctcaaaatatctggttgaacggtttctgactagggtaggcgtcttattggtcgcaagtacgacgaggccgatgttcagcgtgatatcaagaactatcctttcaaggttgtcaacaaggatggaaagcccaacgtcaaggttgatgtcaaccagactcccaagacgctcagtcccgaggaggtttctgccatggttcttggcaagatgaaggaaatcgccgagggctaccttggaaagaaggttacccacgctgtcgtcactgtcccggcctacttcaacgacgcccagagacaagctaccaaggatgctggcactattgccggtcttaacgtcctccgtgttgtcaacgaacccaccgccgctgcgattgcctatggtttggacaagggcagcgaggagcgccaggtcatcgtctatgatcttggtggtggtacctttgatgtcagtcttctttcgatcgatgacggtgttttcgaggttctggccacggctggagacgtccatcttggaggtgaggacttcgaccaccgggtcatggaccacttcgtcaagcagtacaacaagaagaacaacgtcgatgtcaccaaggacctaaaagccatgggtaagctcaagcgtgaagtcgagaaggccaagcgtactctgtcttcccagatgtccacccgcattgagattgaggcgttccacaatggtcaggacttctccgagactttgacccgcgccaagtttgaggagctgaacatggacctgttcaagaagaccctgaagcccgttgagcaggtgctcaaggatgccaaggtgtccaaggctgatattgacgacattgtccttgttggtggttccactcgtattcctaaggttcaggctatgctggaggagttcttcgacggcaagaaggctagcaagggtatcaaccccgatgaggctgtcgctttcggtgccgccgttcagggtggtgttctgtctggtgttgagggtaccgaaagcattgttctcatggacgtcaaccctcttactctcggtattgagactaccggtggtgttatgaccaagctcatcccccgcaacactgtcattcctactcgcaagtcgcagatcttctcgactgccgctgacaaccagcctactgttctcatccaagcttgtaagttcctcatttcatcatcgacgaaagtatcaccattctaacggtctacagacgaaggagagcgttctcttaccaaagctaacaacctccttggcaagttcgaacttaccggcattcctcccgctcctcgcggtgttcctcaaattgaggtttccttcgacttggacgccaacggtatcctgaaggtcggcgctagcgacaagggcactggcaaggccgaatctatcaccatcaccaacgacaagggtcgtcttacccaggaagagattgaccgcatggttgccgaggccgaggagttcgctgaggaagaccgtgctatcaaggccaagattgaggcccgtaacagcctggagaactatgccttcagcctcaagaaccaagttaacgatgagaacggccttggtggccagattgatgaggacgacaagcagaccattctggatgctgtcaaggaagtgaacgactggcttgaggagaacggtgcctcggccactactgaggactttgaggagcagaaggaacagctgtcaaacgtggcgtaccctatcaccagcaagctgtacggctctgctcctcctaccgaggaggacgatgacgagtatggccatgatgaattgtaaaat

SEQ ID NO: 36699 - DNA, 1261 bp, Aspergillus nidulans
  unsure (1)..(1261): unsure at all n locations
attcctaaagtccagacagttgctcttgtgcgagaaatcggcggtcctgtggagtttcccaatgactatcctgttcctactcctggaaacaacgaggtactagctaaagtcctctacaccggggtatgtttaagtggtaattttcgttcccatacgtcctctgtctggatcacatttcgaacggagagcgtcaactgacagtatactttgtagaccttcacacaaaggacgccgtcgccccaggccctgatgggattccgatcacgaagttcaagttgcctcacattggaggccatgaaggcgtagggcgtaattgtggctcttggcccgggttgcgggccagacctgaaattaggcactcttgttgggattcgctttgccagtcgggtctgcaggcggtgcgagtactgcttagctggaacggagcaatactgcctgaaaggcacaaacccccttcaccacgaggacggcagttttcaggagtacatcgcgcttgatgcggactacttgactattctcccagatgacgtcgatcccaagactattgctccagtactgtgcgccggaattactgcatacaaggtagaatgggccagggcagggtatcgatccacatgctaatgatattccaggcagttctaggagcaaatatcagggctggacactggctggttgttgttggggcaggaggagggctcgggcatatggcaggtgagattccaatagagaggcatcttaaccctaactcacgacaccgagaacaacagtccaatacgccaaagtccttggagcccaggatgattggcatcgacgcccccgacaaaacgcgttttcgttctgagtgtggccgctactgaattcgtcgacttcgtcaatacagatcctgttcagcgcgttcatgaaatcaccgngcctaggcgcacattctgcggtcgtaacagccgggagcggaaaggcgtttgcccatgtgtgtgagatgctgcgaaccggaggtacactcagctgtgtcggagttccgtctggagatgcaaagttcgaaacaccaatctgcacgatcgtcatcaaggcattgaaggttgttggaagtgtagtgggctcactgagcgaatgcatggaggcagtggaattgacccggcgagggctggtgaaaccaaaaatacaggttcggccgctcagagacttgtcgctcgtttatgaagagatggagagggggagtatctctggaagaatcgtgctggaagtcaatagtagctaaatattc

SEQ ID NO: 36700 - DNA, 1064 bp, Aspergillus nidulans
gaactcttgacctccggaaatacaacagtctatgaattcaacccctgggaatttggctgttttgatccgactgtctacggatttgcgccattggaatacttgggttcccgctttatcaatggttccattccacgcaatgaaagttgcgttcgtggttttgataatgctggatttgtcatgggcacttcttccagtctgttcaaccagttcttccttcaactgaacggcactagccttccagatttcttgaaggacgtcatcggtgatgttctcgcagatatcggcgaagatgataatgacattgccgtctactcccctaacccgttttacggctggttaccacaaaactccccctacgccggcgaggaaaacctcgacgtcgtggacggcggggaggatcttcagaacctccctctccacccgttgatccaacctttgcgccaccgtcgatgtttatcttcgcgattgactcctctgctgatgttaacgactggccgaacggcactgctctcgtcgccacctacgagcgcagtctgaattccaccggtattggcaacggaactgagttccctgcaattcccgaccagaacaccatcgtcaacctgggattgaacactcgtccaactttcttcggatgcgacagcactaacacctccgctccgctggtcgtctacatcgccaatcgccccttcgtctaccagtctgaagaaaccatatccaatttctcgaccttccagctcagcacctcactcgaacaaagagacaacagtatccaaaatggctatgctgttgcaacaatgggtaacagcactgaagacagcaactggtctgcttgcgttggctgtgcgatcctcagccgctcgtttgaccgcaccaacgagcaggttcctgatatctgcacccaatgcttcgacagatactgctggaatggaaccctcaacagcaccacacctgccccttactaccctgctgccgttctgggtagcggctcttccaagcttttcccaacagttttgtcgagtgtcgtggcggcgagcattgcgattgcgacgatggtataactg

SEQ ID NO: 36701 - DNA, 3371 bp, Aspergillus nidulans
ttaacagaccaagtcgtcaagaaccgagaccgtgaccgagcggctggctacaagccgcgtgagctgggtgtgacatggcagggtctctccgtcgaggttcctaccgccgaggcctccgtcaacgagaacctgttctcccagttcaacatccctcaggttgcaaaggattatttccggaagccgcctgtgcgtccgatcctctcggactctcatggctgtgtcaaacctggtgagatgctgcttgtgcttggccggccaggatccgggttgcacaacgcttctgaacctcctgtcgaatcggcgtcagggatatcgcatgatcaagggtgatgttcgattcgggaccatggatcctaaggaagctgaaaggtatagggggcagattgtgatgaacacggaggaggagctcttctacccgcacctccaggtaggggccactatggactttgcaacgaagctcaaggttcccgcgcatcttccggatggagcagactcgatagatgggtatgttaaagaaaccaaggactttctcctagagtccatgggaatttcacacactgcacatacgaaggtcggtaatgagtttgtgcgtggtgtatccggcggcgagcgaaaacgtgagttacaattgaccattttcaagagccaagaactgattataaaaggtgtttctatcattgagtgcctggcaacgcggggatcagtgttctgttgggataacagcacccgtggactcgacgcaagcacttcgctggagtgggcgaaagcattgagagcaatgaccgatgtcaacgggttagcgacgatcgtcacgctctatcaagcgggaaatggcatttacaacctcttcgacaaggtccttgtcctggacgaggggaagcagatatactatgggccagcggcagaagcgaagccgttcatggaagaactagggtttgtctatactgagggtggaaatatcggtgagtggcatacaaagtcttgataaatctcgtttctaacaagagataacaggcgactttttgaccggtgtcacagtcccgactgagcgcagaattaagcctggctacgagagccgctttcccaggaatgccgacgagattagggccttgtacgagaaatcgccaatttacagccagatgatcgcggagtacgactatccgcagacaccgctagccaaagagagaacagaggcgttcaaagagtccgtcgcatgggaacaagccaaagagctccccaaaggaagctcgttgaccgtcggcttctggtcacaactgcttgcatgcaccatccgtcaatatcagattctctggggtgaaaagtccacgttcctgatgaaacaagttctatctctggctatggcgttgattgcaggatcctgtttctacgatgctcccgacgattcctcaggattgttcattaagggaggtggtgtcttctttgctgtactatataacaacattgtcgccatgtctgaagtcaccgagtccttcaagggtcgccctgtgctggtgaagcacaagtcgtttgccatgtaccacccagcagcattctgtttagctcagattatggctgatttccctgtcctgcttttccaatgtacaatattcagtgtcgtgatgtactggatgatcggactaaaacatactgctgctgctttcttcacgttttgggccatcctgttcacaattactctggtaagtcttaaaagccgaaatgggaaatgacaaccttgctaacccacgttgttcaatagtgcttgacagcaatgttccgctgcatcggcgccgctttcaagacattcgaagctgcatccaaaatctcaggtacggctgtaaaaggcatcgtcatgtacgccggttacatgattcccaagcctgatgtcaggaactggttcgtcgaattatactacactaatccgttcgcctacgcctttcaagctgccctctccaatgaatttcacgatcagcacatcgcttgcgtcggcgaaaaccttataccaagcggccctggatacgaagacgctgggtgccggccaccaagcctgcgctggagttggcggtgcactccctggtgctgcttatgttactggaggatcagtatatcggctccttacactacaaatttacgcagctttggcgaactacggctgtggcctgggtttctctggggcccctttgccggtttgacgatcattttcactaccttctggaatgcaggggctggcagcggttcgaccctcttcgtgccccgagagaagatcaagcagcatcaaagacacaaggatgaagagtcccagtcgcaggttggagcagccaccgcccgagacggtggtgatacatcgctggatgaagggaatatctcgcgcaacacgtctatcttcacctggcagaatttgacatatactgtaaacacccctaccggtgaacgtgtgctcttggacaaggtcaatggctatgtaaagcccggaatgctgggtgctctcatgggatcgtctggtgcaggcaaaacgacgctactggatgttttggcgcagcgcaagaccgacggtactatcaaaggctctatcatggtggacggaagacctctccctgtttccttccagcgatctgctggatactgtgagcaattggacatacacgaggaatatgctactgtccgagaagcattggagttttctgccttgcttcgtcaacctaggaccacccccagaagaggaaaagttgaaatacgttgacaccatcatcaatctccttgagcttcaggatctggcagataccttgattgggggggttggaaacggcatcagcgtcgagcagagaaagcgtgtcacaattggtgttgaacttgttgcgaaacccagcatcttgatcttcttagatgaacctacctctgggcttgacgggcagtcggcctataatacagtccgattcctgagaaaacttgcagatattgggcaagctatcctggttactatccatcaaccgtccgcccagctcttcgccgagttcgacactctccttctactggcgaggggtggtaagaccgtgtactttggagacattggcgagaacggacgcacaatcaagcagtactttggcaaatatggcgcacagtgtcctgtcgaggccaacccggccgagttcatgattgacgttgtcactggcgctatcccagaggtgaaggacaacgactggcaccagatctggcttgaatcaccggagaatgctaaaatgatcaaggatctggaggatatgatcgccgacgcagcctctaagccccccgggacacatgatgacggattcgagttctcgatgcctctatgggagcagatcaaaatcgtcacccaccgcatgaacgtctccttatat

SEQ ID NO: 36702 - DNA, 1297 bp, Aspergillus nidulans
acgaacactcccgataccatcctcgcgcacatcgatcgcagactctatctcgatgatagccaccctctcgcgatcactcggaagctgattgagagtcaatttccccgccccgtctacggcaactattctgagaaggacccaattgtgacgactgcgcagaatttcgatgtcctgggttttcccgcggatcatcccggccggagtcgcacagacacatactaccttaacgaaaagacggttcttcggacacacacaagtgcccatcagcaggcttatttccagcagatcagccgcaatgaagaaactcgcccggaagaagttgggtacactgttgttgcggatgtctatcggagagatgcgattgatcgtagcactacccggtgttcatcagatggaaggtgctatgttgtggaagcgccctgccgacaaaccactagagcacgcgaaacaaactgccgccgcgatcatgaaggacgtctatagcattccgtctcatagcgtacctgttgaagacccaaatcctactatccatccgcagcgaaacccgcttcaggccgactaccatagcgaagaggaagtcgaagccatcgccgcgcacctcaagaggtctttggagagaatggtgatcaaggttttcagcgaggcacaaaaggcttctgcggcctccgagggcgcagaggctgagactttgagggttcggtgggtcgaagcatacttccctttcaccagcccatcgtgggagctggaggtattctggcagggcgactggcttgagattctgggttgtggtgtggtcaagcaagagcttcttaacaactccgacgtgccgaatcgcgtaggctgggcgtttggtttgggcctggagcgcatcgccatgctcctcttcaacatccccgatattcggttgttttggtcaaaagacgagcggtttctctcacaattcaaggcgggccaaatcacgcgcttcgagccgttctctaagtaccccgcttgctacaaggacgttgctttctggcttccttctgctgctaccagcggtggaagcgcagctggcggcgcggtaccggttcatgagaacgatatcatggagattgtgcgtggtgttggtggcaatctcgttgaggatgtcaagctgattgacgagttcatccacccgaagactaaccgcaaaagtttgtgctatcggatcaactatcgtagcctggaacgaacgttgacgaacgaggagaccaatgatctccatgacaaagtgcggcagaagcttgtcagccagctttgtgtcgaattgcgatgagtg

SEQ ID NO: 36703 - DNA, 1168 bp, Aspergillus nidulans
atgtccatccccactatgcaatgggcccaggtcgccgagaaggtcggcggcccgctcgtctacaagcagatccccgtccctaagcccggtcccgaccagatccttgtgaagatccgctactctggggtttgccacaccgacctacacgctatgatgggtcactggccaatccccgtcaaaatgccgctcgtcggtgggcacgaaggagcaggaatcgtcgtggcaaagggcgaactggtccacgaattcgagatcggcgaccaagctggcatcaaatggctcaatggttcctgcggagagtgcgagttctgccgccaatcggacgaccccctctgtgcacgcgcccagctctctgggtatactgttgacggcacgttccagcagtatgcgctcggaaaggcgagtcatgcgtcgaagatccctgcgggcgtcccgctggatgccgcggccccagtactctgtgccggtattacagtgtacaagggattgaaagaggccggggtccggccgggccagaccgtggcgatcgtgggtgccggtggcggcctgggatcccttgcacagcagtatgcgaaggcgatggggatcagggttgtcgcggtcgatgggggagatgagaagcgggccatgtgtgagtcgcttggaacagaggtatgtacatgttctcaatctcaggaagcaagcaactgacctggacagacatatgtcgacttcaccaaatctaaagacctggtggccgacgtcaaggcagcgacgccggatggtctcggtgcgcacgcggtgatcctgcttgccgtgtcagagaagcccttccagcaagccactgaatatgtgcgctctcgcgggacaattgttgctattggcttgccgccagatgcgtacctcaaggcccctgtgatcaacacagttgttcgcatgatcactatcaagggcagctacgttggaaaccgacaggacggtgtcgaggctctggacttcttcgctcgcggcctgatcaaggctccgttcaagacggctcctctgaaggatctgccgaagatttacgagcttatgggtgcgttgactcccatatccgatctcattctctttgcgcgatatatttagatactaatggcttgcagaacaaggcagaatcgccggtcgttatgtgctagagatgccagaataa

SEQ ID NO: 36704 - DNA, 900 bp, Aspergillus nidulans
tccacatctcttctagaccatatcttcaccatgagcaaacccggagactacaacgcagtccgacgcgacatcgccgcgcagctcaagaagcccggctacgatgatggtagcgcaggccccgtcttcgtccgtctcgcatggttcgtccctgatacagaacttctcttgtatcccgacggtgaccgctaacaagcttttaataggcactcctccggcacatacgacgctgcaagcgataccggcggctctaacggcgcgggaatgcgctatgaagccgaaggtggcgacccggcaaacgccggtctccaacacggccgcgccttcctagagcccgtgaaggagaagcacccctggatcacatacagcgatttgtggacgcttgcaggcgtcgtcgcaatcgaagagatgggcgggcccaagattccgtggctaccgggccgtaccgactttgtcgacgactccaaggtgcctccgcgcggacgattgcctgatggcgcacagggcgccgaccacctccgcttcatcttctaccggatgggcttcaacgaccaagagatcgtggcactggcgggcggacacaacctaggacggtgccatgctgatcgctcagggttccagggcccttgggtgaacaatccgacgcggttctcgaaccagttcttcaaactgctgctgaatatggagtggaagcccaagacgttagagaacggtgttagtcagtttgtgtatattgatccggaggcggaggaccatgaggagccgctcatgatgctaccaacagacgttgcgttgagggatgatcctgcgttccggccttgggtggaacggtatgcgaagcacaaggatctcttctttgaccacttctcgaaggcatttgccaagttgattgagttggggatc

SEQ ID NO: 36705 - DNA, 1545 bp, Aspergillus nidulans
acgctaacgttttagggtggaatcacttgtgctatgccatttggatcgctcgtcggtgccctagcctccagtttccttgccgacaaatactcgcgtgtcactgcaattcagttctcgtctactttgtggattattggatcagtgtacgtatagtatatctactctttgacctgatctgactttttagctttcaatgtgccgccaacggtatccccttgctggtcgtcggtcgtgtcattgcaggcctctgcgttggcatcgcctcagctatggttccggtctacatcgccgaagtgagcccaaagcatatccgagggcgaatgatatcgctacagcaatgggcaatcacctggggtatcctgatccagtacttcattcaatacggcgctagcaacgtcgacggcgggcctgacaatgaaacccagagcacagcggccttccgaattccatggggtatccagattgtccccggtgtaatttacttcgttggtttgtttctataccctaaatcgccccgctggctggcgagcaaggaccgctgggacgagtgcatgcatgtcctcgcccgcctccacgggaacggagacatgaaccacccccttgttctggcccagtacaaggaaattcaggacgcgctcgcccttgaacgtgagcaggctagcaccagctatcaggagctcatcaagccacgcatcgcaaagcgtgttttcctgggcatgagtctgcagatgtggtcgcaattgtcgggaatgaacgtcatgatggtaagaatgttcttcgccataagagcacagtcaaattaacaaacgcagtactacatcgtctacatcatgcagtccacaggagcgggctcccctcttctaacagcttccattcaatacatccttaacacggcccttactctcccagcgattctctggctcgaccgcttcggccgccgccctgcgatcctcattggcttcaccatgcaagcaatcttcctttacattgagggtggcctgcaagccggctatggtcgctcgactcgaccgtccgacgacctaaacgccatctcctggaccgtggcggaccacccgggtgtgggcaaggctatcatcgccatgtcgtacctctttgtctgctccttcgcaacgaccattggtccaacttcctggacctacccggctgaaatctacccggccaaggtccgtgccaaggctgtctcactggctacggcgtccaactggacctggaactgtctccttgcgctctttgttccgccacttctgtggaatatcaactggaagatgtacatgattgtacgtttacccacccaccaaccactgcatccttataagcaagatactaacggagttttgtgtacagttcgcagccttcaacactgtcgccgccttgaacatgttcctgaccgcccctgaaacaaaaggatacacgcttgaggagatggacgaggtctttgagagcggcatcgcgccctggaagaaaaggaagatcagctcccgtcttgagcagatcgagagggagattgccgagggtaacctcaag

SEQ ID NO: 36706 - DNA, 1997 bp, Aspergillus nidulans
acctacgactatgtgattgtcggcgcaggagtctcaggacttacggtagcgaatcgcctgtcagagaacaaaaaactaagtgttctcatcattgaagcaggcggattgtacgtgtcttctttttttttgcttgttctacctcgcgcctcagtacaagagatactaattgatttagcgacgaagacgaagactttatccttgttcctggccttgcggggaacgcaatcggcacaaagtatgactggaacttgacatacgcggtaaacccggacctgggaaatcgtactgtttctatcccccaaggaaaggcagtcggaggctcgagtctgttgaaccgcatggtctttgatcgcggatccaaggctgactatgaccgctgggaggcactggggaatcctggttggggttggagggacctctttccattcttcaaaaaggtatgcatatgcgcgccctagagcaatcgaacttatctgatcaacctagagtgagaacttcacgcctccaagcgaggacgtgattgatgagtggaatgccacatatgacccagcagtccacggcacgactggcaacgtccagtccagctacgctccgtggatttggccttctacaaaacaattcatcagcgcgattacgagccttggggtccatgttccccgtgatggtgcgagtggcgacgccctcggtggatttttcgtgccccatagtcaggatgcgatttctgtgactcggagtgacgcccgcagggcctactgggatgcggtgtcgaagagacccaatgttcatcttcttaccggccagagagtgacaagaatgatcagcaaaaggacttcgcgcagggtgcaaatcactggagtggaggtatgtacctacccatcctcacaaccactgttcacagtatatgaacagtaaagaatgaactaatgcgaatgattccatcagtttgcagcgcaccgatcaggggcccgaactattgttaacgctcgcaaggaagtactcctagcagcaggggcaattcacactcctcagctgctgcaattgtcaggaatcggtgacagagcaaccctcaacaggcataacatctccaccgtagccgatgtcccaggtgtcggccgcaacctccaggaccatcttcacgtccccgtagtgttttcatgtaggtgacaagcccgtgattcgactacagcactaacaatgacagtcgatttccccctaaccgccacgaatcttacgacaaacagcacattcgccgctgaatcgtgggccttgtatcgcacccataagacaggcccttacgccgacgcaactggcgacttccttgccttctttccaactgtaaacttcacctctcaagctgatgtcctccagggcattgctgctgatcagaacccgcaagcctacctggacaaagacactccgccctcaattgtggacggctacaccgtccagcataaactcctcacaagcggactcgccgctacggatgaagcgcagctcgtaatcatctgggcggacggcacgtttgtctcggcctccagcatcccttttcacggggcagcgtgcgtctagcgtcatccgaccctttcgcgcaacctctcgcggaccctgcgtatctgcgtaatcctgtcgacgtgcggatcctaatcgaggcgatcaagtacgcgcgctcgttaaccacaaccctttctctggcggcatttaaccccgtcgagctcgtgcccggtggcagcatcacctcggatgaagatctggaagcttatgtccgcggcgcagtagactcgctcttccatccatcaggaacttgtgccgtgggtaaatttgaacttggtggcgttgttgatgtggacttcaaggtacatggagtgaaaggtctaagagttgtggatgccagtgtgttaccaatgttgccggcgacgcatattcagagctcagtctatgcggttgctgagaaggtgagttcgcttttgtttctcgaatcttatccgtagaaacagcta

SEQ ID NO: 36707 - DNA, 1654 bp, Aspergillus nidulans
aaggccaactggcgtgtgttcgccatcaccctgtacatgggcatcgccttgttcgagtatggcttcgacaagggcgccattgcgggcttccaagcaatgcctgggttcttgcaggtgtttggatatcagactgagtctggcgagtgggatattcatgtacagcgctccatttctttccctcagcattttctcttttctcccattgcctgatacacatctctcttttgttaacactgtcgtctcaccgattaggccggtccccaacaaatcatcacctcgttcatgattctcggcagcgtcatcggctccctcctgacgggttttgtcggcgctcgcattggccgtcggtatggattgatgctgggctcactgattgtgatcatctgcgtcgtgatcatgtcagaaacgaccgttctcggagctctctacttttccagactcttaatcgggataggaaacggccttctgctgaactttaccgtgctctacctgcaggagtgcacccctcctcgctttcggggcctttgcctgagcatggtcacttgctggatcaccattgggacgacgattgggatggtgagtctcctccattcgccctatccttggtttgaagattaggaaagaaagttgctaatataaacgtaggtgatcaatcaccaaaccaacggcatgatgagtcgagaggcataccgtatccctctttacgtctgctatcctgcccctgctatcctcatcctcacgctgccgctcctccccgagtctccccgctggctccttcagcacggaaagccagaggccgcgcttcgtagtcttcagtttttccgacaaggtgcctacgacgaagttgcggtgcagcaggagttcgaggagatgaaggcagcagcggcacgcgagagagaccaagagattcatcagaacaaatggcttctcttcttcgaattattccgcggtcataatcttcgcaggaccatcattgcagttgcggtgggcacagccaatgccgctgtcggtgccatgttcatcctatcgtatgggacatactttttccaggtggtgcgtcatcccctcccgttcataccatcactgggtctaacaggttctccaacaggcaaatgtcggagatccattcaagtggattatcgtgaccaactgcgtcggtctcgcgggtctgttcaccacctgggccatcgtcactcatgtcggacgccggcgaatcatcctcgcaggatgcgtaatatgcaccctccctatgctcgtcatggcagccgtctactccgcgcccaacgtttccgcagacggtgcaggcattgccctagtcgtgatcgtctcgatctacgtcttcggatttaatttcggcctcgaaccttacgtctaccttgttgccggcgagatgccttcccagaaccttcgaggctacacaatgggcctgtcgaccgcggtcagctttgtgtttgcgtggctgagcgcctttacaaccccgtacttcatcaacccgggtgagctcaactggggccccaagtatggctacatctggtttggcagcggtatcatcaccaccgcgttcctgtggtactatctgccggaggtaaggggccgcacgctggaggagatcgatgagatgttccggaacaatgtgcccacgcgagcattcgcc

SEQ ID NO: 36708 - DNA, 1447 bp, Aspergillus nidulans
atggtgctcgactatagcaagtgggacgctctcgagctttcagacgactcggatatcgaggtacacccaaatgtcgacaagcgatctttcattcgagccaaacaggcgcagatccatcagcaacgagaacaacgacgtctcaacattaagaccctgaagtatgaacgcatcattaacgatggcttactttcgcgcattgagaaacttcttacatctttcaaggagaaagagggttcctcatccaatcccgaggaagttatcttctcaacacttatggaattagcgagtaatccggaagacgatcagcccccctcacctccggagggcgtccatacccaagaaagggagcaaccgaagtactcccagatgatgagctccctggtggaccaggtcaaagccgaggttgaagaatcgaaacacgacaacgtatttgaagcatatgtcaagggtgtgcaaggacataaggacaaggtgcaggaattgcaaaaggaacttctcacaaagctcgctgagcttgagaaagaggagggcagcaaaatcacaagtgaatctattcatacaggctttgatacctcccacgtatctaaggctaaggctaaggataaggtgccagcgtcagagagagctacttcagtcgagcttctgaatccgaaggcggcaacagaaccttcaaatcaggagtccaatgacaatgaggctgtcgacgacccggatagtatacaagcaagtgcgctagcgaagaaatttgcgaagattgaccgcaatgactacagagctctgcatcaattcatatcagaccatccggaaatcgttgcggagaaggaaacagacgggttactggttgaagcgttcaatagccagatggagggcaaagaaacctatgctcgtcagtgtgtacaccaaggacttttattgcaatactgccgctctctcggtcctgatgggatttcgcttttcttcaagcggtaagtatcctagtcccatgtttgcagggaggtataagcttgcagggtggttactgattgatccctggtatagtatcacgacaagggagcaccaggcaggtacccttttccgaaacgatgtcaacgaaacctataataagatcaagactcgtgccgctgaactagccaaggatagctctgcgtccaacgatcctgccggggtggagcagatacaacttcacgctgtcgatccgaacacgaagattaccattaacatccctcggagcgagagcaacgaacccgtcgaaatcgaagcgcgaaagatttttgagtctttctctaaagaactgcaaacagcgctggagtctgaatcattagatgaggttaacaaagttctcgggaagatgagtgttgaagaggccgaagatgtcgtggagaagctcggagagagcggcatgcttagtctggaggaaggtatcgtcgatgccacgacggaagagggc

SEQ ID NO: 36709 - DNA, 1441 bp, Aspergillus nidulans
atgcaaggaaatatcaccgcgttgtacgatatcgggtgcgtcctcggttcgatagtctcgtatttcgttggagaacgactgggacgacggaccatgttgatagctggtggaggaatcatggtcattgggacagtgattctggcaagctcggacacagtggcacagttgatcgtcggttcgtacagtccataagcttcaaagtctcccgggaccctaggcttgcccctttcgacggatgtctaataagttgaactcgtaggacgcattgtgaccggcgtcgggaacggcatgaactcgtcaacggctccagtgtaccagtctgaatgcgcaccggctgcataccgtggagccctcctgactctacaaggaacggtgacaatcctcggggtcgtgatcgcatactggtacgggctcagggctcaggaatgggctatatttcactgaagctgacagctcacaggatggattacggaccaagcttcacggaatcctcgttacaatggcgcttcccacttgcattccaggccgtcttcgccattttccttgttctgcaagttatcggtctccctgagacgccgcgctggctggtccagcacgaccgccacgaagatgcccgcgaagtagtcgccgctatcaccgaccgggacgtgaacgacccacaagtggtccggacagtcctcgatatccaggtcggcctggaagaagagcaaaagggcgggccgtttaaattcaaagagctcttcgcgtggggggaggagcaaaatcttcggcggctgctcgtcattatcagcgttgagctggggcagcagttcactggctcgaatatgatcaattactacggccctgtcatgttccagacgacaatgaacatggggcggaacctctccatgatcctcggcggtgcgatccaatgtacatacctcgtcggctcggcgatcccagtcctgctaatggaccggttcggccgacgaacgttgctgatagtgtgctctgttggactctgcttctgttttgtcatggtgtctattctgctttcgctggggagcacgaatgccgcatatggcgccaccgcgtttatcttcatcttccaaatcttttatggcattgggtggctacccgtcccctggttctatccgagtgagatatcaacgacccgcacaaggacacggatgcaggctattgcatcggcttggaactggatggccgtctttgcggtcgtgaaaatcacgccgcttgcgttccgtatgtgcttcaaccctctccttccagaataaccagagctgacggaatagaaaacattggctggcgtacattcgtcatctttgccgtgctcaacgcggcgtttatccccatggtatacttcttctatccggaaacgaaaggcttggaattggaggatatcccgctgctcttcagcaagggcgggttcacgggcggggtg

SEQ ID NO: 36710 - DNA, 1572 bp, Aspergillus nidulans
  unsure (1)..(1572): unsure at all n locations
gtgcgtcaggtctgcatcattggtgcgggaaaagagggtgtcataacgggcatcattctcgcatcgcacaatccagaggtcgagttctgtgtcgctgataccgatgaagaattgatcagactatggaaatccgatacgctgcccttctctgagccagggctggaaaatatgttctttgatgacggggctctccacgcgactaggtctgaggacgagaaggaggacgggaagcacgctaatatagatcatggtcaggatcaagaccaacagaggttgacgggaaaggagacagcagctcatgtagagcgccgcaagaaactatctaatctaaccttctcggccgatattcatgctgcgctcgtcccggcgcagctggtcttcctgtgtctggagatggatcccagtgctggcgcatctgtctgtaccttcccctatcttacggctcaagtcttttcctctgttgctgacgagaagttaggacgagtcttcgtcacactcctacctagattccgccctctacacgattgccctcgcctcgagagggcataaaattatcgtgcaacgaagtacagcgccctacggtgctacagcgtatatcaagaatcgagtctgtcgccctctccctatcaatcctgcccccaatgcttcggttaggtgactgaccagaaatactctagttacaagcaatatcttcgccaaggctacccacactgttctggcaaaccccgttctggccgtcccattcccaggctctctaatagcgtcaatgattaccccatcgagcgtgataattggccacatcttctcctctacggcctcgacaccagcgataactgctctgaagaggttgtacgcctcatttgtgcctgaagaccgcattgtgaccatggacgcgtactcggctgaactaggaaccattagcgccaaggcagtaattgtgcagcagatgatggcgttgaactctgtgcacatgatatgtggcaaggtagaggcgagtccgggaaatgtgggatggatactgggagggctggacatcgcagccgtcaggacaggagtgtggatgaggagggaggtgcggtgcttagtcaatcttgctaaggggctggggatggaggaggtgaaggcgtactgggagggggtgctgaagctggaggggatgaagtaccggagagatgttaggaacttcttggaaactctaaaccagggtgaagaccggaagaaggctgctttgatcttgacggatgcaatgggagatcaggagacggcgctggttctgctggacgagttaaaaagagccgaggtgacgattagggcatgggtcgactgtgcgacaaaggagcagagccacaatgttcttcaaaccgttagaggtagggtcgaaggccttgaggtagcgaattcactagaaagtgcgtgcgcaggatccaatgtcgtcatcctccatggttccctggggattcgtgatgaggcgatgcaggcgatacggnacaatatggaaaggccgaacgactactgaatctaggagatcggatggacgaaatgaagatgcggcacgtggggttcaggcttgta

SEQ ID NO: 36711 - DNA, 596 bp, Aspergillus nidulans
gactcgaccatcccgcctctcttccgtgccaaactcgccgactacttccgatccggatatgacagaggccaccaggttcccgcggccgatgcgaaatggtcacaggaggcaatggacggaacattcgcgctgacgaacatgtgtccgcaggttggggagggattcaacagagactactgggcacattttgaggagttctgtcgagacttgacgaaacggtaccctagcgtacgaattattactgggccgctgtacctcccgcatcgagacgccgatgggaaatggagggtgaactatgaggttatcggcacgccgcccaatgtcgccgtgccgacgcacttctacaaggtcgtttatgctgaggaggggccggggttgccgagtgggaaggttgcctcgggcggttcgtgttgccgaatgcgcgaatctcgaatgataagagactggccgagtttgaggtgccgctcgagacggtggagagggcgagcgggttggagtttgcaagcaagctagagcatacgcgtagaaagaggctatgccaggaggtccggtgcgatatcgtggtgagggagtttaacaatgcgaagaagaaggct

SEQ ID NO: 36712 - DNA, 1507 bp, Aspergillus nidulans
ggccacattcacgacgagccccgacccgaagcaaaaccggttgaaaagctgcgctatgaattcggtggtccaattggagtatcagctcttatggtcggatttccactcgtgatgtactatatgttcatcggcgcaaaggtttacgatgggaaactacctctccccgagtccaaccagtccatcaccgacttccttgtgcattttgttgacctagcatatgagcatgcatacccacacaaaaaggcctggactatttactggtcgttcctcatcttcgagggctttgcatacctctacttgcccggagtctaccgcgtcggcaaaccgcttcctcatctgaatggacaccagctcccatactactgctctgctgcctggagttggttcgtcacaattggcctggccctgggcctgcacttcactggtatcttccgtcttgacgcactcatcaccgaattcggcccgatcatgtctgtcgcgattgcgtcggggtggatggtttcggtcatcgcatacgtctctgcgctggcgagaggtgctcagcacaggatgactggaaaccatatctatgactttttcatgggcgctgaactcaacccgagactcttcaagtggatcgatatgaagatgttttttgaggtgcgaatcccctggttcatattgtttcttctgacgctcgcgacggcgttgaagcagtatgaacagctggggtttgtctctggcgaagtctgtttcttgctgatggctcacttcctttacaccaatgcttgtgcgaagggagaggacctaataattccgagctggtatgtcaagattatgtcttttagccccgagaatcaagaaagctgatacttgggtctctagggatatgtactacgagaaatggggtttcatgctcatcttctggaatctcgccggcgttcccatgagctattgccactgcaccctatacctagcctaccacgatccctcaacctaccggtggaacccggtaactctgatcatctgggcgggactgtacctctttttctactggatctgggacacctgcaacagccagaagaatgtcttccgcgctgaagagcgcggcgcaagtgttgaccgcaagtccttcccgcagctcccttggcgcagtgtcaaaaacccgaagaccatcaagacggctgatggggggttgatcctttgcgatgggtggtgtacgtccaataatcattctaagtccctgttattctccggatacgtatactgatggcttgttcaactgacagatggtatcgcccgcaaaatgcactatacctgcgactggttcttcgcgatatcgtggggcctgattacaggcttcgactcgccgtttccgtggttctactctatcttctttacgatcatgatcatccaccgcgcgaggagggatatccggcgctgtcgcgagagatatggcgaggcttggaaggagtatgagaagcaggttccgtggctgtttattccggttagtctccccctttttctg

SEQ ID NO: 36713 - DNA, 2821 bp, Aspergillus nidulans
atgtcgtttctcggatccatctcaccaaacctaccgcggtctcagtcggttgtcagtcacaatctaccacaagcgcatggcctcgacgagaacgacgacatatatcacaatcattccaccaccgcgcaaccaggcgcttccgagaaggacaaaagcgaagatggagaaacgctacacgaaaacgagcctgacggggaagctcgcgtgacattactggctcgacaattgactcgtcactctactaggctgacggcaaagagcactctcgagaacccattctttcttgatgattctgactctactctaaaccccaacagtccaaacttccgagttcgtgactggatgaaaatgttattagaggatccggtctcgcgacccagagagatatccggatcgcacagctggcattgctttcaagaatcttagcgtgcatggcttcggctccccaactgattaccagaaagacgtcatgaatgtgctgcttgaaatcgggacaatagctcgcagactcgctgggatgaagatgccaaagatacagattctccgggatttcgaaggattggttagaagtggtgaaatgcttgttgtcctgggaaggcctggaagcggatgttccacctttctcaagactattgctggtgagatgaatggcatccaagtgtcagatgacgcagtattgaattaccaaggtcagcctccttcgacatcaggatcgttagcgattttatgaattcgcttctaacacctttcatctaggcatttcttccaagaatatgcagaactcgttccgaggcgaagctatctatacagcggagaatgacattcattttccccagctctcagtaggggatactcttatgttttctgccctcgcaagagcaccgcgcaaccgcttggagggcgtgagtcgaaagcaatatgcagagcatatgagggacgtggtgatggctatgcttggtctctcacataccattaatacacgtgttggaaatgacttcattcgtggcgttagtggtggtgaaagaaagcgggttagtatcgcagaggctaccctaagtcaggcgccgcttcagtgctgggataacagcacgagaggacttgatagtgccaatgctttggagttctgcaaaaatctggctcttatgagcaagtataccggctctactgcttgcgtggcaatctaccaagcgtcccagagcgcttacgatgtcttcgacaaggtcactgttctgtatgaagggagacagatctatttcggtaacaccaaagacgcaaaaaagttctttgttgatatgggtttcgagtgccctgagcgtcaaacgacggcagactttctgacatcgcacactagtccagcggaacgcctggtacgccctggatatgaaggccgtgtcccttgcacgcccgacgaattcgcagatgcgtgtgagacaagcgagtcacgtgctcagcttatgcgggagctgatgtaatatgatcgacagtctcccattgggggtccatcctggtatgcagtggtggatgcacgcaagtccatgcaatcgtagcgccagcgcgtgaactctgcgtatccgatctctatatggcagcaagtctccgtatgtgctgttcgtggatttcagcgtctccgtggtgatttcagtctcctgacagcttctttaattggcacctttatgatggcattaattattggatctgtattcttcgatctccctgacgatgcgtccagtttttactaccggggtgctcttctcttctttgcagtgctgttgaatgccttctcgagtgccttagagattttgacactctattcgcaacggccaatagtggaagaacaatcaagatacgcattctatcatccttttgctgaagcagtcgcatcaatgatatgggatactccatacaaactggtcaattcattcacgttcaacgtccccttatacttgatgacatacctgcgtcgcgatgctgcggcctttttcacattctggatattttcggtggtcaccacatttacaatgtgcatgattttccgcactattgcttctacctcccgttcgctatcccaagccctcgtgcccgcagctatgctaattttaggaatggtaatctatactggttttactatccctactcaaaatatgcttggctggcctcgttggatgaactatatcaaccctatcgcctactcgttcgaaagctttatggtcaacgaattcgacggtcggcaattcgaatgttgtgtccattattcccagtggggatgagtacaacaatgtgtctatgcagtaccgcatctgctcaacagttggagcagagtcggggtcaagaattgtggacggcggacaatacctggaactaagctatcaatataccaaaagtcacctatggaggaatatggggattttgattggctttatggtattctttgctttcacctaccttcttggcactgaatatatctctgagcaaaaggccaaaggtgaggtcttactcttccgccgcggtcgtcagccagacctgtcaacaactgaggccgatcccgatgaacctatacaacctagtaatgccccaaagaccgaagaatcggcgccacagaataccgctaggattcaaaggcaaacagcaatttttcattgggaagatgtctgctatgacatcaagatcaaaggccagccaaggaggatcctcgataatgttgacggttgggtcaaaccggcacctgcaccgcgctaatgggtgttccggagcaggaaagacaacgttgctagacgttctggccacaagggtcactatgggtgttgtcctggatcatgcttgt

SEQ ID NO: 36714 - DNA, 1339 bp, Aspergillus nidulans
gggataacggaggtccagatcatccagtggtatgttgaggaaggagcaagggttgaagagtggaagccgctttgtcagtatcaatctgataaagcggttgccgatgttggtttcccttggccctggatgcattagtgcgtgctaatatacatatatagatcacttcgaggtatgagggaattgtgaaaaagctacattttcaggcagatgataccgtccccacaggaagggtaagaagctacctcgcaatatttttttggctatgctaatcagtgcatgtttataggctctttgtgacatcgaagtagacgatgcacaataccctgaagaccatcctcccacggagtcgaacgcagagacctctccaccagcgcggacaacgattgattcgcaacctgtacctcgtccgactaccccgttaccagcttccccagccgcagaaatcccaagcaatggtgcgaaaggacgatatgctacgcttgctactccggctgtccgcgggctgcttaaacaattgaatgtgaacatcgaggatgtgaagggaacaggcaaggacgggcgagtgctcaaggaggatatccaccggtttgtcgcgatgcgggacgcaccgagcgcaactccatcactgtcacaggacgccgacacagcggttaacctgacacacatccaaacccagatgttcaagacaatgacacggtcacttacgattccgcatttcgggtacgccgacgagctcaatatcaacaacatcacagccctgcggaagaaaattgccaatgacaaaagcgatccgaggaagatcacattcctctcatttgtagtcaaagcggtgtcccttgctctaaacgactaccccattctcaacgcaaagctcgacaccagcaatgctgacaagccgcaactcatcatgcgcccaagacacaatattgggattgcaatggatacaccgcagggcctgatagtccccaacattaaggatgtcggcagtcgttccatcctagatgttgcccaagagatctcgcgtcttagcgcgctcgggaaggaaggcaaactcacccctgccgacctcagcggcggtacgatcacggtctcgaatattggaaacattggaggcacctacgttagtccagtgcttgtccccaacgagctggccattcttggaatcgggagggcaagaacgattcctgtttttgatgatgctgggcaggtaacaaaaggcgaggttgtgaactttagttggagtgcagatcatcgagttgtggacggtgcaacaatggcaaggatggcgagcaaggtcaaggagcttattgagtcgccggagcgtatgctcttgagtctg

SEQ ID NO: 36715 - DNA, 1620 bp, Aspergillus nidulans
ttcatcatgggctttatgcttaggaagcctgatgatgcagcgggctctgcggcccctgctatcctgatcggcctgtttgtggcctttggtggcgtcttgtacgggtgagtatcttgttccttccgttggtcaacattgggtctccctaacatgctctagctatgatactggtactatcagcggcattctcgccatgaaatactggcggaggcagttctctaccggctacgttaaccccaacgaccatatccccgacgtcacctcctcccagtcctcgatgatcgtttctctcctgtccgccggtaccttcttcggtgccctcacgggcgccccagttgctgattactttggtcgccgcattgccatgatcctcgactgttttgtattttgcttcggagtggtcttgcagacagcagccaccgccattcccttgttcgatgctggacgtttcttctccgggtttggcgatggattgctctccgcaacagattctttataccaggctgagacggctctcaagtggatccgtggcactattgtcggtgcttatcagcttgcgatcactatcggtctactccttgccgctattgacaacaactctacaaaagaccgcaatgacaccggttgctaccgcattcccgtcgcggttcaattcgcctgggccatcatcctggttgtgggaatgatcatcctccctgaaaccccgagattcctgatcaaacaagacaaccatgaggctgctatcaagtctcttgcccgtcttcgtcgtctggacatcaacgatctcgctgttgtcgaagaacttgaagagattaaggcaaaccatgaatatgagctcagcgttggcaaagccagttaccttgagatactccgcgggtccattggtaagcgtctggcaacaggctgcgctgtccaggcacttcagcagttggctggtgtaaacttcatctgttcgtacccttatccctaaccagaaggctcgcaatgtctctaacagtcacagtttactacggaacgacattcttccaacactctggcattaacaacagctttgtcattaccttgataacgaacatcgtcaatgtagtttcaaccctacccggactttggatggtcgagaaatggggccgtcgcccgctgctactttttggcgccgtcggtatgtgcgtcagccagttcattgtggctattgtcggcacaaccaccgactccggcgtcgcaaacaaggtccttatcgctttcgtctgcgtttacatcttcttcttcgcgtcctcatggggaccggtcgcgtgggttgtcactggtgagctcttcccgctcaaggctcgcgccaagtgtctctctatcactactgctgcgaactggctgcttaactgggcgatcgcctacgccaccccatatatggtcgactctggtccgggaaatgccaacctccagtcaaaggtgtttttcatctggggaggattctgcttgattgctggaatatttgtctggacctgcatctacaagaccaagggtcttaccctttgggaggtcgatgccctttacgccaaggttcccgttgcctggcgctctaaaggctttgttccgtccgtgcattacacagacgtgcgctacgtt

SEQ ID NO: 36716 - DNA, 652 bp, Aspergillus nidulans
gactctatcgagcgtattgaccagaggtacgaccctcccccgaaccagaatgtcatacgctcacgttacagacccctggaatcgccaaacgaccttcatagcggcgatctgacctatcgaatgttcgacgttggtggtcagcgttctgagcgaaaaaagtggattcactgcttcaagaacgtcaccaccattcttttcctggtcgccatttccgaatacgaccagctgcttttcgaagatgagactgtaaaccgtatgcaggaagctctcactctgttcgactccatttgcaactcccgctggttcgtcaagacctcgattattctcttccttaacaagatcgaccgctttaaggagaagctccctgtcagccccatgaagaactacttccccgactacgagggtggtgctgactacgccgctgcctgcgactacatactcaaccgcttcgtctctctgaaccaagcagagcagaagcagatctacacacatttcacatgcgccacagacacgacacagatccgatttgtcatggcagctgtaaatggtaagctattatccttcacagttggttcttccttcgctaatgctctcggtagatattattatccaagagaacctgagactctgtggtctgatttaatgatcggta

SEQ ID NO: 36717 - DNA, 1665 bp, Aspergillus nidulans
ggcggcctcgagactggcttcttccagatccagttcaaggaccctaaacacttcacctggttacttgttccttcgccagtatgggtggtctgctttcaggcatcgaccagagtaccatttccggagcgaacttgtaccttcctaaagacctgcacttggatgcaaggcagaacagtctggtcaactcagggatgccgctgggcgctgttggtggtgctttgattctgtcgccttgcaacgagtaccttggacgaaaatggtcgattattatctcgttgattctatatactattggtgctgcgctcgaggcggggtcaattaactatggtgggtttgattttcatctctggtcctatatgacggctggctgacggggcttacctaggcatgatggtcgctgctcgtgttatcctcggcgtcggtgtcggtctcgagggcggtactgtccccgtctatgttgcggagaccgtcgagcgccgcattcgcggtaatctggtttcgctgtaccagttcaacatcgcgctcggagaggtcctcggatatgccatctctgccatgttcctgcgcgttcctggtaactggcggtatatccttggctcatcgcttgtcttctctactatcatgtttgttgggtacgtcgaaccatatctgcaaattcatacgaagtcttgctgaccccttgtctcgtagaatgctctttctccccgagagtccccgtttcctcgtccatcaaggcaaaaccctcgacgcatacaaagtctggaagcggattcgcggtattcagaccgttgaagcccgcgacgagttcttcgtcatgacggcttccgtccgtcaggaagagaatgaggtccatgaaggcgcccacaacaagcgcttcccctggatggatttcttcacgtaagcacctccgtcggcccttggcgctctttccgcccaccataaccgtcctgattcgcaccatactgacatgtctacagcgtcccgcgcgcccgccgctccctcatttacgccaatatcatgattatccttgggcagatgacgggtatcaatgccatcatgtactacatgagtgtgcttatgaaccaaatcggtttcaacgaggaaaatgcaaactatatgtccctcgttggtggcggctccttgttgctcggaacgatccccgccattttcctcatggagtctttcggccgccgcttttgggccattgttacgctccccggattcttcatcggtcttgttctcattggcgctagttatcaggtcgacctcaagacggaccttatgaccgtcgaagccctctatcttaccggtctcatcgtctaccagggatttttcggctgctacgcctgtctcacctgggtcgttccatcggaagtatacccaacatacctccgcagctacgggatgacaacctctgacgccctcctcttccttatgtccttcatcgtgacatacaacttcacggccatgcaagaagccatgggcaagacgggtctgagtctgggattctacggtggcattgcggccgtcggctgggtgtatcaggtgttctttatgcccgagaccaaagacaaaacgcttgaggagattgaggaggtgttttcgaggcccaccatggatattgtgcgtgagaactgggcaggtgttaaagagacgtgtgggaac

SEQ ID NO: 36718 - DNA, 1830 bp, Aspergillus nidulans
gttcaagctatagcggacgttctcgggccagacgcagtgaccatggacgaagacgacattgatatgcattcatacacagaggtttcgacatcccattgcgcaacaagaccagtggcggttgtgaggcccaaaaacactgaggaagtctccagcattgcacgtatatgctcagagtataagatcccgatgagtatgcctccgcgagagcgattttataacaggcaggaattgacaagcactgcaatgcatagttccatttggcggcggatccagcgtcgagggccatttcacggctccgtattccggactaagtatcgatttctcccagatgaatcagatagttgccttccacgaggacgagtacggcatcctagagatggattgtacgcttgctgatacttgatagcatggatgtggtcgtccagccgggcgtaaactggatggatctcaatagagagatcaaggacagtggcctattcctgcctatggatccgagtccaacggtaagctcgcttacctttcattgtgagtattactcacatggctccaggcacttattggaggcatggttgctacgaactgcaggtatcttttaccgccagagctaaaggaaacccagatcagagctgataccatgtccgtagtggaaccaacgcagtccgatacggtacaatgaaggactgggtaatcaacctaacagtggtcctggccgatggctctatcatcaaaactcgccaccgagcccggtatgtagcccagatcccttgactttgttcaccatgaacggaactgtttatctaataagcccagaaaatcatccgctggctacaacctcaccggcctgttcaccggttcagaaggtacattggggatgatcacagagataacactcaaactggcaccaattcctgagaagcagagtgttgctgtagctaccttccagtctattcgggaggcggtagcctgcgcttcaaagatcatacgccagggtatccccattgccgccttggaacttatggacgaagtacaaatgcaagttttgaatcggaatggtggtgctggtggtagaatgtggcgggaggagcccacattattgttgaagtaggtacatttctgcaattccctcgtcacagcgaactcctataactcactttgtatgattagatttgcaggcaccagtcaatctatagacgcagacatcggacgagttcagagaataatcccggaggaaggggggaagagctttgaatttgcgcggacggaagcagaaaaaggtaatctctgggctgctcgcaaagaagctgtttgggcgatgttggcgcaaagacccgaaggtacgcagctatggtctactgatgttgctgtgccgttgtcgaggacgccggagattattggtaggtggcaagtccttgcctacctcagtggttctatgctgtactaagacctgagttcctgagttcagatctatcaaagaaagagtgcgagggtcttgggctattctctagtattttgggacatgtccgcgatgggaactttcatcaagctgtcgtgtatgaccctagtagcccgactcagacccagatagtgcaggaatgtgttaggaaaatggtgcataaggcggtagagatggaggggacggtttcggtttgtcccctcgaagtactatactagcggatcactaatttagctggcgtatcccagggcgaacatggaattgggctaggcaagaaggagtgtctgcttgaagaactcggcctagaaacagttgctttaatgcggacgttcaaacgaagtgtagatcccaagtgagttacttgtaccaggatcaca

SEQ ID NO: 36719 - DNA, 606 bp, Aspergillus nidulans
gtcgaaaaataccgcccagtatttcttgacgacgttgtcggcaatacggaaacggtagagcgtctaaagatcatcgccaaagatggaaatatgcctcatgtgattatttcgggcatgcctggtattggaaagacaacttcaattctctgcctggcacggcagttgctgggtgactcttataaagaggctgttttggagttgaacgctagtgatgagagaggtatagccgcccctaagttggcaataatagtgttttaactcgtcggtttatgaaggtatcgacgtggtgcggaatcgtatcaaagggtttgctcagaagaaagtaacgctgcctcctggtcgtcacaaaattgttatacttgatgaagccgataggtacgtgtacgcacatgtgttctaaacttgccacttacggggtttctagtatgacatccggcgctcagcaggcgttgcggcggacgatggaaatctactcctctacaacacgattcgcatttgcgtgcaaccaatcaaacaagataattgaaccgttacaatcccgatgtgctatccttcggtacgccagattaactgatgcacagattgtgaacgattgaagcaggtttg

SEQ ID NO: 36720 - DNA, 1627 bp, Aspergillus nidulans
acgttacattcaccttcgaagttggtacttttcttgccctaaccccgtgataagtgctataccttaccagcctctcacgaagatgacttttatgggcctggttggttcatctttggccacggctcgaatttgcatgatcctcattccagccttcctcctattcggctacaaccagtccaacctagggggcgtgctggattatccctccttcacccggaacttccccagcatcgatacgagcaacaccaagggagcagtcaaagaccacaatgccactgtccaaggtaatcaatatcagtctcctattctcctcttacgtttgcttttatgtttgctcgcagccctatccacattcagttacttaccaaccgcgtcttctctaggcactatcgtcgctgtctacaccctcggctgtcttgttggctccctgggggtcactcaactcggcaaccggatcggtcgtcgcaaatccctcatcgtgtcagcagttgtagctacagtgggcctggtcatacaagcttcatcatacagcctgggccaactcgttgttggtcggctcgtctctggcgcaggtaatggcggcgtcaatgcgatcgtccccgtctggcagagcgagtgcacccagccgaaaagccgcggcaagaacgtggtcatcgtcggtgtgtttattgccagtggtatagcggcggccggctgggttaatgtagggctttcctatctggaagaaagcgaggtggcatggcgtttgcctctggccataccaatcctcttcacgctcccactcatgactctgaccatgacctttcccgagtcacctcgatggctcatcagcaacgggcgcagggaggaagctcatgctgccatatgggcgctcaccgggcgcgaggagtccactgctgagatgcaagagttggaacgcgtcctacaacaaacgcccacccaggaacggggtttcatggatctgctcataccaggaccccaacgtctcttttacaggctctgtctcgctgtcggtatcaacttctgtgctcagatgaccggcgctaatgtcatctcctactacggcaagaccattttccgcgactccctgggcctctcgggtgacaaggcatcgctcctcaacgcgggcgtcctgacctggaagatcttcgctgcgatatcggcatacttatccgttgatcgctttggccgcaagcccctctttatcaccgcctgtctagggatgggtctctccatggctggtctggctgggaccgtctgggcgatcgagaaccgaccgggatctacgctcggcgcatctgtcgcagcgaccttcttcctcttcctgttcatgaccttcttcccccttggcttcctaggcgcaaacttcctcctcggtagtgagattgcaccacaggatctgcgtgtgcatcttgccgctgtcggcacggcagcgcattggcttttcaactttgtgatcgcagaaatcacccccgttgccttcacaacgatcaagtaccggtactatattgtttatgcagtaatcggcgtctccgcctcgatcatggtatacttcttttgcccagagacaaaaggtcgctccctagaagagatggatagtctcttctctgagcccgaggcatggtgg

SEQ ID NO: 36721 - DNA, 863 bp, Aspergillus nidulans
ggcaagttcgatacagagttcatcaaccgactacccccgagctgcaaatatatctgtcacaacggcgctggtacgcgagatcccatattttttcccttcctgcagagccatagctaattgagacgagcggagaaggatacgacccaattgacacagacgcctgcgccaagagaggcatcgtggtcaccaatgcgccagatcccgttaccgatgccacggccgacttggccgtcttcatgctcctggagccactgcgtcagttcaatcccgccatgaactcgctgcgagttggcatattcaagacaggtgtcgccgtcggcaatgacccgcagggtaaggtgctcggcatcctaggcatgggacgcattggccgtgcgatcaagaaacggtgcgatcccttcggtttgaagacagtctaccacaaccgaactgtattggcaccggagcaagctgcaggtgcggaatatgtctcgtttgacaaattactggccgaaagtgatattatcagcgtgaatgtgccgctgacggggcagacgaagcaactcattggcgcggcggagctggcgaagatgaagcgcggcgttatcatcgtgaacacggccagaggtgcgattctcgatgaggcggcgttggcagatgccctagagagcgggcatgttggggccgcaggactggacgtctatgagcgggaaccggaggtgaatgaaaagctccttaagcaagagagggccctgatggtgccccatgtcggcacgcacacggcagagaccctggcaaagatggagacttgggcaatggagaatgcgcggcgggcaatcactggagaggccctcttgtcgccggtccctgagcaccaggggcta

SEQ ID NO: 36722 - DNA, 1101 bp, Aspergillus nidulans
gttataacccagatgacccagttcaacgcctccatcggctatctctcttccatccaacaaggggtttacgttgcctcgatcctactctcgtcctctgtatcctccttgacaagcggccgtgtctcggaccgcatctcccgcagatacggcatcctcattggaaatgttatatcgctccttggaaccgtcatatcagcttgctcacccaacttcgccagcctcatcgtcgcgagcctcgtgactggtgctggtatgggacaggacatctccgtaaccacagtgtatctggtggagattgcaccagttgctatccgtggagttgccgcttgtttgctgcagacttgtgttgttttcggaattatgacggggtactttattgcgttcgggtcgtcgaatatcgcggggaattcctggtcgtggatagtgccgttcatcgttcaggccgtggttgcagcggttctttctctgggaatggtccttgtcccgttctcgccaagttggcttgcacaaatagggcgtaacaatgatgcgaagaaggtgcttttcaaattacggcctgtggcgacggtagaagcggagtttgaagagataaggcagagtctggatccggagaagcagcaacaaacggcgagtatcaaagagatttttaagcggaagtatagaagtaggaccgtgctagggatctttctcaagtcattccagcagttgaccggggtaccacaggaccctcagcttttttttttctaacatagttagggctaacatggacacctacagattgacgtggtgctgtactacgcaccaatcctttttcagcaagccggcttcacgtcccagcgagcctcgttcttgtcctctggggtgatcggcattgttatgctggcgtgcacagttcccccgcaaatctgagtcgattgctgggggcgcaagacgccgttgatcatcggcggagcggcaatggcaatctgcttcattgtcatcggatcactttacgcgcgattcggccgtaccgaagggaacaaagtagccctcgcctctgactctgctcaatgggttgtgattgtcctgatctacttcttcgtcgctaatttttctcggtct

SEQ ID NO: 36723 - DNA, 637 bp, Aspergillus nidulans
gatgtctcgaaccccgactctgttaataatgccctctcagaggtcatcgcaaagcacggcaagattgaccatctcgtcacgtctgcgggatttaccgaaaacttcgacgccatcagctacccatacgaccgtatgcagaagctctggggggtgaacgtggacggcacatatctgtttgctacgggcgtggcaaagcacttgatggagcgcaaggcgcccgggagtattgtgatgatcggtagcatgtctggtgccatcgtcaacgtacctcaaccacaagcgccctacaacgccgccaaggcagccgttcgccaccttgcttcgtctttcgccgtcgaatgggcaggacatggtatcagggtaaactgcattagccctggatacatgctgactgctctgtaagttgcccgaatctttacaaaatagctgagcacgaactatatgctgatttgttgcaaccaggacccgcaaaatactggatgagaaccccgaactgcgggataagtggatctcgcttatccccactggcaagatgggtgtacccgaagatctgatgggcgcggtgactttccttctcagcgacgcgtccaagtacatcactggtgccgatctccgcgtggacggtggctacaccttg

SEQ ID NO: 36724 - DNA, 1405 bp, Aspergillus nidulans
gcaggctcgaaagtggtggagaaaggttcagtcgacggcgctccggccgcaaaactacacattactgagctacctatgacatggtcaaactggtatcagcacgtcaactggctaaattgcttctttgttctcttcattcctcttgtcggatgtataggggctatctggactccattgcggttgcatacagccatatttgcaattatttattacttcaatgccgggctcggtatcacggcgggtaggttcttccttgctgtttctgctatgggagctttgagagagaggattaactgaccgttcttgtctagggtaccaccgcctctgggcccattgttgctacaaagccaccctcccactacagatctacctcgcccttgctggtgcgggagctggtcaaggctcaatccgatggtggtcccgcggccaccgagcacaccaccgctatacagacaccgaaaaggacccgtactctgtccggaaagggttctggtactcgcacatcggctggattatcatgaagcagaactataagaaggtcgggcggtcggacgcgtcagacctcgacgctgatccggtggtgatctggcagcataagaactatatcaacactgcactgttcatgactctcatcttcccgacattggtctgtggacttggatggggcgattggcgcggcgggtttatctacggggggattttgcgagtgttctttatccagcaggcgacaaattgcgtgaactcgctggcgcactggataggcgagcagccgttcgatgatcgcaattcgccgcgggaccatgtcatcacggcactggtaactctgggcgaagggtatcataatttccaccacgagttcccgtctgactaccggaatgccattgaatggtggcagtatgacccgacgaaatggatgatctggatctggaaacaggtcgggctggcatacgacttgaagcagttcagggcgaatgaaatcgagaagggaaggctgcagcagatgcagaagaaggtggacgctcgacgggcggcgctggattggggagttccactgaaggagctccctgtctttagctgggacgagttcattgctgagtccgcgaaccgagccctggttgcaattgggggtgttattcatgatgtctcggatttcataaaggagcacccgggtggaaagacattcatttcgtccgcggtcggtaaggatgcaacagccatgttcaacggcggtgtttatcaacattcaaatgctgcgcataacttgctcgcaatgaagcgggttggcgtggttcgtggcggaggtgaggttgagatctggaaggacgcaaagcagccttcgaaagtgagctttccagaaatggttcgtgctggagagcaaataacaagaaggactgtgccggtgctt

SEQ ID NO: 36725 - DNA, 2455 bp, Aspergillus nidulans
attaataacgtcgagagcaatgacacagtcgacagaaatgccgtccttgacgaccacgatgcggagaagatcctcccctacgaagcggacgattcgcctttcccggaggtgcgagctgtcgttcggcctgtagacgacgtagaattgcctctcaatacgatccgaatgtggataattggcattcttttcacaattgtatgcgcacctttagcggtttgacctctcactttttcactttccggagctgactgagagtgctatcttaaggttggcagtggattaaatcagttttttagtctacggcaacctagtgtcagaattagtgcgctggtcgctcaactggtagcatatccaatcggctgtgcgtgggcaaaatggatgccgttgggctggctcaatccagaccgccgcttcaacatcaaagagcatgccctgatcacgataatggccaatgtctccttcggatcagctgcggccactcaggtcattgaggcaatggtcaaattctaccatatgccgtcgcaaggcggctttcaaatactcctttgcatcacgactcaactattcgggttcggcgtcgctgggatggtttcacgctggctcgtggaaccagcgactatgatctggccgcaggtcctgtcaaatgcagcccttctttctaccttacactcgaaatccaacaaggtcgccgacggatggacaatcacgaggcagaagttcttcctccttgtcttcgttggcggcgccctttggtattttcttccggggtatttgtttaccgctcttagtatgttcagcttcgtgtgctggatagcaccaacaaatgtcgtggtcaatcagcttttcgggcagaaaaccggattgggaatgtcgcttttgaccttggattggtctcaagttgtcttcgccaacgacagccctctcctagtccctttctgggcaggtttaaacgttatgggatcgtttgtccttttcttctggattctggttcctatcatctattatacgaacacatggtattccgcttacctgccgcttctggactccaacaccttcgataacactggtcgcatgtacgatacgcgccgtgtaatgaacattaacaatggcacagtcaacgtggaggcttaccgaaactactctccgatgttcatacccgccgggtttgccgtcacatatggcgtggcatttgccaatctcaccgggatattcgttcacacagcactataccatggaaaggacctacttcagcaatggagtggtcgacacaaaaaagatatccattctcgacttatgcaatcatataccccagtaccctggtggtggtttggtgcagtaagccttctgatgttcatactcagtattgtgaacaatgaggtatgggaaacgcgcctgccggcctggggcgtccttcttgccttcgtgttgccgataatatatttcatccccgtgggcattattaaagccttgacgaacattacgagtaaccaactgaatctaatcactgaatttatcggtgggtatgcctttctcgggaagcctgtcgccaacatggccttcaagttctacgggtatgtgacggtctcgcagggactagagtaagtaccaacagtcaattatcatgtgtccccaatgtctctaaatgcaattccagatttgtcgcagacatgaaactggcgcactacctccacattgcaccgcgcaccctctttttcgcgcagggtctcgctacactcattggcgcaattgtgcaatgcggtgtcacggtattcatgctcacccgtttcgaaggcatctgcaccccgcatgcggacggcggcttcacctgtccgcacggtttagtcacattttcctcatctctgatctggggtacgtagtgaattctacaacctgatctatagacctctaactaattgtcattaccaaaccaggtgccttgggccccgcccgcaacttcagcccaggtcaaatctacgggaatctcctctggttcttcctcgccggtcctgtggttgtcattatcacgtaccttcttgggcgccgctggaaggcagcaaactacatatcttggcccgtcgcattcggcgcaatgagcatggtcccgcctgcgacagggatcaacttttcgtcatggtgggttgtcaatgttatcttcaacggtcttgtcaagcgcaaacggccagcttggtggtcgaagtatagtacgtcatctcttgcttcagtccttcttcaaaaatgtgtacccggctaacagtacccagactatgtcctcagcgcagccttagattcaggcgtcgctgtttccaccgtcgttatctttttttgcatcatgctacctgctgggccgctgaggtggtgggggaacgaagtcttcatgagaacggccgatggtcgtggcacgccgtggaagactgttcccccccatgaacggttcgggccttcgacctgggaataa

SEQ ID NO: 36726 - DNA, 1062 bp, Aspergillus nidulans
aaagtctggcataaccctgttcatgaacgtaacgagaagaacgagacggagacgcagaaggcctgcttcaagtttctggacctcacaagtcggagtttcagtgctgtgatcaaggaattacatccagagctgcttttgccggtctgtgttttctatttggcacttcgtgggcttgatacaatagaggatgatacctcaattccccttgaaaccaaggaacctctactgcgcaacttcaaagacttcctagagcaagatggttggacttttgatgggaaccgcccggaggagaaggaccgtgagctgctggttcagttccacaacgtcgttactgagttcaggaacatgaagcctgcctaccaagtcatcatcaaggatatcaccgacaagatgggtaacggtatggctgactacgcgcgcaaggctacctttgaagatgcgagtgtaaagactgtcgaggagtacgatctttactgctattacgtggctgggttagtgggtgaaggcttgactcgtctctttgtggaggcagagtttggcaaccctgctttgctgaagcgcacacgtcttcacaagtctatgggtcttttcctccaaaagacaaacatcattcgtgatatccgcgaagatgaggacgatggtcgacgattttggccaaagtccatctggtcgaagcacgtcgataattttgaagacctgtttaagcccgagaaccgggaggcggctctcaattgcaattctgagatggtcctaaacgcactggaacatgtcgaggactgtctcttctaccttgccggtctgcgcgagcagagtgttttcaacttctgcgctattccccaggccatggcaattgctacattggaactttgcttccgtaactacactatgtttgaacggaacatcaagataaccaagggtgatgcctgccagctcatgacagagagtacacaaaatctccgagttctgtgcgacgttttccggcgctatgtgcgacggatacacaagaagaacacacccaaggatcccaatttcctaaaaatcagtatcgtctgcggcaaggtc

SEQ ID NO: 36727 - DNA, 3976 bp, Aspergillus nidulans
ttgactcccgaagagaagcgagtcttctaccagctctttcaagctgccgatacaacaaaccttggcgttattacaggcgagatcgctgtcccattcttcgagaaaaccaagcttcccccggaaaccctcggattggtatgtcgaaatcccagcatcgtaaagtgcgcaagatgcatttcgtctaatggtttgattcgttcgcgacgctagatatggcaaatagcggataaggagaacagggggcttttgactccctctgggtttggcatcgtgatgcggctgataggacacgctcaggctggtcgcgcacccacagatgaactggcattacaacgtaagtggtcttgcagtctggaactgcttcatttgctacgttccgggacgttcccgtgacttccggcgtggtgctgacgaactatagctggtccattacctaaattcgatgggattacagttgatgccgctgcgccttctccgcgcgatgctggcgcaagcagtccgcagccagccccggggcccattcgagtcccacctctgaaccccgaggatgttaacaagttcgtttcattgtttgagaagtctgacgttaccagaagcggaactatatctggtaagcatagatctggttccatgaatcctgctttacgttgacgtgtgaactctaccaccaggcgaaaccgcgaaacagatcttcgaacgcgcaagactcccgaatgagatcctgggccggatatggaatctggcggacaccaaacaacgcggagtactcgatacgacggagttcatcatcgccatgcacttgctaacttcgtttaaatctggtattatgagaggaattcctcaagtcctgccaccgggtttgtacgaagcagctgctcgacgaggtgctagccgcccttccttcagtggcccaaggcctggacttgatgttcctcctgtaccggcaatccccaaacaattcacaggacctcaacggacccaaagccccatcaataggcaacagtttgggacccctctttcaacacaatcgactggtggcgactggcttatttctccgcaggagaaactccagtttgacaactacttcaatactgtcgatacgacgaaatctggggttataagcggcgatcaagctgtagcgttctttacgaaggcgcagctacccgaggagaccttggcgcagatttgggatcttgcggatattgatgctgatggccagttaacgagggatgagtttgccgttgccatgtatttgattcgccagcaattcaccaacaagggccccctaccgcagactttaccacccgctttgatacccccaagtatgcgccgacccagttccacgcacgcagcgccggtccctgctccagttgcagcttcgtcccaccctcctgctccggttcacaccgctgcagatgacctatttggactcgatccatttgcaacaggtcctgcaccctcggctccggctcctgttcctgctcaagttccacagtccacgggcaactcaaattcacctttcgcaactccgagctcaccaacccgccaaacgtctccaccgggcagcgcaacagccttcaaacctttcatccccacatcaacgttcggacaaagcctgcagccgcaggcaactggtgcatcatccgttccttccacagctaaatctcctcaaccctccgatgaccttctcggggacaatgatcctgaagaatctaacaagttgacgcaagaaactaccgagcttgccaacttatccaatcagatcggctcccttgcgaatgagatgcaaaacgtccagacaaaacgaagtgctaccgagcaggagctatcccagacctctcagcaaaaacgtgattttgaatctcgtcttgcgcaagctcgcgcaatgtacgaacaggaggtcaagcatttcaaagagttggaggaacgcctgagaacctcgaaagctgagacgaccaaactgcagcaggagtacgctttgattgacggcagtagacaggatcttcagaaccagtacaaccaggtgtctgcggatcttgcggctgatcaacaggaaaatgcaagcctgaaggagaaaatccgggaagctaatgcggcagtggctcagttgaagcctgcattggagaagatccgttccgaggcacggcaacagaagggcttggcagcaattaataagaagcaactggctaccgtagagggagaaagggataagattcaagaagaacttggcgagttgtcgaaggagcaaacagtggagcccgagggggttgtgtcccctgtcagcaaccctcctagagtggcaagcccggctacctctacaactagccagcaaactaatcccttcttcaaacgcacgatgactggctcgagtgagagcaataacgttacttctcctcagatttcgaacgaccagcaacgtgcttttgataatctctttggcccttccttcggcgctgctccagcaacggctgcgactcctcctcctccgacttcgttccgtgccgattctcgaacggactcagtaaggtctccgtccggctctggagttccaaccccttcaatatctcctcctccatcctcggctggtgcgttcggctcggaaccaccacctccggctctatctaggcagatgaccccgaatgctcttccattgactggaacgctctctgagaccacttccaccaaggtttctccaccaattagtcgattcggtacccaagaagcatctagcgtcggaactccatctcaagccgagggcagtgacgctcgccccacttctgcctctccattcgatgagactgaggattccaaggagcgatttcccacagtgcctggcgcctttgagaccccttcgggaaccactacgtctcaaggtagtgaggagaaaccagctgacacaaaggatccaagctttgacgaactgtttggcggaccggctcatcagcggtctaaatcacagcaaaataatgacttcgaagaggcttttgctgccatgaaggcacctaacgcggcaaatacccaaggagcgccagagtctgagttcccgcctatccgtgagattgatgatgacgacgatgatagcacagatagtgaaacacagttgggttttgacgataactttacgcctgtcttccctcagagtcatgcagtctcgaaatcagatcagatcgagccatcgcaacttgatgctttcccggctccgggggcatcaagtaccccgactgggcctcctcctgctgcggaagcgcaacccagtcctccaaagtatgatgaagacgctgaaaaacaagcttcaggaaacattcctccagagtttggtggcttgcttcccggaagggccgacccaactcttcccccagacgctcctcattcaatagagactacaaccggagcgcctattgtcggcggagaggctcagaataacgtgacaaaagcagcgccacctgctcaagccccaaacggaggcaaggcgcctgatttcgaggccgccttctcaggattgaaccttgcgcccgcaaaggaggcagatgacgatgatgatgatgacgacttccctcagtctgaaggcaaacctaacatggattttgatttctcgtttgattccggagcttcccagcatgagaaggctgccgctcctaccagcacatctggaactgcgagctccgatttcttcagcttcgatcagaatgcccatgcttccgcgtcctctggcccagtaaaccccaacgcgaaatccgaagatcacgattgggacgctctctttgcaccgctggataatatgaaatcaccaggcacagaggcgacaaacgcaactgccccttcaacctcttcccccagctcgaagcaacctggttgggcccttcagactgacacacaggatgatcccaacctccagcgccttacaggaatgggcttccccagggacgcctcccttgcagccctggaacagttcgactacaatattgacaaggtatgt

SEQ ID NO: 36728 - DNA, 863 bp, Aspergillus nidulans
gtcgagccctacaactctatcctcaccacccacaccaccctcgagcactccgactgcagcttcatggttgacaatgaggctatctacgacatctgccgccgcaaccttggcattgagcgccccagctacgagaaccttaaccgcctgatcgcccaggttgtctcatccatcaccgcttctctgcgtttcgatggctccctcaacgttgatctgaacgaattccagaccaaccttgttccctacccccgtatccacttccctctggtggcctactctcctgtcatctctgccgacaaagcctctcacgaagccaactccgtccaggacatcaccatgtcttgcttcgagcctaacaaccagatggtcaagtgtgacccccgcaacggcaagtacatggccacttgcttgctgtaccgtggtgatgttgtccccaaggagacccacgctgccgtcgctacccttaagaccaagcgcactatccagttcgtcgattggtgccccactggtttcaagattggtatctgctaccagcctccccagcaggtccccaacggagacctcgccaaggtcaaccgtgctgtgtatgttcctgtcttaccccttgagaaagagaaatctgaatctaattcgtgcatagttgcatgctttccaacaccaccgccatctccgaggcctggtccgctctcgaccacaagttcgacctcatgtactccaagcgtgctttcgttcactggtacgttggcgagggtatggaggaaggtgaattctctgaggcccgtgaggatcttgctgccctggagcgcgactacgaggaagtcgccagcgactccctggaggaggagggtgaggaagttgagtactaa

SEQ ID NO: 36729 - DNA, 1252 bp, Aspergillus nidulans
tcagtcgttggtgccggtgtcctcgccatgcccctcgccatctcacacatgggaatcgtcctcggcatatccgtgatactgtggtctggtgtaaccgcggggttcgggctctaccttcagtctcgatgcgcgcagtatcttgacaaaggaagcgcttcattctttgcgctgtcgcaaatcacctatcccaacgctgctgtgatatttgatgcggcgattgcgattaagtgtttcggtgtcggggtcagctacctcattatcatcggggacctgatgccgggagtggttcagggcttcgttggggaggcggcgtatgatttcttggtggatcgccatttttgggtgacggcgttcatgtatgactattggtcctaactggtggtatgcgttgctgaccggaccaggttgattattattccgctctcatatttacggcggctgacatccctcaaatatacaagtatcgcggctctggtttcaatggcctatttggtgattctggtcgtttaccatttcatcattggggacacaaaagagggccggggtccgatccgtgtcattcgctgggcaggtgctgttccgacactcagcagcttcccggtgatcgtattcgcttttacgtgccatcagaatgtgtgtctcctcttggctggtggaaattgacgtgctaacccgtgcagatgttttctatcctcaacgagattagcaacaacagccactttagaacgacagcagtcgtgctcgccagtattggaagctcagctaccacctatattctcgttgctattacgggttacctgtcatttggcaacagcgtgggcggaaatatcgttggcatgtaccgccaggcgtatgggctacaattggacgtgccgctattgtcatactcgtcatgttctcctaccctctccaatgccacccttgcagggcatcagtcgatgcagtcctgcattggagacccaaacgcttcacgcgttctcgaagcgaaggctcccctcaccgccaccctctacttgccgctggtccccgaggctctcgaacaccagaaccaatgagtgaccttcgattctctgtaatcacgacgtcgatcctcattctgagctacattgtcgcgatgagcgtctcctcactcgaagccgtccttgcctatgtcggcagtaccggaagcacaagcatcagctttatcctcccgggcatgttctactacaagatctcagctccagactcagcagcgcaccagcgtctcatgaaa

SEQ ID NO: 36730 - DNA, 1618 bp, Aspergillus nidulans
  unsure (1)..(1618): unsure at all n locations
tacgactatgtgatcgttggaggtggtactgccggctgtgttattgccagccgtctggctcagtaccttcctaacaagaggatcctcttgattgaggccggtcccagcgattacatggatgaccgagtcctcaaccttagggaatggctcaacttgttgggaggcgagttggactacgactaccccacagttgagcagccgatgggtaagaacacttattcggcgggaattcaaggcactagctgactttctcgcaggtaacagccatatccgtcactctcgcgccaaggtgcttggaggctgctccagccacaacaccctgatctcgttccgtccgtttgagtatgactgcaagcggtgggaaagccaggggtgcacggggtggtcgttcgagaccttcacgcgcgtgctcgatagcctccgcaacaccgtccaggccgttcacgaccgtcaccgcaaccacctgtgcaaggactggatcaggtcctgctcgaccgccctgaacattcccatcatccacgacttcaacaaggagatccgttccaacggtgagctgacncagggtgttggtttcttctcagttgcgtacaacccggacgatggccgccgcagcagcgccagcgttgcttacatcccaccctatcctgcgcggtgacgagaagcgtcccaacctgacgatcctcaccaacgcgtgggtgtctcgcgtcaacgtcgacggcgataccgtcaccggtgttgatatcaccctgcagtccggtgccaagcacactctccgtcccaagaaggagaccatcctctgtgccggtgccgtggatacccctcgccttctgcttcactccggtctgggccccaagcagcagctggcctctcttggcatcccagtggtgaaggacattcctggtgttggcgagaacctgcttgaccaccctgagagtatcatcatctgggagctcaaccagcccgtgcctcccaaccagaccactatggactccgacgcaggtatcttcctccgccgcgaggcacccaacgccgctggctccgacggcagcgccgccgacgttatgatgcactgctaccagattcccttctgtctcaacacgtcgcgcttgggctatgacactcctgtcgatgccttctgcatgacccccaacatcccccgtcctcgctcccgcggccgtctttacctgacctcctccgaccccaccgtcaagccggccttggacttccgctacttcaccgaccccgagggctatgatgccgccaccatcgtccacggtctcaaggccgcccgagagattgccaagcaatctcccttcaaggactggatcaagcgcgaggtcgcccccggccccaaggttcagaccgacgaggaactctccgagtatggccgtcgcgttgctcacaccgtctaccaccctgctgtacaaccaagatgggtgatgtgacccgcgaccctatggccgttgtcgatcccaagctgaagattcggggcctgaagaacgtccgcatcgccgatgccggtgtcttccccgagatgccaaccatcaaccccatgctgactgtcttggccatcggcgagcgcgccgccgagcttattgccgaggaagctggctggaag

SEQ ID NO: 36731 - DNA, 1537 bp, Aspergillus nidulans
atgactccttcgctccagcgccagctcttctacgacggcaaaccccagcacgcctcgtccggccggactttccagtccatcaaccccgccgacgccactctgctggctgaaatccccgtcgcttcacagtcagatatcgacgctgccattacagccgccgagcgcgcattcccttcatgggcgcaaacgccgcctattgcccgtgcgcgtattctccagaaggcggcggccttgctgcgcgaacgcaacgatgagatcgcccgcgtcgagactctagattccggcaaagcgtattcagaaacgagcaccgtcgacgtcgtcactggagctgatgtactggaatactatgcaaacctcgtgggcggtggcggactgaatggagagaccacgcagcttcgggaagaggcgtgggtgtattcgaagaaggctccgctaggggtctgcgtgggaattggcgcatggaactaccctattcagatgtaggctcccttctccccgttcagagagaactttttgaaggacaaacaataaccaaggctgactgactagcgcgctgtggaaatccgctccctgcctcgccgccggaaatactatggtctacaagcctagcgaattcacttcccttcacggtcaaaccctcgccgaaatctacaaggaagctggtcttccagacggcgttttcaacgttgtatacggtgccggcgatgtcggttcctatctcacctcgcacccgaccgtcgccaaggtctctttcaccggccaagtctctactggcatgaaggtctccggagccgcagccggaaatatgaaatatgtcacgatggagctcggtggaaagtcgcctcttcttattcttcctgatgcagatctcgagaacgcttgtgacggcgccatgatggccaatttctacagcacccgcccaggtctgcacaaaccgcacgcgggtttcattcccaagtctatgaagaaggactttgagtcccgtctcgttgagaaaatgcaatatatccggccaggtccgctgttcgatgagaacaccaacttcgggccccttagctcggccgtccaccaggagaaagtcaccgcttatattcgccacggcattgagcaggacaaggccacccttctttacggaggccttggcaagccttctctgccgaaagacctcgaagcaggcttctgggtccgtccgacgatcttcaccgattgcacggacgacatgcgtatcgtcaaggaggaaatttttgggcctgttatgtcaattctgacctacgactctgtggaagaagcagtcaagcgcgccaatacgacggagctgggtcttgccgccggtgtcttcacgaaggacctcaacctagcacaccgcattattgaccagctcgaggcaggtatcacctgggtgaacacatggggcgagagtcctgctgagatggccgtcggtggctggaagaagagcggtcttggcgtggaaaatggtcgtcgcggtattgaggcctgggttcggaataagagcacccttgtcgatatgggcaatgct

SEQ ID NO: 36732 - DNA, 1627 bp, Aspergillus nidulans
tacaccgaaccttacagacctcaataccacttcacccctgctcaaaactggatcaacgaccctaacggcctgctctaccacaatggcacctaccacatgttctatcagtataatccgggcggagtcgcgcacgaggcaatgtcctggggtcatgcaacgagccaggacttaacgcattgggatgagcggcctgttgcgttgacggccaggggttttcccggcaagaacatatcagagcagtttttcagtggcagtgcggtttatgacgtggataactccagcggatatggaaatggaatgggaacggctgctcctatggttgccatgtatacgtctttcgtatgttacccatctctgcttatagaatggtcattggatgaaatggggctcgtactgacgaagacagtatgtctacggccagacgcttcccagcggcaagaaggtccgcgcaagccaacaatctcaatcattggcatacagtctcgactctggcgaaacatggactactgatgacgctgtgaatcccatcctcttacagcctccgcacccttacgaatctcagtataaagaatggcgtgaccctaatgtcttctggcacgcgcctacaaaaaagtggattctgacaactgcactgtccgatctgcacaaactccttatctacacctcgactgatctcaagaactggacgctcgctagcgagttcggtccctataatgccgtcggtggagtctgggagtgtcctagtttcttcccgctacctgtagacaacgatgagtcgaacgtgaaatgggtcgcgatcatcggcctgaaccccggcggtccaccggggacagtgggatctggaaaccagtatattctaggccaatttaacgggactcattttcttccggacgccgaaagtttgcatgagcaaggagaggcgaattggctcgattatggaccggacttttatgcggcgctcgtttataatggcctgccggagtttcagcgtactgttattgcatggatgagtaactggcagtatgccgagaaggtcccgacgacggtttggcgcaacgcaatgactattccaagacgccttggtcttaagactatcaatggaaaggtgctagttgttcaagaaccggaagcaaactgggctgctatcatgagcaagccacaaaccacgcgtattttgtctctcccggcaaatagcacgcgtaacctagggtctctagggaagacacttgctgctaatctcaccttctctgccggagaacaaaatggctcttccttcggaatctcccttttggcaacccagaacttcacaacccagacccttatcggctataacttcgccacgaagcacatctttgtcgatagacgggcatcaggaaatacctcttttgacgagacatttgcgtccgtttatcgtgccccgcttgaaccagcggatgatgggactgtgacgcttaggatattcgcagactggtcgagtgttgaagtctttggagggcagggagaaaccactctcacagcccaggttttcccgcccgagggagcgacacatgcaaggctctttgccaacggtgccggtgtggaggacgtgctactgagtgtgagtaaggttgggtctgtttggaactga

SEQ ID NO: 36733 - DNA, 933 bp, Aspergillus nidulans
aagcacgccgtggccatgtccgtcgtccatgccttcaagacgtccggattcctttacctgaaaaatcatggcataccgccatcggtaacatcccgagtattcaagtcctctgcatccttcttcggcagaccccaagaccaaaaagacacattaggctggacaaccccgcaggcaaaccgtggttacgtccgcacgggccgggagaagctaagtacggttgatgaccaggcagaccgcacggtcccagatatcaaagagagcatggaaattggccgcgagggcgtggaaggtctcccaaaccgttggccggatcagcttgacgaagagggcaaagacttcaaaaacgtcatgcttgagttctttgagatgtgcaaggagctgcatattaaagtcatgcaggctattgcgttggggatgaatttacccgtgcattttttcgatgagtacgtggacaagggcgataataacttgcgtctgctgcattacccggctgtgcataaggatgtcttcaagaagaatcctggacaggtcagagctgcggaacatagtgattacgggtccattacacttctttttcaagatcgacgaggtggcctgcaggcgaggagtcctgaggggacatgggttgatgtgacgccattccctgatacggtagttatcaatgcaggtgatttgctagcaaggtggtcgaacgacacgatcaagagcacgaagcatagggttattgagccgccgaaagtgcctggcgcggaggatgatgacactgatatgtacccagagcgatacagcgttgcgtacttctgcaaccctaacatggacaaattcatcgaggctatccccgggacatatggcgaaggggagggccttagcaaggcaaaataccccggaatcacatcaggagattacctagtgcagcgtctctctgcgacgtac

SEQ ID NO: 36734 - DNA, 817 bp, Aspergillus nidulans
ggcctcgggcgcacaatggccctgacgctagctacgaacggcgcatccaaggtttttatcataggacgccgtgaagactccctccgcgaaaccgtctccctcgcccccgactccgccaaacaaaacatcatccccgtcccggcggatgtgacatcccaggaatctctacagtctgcatatgagacaatcgccgcccaaacaggatatgtcgacctcctaatcgccaactctgggatagtaggcccacctgctatcatcaaacgtaaggacgatgggtctcttctccccatctccgagctcaaggactatctctggaacatcccaatggcggagtttaccaaggtctttgaggtgaacaccacaggcgcgtactacaccgccatcgccttcctacctctcctagatgcggcgaataaacgccgtcctgcgccagagaagaataagctgtccccgccgctggctcagattatcatgacctcgagtattgctgggtattcacggcaggttccattggatttcgcgtataatctgtccaagggcgctgtgaatcatctggttaaggcgctctcgacgagtctaaccgagtacgggattagggttaatgggattgcgcctggactgttttactcggagatatcggtgggagcaactttgagctggggataagggtgtccagatgggcattccagcggataagatccccatgactagggctgggggtgaggaggatattgcggggttggtactttggatggcaggtgcttcgggaggttatttgaatggcaatatcacggttattgatgggggaaggctgagt

SEQ ID NO: 36735 - DNA, 2527 bp, Aspergillus nidulans
tggtccaatctcaatgtattgcaccgcaacactctacccccttgggcacacttctactcatacccaaatgaggaggcagcgctcacattcaaccgcgatgagggcctttttcagagtctgaacggcacctggaaatttcactacgatgcctcgccatttgaagctcctatctggaacacggccaatactacggagtgggatgatattatcgttcctggcgtgtggcagatgcagggatatgggcgcccgcaatataccaacatccactatccaatccctgttacgccgccaaatgtgtcgtatatgaaccctacgggctcgtattggcgggagtttgacgtccccgccgactgggatgggcagcagatccgcctgcgatacgagggcgtagacagcgcttttcatgtttgggttaatggcgaggaggttggctacagtcagggcagccgcaatcccagcgagttcgacattacgggttacctctcgtcggaaggcaccaacacacttgctacgcgcgtataccagtggtctgacggcacgtatctcgaggatcaggaccaatggtggctttctggtatcttcagggatgtgtacttagtgccgtttcccagctctgcgatcacagacttcttcattcagcctgaagtcgatgacggattcgctagcggcacgctaaaggtcaatgttactatccagggcgagcacgggaacctcagcgtcaaggtcttgtccccaggcggcaacgtggttgacgaatggactgggtcttcgtccaccatttactccaaggatatcaagggcgacgactttctactctggtctgcggagacgccgaacttatatactgtcctgattgagttcaatggacgcaccatcagccaaaaggtcgggttccgccgagtagaaatgagtggctccaatttccttgtgaatggccagccgattatcatctacggtgtcaatcgccatgaacataactacacctctggtcgaacagttccctacgagtcgatgcgcgcagacttgatccgaatgaagcaatccaacatcaacgcgatccgcacagctcactaccctcagcacccgtcattctacgacgtcgctgacgaactagggttctatgtgataaccgaagcggatcttgagtgccacggcttccgcgatattgcagggtctgaagagaacgccgcggcttggacctccgataaccctgagtggacacatgcataccttgacagggctgagcaactggttgagcgttacaagaaccatccctccgtcatcatgtggtcgctcggaaacgaatgccagtacggccaaaaccaggctgccatgtacaaatggatcaaagaacgggatccctcacgtttcgtccactatgaacaggaccacaatgctgaaactgccgatatatacagtcagatgtattcctcacccgatacaatgctggagcatatggccaaccacacggacaagcctctcattctatgcgagtttgcacagtaagtttccccgccctctataacagcaggctgctgactactccagtgccatgggcaacggtcctggtgggctgaaagaatacatcgagctgttccgttcacatccgctttcccaaggaggactagtctgggaattcaacaatcacggcttgctgaaaaaggagggcgaccttgaatactatgcctacggtggcgactttggcgatgagccgaacgatgcagacttcgtcatggacggcctaaccctctcagaccataccccgatgcccagtcttctcgaatacgcaaagattatccagcccgtctcggtgaatctgacggatgactcaagcagcatggtcataacaaaccactatgccttcgtcgatctcagcggtctcgatgtttcttggcatattgtccaggatggcgaaaccacagaggcccaagagctagatctgcctcctgttcctgccggagaaagccgcactgtggacttgccactcgatccgtcaagcctttcgaaagagacatggctcaccatcgagttcaagctcaaagaagacaaagcttgggcagttaggggccatgtcgtcgcctgggaccagctatattttcccggctcttctgcttctacttcctcaagcaagcgctccactccgatctctcgccagacttcgggaggcctggaagtcaaacaaaaccaaacaagcctccgaatcataaccggcacatcaatctttggcttcaacctgatacaaggaaacgtcacttgggaagccaacggcgcaagccttttccagcgcgggcccgaactctccttcatccgcgccatgacccaaaacgatgaaggccaatccggcaacgaggccgagtgggacgacgcatgggtcggcacgatgcacacccaagtccgcgatgtcacctggcggagctccgacactgaagcaatagtgcacttcaaagtccgcgtcgcgccgcaagtcctcgaatggggcgtcgaagcagacctcatctacacgatatccacagaggactctgtacca

SEQ ID NO: 36736 - DNA, 1035 bp, Aspergillus nidulans
ccagagtatctacagcagatcgactcaacgatggcagcattacgggcgagcaacctgctaggcgacccgttcgcccttgccacgagttccatcgcgatggtatgtcatgaaggcagaagtgtgggcatgcggctgacaagatgctagcttgggtggttgattgcgtttattgcatccatcgccgcggacgtgcaggatccttaccctagttttcaatggtgggccattgcatactcattctgctgtaacgttggagtgattgtggtgtttctcacagacaccggtctcacttacggcgtggcggtacgtttactgtgtccttgtcagcacgctttgactgacaaaactcaggttgtggggtaccttgctgcctctcttgtgatgaattcgatctcggcaaactcgatgttcaattccaagagcacatctagtttccaagccgccggtgctggcttcattctgctgtgcatggtcaatgtaagccactatatgctttttgactcaaatatgttctaagactggcagatcgtgtggactttttacttcggatcggcccctcaagcgaaacaccgtgggttcattgactcctttgcactcaacaaggagaaccaaggctcgtatggcgccaaccgacctatgtcatctgcctacggtgcacgccccgagaccacgacgagccgtccccagatgtatacatccgctcagctcaacggttttgaaacgtcgtcgcctgtctcaggctatcatggcggtgcccccggggagactcgtagcccatcgcaagcccgattcaccagtctcggcggacccaatgccagtaaccctgacaccgtgggagagattccgccgccgacagaatacccatacaaggcaaaggccatctataagtacgaggcaaacccagaagacgccaacgaaattggcttcgagaagggagaagagctggaagtatcagacgtcagcggccgatggtggcaggctagaaaagccaacggcgaaacgggcattgcaccatcgaactacctcattctgcta

SEQ ID NO: 36737 - DNA, 723 bp, Aspergillus nidulans
gaggtcgtcgtcctcacgggcggcagtagcgggattgggcgacagatcgcgcaacttctcgggaaccgcggcatcaaggtcgcgatcctggacatccagcctccccaagacggacaagccaatctgccctcgactgtccgctaccacaaatgcgatatcacgtcgccttctgccatcgccgaagcagccgctgctatacgcacgacaatgggcgagcccacaatcctcataaacaacgcgggcattcttagcagccgcactatactgggcagcacggagtcgcagacccgtctgcagttcgaagtcaacacgctctcacactactggctcgctaaggagttcctccccggaatgattaagaataaccacggcatggtcgttaccgtcgcctcgcaggccggatacactgtcacgccgaacatggtcgactactcagcaactaaagcggccgcgatcgcattccatgaaggtctcggtgcagaactagtaacgcggtacaatgcgccgcgagtgcgcaccgtgctcatcacgcagagctttgttaacacaggactaattgataagttaactcctgaggatacgtggttgcatccgctattaaatccagagacggtcgcggagggcattgtggagcaggttctctccgggaagagtggccatgtcctgcttcccgggtcaacgggatggcttgcgaagtgctttagggggtttccgctttggttt

SEQ ID NO: 36738 - DNA, 1882 bp, Aspergillus nidulans
aatttccacacattgtctcctacgttctttctgccgagggcggcggcgatagagccagatgtgggttctgtccattccaagatctaaagggtagcatttattaattttggttgtcatgcgcaaggccgaggcgatataccacattacagcaaataaccaagtgctacgaagaacctaccaagagactgcggatcgggctagagggctcgcctattttctcaagaagcatgggtataagagagtcgggatcctgtgcccaaacacaccggcttttctggagtcgattttcggtattgccgctgcgggggccgtgaatgtttgtaaggctttgattctttgttcttccaattaggtatatattcgctaatatgcatattatagccgtgaattatcgacttaaggaggacgatatcgcttatatatttactcattctgacgccgaaattatcatcgctgacaaggaatacttgccgctgctgtcggcctatagagcagcgaagccgcatgttcgtgtcattttggatacagatacagatgcaacagagggccaacttgcgggtccatttgacgaggctattctcgaggggttgaattatgaccgggatacaggcagaaagggctggagtgctcttgagagccaagccgcgtctgaagatgatgttattgcgctggcatataccagtgggacaacggcgcgcccgaagggagtggaatacactcatcgtggttgttatcttgctgctatgggcaatatcattgagtctgggctcaactttcaaggacggcgctgtaaatacttgtggaccttgcctatgtttcatgctatgggtaggttttgacagtgagatttgttttcacttgcctctgactaatgctcgatttctaggttggactttcccttgggccgttactgcagtgcgcgggactcactactgcctgcgcaaaatcgactatccgcagatctggaaacttctcaagcaagagggcgtcacccactttaatgcggctccaacggtgaatacgttgctttgcagctctcctgaagctgagccgcttcctgaaccagtccatgttacagtcgcagcgagcccgccaacacctcatttgttcgaacagatgacgggcttaaatttgcatccagttcacgtttacggtatgacggagacttatggacctatcactaaagggtactatatgacggcctgggaaaacctccctcgcaaggagaaatttgcgcgaatggcacggcaagggcatggtttcctgaccagtcttccagtacgggtcatccagacagaggtgcctgagggcaccatcattgatgtcaagcaggacggcaagaagattggtgagattgtgtttgtcgggaatatctgtgccaggggctactataaagaccccgaggctacgcggaaattgtttgctggcggagtcctccattcaggagacttggctgtctggcatccagatggggccattcagattcttgacagagccaaggatattatcattagtggtaggtcgcaccgccgcttttttttccccgccgcattgttatactgatactagtgtaggaggtgagaacatctcgtccgttgcactcgagtcgatgctggtcacccatccggatattctagaggccggtgttgtcgccgttcccgacagccattggggtgaacggcccaaagcttttgtgactgtcaaaccagggaggcagctgaagggtaaagatgtcgtcgactgggccaggaacactagcggaatcagcaagttcatggttccacgggaagtggaggttgtcgcagagcttcccaagaccagcactggcaagttgaggaagaacgttcttcgtgagtgggcaaaggatggaagccgatcatga

SEQ ID NO: 36739 - DNA, 2470 bp, Aspergillus nidulans
agtgatctcccggtccttttcccgtaccctcgtatataccccgaacaatatgcctacatgtgtgatcttaagaagaccctcgatgccgggggtcactgcgttctcgagatgccttcgggtactggaaagacggttacattgctgtcgctgattgttgcctaccagcaacactatccagagcacaggaaactcatatactgttctcgaacaatgtccgagatcgagaaagcgttagcagagctaagggagctgatgaagtttcgttctgaacaattaggatatactgaggactttcgtgctttgggcttgactagtcgaaaaaacttgtgtctgcacccatccgtcaaacgggagaaaagcggcacggtggttgacgctcgatgccgaagtttaactgccggtttcgtcaaggaaaagaaggaaaagggcgaagacgtcgagttgtgtgtatatcacgaggtatgaaacggaactgctcattgtatggagtgcgcagctgattttatccagaatctagaccttctcgagccccataacctcgtacccccgggcgtgtttacacttgatggcctgttaaactacggggagcaacataaacaatgcccttatttctctgctcggcgtatggtaagtccacacctaatgagagcgcacgtttatttatcagcccttaacgccagttcagatgccatattgcaatgttatcatttactcctaccattacctcctagacccgaagattgccgaaagggtctctaaagaattctcgaaagactgcatagtggtattcgacgaggcacacaatattgataacgtttgcattgagtcgcttagcattgatataacggaagattcattgcgaaaagccactcggggggcaaacaacctggagcggaagatccaggatgtaaagagttctgacgcagaaaagcttaataacgaatacatgaaactcgttgagggattgcgggaggctgagcaggctagagacgaagatcaattcatttcaaatcccgttcttccagacgatctgctcaaagaagctgtcccaggtaatatacgcagggcggagcattttgttgccttcctgaagagattcatcgaatatctcaaaactcgaatgaaagtcactcacaccatctcagaaacgccgctttcttttctaaatcatgttaaggaattgacttttattgagcggaagccactgaggttttgcgcggaacgcttaacgtcactagttcggacactggagctcatcaatatagaggattatcaaccactccaagaggtagcgacgttcgcaaccctggtttcgacttacgacaaaggcttcctcttgatcttagaacctttcgaatcagaggcggcaacagtcccaaatccagtcctacattttacatgtttggacgccgccatcgctattaagcctgtgttcgatcgcttcagctctgtggtcattacgtcgggtaccttatcaccacttgagatgtatccgaagatgttaggatttacgactgtcatgcaagaatcgtatagtatgacccttgcccgtcgatctttccttcctatgatcgtgactcgtggatcggaccaagcacagatttcgtcttcatttcaaatccgaaatgaccctggtgtcgtacgcaactatggaaacatagtccttgagttctctcgcataactcctgacggagtcgtcgtgtttttcccatcctatctatacatggagtcaattatcagcatgtggcagggtatgggcatcctcgactctatttggaactataaattgatccttgtcgaaactcccgatgcccaagaatcatcattagccctagaaacataccggacagcatgttgcaacggcagaggtgccttgctattttgcgtcgcacgaggtaaagtttccgagggtatcgatttcgaccaccactatggccgggctgtgctatgcatcggcgttccattccaatacaccgagtcccgcattctcaaagcgaggctagaatttcttcgggagaattaccgcatcagggaaaatgatttcctttctttcgatgctatgcggcatgccgctcagtgtttaggtcgcgtccttcgaggcaaagacgactacggaatcatggtcctcgccgaccggcggttccaaaagaaacgaaatcaacttcccaagtggattagtcaggcgcttttggagagtgaaacgaatctcagtacggatatggcagtggcgactgcaaagaactttctgcgcaccatggctcagccgttcaaagctaaagatcaagaaggtatctccacatggagtcttgcggacttggagagacatcgtcagaaacagatacaagagcaggagagactacagcgggaaactttcgctcagggggatagaacgaacggttctcgcaacggagcgggagatgagtttgatgaaggaattgatgaggatctcatgatgttggatgcgcagtga

SEQ ID NO: 36740 - DNA, 4868 bp, Aspergillus nidulans
gtgcgcgtcgtcaacaaacatctctgccaggatgaagacatccacactgtcctggcgccattggctctggagcctgaggagaagttccacataatccagacctattaccaagcgatcagtatgacccaattcgtgtcaccgaagtggaccagcagtctgctctcggatgccctctgccgtcgggccaacattgtgacggtcttcaatggtcagggggtggaagggtacttcagtgaactgcagcatctctatgacacatatggaggactgctggccgagcccctatatgccctgagcaaacagctcaaggggcttgcgtcagatgtgcgcgcccaggacatgtacccccacggcctagatgtcatcggctggctcgagaacccagaggcgcgcccgtccactgactatctgctctcagcccctgtcagtcaacctttgatcggtcttgtgcagctgctcaattatgccatcacctgcaagatcctcaacaagagccccggcgagttcgcccgtcacctcagtggttccgccggccactctcagggcattgttgtcgcagcgatgctggctacggttgtctcgtggcctacattcttcgacgccgcaagcaccgcactgcaagtgctgttctggattgggtgtcgttcgcaacaatgctacccatcccactccattccgccgtcgctggtcgatcagtctgagcgcctgagccccatgctcagcgtcaagggagcctcgcgtgagtcattactcaagtatctcgacgagcacaaccgacatctaccccccgcacagcagggctcccttgctttgattaacggccggcagcagttcgtggtggccggcaatcccctctcgctctacgccttcgccaacaagctgcgcgcagcctccaacaactccagcactaccaacacagcccgcgtgccgttcagccaaaggcccttgttgatcaccgcgcgcttccttcccatctcagttcccttccacaccagtctcctggaggatgctgaggcccagatcctggaagacctccgctccgtccacgtccctgggaacagtctcctcttccctgtcctccgtaccgacaatggggccgacctccgcgagtttgacaatctggtccccgagctcgtgcacatggtcgtctgcggcgtcgtcgattgggaccgagccacgcgcttccccactgccactcacttactcgactttggtcccggccgcgagaccgggatcggggcgctgctggcctccacaaaagccggcaccgctgcacgcgtaatactctctacgaccctcaccggccccagcaagaagacgctcggctacatgcccgagctgctcagccggcgccgccccgtagtctacaacaccagctgggaacaagactttgctccgcggcttgtccgcgtcggcgacgacatcctcctcgacaccaagttctcccgcgccttgggtctgccccccgtaatggtagctggcatgacgccgaccacggtctcaccggactttgtcgccgaggtcatcaacgcgaactaccacatcgaaattgccggcggtggttaccacgacgcagccggcatgcgctcagccctcacccggctcgttaacctcatccccgccggccgcggcataaccgttaacctgatctacgcgaatccgcgcgcaatgggttggcagatcccgctcctcgtacaattgcgacaagagggcttgcccattacagggctgacaactctggccggcgtgccgtcgcccgacatcgccagcgagtatatccgcaaccacgtcttgatccatatctccttcaaacgggggtctaaagaagcaatcaacaatgtgctgcgcatcgcggaatcgaaccccggtttccccattatcctgcaatggaccggtgggcgagcgggcgggcatcactcgtacgaagatttccatgaacccatcctggaccggtacgcgcagatcagagcctacccgaacctcattctagtcgctggcagtgggttcggtggaagcgatgataccattccttatatcacgggatcatggtccaagaaattgggctacgcggctatgcccttcgacggcgttcttgttggcagccgcgtcatgactgccaaggaggcgcggaccagtccagctgtgaagcaggcgattgttgatacccctggagtaccagattcccagtgggagggcacatacaagaaagcaactggggggattatcacagtgaagtctgaaatgggtgagccaatccataagcttgcgacgcgcggggtcctgctatgggcagagctcgataaggaggtgttttctcttcctgcggcgcagcaggtccaggagttgcagaggcgcaagggctcgctgatgaagcggctgaatgcagatttccagaaggtttggtttggtatcgaccagcagggaaaccccgtggagatttcagagatgacctacgcggaggttctcacaagggctgttgatctgctctacctcaaggatcagcaagcctggattgatccctcgtatcgttcctttgtggcagactttattcgctgcgtcgagaaccgcctgagcgcgcgccagcctcgaccccgtgcagttttccagtccgcattgcagctggaccggccccaggtctttctgagcgagttcctgcaggcatatccggcagctctggaagacgtgattgtccgcgaggacgaggaccagctggtgaagctgtacaagcaaccgggacgcaagcctctgccgttcatcgttgcgctggacgagtcgttcgagtactggttcaagaaggattctctgtggcagtctgagagactagaagccgtcaccaatcaagacgtcggacgaatctgtattttgcacggccccgtggcggcacagtacactaaggtcgccaatgaaccggtgaagcacatcctcgataacatccataaaccccacgttcaggccatccttgaagcagcagtacaccggtgacacgagccgagttccaactctggattacctgtactctgcgggcgcagtatcgcccatgttgtctccgcaggacgagctgctactgccacatgtcaagcatagtcgttcatacgacccgccgaccctcgcgtatgatctgaaaggccccgaggagaacctacccaccgaaaagcagtggctggctctcatcggcgggacgaagccatcctggcggaaggcattgctgacgctgaacgagattgtgcaggggaagatgctggtggagaatcctatcaagggcctcttcgctcctcgcgccggcctctccgtgcgtatcattcaagctggacgaccccagaagacagtcatccttatgcggcagaaaagcagccaaggacaggaaaaggatgaagcgacggtggaaatccgcgctttatctacctcagagatcatgctgacactgcgagctcctatgactgggggcagtgctggcaaccctccggtcgatctggtgctgtacttcacttacaagccgacatacggcaataacccgatccacgaggttatgggtacacgcaaccagcgcatcagccggttctacgaacagctctgggtcggcaacgcaggggatgagggcacgagcctgcaaaaatccgccgacgacgtgcaagtgctgacccgcgaagcgatcttaaacttcaccaaggccattgacaaccggaacagcgcatacaatgggaaaaagaactctaagctgcttgcaccgcttgacatggcgattgtggttgcgtggaagccgttgatgcgttgtctcttcacggacgcagtcaacggcgatatcctcaagctcctgcatttgaagaatgatttccgggttattgacaacgcgagtccgatgcgcgaaggcgacgtgctgtcttcgacagccgcgatcgagtcgattcgcatccgcccggactcagggaaggtggtccgcgctgttgcgacgatcttcaagaaagcacgcccatcattactgttgccagtgagttcatactccagggccggtatgaagactaccacaacacgttcgagacaaaagaggagcaggtgtacaagttgcccttgaagtcgaagcgggacgtggtcctgctggcatcgaagccctggttccgcatcgccgcggccgacctcagcctcgacgaccacctggatgatgagctcactttccggctgaaaagctcataccattttcgcgacgccaacacgtacagccagatcgaaacctgtgggaccgtcagctgtgccgtggggaataaggacatgacgatcggcacagtgatgttcaaaagcaactcgcacttcctcaagaaccccgtcatcgacttcctgacccgtcgaggatttgcctacgacgaggtcaagcagcttccaaatgctgtgcccttggccgcagatgtccgcattgagatgcccacgtctagtgaccagtacgctgccgcctcgggagacagcaacccaattcacctatcgcgtgcgtttgcgcggtacgcggccacaacgaaggtcgggtcatccacggcatgcagactagtggtctggtacgaggcgtcgtggagttgcatgcggcaggcaacgatccgcggcgcatgaaggcctggtctgcttcattcaagggcaaggtatcccctggcgagaccctcctcgtggatatcagccacacggggatgaacaacggccgcttgattgttgttgctactgcacggtcggaatcgtccagtgtagaagtgtttcgtgcgacggctgaagtggcccagaagccaggagcctacctgttcactggccagggcagccagaagccggcgatggggatggatctgtacgagaccagccaggccgcacgcgatgtatggcacacggccgagcag

SEQ ID NO: 36741 - DNA, 2760 bp, Aspergillus nidulans
tggctgtcggatgcgtggagttcctttgtggatttgatcaaggtatcccttgcgtgggcttctctacatgtccgattgctaactactgatagcatgccgaaaccatcgatatcatcatcatgactctaggttatcttgcgatgtatcttagctttgcctctctgttcttctctatgaaacagttggggtcgaagttttggcttgctaccactgtccttttctcgggcatgttcgctttcctgtttggtctcctcgttaccacgaagtttggcgttccgatcaacattctccttctatcagagggcctcccgttccttgttacgacaattgggtttgaaaagccgattattctcaccagggcagttcttagtgcgtcgatcgacaagaaacgccaaggttcagcgacttcgactcccagttctattcaggattcgattcagaccgcaatccgagaacagggtttcgagattattcgagactactgtatcgaaatctccattcttattgcaggagctgcttctggagttcagggcggtctgagacaattttgcttcctcgctgcttggatccttttcttcgactgccttttgctcttcaccttctacacgactatcctctgcattaagcttgagatcacacgtatcaggcgccatgtgacccttcgcaaggctctggaggaagatggtattacgcagagtgttgccgaaaaggtcgcctcgagcaatgattggtttggtgccggatcggacaatagcgacgcagatgacgctagtgtttttggacggaaaatcaaatcgaacaatgttcgccgcttcaagttcttgatggtcgggggttttgtgctggtcaacgtggtgaatatgactgcaatccctttccggaattcgagcttgtcacctctctgcaatgtcttctcgcctacaccgatagatcccttcaaggttgctgagaacggtctggatgccatctacgtttccgctaaaagccagaagttggagacattagtgacagttgtcccgcccatcaagtacaaacttgagtatccgtcggtgcattatgctaagctgggagagagccagtctattgaaattgaatataccgaccagcttctggatgctgtgggcggacacgtcctcaacggcgttttgaagagcattgaggacccagttatcagcaagtggatcattgcagtgttgactttgagcatagtcctcaacggctatctatttaacgccgcaagatggagcatcaaggaaccacaagccgcccccgctcctaaggaaccggccaagccaaaggtctatcccaaaatcgacttgaacgctggccctaagaggagcatggaggaatgtgaggcaatgctaaaagcgaaaaaggcagcctaccttagcgatgaggagctgattgaactttcactctctggcaaacttcctggatatgctctggagaagtcattggaaaatgaggaacttatgagccgtgttgatgccttcacccgggcagtcaaaatccgcagggctgtagtatcgaggacccccgcaacttctgcagtcaccagctctttggaaacttctaagctgccctataaggattacaattatgcgcttgtccatggtgcttgctgtgagaacgttattggcaccctgcctctgcctcttggagttgccggtccccttgttattgatggtcaaagctatttcattcccatggcaacaactgaaggtgttttggtagccagtgccagtcgaggcgccaaggctattaacgctggtggtggtgcagtgactgtcttaactggcgatggcatgactcgcggtccctgtgtcgggtttcctacacttgcacgcgcagctgcagctaaggtctggctcgactccgaggagggtaagagcgtcatgacagcagcattcaactctaccagccgctttgctcgactgcagcacctgaagactgcccttgccggtacctacttgtatatccggttcaagacgactactggcgatgccatgggtatgaacatgatttcgaaaggcgttgagaaagcactccatgtcatggctacagagtgtggattcgacgacatggccaccatctctgtgtctggcaacttttgtaccgacaagaaagcagctgctctcaactggattgacggccgcggcaaatcagttgtggctgaggctattatccccggtgatgttgtgcgcaatgtgctaaagagtgatgttgatgcattggtggaattgaacactagcaagaatctgattggcagtgcaatggcaggtagcttgggcggattcaacgctcacgcatcaaacattgttactgcaatctttctcgcaactggtcaagaccccgcgcaaaatgtggagagcagcagctgcattaccacgatgaagaagtaagtagtatactttgatgtctttctctcctggtcggcgctaaccacgttttagtacaaatggcaatcttcagatcgctgtgtctatgccttcaattgaggttggcactatcggtggtggtactatcctcgaagcgcagggtgctatgcttgacttactaggcgtccgtggctctcaccccaccaaccccggcgacaacgcgcgtcagctggctcgtattgtggcagccgcagtgcttgctggcgaactgagtctatgctctgcgcttgcggctggacatcttgtcagagcgcacatggcccacaaccgcagtgccgctcccactcggtcagcgaccccggtctcagcggctgttggtgct

SEQ ID NO: 36742 - DNA, 1980 bp, Aspergillus nidulans
ggcatcaaaacagccgatcaggttctccggaaaaacccaaaccatggcgatacgttagcgatgaaggctctgatcatgagcaatcaaggtgaacagcaggaggccttcgccttggccaaggaagctcttaagaatgacatgaagtcgcatatctgctggcacgtgtacggcttgctctatcgcgcggagaagaattacgaggaggctattaaggcataccggtttgctttgcggatcgaaccggactcccagcccattcagcgcgatctcgccctcctccagatgcagatgcgggactaccagggctacatacagagtagaagcactatgctgcaggctcgacccggcttccgacaaaactggaccgctctcgctatcgcacaccacctctccggcgacctagaggaggctgaaaaggtgctgacgacatatgaggagacgctgaagaccccaccacctctgtcagatatggaacattccgaggcgacactgtacaaaaacatgattattgcggagtcaggaaatatccagaaggcgttggaacacctcgagtctgtaggacaccgctgctcagatgtgctcgctgtgatggagatgaaggcggactaccttctacgcctggacaagaaggaagaagccgctgcagcctacactgctcttctggaacgcaactcggagaactctctctactacgatggcttgattaaggccaagggtatctccagcgacgaccacaaagccctcaaggccttgtatgactcctgggcggagaagtacccccgcggtgatgcgcctcgcagaattcccttggacttccttgaaggcgatgattttaagcaggctgccgatgcctatctgcagcgcatgctcaagaaaggcgtgccatcgctctttgcgaacattaagcttttgtacaccaactctagcaagcgtgacacagtacaagagttggtcgaaggttacgtctcaaaccccccagcgaacggtgcggctgacggttccgaaaacaccgaattcctctcctccgcatattacttcctcgcacagcactacaattatcaccttagccgcgatctatccaaggctctccagaacgttgacaaggcccttgaattgtcccccaaggcggtagagtaccagatgaccaaggctaggatatggaagcattatggcaaccttgagaaggcagcagaggagatggagaacgccagaaagatggatgagaaggatcgtcacatcaactccaaggccgccaaataccagcttcgcaacaacaacaacgacaaggcgcttgacaaaatgagcaagtttacgcgcaatgagaccgttggcggtgcccttggcgacctccatgaaatgcaatgtgtgtggtatctgacggaagatggcgaggcttacctgcggcagaagaagctcgggctcgccctcaagcgttttcacgccgtctacaatatctttgacgtgtggcatgaggaccagtttgatttccacagtttctctctgcggaagggtatgattcgagcctacgttgacatggttcgctgggaggatcgtctgcgcgaacatcctttctacacccgagctgcgctttccgcgatcaaggcctatatacttctccatgaccaaccggatctagctcatgggcctcttcctgagattaacggtgctgatggggacgatgctgagcgcaagaaggctctgaaaaaggctaagaaggagcagcagcggctcgagaaactcgagcaagagaaacgggaggctgctagaaaggctgccgctaaccccaagagcctagacggagaggtcaagaaagaggaccccgaccccctcggcaacaagcttgcgcagacacaagaaccgctaaaggaagcactaaaattcctcacacccttgctggagcactctcccaagaatatcgaggctcaatgccttgggttcgaggtacaccttcgaaggggtatgtttcaagagttccgcaaa

SEQ ID NO: 36743 - DNA, 1068 bp, Aspergillus nidulans
gccgtcgtgcgcgacggcttcccgcgccccgtccctgataccccctccaacgttctcgagcagtttaagatggccggcaagacgatcgttgtcaccggcgctgcagacggcattgggtacgcggtcgctgaggcgatggccgaggctggcggcgatgtcgcgctgtggtatcactcgtgcgtgaccctttaggatccagcagaaaatgcgaagattgtagcaaagcggcaacaatgtgctgatagatgtatgtgcagaaacgatgctgcgattgcaaaagctgagggactgacgaaggagcatggtgttagggctgttgcttataaggttgatggtgcgtattgctggtagttggccggggtctattgtgtgagtgagagcgagtgtgtttctaacattttgctctaactgtacagtatctgaccctgatgcggtccagagcaccatctcgaccgttgtgaaagactttggcaagatcgacgtcttcgtggccaatgctggtacgttccccgagacccctatcaagctcgtcttcctctcctttccccttccgaactgtcgacgctggacatggcacaaattaacaagtgcaaaggaatggccatctcaaaacccatcctctcgcagacactccccgaatataaagcgcaactctctgtcaatatcgacggcatcgtctactgcgccaagttcgccggcgaagtcttcgcccgccagcgcactggaaacctgattatcacttcgtcaatgagcgcacacattgtcaacgtccccacggaccagccgatttacaacgcgacgaaagcgttcgtcacgcactttggcaagtccctcgcgcgcgagtggagggagtttgcgcgcgtgaatattgtttctccgggctttttcgacacgaagatgggggcgagtccagagacggtgaatgaggcgtatcgaatggcggtgctgggcaggcagggatctacgaaggagatcaagggaatttatttgtatcttgcaagtgatgcgagtagttatatgacggggagcgatgtgctgattgatggagggtacgttttgccatagctt

SEQ ID NO: 36744 - DNA, 1032 bp, Aspergillus nidulans
gcgaaacaacatgcccgcaaggttgcttcaaagctaggggtccgcgacggtcttatctatctcgttggcaaagctacgataaactggggagactcagaccaaccacgccctttccggcagagacgctacttctactatctgagcggtgtagacgaggcagattgctacctgacatacgacattcgcaacgaccttttgactatctacgttccgaatttcagcctgcaacacgcgatatggatgggaccgacactcactgtctaggaagcacggcaacggtacgatgcagaccgcttccgctattatgctgctctacggagcgacctcaattcatgggtggaccaatataacaaagacagcccgatttacgtcctccatagctcccagaaacccgagatttcggcgaaggagcttcgcttggacgaaaagtcgctgttacctgcaatggatgcagcgcgggaggtgaaagatgaatacgagatccggatgattcgcaaagccaacgagatctctgcccttgcacaccgaaacatcctacaaaacatacaccgcatgtcaaacgaaagtgaaattgagggactcttcctagacacatgcgtgtcgcacggtgcgaagaaccagtcatatgaaatcattgctggatctgggcccaacgcagcggtgctacactatgtgaagaacgacgagcctcttaacgggagacaacttgtctgtctggatgcgggcgcggaatggaactgctacgcgagtgacgtcactcgcacaattcccctagggaaagactggcccagctcgcacgcgaaagacatctacgccatcgtcgaagaaatgcaggaggaatgcatcagacgtgtaaagcctgggctaagatttcgagacctgcacgagcttgctcatatcatcgccatcaaaggactgcaagaactcggagtcctcaaggctggaactgtagaagaaatccgtcgatccggagcatcctccatcttctttccccatggcctcggccaccatgtagggttggaggtgcatgac

SEQ ID NO: 36745 - DNA, 5058 bp, Aspergillus nidulans
aaatcagaaaagcccatggagcccttccaagtacgcctgaactgcgtggatcattatcaggcaaatccatcagaattcgatcctcctctaccttaccgtgacggtaataatgagaaaggctacatgcctaaggttcccgtcattaggatattcggtactacagaaactggccaaaagatatgtgtccatgtccatggcgcctttccttatctctacgttcagtatgacggggatctgagccccgattcaggttcgtcatagcttgttcctttgtttttctttcttcaactaatgtctttgctagtgcgctctgcagcaaggagtctacacctgtccatagaccatgcgcttgcagtcagctatcgccgcaatgcacacgacaagaagacagtttttgttgcgcatatcaccttagtaaagggtgtccctttctacggctatcatgtcggataccgattttttttcaagatatacttactgaatcccatatatattacaaggttagcggatctgctgcttcaaggagctgttatgaaacgccctattcaaccatacgagagccacctacagtatgtcccacaatggatgtgcgattacaatctgtttggctgcgcgttcatgaagtgtggcaaggccaaattccgttctcctataccggagtatttggatctccctgatctgtcccatcgctggcatgaccgatcaattccacctggctggatcttagatgagagtgtcctacccaaacagagccattgtcctctggaagccgacgtttgcgttcaagatattctaaacaggctagaaattagcgagcgttcaattcaccatgactttagggagtttttaaatcccctgacatcgaatgaaaagcttgttccaagtatggcgggattatgggaggatgaaaagcgccggcgaaagaaaaaacttgggcttgatgatccggatagcagcccattcagcactgaagatctcgtttcattctcatctgatccacggaaggcttcgcagggtgattggattcataaagatgaacttcagctattggtgcgtcagatcactgcagaggagagggagcgagataacaatcgggatatgacgctggatgcgcatttacaagagaatccttatgcgaaggatgtcaagactgctttacaaagcattgaagatttcttcactgacgctgatggtttgactaacttacaacttccttataattccgggattgattattcagaagagcaagccgttgattatgtcgacgaagatgctgttcgagccaccgaatcgaattcgggtctttactcctccgatgaggatggcatgattgacatattttctgatgatgattatgacaatagtgagaacgagatggcgcaagttgacttggagaatgatttacaacaggatgaaagatccaatgctatctccaagacccatgggcctcgggtttccgccccgtcagttgatggtcttgctgggaacagttccggactagaaggacctcgaagtgatgctctcgaggccaggaatgcaataagtttcaaagctcccactcaacaaaatgtgcaatcaggtcgatcgtcagtcactagatcaaagtacgaggagaatttggataaatcttctcagagccaggagagttctagcctcgttcagttttggacggcgaatgcggacagcagtaacaagaagatccgcatgccgagtcgtgccacggaaccatcctcttcagacggacagagcatttcttcccagaaaacgatccgcctcaaagcccttagccaatatggcacactaaacttcccagttgtgaaagatcctaacgaccccatgacaattctacgttttagccaggaagcgtcgggttcaaaagaattgatggacgtggtagcgaaggaggccagcagttctgggaaaagttctagcactcttcagccgcgttcgtccgacgagaaggagcttagtagttcgtcagataacatcgcaactgactttgcaggacttatatctgatgcttttaacataccaccaagcacccgcttgtgctgctttcggcgggcctgtccaagccccaaggaggtttcctctacaataaacgcctacggcctttcagatatcatctatcaaaatgcacactacagtatagatgctgacgttccggatcgccctcgtgactacgcaggaaaggagtttcagctgggcggtatcggcatacgctacctccccgattttgatccttctggtcgtttacctgcaatgctagcggaggagaatataggccaaaaagagaaacgtgactggcaagaactggaccatcaattgcgggttgggtccacggccagattctgggagtttactcctgtccctccgagccgctcagaggtcatcacatggtataacggcgaacagcagaaatctttggcagcaacaacgaaaacagaagagcaatacgaggagaaagagtatcgaggaaaggtactttctcagattgagggtcctacacaaaagaatgaacatggcttcaaatactcacaacataaaaagtccacaagtgtcgagcatcagactcagtatatgagcactatgagcttggaggttcatgtgaatacccgcggtgtgctattgccaaatccagaggaagatgaaatagccgcgttcttttggtgtgttaactccgaagatgaacctcaggaggaagatgattctttatcagttgtcaatatgggggtcgtattccaaggagaagaagagtacccggagtcgaaaatctcaaaggcgctgaggtttgagtgcgagcatgaatcgacagaattagacctgatcaaccgtctagtcgatatcgttcgactccacgaccctgatattataaccggatacgaagtgcataatagttcttggggcttcatcatcgagagagccaggaagaagtacgacttcgatctatgtgacgagttatcgcgagtgaaatcgcacgctcatggacgatttggcaaagaagctgataaatggggcttcgaccacacatcatccattcgaattactgggcggcacataatcaacatatggcgcgccatgagaagtgagatgaatttgctccagtataccatggaaaacgttgtcttccatctcctgcaccggcgaataccacattattcgttccgcgacctcacggcatggtaccaaagtgataaaccgcgagacttcatgaaagtcattaactactatacgtcacgcgtccaaatgaacatcgagattctaaatgcgaacgaattaataccaaggaccagtgaacaggcaaggctgcttggcattgatttttactctgtgttctctcgaggctctcagtttaaggttgagtctctgatgtttcgaattgcaaagccggagaactttatactcgtttcgccaagcagaaagcaggttggtcaacagaatgccctggagtgccttcccttggttatggaaccccagagtgatttctacaccagtcctcttattgtgctggatttccaatctttataccctagcatcatgatcgcctacaactattgttattctacctttcttgggagagtccagtcatggaggggacgcaataaaatgggtttcttggactataaccggccgcctagcatgcttgagctactcaaagatcatatcaacattgcgcctaacggcatgatctacgcacgatccgaagtgcgaaagtcgctccttgcgaaaatgcttacggagatattggagacccgcgtaatggtaaagactggaatgaaagttgacaaagatgaccgagcattgcagcgcttgctcaacaaccgacagcttgcactgaaactaatcgcgaatgtgacttacggatatacctcggcctctttttctgggagaatgccttgctctgaaatcgccgacagcatcgttcaatcgggccgggaaactttggaaaaagcgatcgccttcattcattcggttgagcgatggggtgctgaagtggtttacggagacacggacagtttgttcgtctatctcaaaggacggactcgagaccaggcctttgacattggcgaggaaatcgctcaagctgttaccaacatgaacccccatccggtaaagctcaaattcgaaaaagtatatcacccatgtgtgctgctcgcaaagaaacgatacgtcggttttaagtacgaacacagaaaccagaaggaacccgaattcgacgcgaagggcattgaaacagtccgtcgcgatggtacccctgctgagcagaagattgaagagaaagccctcaagctgctcttcagaacagcagatctgagccaagtgaagagctattttcagagccaatgcacgaagatcatgcaaggacgggtgtccgttcaagacttctgctttgctcgagcagtaaagctcggaacatacagcgagaacggaacgctccccgccggagctctcattagcacaaagaagatgctagaggaccctcgcgcagaaccccagtatggagagcgcgtcccttatgtcgttgtcacaggtgcgccagggtcacgattgatcgaccgctgtgtaccccccgaaacccttctccaggatgcgcaacttgaccttgacgccgagtactatatcactaaaaacatcattcctcctctagagcgtatcttcaacctagtcggagctaatgtgcgtcagtggtatgacgagatgccgaaagttcatcgcattcgccgtgtagaagggacatcttctctggctggtggaaaaagcagcatccggaccctcgaatcatacatgaaagcttcatcctgcgtcgtatgtaaggcaaagctctatgatgccgaaatccctgtctgctcggattgcgtacggcagccccatgtctccttgcttgagcttgtctcccgccagcgtcatgccgagcagagagttgctactctcgagcgtatctgccggtcctgcatggatgtaccgtttggtgatgaagtgaaatgcgacagccttgactgcccagttttctatgcaagaacgagaggtcttgcccattggagacatacaaattccgtg

SEQ ID NO: 36746 - DNA, 3132 bp, Aspergillus nidulans
cgtggtaagaatgtccttttcgaaaattgttcctgatattcgactgacttattgcttccctcattattaggccgccagcgactcctttctctcaggaaacaccgccaactatattgatgagatgtacgtcgcatggaggaaagacccttcaagcgtccacatctcgtggcagacgtatttccgtaacatggaggagggcaaaatgccaatctcccaggccttccagccccctcctaccctcgttccgacgcccactgggggcgtccaccaggagatgcccggtgctggtctcggtctttcccaaggcactgatgtcacaaagcacctgaaggtccaactacttgttcgcgcataccagcgtcgcggtcaccacaaggctaagatcgatcccctgggtatccgtggcgaagctgaagcctttggttacagcaagcccaaggagctcgagctggaccattacggcttcaccgagcgcgatctagatgaggagtttgaccttggtccaggtattcttccccgcttcgctactgagggccgtaagaagatgtctctccgtgagatcattgctgcttgcgaaaagatctactgtggctcgtacggcgtggagtatattcacatccccgaccgtaagccttgcgattggattcgtgatcgtttcgaggtcccggagccctacaagtactccgtcgatgacaagcgccgcattctcgaccgtctcatctggagttctagctttgaggctttcctggctaccaagttccctaacgataaacgtttcggtctggagggttgcgaaacccttgtgcctggtatgaaggctttgatcgaccgcagtgtcgattatggtatcaaggacatcgtcatcggtatgccccaccgtggtcgtctcaacgtcctgtccaatgtcgttcgaaagcccaatgaatccatcttcagtgagttcgccggttctgccgagccttccgatgagggctctggtgatgtcaagtaccaccttggcatgaacttcgaacgccccaccccctctggtaagcgtgtgcagctctctcttgttgcaaacccgtcccatctcgaagccgaggaccccgtcgtcttgggtaagacccgcgctatccagcactacaacaatgatgagaagaacttcgatagcgccatgggtgttttgctgcacggtgatgctgcgtttgctgctcagggtattgtctatgagaccatgggcttccactccttgcccgcctactccactggaggaactatccacatcgtcgtgaacaaccagattggtttcaccaccgatcctcgctttgctcgctctacaccttactgctcagacatcgccaagtcgattgatgcgcctgtcttccacgtcaacgctgatgacgttgaggctgttaactacgtctgccaggtcgctgctgactggcgcgccgagttcaagcgtgacgttgtcattgatattgtctgctaccgtaagcagggtcacaacgagactgaccagccctctttcacccagcctctaatgtacaagcgcgttgctgagaaaaagcttcagctcgacatgtacgttgagaagctcatttccgagggcaccttcaccaaggaggacattgacgagcacaagaagtgggtctggggcatgctcaatgacagctttgaccgaagcaaggactaccagcccaccggtaaggagtggctgacctccgcctggaacggtttcaagactcccaaggagcttgccactgaggtgctgccgcatcttcccaccgctgtcgagcctcctattctgaaaaatgtcgccgacaagatcagtggtgctcctgaaggcttcactcttcaccgcaacctcaagcgtattctgggcaaccgcaagaagaccgttgaggagggtaaaaatattgattgggctactgccgaggctcttgccttcggttccctcgtcagcgagggttaccacgtccgtgtgtccggtcaggatgttgagcgtggtactttctctcagcgtcatgctgttctccacgaccaggagactgaggcgacttacacccctcttcagcacatcagcaaggaccagggtagctttgttatttctaactcgtctctgagtgaattcggagcgtaagtttcactggaaattctctttcgcaattctctaacctgtttacagccttggcttcgagtatggttactctttgacctctcctaacgcccttgttatgtgggaggatcagttcggtgactttgccaacaacgctcagtgtatcatcgaccaattcattgcctctggagaatccaagtggctgcagcgctccggtttggtcctgtctcttcctcatggttacgacggtcagggccatgagcactcttccggtcgtatggagcgttacctccagctctgtaatgaggagccccgtgtcttcccctcacaggacaagctcgaccgccagcaccaggactgcaacatgcaggttgcttacatgaccagccctgcgaacctgttccacttgctgcgtcgccagatccaccgtcaattccgcaagcgtatgttgttccctcccttacaatatggacctaagctaatcaaatctagcccttgtgatcttcttctctaagtctctccttcgtcacccacttgctcgctcctctattgaggagttcactggcgactctcacttccaatggatcattcccgaccctgctcatggaaccgccatcgatgagcctgagaagattgagcgtgtcattctctgctctggccaggtgtacgctgccctcaccaagcaccgcgaagccaacaacatccgcaacactgccatcacccgtgttgagcagctgcatcccttcccttgggctcagttgaaggagaaccttgacagctaccccaacgctcgcaacattgtgtgggctcaggaagagcccctgaatgccggttcatggagctacgtccagcctcgcattgagactctgcttaacgagaccgagcatcacaaccgccgccacgtcatgtatgctggtcgcccgccaagtgcttccgtagccaccggcttgaaatccgttcacgtgaaggaagagcaggaaatgctcgaggaggctttctccgtccaccaggagcgtttgaagggcgagtagacttgc

SEQ ID NO: 36747 - DNA, 977 bp, Aspergillus nidulans
ggtcacgatagcgccggcgctgtcgtacaggtgcgcgatagtgtcacgagcatgaaagtcggcgatagggccggtatcaaaccgatgatggacacgtgtggagcttgtactagttgctggagcgacgaggaatcatactgtgcgcgggacgtgcatactgcgctgacgattcctggtgtccatcagcaactttctggtgggcgctcagacattagggttattaacatcggaggtgctagcacttaccagcagtacgtcgtttctcccgcgcgatatgcaacgcctatacctgaggggatccctgatgagatcgctgcgccaattatgtgcagtgcgtcaacgatataccgttcgcttgtagaatcgaggctccaggcaggcgattgggctgttttccccggcggtggtgtatgtcgctcttatcatatgagtatgcctggtctccaggactgacagagccagggtggtgtcggcattcagggcgtccaactggcatcggctatcgcatgcgccccattgtcgttgatactggcgaggagaaaaagaatctagcgctcaagatgggcgctgaggccttcatcgacttcaagaccgtccctgacgcagccgcagccgtggttgaaatcgcggacggcataggtgggcacggtgttttcgtcacagcacaagctgcgtaccccactgcattggcatacctgggcacccgcattggcggggatttgatgtgtattggcattgcgccggccggaaccatgagtatccccgttgaccctaacttgttgctcttcaggaacacccggatacaagggacactggttgccagtcggcatgatacgatcaaggcgttggacttcgcacgcaggggtaaactaaagcagatctgtgaggtttggccggtagagcgcttgcctgaggctgttgatagactgaggaaggggcttgttgcaggaaggatggtggttgattttaaccagtag

SEQ ID NO: 36748 - DNA, 1205 bp, Aspergillus nidulans
  unsure (1)..(1205): unsure at all n locations
atgacttcgccctcgactatcaagcagagattcctctccaagccaaaccagctcggcgtagttgctgttggttttaatggcggccaggtacggatacccacggctcggcgctgctctgtcgatcatctttgcattgcagtgcattacagtctcgcgcaggggcaccttgcaccctgtagaagacggatgctgacatgactggtcccatgacacagtgcaagcttggcgttgaggcagctcctatggctctcgtcgaggccggccttctcgaccagcttcgcgatgatcttgactacgaaatacactacgataacaccgtacactactatgagaaggagatccccgctgaagaccccgaccaccggggcatgaagaagccgcgggctgtcagcgccgtcacagaaaccctcagctcgcaggtgtacgagcactccaaggagggcaagttcacgctaaccctaggcggagaccactcgatcgcaattgggagtatcttccgcaatgcaaggcgacncgcgagcggctgggacgggagattggtgtcatttgggtcgatgcgcatgctgatatcaacattcccgaaatgagtcccagtgggaatatccacggaatgccgatggcattcttgacgcggttggcgacggaggagaagaaggatatctttggttggttgcaggaggagcacaaggtcaacctccgcaagctggtgtatatcggactgagagatgttgatcgcggtgagaagaagttgctccgggagcatggaatcaaggcgtttagcatgcatgatgttgatcggtactacccccttcctatccgcatttgccctcgtttagccctcggcctcgtctgggttctacgccctggagataaatgttgctaacgttggctttagccacggtattggtcgagtggtcgaaatggccctcgctcacatcggaaacgacaccccaatccatctgtcctttgacgtggatgcactcgatccccaatgggcgcccagcactggaacgccggtgcgtgggggtttgactcttcgcgagggagacttcatctgcgagtgtgttcacgagacaggaaacttgatctccatggatttggttgaggtcaaccccagcttggaagctgtgggggcttccgacaccattcggaccggttgctcgttggtgcgtagtgcgttgggagataccctgctctagagtctg

SEQ ID NO: 36749 - DNA, 1343 bp, Aspergillus nidulans
gactccgtagagacaaaaaagccgaagcggccgaaagctgcggagcatgcagagagggatgacgaatcgaagcgaacgaagaacaagtttgcgggtatattatcaaagtttgagaggtctgcaaaagttaagaaggccactgagaaattacatcgagaggatgagacgccagttcaagacgagaacgttgctcaaccagtcatagcacaaggattggagcctattccccaaccaaaacccgttgtcgaagaagctgagaagcctacatattcctctcttccaccttggctggctaatccagtaagagcatcagctgaaaccagggccaaattctccgacttgggaatcgagcccaaacttcttcgagttcttgaagttaatgggtacaaagaagcctttgctgttcaggccgctgttataccacttcttctgaaggggccgaacaaccacactggagatatatgcgtctctgctgctactggttctggaaagacactttcttacgttcttcctctcgtcactgagctggagcaaatcccagctccacggctacggggactcatcgtggtaccaactagagagctggtaaacaagcccgagaagcctgtgagttttgcacggcaggaacaggtctacgcgtcggatctgcagtgggaaatgttgccatcaaggatgaacagcgatcccttatgcgtattgaacatgtttacagcccagagagcgtcgagtcacgacgaaaagcggagttaacaggggaagagtgggctgacttcagtctacaagactatatctcgaatacgacggacttgggtgagacattaccaggctatatccacaggggtgagcccaatgttgatatactcatctgtacacccggtcgcctcgtggaccatattcgctatacaaaaggctttacattgaagcatcttcagtggctcgtcattgacgaggctgaccgattgcttaacgagagctttcaggagtgggtggatgtcgttatgcagtcccttgatgcacgcaaggcgtacggggctttcggaccaagtggacggttcctggcggatctcgggatgtctttgcagactaaagagcctaggaaggtggtcctcagtgccacaatgaccaaagatgtctcaaagttgaactctctccggctcacgaatccgcgattagttgttgttggtggctctgatcaaactactacagccgatgatgagagcggggttgttgtccacgcagatgaaagatttactcttccgacgacactaagagaatactccattgcggttggtgacggagagcacaaaccgctgtatctcttgcgcctgctcttatccgagatg

SEQ ID NO: 36750 - DNA, 1414 bp, Aspergillus nidulans
ttctttaaaaagccttggatcgatcagtcaatactcatattatactagaaactcattgaccggggacataaagtcatcatcattacccatgcctataagggtcgcacgggtgtccgttacctgaccaacggcctcaaagtttatcatgttccatttttagtcatataccgagagacgacgatgcccactgttttctcctttttccccatctttcggaacatcgttatccgggagcagattcaaattgtccatgggcatcagagtttgagtagcttctgccacgaggctatactgcacgcccggacaatgggcctacggactgcatttactgatcattcgttgtttggcttcgccgacgccgggtccattctgaccaacaaattgctgaagtttacccttagtgatgttgaccatgttatatgtgtcagccatacttggtgagtctgctgtgcaagcttctcagttcagtcatcttaatgttgcctgcagcaaggagaataccgttctccgggcctcgttggacccattaatggtctccgttatccccaacgctgttgtcgcggaaaatttccggccactgcatgctacggcccgggcgaatgagcggcagtctggcgggggatcacagatacagcctcctcccaggcctattggaccgaacgacatcattaccattgttgtgatatcgcgtctcttctacaataagggcactgatctcctaatagctgccattccaagaattcttgcatcccatccgaacgtacggttcatcattgcgggctcaggtcccaaggccatcgacctggagcagatgctggaacggaatgttctccaagacaaagtagaaatgcttggggctatacgacatgaagaagttcgggatgtcatggtcagaggtcacatttatctgcatcctagtttgactgaggcctttggaacggtcattgtagaagccgctagctgtgggctatacgtggtgtgcactcgtgtcggtggcattcccgaggtgcttccccagcacatgacaacctttgcaaaaccggaagaggacgacattgtgctagctaccagcaaagcaatcagtgcattgcgatccaacaaggtccggacggaacgattccatgatcaggtaaaggtcatgtattcatggacggatgtagcgcgtcgaacagagcgggtatacaagggcatatctggggacatcagcccacaagagttctatgggtactacccgggagagatccaggaagccggcgatagagttcgcaattttgccttgattgaccgattgaagcggtattatggctgtggagtctgggccggaaagctgttctgcctctgcgtcgtgattgactttctactctacacgttccttgaaatgtggtttccacgagcaaatattgacatcgcgcga

SEQ ID NO: 36751 - DNA, 782 bp, Aspergillus nidulans
gaatactccgtccttcttctcggtttagataatgcaggcaagactacgctcctttcccagatcaaagccctctaccagcatcgacctgatggcacgcctgcgcccaaccccggcaggaccgtaccaaccgtagggcaaaatgtcagcacaatatcattgccggacatgtcttgaagatctgggatgtcggtggacagatttccatgcggaacctctggcagagctactattccagctgtcatgcgatcatctttgtggtggacagtacagacgtcggacagaatcctgacattacgcgccttccttctctatccgcaagggctagtagctctcggaaaccgtcgacacccaggccaggatcaggagcggcggaatcatcagcagagcgcgaagtcgatgctgacggtgacggcgatggtgggaatgatagcgtaaacactttcgccgagcaactggccagcatcaacgctcccgatagtgacttcggccgattagacgagtgtcgtcaggtgcttgaatccgtgcttcgcaatgctgatgttgccggtgtgcctattctcgtgcttgctaataaacaagaccgggaagactcagtagaggttgtccggatcaaggaggggttcgtgcgaaaggtgtttgagggagaaacaggcggcgtcgttcgcgatagtcgtgttttacccatcagtgctcttatgggttcaggagtacgggaggctgtcgaatgggtgcagagccgggtgaagtggaacaaggaggggaggccgcccgttatgaggtga

SEQ ID NO: 36752 - DNA, 1300 bp, Aspergillus nidulans
gtagcagattggtatatggtcatccgccggcaattcaaggatcgcgacgacgcttccaagaatagccctgaattgccggtcctcgactatccaactgtgcagatacgcatcctgcctcttctcgccacggcattcgcactgcactacacgggtttggcaatgcagaatgtgtactctcgtactcggaggcagattgaatcgggagattttagttctcttgcatacatgcatagtatgtcttctgggctcaaaagcctatgcacaactcttgcagcagacggtatcgagacctgtcgacgggcactcgggggtcatggatacggcggtgggagcgggcttgtgcagttgaatgcagactacttatccaaggttacagtcgagggggacaactggatgattacgcagcagacagcggcctatctgataaaaaagatgggctctgttgtttctgcatcagtggcaaaggtggaaaaagacgaaattgatgtacagtttacgacgtatttccccaaaatacagggaggagagaccgacagaggtgaccggcaatgtgattatgatatcctgcggaatgatggcgacctggtccaggctttccagcatagggctaccgctctcgtgagtatcactatgcatgccgagtacagcatgccgagctacagtaacacgagacttaggcctacgatgtctaccgagagcgcgtggtgagaaaaagaggatggacatccatcatgacacaattacacagactgagcaaaggtactgaatctctcctcgttgagcaggaactaacatcctcagcacaatcacaatccatccttgtaacgcagttttacaacgccctcagctcagacacggagctgtctgcggcggttaaagatgtcctctgggatctctaccgcctcttttctctctccacattagagactgaaaaatatgagtgtacgttccgctatatgctgcaaaaaatgcagctcattgcgtaaactaacgttagatagtcttttcacacaacgccgcatcgaaacacgacctcgacgcagtcttggaacgcatcaatgagttaacgtcccgtatacgcccacatgctgtccgattagtggacgcatggcagatcccagactatctgctagacaggtgaattgccatccagagctctattttactcagagttaaaacggctgactgcggttttagtgctcttggccgctacgatggccgggtctacgaagacttgttccaccgcgctcatcgtgttaatcccctgaacaagaccacagtcaacccaaattactgggag

SEQ ID NO: 36753 - DNA, 1624 bp, Aspergillus nidulans
gacatcaagtccgggtcaacaacgcagattgacctcgcgatggatccaatcctcgaacgcagagtcatccgcaaatgcgaccttcacgtcgtcccaattctaacacttttattcttattcgccttcctcgacagaatcaatatcgggaatgcgcgattgctcggcctggaagaagaactcggtatggaaggtcgccagtataacgttgctttgtttgtcttcttcattctgtatattcttcttgaggtgccgagtaatatggttctgaaaaagatcaagccaagctggtggctcagtggaatcatggcgggctggggtattgtcacaatttgccagggggtgacgcaaagctttggagggctcgtggcttgtcgagtgattattgggggccttgaggccgggtttatgcctggtttgtctctgccacctttctataccccatccgctttaggcaatagtgctgacttctggataggaagcgtatacctaatcaacatgtattatcgccgccacgagcttcagcggcggctgaacttcttcttcagtgctagtatcttcgctggcgctgttagcggcgtatgactcttctcctcccctttcctttacttcagcatcaagcaaagaaacactaataccgacgagcagttcctcgcctatgcaatcgccaacatggacggcaacggcggctacaaaggctggcgctggatcttcattctggaaggcctagcaactgtcgtcatagccataatcgcaaaattcatcatcgtcgactggccagagtcggcaacattcctgaacgaggaagaacgcgcttgccttctccgccgtctagcagaggaccagggcgaggcgcaaatgaaccggttcgacaagaaggccatgaagaggacgttttccgatccgaagatctaccttgggtacagactcccttaaacgtttctcctgtttcatgttttggacaggacacagtgattaatatgcgtgtagacccatcatgtatttcggcatcgttaacaccggctatgcggtctcgttcttcacacccacaatcctgcaacagctcggctggacctctattcgtgcccaagtaatgtccatccccatatacgtcgtcgcgatggtaatcacgctttcaactgcctggctcagcgaccgcctggcccatcgttatgccttcacactcgcgggagtgctcatcgccacaatgggctatgtcatgctcttgtgtcaaacctccatcccagttggggcacgctacttcgcgctcttcgccatcactggcggcggatatctaactcagccaatactgatgggctggttgagcaataacatggctggccattacaagcaatccattgcgtcggcgatgcaaattgggttcgggaactgtggcgggttagtggcgagtaacgttttctttgatagtgagaagcctgggttcagaacggggttcggggtgagcctgggaatgacatgggtctgtggcgtttcttgcgctgtatttctggcatgtcttgttagagagaatagggtgagaagtcaggggaagagggattggaggtttggtctggaggaggaagagaagaggaacttgggggatgattatcctacgttccggttcact

SEQ ID NO: 36754 - DNA, 1513 bp, Aspergillus nidulans
tggtggaaaaggaagaatatgcggaagctttatatctacattatcatcctgattctgaccaacaccgcaaatggattcgatgggtccatgatgaacgggctccaaacgctctcctactggcaggagtactttaaccatccccgcggtgctatcctaggcctcttcaatgcgtccatgagtctggggtctctcattgggctttttttcgtgccttacctgatcgactggcgtggccgcaaaattggtcttgtcgttggctgtcttatcatgctgctagcagtggggttacagtcgggagcaaggaattttggcatgttcgtcgccgcccgcatcctgatcggctttggggactgcattgtgcttggtagtgcgccccttctgatcgcagagattgctcatcctcaagaccgagcggtcttggtcactctgagcggtgcctcgtatcactcgggcgctttcatagccagctgggttacgcttgggacgctcgaaattccggtaaactatgatatcacactggggctttgaagttgtgactgacggggcttagagtgactggtcctggaggcttcccagcttgttgcaggcgatctgcaccattgtcattgtcatcggagtgtggtggatgccggaaagcccccgttggctgatctatagggacagacaccccgaggcactcgacattctcgtaaaatttcacgcggaaggcgatgagaacgatgagtttgtccagctggagtacgccgaaatcaaggccgcgattgcattggacaagcagattggccataccggctgggtggacttttttaggtcccgaggcaatcgcaagaggatttaccttatcactgctcttggtctcttcagtcagtggagtggcaatggactgatctcgtactacctcaaatatgtcatggacggcgtcgggatcacaaatccccagacacagcttggtatcaatgcaggaatgaagactgagggcttagttaccaactttgtctttgctttcttcattgagaagctaggaagacggccgatgtacctggtctccacgatcggcacctgtgtcgtgttcaatatctggacaattgtttccgcgcggtacgaaattgcaccaaataaggggctgggatatgcctttgtcttcttcaccttcctctacggccttttctacgatatcaagtaagttccgctacatttccctgttgatctgcgccgtcagaatgctaatctgggaacggataggtcgggtctcatggcaacgtacactactgagattctcccgtatggtctccgtgcaaagggctttacgtggctgaacttttgcgtcactggagcactttttttcaaccagtatataaatgccattgcgctggaggcgttggcctggaagtattatatcgtgtactgcgtgttcctgggatttgaagtctttgtgatctactccttccttattgagactcgctacacaccgatggaggaaatcgctaagtattttgacggagatagcgccgtg

SEQ ID NO: 36755 - DNA, 1657 bp, Aspergillus nidulans
ggaatcatcgggcccggtttattggttggatcagggaaagccttcagcgaaggcggtccagcgggcgtgctcatcagcttctcgctcgttgggattatcgtttatttcgtcatgtagggcacttgatgagcaagaagaaaggggagtcgctaaatgccataggcaagcactcggtgaaatggcgaccgcgatcccagtcaccggctcctttacagagtacgcgcagcgcttcgtggatgactcgctcgcgttcgggctcgggtgggcgtactggtatctctgggtgacggtcctcgcgaacgagtacaacgccgtctcgctggtcataatgtactggaccgatgcggtcccgcaatgggcctggatcctcatcttctggattctgtttttagggctggcgaattttggggtgcgcgcgtatggcgaaatggagttttggctgtcattgtacgtctctccctgtgtgcgtctcgtcaaaagggcactggctgatccgcgcagaatcaaagtcctcgcgctcattgttttcttcatcttggccatctgcatcagcactggcggcattggtggcgacgtcatcgggttcaagtactggcataatcccggagcgtttgcggactcgatcaacggcgttgccagaacgtttgtcgttgcggggacattgtatgcggggactgaaatgtacgtcgccaccttcgagactttctttggagatactgatgttagctatcagggtcggcatcacggccggagaatccagcaatccccaaaaggccgtccccatcgcaatccgccaggtcttctggcgcatactcgtcttctacatcggtaggttctccccatctctgatattcatacgagactaattaaggctacaggaacaatgttcttcatcggcatcttgatgccctacaccgaaccccaacttctcaactcctcctcctacggcgcaaactctcccctgacgatcgccctctcctccgccggaatcctccccgccgcacatctcatcaacgccctcatcgtagtgagtgtcatctcggccgggatcggctcgctgtacgtcgcgtcacgcacaatcctattcatggcgcggaatggcaaagcacccaagatcctgggccgcacaaacgcagccggcgtgccctgggttgcgatcatcttctcaaatatcttcacctgcatcgtctttctgacgctcggcgaaagcgcggggaaggtttataatgcgctgatcacgctatcgggagtagccaccttcctcgtctggacgtccatctgcatagcgcatattcgctttcgggctgccctaacagcgcagggtcaatcgccgtcaacgctccccttccgggcggcgctgtatccctacgggacttattttgctctggttctcaatatctttatgatttttttccaggggtacacggcgttcctgaacccgttcagttcggacgactttgtgataaactatatcctcttgccggtgtttgtgctgtttgttgttggttggaaagtttggcataaaacgaagattgtcagactcgaagatatggatatctggacgggcaggagggagagggcgcctgaggtggaagagagcagcaggtggaaagggaaggggtggagggagaaggtctggaggggggttgttgggtga

SEQ ID NO: 36756 - DNA, 1473 bp, Aspergillus nidulans
cttctcatcgccattaactgcgtggctgccctgtcaatccttttctttggatatgaccagggtatgatgtctggagtgaacaactccaaggactatatcgatctcatggggtttggctatacggagatgaaggatggccacccttcccccgtggtgaccaacagtctgctccaaggcggcatcgtcagtgtctattatttaggtacgctcttcggtgcgctggttggcggttggactggagacaaggttggtagaatcaagacgattgccttcggctcagtctgggccatgtttggggccgctctacagtgctcagcccagaaccacgactggatgatctgcggttagccgtcttgcccgatccctgtgtttttgtgacttttctagctgacttaggtagcgcgatttataaacggaattggaaccggaatactcaacgcgattgttcccgtatgggcgaccgagactgcagaacacacgagtcgtggccagttcattgcaatcgagttcacactgaacatcttcggtgtcgtgctcgcatattggcttgaattgtaagcaatagaagaagccaacttggaccatgcactaacgatcatacagcggcctgtctttcatcgataacggcgcatcgcccttccgctggcgcttcccgatcgcgttccaaatcatcttcttgctcgttctattcgccgccgtttggttcttcccggaatccccacgttggttggtgagggttggtcgggagcaggaggctcggtatattctgggtaggctgcgtggcagcagcggtgaagatgccatccgggccgagggccgagttccaggatattctcagcgtcgcggaggcagagaggtccatgggccacagcacgtcttacctggctatgcttttcggatacaagaccgggaagttgcatcttggccgccgggttcaacttgtggtatggctacagatcatgcaggagtgggttggtattgccggtgttactgtttgtacgtcgcccttgagataatgtcgggcccaggctaatggttctgcagatgccccgactattttcagcattgcaggattcgattccatgaagagtcaatggatcagcggtttaaacaacgtcttttacatggtatgtcgtccttctctgggcttggtacaggcacatgctaacagaacagtttgctactatgatctgtgtctttactctcgaccgaatcggccgtcggtggactttgtactggggagctgcagcccaaggaatcgccatgttccttgctgggggtttctcacgtgtttcgatcgacgcacgagatgcgggcaacatggcgcgagctgaatcattcggtgctgctgcagcgtccatggtttttgtattcaccgcggtcttcggagccacctggctcacagtgccttggatctatcctgcggagatttatccattagccgtccgtgcaaagggtaatgcctggggtgtt

SEQ ID NO: 36757 - DNA, 667 bp, Aspergillus nidulans
caaggagcgttcaagtacggaggctacgagtatttcaagaagttctatagtgaccttgtcggggttgaaaatgccgcccgctataagacgcctttgtacttggcagcgagtgcttcagcagagctgattgccgacgttgcactctgtccctttgaggcagtcaaagtgcgcacgcagacgaccattccgcccgagttccgctccacgtttggcgggatctctgctgttgtcgcaaaagaagggacagctgggtaagcaggcgcttatgctgccttaacctgatactaatagggccagactatacaagggtttgtatccgctctggggccgacagatcccctataccatgatgaaattcgcttcttttgaaaatattgtcgaggccatttaccactacctcccgggccaaaagtcagactacaacaaaggcgcgcagactgctgtcgcattcactggaggatatcttgccggtattctgtgtgcgatcgtctctcatcctgcggatgttatggtgagtaagttgaacgcaaatcgcctgcctggtgaggcctttggtgccgccacaggcaggatttacaaggaaatcggctttatgggtctatggaacggcctccccgtcaggatcatcatgatcggaacattggtgagttcatatacagttattcct

SEQ ID NO: 36758 - DNA, 1346 bp, Aspergillus nidulans
caattttctccaggccagatcgagtctaactatcgatgagatcaccgactccttcgactctatggagttgaagcctgagctgcttcgcggtatgtgaagatattccccagtatcaaaggaaaaagtgggggcattttctgacagttttcggcatccaggtgtctacgcctacggtttcgagcgtccctctgctattcagcagcgtgccatcctgcccatcgtcaagggtaagttcagacattccacgcaacccgttctagcgctaatggactgtttcaggcaacgatgtcatcgcccaggcccagtccggtactggaaagaccgctactttctccatctccgctttgcaaaagctcgaccccaacgtcaaggcttgccaggctctgattgtcgctcctacccgtgaattggcccagcagatccagaaggtcgtcatcgctatcggtgacttcatgaacatccagtgccacgcctgcattggtggtactgctgtccgtgatgacatgaacgctctccgtgagggccctcagatcgttgtcggtacccccggccgtatccacgacatgatccagcgtcgtgtcctcaagacagaccagatgaagatgttcattctcgacgaggccgatgagatgttgtctgtatgttttagcctttgattttagtcgcacgatatatactgacatctgcagcgtggtttcaccgagcaaatctacgacatcttccagctccttccccagtccacccaggttgtcctgctctctgccaccatgccccaggacgttcttgaggtcaccaccaagttcatgcgtgacccagtccgtatcctggtcaagaagcaggaacttaccctcgaaggtatcaagcagttctacatcgctgttgagaaggaggagtggaagcttgacaccctctccgatctctacgagaccgtcaccatcacccaggccgtcatcttctgcaacacccgccgcaaggttgactggctcactgacaagctcactgcccgtgacttcactgtctccgccatgcacggtgacatggagcaggcccagcgtgatgttatcatgaaggagttccgctctggatcctctcgtgtcctcattgccactgaccttctggcccgtggtatcgatgtccagcaggtttccctggtcatcaactacgatctccccgccaaccgtgagaactacattcaccgtatcggtcgtggcggtcgtttcggtcgtaagggtgttgctatcaacttcgtcaccgctgacgatgtccgtatgatgcgtgagattgagcagttctacagcacccagattgaggagatgcccatgaacgttgctgacctcatctaaatt

SEQ ID NO: 36759 - DNA, 2784 bp, Aspergillus nidulans
acgaacatcggattgatcaccgctcgtctgtaccgtccctgggttggtgccgagattgcgaactcgattccccgttcgattgagaagatcgcggttcttgagcaggtccggaagaccaccagatggggcccttccttcatggacctcctttccagcctgactccggccgctgttggaggacgcagcccgcaaattgtgggctacagactcggctacgtcgagccttccactgctgtccaggctcttcgtggaatcatccaaaacctcagctctccttctcctatccagagtcttgaaatcggcagttccaacgttcctactctccagacccccctcgagcagccccgtattgagaacgcctatctgaaaatcctgaaccagcttttcggtgagcggttataccttgcgaaccagcttagctcgaacaacgccggaatttcttccaccattgcggccagccctgagtacggtttcggttctctgattgctagaaaggaacaccgccagcgcttcatccgtgaggttgaggcggcttccaagtccaacagctttgcaactgacgtcgtttccaaatggcttgccgactgggctttgaatgcgactgacgctacaaaggccaacaggttggcgccagatgtcattgctcgtctcagcaacgacggctctgcgctttcaaagcagctgctgcagactaagaagctgttctacagtgaatcccagtggctcattggttccgacgcctgggcttatgatcttggtaactctggtgttcaccacgttcttgcttctggagcggacgtcaacatgctcgtcattgactctcagccttactctgagcgctccgcagcagaccctacccgcagaaagaaggacatcggtctctatgctatgaactttggcaacgcttatgtcgcttccgttgctgtctacagctcttacacccaggttctccaggccatggcagaggctgagcagttcaagggcccgtccatcgtagtcgcttacctaccgtacaaccaggagaacgactccgccctcactgttcttcaggaaaccaagaaggctgttgacctcggttactggccgctctatcgctggaaccccgccaacgaggacaagggcgagcctaagttcgctctggactctgagcgtgtcaagcgcgagttggaggagttcctccgccgggacaaccagcttacccaactaatgaaccgccagcccaagttctcctctgtcctctccgagtcttacggtacggaggtccgcgctatccagaagcgcaaggccaaggactcctatgagaagctgctcgaaggtctctttggtgctcctttgactatcctcttcgcgtctgacggtggcaacgccgcgacactggccaagcgactgggtaaccgtggacgtgcccgtgggctcaagaccttggtcatggccatggaggactacccatttgaggacttgcccaccgaggagatcgtcgtcttcatcaccagtaccgcaggccagggagaattcccacagaacggccttgccttgtgggagtacgtgaagaacactggtgacctcgacctgtccaccatcaactactccgtcttcggtctcggagacagccactactggcctcgcaaggaagacaagatctactacaacaagcccgctaaggaccttgatgctcgcatcgctttcctcggtggacgcaagcttacagacattggtctcggcgatgatcaggatcccgacgcttttcagaccggttactccgagtgggaaccccgcatctggcaagcactgggtgttgacaaggttgagggtctccctgaggagcctgctccccttacaaacgaagatatcaagatccagtccaactacctccgtggtactattgctgagggcctgctcgacgagagcactggtgctatctctgctagcgaccagcagttgaccaagttccacggtacttacatgcaagacgatcgtgatgttcgtgatgagcgcaaggctcagggccttgagcctgcctacagcttcatgattcgttgccgtctccctggtggtgttgctactccctctcagtggctgcagatggatgccatcagcagcgcttatggtaacgagaccatgaagctcaccacccgtcagaccttccagttccacggtgtcgttaagcgcaatcttcgtggagctatgcgtgcgatcaacaaggctctgatgacgactattgctgcctgtggtgatgtcaaccgtaatgtcatgtgcagttcgctgcctgagctctcctactaccatcgtgaagtgcacgccgtgtccaagaagattagcgaccatttgctccctgccaccactgcctatcacgagatctggctccaggatgagaatgacaagaaggtccaggtcgctggggatgctgttgttgaccaggagcccttgtacggtcctacctatctccctcgcaagttcaagattaccattgcaattcctcctcacaatgataccgacgtatacgctcacgatattggtctcattgccatcaagggtgccgatggacacctggaaggtttcaatatcctcgctggtggtggtatgggtaccacccacaacaacaagaagacgtacccccagactggtcgcatgtttggttacgtgcccgctgatcaagcccacatcgtttgcgagaagattatgcttgttcagcgtgactatggtgaccgcaagaaccgcaagcacgcccgtctcaagtacacaattgaagatatgggcgtccaggcgtacaagcacaaggtaaag

SEQ ID NO: 36760 - DNA, 747 bp, Aspergillus nidulans
ctatctagaaagctggtgatcatcggtgacggcgcctgtgggaaaacgagtctgctgagtgtttttacattgggctacttccctacagtgagtattctctcttgtcagtccagtaggcagttactaatcgctactttatagcattatgtcggtcctttccttcccgcgtattcactcctcggtcttatctaatatacccccaggtcccaacggtgttcgagagctatgtgacagactgccgggtagacggccggtcagtccagttagcattgtgggatacagccggtcaggaagattacgagcgactgcgtccgctagcctactccaaagcccacgttatcctgatcggatttgctgtcgacacgccagattcgctcgagaacgtcaagatcaaggtccgtcgttatcgcttcacctgagtcttcatttacggcctactaacatatctcatatatacagtggatcgaagaagcgaatgagcgatgccccggcgtacccatcatcctcgttgggctgaagaaggacctccgcgagaaccccggagcgatcgaggaaatgcgaaagaagtctctccgatttgtgtcgcccaaggaaggaagtgaaacagcaacgcagatcaaggcccgaaaataccttgagtgctcttcgctaacaggcgagggtgtggacgacgtctttgaagccgccacccgcgccgcgctcctcaccttcgataagcggaaatcctcatgttgcattgtgctatga

SEQ ID NO: 36761 - DNA, 1017 bp, Aspergillus nidulans
atggccatggaagggttgcacaaggtgttcccaggcatggattacacaccctggggcgtccaacacccggagtgtgacaaatggccaccatcccagaacaatgtcacccgtgatatggcagtgctctcgcgactaaccaacaccgtccgcctttacggcacagactgcaaccagaccgaaatggtcctccacgccatcgaccgcctcgaacttacagatatgaaactttggctcggcgtttggattgacacaaacactaccaccaacgaacgccagctctcccagctctacgacattcttgacaaacgctccgatcactctgtctttaaaggcgctatcatcggcaacgaagctctttaccgcgcaggttccacaaaggaagaagcgcgcaagaacatcatcgactatatgcgccaagtccgcaagcactttaacgaccacaacatcgacataaaagtcgcgacctccgacctcggcgataactgggacgaaacactcgcagatgccacggatgtcgtcatgtcgaacgtccaccccttctttggaggcgtggaggtcagcaaggcagcgggttggacctggagtttttggaactcacataacgctccacttacacaggggacgaacaaaggcaatatcattgccgaggttggctggcccagcggtggaggaaacgattgcggcgacggcgccaactgcaaggatgatacctctggtgctgtggcgggggtcaagcagatgaaccagtttatggcagactgggtctgcccggcgctggagaatgggacagattatttctggtacgtttcatccatccacctaccgtgcatcccgtcaatccttggagtcattagtactgacaggaattacaggttcgaggcctttgacgagccctggaaagtgaaattcaacaaaggtgacgagcagtgggaagacaaatggggtctcatggaccctggtcgcaacttgaagcctgggatcgaaatcccggattgtggtggcaagacggctgcatag

SEQ ID NO: 36762 - DNA, 3343 bp, Aspergillus nidulans
gatatcgagaacaagaagacgaccctcgttgaagtcgtgcaatctctgggagaatacgtcaatgacgaagatccactacttcgcggcaaggccgtttcctacctgagcgcggtgatcaaggcgcttcctccaaaattcctcacgagacaacaggtccaggtcctgacgactttcttctgtgaccggatcggagatgcaggcgcggttactggacttgagacgttgcagaaactagacaggttcacgaaggagatggctgaggaattggcgacagcgtgagtgttagctatctctatcgcattgccgcatccccccgccgcgtttggaatcatgagggctgacctgcagaatacaggctgttcgagaacttcaataccttgcaatctcgtgcgcagtctcagagatttcaggtgtatcagctactcaacgagttgatgtccaatcaccgatctggtttgtcgcggcttcctttcggcgtcttccgtatactgacgggttagtcttacataatatgggcgacacttctctcgtcgggatggtagatctcatgacaggtgaaaaggatccgcgcaaccttatgttggtgttctctatccttaaagtgatcatggttgagtgggatatctcaaggcacgtagaggtaagcctcttcaatcacgatgcttttgaggcaaattctgacttaagaagctgttgtttgattctgtctacaactactttcctattacgttcaggccgccgccaaacgatccttacgggatcactgcacaagacctaaaggaccgcctgcaagactgcatttcatcgacgagtcacttcgcgccccattctatcccggctttactggataaactagattcaacttctcagaacgttaaggtatgcaataataacctaacgccaccgtgcacataatctaacatgctcaaagaaagacgcactgaatgccctgattgcctgtatcaattcatataatcccgataccgtgtctacgtattcaatcacgatatgggagacgcttaagtttgaggtcctcaatgcccaagaagaacttctctccgacctctctctcaaggcgttacacgatatagcaaggcgtctatctgagggcgtaatgcagatacacgaccagttgcctctcgctcagtacctacgtcccataaccaaagagtgtaacgagcaattaagagaacctcagcagaagcaagccaagcccgcgcagaagattttaaaggccgtttcggaggcctctgcaccttccttcactctggtcgcgcaagttgtcattgcacccctcttaaccctctaccagggagccgatgggatcacaaaacagcgggctcttttggaaacattgacattgctttttgagtctgcgatatctgtttttggagaatggacaacgcggaacccggaaacatctgccgaaaatcctctgctagaattcaaagatcagttttccgagatatttggtcaggctttgatgagtacggtcaaagaagaggtctctttccgcgtttctgctttgaaaggattcctacgtctgtcagtcctgcgcgattactttcacgagtctgagattggcctgtttgtgcaataccttgacgagattcttctgacggaagagccagtaggccgcgatgacttgaaaagggaagcaatagctgctcttgctgaggtttcaaagcatcaaccgcggctgataatggatatcaccttcccggccttcgtcgctacgcttcccgattccgacgaaggaacggataccagctacctacctaccctagaaaccctggctcaaataagcgtcgaaaaagctatctttgagacactggtacgccggttgctaactaagttgtcgctactgctgcaaaaggaacagccaggctctgtggcctatccaagggccattctcatgaccatcttttatgttatgaaccagaggcgactggatggagaacctggtttggagatgtactatgataaaatagtggtagctatgtgccggaatgctgctgcaacagctttaggtaaagcgaagaataacatcctaggtgataccacggttctcgatgtcctaggacggctctgcaacctcattgttaggtctctcccaagactaaagcaagatgaagttacaaagaacatctacgccctgttcgctttacccgaggacttccagcctgtcccatttgcgcagtcgccatctgaagatcagcgacgtacgatgattctgtcgacctaccttttagctggtctgccagtggactcgaaactcccccacagcacccccaacatggccgaccttctctcataccttgtgaagctctccatagctgaaacctcgccccaaatccaactcgccatccttcgccacattgctcttctcgtgaacaaattccttcccaaatccgagcttgaaatcgcaaacacattactaaattccttccttttcacggacactacgaccgctttagagccaacaccagaagccgtcagaacagttttctggctttccaaagcgctcattctccgcctcgctccaacaacgacccagatccttacctcccttctccacctcctctcctcaccgtctgaacaaacaagcacaactgcctcccgtggctttgctatccttctaaaggatgatgacgttctctcccccataaacggcgcgaatatccgcctcctctccaaccaacgtgtcttcactaccttggtccccctcatttccaccaaaatccgggagattaacattaacagcagcggaaccaccatgatggcagcagagcaagacaaagcctacatgaaacccgcccacttaacagccctctctggaattctctcgactatccctcccgctcttgatatgcgtgagctcccaaccctgctacccctcctcctgcaatcccttgacctccaaacagcaacacgcgactctttcgccgtccgcgccgcgacactccagaccttatcggtcatcattcgcgagaatggggtcggcgtcattgaagagtgcgggcatgtccagagcctagtcactcgactcctcaagacagctgagcacaagccattacctgctgcatctgcctctgaaaagactggtgaaggagcggctgtaaacgcaccccgcctccgggtcgacgcgcttagatgtctcttcttactcgcccagcctcgtaatgcggaaaatgcccctgccgttgcgaaagccggtaaattgtcgccgcttttgccagttcggagccaggttctgcgcgcactgaaagttgtccttgatgatccgaagcgggatgttaggaaggctgctgttgatgcgaggggcgcttggttgagggggatt

SEQ ID NO: 36763 - DNA, 731 bp, Aspergillus nidulans
atggcggcttcagtgtcgaagatcatgggcaaaatttttgaaacaaagaagatgcggaattctcatgctgggtttggattctgctggaaagacgagtacgttgccgattcatgttcccttaaaactctcgcgagcgtttactgacttccatagcaattttgtacaaactcaaactcaccaaccaggatgtcaccacaattcccacagtcggcttcaacgtcgaaagcgtcacctataagaatgtgaaatttaacgtgtaggatgtgggtggtcaggacaagatccgtcctctctggagacactacttccagaacacccagggtatcatcttcgtcgtcgacagcaacgatcgcgaccgtattgtcgaggcccgggaagaactgcaacgcatgtgaacgaggatgagctccgtgatgcccttttgcttgttttcgccaacaagcaagatttgcccgtacgcaccaccttgacctggtcgataaacattagatgctgattcgaattttcctagaacgccatgagccccgccgagatcacccagcagctcggtcttcagagcctcactcgtcgcccctgggtaagttgacccgatcattctggtttatcatcgatatctaacacatttctagtacatccaatctacctgcgccaccaccggagacggtctgtacgaaggacttgaatggcttgccgagacgctgcggaagactggccgcgactaattgcggtag

SEQ ID NO: 36764 - DNA, 1930 bp, Aspergillus nidulans
cagcttagcgaatctttatctagaaaggccctgactgctcccgttccagcgcctgccggcaagaacttcgaaaacgtaacctcgaacactagagtacccgctgcgtcatctttgatggatataccaaatgttgtgagctttttcgactccatgccggaggagatgaagacgtacctcatgtatcaacttctcaaacgctgtccaaaaccgactttgcactttgtcgccgacgttgttaacccagccctgaaatgcgacttcctcacacttcttccacctgaattaagtctaaatattgtgaaatattttgatgtacaaaccatgtgtcgtgctgcgcaagtatcaaagaagtggaggcacatcatcaattcagacgagaagtcatggaaagagctcctcgatcgggatggctttacgcttcctgaaggagagttgcagcgtgcaattcgagagggttggggctggcaatttcctaatgggcttgaggattacgaaaaggaccttagcctatcgtccttaatttcggagccttctggttctgctttgtcgccacttgctggacctagcgacagatccacggctgtcaaccgtcgaccgaagaggaaagcgaattcgagagtcttgagcaggaaactggcaaagcgcatgatttcgtcaagcggcactgatcaatcagactcttcagactggaaaaaggatgtgtcagtcgcagaaggtccatatgccgctgccaatgctgcggccgcggctgttccatatccagatataggtctcccatccctaaggggtcttcacttgtacaagtccttataccagcggcattattgtatgcgcaaaggttggatgaaaccgggagtgaagcctagacatattgcattccgtgcccacgaccgtcatgtagtcacatgccttcaattcgacacagacaaaattttgacgggcagtgacgacacgaatatcaacgtgtatgacacgaaaaccggcgtgctcagggcaacgctcgaaggacatgagggtggtgtttgggcgcttgagtattacggcaacactcttgtatcaggatcaacagataggtccgttcgtgtctgggacatcgaaagggcgaggtgtactcaaatattccacggtcatacatcgactgtgcgttgtttacaaatagttctgcccgttgaagtcgggaagaaagcagatggcacttctgatatgatgcccaaggagccattgatcatcacaggctcacgggactcaaacctacgcgtgtggaagcttcctaagcctggtgatcccggttactatcaaagcggtccgcaatgtggatgatactgattgtccatattttgtccgtgtactcaccggtcatcagcattccgttcgcgccattgcagcccatggggacactctggtaagcggtagttatgactgcactgtgcgtgtctggaagatttcaactggggagactgttcaccgattatctggccattcattgaaagtatatagcgtggtccttgaccacaagcgaaaccgttgtatcagtgggtctatggacaacatggtcaaggtttggtcactggagactggctcgattctctacaacctggaaggtcatacgtctcttgttgggcttctggacctgaagtgtgatcgtcttgtctcagcagctgcagactccactctccgcatctgggatcctgagacgggtcaatgcaagagcatgttaagtgctcatactggcgcaatcacatgtttccagcatgatggccagaaggtcatttcgggctccgaccgaactctgaaaatgtgggatatacgaactggagagtgtgttcgcgatctcctcacaaatcttggaggagtctggcagatcaagttcaatgaacgtaggtgtgtagccgcagtgcagcgggatggcatgacttatattgaggtaagt

SEQ ID NO: 36765 - DNA, 1625 bp, Aspergillus nidulans
gatcatcagtatgtcgacagcacatcttcagtccgccccacggtcgtgaacccctacaatgaaactcccattccatacgaggcccacgctgccagtgcatccgacgtcgacgccgccgtggccgcagctaaaaccgcgtacaagaccagctgggcttctttttctcctgcacagagacaagcatgtatgctcaagtttgcagacttggtggagcgcgatgcagaacgacttgccatcctcgagtccctgcctacagggaaaccggtgacgcctaccatccactttgatattgcgcatatgttggaggtttggagatgtacgttgcgtgcccctcacaccgatatcttccgctatcttctactttcagagggacagcagactgatatatattgagatagattatgccggctggaccgacaagatctccggcgaatcgtaccctgagtccaacggcgtgtacaagatcgtccgccacgagcccctcggcgtctgcgcggggatcgcctcttggaacgcgaccttcatgtatatcggttggaagattgcgccggctgtcgccgcaggcaactgttttatcttcaagccgtctgagaagtcaccgtttgggacgctggcgctcggtgcgcttttcgctgaagctgggttcccggcgggtgttgtgcagatcctcaacggcggtgcagagacaggtgctgcattggcgaggcacatggatatcgcgaagattagcttcacgggctctctgggcggtggcaaggctgtgcaggaggcggcgacaaagagtaacctgaagaaggtcaccctggaacttgggggaaagagcccggcggtggtgtttgcagatgcagagcttgagagggctctaggagggtaaggctactccctttccatttggctgggaaacaggggcatggttttgttactgatactaaagagctgacgatgtagggtctgcggtttcctgtttaactcgggccaggtctgtgtcggtacgttctccatatactccattgttttcggcttcaaccctgccatactgacaaagaaaagcgacatcccgcgtcctcgtacagaaaccgatcttcgagaaattcacccagggcctcaagtccgccttcgaacagacctcctccactcttggcgccgaccctctggacaagaacgtcagctacggccccatcgtcgacaaagcgcagttcgacaagatcatgtcctacatcgccatcggcaagcaaaccgccaccttactgaccggcggcgagcgaaaaggcgacaagggcttcttcatcaaaccgacaatcttcgtcaaccccgagcctgagagcccgatcgttaaagaagagatctttggacccgtcatggtggttcagacattcgagacggaggaagaggcgatcgctctggcaaatgcgaccgtgtatgggctggcagcttctgtgtatacgtcaaacattgaccgcgctctgagggtatcgagcgcgctcgagtgcggaggcgttgccgtcaactcgccgttcctgccgcaggtaaatacggcgtttggaggcatcaaggcgagcggaaagggacgagagctgggtctctatgggctgctggagtatacggaggcgaagagtgtgcacatc

SEQ ID NO: 36766 - DNA, 1079 bp, Aspergillus nidulans
gacatctcaagccagctacattctggctacagccatccactcagcatgtcatggcaagcagagaggcaattgaccaaggtctgtagcataaaaatattcgttacctctacttcgcctgaacttcgctttcactgcagtcgcgtcgttcatgcccgatctgacttgactctaggaaatgttaatctactcttttttcatcaccgacaacccggatgaagagacgcctattccgtcactcccaaatcaacaccgtcgaggattgaatcggctcgtaccattcctgcggccccttgttcagaagggtctccgctctgttatcctgtttggtgttccgctgcatccatctgccaaggatgcattgggaacctccgcggacgacccagccggccccgtcgtacaggccattcgtcttctccgctcgcgctttccagaactttacatcgtgactgacgtttgcatatgtgaatacacatctcatggccactgcggaattctgcgggaggacggtacgctcgataatgcgcagtccgttgaccgaatatcggatgttgcgttggcttatgctagcgctggtgcgcactgcgtcgcgccatctgacatgaacgatgggagagttcgcgccataaaattgaaactaattgaggctggtctggctcatcgtgtgctgttaatgtcttatagtgctaaatttagcggctgcctttatggaccgttcagggacgcggctggttcttgcccttcatttggagaccgcagatgctaccagcttccccctggtggccgccgggcttgcacggagagctattcaaagggacatcggcgagggtgcggatatcattatggtaaagccagcaagcagctatcttgatatcattagagacgcaaaagaacttgcgaaggatattccaattgcggcttatcaagttagtggcgaatatgccatgatacatgctggagcaaaggctggagtcttcgatctgaaatcaatggcttttgagagtaccgaaggaattttacgagctggcgctgggataatagtcagctattttgtgccagaatttttagattggctctaattt

SEQ ID NO: 36767 - DNA, 953 bp, Aspergillus nidulans
tccatgtctgcagacttttgggccggctatattagcggcgctatcggtataatcattgggaatccccttgacctaattaaagttcgactgcaagcaagcagttctgccaatggccctgtatcacctcgacagttgactcgatttgagagcactagttctcttgtgcgaggtatgtgaactcctgcgtggttgtccactactattcgtcatttctgattcttccaggcgctgcggctccaatccttggatatggagctctcaatgcactactctttgtgtcttataaccgggcattgatgctcttggatagatcagtcactgaccccaccaaccctcaaaattgtgctctatataaactttggcttgctgggccttaggcggaattgccagctggacagtttcctccccaacagaattcatcaaatgccgagcacagcttgacgcttgcccgggagtctcatcgtggacagtcgccaaggatatcgttcggactcgcggctggaggggattatattttgctggtggaataacatgtgctagagactctataggatacggattctagtacgtatttcctaagctctttgatagaaggcgtttgtttacaggttgacagcttctggtcctacgaatactgcaagaggttaatgtcctctcccgatggagaagatacgagcaatactgccttgaaggtgcttttttgcggcggcattgctggaatagttacatgggcttccgtcttcccgcttgacgttattaagacccgtctgcaagcaagtacgattgcggactatgctgaagcacgccctttattacaagcgcagaccagcaaacagacgctaggttcgttcgacctggcaagggagatgtatcgagcggaaggcttcaaagccttttatcgaggcattggggtatgcagtttaagagccttcatcgtaaatgcagcccaggta

SEQ ID NO: 36768 - DNA, 1011 bp, Aspergillus nidulans
acagcatactacagcgtcgataaacgcaatgggaaatcagtggcgatcaagataattgacgttgaaaacgccgaggatgaagtcgaagatatcatccaggagattgccatcctgtcggaactcaactcgccatacgtgaccaggtaccatggatcatatttgaaagggtcgagtctatggattgtaatggaattctgttccggaggcagttgctctgatctaatgcgcccggggcctattccagaggaatacattgttatcatcattcgagaactgcttaaaggattggactatctgcacagcgacaaaaagctgcatcgcgacgtcaaaggtgcgcaatcacccgttactattgggaatatggttcaatactcacgattaatagctgcaaacatcctcctaacgtcgggcggccaagtaaaactggcagactttggcgtctccagtcagctatctgctacaatgaccaagaaaaacaccttcgtaggaactccgttttggatggccccagaagtgatcaagcagtcaggatatgattacaaggccgatatctggtcactcggtataaccgcgattgagcttgccaatggggagccaccgtactcggatatacatcccatgaaagtcctttttctaatacccaaaaatccaccccctacactgcaaggtgcatacagcaaagcattcaagaactttgtcgagctctgtctacgaagagacccgcgagagcgaccaacggccaaggagctccttgagcatccctttatcaagcgagcaaagaagaccaattacctaacggagctaattgagcgctatgagcgttggcaggcagttagcggaaatcagaaggctgacgaagatgacgagctggatcaggagcctgcagctgcgccgaagaccaccgaggaagaggatgacctttgggattttggcactgttcgccctgtgggccgagggcacgctttaaatccgatgagagtgacagatctcaacgccaggggctatggcacg

SEQ ID NO: 36769 - DNA, 1263 bp, Aspergillus nidulans
agggcgatcgcccaacttcgcgcctgtcgcttaatccccgaggcccaagtccgcgaactctgttacaaagcgcgagaactcctgatagaagaagggaatgttgtttgcgttgatgcgccagttacgatatgcggggatattcatggtcagtttcacgatttgatggagctcttccgtgttggcggagacgttccagacaccaactacctattcatgggcgacttcgtcgatcggggattctactcgttggaatcgtttcttcttcttctctgtctgaaagtccgctatccagaccgcatcacgttgattcgcggcaaccacgagtcccgacagatcacgacagtgtacgggttttatgacgagtgcatccgcaagtacggaagtgccaatgtttggaggtactgctgtgaggtgtttgactatctagcactcggggctttagtccttggagccagttcagagctggagccgtcaggaccaagttacaacgacacgacgcaatcaaccatgtcgaccgatgacagcgagctggagaccgaggtgctaaactccaaaggggaagtcctcatgaacacctataggcccagatcaagaacgtcactagataacggaaacacatcaccctcaagagatcaaagccagacacccatgcgatccggcgcaccagggacaggcgcatccggcagcgcattcggcagcaacaatagcagccgaaccggtgccgtcctctgtgtgcacggtggcctttccccccttatcgatacagtcgacaaaatccgccttattgaccgcaaacaagaagttccccacgaaggcgccatgtgtgacctcctctggtccgacccagacgagattgatggctggggccttagtccccgcggcgcaggctttctcttcggcgccgacatcgtcaagcagttcaactacaagaacgacctgtctctcattgcgcgcgctcaccagctcgtcatggaggggtagaaggagatgttcgatgctgggatcgtcactgtttggtacgcactgaactagtgctatggttgcgggaatgctgatgctatcctggaattaggcgaagatacgagcagcggtggcacagtcacaaggagcaatggcgaccaaggtcggagtaatggcatcttgtccagtggtgtcgataagcaggccctgcgtagccctggacgaagatatagggtctttgaagccgctgcgcaggatacaaggggtatgcctgcgaagaagccagttgctgattatttcttg

SEQ ID NO: 36770 - DNA, 1097 bp, Aspergillus nidulans
atgtcgctcacaaattgtcggttctacgaggagaagtacccggaggttgacagttatgttatggtcaacgttaagcaggtatgagatcggattgcaaatatagccatttggaacagcaaattaatataccgactcctcatatctagattgccgaaatgggtgcctacgtgaagcttctcgaatatgacaacattgacggcatgattctgctctctgagctttcgcggagacgtattcgtagtatccagaagctcatccgcattggccgcaacgaggtcgttattgtgctccgtgtggacaaggagaagggtgagtgcaacgtgagcagctagcgagagaatttctaaccctttgtcttcgacgttaggttacattgatctgtcgaagcgacgagtttctccagaagatgttatcaaatgcgaagagaggtacaacaagagcaaggctgtccactcgattctgcgacatgttgcagaggcaactcagacccctcttgagacgctataccagcagatcgcctggccgttgaaccgaaaatacggccactcgcacgatgctttcaagatctcaatcacgtaaggctcttccagctagacgtcagaacttcgcgtaactcatattattcttataggaaccccgatgtttgggccgatgtcgaattccccaatgaagccgtgaaaaaggagctgactcagtacattggcaagcgacttacaccccacccgacgaaagtgcgcgcggatattgaagtcacctgctttggttatgatggtatcgatgcggtcaagaacgctctgcggaccgctgaggcagagaacactcctgagaaccaaataaaggtcaaactggttgctcctccgctctatgtcttgactagccaatgtctggacaagacacacggtatcaagatgcttgaagaagccattgaacggattgagaccacgatcaaagcgtctggcggtggctgcactgttaagatggctcccaaggctgttacggagcacgatgacgctgctcttcaggagctcatggagaagcgcgagcgtgagaacatggaggtcagcggagacgagagccagtctgagagcgacgagggt

SEQ ID NO: 36771 - DNA, 1092 bp, Aspergillus nidulans
gatggtgctgtcattcgcaacatcgaggcctgccaggccatctcccagaccgtccaaacgtcgcttggtccgtacggccgcaacaagattgttatcaaccacctgcaaaagatgattctcacatctgacgccgctacaattctccgtgagttggaagttgttcatcctgcagccaaactcctggtcatggcgagtcaacaacaggatgcggagatgggcgatggtaccaacctggttattgttctggcgggagaactgctgaagaaggctgaggaattgctgcgcttgggtctgaagacgagcgatatagttcagggatacgagaaggcacaaaactttgcgcttaattttgttagaaggtgggttcttgatctttcaataaaatgtccctgaatgtccccgtcttagaggccatatctaactgaaggatgcaatagatcttgaagtcgatcgtttgcaggatttacgctcccagactgaactcactaaggccctacgcacggtggtcgccagtaagcagtccggtaccgagcagctcctcgcttctcttgtcgccgaggctgtcctgtccgtgctgcccaaaaatcccgtcaacttcaacgtcgataatgtccgcgtggtgaagatcatgggaggaagcttggaacagtctcgtgtgattaagggtatggtgtttggccgcgagcccgaaggttcaatcaaaaaagcccacaaggccaaggttggagtcttcagctgccccatcgatatctcccagaccgaaaccaagggtacggtcctgctcaagaacgcgcaggatatgcttgacttcactaagggtgaggaggagcgccttgaagccgctattaaagagctctacgactccggtttgcgtgtcgtcgttgcaggcgctcaagtcggcgacctggccctccactacctcaaccgcttcaacatcctcgtgatcaagattctctccaagttcgagctccgccgcctgtgccgcgttgttggcgccactcccctcgcccgcctcggtgccccaatgcctgacgaaatgggctccgttgacgttgtcgaaactaccgagattggaggcgaccgcgtcactgt

SEQ ID NO: 36772 - DNA, 948 bp, Aspergillus nidulans
gggctaacaaacgcagtctacgccagcaaagaggtcatcctctctggcggctctctcgacacgccgcgcattcttatgcactccggcattgggccggcagaccacctcaaagaattcggcatccccgtctttaaggacgtgccctgcatcggccaggggctgcgagaccaccccttcgtcccgatctgctacctccgcaacccgtccacaaacgaccgcaatgcgttctacggctcgcaagaagccatggacgccgcaatgaaacagtggctggtcgacggatccggaccttgggcacgccatggcgcccagctgatgatgggctggctgaagagcgatgcggtgaccaagtctgccgagtttgccgcgctaccaaaggacgtccagactttcttgaacagaccaacagtccctcactatgaggtctcggccgggttcccgctgcatatgctggcgccggaactgaccaaggactacagctatgtctgtcttcttgccttcctgatgaacgagcagagtgccggcgaggtccgactgcagtcgtccaaccctgaagttcccttgctctttaacgccaacttcatggcgcacccgtacgatcgtcgtgtctgcgtcgaggctgttcgggaagttttggctgtgacgaaccaccctgcctttgccaaagataccgtgaacatgatccttggccccaagtccgacagcgaagaagatattttagaccactggaggaacacgatcgtctcgtcctggcatatgacggggacggtcaagatgggcaagcggggcgagcaggacgcggcggtggacaagagcttcaggctcatgggagtggacggactgagagtggcggatatgagtgtcgtccccgtcctggcaaacaaccacacccaggccacggcgtacgttacgggctcgacggcggcggacgtgttaatcaaggagtat

SEQ ID NO: 36773 - DNA, 1513 bp, Aspergillus nidulans
tccactgtggtagaagaggctacgcgcattgctcgccagttcgagtactcgccggagcaagtgcagcgcggagtgaaggagtacatcagggaggttgaggagggattgtccgaggagggcacaaccttaagtcagatcccgaccttcgtgacgtctgtgcccaatggcactgagaaggtacggattccgctatgtgagcagtctgaagccgggtctgacattgttgcaatagggcttgtacttggccgttgaccttggaggcaccaacttccgagtctgctccatcgacttgcacggcaaccataccttctccctcacgcagtccaagatcatgattcctcgcgagatgatgacgtcaggatcagcaaaggagctcttcctctttcttgcgcgtcagatcgagtccttcctgcgcatccatcacaacgagcattttgaggctcatttgaaacgcaagattgccggaacagccagggaggaggatttgtttgatcttgggttcacatttagctttcctgtgcgccagttgggaattaacaagggtacgcttattcgctggacgaagggcttcgacattcccgacgccgtaggccaggatgtttgtgcgctcctgcaaaatgccatagaggaactgaacctccctgtgcgcgtggctgcgcttgtaaacgataccgtcggtacgctcatggctcgttcatacacgtctcctggcgagactggaacttttctcggtgcgatctttggaacaggcacgaacggtgcctacgtcgaaaaactcaacaagattaccaagatggccaagattgagcactctgattacgacaagtcaaccggcgagatgatcatcaatgctgaatggggtagcttcgataaccatctgagcgttctgcccactacggaatacgatcggcagctggatgctgacagcaacaacccgggtattcaaatgttcgaaaagcgcgtctctggtatgttcttgggcgagattctgcgtctggtcttgctcgacttgcacaagtcccaaggtctctttaagccggcttcggggtcggatgtcttcatcccagagtcgtcttccctctaccgacaatggggtattgacactagtcttctgagtattgtcgaggcagataagagcaaggatttcgagcaggttaaatccgcgctgaaggaccacctgaaggttgagcgggcgagcgaaaatgactgcaaggcagtccaaaccgttgttcatgctatcggcaaacgtgcggcccgcctggctgctgttcctattgccgccaccctcatttccacgggcaagctgaaggaagagctggtggacatcggcgttgacggcagcctggttgagttctaccccaactttgagggctatatgcgtgaagccatgcgcgaagttcctgaggtcggtgatgcgggagacaaaaaggtgcggataggtatctcaaaggacggcagtggagttggcgcggctcttattgctctcgtcgcaagcaaagaggggacaaagccc

SEQ ID NO: 36774 - DNA, 1431 bp, Aspergillus nidulans
gcttcgcgcggctatgctacagcgtttaagtgggaggaccccctccttgcgtctgagctctacacggaggatgagctggctattcaggagacagcaaggcaatactgtcaggaacggttacaaccacgggttcttggtaagtggtccgctgcaagtcatgcggcatttcataatctggcagtcgcccgatccccacagaagctccttgctgactccttgattgtcactagacgcctatcgaaacgaaaactatgaccgaaagattcttgaggagatgggtgagcttggccttttgggtgctagcattgaggggtatggttgtgcaggagtgagcacggttgcgtctgggttgatcacgaaggaagttgagcgcgtggactcgggatacagatcgggaatgtctgtgcagagctctttggccatgaccgcgattcatgagtccggtactcaggagctcaaggatagacttgtcccagagttggcgaagggcaagctagcaggctgctttggtctgactgagcccaaccacggttctgacccagggtcaatggaaactattgcgcgtgaacaccctaccaagaagggtgtttatctgctctccggcagcaagacctggatcaccaactcgcctatctctgacattttgattgtttgggccaagttacaaagcactggcaagatccggggattcgtagtggaacgcagcaagtgtcctccaggaacgctagagacacctgccctcaagaacaagtcagcgctccgtgcatccattactggcatgatccagctggatgattgccccgtgcccgtggagaacatgttccctgatgtcgagggactcaccggaccttttacctgccttaacagtgctcgtctgggtattgcctttggggccatgggtgccctggaggattgcatcgaccgtgctcggacctatgccttggagaggaagcagttcaaggggaaccctctggccaagtaccagctgattcagaagaagctggcagatgcagtcacagacgctacatacggcaccttggccgcaacccaggttgccagactgaaggacgctgggaaatgcactcccgaaatgatttcattagtcaagaggcaaaactgtgaccgggcgctggctaactctagaacgtgggtgtttccaagatcctaccagccgcggcagtcttctatgatccaaaaaatgagctaacccgctttcttaaacagactgcaggaagttttcggtggaaatgctgcaagcgacgagtaccatattgctcgccatgtggcgaacttatttgtggtacaaacatacgaaggacagagcgatattcatggtaagtgcttttctacttttgactgttcaacaatactgatctcaaattagccttaatccttggtcgcgctattactggggtgcaggcgtttgtgtag

SEQ ID NO: 36775 - DNA, 382 bp, Aspergillus nidulans
ggtgactccccatactcgggcggcgtgtttttcctaacaattcacttccctaccgactatcccttcaagccaccaaaggtcaacttcaacactcggatctaccatccgaacatcaactccaacggcagtatctgccttgacattctccgagaccagtggagtccagccttgacaatctccaaaggtccgtcatcgaaactttgttccactaaatttgtcgaccaacactaaatgcttcgcagtgctgctctcgatatgctccatgctcacagatcccaacccggatgaccctctggtgcctgagattgctcatgtgtacaagactgaccgtccccgatatgaagccaccgcacgtgaatggactcgcaaatacgccatctga

SEQ ID NO: 36776 - DNA, 2120 bp, Aspergillus nidulans
tcctttgacttctcctttgaggccgttcgtgagaaccttttccgcgttactttcacctccccgtcccatcctccccctccataccccagcgtcacgaagccaaaaactagcctgaacggcatcgaggtcgcgacaagcagcagtccttcgcaaatagacatcgaggttggagatgtgaaagccgcagtcaactgggagaacaccccggtggtctcgctgtcatggaaaggtgacagcaagccgctgtaccgcgacctccccctacgttcgtatgtcatcgacggcgacggcatcgcccactacaccgagcacgaccgaaaggcacttcacgtcggattgggtgaaaagtctgcccctatggacctcaccaacaggcacttccaactctcagccaccgacagtttcggctacgacgtctacaacaccgatcctctctacaagcacattccgctgctaatcaaggcgacgcccgccgggtgcgttgccatcttctcgaccacacatgccagggggacatggtccgtgggctcggaggtcgacggtctctggggccacttcaaagtctaccgtcaggactttggcggcctagagcagtacctcatcgtcggtaggacgctaagggaagtggtcagatcctacgccgagctggtcggcttccctctggccgtccctcgctgggcctacggttacatctccggtggttaccggtacagcgcgatggacgaacctccagcccaccaggccctgatggagttcgcagacaagctcaaggagcacgatatcccctgctccgcacatcagatgagttcaggctactcgattgctgagcacgagccgaaagtccgcaccgtatttacctggaacaggtaccgattcccagatccagagagatggattgcagagtaccactcgcgcggtatccgtctcctcactaacatcaagccgttcacgctcgcctcgcacccggacttccagaaactcattgacggaaacgggttcttcaaggatccagaaacgggagagcctggttacatgcgcctgtggagtgccggaggtggaacaggaggcgatggatgccacgtcgattttacctccgctgtcgccttcaaatggtggtataacggtgtccagtttctgaaacggtctggcattgacggcatgtggaacgataacaacgagtacaccctccctaatgacgattggcaattggccctcgacgaaccgaccgtcgccgaggcagcgaagaagcagactgataacaacaccgtcggcctttggggccgagccatgcacactgagcttatgggcaaggcgtcccacgacgcccttcgtgacctcgaacccaacgtccggccctttgtgctcacccggagcgccacagccggtacgatgcgatactcggccagcacatggagcggcgataacgtcacgagctgggagagcatgaagggagccaacgcgctgtcactgaatgcagcaatgtcccttctccaggcaagtccactatgccccaaccagagcatcctgaaacttctctaacaagtcgacagtgcgaaggtcacgatatcggcggattcgaaggcccgcagccatcgcctgagctcctacttcgttggatccagcttggcatctactccccgcgcttcgcaatcaactgcttcaagacatcccccaataacaacgaggtcggagaagtcatagaaccctggatgtaccccgaagtgacacctcaggtccgtgccaccataaagcggcgttatgagatcctgccctatatctataaccttggcttggagagccatttctacgcctctccgccccaacgctgggtcggctggggatatgaatctgatcccgaggtatggagcaagaagctcaagcgtggcgaggaacagttctggtttggcgagaccatcctcgtcgggggtgtttacgagccgggcgtcaatgtcgccaaggtgtacctccctcgcaaggcaggggacgagtttgactatggctttgtcaacatgaacgccccgtacacgtactatgcctccggacaatgggttgaggtcccctctaaatggaaggaaagtattgcccttctcgccaagataggcggcgcaatccccgtcggc

SEQ ID NO: 36777 - DNA, 520 bp, Aspergillus nidulans
tataaccgtttctgacaaacggcgacaggccagattaccactaaggagcttggcactgtcatgcgctcgctcggtcagaatccttcagagtctgagcttcaggacatgatcaacgaagttgacgccgacaacaatggcaccattgactttccaggtacgcgaactccccaatctacttcgcaccagcctagaaatgtactaatgctaaacagagttccttaccatgatggccagaaagatgaaggacaccgattccgaggaggaaattcgggaggcgttcaaggtcttcgaccgtgacaacaatggtttcatctccgctgctgagctgcgtcacgtcatgacctcgatcggtgagaagctcaccgatgacgaagtcgacgagatgatccgcgaggcggaccaggatggcgacggccgaattgactgtacgttggctccccgcttatccttgaccgtagaagaggtatgatactgatcggctgcagacaacgaattcgtccaacttatgatgcaaaaataa

SEQ ID NO: 36778 - DNA, 1818 bp, Aspergillus nidulans
ccaggcgcggagaaaacttacattgaacattactcacaaccagcccacgacataaccgagatcgccaaagacaaccgtatccactggactaagcacgccgagcagtatccgattgccgattatatctctctgccaactgcctctccagctccgattcccaagatccaatacgacttccccgccgaatcatggtttgctcgtatatggcggaagaggaagcagggcgcggtgaaggaggctttcaagcatgcgtggaagggctacaaaagcaatgcctggttgcgggatgaactgtcgcctttaagcggtggatacagaacttcctttgctggctgggcagccacactggtggatgccctggatacattgataatcatggatcttacagacgaattcgaggaggcgctggaagcactcgagcatattgatttttcaaccaccgattcaatccagatcaacgtgtttgagacaaatatcagatacctcggaggtcttcttggtgcacacgaccttacagagggcagatatcctattcttctgaagaaggcgactgagatagccgattttctctacgggtcgtttgatacgaggaataggatgcctcagtctcggtgggagtggacaaggtgagaatgcattctggttactgcttggacaggccagcttcggccctcaaaatgattatttcatcatattgatagtagttagatccgcatcgggccagaccattcatcctagtgggaacactattctcgcggagctgggttctctgaacctggaattcacccggatgtcccagttgacgggagaccagaagtactttgacgcgattcaacggatctcagaccacttagaatcagctcagaaagaaaccctggtgcccggtttatggccaatgatggttgacgccgagagcatgcggttttccgatcctcggtacacaattggtggtatggcggattccgcatatgaatacctccctaaagagcatatgcttcttgagggtcggacgcaacagtatcaacgaatgtacgaatccgcaattccagcgatcaaggagaggatgctgttccgcccgatgaccaagggtggagaagatatcctattttcaggtaacatttacgctggtacaaaggccagtcggaaaaaggtagaggcacaggcggaacacctcaagtgttatcttgggggcacgattggcatcggggccaaagtgttcaatcggcctgaagagctgtcaatcgctcgcaagctaaccgacggctgcatctgggcgtacgatatcatgccctctgggatcatgccagaagtcatgtatctcagcccttgcgacgacttggaaaactgtccatgggacgagcaaaagtggtatcgagacgtgcgcgcgcggccaccgcctcatgcgaacattgcggatactgaggaagcggcgaaattgcttatcgagaaattcgacctggtcccaggtgtcgccgaaatcgccgatgcacgctatatgttgcggtaagcgctgaaacagctaacgtgagcgaagtttgctgaatgtttggtaggccggaagcaatcgagtccgtatttatcatgtaccgcatcacgggcgacaagaaatatcaggatgctgcgtggcggatgttcaacagcattgagaaggccactcggactaagtatgcccatgcagccatcaatgatgtgcgagaggaaaacccgaaacaattggactatatggagagcttctggctggcagaaaccttacagtacttctaccttatattctccgagccggagctcattagtcttgatgattatgtgctgtaagtc

SEQ ID NO: 36779 - DNA, 1090 bp, Aspergillus nidulans
ctagatggtcacaacgatttccccgaattcatccgttatttctaccacaaccacatctaccagagcaatttctctgaccaaatcgcgctccccggtcacgtcgactttccgcgtctagctaagggtggcgttcgcggtcagttctggagtgtctatgtagcatggtatgttgcgcctgcttcccatatacccatacagttcgcagaacgtggaatgctaatagtgcagccatgattctccccccgaaccagactacgagtacgtccacgataccctccaacaaattgacctcgtgcaccgcctcgcatccctctaccctggatacctggagattgtgcccgacaccaccgctttccgacacactttcgaatcatccccgacgaaaatagcctccttcctcggcgtcgagggtctgcaccagatcggctccagcgcatctaccctccgcctctaccactccctcggagcgcgctatgtgaccctaactcacatgtgccacaatgaatacgcggatagcgcgaccccgtctaagccgcgacacaacggtctctcggcaaaaggccgcgatatggtccttgaaatgaaccggctcggcatggccgtggacatctcacatgtcagcgcgaagacaatgcatgatgcgctagatacatccaaagcaccggtgatcttctcccattcctccgtgtatgcactctgtccccatgaacgaaatgttcccgacgacgtcctccttcgtcttgcggagaatggaggtgtgattatgatcacctttcttgatgaatacacccgctgcgacaatcctttggctgctacgttgtctgatgtggcggatcatatccagtacgttggagagttgattgggtatgaatatgtcgggttagggtcggactttgacggtatggtcacaacgatacaaggcctagaggacgtgagcaaatacccggatttgatcaaggagctgttggatcgcggtgttagtgtgaaggatgctgcgggaattattggtggaaatatcctgagggttatgggtgagattgaacgcgtggcgagggagatgaacgaggagggtatcacgcctttagaggat

SEQ ID NO: 36780 - DNA, 1718 bp, Aspergillus nidulans
tgtcacgaatttgtagcttctcttccgctgcatagtgatagcaaacgccggacacagcacccccgagtccatcgtgagagcaatcagtcaccagaagcaccctcgactcgccggcttcgatctcggacaatatacaacgacgagcctcaatctgagaatgccgccaccacaaaaagccgctcgcctgtctctaggcggaaaaagaagactgatttgcaggaggatcaggagccgtcctattcgaaagagaatattatacggagtacatcccaaacttttgacggtaggcacgaacggcgacgtgtgaaatacattggctgatctgttcagacaacaacctaaaacctgctgaagtcagaactcctacgaaggccagatatcgggatgctcttggctcgccgcctgtcacaccgaagcatcgagttcaggtgggagcgaaagctctaacaccccgtacgccgcgacagttgggaactccgaccactactcagactgtctacacccaagcccgtcagctattcgcgcgaggtgcaaattcggggcgtatcatcggtcgtgaggtggagaaagaaaagcttgcatcgttcatcgccgatggcatgaagttcaaaaagggcgggtgcatgtatgtcagcggtcctccaggtaccggcaaaagtgctcttgttaaggaggttcttgatgaagttgaaattaagccggcaagagtcgcgcagctgaactgtgcgagtatgaggacagcgcgggacgtctacagcaagcttacggaggatctgtgtgatgatgacgatgttttcaaaaagagcgaagccgacaggctcaaaagtatgtttttgtcggacaagaaacaagccagcaaacatgaaatgtttctagtcatgctggatgaaattgaccatcttctcacatcggatgctggcatcctccagtctttatttgagtggtcactacaaggggaatcgaagttgttgttgattggaatcgctaacgcacttgatctaaccgatcgatccctgcctcaactgaaggcaaagaacttgaagccccttctgctcccatttctgccatacaatgccagccagattgcaggcgtggttatcgaacgccttcgctcattgctcccagaaggccaggtggaggatccgaatttcattccttttgtccaacctgcagcaatccagttatgtgcaaaaaaggtgcgttcgcaaaccggagatctacgaaaggctttcgagctcatcaaacgagcaatcgacgtgattgagcaggaaacgatacagaaacatgacatgcagaatctaaacagcccttccaaaactattttggtcgaaaataacaatctttcatcgtcacctaagcattcattggcgaaggggacttcggcacttccttacacgattatgacagcaccccgagctagcattgcacatgtcgcaaaaatcacatcatcagtttttggacagggaacaactcagaggctacagtgcctcaaccttcaacaaaaagcggcaatttgtgcgctggtcgcactggaccgaaaacgacgcgaaaacgacattccgcaaactccatccaagtccaagaacttggctccaacagttaaacaaatatttgatgcatattgtaccctttgcaggacggacaatattctgcacccattgactgcaactgagtttaaagatgttcttggtagcttggagactttaggccttgtcggt

SEQ ID NO: 36781 - DNA, 1207 bp, Aspergillus nidulans
ccttctcggacgctgcaggctcgagcagtctgcacgccaaaagccgggggctcgtcgagtatcgacgacgtcccagctattgtcaagtcgatctcggcgtgcggagatggcggaactatcgtcttccccgaggactcaacatactacttgaatagcgtgctggacctcgccggctgctccggctgcgagcttcaagtagagggcctcctcaagtttgccagcgacactgactactggaatggcaggacggcgatgatcaatgtaaagaatatcgatgggttgacgatacgctcactcacgggatccggcgttattgatggaaacggccaaaaagcgtattctccccgttttccgttctctatatacgaactccatctataaactaaccgtgatggccaggtatgaccgctttgcacaggactcaagttatgaccgtctgacgcccttgtatataacaggaggtggggatatcaaagtctccgactttcggctgaagaatgctcccaatgtcttcgtctccgtcaagggcgggaccacaaacgcagtcttctcagatatgaggttagatgcgacctccaaatcggagactttacccgagaacacagacggattcgatatcggtgagagcacctacgtagccatcagtggcccgtccgtgtccaagtcccacgattgtgttgcgtttaaacccggctgcgtctccgtgacggtcgccaacgtcacctgcacgggatcccatggtctgtctgtcggcgccttgggcaagagcagcgacgacatcgtgcagaacgtccgggtggagggagcgaccatgatctcgtctaccaaagcggcgggaatcaaaacgtacccgagtggcggggatcatggcctcagcactgtgacgaacgtgacctggaaggatatcactattcaaaactgcgactacgcgatccagatccagagctgctatggcgaggacgaggagtactgcgagaccaatccgggggacgcagtgttttccggaattgcctttgaaggattcagcggcacgacaagcagtaaatatgacccagtaacaggaaaccttaactgcggggaagacggcaagtgcgatgtctccgttgttgactattctgtaaaagccccttcggggggtggtaaggtcctttgtgcgaatacgccgtctagtcttgggatcagctgctcgtctggagcgtcgggatga

SEQ ID NO: 36782 - DNA, 3159 bp, Aspergillus nidulans
atgggtgttcccgatgagctgccgccaggctcatcagagacggacacgatcgtgtcttcgtcgcagcccaccaatcgttctcccatggacctgatcagtgaagctgagagcttgaacctgcgcagaatagcaacgaaccaatcaaaagcccagtgccgaccaggctcagcagccgttccctcgcatgacaatccacccaacgatgacctagaagacgcaacccttgaccccaactccgcctcattctctctcgagaagtggctacgggctgcggtctccgacgcttcacagcacggtctatctaccccgtctggaggaatcctcttcagaaatctgaccgtctcgggctcaggctcggcgctgcagctccaaccaaccgtgggttccgtcttgactgcgccattgcgattcgcgagtttgctgcgacacaggcgaatcgagcctagacgcatcctgcatggatttgacggcgtgatgaagactggggagctgctccttgttctcggcaggccaggggccgggtgtagtacattcctgaaaacggtttgtggcgagaccaatgggctgcatattgacgcggacagcgtcctgcattataatggtataccttcagaatagactgccgtgaccgggtcctgaaatagttgggctaacgagatccaataggggtatcacagcagcgtatgatgaaggagttcaagggcgaggttgtctataaccaagaggtacatctttcctgcttagttcactgtagctcgactcatagcatgttaacccccgatcaaggtcgacaagcactttccccatctaacagtccgccaaacgctagaatttgctgccgcagcacgcacgcctgcgcaccgtttccagaacatgtcccgcgacgagttcgcttcatacgcagcctcagttgtcatggccatattcgggctctcccacacacacaacacaaaagtcggcaatgatttcgtgcgcggtgtgtcaggcggcgagcggaagcgcgtctccattgctgagatggcgctacgatgacaccattcgcagcatgggataactcgagcagaggccttgactcggctacggcactgaagtttgtccaagctctaaggctgagtgcagaccttgcgggtgctgcgcatgccgtcgctatctaccaagccagtcagagtatctatgaggttttcgacaaggtcactgtgctttacgaggggaggatgatatttttcgggcccacaggcactgctaaagaatacttcgagcggatgggctgggtttgccctgccagacagacaacaggcgatttcttgacctctatcaccaatccgctggagaggaaggcgagagcaggaatggaagacgtcgtgcccaagacaccaaaggatttcgagatatactggcgacagtcccccgagtacaagactctgctgggcgaaatgactgagttcgagacccaacaccccaccggcaacgacgagcaggcctcagcagaattgcgagctcgaaaggagaactcgcagagtaggaactcacgcgcagcttcgccatacatcctcagcattcctatgcagatcaagctcaatacgaaacgtgcatatcagcgtatctggaacgacatgtcttcgaccatgagcacagtcgtcgggcagatcgtgatagccctaatcaccggctcagtattctacgactcgcccaacacaacggccggtttccagagcaggggcgggacactcttctatgctgtgctgctcaatgcattgacagccatgtccgagatcacgagcctctactcgcaacggcccatcgtcgagaaacaagcgtcatacgcgttctaccacccggccaccgaggcgattgccggcgtggttagcgatgtacccgtcaagtttctgctcgctgtcgccttcaacgtaatcatgtacttcctcgcgaacctgcgcccgtgaaccagcgcagttcttcatctactttctaatgtcgttcacggtcatgttcgtcatgagcgcggtcttccgcactatggccgccgttacaaagaacgctgcgcaagcgatgggtctcgctggagtcctcatgctcgcgctcgtcgtgtacacgggctatgttctccctgtcccctcaatgcacccatggttcgagtggatccattaccttaatccaatctactacgcgttcgaggcgatgatcgcgaacgagtttcacggaagggactttgactgtattgcttttgtcccgtcgtatgcagatctggacggggatagcttctcttgctcctcgctcgggtctgttgccggagagaggatggttagtggagatagctatatcaatttcaactatacctacacctacagccatgtctggagaaacttcggcgttcttcttgctttccttattgggttcatggccatctacttcctcgcgtcggagctgaactcgtcaacaacgagcactgccgaagctctggttttcagacggggccatgtaccggagtacatgcgtccaggatacaccagacctactgacgaagagaaagccgtcacacagagcgacatcaaaccgtccagcccatcgccgacgaacaccgatctccctcttcccccacaacgcgacatcttcacctggaaagacatttcctacgacatcgagattaagggtgagccacgccgtctgctggacgacgtctcaggttgggtcaaacccggcacgctgaccgcgctgatgggtgtcagtggcgccggcaagacaaccctgctcgatgttctagcgcaccgaacaacgatgggcgttatcacgggcgacatgtttgtcaacggcaagggccttgatgcaagtttccagcgtaagactggctacgtccagcagcaggatctgcatctggagaccgcgactgtgcgcgagagtctacggtttagtgcattgctacgacaaccagcgtctgtttccatcagggagaaacacgactatgtcgaaagtgtcattgagatgcttgggatgggtgactttgcagaggctgttgtgggcacgcccggggagggactgaatgtcgaacagaggaaactgttgaccattggcgttgagttggccgcaaagccaaagttgttactcttccttgatgaacccacaaggtatgttctttgcgtccaagagatcctacgggagaat

SEQ ID NO: 36783 - DNA, 929 bp, Aspergillus nidulans
cctttcccagacgatgtgccaaccgctccactgcttcgcctttcgttgaaagatctacttgcagggaacgaaacagagatcgaaaaactaagcaaagcatgcgaggacattggtttcttctaccttgatatgcgagacgcaggcacagtcacgcagattctggaagatgccgataaattgttcgaaataggagccggcctatttgagctcccgctaggagagaagaaaaaatatgacctcagtagccaaaagtcttacttcgggtacaaggcacagggagctgcggttgttgatcggcagggtaacctggacaggaatgagttctacaatgtcagtccgcttcgttgcttgttttcctggtatcgcctacactaaaacatttctaggtttcgaaagacgacatcatgggcatatctggaccactcccagccccagacattataaataaaaatcgccacattctcgaatcattcatcaagtactcgcactctatcgtcacactcatcctcagtatcctcaacacaagcttgggtcttcccgagtcgactttgaccaacatccaccgtcttcacgctgtaagcggcgatcaagtacgcttcgttaaagcacctccacagcctgctgatgaccgccgtactgctctaggcgagcatactgacttcgggagcgtgactattctattcaaccgcttgggagggcttcaagtgcttcctccgggtgcggacgcagagtggcagtacgtaaagcctctcccggggcacgtaattgtcaacctaggagacgccatggtgaagttcacaaacgggctgcttcggtcgaacattcaccgtgttgtctctcccccgggtgatcaagcagacaccactcggtttagcctggtctacttctcccggccggaagacgatgtcccgctgcggcgattggaaggg

SEQ ID NO: 36784 - DNA, 1590 bp, Aspergillus nidulans
atgaacaccgacaagtacacagacaaggccaacaaggccttacaagatgcgctagaactcaccatcgaacactcgaacgccgaactataccctgttcacctcgcagttgctctccttgacccctcacaaaacgaagatgacgggccatcgctccacccctctcacggagattccacctctctcttccgccaagtcgttgaacgcgcgcatggtgacgttcagctcctccaccgtggtcttatgaaacggctcgtcaagcttccgagccaagaccctccgccagagactcgtagcatctctgcgcccttccgaaaagttctcacagctgcggccgatttgtccaaaacgcagaaggacagctacatcgccgtggatcatctgatccaagctgtatgccaggattcaaccgttcaagctgctctcaaagacgccaatgttccgaacgtcaagttgattgataatgctatccagcaaattcgaggtacaaggcgggtagattcgaagacggcagatgctgagagcgaaaatgaaaacctcaagaaattcacaatcgacatgacggcgctggcccgagagggtaaaattgatcctgttattggccgagaagaggagattcgtcgtgtgatccgtattctcagtcggcgaaccaagaacaacccggtactgatcggcgagcctggtgttggtaaaacaacaattgttgaaggactcgctcgtcggattgtcaatgcagacattccagctagtttgtctcagtgcaaacttctttctctcgatgtcggctcactggttgctggaagcaagtaccgcggcgaattcgaagagagattgaagggtgtcctcaaagagatcgaggagtccaaagaaacgatcgttctttttgtcgacgaaatccatcttctcatgggtgcaggcgctagcggcgagggtggaatggatgctgccaatttgttgaaacctatgcttgctcgcggacagctgcactgtattggagcaacgacgcttggtgaataccgaaagtacatcgagaaggatgccgcattcgaacgacgattccagcaagtgctcgttaaggagcccactgtctctgagaccatctcgattcttcgtggtttaaaggagaaatacgagggccaccacggaagcgtgcgaattctcgatgccgttatcgtcaccgcagctacccttgctgcacggtatctcacggcccgtcgactgcctgattcggcggtcgatctcattgatgaggctgctgctgccgtcagggtagcccgcgaatccgaaccggaggctcttgataaccttgagcgtaagcatcgacagctccagatcgagattcatgctctcaagcgtgaaaaagatgaggcttccaaagcccgtcttcaggctgccgagcaggaagcggccaatgttattgaagagctgcggcctatgcgtcagaagtacgaaagtgaaaagcaacgtaacaaggccatccaggatgccaagactaaattggacaacctgaagaacaagcaagaggaagccgagcgatccggtgacaccgaaaccgcagcagatctgaaatattacgctattcctgagacccag

SEQ ID NO: 36785 - DNA, 1179 bp, Aspergillus nidulans
ccagatcatggcctcagggcctggctccaagtcttgtgtatgcacctcgtcttcctcaacacctggggcgtaagcaacggcttttccattttcaaccaactgtacaccaaaacccttccagaatccagttccaccatctcatggatcggaagcatccagatctcgctcctcttcttttttggtgtcttcgccggccgcgctacagacgcagggtacttcaggctcatgtacatggccggtgcgttcttccaagttttcgggttcttcatgctgtcattgtgcaaggactactggcagatcttcctcgcccagggcatctgcatgttaatcagcaacggtctcaccttcgggcccggactggctgtcacgtcgtcatacttctccagaaaccgcgggcttgcagtagggatcgccgcagccggcgcaacaacaggcgggatgatataccctgtcctaatacaccagttgcttgatattcacagcctcagctttggctggacagtacgaatagccgcctttgtgatgttgataacccagatttccggcttactattcttccatcctcgcctcccccctcggccctccggcccgttcctcgacagcgctgctttcaaagagaagccgtttgtcttcttcgcgctcagcatgttcctcaatctctggggtctctactttgcctttttctacatggggacatttgcgagagaccggctcgccgtacgcgatacacagaacttcatactcatccagaacggcgtaggcgtgctcggccggatcctcccaactcgcctcgccgacagagtcacaggaaaattcaacattcttatcccgctgaacttcactgctgccgttgttgtctatgcgtggatagccgtgcataccgttgccgggctgtacgtcttcacagtgatctacggcctagccggcggcgcagcacagtctcttttcccggcgacagcgacgacaatgataactgatgtacggaaaacggggacaagaattggcatgattcttagctttgtgggcatcgcgaccctgaccgggccggcgattgacggagcgctgattcaggcgatgcaaggagagtatacgggggcacaagtgttttcggggacttgtattgtgctgagagctgggtcagcgctggcagcaagagtggcgaagacggggtggaagtta

SEQ ID NO: 36786 - DNA, 1410 bp, Aspergillus nidulans
tcccttgttggattcagcgctagaagcagacacattggtgaagccgcgaagacacaagagacctccaacctcaagaacacagttggaaacctcaagcgcctgattggccgcgctttcagcgaccccgagattcagatcgagcaggaatacagcgttgcacagctttgtgacgtcaatggccaggccggtgttgaagtcagctatctgggcaagaaggagaagttctctgccatccagctggtcgccatgtatctgaccaagatccgcgatatcacctccaaagaattgaaactccccgtcacagatgtcacaatcagtgttcccgcttggttcaccgacatccagcgtcgcgctatgctcgatgccagtgagatcgccggtcttaaggttcttcgactgatcaacgacaccaccgctaccgcccttggatatggtatcaccaagcttgaccttcctggccctgaggagaagccccgaagggtcatgtttgtcgatatcggttacagtgactacactgccactatcgtcgagttccgcaagggtgaacttaacgtcaaggccactgcctgcgaccgtcactttggtggtcgtaacttcgacaaggccttgactgaccacttcgccgatgagttcaaggagaagttcaagattgatatccgcaccaaccccaaggcctgggcccgtacccttgtggctgccgagaagctcaagaagattctgtctgccaacacagtcgctcctatgagcatcgagtctctcatggaagacattgatgttcgcgctatggtcaagcgtgaggagctcgaggacatggttaggcctttgttggaccgtgttaccgttcctttggagcaggctctcgcggaagctaagctcaagcccgaggacatcgacttcgtcgagatggttggaggctgcactcgtgtccctgccatcaagcaagcggtcaacaagttctttggcaagaacctttccttcacactcaaccaggatgaagccattgcccgtggatgtgctttcagctgcgctattctttcccccgttttccgtgtccgtgacttctccgttcacgacatcgtctcctaccccatcgaattcacatgggagcagtctcccgacattcctgacgaggacaccagccttaccgtctttaacaagggcaacgttatgccatcaaccaagatcctcaccttctaccgcaagcagcctttcgacctcgaggctcgctatgccaatcccgaggcgcttcctggcaaggttaacccatgggttggtcgcttctctgtcaagggagtcaaggccgacgccaatgatgacttcatgatctgcaagctcaaggctagattgaacttgcacggtattctgaacctggagtccggatactacgttgaggacgtcgaggttgaaaaa

SEQ ID NO: 36787 - DNA, 1076 bp, Aspergillus nidulans
accatgaaggcggcgcaatgggatcctaagctgcaaaaggtggtggtaaatcgagtacctatccgaaccccgggcccaaaccagatcctggtcaaactggcctcggcgtctctctgtcactcagatatcctggccatcaaccagcccaacatggccgagcctttcacgcttggccatgaaggtgccggctacgttgctgagctgggaacgaaatgcactgacaaggggtttcgagaaggggatccagtcggattcctgcatatcaacggctgctgcttcgaatgtgaagggtgcatggtgcacaacaataactgtacacaaggcacccccgtagtctctgggttcgggggcatcagggatttcgggttcttccaagagtacgctgccgttgattggcagaacatcatccaccttccgtaccagctggattcgaagcgcagctctgcgattttctgtgcagggataacaggtatgttggggacagccatgtctgacagatctgttgctgaccggacgccagcctttcatgccgtagacagctgcaacctgacggctggccagtggttcgccgcgatcggggctggaggcctgggccagctcgcagtccaatacgccaacgcgatgggctaccgggtcatcgcgaccgatatcaacgacggggctctcgagacatgcaagagacaaggtgccgatgttatcatcaattctctctctcgaccagactacgccaacgaggtcaagaaactcacccccggcggcgtccacccgacggcggtcttcagcggtgctccagctgcctataggggcgcaccgtctatcgtccggccagggggttgttgatggtgattggaatcagctccagcctgctcgagctgtcgacgtttgacctcgccattggcacctatgttgtcaagtcggagagcacaagcatccctcagcgtatggccaaggctgtggatttcacagccaagcatggcattacacctgagatcaaggtccggtctgggttggaagatgtcgacgagatggtctgtgatatgcaagcgggaaggtctagtaaacggatggcagtcgtt

SEQ ID NO: 36788 - DNA, 1037 bp, Aspergillus nidulans
atgtcattatagtgtcgttaaccaacgatggccacatcaggctgcggctcatttggcatcattcgcaaagtgaagcgaaaatccgatggttttgtaaggcagaccggcgagcctgtggtgtaacctactcacaagggactgtctagatactatgtcgaaaggaaatcaactatatcaagatgtccacaaaagagagagagcagctgactgccgaattcaacatcctgagctctctccgacacccgaatatcgtcgcctattaccaccgcgaacacctcaaagccagtcaggacctctacctttacatggaatactgtggtggtggagaccttagtatggtcatcaagaatctgaaacggacgaataaatacgctgaggaggatttcgtctggcgtatactgtcgcaattggtaacggccctatatcggtgtcactatggtacggatccggcagaggtgggatcaaacctgttagggcctgctccaaagccttcgggcctcaagggcaaacaggcccagatgaccattctacatcgtgacttgaaacccgaaaacatctttctcgggtcagacaatactgtcaagttgggcgacttcggcttgtccaagctgatgcactcccacgactttgcgtccacctatgtcggaacaccattctacatgtctccagaaatctgtgcagccgagaaatacactctacggtccgatatctgggcagttggctgtatcatgtacgaactctgccagcgggaaccgcctttcaacgcgcggacacacatccaacttgttcagaagatccgcgaaggaaaatttgcccccctgcccgatttctactcatcagagttaaagaatgtcattgcgagctgcctgcgtgtcaatccggaccatcgtcccgacacgcgtacgctcatcaacactcccgtcatccgccttatgcggagggaggtggaactgaacaacttatcccgagcagcacgaaagcgagaggaggctaccatgcaaaaggcgaaggatgtggaacaagcgtttgccaaactt

SEQ ID NO: 36789 - DNA, 1680 bp, Aspergillus nidulans
  unsure (1)..(1680): unsure at all n locations
aggaacaggcgatgcgctctacccgtgaatcaagattcggctgactttgagctcgattcctggattgtataggatcccgccgagttagaccaaatcactacgctgccgaatggcatccgcgtcgccaccgaatctcttcccggccccttcgcaggtgtcggagtttacgttgacgccgggtctcgctacgaggatgcgagcttgcgaggtgtgagccatatcatggatcgtttggcctttaagtcaaccaagacacgcactgcggatcaaatgcacgagacgctagagtcactgggtgggaacattcagtgcgcctcttcccgtgagtcgttaatgtaccagtccgccagcttcaactcggccgtcccgacaacgctcgggttgttggcggagaccatacgcgatccccttattacagaggaagaggttctacagcaacttgctaccgctgaatacgagatcaacgagatttgggcgaaaccggagcttatcctgcccngagttggtgcacacggccgcctacaaagataatacgttagggcatcctctgctctgtccgcgcgagagattgactgagatcaacaaggctgttgtggaaaagtatagagcaactttcttccgtcccgaacgcatggttgttgcctttgctggtgtgccgcatcacgaagcagtaaggctcacagagtcgttgttcggtgatatgcaaggacctagcacgaacaatggacctagcctgtcggggaccggtgttgacaccaccttgtcagattcaaagtctgaaggacaatttgcggccgctcctcagtttacaccgacctcaacggtcgcgtctgcccctgccacaaccgactcaagcattctttcgaaactcccctttctcaaaaaattcgggtccaataatccctcatcctcagagtctgcaccagtagatctgacccaagcttcccactacaccggtggatttctaactctcccccctattcctccgccagcgaatcctatgctccctcgattgagctatatccacctcgccttcgaggcgcttcccatttccgaccctgacatctacgctcttgcaaccctccaaacactccttggaggtggcggatccttctccgccggcggcccggggaagggaatgtactctcgtctgtatacaaacgtgcttaatcaacacggctgggtcgaaagttgcattgcgttcaatcacggctacacagacagcggtatcttcggtatctccgcttcatgcagtcccacccgcatcaaccaaatggtcgaagtgatgtgccgcgaacttcaaaacctcaccctcgacaccgggtacacgtctctccagccgcaggaggtcaaccgcgcgaagaaccagctgcgctcgtcacttttaatgaaccttgagtcgcgcatggttgagctcgaggatctaggccgccaggtgcaagttcacggccggaagatcggcgtcacggagatgtgcaagcacattgagtctcttaccgttgaggatctgcgacggtcgcgcgcaaggtcttcggtggccaggtccataacaaaggacagggtactggtaagcctactgttgtgcttcaggagggtgagctggaaggattcaagttgcgtcccttcgcgtgggatgagattcaggaacggatagcaagatggaagctggggaggttgtag

SEQ ID NO: 36790 - DNA, 2077 bp, Aspergillus nidulans
caggagctctgggggcactccgctcccgaatccacacgaatctaccatttcacgaagacaatcgccgagaagcatggaattccgctaagaagctataacgacctctggaactggagtatatcggagcctgccaaattctgggaggagatttggctgtatacatctataattgcccacagaccttacgaccaagtgcgtattctatccgcagctagttatgagctctcgaccttctgactcaacgcaggtaatgggctcagagacgcttctctttcctcgacctcagttctttgaaggtgcaagtctgaattttgctgaaaatctgctgtaccctgcttgttcgcctgacgagaatgctgtcgctatcattgcggctacagaggcagatcgtgaatatatctcttggaaagagctcagagaccgtgttcgccggtgtgccaatgcgctgaaaggagccggattgcaaaagggtgaccgcgtggctggatttctggggaatcatgctaacacagttgttgcaatgctcgcaacaacgtccattggggctttttggacaggcgtatccccggatacgggggtccatgctgtccttgagcgcctgacgcagattgaacccaagatcctatttgccgataatgcctcgctttacaatggcaaggtgcatagtgcagctgccaaaaccagccaaattgtctgcgaactccctaagctggaggcgctcgttatattcccaacaattgggtcggtcgaaatcaagctggaagaggtttcacttcgacaagggaaggcatatacatacgctgacttcctgctaacggccagcaacccggcagcaccgctggagtttgcaagcttaccacctgagcaccctgtttacatcctgtacagttcaggcacaactggagccccgaagcccattgtgcacgggtctttggggacactgctgcaacataagaaagagcatgtacttcactgtgatatctatccgggagatcggcttttctactttactacaaccacctggatgatgtggcattggttagtgtctggtctggcaagcggggccactattgttctttatgatgggtcgcctttccggcctttagatcctgaaggaggggctggagagatggccatgccccgcctcatcgatgaactccagataacccattttgggacgtccgctaaatatctctcaatgctggagcaagctgccctcaatccaagagagtatccccaccgccctgtgagtctacagacgctgaaggcgatcttcagcacaggctctcctctggcgccatccacgtttgagtatgtctactcgtcaatccatccggatatcatgttgggttcaatcactggtggtaccgatattctttccctgttttgctccggctgtccgatcctccctgtgtataagggcgaaatccagtgccgaagcttagcaatggcggtctctgtgtatgattacgctggtaacgacatcagctcgtctggcgagccgggagacctggtctgtacccggccattcccagcgcagccagttatgttctggccacctggacccattggagttgagaaataccgcaaaagttattttgacgtctttggtccttcaatctggcaccatggagactttgtacgcttaaaccccgaaactggcggagttgtcatgctaggacgaagcgacggtgtgctgaaaccagccggcgtacgattcggcagcgctgagatctataacatcctgttgaaacactttgcggatgagatcgaggattctctttgtgttggacgtagaagggaagggatcgatactgatgagacggtagttctgtttgtgaagctggcatccccgagcgactcgttgcccccggatcttgcatcgcgcatccaggctacaatccgcagagaactcagtcctcgccatgttccaggaatcgtggacgtttgtcctgagattccggtgacgtcaaatggcaagaaagtcgagaacgccgtcaagcagattctctgtgggcttaatatcaaaatcggcgccagcgttgcgaatgcctcgtgccttgattggtatcgcaca

SEQ ID NO: 36791 - DNA, 1746 bp, Aspergillus nidulans
ctgcgacggcggacaacccagaatatgaatgaaccgccaaccacgctctttcaaccaccgtcaccggaagaggctcgtcgtctggctaagcaacatgcccagttcggtccgatcggtcatccgagccaccggtactccagccggcatcccggtggcccctttccggagcctgtaatggatgagcctccttattactatctcattaccacttatatcagttatctgattctaattgctttcggtcatgttcgtgatttctttggtaaacgttttcgcgaggagaattatcgtcacctgaagccccggaatggctatgcggctcttaacagtgactttgacaacttttacgttcgccgcctgaagctacgtatcaatgactgtttcgaacggcccgttactggtgttcccggaagatacatcaccttgattgaccgagcgacggatgaccacaacaaaaacttctaccttaccggaactacgaccgacacgctgaatttgagctcgtacaactatcttggttttgcccagtcagaaggcccttgtgccgatatcaccgaggaaacgattcgcaagtacggcattacccctgtgagtactcgcgcagaagtcggtacacaggacctgcatgtcgagctcgaggagttggtcgccagctttgttggcaaagaagcgtctatggtcttctcgatgggcttcggtaccaatgcaaacatcttccctgcgttggttggcaagggtgatttaatcatttctgacgaactcaaccatgcctccatccggttcggtgcgcgtctttctggagcatctatcgccatgttcaagcacaacgatatgcatgacttggaagctaaactacgagaggctatcagccaaggtcaaccacgtactcaccgaccatggaagaaaattcttgttgttgttgagggtctttactccatggagggctcgatgtgtaaccttcccggtcttattgccctgaagaagcgctacaagttctatctcttcgttgatgaagcacactcagttggagccatcggtcctcgtggtcggggtgtctgtgattatttcggcattgataccaaggaagtggatattctcatgggtactttgaccaaatcgtttggtgccaacggagggtacattgccgccgacaaggtgatgattgacaagcttcgggcaaccaactccggcatgttctacggagagtcaacttctccggcagttatcgcgcagattatctcagcactacgacttatcaagggtgaacttattcctggccagggcgaggagcgactacagcgtttggccttcaattcccgatatcttcgtctgggcttgaagcgtcttggctttatagtgtacggtcacgacgattcgccgattatacctgttctcctcttcaaccctgccaaaatgccggctttttcccatgagatgctgaagcgcaagatttccgtggttattgtcggttatccggcaacgcctttggtttcctcgcgtgctcgattttgcgtttcggcggcgcatacaaaagaagaccttgaccgaatcctgacggcttgcgacgagattggcaacatcctgcagcttaaattctcgaccggtgtcgcaggcggtgcactccccatgaatgacgacatggcgccgcccccagagaaggaagtccagtggcagcagaagcgaaacccgcgaattgtccctccgcggtggcgcatagaggacgtcattaggcgtggtgtccaagat

SEQ ID NO: 36792 - DNA, 756 bp, Aspergillus nidulans
cgaatcttcatcaccggctcaagcgatggtatagggcaggcagctgccaaggtcctttccgagcagggccactcagtcgtccttcatgcgcgcaacgccgaccgcgccgcctcagcccaagaggccgttccaggcgccgaggccgtcctggtgggcgatttgagctccattgctgaaacaaaagccctagcagaggaagcaaacaagttgccaccgttcgatacggtcatccacaacgcggggatcggatacggggcgacggccagccaggagatcaccgcagataagatctcggctgtctttgctgtcaacacgcttgcaccatatatcctgacctgcttaatgcataaaccaaaagcaaggcttctttatatgagctcggatagtcattacggcggtgacgagagtctacggaacatcacgcagtcccattcgtacgggaataccaaactgcacgatgtaatgctagcaaatgcattctctcgacgatggggcaacgcgatccaagtagttagcatgcatcctggctgggtgaggaccaaaatgggaggcgtaatggcgcctggggcgttggacaggccggccagagtcctggccgactgggcaatcggaaagggagatctggcccgcctcaagagcggtactttctttacgactagcggcccagaatctgcacatcccggtgccgataatgtccagaaacaagaggagttattgcgcatctgtaaggaggtgtcgggcgtgggggttccgggg

SEQ ID NO: 36793 - DNA, 597 bp, Aspergillus nidulans
tcttcagtcgacaaggatgaagtggaccgactccgcaagagatttatgaagctcgacaaggtgcctacgcaacccgtacaaacagagaagacctttctaaacaatggcctaggacaactccggcacaatcgatcgcgacgaattcctctcccttccacaagtctcaactaacccccttgctacaaggtgcgctgcctcgaactccatctcagttcaatatcatctaacgagataacttgagtcaacagaatgatcgcaatattcgacgaagacggcggcggtgacgtcgacttccaagagttcgtctcgggcttatccgctttcagctcaaagggcaacaaggaagagaagctgcggttcgcattcaaggtctacgacatcgatcgcgacgggtacatatccaatggcgagttgttcatcgtgctgaagatgatggtcggcaataatctgaaggatgtgcagctacaacagattgttgacaagacaatcatggaggctgataaagatcacgatggcaagatcagctttgaggagtttacagatatggtggagagcacggatgttaatttgagtatgactttaagtatgtggtcctcc

SEQ ID NO: 36794 - DNA, 732 bp, Aspergillus nidulans
atagtcaccggtgcaaaccaaggcattgggctcgggatcgcagaagtcattctggccaactctgcagcgcacgtctactctctcgacatctccacgcccggcgacccctttaacgagctcgcgcagaagaacccgaagcgcttctccttcatccagacagacgtgacctctgaagaatccgtccaggctgctctcgaccagatcgtctctgaacaaggccggttggacgggatgattgccaatgccggcgcaacaaagcaccagcccgcgttggacttcaccatggatcaggtcaagcgcctcttcgagctcaacgtcttcggtgcctggaactgcgcaactgcggcggcgaagacattcatcaaactcggcatcaagggctcaattgtctttactgctagcatgacatcttacagaccgaaccgcgcggcgccgagcgcgccatatggaggcacgaaagcggcggtacggaacatgacgcataccttggcgatggagtgggcgaagcatggaatccgggtgaacagtatctcgcccgggtttgtgaagactgcattgacgtattatgttgagacaagtcccgactgggataccaagatgaagtactatggggggatgccgagactggcgattccgcaggagttgggtggcgcgtatgtttacctgcttagtgacactgcgacgtatacgacgggaatcgatattccaattgcggggatcgtgggggcttgg

SEQ ID NO: 36795 - DNA, 477 bp, Aspergillus nidulans
ttcaccctcttcgatctcgatcgtgaccgacatctagactaccatgaactccgtgtggcattccgcgcccttggcttcactctcccgaaacaagaactcatctccctcttaacgacgtacggtgtcccacgtcctcaggtccaacagcaagccgcagcgcaacaatctcagcaacagcccaagacggctccaactacgaatccccagcatccatctaacctgttgatgccactttctgcatttcaagcagtaacagcggtgaaaatcctcgagcgagacccgcgagacgagatcctccgagcgtttgagcttttcgacgagggcgggaaagggtatatcgacctggaggatctgcgccgtgtcgcgcgggaactaggggagacgggcctggaagaggaggaacttcgtgcgatgattgaggagtttgaccttgagggcgttggcggtgtgacgagggaggcctttgtgagtatctgt

SEQ ID NO: 36796 - DNA, 1134 bp, Aspergillus nidulans
tacggcgtgttccttgcttactatctctctcacgatgtattccccaacacctcggcacttatgtatgccttcactggtggcttgagtatatcctgcgctctcctcgttgcgcctctggccacctacctcatccatgtcttggggacgcgtgcggtcctgaatattggtgtctttttcgaaacactcagtctgatagcatcttcattcgtttctcagcgttggcagatatttctcagtcaaggcgtctgtttcggtatcggtatgggatttctattcgttggcagcgtgggaatcacgccccaatggttccatcgtcgacgaagtcttgctatgggcatcaatgctgctggatctggcctaggaggactaacctactctcttgccgtgggagcaatcatccctcggctagggcttagttgggcatttcgaatattagggattgtttcctgcgttgtgaacctagtgtgtgcgaacttgctgagagatcgcaatacagctgttggaagccgcttcaaagcattccactttccacttttcaaacgcccagagtttcttctctttcttggttggggtatattttccatgcttggctatgtcgcgatcctatttagcatgtcaaatttcgccgtctcagttggtctctccgcccaccaggcgagtattattagcgccctgctcaacctcggccaaggactgggacgaccctttgttggtatgttcagtgataaacttggccggatcaacatcgcaactttcctttccttcctctgcggagtcttctgtctgctgatttggacatttgcccgcagtatgggccttgtgtccttttttgctgtgcttgttggcactgttgctggcacttactgggccactgtggccccagtgttggctgagattatcgatttgaaagacctacccggtggtcttagcatcacctggattgtcctggtggcaccgacaaccgtggcagagcccatcgcactgttattacgtgataacgactctcccagccgcatttatctacatgtgcaacttttcaccggcctgatgtatattgcggccgcggtatgcctctggacagttcgaggctggaaagtgggagaaaaccttcgcgtcaagcaagaaaagtcagcg

SEQ ID NO: 36797 - DNA, 3138 bp, Aspergillus nidulans
  unsure (1)..(3138): unsure at all n locations
acaatgaagagtctcaggcgggattattcaactgatccttccactgcgaacgtcactagcaaagtcttcgtccggtcgacaaaaagtggaaaagtgcagaagattgttcgcgagctctacttaagacaggatatcccttgctcttcgaggttatgcanttttgcccctttcggttgcaccgacggatgcaaatggaaatagtgagaacggacttaaatttttcgtgaaagtctttttgctaacataacgttgtatgtcgtgccattcgttctcttgaagcaacctgcaggcacaacggccttcccccggagacattacattgttcctgacacgaatgcgcttttgaatggaatgaatttgtttgagcatacaggggctttctatgacgtgattatccttcaaaccgtcctggaagagttaaagaaccagtctcttccgctctacaaccgtttgcttgcgctaatcaaaaccgacgaaaaacgcttctaccttttcttcaacgagtttcgtctcgagacgcatgttaggagagagcaggatgagtcgataaatgaccggaatgaccgagctgtgaggaccgtcgcaaaatggtacatggatcatttgcgcgcagttaccaaaagcaagaaggagaagtccattccggctattgtggttataactgatgataaagagaacttgcgcaaggccaaagaggaaagtgtgacggccttgtcgttagagaactacgttagtggattggaagatgcggacaggttgctcgacatgatcaatgagtctcgggaagcgagggaggcgaaagaagcccgcggagaactctactatccagagtactattctatgtcgaagatcatgacaggattacgggccggaaatcttcaccaaggcgttttcaatgtctcgccatataattatctagagggacaagtcaaagtcgcggcatttgataaaccacttatcattatgggccgtcataacagtaaccgagccatatctggagatgtcgtcgtggttgaaatcttacccaaagatcagtggaagtcgccttcaacaaagatcgtcgacgaagaagccgtgacaaagaatgataatcctgagggcgaggacaacgaaactgtcatcactgagaaggagcggagagctttacaagaagaggttaggcaagcgcatggaaagaaccacgaggggcggccgcaaccgacggcgaaggttgtgggcgtcgtgaaacggaattggcgccaatacgtcggaaccgttgatccaacatccaccggctctcaaaccactggccgacgacagcagaatgttttcgtcctcccgatggaaaagaaggtccccaagatccgggttcgaacacgacaggctacggaactgttaggtcaaaggatcctggtcaccatcgatgcttggaaccgcgactctcgataccctaccggacacttcatccggtcactgggcgaattagagacgaagtccgctgagacggaggctttgttactagaatgggacgtacaatacaagcccttcccgaaggctgtgttggagtgtcttccccctgaaggacacgattggcgtgtcccggcaagcaaagatgatattggctggcgagggcgaagggatctacgggatcttcttatctgtagtattgatcctccaggttgtcaggatatcgacgatgctcttcacgcgcggaagttgccgaacggcaacttcgaagtcggtgttcacatcgcagatgtctctcatttcgtgaagcccaataatgctatggaccttgaggctagcgttcgtggaacaacagtttacctagtggacaagcgtattgatatgcttccccaccttctgggcacagatctctgttcccttaagccatatgtggagcgttatgccttctcagtactgtgggaaatgacgccagacgcagaggttgtgtctgccgacttcacgaaatctgtgattcgatcgcgtgaagccttcagttatgaacaagcccagctacgtatcgatgacccatcgaagacagatgagctgacagaaagcatgcgtaccctacttcatctctctaaaatcctgcgccagaagcgcatggatgccggtgcactgaacttagcatcaccagaggtccgcatcgaagcagacaacgacgaggtcggcgaccccttggcggacgttaagacaaaagcgatgcttgcaacaaacagtctcgttgaagaatttatgctccacgccaacatcaccgtcgcggctaaaatctacagcaccttcccgcaaaccgccatgctccgacgacatgcgacacccccgccccaaaacttcgaagaactgatcaaccaactcaccaagaagcgcgacatgcgccttgacgtctccagctctcgcgccctcgccgactcgctcgaccgctgcacagacgctgaaaacccgttcttcaacaccctcgtccgcattcttgccacccgctgcatgacttccgcagagtatttctgcgccggcgcgcacgcggagtctgaattccgtcactatggcctcgcctcacccatttacacacacttcacgtccccgatccgccggtacgccgatctccttgtgcaccgtcaactcgcagcggcaatcaattacgagggcgaagacggccgcgccacgatcgagggctccattacgcgtaaccgcctcgaggatatctgccgcaacatcaactaccgtcaccgcaacgcacagcacgccggccgcgccagcatcgagtactatgttggtcaagctctcaaagcacgtagcgagaagctcgccacaaacggcgtagacatcggcatcgaagaggacggatacgtcatgcgcgtctttgaaaacggtgttgtggtctttgtgcctcgatttggtattgagggcgtagtcagacttgaggatttcgttctgcctagtgatgaggcgctgcggtctgttgaggataggagggagcttgttaccaggcgcgagagtgagtttgatccagaggaatatacccttaaggtctcgaataaggggcaccaagaacggtcggtggccgtggagcttttccagagggttaaagttaacattagctctgtgaaggaggagactggacggggtgttgggaagaggagggtgaggatattgattctg

SEQ ID NO: 36798 - DNA, 1556 bp, Aspergillus nidulans
atggctgcccccgctcagaaattcaaggtcgccgacatcgtacgtctttcaacccagcttgttgaaggggaatatcacgtctaacttgaatagtctctggccgccttcggcgccgtgagattgagctcgctgaaattgagatgcccggtctcatggctatccgtgccaagtacggtcccgcccagcctctgaagggtgcccgcattgccggttgtcttcacatgagtacgttccgcataccggaatgattgtggaacgaactgacctttccccagccattcagactgccgtcctcattgagactctcactgctctcggtgctgaggtcacctggacttcctgcaacatcttctccacccaggaccacgccgctgctgccatcgctgccgccggtgtccctgtgtatgtcgattctcaatcttattggtcaactaagctaatatgagcagcttcgcctggaagggtgagaccgaggaagagtacaactggtgcttggagcagcagctctccgccttcaaggatggccagaagctcaacctcattctcgacgacggtggtgacctgacctcccttgtccacaccaagtaccccgaacagctccagggctgctacggtctttctgaggagaccactaccggtgtccaccacctctaccgcatgctcaaggagggcaagctcctcgttcccgccatcaacgtcaacgactccgttaccaagtccaagttcgacaacctgtacggctgccgtgagtctcttatcgacggtattaagcgtgctaccgatgtcatgattgccggtaaggtcgctgtcgttgccggtttcggtgacgtcggtaagggttgtgcccaggccctgcacaccatgggtgctcgcgtcctcgttactgagatcgaccccatcaacgccctccaggccgctgtccagggctacgaggtcgtcaccatggaggaggctgctcctctcggtcagatcttcgtcaccaccaccggttgccgtgacattctggttggcaagcacttcgaggtcatgcgcaacgatgccattgtttgcagtaagcacccttcaaccacactgataaagatgtagctaaacgtttagacatcggccacttcgacattgagatcgatgttgcttggctcaaggccaacgccaagtccgttcagaacatcaagccccaagtcgaccgctacctgatgcccaacggccgtcacattatcctcctcgctgagggtcgtcttgtcaaccttggctgtgctaccggccactcttccttcgtcatgtcctgctctttctccaaccaggtccttgctcagattgctctgttcaaggccgaggacaaggacttcggccagaagtaccccgagttcggtacctccggcaagaagcccgttggcgtctacgtcctgcccaagattctcgacgagcaggttgcctacctccacctctcccacgtcaacgccaagctctctactctcactcctgtccaggctgagtaccttggcctggatgctaagggcccttacaaggctgaccactaccgctactaagttttttct

SEQ ID NO: 36799 - DNA, 3473 bp, Aspergillus nidulans
atgccggctgatatcaggagtttctttggtggcaagtcgagccaaggctccgcctcgtctcctacgaaaccgcctgcaaaaaaagaggtatgtgtatgatcgccaatgcttaatttatgcccagtattttgctcctgcttagtctgatggatggctgttaacttcgctatagaaacagaccccagcccgcaataagcgtacgattcgcggaaatctatagcacatggaccattgcattgacaaagttacaggtggcaggaaggttgtcaatgacagcgaggatgacgatgatgtcgtggtgaccgatgccccggtctccagagctaagccttcgagcaagtcgtaaggctcttttagtcgaattacagcttcgtccactaacgcatgaccgaaggaagcctgcagtgccagaaggcgaacctacgacggcctcggactatttcgcatctagcaagaagaaaggacgaactaaatccagtaacgcagataccaataacaaaccatccaaaagtagcgctacgaagacggagagtccagaagctaccgtggggactgcggagcagaaagacgcaaccagagctgggtctcgccgtgacacgaacaaggctactgtgcgtcttgacgacgaaaagctgggtgatgacgacatttttgcgaccgagtatggcaaggcgggcaaagggaacgacgattataaagaggaagaagatgacgatgacagcgatgattttgatcccttggcgaaaccagtaaatggtgctcggggcaggccagtgtccaaaaagcgttctgcacttggtgaagacgatgaagacgtgattatggaagatgccccccggcgaccggcgagcgcagccaaacctgcaacctctcaaacgcaaaggaaacgaaagtctgaagcagttgataaggatgacgatgatatccaggccacctcaaagagtgtcggtactggagcaagatccaaaaagccaaaggcgttaaccgccaaacaagatcagtcagatagcaaagagattcaagatatcttcgacagcatcccgacaataaaagctccgtcgcccccgcctccacaaggttctgacgagaagaagaagttcgttttcggaggagggaaatcgcgagaccctgtttctgggggcgccgaactacctgttggagcggaaaattgtcttgcaggtctaacgttcgttttcacaggtgttcttgacaccctaggccgcgaagagggccaggctttagtcaagaggtatggcggtaaagtcacaacagcacccagcggtaagacaagctttgttgtcctcggaagcgatgctgggccatcaaagcttgccacaatctcgaaacacaaactgaaaacaattagcgaagaaggcctatttgaactcattcgtcgtcttcccgcaaacggcggcgatgggaaagctgctgaaaagtatgaagcgaagaaaaaggaagaagatgagaagattcggaagatggccgctgagattgatgcggaagagaaacgtaatgaagctgagagacggaaagaagtcaaaagcggccaaaccactcaggatgtcaaggacaaaaaggaaaataacgccgatgaccaactctggacctcaaagtatgcacctacatctctgaatatgatatgcggcaataaaggagcggttgagaaacttcaagcttggctcaggaactggcgaaaaagcgcaaaggcgaactttacaaaaccgggcaaggacggatctgggctatatcgctctgtgatgatacatggccctcctggaattggtaaaactaccgcggcgcaccttgtggcaaaacttgaaggttacgatgttgtggaatcgaatgccagtgacaccaggagtaaaaaactcgtcgagagtggtcttctaggtgtcctggatacgacttcactgcaggggtatttctcgacttcaaacaaaaaggttgaaagtggcaaaaagaaccttgtgctaatcatggacgaggtggatggtatgtctgctggagatcgaggaggtgtcggagcgatggctgcgattgcgaagaagacacaaattcctctcattctcatctgcaatgagcgacgcctcccaaaaatgaagccctttgatcacgtcacattcgaaattccgttcagaaggccaactgtcgagcaggttcgagcccgccttctgaccatctgctttcgagagaaaatgaaaataccaccgcaagtcctggatagtctgatcgagggaacacacgcagatattcgacaggtgatcaatatgctctcagcagtcagattggatcggagcgagcagggcgaccaaaccggccaggattattctctcgattatgaccagggaaagcagatgtcgaaagcatgggagaagcatatcatcctgaagccatgggacattgttggaaaaattttgaatccacaaatgttcagtcaaagctcgacggctacgctcaacgataaaagtgagctgtatttcaatgaccacgagttcagctatcttatgctccaggagaactaccttaggacgaaaccgacacgtgccaataactatgagggcaaagagcgtaagttaaagctgctggaattagcagataatgctgcctcgagcataagcgatggagatctcgtcgacagaatgattcatggcagccagcagcaatggagtttgatgccaacgcatgctattttcagttttgtgcgtccggctagttttatgtttggtaatatgatggagcggcctgccttcaccagctggctcgggcaaaatagtaaacaaggtttgatcatcgtctttggagtaattgcacgcgaggctgatgttgtacacgcaggaaaactctcgagatatgtgaaggaaatccaaggacgcatgcgcgttcgcgcctctggagatcgccacgaggtccgacagcaatacataccactattatgggacagactcgttaagcggctgatggtagacggcaaagatagtgttgaagacgttgttgattttatggacagttattttcttaccagggatgactgggatgctcttgtcgagctcggacttgggcctatggatgagtctaaagtcaagctggagacgcagaccaaagccgccttcacgcgtgtttacaaccaacgctcacacccgcttccatatatgaaggctagcaatgttcttgcgccgaagaaggcgccgaaggaaaaacccgacattgaggatgccatcgacgagtcggacgaggatgacgtccttgtggacgacactaaagatgacgaagatagcgacgagattgatctcaagaaggacaaacttattcgtgtgcctaagaagtctaccgctaagaaaagttcaaagagcagcacatcagcgaaaggcaaaggaaaatccaagaagacaagcgcggacgatttcatcgacgacgaggacgacgatgcgccgaagccaaagaaagcgcgaggcaaaaaagccaagtcataactt

SEQ ID NO: 36800 - DNA, 1228 bp, Aspergillus nidulans
ctcttagtcgacaagcaccgtccgagatccctcgacacgctctcatatcaccatgagctctccgcccgattaaggtctttggtatggaaatcaccagctattttaaagaagctcaagctctaatatctttttcaggcccaaagtggcgacttccctcaccttctcatgtacggcccatccggcgctggcaagaaaacccgcacgatagctacccttaaagaactctacggcccgggcgtcgaaaagatcaaaatcgacaaccgagtattccaaacaacaagcaaccgcaagctggaatttaatatcgtctcttctgtctaccatcttgaaataacgccctccgatgtcggcacctatgatcgcgttgttgtccaggaactgctcaaagaaattgcgcagacgcaacaagtcgatctgtccgcgaaacagcggttcaaggtcgtggtcatcaacgaggcggaccatctaacacgagatgcgcaagcggcccttcgacggacaatggagaagtacagtcccaatatgcgactgatcctcctggcaaatagcacgtctaacatcattgctccgatccgctcgagaactctgttggtcagagttgcggcaccgagtgaagaagatatctgtaccattttgagcacatcggcgaagagggaaggttggaatgaggccccggagcttaataaacggatagcgaaggagagtgggcgaaatctccgtcgtgcgctgcttatgttcgaggctatttatgctcagaggtatgcttcttgactccctctgctctgtggagctaataaggttctccgtagtgagaaagtatcggatgatacacccattccaccacctgactgggaagctcttatctcggtgatcgcggaagagattcttgcggagaggtcaccggctagactgttacaagtccgtgccaggttatatgatctgttaacccactgtataccggctacgacgatcctcaaggtctgttagctgattatggaaaacggcgaatctactaaccatgtctagacactgacattcaaattgatcgccaagattgacgacaccctgaaacctgaagtaatcaagtggtctgctttttacgagcacagaatcactcagggtagtgtaagggttccattgagttgttgatgatgtcaaagctgactcagaacagaaagtaatatttcatctcgaggcttttgttgccaagttcatgcgtatatatgaa

SEQ ID NO: 36801 - DNA, 977 bp, Aspergillus nidulans
atgggtcacgaagatgctgtttacctggccaagctcgccgagcaggctgaacgctatgagggttcgttctccttgtttctaggtcgttgctggaactcgtggcctcgatattgacggagttccatctagaaatggttgagaacatgaaggttgtcgccgcctctgacgtagagctcactgtggaagagcggaatctgctttctgttgcctacaagaacgtcatcggcgcccgccgtgcgtcctggagaattgttacctccatcgaacaaaaagaggagtccaagggcaacgagtcccaagttgctctcattaaggagtaccgccagaagattgagggcgagctcgccaaaatctgccaggacatcctggacgttctcgaccagcacctgatcaagtccgctcagagcggcgagtccaaggtcttctaccacaagatgtatgtttctgtagttgttcatctatgccacccatcttaacatatctctacgccaacaggaagggtgactaccaccgttaccttgccgagttcgctgttggcgacaaccgcaaggctgcggccgacgcctccctggaggcctacaagtctgccaccgaagtcgctcagaccgaccttgcccctactcaccccatccgtctcggcttggcccttaacttctctgtcttctactacgagattctcaactctcccgaccaggcttgccacctcgccaagcttgctttcgacgatgctattgccggtatgtagcgcattaatgtcagatctaggcgctcgactaactttcgttgcagagcttgacaccctgagcgaagagagctacaaggactccactcttattatgcagcttctcagggataacctggttagttaaattcacgcgatgctcggaacagttcttctgacatgatttagactctctggacctcctctgaggccgaacccgctgcagagaatgcccccgccgaaaagaaggaggaag

SEQ ID NO: 36802 - DNA, 1659 bp, Aspergillus nidulans
atgtacagactagaagccgcgacttcccgcctggaggacatggcgatgtcgttagatgaacacgatgcccagaagaagaccgctgacaactcggccgcgctggagccgcaagcctctgagcgacctacaccaaccgcccctgccgcccccgcagctgctcctcttccaccccagatcgaagacttcgatacattgattagcaaggacgttgggaatttcgtgcaactgggacagaagattggaggtctcgtcgcagagcaggtatgatgccaggtgtcataatagttgctgaatgccttgctcatttgtttttaagtccaacgctgtccttgaagccttcaaggcggagcgcacttacctctatgtctcgaccaaggcgaagaagccagaaatccagcctccggagcttatgaccggactccacacggcatccgatgccatcaacaatcttcgggagtctaacagggcatcgcctcttattgaccatctgagtgccgttgccgaaggtatcgttgccctgggctggttttttgatcccaaacctgccgatttcgtcagcgagatgctcggaggtattcagtactacggtaacaaggtgctgaaggaatacaaagagaagtatgcgttttgcaccggaggtcatgttgcaccgtggtttactgacagacttgcagggatcgtacccattatgactacatccaagcgtactaccaaatcttcaaatctctttcatcctaccttcgcaagcattacccaaagggcctgacatggaatgacaaggatggaatagatgcacaggaggcactcagacaggtcaaaaacagctccgactctgctgctggcggtgcaggaactccccctccgcctcctccagtgccgactttgaatatacctggtggtggcgcgccaccaccaccaccaccccctcctcctccccccatgatctccgaacagcagagttctggcgcctcatctgatatgtcggctgtgttcgctcagctgaaccagggagacgctgtcacacaaggcctgcgcaaggttgacaagtcccagatgacgcacaaaaacccaagcctccgagctagctctaccgttcctggaagccctagctctagttcccgctccaagtctccagcccctagcaaaaaaccaaagccagagagcatgcgtagccggaaaccgccccgcaaggatctcgaaggcaccaagtggttcatcgagaacttcgataaccccggagacattgtcgaaatccccgccaagcagaaccaatcaatcctcatttctcgatgcaacaagactatcatcaaagtgtccagcaaggccaatgcgattgccatcgataattgccatggcttgtccattatcgtcgactcgctcgttagcagccttgatgttgtcaagtgctccaagttcgctcttcaaattgacggcgttgctcctacactgcttatggaccaggtcgatggcgcaactgtttatctgtcgtcccagagcctaggtacggagctcttctctagcaaatgcaccgctgtcaatgtgatgcttcctccaaaggaaggcaccgatgaagatacaaaggaatgtccggtcccggagcagataaagacctccgtcaaggatggtgttcttgtcagcgaaattgtcgagcatgcgggc

SEQ ID NO: 36803 - DNA, 1540 bp, Aspergillus nidulans
aagcagcgtcactaacagctcgcagtgctcgacggaggaacgggtttcctcaaagtcggatatgctgcgcaggtacgtctgtcaagtcctcgagtttctcttctcagtctagggctccgtaatgactttactcttattttacagaacttccccgagcaccagttcccttcgatagtggggcggcccatcttgcgaacggaggaacaggctggcgatattgttgtcaaggatatcatgtgcggagatgaagccgctgccgccagatcgatgctccagatcagctaccctgtatgtccacatcccgctcgttctacacctcgccatggaatgctcgcgagttccgctccccagattcccaatggtagtgtgtttacactctggggctgattcctatgaccgctatgtagatggaaaatggtatcgtcaagaaatgggatgacatgcaacatctatggaactacactttctacgataagatgaagatagatcctaccggccgcaagatcctcctcactgagccgcctatgaacccgctgaagaaccgcgaacagatggcggagatcatgctggaacactataacttcggcggagtatatgttgctatccaagcggtccttgcactatatgctcaaggtcagtgcagaggcaaccgaaaattactcagttgctgatctggcggactctaggtctcagcagcggagttgtcgtggactctggtgacggtgtcaccacatcattcctgtttatgaatctaccgttctaaatcaccacatccgccgactggacgtcgcaggtcgtgatgtcactcggaacctcatcgcgctgctactccgccgcggttatgcgctgaaccgtacagccgacttcgagaccgtgcgccagatgaaggagaagctcgcctatgtgtcctgcgacctcgaactcgataggaaactctccgaggagaccactgtattagttgaatcctacactctcccagacggccgtgtcatccgagtcggtagcgagcggtttgaagcccctgaatgtcttttccagccgcacctggtggatgttgaccagcctggtatggctgagttgcttttcaacaccatccaaggcaccgatgtcgacgtccgctctagtctatataaagccatcgtgctcagcggagggagcagcatgtaccctggtctaccgacacggctggagaaggaattgaagcagctgtggttgacacgagtactcaaaggcgatccagaacggctgagcgtacgtcatctatcacactaactgctcagtcatctaagctcgtgctgactcgacacaacagaaattcaaagtccgcatcgaggacccaccccgacggaggcacatggtatttttaggaggagctgtgctcgccaatctggtacgttcatggttccctttctactgccgagctcatccctttacttaccgtatcatgaaacagatcgcagacaaggaagacatgtgggttaccaagcaagagtgggaggaacaaggagcacgcgcgctcgccaaactcggtccaaggtag

SEQ ID NO: 36804 - DNA, 3135 bp, Aspergillus nidulans
gacagcgaggtcgaagtgagtctcgaagggcttcccgatgatcctaccgaattatgtacactcctggaaaatgaaagagcggcgaagaatttttgggtcatcatagcgctcgcctatgccaaacaaaagcaaatcgatcacgcgatcgacatcctaaacaagggtctcgcatcggttgctcaaggtgctacaaaggagaagttaggcctcttgggatgggtatgctggctgtacttgctgaagagcagggaggcgcctcgtgtggtatcagacgttggtttgggtacagaagcgaggaccaaagactactacattcagcaggcgaccggaatattaaacgaggcgtcgcggttgaacccatccttcccgccccttttccttgctcggggggttttatctctgttgcgcgcctctttacatcccccacggcctgttcgaccaggggctgttgataactcagaaagagtggaatcattgcgccaggccctgaagcagtttgatgaatcctcgaaagcgttcggtggtagaaatgccatggctattcttggacgcgccagggcgcactacctacttgggcgatatgcagaagcgctggaagggtaccagaaggttctaatgagaatgcctggcctgactgatccagatcctcggatcggtatcggatgctgtctgtggcaattgggcttcaaggagcaagccaaagctgcttgggaacgtgcactagctctggtatgtcagttcgaagaatgcatcttggatgttgtagtggtactaatacagtacttccgcacttatagaatcccgactcgaaagttgccaacatcctcctcgcggtatattacctttatgacagctcccggcatgctacaacagatccggcattcggttccctgtacaaggtggccatgacacaatatactcaaaaagccttcaagctggacaaggaatatcctatgacctgcgctctgtttggcagttatttccttttacgaaaagcttattcaacagttgatactcttgctcgcaagtcgattgagaacactgacgtcatgcaaatagccagcgatggatggtaccttctcggtcgaaaatgccattatgagggagacctggccaaagccgcagagttctaccaccgctctgaccaagctcggggcggaggcgataaaggttatcttccggccaagtttggctctgtacaaatgcaagtgtctaacaaggactacgacggagccaagtttcagctggagaaaatcatacagcagacaaagaacccggagtgcatgacactactggcggctctctatgcggaggaggtctttgcagcgcagaaaagtggaatgaaagaagacaagtccgccgaagctaaaaaagccatcacgttgtttgaggcagtacgcgcgctttggaaggatgaaagtaagaagattacgccggacgagtcagttttggtatatctttctcggctatatgagcagaacgccccggataagagcatgcagtgcttgacacaactggaagaattgcagctggctgagatatctgatgaggaacgcccagaaggcctcgaagatgaggaaatgaaggctgccctccgagtaaatctgccgccgcagctccttaataatatgggttgcttcctataccagagctcgcagctcaacatggctcgttccatgttccaggcagcgctagactcttgtgctcgatcgcaagagagggaaggggaactcgatacggacgcccttgtcacaacaataagctacaacctcgggcgggcgttcgaggcatctgatatgcccgatgaggcgaagaaagtttacgaggccctcctggaacggcatagcgactacactgaggcgagcgcgcgattaacataccttgctctccggcgtagcccgacggatgaagggcccaagaagatggcgaaactgtacgagacagattccactaatctcgaagttcgggctttgttcgggtggtacctcagtaagtccaagaaacgggccgcgaacattgcagaggaccacgagcagcgccatcacaagcatacgctgcagtattttgacaagcatgaccgatacgcacttactggtatgggtaacgtccacctgctgttcgccagagacatgcgacgtgatacggaccaggagaaggagaaacggcgcaagatgtacgagcgcgccgttgagttcttcgacaaggctcttcagctggatccacggaacgcgtatgcagcgcaaggtatcgccatcgctttggttgatgacaggaaagatcttagtacagcagtacaaatcttctccaaaatccgtgactcgttgagagacgcgagcgtctacctgaacctagggcatgtctacgctgagctacgccagtatacacgatccattgagcactatgaggctgcattatccaaggaccgggcccgcgacgctcaaatcctcgcctgtctcggccgcgtttggctccttaagggtaagcaggaaatgagcctcgcagccatgaagacagccctagattatgcccaacgcgcacattctgtggcgcccacccaagcccacctcgaattcaatgtcgccttcgtccagaatcagatcgcgtccctcacatacagcctacccgaaacacaacgaactgcccaagacgtgcaagacgcagcggacggcctccgcaccgcggtcgagactttcgggcgtatcgcccaggccaagaatccgccttacccggctgagtctcttgaacagcgcgccaacatgtccaagacaattataaagcagcttgaacgggccctccagagccagaaggaatacgaggagaagaatgccgctaaactacagcaggcccgcgaggcccgggaggccgagattcgccgtcgcgaagaagaagtccgcaaggcggaggaggctgagcgggagcggaagcagcgtatcgcggaagaacgtcagcggctcgttgaagaggctcaaaggcttgcgctcagcgggcagaagaggaacgggcccgcgaagaagcggagatgactactgaatccgaaacaggcgaaaaggtcaagcgaagaagaagtctgctggctcatccaagcggtagaagcagcgccgtgaggatgacttcattaatgacgatgagggcgac

SEQ ID NO: 36805 - DNA, 614 bp, Aspergillus nidulans
ctgctaacgctgccagacatctttggcttcttccctcaaacccttcagggcgccgatatcctcgctacctcgtcgaaacagaaataccgcatcttcatgcccgacttctttgagggcgagcccgcagatatcacctggttcccgccctccaacgaagaccagaagaacaagctcggcaacttcttccagacaaaggcggcgctcccaagaccctctccaagatccccggcgtcgtctcggaagcaaactcctacgccccctctggtggcgccttcgaatcatggagcatcctgggctactgctggggcggcaagatcaccgttctctcgtcgggttccgagaacaagacgttcaaggccgctgtgcagtgtcaccctgccatgctggaccctaacgatgccaagggcgtgaacatccccatggcgctgttggcgtctaaggacgaaaagcccgacgacgtcagccagttcggcgcgaacttgaaggtcgatcactatgtcgagactttcccgacgcagatccacggctggatggccgccagaagtcagttggaggatgagcaggtgcggaaggagtatgagaggggataccagaccgcgttggactttttggca

SEQ ID NO: 36806 - DNA, 1570 bp, Aspergillus nidulans
ttggctcaagcattctcccccgacggctctaatgccgttgttatcggtccggggaatccggctttaactgatacctacgcgcagctgcattggcatatatctgccgtccatgaaaagctggctaaacttggtgtcggacatggtgccgcggttaatctgcatctaattaactcgcgcgattccattgttggctttgtagcaacctgctggcaccgcgcaatcgctgctcctctgaaccctgcctacaagcaggacgagtttgagttctatatcgacgatcttagctcaaccctagttcttatccctcgggaatcctatgctcagaatggccccgcggtcctcgcaggtagaaagtatcaagcggctattgcggagtgctactggaacgggacggaggttgtgctcgatgtgaaggagctgggcaagctaaagggcaaaggagacattggcgtccagaccgctcagcccgatgacattgcgcttgtcttgcacactagtggaacaactggcaggcccaaggctgtatgcgagcactttccgcaggagtttgattgggaactgtactaactcttgagacaggttccgctcacccacaagaacctgacaactaccatgagtgagtgtcgcggtatcgcttctgacataggactaattccgttctagggaacattcaagcaacgtacaagctcacccctcaggatcggacttacctggtgatgcccttgttccacgtccatggcctcttagccgccttccttgctccccttgcctctggcggttcagtaattgtacccaccaagttctctgctcaccagttctggtcggactttatcgaatacaaggcgaactggtactctgccgtgccaaccatccaccaaattctgctcaagtcgccgctgcccaaccctattcctcaaatccgcttcatccgctcctgctcctcgccgctgtcaccaaaaaccttccaggatctagaaaaaaccctcaatgccccagtacttgaggcctacgccatgacggaagcggctcatcaaatgacgagcaaccccctgccccctgcaaagcgacagcccggtagcgtgggtattggtcaaggcgtcgagattaagattcttgatcaatccggaaacgaagttccacagggacatgaggcagaaatctgcgttcgaggagaggaatgcacgaaaggataccttacaatccagctgccaataagtcatctttcaccaaagacggctttttccgcacaggtgaccaaggcaagaaggaccctgacggctatgtaattatcaccggccgcatcaaggaacttatcaacaagggcggagaaaaaatcagcccaatcgaactggacaacacgcttttgcaaaaccccaacgtcggcgaagcggtctgcttcgccattcctgaccccggtcactacggcgaagacataggggccgcggttgttttgaagagcggtcagaatgctactgaagatgaattgaagtcgtgggttcaagagaaactggctaaattcaagaccccaaaacaggtaagccagctatctctctgcccctgaccgggctgt

SEQ ID NO: 36807 - DNA, 1604 bp, Aspergillus nidulans
gaccaggctctgcaccagttacaacagcagcagtccaagctactggacaagattgatgatctacgcaacattggcgttggcagcctcgtagagttgccgcaacttatcgtttgtggcaatcaatctagtgggaaaagctctgtgcttgaagccatctcgcgtgtcggtttcccgcaaaaagcaatgtatgcacacggttcgctactgaggtgatcttgcggcggaatccagtgtcgaggatcaagatctctatcgagcctggtccctcacgcattaacgaagaagagaggaagagacttcaaagctttaggcacgagcagttttcgaccaagaacgatctgcctgccctgattgagaaggcgaaggagtgcatgggcgtttcagagtccggcgggctgggctttagcgacgatatcctaaaggtcgagatctcgggaccagataaaccagagctgaccctggttgacctaccaggcctgtattattcaaccagtcgagagcaggggctggcgggtatagggatcgtccgcagcctgacagagaaatatatgcagaattccaggagcatcattcttgccgtcatcagtgcaaagaccgactatcatctacaggaggtgttgaatatcgccgcgagattcgacccggggggcaagcgtacgctgggaatcatcactcaaccagacattcttgaggcgaattctgaggaggaagacacataccttcaattcatgaagaacgagaaggtccgcctacatctgggatggcacgcactgcgcaatcggtccttcgaaacccgggacgtatcggacaacgcccgcgatgagcaggagaaggagtttttcagccagggacgctggacgtctctgccgcgcgaggttcttggagtagacaccctgcggcgtcggcttagtagcgttctgctggagcacattcgtcacaacctccccggattgatcggggatatccagcagaagatttctgaccgagaacagagacttgcaaagctcgggtctccgcggtccaccattcaacagcaacggggctttcttcttcagattagtagcagcttcgaacggatcgccgcgcaagcgctgaacggcatgtatgcagatcccttctttggtgggttgggagatgcaaaagggacaagcgatattcgacgcctccgagcagtacttcgacaactaaatgaactctttgctgaagcgatgtcgattcgaggctgtcgacgcacaatcgtcgacgaatcgacctcaggctcggcctctacgacggcttccatgccggggtcagagaacccgtacatagacggctgggcagcagagtacatcgaccgcggcgcactcgaggctgaggtcagtaaacaagcacgtgaaaaccgtggcattgagcttcctgggagtgccaaccagctccttgtagggagcttgttccgtgatcagtcccatccatgggaggagctggctaaagcccatctgctcagagcttgcgactccgtgagatactttgtctttcttgtcctccagtacctggccgatgagcatacatcctccttgctcgccgcatccgtcattgagccggaattggagaggatgaaacaggct

SEQ ID NO: 36808 - DNA, 1267 bp, Aspergillus nidulans
ttgactcccaatgaaattgttaacatccaattcacctccggcaccaccgccatgcccaaggcagcctgtctaagccaccgctccatcctgaacaatggcgcccagatcggcgaccgcatgcgcctctcgccagccgacacagtctgctgtccgccgcccctctttcactgtttcggctccgtcctgggctacatggctacagcgacgcatgggtcggccattgttttccccgcagaagcttttaatgccagggacaccctacgcgccgtccaggaagaacagtgcacagccctctacggtgtgccaacaatgtttctcgaagagctcgggctcctggaatcaggccaggtcccacacaagggatttgaatatctccgtaccggcatagcggcaggaagcagtatccccgctgaactgatgaaaaagcttcacaagacgttgaatctaacggaactgacaatctgttatggcatgacggagacgagtcccgtgtctgcaatgacaacgacagatgacccaattgataagagaatcaataccgtcggacgtctgatgccgcatgttgaggcgaaggtcgttgatccgctcgaccgtaacaagattctccctataaattctcgcggtgaactcgccgtgtctggatacctgcttatgaaaggatactggggtgatccggagaagacggcggaggtgatgctgaaggataaagacgggaaggtttggatgcatgtatgtctttccatcacccgatccacctgctcaaaagacctaacccagggataccgtctagaccggcgacgaagcaactatttcgccagacggctacgtcaccataaccgggcgtattaaagacctgattatccgtggcggcgagaacatacacccacttgaaattgagaactgtctcttgaccttccccggtgtcgcggatgtctctgttgtgggggtccccgacgcccattatggcgaggtcgtggcggcttttgtgatatggaaacaggcgcatcagaatacggaagagcaggcagagacgggagagaagctgaggaagtttgtaagggagaaactgagtgcgcatcttggtaggtcgctatttttctttcttctgatcttcaggacgctgggtttgattcgggcggtgctgatacttttgcgcatagtgccgaagtatatattcttcctcgagccgacggattcattcccgaagacggcaagtgggaagatccagaaatttaagcttaaggagacagcgatcaagcttttgggt

SEQ ID NO: 36809 - DNA, 1074 bp, Aspergillus nidulans
ctgggattcggtacctggcagtccgcccccggccaggtcggcgaagcggtctaccaggccctcaaggtcggctaccgccaccttgacctggctactatctaccagaaccagcgcgaggtcgccgagggcatcaagcgcgcctacaaggacatccctggcctcaagcgtgaggatattttcatcgtacgtcaatttttgtacccagagcagctcgttgggccattagactaacagttcgcttgcagacatccaagctctggaacacccagcacgaccccgccgttgttgagaaggctctggacgactgccttgcggagctcgagctcgactacctcgacttgtacctcgtccactggcccgtcgccttcaagaccggtgacaactacttccccttggacgagagcagtgaccaccccgacggtgacgtcctgatcgatgacagcatctctattgttgacacctggaaggccatgaccaagctccccaaggagaaagcccgcgccattggtgtctccaaccacactgtcgagcacctcgaggcgatcatcaacgccaccggtgtcgtccctgccgccaaccagatcgagcgtcaccccgttctccagagcaacgacctgatcgagtacgccgctaagaagaacatccacatcactgcttactcagtacgtccctgaagcgttgtacgccgcttgcagcctaaactaatgaaaaaactaggccttcggtaacaacatgttcaacatccctctcctcgtcgcccaccccgaagtcaaggccgtcgccgaagaggcctccaagcgcctcggcaagaccgtcacccccgcccaggtcatcctcaactggtcccaggagggaggccactcggtcattcccaagtccgtcactgcctcgcgcattgccgagaacttccaagaggtcgagctcaccaaggaggagctcgccaaggtctccaagcttggcgaggagcgccgccgctacaacacaccttacgtggctaacaagcctcgctggaacattaacatcttcggcgaggaggacgagaagcctgccaagcacaaggttatcgtttagatg

SEQ ID NO: 36810 - DNA, 2520 bp, Aspergillus nidulans
cgccgtgtttggactgccttcgtttgggcgctaacattctggattccgtcattcgtcctacgctatgttggacgaatgaaacgccccgatgtccgaattgcctggcgagaaaaggttgtcttggttcttctaatcctgctcttcaatggcattgtttgcttctacatcatcgccttcggcgacctcctttgcccaggcaaagacaaagtctggaatgaaaaggaagtcagctggcgctcgacaagcagtaatttctatgtcagcatccatggctatgtctacgatatcaccaaatttgccaaggtcactcatggcgacacatcaccagaagcgacgccttcgctgatggaaccattggccggcaaggtattggacgcctattttccgcctccgttgacccggatgtgcgggaactatgtcaatgatctcgcaatcaacctgcaaaacaacgacacctccgccacagaggatcagccgctggccgtacataaatctggaccacgcaatcgaccagatacgactaccaagctgcacaatatcacttggtacgaacaggacttcctgccgaagattaatgagtactacaagggcaagcttgtctggtccaaggatactgttaagaaacaagccgaaagtagcagtgaacgaaaatgggtcattgctcacaacaaaatctacgatcttacggattacttctatacgctagacatgatgaattcggaaagttcatatgattggcttccttctgcaatcactgatttggtcaagaacaaccctggccaggatgtctcggataaatggccgttgatgtcgtctcctttccgcgaagcccagtcctgtcttgattacgtgttctacaagggcgatacagatttccgtgatggtccgcggtgcacggtcaacaactggattctactcgcattcacgatcttgatttgcgcagttgttcttgtcaagttccttgccgctctccagctagggtcaaagccagtccagcaactgcaagacagattcgtgatatacatggcgccgacatacagtgaagccgaagactcggtatgcaaaggtctgaactcactcagtgcgcttcgatacgacaacaagatagaactgatctttgttatatgcaatagtatgattgatggtggtggtaacgagcggcggacgccgaaaattgtcctggacattcttggagttgatcccaaaatcgaaccctccagcgttgcctgtcaaatctatcggccaaggcaacgaacagcttaattacggtaaagtgtactctggactgtacgaatatgaaggcaacgtggtgccttatgtggtcgttgtcaaggtcggcaaggagtcagagcagaacaaatccaagcccggtaacaggggtaaacgagactctcaggttctccttctcaatttcctcagccgcgttcaccaccgtgccccgatgtcccctcttgagctggaagttttccaccagatcaacaatgtcattggcgttgaccctgagctttatgagtactgcctgatggtagacgcggatacaagtgtacgtgaggattccctcaatcgccaagatagctgcgtgcgccaatgatgctcgcattgctggtatttgcggggaacgtagtcttcaaaccgaggaaccaagttggtgcacaatgatacaggtttatgaatacttcatctctcatcatttggccaaggctttcaagtctttgtttggcagcgttacctgtcttcccggatggtaagtctattatcccactgttatacacacatcactaacgacacagtttctgtatgtaccgtcttcgcacagcagaccgcggtcgtcctttaattatatcggagaagcttcttgaggagtattcggataataatgtcgatacgctacacaagaagaacttgctggcccttggtgaagatcgatatctcaccactctcatgaccaagcattttcccaccatgtcttacaagttcatccccgatgctttcgctagcacggcggctcctgagacatggtcagtccttctgtcgcagcgacgtcggtggatcaactctacaatccacaacctggttgagttggcggccttgaaagacctttgcggattctgttgtttcagtatgcgttttgtggtaatggttgaccttctgggtacaatcatccttccagcgacctgcgtctaccttggatatctgatctaccgcgttgcgagcgacacggggcccttcccaatgatctccattgtcatgctggctggtatctacggtcttcaggcgattattttcataatcaaacgccagtggcagcacattggatggatgattatctatctctgtgcataccccatctacagtttcatccttccgttgtattccttctggaagcaggacgacttcagttggggtaatactcgtgtagtcattgaggagaagggttcgaagcgcattgtcgcggtggaggacgagcaattcgatccccgcagtatcccccttcagcgctgggacgactatgccctagcc

SEQ ID NO: 36811 - DNA, 1644 bp, Aspergillus nidulans
ggcccgaactccctcgattctagatatcagaacactcagcgcgggctgaaaacacggcatgttcagcttatggcgctgggagggacaattggttcgtgtgctttcaccctcccaccttcctcttaccccgtcctattggagtgactcttctaaaccggggctcaggaaccggcctcttcgtcgggtccggacaagccctcaacatcggcggacctctctcgcttttcctgggctatgtctttatttcaaccctcgtctactgcatcgtcacgggtatcgccgaggtgggcgcatacctacccgttcacggaggcaccatgtcttaccacggctttcggtacgtgagccgtagtctcggctttgcgatggggtatctgtattggtacagcttgggtatcttggtcccctacgaaatcgtcgccgcctcgctagtgattgattactggccgaacggtgtgcctttggctgcttggatcactatcatgctggttgtcattgtggtcttgaattatatgcctgttggaatatacggagagaccgagttctggtttgctgggatcaagatcatcaccctcatcgggctgttactgttgagtttcatccttttctggggcggcgggccgaatcgacaacgattgggattccattactggaaggatcctggggcgatgaacacgtacctcgttacctcaaatgagaacacaggaaggttcatcgggttgttacagtgcatcgtcaagtccgccatcgcattcatctttgccccggaactcatcatcgtcacagctggagagatggagtcgccgagacggaacgtgcccaaggctgggaggagatatatttatcgactcgtgatattctatctcctcggcgccctcgcgattggcgtcatctgctcgagtcaggaccaggcactcctcacgggcgacacgaacaacgcctccgcgtccccattcgttgcagcaatccagaacgcaggcatacctgttctccgccacattgtcaacgcggcgattctgacatcagcatggtcggcaggcaactcgttcctgtacatgtccagccgtagcttgtacggtcttgctgtatcggggaacgcaccgagcatattcaagtcgtgcaacagatttggtgttccatggcttgctgtcactgtgtctgcgcttttttctctcctctcatacctcgccgtttcttccggcagctacaccgtcttcaactggcttatcaacttcaccaacacgtcaggcttcatctcctggatctgctgctgcatcgtgtactttcggtttaacgccgctatcaaggctcagggtgtggagaagccttactcgtctcgcctgcaaccctatggaatctgggtcggattatcttttgccatttttctgctactgatcaacggcttcacatgtttcttcccgcaaaattggtcagcagcgaacttcttcacagcgtacatcggcatcccggcgtttgcgctgctttatgtcggacatcgcatctggttctggagcgacccgtgggcttggaagagcaccgaggtggatttgcagaccgggctgcaggagatccttgcggctgagaagccggcgaggccgcgtgacacaatcgggagaaagctaatggcgttggttgagtgatttg

SEQ ID NO: 36812 - DNA, 993 bp, Aspergillus nidulans
atgggttcagtcagcaaagccaatgttccaaagatcgatgtttctcccctgtttggagacgaccaagcagccaaaatgagagtagcccagcaaatcgacgccgcttcgcgtgatactgggtttttctacgccgtcaaccatgggatcaatgtgcagcgactctcgcagaagaccatggagtttcatatgtctatcacacctgagtaaaagtgggaccttgcgattcgtgcctacaacaaagagcaccaggaccaagtccgtgccggatactacctgtccatccccgggaaaaaggcagtcgagtccttctgctaccttaacccgaacttcacgcccgatcatccccgtatccaggccaagactcccactcacgaggtaaacgtgtggccagacgagaccaagcaccctggtttccaagactttgccgagcagtattactgggatgttttcggtctctcttctgcactgctcaagggctacgccttggcattaggcaaagaggagaatttcttcgctcgccacttcaagccagacgatactcttgcctcggttgtgctgatccgctacccttacctggatccctaccccgaggctgctatcaagacggcggccgacggcaccaaactgagttttgagtggcatgaggatgtatccctaatcactgtgctttaccagtccaacgtgcagaacctgcaggtagaaactgctgccgggtatcaagatatcgaggccgacgatactggctacttgatcaactgcggcagttacatggcacatctcacaaacaactactataaagcgcccatccatcgggtgaaatgggttaatgcagagcgccagtccctgccattcttcgtcaacctgggatacgacagcgtgattgatccatttgatccccgagaacccaatggcaagtctgatcgggagccactctcctacggcgactatttgcaaaacgggctggtgagtttgatcaacaagaacggccagacc

SEQ ID NO: 36813 - DNA, 1419 bp, Aspergillus nidulans
tcccaacgagtagaggtccacaataactcaacgacatctgcccagactcttccagccggcgacaccaagactgaatcagagtctgccgctataacagccgctgctcatcctctctctgccctccccacccccgttctccttcgctccctgctcattgctaccatttcctcgaaaccctccctcctcatcccctccctctcagccttgtcattcctctgcaagccccgcgctggtcctctgctcaatgtcgaccggaatcccatcctgcactttatcctcaaagcaaccttttacagacagttctgtgccggtgagacgcccgacgaagtgcgctcaaccatccgccagctcgccggtatggggttccagggaacaatcatgacatatgcgacggaatcggggtttgctgcaaagaccaagatgcagacgggcttgggcgttagtaccaagatgtacgggaaacaggaagttactgagcccacgttggccaggggcgaggccttttgcccgcatatagaagcgtggaggaaggagactgtcgagacgattgagctactgggcgcgaatgattacctggctctaaagttggtttcttttctgctctggcatcttctacttacaagctagcatagattgacaggcgcaggttcctccggcaccaccgcgttcaggactgaccttccccccaccggctcagatgctctctgcactagacgagatcagcactaagtgcgctgcaaagggggtgcggatcctcgtcgacgccgaatcccaccacttcttgaccggcatcctccgcgtcaccctggacctaatgcgtaattcaataaggatggccacgcccgcatctacaatacctaccaggcgtacctgaagagcacacccgccacaattgcacggcatctccaagctgcaagcgacgtggggtttacgctaggacttaaacttgttcgtggcgcatacattttctcagacgagcggagcctgatccacgagacgaaggcggatacagatgcggcttataacgggattgcacagggggtgctgtgccggcagctcggcgcgttcgggacagagaagccgttcccatctgtggagttgttcctggcgagccataataaggagagtgtcatgaaggcgcatgcgcttcgactgcagagactgaaggagggattgccgactgtgccggtgggattcgggcagctgcatgggatatccgatgaggtgagctttaggttgttaacgctgaagaatgagcgtaacgagccgatggtgtataagtgctcgacctggggcaggctgagcgagtgtctggcatacctggtaaggagggcggttgagaatcgggacgcggtaggccggacggaggatgagtatcgagccctgaagagggagatggctagaagggtaaagatctgt

SEQ ID NO: 36814 - DNA, 708 bp, Aspergillus nidulans
atcgacatcgaatctttcaagaaatactgcgcctacttatcatcccatctaactggcctcgtatactcggcacaaacgccgaagcattcctgctcacccgcgacaaacgattcgcggccataaaggccgcccgcgaagccgtcggccccgggtatcccattatggcaggcgttggtgcacactcaacaaagcaagtccttgaacttgcgaatgacgcttcagaagcaggggcgaattacctcttggtcctaccgccagcatattttggcaagcgacaactcctgcagtggttaagaggttctttgcggatattgcggcaaaggcactgcacccagttgtggtctacaactttccaggtgccacaaatggggtggatattgactcagaaacaattgctgatattgtgagaacgtcgaaggaggcgtcgggtgggaagagcaatgttgtcggtgtgaagctcacctgtgcgcaggtcgagaagatcacgcagttgacggcggcattcgggcccgatgagtttgccgtttttgaaggacagtcggatttctttattggtgtctgtcagtgggttctgttaggtgtatcgctgcgtttgtcaatgtcgtgcccaagacgattatacagatcgaccggctgtacaaggctgggaggtggagaaggcgttggctctgcatcgcaaggcggctctggcagagtctcctcgcaaga

SEQ ID NO: 36815 - DNA, 1486 bp, Aspergillus nidulans
cgcaatccagccgctacaacgaccatcaccatgcccatcctccctcacctcacggtgaacacctacaacctcaccgttgtaatcctcgtggccataggcacaatctcgacagcgtatggcctcgccgtcattgggtccaccgtcggccaaccgaatttctacaccttcttcgacctagaggccgacaccaccgatcccgactacaagcacacgacgaatatgatcggcgccttgaatggcgtcaactccgccggcgccttcatgggttgtatcctgcaagcctggagctctgacgcatatgggcgcaagaccaccatccgcttgggcgcggcggtgctgattgtaggtggcgcgctgtgcgctggggccgtgcatatggccatgtttctggtcggccgatttgtcgctggtctaggagctggcattctagcgtgtagtgtgccgatctatcaggcagaagtgtcgacggcagagacgaggggtgccatggtctgcgtgacgggcgtcatgtatgcggtcggctatagccttgccggatggttagggtacgcctgctggttcatggaggcgacgagcccagcggcgcagtttgcatggcggtttccgctggccttccaggtgcttttcccgctgtgcgtgctcgtcggtgcgccgtttattccagagtcaccgcggtggctgttggcaaaaggtaaaggggttgaagctctaagcgtgctgcagaaactgcactcgaccaacgggcatagcaacggcgacaacaccaaagcgcgggaagagttcagcctgatggagaaacagctcgaactcgaccagtcgcgtatcgtgaaatccaggtggccagcgctagcactcttctctacgcccgcaaaccgtaaacgctcactcattgcgacgattctcatgatcggaaaccagttcctgggcaccttcgtgctgaccaactacggagtccttatctacgcctcccttggtctaacagggtctatcccgttgcttctgaatgcctgctggacatcattcacgcttatcggaaacacctggacagcactgtacatcgaccgcttcgggcgccgtcgtttcctgctcgccggcgcaacaggctgcacactgtgcatggtcttcttgtgcgcactgacggcatctttcctgaatacagacaacacccccggactgcgggctgccgtcttcttcatcttcttctatatcttctggtggtgtttcttcgtggacgcgacgcagtttgcgctacattgctgagatcttccccaaccatctacgcagtcagggagttgcgctgggactgggctggttttatctctcaagtgaagtgacccttgttgcagcgccggtagggttggatcgtgttgggtggaggttctatcttgtgcttattgtgccgagtgtgctgtatgtcgggtgcatttatttcttgtttcccgagacgaaagggcgaacactagaggagatggggcgggtctttgga

SEQ ID NO: 36816 - DNA, 1320 bp, Aspergillus nidulans
cgtctcgatgacgggctagcacgcacgcctcagatggggtcagctaattcttccctttcttgggggtccagatcgtttcactaatgccgatatagatggaacacctataatcaatataactgctttcccaacgagagtattgtgcacgagaacgcgcaagccctagtcgacaccggcctcgctgacctcggctaccgctatgtgactatcgattgcggctggggcgtcgaggacagattgcccaatggcacgatcacttggaacccggagctctttccgcagggcttcccagcgatgggtcaatatctgcatgatctgggtctactgttcggagtctacggcgactcgggtattctgctgtgtgggagtccgcccaacattacagggagcttgtgtatgtcttcttttctttgccttcttccgcttgttgccgggcgaaaatatgctgattgggttgggatgacagactacgaggatatcgatgcaagaaccttcgccgaatggggagctgattcgctgaaatgtactctataccatatccttattctctagtcttagaatgctaacaagtcagacgacaactgctactctgacgccgcaactaactacccaaacgtcaattacgcgccttcaacatccccgcacccccgttttgcaaacatgtctcgctacatccaagcccaagaccgggacatcctattccaagtatgcgaatggggtatcgacttccccgccctctgggccccggaaattggccactcgtggcgtatcgggaacgacattatacctcactggcgctccatcttccgcacgctcaaccaggccgttccgcaaaccgactttgccgggccaggccagtggccagatctagacatgttgcttgtcgggctcgatggagtgttgaccgtgcctgaggagcagacgcatttctcgctgtggagtatcctcaagagccccttgacgattggggctgcaatcccgggtatgagggcggaatcgttggagattctgagtaatgcagatgttattgcattcaaccaggacgctcttggtgtcagcgcggccttgagaaggaggtggagtgacgaagggtatgaggtatggagtgggcctttggaaggggggaggactattgcggcggtgatcaactggagggacgaggatagggagatcacgcttgatttgccggacattgggctgcagtacgctgagacactgcagaatgtctgggcggatgaaaccgtgaatggggtcaagacaagctacagcagtgttgtcgaggcgcacggagtgatgctggtgcagcttgctgagacggta

SEQ ID NO: 36817 - DNA, 1184 bp, Aspergillus nidulans
tcctcagaaggccaagatgagtgctgtatatatggcgtctccgccatgcagggctggcgcatcagcatggaagatgcccacgctgccgttctagatctccaagcgaaacaatcaggctctaacgaccaaccgaccgatcccgacaggcgccttgctttcttcggagtatacgatggccacggtggagacaaagttgctctgttcgcgggggagaatgtccataagattgtcgcgaagcaggagacctttttaaaaggcgatattgaacaggccctgaaggatggatttctcgctactgatcgggctatcctagaaggtttgtgaactgttatcctgggagggtcttgcgctcgtctcgtgcttccgggctcctgtctgacccaattagatcctaagtatgaggaggaagtttccggctgcactgccgctgtcagtatcatctcgaagaaaaagatctgggtggtaagtttgctctaggggataaggggaacttgggcggtaacacactccacaggcaaatgctggtgattcacgttccgttttgggtgtcaagggtcgtgcaaagcctctctcgtttgaccacaagccacagaatgaaggtttgtgattagtttctattgatatgtcccatattctgatgaatgggtgtataggcgagaaggctcgtatcagcgctgcgggcggcttcgtcgactttggccgggttaatggcaacctcgccctgtcgcgtgccattggagattttgagtttaagaagagccctgaactatcgcctgaacagcagatcgttactgcctacccagacgttacagtccacgagctcacggaggacgatgaattcttagtaatcgcttgcgatggtgggtttcccctcaactttgccgctctgttccacaatctgatatactacaggaatctgggattgccagtcttcccaagccgtggtcgaattcgttcacggcggtatcgcggccaagcaggatctctatcggatttgtgaaaacatgatggacaactgtctcgcttccaacagtgagactggtggagttggctgtgacaacatgacaatggtcattataggtctcctcaatggaaaaactaaggaagagtggtacaaccagatcgcggagcgggttgctaacggcgacggcccttgtgctccgcccgaatacggcaagtctctc

SEQ ID NO: 36818 - DNA, 1344 bp, Aspergillus nidulans
atcatgattctcatcatcgtcttctaccactacttcgccattgctctggtcccacttttcctcctctttttgacggcaagcaattactatcgctcgtctgcgcgcgaaatgaaacgccacgagtccatcctccgctccgccgtctacgcccgcttcagcgaagccatcactggtacagccagcatccgcgcgtatggcgtacagaaccaattccgctcttccctccgtgactccgtcgacaccatgaacggcgcgtacttcctaactttctccaatcaacgctggctctccgtgcgcctcgacgctgtcgctgtcctcttggtcttcgtaacgggtgtgctagtcgtgacctctcgtttcgacgtgtctccttccatctccggattagtgctaagctacatcctagccatcgctcagatgctgcagttcaccgttcgtcagctcgccgaagtagaaaacaacatgaacgccaccgaacgcgtgcactactacggcacgcaactggaagaagaagcaccagcccacatcccttccaacccagtcccagaatcatggccgccacacggcgaaatcacatttgacaacgtcgccatgcgctaccgccccggtctccccctagtcctcaaaaacctctcgatgaacatatccggcggagagcgcatcggaatcgtcggacgaaccggggccggaaaatcaagcatcatgtctgcgctctttcgactaactgagctgtcatcaggccggattaccatcgacggcgtcgatatatccactattggactgcatgatctgcgctcacggctagcaatcataccgcaggacccaacgctgttccggggttctatccgctcgaatctggatccgtttaatgagcacagcgatcttgagctgtgggatgccttacgaaaagctcatttgattgactctgacacgaaagattccgcagtcgatgcctcgaatccaaatggcaatgccaacgcacagagactaacgctcgacacggcggtcgatgaagagggtctaaccttctcgctgggtcagcggcagctgatggcgttggcgcgtgcccttgttcggaacgcaaggatcatcatttgcgacgaggccacctcgtcggttgattttgcgacagatcagcggatccaggagactatggcgcagggatttgaagggaagacattgctttgtattgcgcatcgactgaagacgattatccactatgatcgtatttgtgtcatggatcagggctcgatcgcggagatagatacaccattgaatctgtgggagaaggaagatggaatatttagggctatgtgtgagcgcagtgggatctcgagggaggat

SEQ ID NO: 36819 - DNA, 1417 bp, Aspergillus nidulans
gagacaaagctactcgtcaagatcgattggtttatcttgtctttctgctgcgtgacttatttcttcaactatctggatcgctccaacctgaccaacgcgtatgtaagtggcatggaggaagagctctccttccggggcaatcagttgaatcaaataaacactgttttcactgtcggctatatactcggtcaaatcccctctaatctggcgctgacctacttgcgtccacgcatatttttccctgctatgattctctgctggggttgtatgtatgccttcgatacgggttcgtactgcgcttaccaccgttctaggtctaacaatggtcaccgcggctgtccacaacccacaaggcataatggcgatacgctttttcctaggagtggccgaagcaagcactttcagtggcactcattttatactcgggtcatggtataccgagcgtgaactaggcaaaaggagcgggatctttactgcaagcgggctcgcgggccaaatgttcggtggtttcatccaaactgggatccattcgtcgttagatggtgctgcagggctgtccggctggagatggcttttcatagtgagtatattccactcttatccagggcgatttctgcctcatcccagctaaccattccagattgatggcctgataacccttcctgttgcattgtacggagctttcttgtttcctgatactccagccacaacccaagctccataccttacatcctcagagcgagctttggccgtgtcccgattgccggtagcgaagcatgccccgatatttaaccgaacattcctgaaaaacctattcaagacctggtattggtgggcgtttgtcattctttgggtgattgcaggcgagacggagtcattctcgtccaattctttgttggcactttacatgaagtcgcaccccacaaaccattactccattgcccagcttaacaactaccctactggcgtgcccgctgttggaattgtctctacactgttctgggcgacgcttactgatttttgggggggtaagcggtatattgtgggttattttatcggcattactggcatcatcacgccgatacttattctgactcggtttgactcaaccgctacagtctttggtgcatactattgggccggagccgtttatgcttgccaagcaacctttttcgcatggtgtaatgatgcgatgaggatgcaggaggaacggcatcgttctgttgtgattgctagcatgaatctgggcaacaatgctgtcaatgcttggtggagcattctgttctactcggcagatctggcgccgcgattcacccgcgggatgtatgcaatgatcggttgttcagtagcattgattatttgggttacagctatcctcttgaagactttacaggaggacaaggcctcttcaaggctc

SEQ ID NO: 36820 - DNA, 1800 bp, Aspergillus nidulans
gtgcgaatttgtgtttgcggggatgagggaactggaaagtccagccttattacctccctcgtaaaaggcgtgtttgtgacgaacaagatccagcccattctgccacagatcactatccctcctaccattggaacccccgagaatgttacaacgacaacggtggtcgatacctctgctgtgccgcaagaacggagcaacttggctagagaaattcggaaatcgaacgtgatattgcttgtctattctgatcactatagctatgagagggttgcgcttttctggctgccctatttccgctctctcggcgtgaatgtgcctgtcgtgctgtgtgccaacaagtccgatcttgctgccgatcataccgagacgcaagtcatcgaggacgagatgttgccgttgatgtcagagttcaaggaaatcgattcatgcattcggaccagtgcccgagaacatcgtaatgtcaacgaggcctttttcctttgccagaaagcggtcacacaccctatcgcacccctattcgatgcaaaggaatcagccttaaaaccggcggctgtcgccgcgttacaacgcatcttctacctcagtgataaagaccgggacggttatctctcagataaagagataaaggattttcagatgaggtgttttgagaaacctctgagcgaagaagacttggtccatataaaagagacaattcagaaaacacatcctgactctgtgacgccgtccgggatagattgccggggatttattcatctgaacaagatgtatgccgagaaaggacgccatgaaacagtttggatcatacttcgcgcatttcagtacaccgatagcctttcgttgcaagagagctatctccacccaaagtttgaggtgcctccgtttgcatcagcggaattgtctcctgagggctatcggttctttgtcaaccttttccttctctcagacaaagacaatgatggtggactcaacgatgccgagttagcatcattgttcgcacccacccctggattgccgccctcttgggctgacggctcatttccttcatgcactgtcagaaacgaggctggccatgtcactcttcagggctggctagcacagtggagtatgacaacctttacttctcccaagacgactctggaatatctagcgtacttgggattcgagtcttcagatcggagcaacccctccacgaccgcggctcttaaggtaacacgaccccgtaagcggagaaaacgtccaggacgcgtcggtcgcaatgtcgtccttggccacatagtcggagctccggggtctggcaaatctgcccttctcgatgcttttctgtcccgcggatttagtaccacttatcaccccacaattcaaccgcgtaccgcagtcaacacggttgagcttccaggcggaaaacaatgttacctgatcatggatgagctcggcgagttagaacctgcgattcttgaaaatcaagcgaagctactcgatcagtgtgatgtgatcgtatacacatatgactcgtcagaccccgattcattcgcatatatacccgctctcagggcgaagtatccacacctggaggagcttccgagtgtgtacatcgcactcaaggctgacctagaccgtacaacccagcgcgctgaacatcagcctcatgaatacacagctctattgaatatgcctggtccgccgcttcatgtgagcgttacctggagttccattcaagaggtgtttgtgcacatcgcagaagccgcaatggaaccgagtacagcattccctcggagcgaggaagacgtcgagggcaaa

SEQ ID NO: 36821 - DNA, 1433 bp, Aspergillus nidulans
atggctgagcagctggtccttcgcggcacccttgagggtcacaatggctgggttacttccctggctacctctctggagaagtaagggcaccgatttgcatggataaaatacgtatatggaactacatgcgaatccgtgtgtatatccatatacgtatcgcatagatttttttgtgctggttgaaaatggacaatggttctgacttgagatttttattgatagccccaacatgctgctctctggcagtcgcgacaagaccaaaatcatctggaacctgacccgcgacgagcaggcctacggctaccccaagcgcagacatgagggtcactctcacatcagatccgactgtgtatgcctacgatccgctattccccgaaattcgtggcccaaagaatgtgcaaagagcggggttcagacggaagggatatatgacaatcagaatcagtttgactgatgagtgtgcttggacgtataggtgatctcctccgacggagcctacgctctgtccgcctcttgggacaagtccctccgcctctgggagctttcctccggccagaccacccggacgttcgttggtcacaccaacgacgttctctccgtttccttctccgccgacaaccgccagatcgtttccggctcccgtgaccgcaccatcaagctctggaacactcttggagactgcaagtacaccatcaccgacaagggccacaccgagtgggtttcgtgcgtgcgcttcagccccaacccccagaaccctgtcatcgtctccgctggctgggacaaactcgtcaaggtacgtcctctttacatgttctctcgcttgctgcacgcacttggtcctatgatgtttgcattttacacgtatttgctacttcagagccttacggccatgagacaaaaaatcaccatatgcctgatggacacgccaaccccgtttgcttatttcttttactgctataatcctgattataagtcatgagggctgcaactaacaaaacaaaaaggtttgggaactcgcttcctgccgcctccagaccgaccacatcggtcacactggctacatcaacaccgtcaccatttcccccgatggatccctctgtgcctccggtggtaaggacggtgtcactatgctctgggatctcaacgagtccaagcacctctactctctccacgccggtgatgagattcacgcccttgtcttctcccccaaccgctactggctctgcgctgctaccagcagcagcatcaccatcttcgaccttgagaagaagagcaaggtcgacgagctcaagcccgagtacattgagaagggcaagaagagccgcgagcccgagtgtgtttctctcgcctggtccgctgatggccagactcttttcgctggttacactgacaacaagatccgcgcttggggtgtcatgtcgagggcgtagatt

SEQ ID NO: 36822 - DNA, 1031 bp, Aspergillus nidulans
ttgaaacccaacgaagttctggtcaagatgtatgctgccagcttgaactaccgcgagctggtcatagccggtccaatggtatttgcgactctaaaccgtatgcctcgcatgttcctactgacaatttgcagggcatcaacggcccgataactccgccgattgtacccggctgcgatggggctggcctggtagaggctgttggaccttcagttcgcgagttcagtccaggagaccgggtcgtgacgtacatcgcccccaaactcgtcgaagcacacggggacgatgcccacgctggagttgcagaggcagttgccagcatggggcaaggaagcgatggcacattacgatcctgggctgtgtttccggaggcaggcctagttcattcgccgagaacgttggactggttgtcggcggccaccttaccctgtacttggctaacggcttggaacgctctcttcggtctgaacggcaagcaagcgggaccggactcatgggtgcttgtccaaggtacaggcggtgtcagcatagcagcattgcagctcgcggtcgccgctggggcaacagtcgtcgccactacatccacggtcgagaaagccgatcgcctcaaggcgctaggtgcggcccatgtggtcaattatcgcaataatccagaatcttggggcaaagaagcacgactccttaccccagctgagaggggctttgacttcgtcgtcgacgtcggtggtaatgagacgtttccgcactccttggccgctatacgagttgacggggtggtcttagcggtcgggcaagtcggcgacagcacagcagagccagtacctatatttgccgccctgatacataactgtattatccgtggcattctagccggctcctgcaaccagtttaaggaattggtgcggtttatcgatgagaagaagctcgtgcctgcgatggatgacgtgattttcgagcttgcccaggcaaaggatgcgtataggcgactgaaagagaggaaacatttcgccaaggttatgattcggattgatcat

SEQ ID NO: 36823 - DNA, 708 bp, Aspergillus nidulans
cgcagacagtcaaaactatctccaacccagctcgaagagctccaaaaggcgacgcatttcgataagaaagaactgcaacaatggtataaaggtacttttggctctggagcgtggaaatattgctcgaaatcaattttatgtgctcgttgagagactgctgctgacatacgtcatatcaggatttctgaaggactgcccgtccgggcaattgacaaaggaggagttccaggatatctaccgaaaattctttccgtttggtgatccctcgtcatttgcgaattatgtcttccgggttttcgattcagataatagcggcatgatcgatttcaaagagttcatatgcgccctgtcggtcacctcacgtgggagaatggaggacaaattggactgggctttccagctctacgacattgatggcgatggaaagattacgtacgatgagatgctggccattgtcgaggcgatttacaagatggtgcgttcacccctgaatcccgcagggcgtttgctgacgtgtgattctaggtcggctcaatggtgaagctcccggaggacgaggacacaccggagaaacgagtgcgcaagatctttcgcatgatggacaaggatgagaacggcagcctcgatatggaagagttcaaagaagggagcaagcgtgacgaaacaatcgtcagcgcattatcgctatacgccggcctggtatgattg

SEQ ID NO: 36824 - DNA, 1452 bp, Aspergillus nidulans
atcgtcaagaagccactcgaattcactccacttgggactcgcgtgctatcccctgcccattttgcatcaccctaccgacaagctcgcaacctcctccatgtttctgccgttccggactcgcttccctgccggaagaaggaattcgacacagtatatagccacctcagtgctgccattatggaggggacaggcacctgcatctatatttctggcacaccaggtactggaaaaacagccactgtccgcgaagtcgtcgcgcagttgaatgccgccgtacttgcagaagagatggacgacttcatattcgtggagataaacggcatgaaagtcaccgaccctcatcagtcctactccctgctttgggaggcgttgaagggtgatcgagtgtcaccttcccatgccctcgatctgctagatcgggagttctccaacccttcgcctcgaagagtatcatgtgttgttcttatggacgagttggaccaactagtcaccaagaaccaatcagtcatgtacaacttcttcaactggccagccctcagacattcgcgtctcatcgtgctcgccgtcgcaaacaccatggaccttccagagcgaaccctaagtaacaaaatttctagccgtctgggtctaacccgcattacttttccaggctataagcatacggatctaatggagatcatcactactcgattagccagcgtgcctggcaagatcgttgattccgacgcgatccaattcgctagccgcaaagtggcggcagtgagtggtgacgctcgacgcgccctagacatctgccgacgcgcggtcgagattgcggaacaaagcaacgaagccgccggagtagaagccctggatgcggacgacaccgagtccctccctccgacacccagcaagactgctgcgcggaaagaaagagcaaacgcaaaacaaaccctttctatatcgccgcaaaaatccaccgcgactccaaggaaacaaacacccggtcgcgtcaccatcgcaacaataaagcaagccatccaggaagctacctccacccccctgcagcaatccctccgctgtctcccgctctccgcgaaactcttcctagccgccctccttgcacgcgtccgccgaacaggaataacagaatccaccttcggtgacgtcaccgatgaagcgaaacgcattgccgacgctgcggtagcagttgctggagctgctggtgcaggaattaaagaattcttgcttgctggtggcaccgggacccgtgttcaggcgttgggatttgcggcaatggagctcatgaattcaggggttcttgctttagaggccacttccggttctagaggcttagggggcgcggcaattccgacgaggggcgatcgtagtggaaaggtgaggctcagggttgcggcggaagatgttcgcgctgcgtttcgagatgatgttgaggcaaaaggattggggttg

SEQ ID NO: 36825 - DNA, 2556 bp, Aspergillus nidulans
gttagaatcccgctgaacgacgatgtcgaggagaaagcagcccgtatgggggctcggcaggctctacatgaccgtcagatggatcaaatcaaagccgcagtcaaaacgcctatgccgccgcgcaggtataccatacatgatcgatcgagcatgagcccttccacgccccaaggttctggtcatcggcatcgggatagtgatgctcatgggcggcggggggttaccccaatgaagcgcgtaccaatcctagcgaacttcgaagagtggatgaaaatggctaccgataacaaaattaacgctacaaactcatggaatttcgccttgatcgattatttccacgacatgtcgcttttgaaggaaggagacagtgtgaacttccaaaaagctagctgcacattggatggatgtgtgaagatctacacaagcagagttgatagcgtggccacggaaacagggaaactcctgagcggtttggcagatagcagggacaagaaagcacgcgaggcggaggctgaaggcgagggcgctgaagacgatgaggaggacggcgaagagggtactagcaagaggtcacgcagaaaggtacggtcccactagaagctcagcattgcttgagcccgtatcactaacggaattcgccatgttcagcgcacgcacgaggctacactcgctccttcattttcttcgctccagttgaagaaattcgagctcgaattctcagttgatccgctgttcaaaaaagcttccgcagactttgacgagggtggtgccaaaggactactcttaaaccatttatcgatcgatggacatggccgtattgtattcgacagtagcgatgacgccgtggaaactgctcaagatagggatgacacaagagcacagtcagagtccctcgaagacccggaatcgacatcgcaacctccacctaccgaaccacctcgcgacgattcattcgaaggaggtgtagagatagacatcgctccattggctagcaagttcttcccagatcttgacagacttgacgcccaagatatttgcccttctttaaagaatttcgaccttggtgatcctagtggctcattggatatccctcttctgaaggctcctgaagactggcggcaggataaaggcgatgacgacgggcatccatccaatgacgcatcaggaatcatgcttgatgatgataatgctgtcgggtttgatgacgatggcagcttggctggctttgatctcagtgatgatgctgggttcggcggtggaggggaggcttgggctcgggaggccgccttggagcctatgcttaaggtgcaccgtgtggacttggaaggtgaagaagttcaggatggcggaagcctcgacaatgacgatgcctatgctatatcgctcaaccaccaaccaagcagccgggaccatgagaacattcttagttattttgataacgcattgcagaaaaactgggctggccctgagcattggaagattcgacgaataaaggaaaatgctgctacaactgccgccagcacggcgccaaagcagcgaaaggaaaaggagccattcgaaattgatttttctgcgccgctcgatcccactgtggccgaattgatctatttaccagcaagctctaactccgcaatatcccttcccaaatcgcagtggaaaacaaaaggccgaaacttgcttccggatgataaacacttcaactcgaggcagctgcttcgacttttcctcaagcccaaggcacgcatgggctctaggaaactaaacgggccgcggagcttcacccagcgacgccaggaacagacgtcagggaatggggagatggatgaggcattctgggccaatcacaagactgaggatcagactggcgatgatgaggcagctcctggggcgtatgatgctaacttctttgcggacgatgatggccttgctttccccaatggcattgatcttgacgacgacgacaatcttccattcgctgacgctagggaaatgttgtctcctccacccggcggcgttccaggtacagctgcgggagatgctggtggggccacagggctcgcagcattactgaatatggtgggtgcaacaccgggtggctcacaagtccaaagtgcctctggaggctttgggtcacagttggtaacgcaaggtggtcggagagcacgacctgactatgttgcatacgccagagtggccaagaaagttgacgtcggtcggctcaaaacagatatgtggaaaggaatgggtgagcggcttatatccgctatggattccggcccccaactcagcgctgcgaccagcccgtccaaagaacagcacgaaactgatgatgatggcccgtcaacacccaccccaattcataagcgcccaaggctctcttcggacctggaacctgctaaagaagggcacttgcgcttcactgaaataatgaactcgctaaaatcagtctaccctccagagatgctccgtgatatcagtacatcatacggcttcatttgcctactccatctggcgaatgaacaagggctcatcctccaaaacgacgatgatagcagc

SEQ ID NO: 36826 - DNA, 1520 bp, Aspergillus nidulans
ggagggttgtcgttcgggtacgatcagggtgtgatctcagtcaccctggtcatggaacagtttctgggccggttcgtggaggttgccgagggccatccgggatcagggttctggaagggcttgatgacggcaatgttggaattgggtgcttttgttggcgcgctcaatcagggctggctcgctgataagatctctcgacggtactcgatcgttgtggctgtggctatctttaatgtcggttccgtgctgcagactgccgccgtggactatgcgatgcttaccgtcggacgcacaattggcggtattggcatcggtatgctgtccatggttgcgccgctctatatctcagaggtctcgccgcccgagtgtcgaggcgcgctgctcgtcttggaggagttctgtatcgtgctcgggatcgtcattgcgtactggatcacgtacgggacacggttcatggccggcgagtgggcgtggagacttcctttcctgctgcagatcgtgccgagtttcgtcttgctgggaggtgtcattgtcctcccgttctcgcctcgttggctcgcgtccaagggccggaatgacgaggcgcttcagagcctgagccagctgcgccggctgccgaccaccgaccaccgtatccaacaagagctgctggacatcaagatcgatgtccgctttcatcaagagctgaacgccgagaagcacccgacccttcagggctcggggacgacaaagagcctgcttcgcgagctggccggttgggccgactgcttcaagagcggttgctggcgacgcacccaggtggcagtccttgtgatgtttttccagcagtttgttggtatcaacgccctcatctactactcgcccacgctcttcaagaccatgggtctcgattacgatatgcaattgctcatgtcgggtatcatcaacgtcacgcagctggttggcgtctgcaccagtctctggaccatggacgccctcggccgtcggccgctcctgctctggggtgctgccatcatgggaatttcccatgtcattattgcagccctcgtcggtatctactcagacaactggcctgcgcaccgaacacggggctggaccagtgtcgcttttctgtttgtgtatatgctcgcctttggcgccacctggggatcagtaggctgggcgctgccggctggtaaggaccctttctctgatgctttcaatagatagtcctgacatgtcgcagaggtgttctcttcatttctccgcgccaagggtgtcgctcttgcaacatgcggcacctggctgttcaactttatcatcgtgagtccctcgccattttttttttttttttgaccgggacgatggactaatggaaatagggccttatcacacctcccttgattcaagatacagggtatggtgcgtacgtcttcttcgcagtgttctgtatcctcgccttcatctggaccttcttctgcgtccctgagacaagcggccgcaccctggagcagatggacgcagtattcaaggacaactca

SEQ ID NO: 36827 - DNA, 951 bp, Aspergillus nidulans
tatatctagcctttgtcgaactcttcaggcggtctatcttcgggagcggacagaagtttgtgataatacttcaatcgaataccgagggtggagtcatggagtggaaaggtgcaagagaatgggctattgagcgaaacagtatctcgaataagaaagaatatgctaaacgatgggggtataaactggaggttgttaacatgctagcaaagaagcgctactctcatgaatggcgtgaggggtgggagaaagtcgatatcctacgtgagaccatgaagaaatacccaaccgcagaatggtacgcgacccaggaagcctacagggtggtgacatctaacagtatataggttctggtggctcgacctcaacacttatatcatggaaaactcgtactcacttgaggatcacctatttgatcgccttgatgaggttgtttatcgcgacattaacgagtacaatcccctaaacatcacacatccgccaacccagccataccttgatgaagtatctcgctcggccattggtgacaatgacccaggctcaatccatcttctgctctctcaagactgtggcggcttcaatcttggctccttctttgttcaccgatctctattctcagagcggctactagacacatggtgggaccctgtgatgtacgagcagcggcatatgcagtgggaacacaaggagcaagacgccctcgagtacctgtatataaaccagccgtggatacgcagcagtgtcgccttcgctccacagcggtacttcaattcgtttcctcctggggcttgcggagactcccttgacccgatggttcactatacaccagatgcgcgagattttgttgttaacatggctggctgtgattttggtcgcgactgctgggatgagatgtaccagtaccgggaatacagcaagtggctgaaccggccaatatgggagcgcctcagggat

SEQ ID NO: 36828 - DNA, 964 bp, Aspergillus nidulans
tacaatgtcaccggccagattggaaagggtgcatttgctgtggtttataagctggctacaaaacaacatggagccgtgtttgcggccaaggaactcgacaaacgccacttcatgaagaatggtgttttgaatcaaaaagttgataatgagttgaagatcatgaaagatctaaagcatgtaagtgattgagataatacagtgcaaaaggacttgactaatattacccgacagccaaacattgtccagtacattgatcaccatgagcatgaccgctggatctatatcatcatggagtacgtcccttgcggcgaattatcaacgtatttacagaacatggtcaacattcctgaggatatggtgaaaacaattgcacgtcaaatactccacgcgctgaaatatcttcataagcgaaaaatcacacatcgtgacatcaaaccggacaatatcctgatcgcatcccatgagccactgaaagtgaagctctcggattttggcctgtccaaagttgtccaagaggagacgtttctcaaaactttttgcgggactctcctctactgcgctccagaggtctaccctgagtacgatatgtatcgacgtggggaggtgaggaagcgacgcagggtcggtgatccgtaagttactccatggtgtgttattggatactgtactaagtattaggctcccgaaaacctccccatatgatcaatccgtggatatgtactccttgggtgctgttctttaccacctcctagctggcattcctccatacaccggccgaggcgatgacagaggagcacagatgttacgaacaattatgacaacagaaccagactatcagatactccgcgaagctggcgtctccgaggagggcattgacttggtatctaagctgttgaaccgtgaccctcagcttcgtcccaaggagctggagtgcctcaaacacccttggctagttgatatcccc

SEQ ID NO: 36829 - DNA, 1315 bp, Aspergillus nidulans
  unsure (1)..(1315): unsure at all n locations
gcggcgcgaacagatgctcaaaatgaattccctgctgagatgtggaagaaactgggcaatgctgggtagatattacttggaatcctgggtatcgcttgtcgaagcgtgtctaatgtctatctagcttccttggtgtcaccgcggatgaagagtacggagggcttggaatgggctaccaagcccattgcgttgttatggaggagattagccgtgcttcaggtatgcgacttgatttgttctatgttggatttggccctctttaacgaccccatcattctataggtagcattgccctttcgtacgcagcacactcacagctatgcgtgaaccaactctccttaaacggcacgccagagcagaaagcgcgttttcttcctggccttctatcaggcgagaagatcggtgcgttggctatgtcgaagcactcggccggttcngacgtcgtcagtataaaacaacgccaaaaaagtgatgcggctgggtcttacgggaacaagatgggattccaaaaggaagataccatgccacgccgaaaaggaacaaagccaagagtcacagggccctgacgcagataacaatggcggacaagccaaaaccgagcccgagaaaggttccaaggggataacagcgttcgttgtagagaagacattcaagggcttttcatgcgcccgcaaattggataaactggggatgcggggctcaaataccggagagctcatcttcgaggacgtcttcgtgccaagagagaacttgctaggcgaagtaaaccgcggcgtcaaggtcctgatggagggtcttgatttggagcggcttgttctcagtgctggtccgcttgggtgggtccactgcatctcaatctgcgaggatgaacctcggcaaaggccgtgctaacaagcaatttaggatcatgcaagccgcccttgatctcgttctcccgtacacccacgttcgcaaacaattcggagccccaattgctcataaccagctcatccaggggaagctcgcggatatgcataccaagcttgctgcgtcccgcgcctatacctacgcgacggcccgccacatcgacagccatgcctccctgggatcagcagccattcgcactcaggactgcgccggtgcgattctctacgcagccgagagggctaccgaatgtgctctggatgcgatccagctcatgggcgggaacggatatatcaacgagatccctgcagggaggctactccgggatgcaaagttgtatgagattggagccgggacgagcgagattagacgcatggtgattgggcgtgcttttaacaaggagtatgctcaa

SEQ ID NO: 36830 - DNA, 3404 bp, Aspergillus nidulans
gagcgagtcggaaaacaaataacctctgtgcaaagtcgtgtacagaggggttatacagctagagaaatactacttgattggcaagatttcaacagctcgcgcatgaatacccccctattcttggtggaggcactagtcaaccatatctataatgctcgtacaatgatagatacaggctgcctgacctatggggtaatcagtgacaagtttgtcaagatacattaaatacctaccatacctatccacccgaaacctttcaagggagtgactgggaatatagaggagattaataagattatacaggttcagctagatatcagggcgcatacagaaaaaggagcctacttctatgtaatacctgataacctgggctatgacttaatcttgggactcccctggctggagcaacataatagaaggttagaggctaagaggggcaggctgtacctctgtactactggagtctgtctatggagtactacaaagaggcccttactaaagctgaacatagcacagatatccgctgcaaccatgggaggatttatacaaaggaaaaggtaccatggccaagatattaagatatttgcagtcttattggcagatatacagaaggcactggccccaaagagacatattgacccccgtacaaagctaccaagataatactggaaatacctaaggctctttgaacaagacaaagcagaagaactactactgcactggggagataggattgatcacaaaatcaagcttgtacaggaggagagtgggaaggatcctgaagtcccctggggccccctttacaacataacctaggaagaactaatagtcctctagaaaatactctctgaactattacagaaaggctttatctgcgtgagccattccccagctgcagccccagtactctttgtataaaaaccaggaggaggactgcagttctgtatcaactactgtgctctaaatactattaccaagaaggactgctatccattgcccctgatccataagacactaaactaaattagacaagccagatggtttactaagctggatgtgtctgctgccttctataagatctacatagccaaaggccaggaatggatgactgccttctgtacaagatatgggctctttgaatggctagttaccccttttgggttggctaatgtaccgagcaccttccaaaaatatattaactggaccctccgggaatatctagatgaattctgctcagcctatattgatgatgtgcttgtctataccaatagggacctccgccagcaccggaagtatgtatgaatagtcttgaagaaactggaagaagcaggcctatatttggatattaagaagtgcaaatttgagtgcaaggagacaaagtacttgggctttataatacaggcagggaagggaattaaaatagacctggagaaggtgaaagcaataaaggaataggaaacccctactattataaagggtgtctgaggattcctgggctttgccaacttctaccaaaggttcatccctaacttctcagggatcatacgcccactgaacaacttgacaaagaaaggacacccttcttgtagactaaggagtaccaggatagctttgatctgcttaaggaaaagtttattactggacctgtcctagcaaccttcaacccttcctactatatagtagtagagactgactcctcaggttataatacaggaggagttctctcttaatataataaaaaaggggaattgcacccatgtgcctacttctctaaaaggaattctccagctgaatgcaactatgagatctatgacaaggagctacttgcaattgtacaatgtcttgaagcctgggatgctgaactgtgcttatatagagaattccaagttattacagactataaaaacctggagtacttcttctccccaaggaagctaacagaacaacatatacaatagtccttatttctcagctggttcaacttcaagctagtatataggaaagggtcagctaatcagagagctgatgtactttcatagagagaccaagacatgcctgataatgaagatgacagggtcaagtcttgtataatgcaactttttacagaaaaatacttggggaagatggtagttgccaccctctgaccagctgaagagcaaccatgggagctgtatgaaaaaagtgatatatagaaggaggcacttaaacaggatgaaagatatagtaaagcagtactgtgcctgaaagatggagcaaggagatttcttctatacctataattgaaagtcagaatctcagaatgccagctggacgcccaagaccatatcctcttctataggaggaggtgggtgcctgatagtaaacagctctatataagtataattcaggctgtacatgactctatattaacaggacatcctggctaagagcaaatatatttgctggttagctgtaaatacttctggcctaatatgtcccaggatatcagaagattcatctggaactgtgatatatgtgggaggaccaagtcttggagagaccagagaagggggctattaaagcccctccctgtgcctgatcgtccctggcaggaggttttaatggattttattatagacctaccagagagcaaaggttgtacaaatatcatagttatcacagactgattaaccaaaggtgtgatactagaaggaatatcagaaactgactctgagagtgtggcctgggcacttgtacaagtacttataagcaaatacaggatcctaaaggctatcacctcggacaggggaagccagtttacaagtaatacatgggcctgcatatataccctgacagggatcaaccgccggctatctacagcctatcatcctcagactaatagatcaacagagagaatgaacagcatagtggaaacctacctctgcatgtatacctgctatgaccagaaggactagaacaggctacttctacttgcagagctggcaattaatagctgtacatcaacagcaacaggggtcagccccttctatctaagctatgggtacaacctcagcctatttacccctaccgaggaggtagagcatctagctgaagaaccaaccaagagtcctatccagaaaggggaagccattgtacagaaagttaaggaagccctagactgggctcaagcctccatggcctattcccaacagaatacagagaatcaggctaataaacacaggagccccggccacaaactaccaagtaggagataaggtctggctaagtctgaagaacatccgtacggaccaacccagtaagaaacttgactggaagaacaccaagtatgaggttataggcctggtgggcagtcatgctgtacagctgaatacgcccccagggatccatccagtcttccatgtaga

SEQ ID NO: 36831 - DNA, 896 bp, Aspergillus nidulans
ctcaatactggagcaaaaatcccggctgtcggattcggaacatggcaggccaagccattggaagtggaaaactccgtggaggtcgcgttgaagcagggttaccgtcatattgactgcgctgccatctatcgcaacgagactgaagttggcaatggtattcgcaaatcaggcgtgccccgtgaggaaatcttcctcactggaaaactatggaacacgaaacatgcgccagaagatgtcgagcctgcactagataagacattgaaggatttgggtgttgaataccttgatctttatcttatgcactggccttggtaatacctctaatcctggccgaaacaaccgtgctaatagcaaacagcgccttcaaagcgagtgacaaatggtttccccttgacgacaacggtgtattccagctagccgatatcgactatgtcacaacttacagagccatggagaaactgctgaacaccggcaaagttcgcgccattggtgtttcaaacttcaacgtccgccgactcgaagatctcttaagcaaggtctccgtcgtccctgccgccaaccagattgaagcccatccgtacctccaacaacccgaccttcttcgctactgtcaaagcaaaggtattataatcgaagcatactcgccgctagggaacaaccagaccggcgagccgcgcacggtcgacgatcccgtcgttcatactgtggcaggccagctgagcatggaccctggcccactactggccagctgggccgtgcagcgtggaacggttgtcttgtccaagagtgtcacgccgtcccggattgcggcaaaccttcaagtcaagcgcttacctgacgacgcgtttgcgactcttgcagccctcgagcgccataagcggttcaactttccggct

SEQ ID NO: 36832 - DNA, 474 bp, Aspergillus nidulans
atcttcctgacaggagcctgtggctcagggaaatccaccgccggacttcacctctcgacaaaattcaggatcacaacaatcgaaggcgacgacatgcactctcgtgtctcccgcgcgaagatggcgtctggtatcccactttcggattcagacagatgggaatggctctctcacatacgtggagccgttatggaccgcctactccaaccatccacctcggcgggaattgtcgtcacctgttccgcactcaagaggtcctaccgcgacgaattacggaaattgatgtatctattggaggaccccgtaaatgttacatttatccacttgtttgttggcaaagaaaacaagacggagctccaggagcggttgattctgagatcgaaagtggaggcgcattacatggcgtctactatggtcgattcgcagttggaggctttggagagcccagaggaagagcgggatgtcgtagttgtc

SEQ ID NO: 36833 - DNA, 2937 bp, Aspergillus nidulans
cctttgctctgactagctagtagatactacgaagatttgggtgtcgttgaggatatgttgacgtctacgataatcgaggcatttaatcgccaagtcgcagttgatccggggcgggctccgggctacttgcagtgccttaaggagataggctcccttcgaggcggagaagatgcggaggcaataaaccgtgctgtcgagacggcatactcggaaggaaatttatacaccgatgcagacattactgaagcatacaagtacttcggtcttagccgtgatgacccgcgacttactgaggacagcattattggaacattctatgcctacttgagctctactcctcaggagactgaaacccgcagacaactctggaggataggtgacagtaggaggagcgagcgcatcaagtctgcagccgaagacagtaagcacatgttcctctttccatttctattctcgttagctcacactcttgaaaggagtcgctacaccagaacaagctcaagtctttcttggggtcagtgatgacaccgcagatgatttcgtcatggcgatgtttactgcaaaggtaccatatgcgctattttgacgtccaatgcaggaatagctaatttatcgcaggtaaacgataacccatcttgcagggacatcgcgcggcgggccgttgaattaatagccgaggcgcggaagtccgatgtgttaaggcactttgtcaagacgggcgagatgacggctggtgaaatggatgtgggtgatgcatacctgctgctgcagatacctgatcgcaacgcagacgagggcgccatcatggctgcatatacaatctgtgtcgacgatgccccagcacaagcggaaaaatataataaggccttggctattattgcaaaggaaaagaacagcccgctcctgagcagtatggttcctggtctcgcagggaaatctgatcgtgacttatccaagtggcccgtcggcttgcagaatattggcaatacctgctatcttaacagcttactacagttttatttctctgttcgtccctatcgcaacatggttctagattttgagaatgtcaaaatggagttggacgaagagagctgccagaaaaagcgggtgggttcccgtggagtctcgaagaaagagattgaacgttcgcagaaatgtaagtaatccagcgaactcgttgtttgactttaactcaccagttgtgaaccatatagttatcagggagttgcgggcgttattttctgacatgatttcttctccaaactcgtttgtgactcctggccaggagttagcacgcttaacattgattagcccttccaacgaggccgctatccgccgtcggtcaacaatatcagcaggtcgattcggggggctcggtgagctcaacggaatgccagttttgggtcccttgggaccgccgccgaagagttcggaaactgaagctcatgttccggctccagagctggagaagactaaaccagccagtgacgaagatagtgaagccacacttgtctctgatccagtgaagactgaggtaccgctggctcaaagtgacgacaaggagaacgagccaccccaagatgatgctgtcatggttgatgcgccgaatgaaactatcagagcagcagagagcgttgagacccaaacagcgcaggctcaagctgacgctactactaagcctccgcccgtacccccccgacctactccgcaagttgatcctcagagacaaattatcgaagaggttgaaataggagcgcaacaagatgttactgaagtcatcaacaacgtcctattccagagccaatgtgccatccgagggcacgctgtcgcaccagatggagaacagcttgaccaggtgaaagagtgggtttcctgcgctgtatatcattactgtcttcgacgctgactacttgcagtttattttatgggcaagccaggtcttatattctgtccaacaagggcaagcgatcgaaggaggagtggtggtgcgacattaagatcgatgtagcaactgggccccgtgacatctacgcagctatcgacggcgcatttgatatccagaaagtcagcgttgaggattcagtggcagaacagtatgctgccatcagcaagcttcctcccatacttcagattcaagttcagagagtccagtttgaccctgtcaagaagcggtctttcaagtcgacccatcatttagatctgaaggagattatttaccttgaccgatatatggatactcagcagcccgaaattgtgaaccgccggaaacaggcttgggagtggaaggataccctgagaaaactcgaagcccgccgagcagaactcctacgccaaagtgtatgcgtcaacaaatccgcagtgttgtcgttctcacgagctaacttggtttataggaatccgatggtctcgacactgcaacattattgaaaagcgccaaggacatcttaactgaactcagcgccatgaagcaggaccccgacgcctctcaggatgcaattgatgttgaccctcaactcatcccagagctcagtcgactcgagcagaaggcacaagatgaaatgaagcgtaggtcaaccgccaagtattattacgaacagtatggctaacccacaaaaaggcctggaacaagaaatcaaaaatatccaggcaatgatctccaaccagttcgtcgactacaaacatctgccctatcgtctttatgctgtctttgtccaccatgggtcggtcgaattcggacactactacatctatatctgtgactttgagcgaaatatttggcgcaaatacaacgacacctacgtaactgaagtcagcgacctggatgagatattcaaaagccaggatcgccacaaccctcctacgccatatttcctggtctacgttcatgacggattgaaagaacgccttgtcagtccggtagccagagagatcgtggag

SEQ ID NO: 36834 - DNA, 1823 bp, Aspergillus nidulans
ggagtcaataccggtttcggtgggagcgcagactcaaggacagacaaaatgaccgctcttcaatctgcactgttgcagctgacgcaggccggcgtcctcttagagtcagataaaagtggcaaccaaaacaagctgctggagtcacacgccatgcctgcttcttgggtccggggtacaatgctggcccgttgcaactcaaatctccgtggacattccgccgtcaaactttctatactgcaatcgattgttaaactgctacagcatcggatcactccaattgttcctctccgaggctctatatctgcgtcgggagatttgatgccgttatcatacattgcgggagcgatagaggggaacccagacgtgtacgttcaagttgacggcctcgacatgcctcggatcatgaagtctatcgaagggctacagtacgcgggcttggaagctcagaagctcggcccgaaagaagggctaggtctgataaatggaacttcaacgtcggcagcagtggctagtttagtactgtatgaaaccaatcagttgtctgtactcgtgcaagcgctatcagcgatgggccttgaagccctcacggcacagcagaaagctaccacccttttatttcggctgtccggcctcacgatgggcaggttgagtgcgcaaataacttactttccttgctccgaggctcaaagctggtacagggtctagatggccagaagtttcaggaccgcccaggcctcattcaggaccggtacgccctacgctgtgtaccccagtgggtcgggcctcagctggaagatctccttctcgcccatcgacaagttaccactgagctcaattcgacatgcgacaatccgctcgtggatgtaaagtctaagtcaatctattctggtggcaattttcaggcagtctcgataacttcagccatggagaaaacaaggcagtgcttgcagatgtttggcagacttattttctcccaagcgacggaaatgattgatcccagtatcaataacggccttcccactaatctcgtcgccgatgatccaagcttatcatttaccatgaaaggggtggatatcagcatggcttcatacatggccgagctgggctatttgtcgaatcccgtgagctcgcatgtccagtcagcggagatgcgcaaccaagctataaactccatggcgttggtatcagctcggtacagtatgcaagccgtggaagtgctgtccctgatgtgcgcttgcgacgtgtatatctgctgtcaagctcttgacctccgcgtccttcataatactttcttggagaaagcgataccccagctgcactctgttacagagagagttctgtcgccgtttctgccccagccagcgcttgaggacttgaacagatctcttgaccagcatctgacccagacctggccgatgacgaatcgcctcagtcctgctgatcgagtgcacacggtaattgagaaagccatacctgttctcctggaaaacctcaaaagccaccgtggtcccagcttgggcgacttggaaacgtggaaatcacaggcacgcaacttactcaacgttgtataccaggaaattgccgagtcattcttcgtgaaaccacacaccgctgattacctcggcgagggggctaaggccttatatgtgatggtccgacaagaacttggtatcccgtttcaccagggcttcattgaacatcctactgttgaaaacgaaatcttgaacggccgtcctaagaaaacaactggatcgtggatatcgatcatatacgaggcgattcgtgacagccgccttatgggcccactaatacaagctcttaca

SEQ ID NO: 36835 - DNA, 2934 bp, Aspergillus nidulans
cggccagtatcgaagaggaagcggaggggtagtttgagtccagagtacgatgattatagccggcgccgacggagggatcggtatcgttcgaggtcgagatcgagatcgcggagtccggcttataataagagggatgaggatccagtggatgagttcggccggtcgactggtggccggtcctcaaatgacgatgaataccgcgatggacggagtgaacgccggaggaggagacgagccgacgaagattactttcgcaaacctccgcctgttgagctcgatgactcgcctgttttgtataaaatctacgacgggcgagttacgggtgtgaaagacttcggcgcgtttgtgaacctggtgggcgttaggggaaaggttgacgggctggtgcatgtatctgcgatgcaggagggtacgcgtgtgaatcatccctcagacttggtatctcgcggtcagccagtgaaggtcaaagtgatcagtatacaaggctcacgcattggcctatccatgaaagaggtagaccaggagactgggcaggatctagtcccgcaaaagcgccttgcatcgggagcgaatatggagcgactagatggcatgccatcagatgatagatacggcaacctcagtgcggatgtgcctgttattgaggaatccgacggccgatctatgaagaaccgaaagcgtctaacatccccagagcgctgggagatcaagcagttaattgcgtccggggccgtttccgcagctgattacccagatattgacgaagaatatcatgctaccttgaccggagagggcacatttgaagaagaggaagacattgatatcgaagttagagacgaagaacctcctttcctggcgggtcagaccaagatgtctctggagctgtctcctatccgagttgtcaaggctccagatggatccatgaaccgctccgcaatggcaggtacaaatctagccaaggaacgaagagagctcaggcaacaggaggcccaggacaaggcagccgaacaggcagctggggtggatctcaacgcgcagtggcaggatcctatggctagtgagcgaaaatttgcggccgacctccgttctactcagcaaacggggactgacgaagcggttccggagtggaagagggtcacgatgggcaaaaccccgtcattcggaaagcggacgaatatgtcaatcaagcaacagagagaaagtctgccggtctacaaattccgccagcagctgctggaggccgtagcggaaaatcagctactgattgttgtcggcgataccgggtcagggaagacaacgcaagtgactcagtatttggctgaggcaggctgggccaataagggaattatcggatgtacccaacctcgccgtgttgctgcgatgtcggttgctaagcgtgtggctgaggaagtcggctgcaagcttggtgcagaggttgggtatacaatccgttttgaggattgtactagcccagagacgaagatcaagtacatgacggatggaatgctccagagagaagttttgctagacccagacttgaaaaagtattctgtgattatgcttgacgaagctcacgagcgaaccatcgcgactgatgtcctctttgggctgctgaagaagacactcaagcggagaccagacttgaggctcattgttacgtccgccacgctagacgctgataagttctctgagtacttctacggctgtcccatcttctctatccctggtcggacattccctgtggagatcatgtactcgaaagaacctgaatcagactacctagatgcagctctcatcaccgtcatgcagattcacttgactgagcctcctggcgatatgctgctgttcttgaccggacaagaggaaattgacacagcgtgcgagattttatatgagcggatgaaagctctcggtccaagcgtcccagagttggtgatcctcccagtctactcagcgctacccagcgaaatgcaaagtcgcatattcgaccctgcaccccccggcggccggaaggttgtcattgccacaaacatcgcagaaacctccatcacaatcgacaacatcttttacgtcattgacccgggtttagttaagcaaaaagcctacgacccaaagctggggatggactctctagtcgtaacgccaatctcccaggcgcaagccaaacagcgtgccggccgagcaggcctaactggtcctggaaaatgcttccgcctctacacggaagccgcataccaatccgagatgctccctaccactattcccgacattcaacgccaaaacctgtcgcataccatcctcatgctgaaagcaatgggcatcaacgacctgctccacttcgactttatggatcctccgccgacaaacaccatgctcacagctttacaagagcttgaaaaactatccgcactagatgacgaaggtcttttaacacgtctaggccgcaaaatggccgactttcccatggagccagccctagctaaggtcttgattgcttccgtcgacatgggctgctctgaggaaatgctctccatcgtcgccatgctctccatccaatccgtcttctaccgtcccaaggaaaaacagcaacaagcagatcaaaagaaggccaaatttcacgacccccacggcgatcatctaacgttactcaacgtttacaacgcctggaaaagatccggctttagcaacgcctggtgctacgaaaatttcatccaagcacgccagattcgccgcgcgcaggacgtccgccagcaactccttggcatcatgcagcgctatcaccacaaaatcgtctcatgcgggcgcaacactaccaaggtgcgacaggctctttgcacagggtttttccgcaattcagcacgcaaggacccgcaggaagggtataagacgcttgtcgagggaactcctgtgtacatgcatccttcttctgcaatg

SEQ ID NO: 36836 - DNA, 753 bp, Aspergillus nidulans
tttctacgagagtacaagctggtcgtcgtcggtggtggtggtgttggaaagtcatgcttgacgattcaattgatccagagccacttcgtggacgaatatgacccaacaattgaaggttagctcgtcacttcacaatcgtatcgaactgtcgctcatcaaggatccccaaaatagattcataccgcaagcagtgtgtcattgacgatgaggtcgctctgttggatgtcctcgataccgccggacaggaagaatactctgccatgcgcgaacaatatatgcgaacgggcgaaggcttcctcctggtctactccatcacatcgcgtcaatcctttgaagaaatcatgacattccaacaacaaatcctccgcgttaaggacaaggactacttccctatcattgtcgtcggcaacaaatgcgatctcgacaaggagcgagtggtatccgaacaaggtgggtttaatacgtcgcttcaggtcatttcgttatcacagttggctaataatcaacctcagagggcgaatccttggcacgacagttcggctgcaagttcatcgaaacatcccgaaatcgcgcatcaatgtcgaaaacgctttttacgaccttgtgcgtgagatccgccggtacaacaaggagatgtccaacccatctggatccggtgcattcggcgcccgcgcccccgacagcaaaatggacgtaagcgagcctggtgagagcgccggctgctgcgggaaatgtattgttatgtaattggca

SEQ ID NO: 36837 - DNA, 4723 bp, Aspergillus nidulans
  unsure (1)..(4723): unsure at all n locations
ctgacgccctgttttctggacgtcggggtctcggttgttgctctgttcgggttggttttgggaagtggtgcgctgtggttcttgctcaacaagcgcattccccagccggtgtcaaagaattggcatttctacgctaagctggttagtctctgggattatctcatcattgcgccgtattatttgctgatgtgttgtctccggcgtaggttgttctgtccgccttgttgttcaccactgccctacaggcggcccttcaagttgagatttatgccagttggtttgccgacttccgattctggagcaccgtccttgttttcgcctcgctatgtgtcatatttgccgttcagtactatgaacattggcgcagccggtatccgaatggcgttgttctcttctactggctctttttcatcattgcctatactgtgaagctgcgatcgcatgtagcgcggaagacctacgatgatcgcctgccgtcctttgtctgcctcaatgtcagtctgggacttgcgattttggagttcttactggagtacttggttccgaagaagcagagtgcttacgatgccttgggcgacgaggatgaatgtccatatgaatatgcggatgtgttctcggtccttaccttcagttggatgacacctatgatgaaatttgggtacaagaacttcctcactcaggatgatctgtggaaccttcgccgaagggataccacgcgcgctaccggagctacgttggaggagaattgggagtatgaattgcagaaagacaagccgtctctatggacagctttgtttaagtcatatggtggcccttatgtccgcggagcaattatcaagtgcggaagcgatattctggcctttgtccagccacaactcctgcggcttctgattaacttcatcgattcataccggactactgagcctcagccagtcattagaggagttgctatatcactagctatgtttgttgtctccgtgtctcaaacatcattccttcaccagtatttccagcgcgcattcgataccggtatgcgtgtcaagtccggcctcactgccatgatctatgctaagtccctgagactttcgagcgaaggtcgcgcatcgaaaacgaccggggatattgttaaccacatggccgtggatcagcagcggctgtctgatctaacccaatttggtacgcagctttggtctgcgccattccaaattaccctctgtatgatttcgctctaccagttagttggagtcagcatgtttgctggtattggtgtcatgatcctcatgattccgcttaatggcgtcatagcccggatgatgaagaagctccaacttgtccagatgaagaacaaggatgcgagatcaagactcatgaccgagattctgaacaatatcaagagtatcaagctctacgcctggaacactgcatttatgaacaagctcagccatatccgtaatgatttggaattaaatactcttcgcaagatcggagctacgcagtccgttgcgaacttcacctggcagtccaccccgttcctggtttcttgctcaacgttcaccgtgtttgttctgacggaagatncgcctctaaccacgtcgatcgtgtttccggctctgacgctcttcaacctcctcactttcccgctttcgattctttcgatggttattactttcgtaatcgaagcctctgtggctgtcaggcggttgactgattatttcgctgccgaagagctttcaactgatgcagtcaaaaatgaagacccagtatcccaccttggagtcgagtctgtccgaatccgtgtagcgtccttctcttgggctcgatataaggatgatacagtgctggagaatatcgatttgagctgtcgcaaaggggagcttaattgcattgtcggacgtgttggttccggaaagtcgtcgctcctccaggcacttcttggcgacttgtggaagactgagggtgaagtcgtcgtccgcggacgcatcgcatacgtcgcgcaagccgcttgggtcatgaatgcaagcgtacgggaaaacatcgtcttcggtcaccgctgggatcctcagttttatgagctaaccgtggaagcatgcgctctgctggacgactttaaaaatctgcctgatggtgaccagacggaggttggagaaagaggtatctcactatctggtggacaaaaggccagattgactcttgccagagctgtgtacgcccgtgccgatatttatcttctcgacgacgttctgtcagcagttgaccagcacgttggtcgccatctgattaaccgcgtacttggacggaatggaatcctcaacagcaagacaagaattctagccacgaatgctattcctgttctgaaagaggctgactttatcggtttgcttcgcgacaagaccttgatagagaaaggtacatatgagcaactgatggctatgaagggtgaagtcgccaacctcgtccgtacaactctgaacgagtcgggtgatgaagactcaagcgccgaaagcggcggactcgctagccttgaaagctccgagactactaccataatcgaggggcccgactctgacttttcagatactgacgaggctgaacagcagattggctctcttgctccgatcaaggccgccggtccacgcaggaccagcacagtcacattacgtcgtgcgagtaccgtaagctggcaaggtcctcggcgcaagctaggcgatgaagagaatgtcttgaagagcaagcagacccaggaaacatcgcagcagggtaaagtgaagtggagcgtatatggagagtacgccaagaacagcaatctgattgccgttgccttctacctcgtcaccctggttggcgcgcaaacagcgcaagttggtggtagttactggcttaagcactggactgaagtgagcgagaggcagtcagcaccaaacgccggcaagtttattggaatttacctggccctgggacttgggtcgtcctttttggttatcctccagaatcttatcctttggatcttctgctcgatcgaagcgtccaggaagctccacgagcgtatggcgttctccatcttccgttccccaatgcgcttttttgagacgacaccgtctggtcgagtcctgaaccgtttctcaaggtaagcgcgctatcaagaattgatcgaattactctaacgtgaatagtgatatctaccgcatcgatgaggttcttgcccggacatttaacatgctttttggaaactcagccaaggcaatcttcaccttgcttgttattgctaattctacccctccgttcctgattgcggttattccattgggatatatctatttcagctaccaaaaatactaccttcgcacatcgcgcgagttaaaacgcctcgacagcgtcacgcgcagccccatctatgcccatttccaggagtcacttggaggaatctctacgatccgcgcttaccggcaagaggaaaggttcagcctggaaaatgagtggcgcatggatgcgaacctccgtgcttatttcccttccatcagtgccaaccggtggcttgctgttcgccttgagtttattggctcggtcatcattttggtgtctgcattgctttcgatcgtgtctgttgcgactggcagcaaattgtccgcaggaatggtcggcttggccatgtcctacgctctccagattacccagtccctcaactggattgtccgacagaccgtcgaagttgagactaacatcgtgtccgtcgagcgtgtccttgagtacgccagtcttccgagcgaagcacccgaggtcattttcaagaaccgcccgcccaccggatggcctgcgcagggtgcggtatcgttccataattacagcactcgctaccgcgaaggactcgacctcgtgctcaaggacgtcaacctcgacatcaagcctcgtgagaagattggcgtggttgggcgtacgggtgctggaaagagttcactgactctggcgcttttccgcataatcgaacctaccaacggtggaatcagtatcgacaatctggacatttcgacaatagggctccgtgatctacgcgggcggcttgccatcatcccccaggacccagccatgttcgaaggcacggtgcgggacaacctggaccctcgccatgtacatgacgataccgaactgtggagcgttcttggtacgtgggcctgcacatgacggtgaatcagtggtttaatggtattgactgtatgcagagcacgcccgactgaaggagcatgtatctcaaatgcagggtcaactggacgcgcacattcaagaaggaggtatgtacagcacatgcagctagtatatccctagcatcgcgcttaattaaccaccaacaggatccaacttgagccaaggccagcgccaactaatctcccttgcccgagctctcttaacgcctagcaacatcctcgttctagacgaagcaacggtgagtggcattgctcaccggtttttgggctctggagaaaactaacaacactaggccgccgtcgacgtcgaaacggatgccctgcttcaacgcaccctgcgtagtagcatcttccaagaccgcacgattatcacgatcgcgcaccgtatcaacacaattattgactcggaccgcatcgtcgtcctggacaagggccgcgttgcggagttcgattccccggcggcactgatcaagcagcgcgggaaattctacgaccttgtcaaggaggctgggctgcttgacagtgac

SEQ ID NO: 36838 - DNA, 965 bp, Aspergillus nidulans
aacatcacccatgtcctttcagtgatccgattacggccgaaggatgatttgttcgctggctaccagcatcaccgcatcgaggtcgatgacttagatgatgagaatctacttgagcattttccgtcagccatcaagttcatccagtctggcttagatgcaggtggcggcgtgctagttcattggttagtttacgtctcatctagttcagtgtcatcttagacaccacgtgtcgtccctacaatgcctttgcttcattgtaggccactaacagcatccagcgcaatggggaaatcccgctccgcaactgtctgcattgcataccttttgcgtcggcaacggaatgcgctcacaccgcagtccgctcttgctcttcttagggaatcccgaccgctatgtgaacccaacccggggttcatggagcagttcaatgtttactaccaaatgggatgccctgatgatgtcacttggcaccctctgtacagccggtggctttatcgcctagaggttgaagagagcgttgcctgctggcgtgctcccgagatggactccgtttatttcgaagacgaacagtcgcaccagaatgtagctaccacgggtccagcaacggagataaaatgccgcaaatgcaggtgcggtcttctaatttctgaaaacagcgattttactcactataaataggcgaaagctggcgatcgcaccatttgttgtttccacatggatcccatggggatgtaaagggcgcaataatctctgagtgcgcacacatattcatgagtccgctaacatggatgcgacctagtcttttccctgacacccctggggatgcacctttgtcaggccggttgacatgtcccaattcctcatgcggatccaacattggaaagtttgcgtggcagggaatgcaatgtagctgcggcgactgggttgtccctgcaattggccttgcgagggcaagagtggacatc

SEQ ID NO: 36839 - DNA, 1158 bp, Aspergillus nidulans
tccaacggttcatatcaaacataaatcaagaacagacaaatgaaagactacagctctgaagcaatagcctggatatatggcaactatgcattccttactttatttggtggtgttcaggtagggcccgtattcgacgccaggggaccacggcttttggttcttggtggatccgtgctagtaatgctgcaggtgataaccatgggcttctgtactcagtactgacatttggtcctttcaataggaatcgctggagaactaggaacctccatgatcttcacccctgcagtgtctgcgattgggcactatttcaatgaaagacgtggagtagcaaccggcctcgcggctactggtggctccgtcgggggcgttgcgtttcctctaatactggagagcctgttccctaagatcggctgggcctgggctacgcgagtcattgctttgatctgcctgatatcgctggccggtgcatgtctattggtgaagtcgcggctgccaaagaagccagcctcgaaggagaacgttctgcccgattttcgtatctttcgcagcctcaagctcagcttcacaacggccggtatcttcttcattgagtggggcctttttatcccaatcagctacatctcctcgtatgctttggcccatggcacttctgagtcgctttcctatcagatgctagcatttctcaatgtgggctccgtcctcggaagagcaatccctggcttctttgcagaccatctcggcagattcaacactcttatagtcacagttgcattgtgtcttgtttgcaacgtgtgcatttggcttcctgccggagacagcgtggccataatgattgtgtattgcgtgatttttggctttgctagcggcagcaacatcagccttacccccgtctgcatttcacaactctgtaagatcgaaaattacggaagatattatgccacttcatacactatagtgagcttcgggtaagttaaaatattctcatttaatttgacatgatactaatgtctgtctgtcagcaccttgacaggaatgccaattgcgggtgaaattttggcccgctgcaacggggactactggggcctgataacctatacgatctgctgctacgctagcggtcttatctgtgtgacaactgcaaaattgctccatgttggc

SEQ ID NO: 36840 - DNA, 2521 bp, Aspergillus nidulans
  unsure (1)..(2521): unsure at all n locations
gtggaaggcacatggaaagatctgaccgaaaacgtcaaccgcatggccaacaacttgactactcaagtcagggagattgctgatgttactactgccgtcgcaaagggtgatctcagcaagaaagtcaccgccaatgtccagggcgaaatactagatctcaaaagcacgatcaacggcatggtggaccgactaaatacatttgctttcgaagttagcaaagtcgccagggaggtcggaaccgatggtacgctaggtggccaagccaaggtcgacaatgtagaaggaaaatggaaagatctcaccgataatgtcaacaccatggctcagaaccttacctcccaggtccgaagtatatccgatgtcacacaagctattgccaagggtgatttgagcaagaagattgaagttcacgcccagggagagattctaaccctcaaagtcaccatcaatcacatggtggatcgtttggcgaaatttgcaactgaattgaagaaggttgcccgcgatgtcggtgttgatggcaaaatgggcggccaagctaacgtggagggaattgcggggacgtggaaggagatcacggaggatgtcaacaccatggccgaaaatcttacgtcccaggtgcgagcgtttggcgagattacagatgctgcaacggacggggattttaccaagctgatcacagttaacgcttctggtgagatggacgagctgaagcgcaagatcaacaaaatggtttcgaacttgcgggatagtattcaacgaaacacggccgccagggaagcagccgaattggctaaccgtaccaaatccgagtttctggcaaacatgagtcacgaaatcagaacgcctatgaatggtattattggcatgacccagctgactttggacaccgacgacctgaaaccgtacacgcgagagatgttgaatgtcgtgcacaacctcgcaaacagtctattgacaattattgacgacatactcgatatttcaaagatcgaagcgaaccgtatggtgattgaaagcatccccttcacagtccgcggtactgtgttcaacgccctgaagacattagcagtcaaagcgaacgagaagttcctgagtctgacatatcaagtcgacaacacagtccccgactatgttattggtgaccctttccgtctacgacagattatccttaacttggtcggtaacgcgatcaagttcaccgagcatggtgaagtcaagctcacgatatgcaaatctgaccgggagcaatgtgcagccaatgaatatgcttttgaattctccgtctcagataccggtatcggaattgaggaagacaaacttgatttgatttttgataccttccaacaggcagatggatcgaccacgcggcggtttggtggaacaggtctcggtctttccatctcgaaacgcctagtcaatctgatgggcggtgatgtttgggtcacctccgaatatggccacgggagtacattccacttcacctgcgtcgtgaaactggccgaccagtcactgaatgtgattgcctcacaaatcctgccttacaagaaccaccgtgtcctcttcatagacaagggagagaacgggcccgaagcggagaacgttctgaagatgcttaaaaagctggacttggaaccgttggtcgtgcgtaatgaggatcatgtgccgccaccagagatccaagatccttccggcaaggagtccggtcatgcctacgatgtaataatcgtggattctgtgaacacagcccgaatgcttcggacgtacgatgactttaaatacgtccccatcgtgctggtttgtccactggtctgcgttagcttgaagtcggccctggatctcggaatcagttcctacatgacgacaccatgcgagccgattgatctgggcaatggcatgttacctgcgctcgaggggcgctccacacccataactaccgaccactcgcgctctttcgacattcttttagctgaggacaacgacgttaatcagaaattggccgtgaagatccttgagaaacacaaccacaacgtatcgngtggttggcaacggcctcgaagccgtcgaagccgttaaacagcgccgctacgatgtcatactgatggacgtccaaatgccggttatgggtgggttcgaagccactggcaagatccgcgaatacgaacgagacagcggtctgagcagaacacccattatcgctcttacagcccacgccatgttgggtgaccgcgagaagtgtatacaagcacagatggacgagtacttatccaagccactgaagcaaaatcagatgatgcaaaccatcctgaaatgcgctacgctaggtgggtctcttctggaaaagagcaaggagtcccgcatttcgagcagtggtgagatgcaccacgtccatacgggtccggacggcaagtcgcaacgcccgggaatggaaggccgatcgatcacctcgtcgagcgccaccagccgcacgctcgctagcacgagtgccgagcgaaccgagcagctctccatagatagggta

SEQ ID NO: 36841 - DNA, 1686 bp, Aspergillus nidulans
ctcgcccagttggccttgaagcaaacccccatcgataaattcctctatctcagcactctccgtaagaacaatgtgcacctgttttaccgtctggtcacagatcatcttagggtcagatttcgggattgcaccatagctattgtcgatcaggaagctaattgtcgaataggaattgactcccctcatctataccccggtcgttggcgaagcctgccagaggtggtccgagatctaccagcagccggaaggttagtttcaagccaacgaataaggcgagctgccgaggtttagctaacttgcccgaactaggtatgtaccttagctgggaagaccggggtaacttggcctctgtcattgccaactggccccagcccaacgttgagatcacatgcatcaccgatggttcccgaattctcggactaggtgaccttggcatcaacggaatgggtattcccattggcaagttggctctctacaccacatgtgctggtatccgacccgaggccactctccctttgactctagatctcggcacaagcaacaaggctctccgggaagacccgctctacttaggtagccgccgcgataagatcactcccgatgaggagcgggagttcttggacgagctgatggccgccctgacggagcgctggccggggtaagttcgatcgacccaactttgcccgagaatacggaggctaacggggaacttctttgcagtatcgtcattcagtttgaagacttcaagaatccattccctgcgctcgaacggtatcaggatgtctacacatgcttcaacgatgacatccagggtactggtgccgtgatcctcggtggtgtcatcaatgctgtgaagcgctcaggggtcccttgcaaggaccagcgtgcagttttcttcggtgcgggaagtgccggagtgggtgttgcgaacagattgttgctttcttcatgcgcgagggcatgaccgaggatgaagctcggtcatgcttctggctcgtcgacaccaaaggtcttgtgacagcagaccgcggtgacaagcttgccgaacacaaggtctactttgctcgcacagacaatgcgggccagcagttcaagaccttggaggaagtcgtcgaccacgtcaagccctcgatcctgatgggtctttccacccaaggtggcgttttcacacccgagatcctgcgtaagatggctgagtggaacaccaacccgatgatcttccctctctccaacccttcgtctaaatctgagtgtgactttgagaccgccgtgacaaacaccgacggtcgtgtcctcttcgcctctggctcccccttccctacaatgtctttcaccaactcggcgggtgagacaaagatgtactaccccggccagggtaacaacatgtatgttttccctggtattggactgggcacaatcctgtccaaggccgtcaaggtcaccgacagcatgatctatgcctccggtgaggctctctccaaggccctcaccgcggaggagattgagcgtggtctcctctaccctgatctgacccgcattcgcaaggtcagcgttgtcgtggctcgcaacgttatccgggctgctcaagaagccaaagttgatcgtgagactactctccgaacgatggatgatgaaactcttgatgcgtggatcaagagtcgcatgtatgacccacacactgaggtt

SEQ ID NO: 36842 - DNA, 1473 bp, Aspergillus nidulans
ataaatcctgcaacaggggagccaaaccctgacgtccccgtcgcaatcaaggaggatgtcgacagggctgttgtggccgcacaggaggccttcaaaacctggattgatgttccttttgatgagcgccggaaggccctgttggcctatgctgatgcaattgaggagtatgtagcagactttgcaaagcttcttgttcaggagcaggggaagcctgtaagccattctatttatcctggggtccagctctaagagcttaactgtacagctccaattcgccgccaacgaagtcgcccagtcagcccaggtcatccgctccgcggccgacgttgctgaaggcctcacggacgaaatcattgaagacagtgcggagaagaagatcgtcgtgcgacatatcccaatcggtgtcggcgcgggaatcattccctggaacttccctcacttactcaccgttgtcaagctggcgcccgctctgatcactgggaatgtgatcatcatcaagccatcgccattcacaccatattgtgggctcaagctcgttgagctggcgcagcggttcttcccgcccggtgtggtgcaggctctgagtggtgatgaccgcttggggccgtggttgacggcgcatcctgggattgggaaaataagctttacaggctcgtcggcgactggcaagaaggtcatggagagtgccagtaggactttgaagagagtcaccctggaattgtaagttgtcttgcacatacgtttttcctgggtgctaacaacgagtaggggaggaaaggacgctgccatcgtgtgcggagacgttgacgttcaaagtgtcgcaccccgggtaagcctggcctagagtgccaataaagtaacgtcacctactaactgcatcaggtcatctcgaaagggttcttcaactctggccagatctgcctggctgtaaagcgaatctacgtccatgaatccatctacaatgagttccgcgacgctgcagtcgcgtacgccaaaactatcgaggtcggccctggcactcaagaaggcgtcttcatgggtccactgcaaaacagcatgcagtatgaaaaggtcaagggattctttgccgacctcacaaaggaacagctcagccttacccacccggacggcaaggcttttgacaacaaggctggctactttatcaagcccactatcattgacagaccagctgaggacagtcacattgctacggaggagcaattcggccctattatgcctctgttctcctggagtgatgagagtgatgtcattgcccgcgcaaacaatacacaaatgggtcttggggcatcggtctggtcgagggacctagaacaagcggcgagaattgcagcaaagctgcaggctgggagtgtttgggtcaacactcattttgaagctgacctcagggcgccgttcggtggacataaagagagcggcattgggacggagaatggcttgcagggtttgaggcag

SEQ ID NO: 36843 - DNA, 2098 bp, Aspergillus nidulans
tgtttctcttcattgcacgatcgcacagttaatcagagcgccgacttctcgtccaccagcaaaaattatgatcgccttggccgacgggcgaaggagaagttgcttgatcgggtacgctatccagcactttaatcgttctttgggcgtgtatctgacctttttttcttttctttctgcaattaggaattctttatgagcttgttgaactcagcgtctaccaaacgagaagccaaatcgtacctcgcccgccttaaggcccaacaaccagcgaagccgcaaaagaagttgcagagcacaacagtacaacagaccattgccgaatcgctaccttctggagtcaacctgggatctttctacggcgcatcacgatctgtatatcaaagtcctgtcttcagacaagactcaacccctgcccctgcgcgcgaggacataccggagcgactgcacctggcacttgtcaagataaagactccgcagctgctggatgactctacccttgatggagtggccaggacgctttcacagattaaccggctgggcttggcctgctgtgttgtggtcgatccgggctcggacggcgacacccatactttgcgaaaaatagctacggagcaggtaggccgcatcgcaacggccgtcgatcgtcaaccggattcgaaatcttcccatctatattccgttttgtctttcccagctaaaagaccagatataccgactgtctcatcccggaaacagcttctcagtccgttacgagatggtcatatcctgatcgtcgcgccgattgcttatacggaggacactcccaaggctcttatggtacccgctaatgatgccgttcttgctttgacaaaagaacttgcaggtttggctacaatgccagatcctgacgaggacccgatgattacagctcagaagatcaatgatctacaaaaggaagtttctttagaccgggtcatcttgctagaccccttgggcggtgttccagcttttcgaggcccacaaacatctcacgctttcatcaatatggaccaagaatttgaacatatcgagcgtgagctgctacaggttcgcaacccagccaataatagccagggcgagagtgtggtcacaaatcctatctcggacagcaatgcggtctcagaatctgccagtacagagccgacgtctacgcctgccaagcaagcgctattgcctatgagcgttggcgaggataccattgatggccatctggataacttacgactgtcgcacaaacgttggccatgctcccgtctgcatcttccgggataatcacttcaccagttgaagttgcgaaactccgcacgttcgctggaatcgagtccttctgagctgtcaagtcggtacgcgacggcaaagaaaccctctgatccataatcttctcacagacaagcctctgctttcatcgtccttacctctgagccggcgggcgcgtggctcgcttcatctccctgcccctccaaccaccttcgtcaaacgaggcatgcctgtcagccttatccctgacccgcgcgtccaggtgtggacggcacagacacgcccgaacatgaatctcgacgatcctcatgttgaccttccccggctggtacacctgattgaagactcattcaaccgcaagctagacgtaaaagactatctgaaccgagtgaatggccgattggctggtttaataattgccggcgaatatgagggtggtgctatattaacatgggagcttccccctggagtggaggatgacggaagcgaatctagcacggccagaatggtgccttacctggacaagtttgcggttctcaaacgtagccagggtgcaggcggcgttgcggacattgtattcaatgccatggtgcggacatgctttcctaacggggtatgttggcgtagccgcaaggacaacccggtgaataaatggtacttcgagcggtctttggggtcctggaagctcgcagataccaactggaccatgttctggacgactcctgacctgcctgagaagccgcagaaattccgagactacgaagctgtctgtcggagcatacagccgagctgggcagaagacacaggtgtaatagactgattt

SEQ ID NO: 36844 - DNA, 2543 bp, Aspergillus nidulans
cgagagcgagtcggaaaacgaataacctctgtgcaaagtcgcgtacagaggggttatacagctagagaaatactacttgattggcaagatttcaacagctcgcgcatgaatacccccccattcttggtggaggcactagtcaaccatacctataatgctcgtacaatgatagatacaggctgcctgacctatggggtaatcagtgacaagtttgtcaagatacatcaaatacccaccatacctatccacccgaaacctttcaagggagtgaccgggaatatagaggagattaataagattgtacgggttcagctagacatcggggcgcatacagaaaaaggagcctacttctatgtgatacccgataacctgggctatgacttgatcttgggactcccctggctggagcaacatgatggaaggttagaggctaagaggggcaggctgtacctctgtactactggagtccgtctatggagtactacaaagaggcccttaccaaagctgaacatagcacagatatccgccgcaaccatgggaggatttatacaaaggaaaaggtgccgtggccaagatattgagatatttgcggtctcattggcagatatacagaaggcactggccccaaagagacatattgacccccgtacaaagctaccaaggcaatactggaaatacctaaggctcttcgaacaagacaaagcagaagaactaccaccgcaccggggagatgggattgatcacaaaatcgagctcgtacaggaggagagtgggaaggatcctgaagtcccctggggccccctttacaacatgacccaggaagaactaatagtcctccggaaaacactctctgaactattacagaaaggctttatccgcgtgagccattccccagctgcagccccagtactctttgtacgaaaaccaggaggaggactgcggttctgcgtcgactaccgtgctctaaatgccattaccaagaaggaccgctatccattgcccctgatccatgagacactgaaccaaattggacaagccagatggtttactaagctggatgtgtctgctgccttccataagatccgcatagccaaaggccaggaatggatgactgccttccgtacgagatacgggctctttgaatggctagtcaccccttttgggttggctaatgcaccgagcaccttccaaaaatacatcaactggaccctccgggaatatctagatgaattctgctcagcctatatcgacgatgtgcttgtctataccaatggggacctccgccagcaccggaagcacgtacgaatggtcttgaagaaactggaagaagcaggcctatatttggatattaagaagtgcgaatttgagtgcaaggagacaaagtacttgggctttataatacaggcagggaagggaatcaaaatggacccggagaaggtgaaagcaataaaggaatgggaaacccctactactataaagggcgtccgaggattcctgggctttgccaacttctaccgaaggttcatccctaacttctcagggatcgtacgcccactgaacaacttgacaaagaaagggacacccttcttgtggactaaggagtgccaggatagctttgatctgcttaaggaaaagtttattactggacctgtcctagcaaccttcaacccttcctactgtacggtagtagagaccgactcctcaggttataatacaggaggagttctctctcaatataataaaaaaggggaattgcacccatgtgcctacttctctaaaaggaattctccagctgaatgcaactatgagatctatgacaaggagctacttgcaattgtatgatgtcttgaagcctgggatgctgaactgcgctcatgtggagaattccaagttattacagaccacaaaaacctggagtacttcttctccccaaggaagctgacagaacgacacgtacgatggtccttatttctcagccggttcaacttcaagctagtatataggaaagggtcagccaatcagagagctgatgcactttcacggagagaccaagacatgcctgatgatgaagatgacagggtcaagtcttgtatgatgcaactttttacagaaaaacacttggggaagacggtagttgccaccctctgaccggctgaagagcaaccatgggagccgtacaaaaaaagtgatatatggaaggaggcactcaaataggatgaaagatatagtgaagcagtactgtgcctgaaagatggagcaaggagatttcctccacacctacaattgaaagtcagaatctcagaatgccagctggacacccaagaccatatcctcttctgtgggaggaggtgggtgcctgatagtgaacagctccgtacgagtataattcaggctgcacatgactctatattgacaggacatcctggccgagagcaaacatatttgctggttagccgtgaatacttctggcctaacatgtcccgggatatcagaagattcgtccggaactgtgatatatgtgggaggacaagtcttggagagcc

SEQ ID NO: 36845 - DNA, 2828 bp, Aspergillus nidulans
gcagacctcatccgagatgtggaattcgtgatttttgacgaggtccactacgtgaacgattttgaacgcggtgtcgtatgggaggaggttatcatcatgcttcctgagcacgtcactctcatccttctttctgctacagtacccaatacccaggaattcgcctcgtgggtgggcaggacgaaaaaaaaggatatttatgtcatctcgaccgcgaagagacctgtacctcttgaacactatctttgggctggaaaggacaagttcaagattgttgactccaacaaaaggttcctcgaaagcggctggaaacaagcagatgatataatatccggcaaggacaagatcaaagctcagaaagcagcagaagctcaagcgcagtctcaagcaagcagaggtggttcacagggacggggacggggacaagcgcccgccaggggtggcccgaggggagggggaggaggacaacgtggaggaggacaacgaggccgaggccagccggcaaaccgaggaacaggcaacattgctcgtacagggagaggcggcggacgtacaactgccgcacaggacaagactgtctgggtccaggttgtgcaacatctgcgcaaggagaatctgttgccagcctgtatcttcgtattttctaagaaaagatgtgaacagaacgccgactcattgtccaaccaggacttttgcaatgcgtccgagaaaagccttattcatataacgatcgaaaagtcccttactcgactcaaacaggaagacaggacgctgccgcagattcttcgacttcgcgaactgctaagtcgcggtattgctgttcaccatggtgggcttctaccgataatgaaagaaatcgtcgagatcctgtttgccaagactcttgttaaagttctcttcgccactgagacatttgccatgggcctgaacctgcctacacgtacagtggtcttctcgggatttcgcaagcatgatggcaaaggtttcagagatctactgcccggcgaatatacccaaatggcggggcgtgccggtcgaagaggtctcgacaacgtcggctatgtgattgttgttaactctggcaaggacgaggcaccgcctgctggagcgttgagaaagatgatcctcggggacccaacgaaacttcgatcccagttcaggctgacttataacatgatcctgaatctactgcgtgtggaagctctgaagattgaagaaatgatcaagagaagtttcagcgaaaatgccacccaggccctgctcccagagcacgagaaacaggtacaaatttctgaagccagcttagaaaagatcaagcgagagccctgcgagatctgcgatgttgatctcgctgcctgtcatgatgcatcgatcgagtatggaaaattgacgagcgagctacacctcaacctactttcatcgcctgtcggcaaacgccttcttatgccgaagcgcttagttgtataccggaaggtgattaatggatctccataattagccgcagcttaagctgacactttgcaggatggataccgaaccgcaggtgtcattgtgcgagaagtcggagggggccccaaccccgtcatacagattctcgagataggtaaactgaacagcaagcgtcacccaagcgagattctcccattccttccagcgttcaggggatttctgaatcctctaccgacccgtgccgccgatatgactctgaaagtttttaagatcccaattgcggatatcgagtgcgtcacaaacactatagtcaaactgagtggcccaacgtggtacctcaatatcaagaaaggttggtctcaatgcatttggtacaagggtcttgctgacattagtttaaagaggcaatcagattcgcagacaaggagctatccaagctatgctcctcgtggactactccggtctgggatgagctagattgggctcgaatcaaggagctccaattaagggacatcctagataaacgacgagagcaggcaaatatcgcccagtcatgcgactgcctgaaatgccccaaattcttgaaacacgtatgttcatattctaccctttgacgattcctgccatactcacgaccttttagtttgagatgcaacgtgatgagtggcaaattaaggagaatatctcgcagttgaagcaactcatgtcggatcagaacctccatctactcccagactacgagcagcgtattcaagtactaaaagacttgggcttcgttgacgaacaatcccgtgtgcagctgaaaggaaaggtagcttgcgaggtaagacttcaaaataaggtattctccataaatgtgctgagacatgtgttagattcattctgcggatgagctcgttttgacggagcttatattggaaaacgttctcgcggaatacgaacccgaagagatagtcgctttactatccgcttttgtgttccaagaaaagacagaaaatgtgccgaccttgaacccccgtctggagaagggcaaggaagcaattattcgcatttccgagaaggtgaacgatgtgcagatacagcaccaggtccttcagtcgaccgaggatatcaacgattttgccagccaaccgcgatttggactggcagaggtggtttacgagtgggccaaggggatgtcgttcaaccggattacggatctcacggatgtgatggagggaaccattgtcaggactattactcggctcgacgagacctgtcgcgaggtgaagaatgcagccaaattggttggagatccaacgctgtacgcaaagatgcaagaagcgcaggagaagatcaagagggatgtgatcttcgcggcgtctctgtatatgtaggtagtc

SEQ ID NO: 36846 - DNA, 1414 bp, Aspergillus nidulans
atggcaccgactgcttgtgtacctgctgaagtgtgcatgcctaaactttatgacaaacccgacttttatgtcaataatatccaccagttcagcaatcatgccccggatgatctgtcgcaatctcggttggctgccaggacctggtcttgaatgtgctgaagaagcgagctgctgaggtcgacaccgaccgatgcgctcctggagaagaagatgctttctatgtggcagacatgggtgaggtttatcgccagcacttgcgctggaaaatgaacctaagccgtgtgcgccctttttatggtatgtcttccatgctttcttataacaggacttgatgctaacagaactagcggtcaagtgcaaccccgatcccgaggtcctccgcctcatggccaagcttggaaacggtttcgactgtgcttccaaggcggagatcgacatggctctttcgactgcgttgatcctagccgcatcatttatgcgcagccctgcaagacaagtcgtacctgcgtcacgccgccaaggttggcgtcaagcagatgaccttcgatacgccgatgagctgtataagatcaaagcctgctatctgaagcagagctctacctgcgcattctaaccgacgacttaaacagcttgggcaattcataatgaagttcggcgcctctttgatgtggctcgtcagcttcttgagctggcccaccaacttgagctcaagatcgttggcgtgagcttccacgttggctctggtgcagaggaccccaaggctttcctcaaggccgttcaggatgctcgcctggtctttgatcaagccgccgagatcggccacgagctgcacactctcgatgttggtggcgggttcaccggggagactttcgagaaatttgccgccgtccttgacagcgctctcgaaacgtactttccgccgaacatccgcataattgcagagccgggccgctactacgttggtggagcgttcaccctagcggcgaacatcattgcgcgccgcggtgtgcaggaccccgagaaccccagcaaggacgcttacatgatttatctcaacgatggtgtttatggaaacttttcgaacatcatctttgatcaccaacacccagaagcacgcattctttcctgcgcgtccgagattaatggtcgccctgtctccgaagaatgtgacctattccatttggggaccccacttgcgatggtcatgatcgtcatcagccagcgcagcgtgcttcctggtttgttggacgttggcgactggctttactttgaggaaatgggtgcctatacccgatgcagcgcaacacgtttcaacggcttctccgataaccatgaggtgatctacatctctagcgaggcggacgcctctgctctccttgaatattagcttagatttggtttgcttttgttgtgc

SEQ ID NO: 36847 - DNA, 1716 bp, Aspergillus nidulans
gactctatccggaggtttcgctatctacttggactcacagatctcttccgtcacttcatcgagtcaaatccaaatcccagaatcaaagagattatggcggaaatcgacaggcaagatgcagaagaagcagcaaagtccaagcggaaagtctctgcgcggtcaggaggtgcaagcggcgagcgaagacggcggacggaacaagaagaggatgccgagcttcttagcgacgagaaacgtggtggaggaaccaacacaatctttcgagaatcgccgccattcattcagggcgaaatgcgtgactatcaaattgctggactgaattggttggtttccttacacgagaatggcatttcgggaatcttggcggatgagatgggtctaggcaagactcttcagacgatctcatttattggctatcttcgacacctctgcgacatcactggtcctcatctcgtcgcggtccccaaatccaccttggacaactggaagagagagttccataaatggaccccggaagtcaatgtgttagtcctacaaggagacaaggaggagcgtcacaagttgattaacgagaggcttctggacgaggatttcgatgtctgcatcactagctacgaaatgattctccgggaaaagtcgcacctgaagaagtttgcttgggagtatatcattattgatgaagctcatcggattaagaacgaggagtcatcgctcgcccagatcatccgcgtcttcaactctcggaatcgcctcctaatcactggtactccgcttcagaacaacctccacgaattgtgggctcttctcaattttttgttgcccgatgtctttggtgattctgaagccttcgatcagtggttttcaaaccaggaagcggatcaggatactgttgtgcaacaacttcatcgtgttctgcgaccattccttcttcgccgcgtgaagagtgatgtcgaaaagagtttacttccgaagaaggaagttaatctatacgtccccatgtccagcatgcaagtaaaatggtatcaaaaaattcttgagaaagatattgatgccgttaatggagccggcggtaagaaagagtccaaaactcgcttactgaatatcgtcatgcaactgcgcaaatgctgcaaccatccctacctcttcgaaggggcagaagagggtcctccttacactaacgacgtacatatcatcaacaattctggtaaaatggtgattctcgacaaacttcttgctcgcatgcaggcgcaggggagcagagttctcattttctctcagatgagtcgtgttctggacattttggaggactactgcgcgctccgaaagtaccaatactgtcgaattgatggcactacagctcatgaggatcgaattgccgccatcgatgaatataataaaccagattcggataagtttattttcctcctaaccacaagagcgggagggttgggtatcaacttgacgactgcggatatcgttgtgctgtatgacagcgactggaatccgcaggccgatttgcaggcaatggatcgtgctcaccgcattggtcaaacgaaacaggtcgttgtataccggtttatcaccgaatcagccatagaagagagagttctggaacgtgctgcgcagaaattgcgattggatcagcttgttattcaacaaggtcgggctcagcaacaggccaagaataccgcttccaaagatgagttgctcggtatg

SEQ ID NO: 36848 - DNA, 2664 bp, Aspergillus nidulans
ctccaagacaatcaagtagtcgatgatttttcagatactacacagcttcattacggagacttgaatactaagatagttggggtccgctattacaggggaacagccaccattggggaacatgttgctctgaagagagagccgcgtaatcaatacgatgggaatgcagtttcgcgtagataacgctatgggaactcaaattggtcatattcctcggaatatggctgcaaagctagcaacttacatggtaagctcgatagtctctcgagcttatccgtctttaagctgacctactataggataacaggctgttggttgttgagggtgtcctgactggagtcattggcgcttttgattgcccaattgtcctgaagctgtatggcccaagtgacctagaacgaagagaagcgttgaaacagagaatggtgcaggataagctgccactcaaccatctcaaaaaggccgagcgtgatgaaaagaaagtacagaaagagcgggaaaaagctgtgaaagaagctgccaagagagcgcgtaaggggcaattgctggaagctgcgactaatctgggctattccaatctttcccaaccgttcggggaagggatcattacggaagagagcctggatgagctcatcaaccaaagcagtacattcaatccccgcgagatcaatcgtgtgactgagagttttgggttgaaggagtcggacttggagaacatgcccatggttgaaagtccctcttctctctccaccactcttcttccctaccagcgtcaaggcctggcatggatgattagcaaggagaacccgggactaccgacgagcgacaacgatgtggtacagctatggaaaaaagaaggcaacaagttcaccaatatcgcgacgaatttctctacgactgctccaccatcgcttgctagcggtggtatcctggctgacgatatgggcttgggcaagacaattcagattatttctctgatactatcgaactcgcagccaaagacgaaagaatcttccaaggctactttgatcatatcgcccgtaggtataatgagcaactggagaaaccagatccaagaacataccaacccggagcaagcaccgcgtgtgctaatctaccacggtcctggaaggaaggaggatgcgaatctagaccactacgacgttgtggtcactagctacggcacccttgcgacggaatacaagacggagagcaaagccacgccccaaaagggtttattctcagtcaagtggcggcgtgtcgtgctcgatgaagggcatacaatccgcaacccacgatcaaaaggtttctccgcggcctgtgctttgcgagctgactcccgctgggcattgacagggacgcctatagtaaacactttgaaagacctttactcccagattcgcttcctaggactcactgggggcctcgaagattttgctgtcttcaacagcgtccttattcgacccctcatgtctgacgatcccgactcccgtctactgctccaggccctcatgagcaccatatgcctgcgtcgcagaaaggacatgggattcgtgaacttacgtctgccaactctaacgtctcgtgttctgcgcataaagttccatcctcatgagaaagagaaatacgacatgttccagtatgcatccacacaggcatatccatgctcaactatactaacaccaaactagatcagaagccaaaggcatgctcctcgacttcaaatccaataataaaaccggcaccacctactcccacctcctcgaagtcatcctccgtctccgccaggtttgcaaccactgggccctagccaaaaaccgcctcgacaagcttgctgctattttagacaaacatcagaccgttccactcacccctgacaatattaaagccctccaggacatgctccagattcgtattgagagccaggaaatctgtcccatctgcctggatattctcgaaacacctgtcataaccgcctgcgctcacgccttcgaccacgactgcatcgaacaggtcattgtccgccaacataagtgtcccatttgccgcgccgaaatcgaaaataaatcaagtcttgtcgcgccagccgcagacttgggcgagaatacagacgacgtgtcagcagacccggacaaccccagcagcaagattgaagccctgatcaagatcttaacggcgcatggccaggtagaggccacaaagaccgttatatttagccaatggacatccttcctgactctcgttgagccgcaccttcaaaatgccgggatccagttcgcccgcatcgacggtaaaatgacatcgatagcccgcgaccgctcaatgcgccgcttctccacagaccccaagtgcactgtgctcctcgctagtttgagcgtctgcagcgttggtctgaacctggttgccgctaatcaggctatccttgcggatagctggtgggcccctgcaatcgaggaccaggctgttgatcgtgtttaccggcttgggcagacacgcgagactacagtatggaggcttgtcatggaagacagtatcgaggatcgagtgctggcgatccaggagcagaagagaaagttgatgctcgctgccttccgggagaaggcgagcaagaaggttgatgatcgagcgacacgtgtggcagatctggagaagctcttaacgtgaagc

SEQ ID NO: 36849 - DNA, 1337 bp, Aspergillus nidulans
gcaagtgaatgtcactaactgtcggctcagtatgcgaataggggcgaaaaatacgatgatgacgatggtcattacattgtcaatcccaatacccctatcactgatcgatgtgagtaccctctaaatcgcaaatgtatggtcgcaattgctaaacctcgtcagactcgataatcaagcttctagggcaaggaacattcggcaaggtcgtcgaagcatatgacaaacaacgcaaagctcgctgtgctatcaaaattatacgttccatccaaaagtatcgtgacgcatcacggatcgaactccgcgtactttcgactttggcgtccaatgacaagcacaaccgaaacaaatgcattcacttaagagactgcttcgatttccgaaaccatatatgtatcgtcacagacttattaggacagagtgtctttgatttcctcaagggtaacgggtttgtcccgttcccaagcagtcagattcagagctttgctcggcagcttttcaccagcgtggcctgtaagttgttcgcatcatgtttcctctggatttcagttaacttggtacagtccttcacgacctcaatctcatacatacagatttaaagcctgaaaatattctccttgtcaagaacgcgtaccaaacctttacttacaatcgcactattccttcctcatccactgcaatatcgcggaatgctcgtcagagacgtgtcttgcttgacagtgagatccgcctcatcgacttcggctctgctaccttcgatgatgaataccattcttctgtcgtttccactcgacactacagagcccccgagatcattctcaatcttggctggagcttcccatgtgatatttggagtattggctgcatccttgtcgagttctttacgggcgatgctcttttccagactcacgacaatctcgagcacctcgctatgatggaagccgttattggtgagcggatagacccgaagctggtccgtcaagtgatgcaaggtgggcggaatggtaaccaaaatcaggcggccaagtaagtgttttcggttctgcaacatgatcacggctaattttccaggtacttcgtccgaaaccgtcttgactacccaaatgaagagacaacacgagcctcaaagaaatacgtgcaggcaatgcgtcgactgactgtatgtcttctctcaaacaaagcatttttaggccagttgctaatcatcccagtcgttcatgccaacgaataccaagttctaccgactcttcctggacctattacaacgcatcttcgtttatgacccaaaacaacgcattactgccaaggatgccctgaaacacccgtggttcaaggagccc

SEQ ID NO: 36850 - DNA, 1219 bp, Aspergillus nidulans
aagtcatacaacatcctcgtcctccccggcgacgggattgggcctgaagttatggccgaagccaccaagatcctctcccttttcaacacatccaccgtcagattcaggacccagacggaacttatcggtggctgtagcatcgacacccacggcaaatcggtgacgcaggctgtcctcgatgctgccgtatcctctgatgcagtcctcttcgctgccgttggaggcccaaagtgggaccatatccgacgcggactcgacggacccgagggagggctgctccaggtacggaaggctatggacatttatgcaaatctgagaccgtgttccgttgatagcccaagcagggagatcgccagagacttcagccccttcaggcaggatgttatagagggggtcgacttcgtggtcgtgagggaaaattgtggaggcgcatactttgggaagaagggtgaagaagaccattatggttcgttcttacctatacttacggtgacttgagtggtttatatattgatgaataccgcaatggacgaatggggctactcagccttcgaaaaacagcggattacttgaactctcggcggagctcgcgctgcgacacgatcctccctggcctgtgatctctctcgacaaagccaacgtgctggcctcgtcgcgtctctggcgccgggttgtcgaaaagaccatgagcgaggaatacccgcaggtgaagcttgtccaccagcttgctgattcggcgtccttaatcatggccacgaacccgcgcgctctgaacggcgtcatcttggcggacaatacctttggcgatatggtatccgaccaggcaggctctctggtcggaacgctgggtgtcctgcctagcgcgagcttggatggtttacccaagccgggagagcagaggaaggtacatgggctctatgagccgacgcatgggtctgccccgacgtaggtcattcccaacccactactatcccttcactcgttgctcaccataatgtatgatagaattgccggtaagaacatcgccaacccgacagcgatgatcctctgcgttgcgctgatgttccggtactcgttcaacatggaggccgaggcgcggcagattgaggctgcagtacgcactgttctcgataagggaattcgaacatctgatcttggaggttcgacgggaactagagagtttggcgatgcggttgttgcggcgttgaagggagagctc

SEQ ID NO: 36851 - DNA, 1153 bp, Aspergillus nidulans
gctaagatcgatgctcccgctgctgcccctgctccccagctgtctgggcttcagctctattccagattcgccttcgctggtgctgtctgctgctccatcacccacggtgctctcactcccgtcgatgtgtaagtcgctctcattgcgctatctgtcacaattttgcgaacgcgcgcctttccggtcgatccgccgcctatattgaattgtgcgctgacatgctgcttcttcgcgccctacagcgtcaagaccagaatccagcttgaccccgtcacatacaaccgtggtatgatcggtggcttccgccaggtcattgccaacgagggtgctggcgctctccttaccggtttcggtcccaccgctgccggttacttcctccagggtgctttcaagttcggcggttacgagttcttcaagcagcagtggattaaccagctcggttacgagtctgcctccaagaaccgcactgccatctacctcgcctcttccgctaccgctgaattcttcgccgacattgccctctgccctctggaagctactcgtatccgtcttgtctctcagcctgagttcgccagcggtcttttgagcggtttctccaagatcctcaagaacgagggtgtcggtgctttctactctggtttcggtcccatcctcttcaagcagtaagtacccgagcagcgcagtagtaactttggcctctgctaactcaaattctccagggtcccctacaccatggccaagttcgtcgctttcgagaagttctctgaggctatctacggcgttgtcgacaagaacaccctctctgatggtggcaagactgttgtcaaccttggttctggtctccttgctggtttcgccgctgccatcgtctcccagcccgctgacaccatgctgagcaagatcaacaagacccagggtctccctggtgagggtaccaccacccgcctcatcaagatcgccaaggaacttggtctcaagggttccttctctggtatcggtgctcgtctcttcatggtaagaacgattccataaaatgcgcgtcttattctgctaacacgattcccagattggtaccatcactgccggtcagtttgccatctacggagacatcaagcgtttgctcggtgccaccggtggtgttgagattgctccc

SEQ ID NO: 36852 - DNA, 2175 bp, Aspergillus nidulans
atggatccccttgaccccatcctagatggcttgaactccgcacagagaaccgcggtcacctcatccgcgccgattttacaagtccttgctcctccaggttcgggaaagaccaaaacgttgacctcgcgcgtcgcgtacctcctcgctcatgacggatatcgcccgcaagatgttatctgttgcacattcaccatcaaggccagtcgggaaatgcgagagcggctggccaaattggtaggtgatcacgtacagtcaaggctcatcttaggaacgtttcattcgatctgtcgacgatacttggtgaggtacgggcatttgatagggctgcagaaggggtttggaattgcagattcaggggattcgctagcgattattcgggttagctgatgtctctggtggggtgttggcgatgttatgctaaaaaacctgcagagaatcgtaaagcggctgcagcttggaattcaacccaacactgcgagagctcgtatatcgcatcagaaggcgcacggcgtatctcccgatgatgtagcggcaaagcagaacaagattagcaagcttctagagcatcgcgagttcgtccaagtataccgggagtacgagagtgagctcgcaacatcgaatttgctcgattacgatgacctattgctacgatgcgcggaattgctgcgaaaacacccaaagtgtgtatccaacgtacaggtggtcttggtggatgaatttcaggacacaaatcagatccagtacgacctcatgaaccttcttgcgtcttggaacaggcgcattacggtcgttggtgatccagatcaaagcatctacggatttcgttccgcggagatcgagaacctcaaacggatgcagcggctatacagaaatacagaggttgtacttttggaggataactaccgttcatcgggctcgatcctcaagtctgcgcaagacgtgatcgagcaagatttatctaggccagcaaaaaagttgcagccaacgcacacctttggcacgctgcctgtactgcgcaagctgccctctgccgaagacgaagctcagtggctggtacttgagatcaaaaggtgcatagttctaacgggaaagttattgaagtattccgatttcgccattctactcagatctgcgtcgctgtcacggcagatcgagtccgccatggggaaacatggcgttccctatcgaatggttggtgggcaaagattctttgatcgagtcgaggtcaagcttctcctagactatttacgagttataagtcatcccgaaaactcggaagcacttctacgtatcatcaacgttccttcgaggaaaattggagaggagaccgttaagatgctcttaaacggggccgagaaagctggcaaaccgctgtgggactacatcaaagatgtagcgcaaggtcgcaggtcgactgagaaagccatgtcgaagcctactaaccaagggctctccagtctagttggcctcattgaatactctagggagaagctccgccagtgcgtcgacagatcggcacctcgaaggctgctggagatcgtgatgaaaagactctcttttcgcgaattcattacggcgacttatgggtcaaatgatgaaaacagatgggcaaacgtggaggaactaatgagccaggcagacgatgcaactgcggccgatgaaagtgaacaggatgagaatcttcctgaaattgctggcctaactcagcaagagtcgcatcctggcgaagaagccttgtccagattcctagccaatgtggctttatcaaccgaggtccagccgaaagaagagactgaaggggaagaccaggcgcaagagaaagttaccatctcgacaatccatgcagcaaaaggcctagagtggcccgtggtgtttattcccgcagcttacgagggtattatcccgcactcacgagcagaagactccgacgaagagagacggctgctttatgtggctatgactagagcgcaggccttgctatacctgagttatccgcttcggcaggcccgagaaaacgcagagactaatgtgacgtcgtttcttccgcaagaactaatcacttcgcgcctgcgcccggttggaccgaaactagacgagaaggttgtttatgggattgcagatatactgcgtcgagaacgaccgtctgcagaaaccatgttggaaggacttgattct

SEQ ID NO: 36853 - DNA, 3360 bp, Aspergillus nidulans
gttttctccgaagccgccagcgacaggctaacgcttcggcttctccgcaggtccaacgacgacattgtcagccaaggcgtagtcgaagtgtccgacaggaaattcttcaacctcgaaaatgaccgttctattgttccaaatggcccgctcgacgcgcgcatggtatctcgaataagacttcaacctgccagacatgcggcggcgcactgcaggtttgcaacggccacttcggtcatgtgcggcttgttttgcccgcttttcatgtgggttatttcaagcgtgtgattagtattctgcaggaaatttgcaaggagtgctcccatattctgctccccgaagcagaacgccgcgcctttctccgtgagatgcgccgcccgcgactggataacctgcgacggatgcagatcgccaaacgagtcaacgaccgctgccgcaagacccgaacctgcgaaaactgtggtgctgttaatggggtggtgaagaagacaggtactagctctcttaagatcacgcatgacaaattccgtgcgtttaatgcctcgacatcggcaaagaagatcccgccacctagcaagatcgtcttcgataggtcactagaggaagctagaagttctaatccggaggtcgagaaacatcacaaaaaagctcaggacgatttgaatgcgctgcgggtgttgaatctgttcaagcgcatctcggacagtgattgtgaattattaggactggaccctaaggaagcaaggccggagatgttcctctggcagtttatccctgcgccgccagtgtgtattcgtccgtccgtcggtcaagatgcttcatcgactgaggatgatctgacggctaagctgggagatatcgtccagagtaacatcaacctcaaaaatgctttgctaaaaggagctccagtgcagacgatcatggagtgctgggactatatgcagcttcagattgccgtctacatcaacagcgatgtccccggtctgaacaaggcagacctcgggaagcctattcgaggtttcgtgcagcgtctgaagggtaaacagggtcgattccgtggtaacctgtctggaaagcgtgttgatttctctggtcgaactgttatctcgcccgatcccaaccttcgcgtcgatgaggttgctgtcccggaattggtggcaaagaacatgacatatcccgaagtggtcaacaggtacaataaagaaaagctacagcaatgcgttcgaaatggacagaagaagtggccgggtgccaactatatcatcaaaaagggcaaccccctaaagaccatgcttaagtatggtaatctgaaatttattgccgatcagctgcaggaaggagatatcgtcgagcgtcatatcgaagacggtgatatcgtcctcttcaaccgtcagccttctctccacaaactcagtatcctttcccattttgccaaagttcgccctcaccggacattccgactaaatgagtgtgtatgtaacccatacaatgcggatttcgacggagacgaaatgaatcttcacgttcctcagacggaggaggcgagagctgaagccatggagttgatgggtgtgaaaaacaacctggcgacacccaagaacggagagcctatcattggagccattcaagatttcattagtgctgcctatttgcttagcagcaaggataatttcttcgaccggcgtagttttacccagatctgcttatacatgcttggtccgcaaacgcgtttcgatcttccgccacccgcagtgtttaagccacagatgctctggacgggaaagcaggtcttcaatattctgatgcggcctaataaggatgacccggttttggtcaatctcgacgccgcgtgcaaacagtttaagccgccaaaggggaatcaaccaagagacctggaccccaacgattcgtggctcgtcgttcgaaattccgaggtcatgtgtggtgtgatggacaaatctactgtcggttccggaaagaaggacaatgtcttctatatcatgcttcgtgattttggccctgctgctgctgctgagggaatgaaccgtttgtcgaaactgtcagcccgttggttctcaaacatgggcttttctatcggtatcacagatgtctatccaagcgatagactagtacaatcgaaaaacgacctcgttgaagcagcgtacgcacagtgtgatgaagttattgccaagtacaaagctggaacccttgaaaagtatcctggatgtgacgaactgcagacaatggaaaaccaactatctggtattctaagtaaagtccgtcagcaggccggtgacgaatgtattgctcagctgagcaaatacaactcccccctgattatggctacgtccggatcgaaaggttctagtatcaacgtgtctcagatggtcgctctcgtcggtcaacaaattattggtggtcagcgtgtgcaggacggtttccaggaccggactctacctcatttccccaaaaacgcccgacagcccccttccaagggtttcgtgcggaacagtttcttttcgggtctccttccttacgaattcatcttccacgccatgtccggtcgtgaaggtttggtcgatactgcggtcaaaactgctgaaaccggatacatgtcgcgtcgtctgatgaaatctttagaagatctttctactggttatgatgacactgttcgaaattcttctcagggcatcgtccaattccagtacggtgacgataaattagaccccgtcgatatggagggcatagccaagccggtccacttcgatcgaactttcatccacgctgaaacgacgacgtataagaacgaggaacgaagcttgtcccctgccgagatcatggaagtatgtgaggagatgctctcaaaagaacgcgccaagtagcgcgatatgatctaatgggtgctgaactcgactatatggatcgaagcgaccatggagttgaccagttcgagagcgctcgggatttccttgattcaattcaacaatacgtccaaaccaaggcggacaaactgatctctcgaggtggtgacagcgacccatctgacgagaggaccatcaagggtctaaaccatactggaaagctgacggagaggacgcttcggacgttcattgctgagtgtttgatgaagtataagaaagctcaagttgagccaggacacgctgtgggtgccgttggtgcgcagtccattggagagccgggtacgcaaatgacactgaagactttccactttgctggtgtcgccggtatgagtatcacacagggtgttccccgtatcaaggaaatcatcaacgcctccaaggagatcagtactcctgttatttcctgcgagcttgtcgagaagcgcaacatcgtcgcggctcg

SEQ ID NO: 36854 - DNA, 2897 bp, Aspergillus nidulans
gagcgcctgacggaggggctggagaagccttctctggatgaccgctcttacagggttattcagctgcctaataagcttgaggctctgctggttcatgacccggagacggacaaggctgctgcggcgatggacgttcacgtgggaagcttcagtgacccggcagatttacagggtcttgctcacgggctggagcacatgctgttcatgggaactgaaaaggtatgcattgcttttcggcaggaaagacatctctgatccgtttctagtatcccgtagagaacgcatacaaccagtacctggcgtctcactccgggtcatctaatgcctataccgccggtaccgagaccaattacttctttgaggtgtctgctacaggtgcgacgggggagtcgagcggccaagtcacgcctaatggaaccacaaatggcacttccgcggaatctaagagcaatggaccttcaccactgtatggcgcgctcgatcggttcgcacagttctttatttcgccacttttcttagagaacacactagaccgcgagatgcaggcagtagattcagaaaacaagaagaatctgcagagcgatctgtggcgtttgatgcagctcaacaagtcgctatccaaccccgatcacccctacaatcatttctcaactggaaatcttcaaacattaaaggaggagccgcagaaacgcggcgttgaaatccgcaatgagtttatgaaattctatgagaaacattattctgccaacaggatgaagctggtggtattgggccgtgaatcattggatgaattggaaaagtgggtatcagagctgttcgctggtgtcagtaataaggacctgccacagaaccggtgggatggcatcccgatctggctgccaaacgacatgtgcaaacagatcttcgctaaaccggtgatggatacgcggtcggtggatatctacttcccgttcttggacgaggaaaagctgtatgagtcgcaaccgagccgatacattagccatcttattggccacgaaggccccggtagtatcctggcatatatcaaagcaaagggatgggcgaatgggttatctgccggtgtgatgccggtttgccctggagctgcattctttactgtttctgttcggctgacgcaggaaggactacagcagtaccagcaggttgtaaaggtgatatttgagtacattgcaatgatcaaagaacgcgagcctgaggcatggattttcgaggagatgaagaacctggccgaggtggagttcaagttcaagcaaaagtcgcctgccagccgcttcacgagccgcctgagcagcgtcatgcagaagcctctgccgcgggaatggctacttagtgggtcgctcctcaggaagttcgacccggaggcgatcaagaaggccctctcataccttcgtgaggacaacttcaagttgattgttgttgcgcaagactacccaggcgactgggacactaaggagaaatggtacggaactgaatacaaggtcgaagatgttcccaaggacttcatgtccggcattcgggcggcgctggacactactccggaaacacgcctgaaggagttgcatatgccccataagaacgagttcgttcccactaggctctcggtggagaagaaggaggtgtccgagcctcagaagacgcccaagctcatccgccacgacgaccacgtccgcctctggtttaagaaggacgaccgattctgggttcccaaggctactgtctttgttactcttcggaaccctctggtttgggctacacccgccaacctcgtgaagtcgaagctgtactgtgagctcgtgagagatgctctggttgaatattcctacgacgcagaactcgctggcttggattaccatctctccgccagcatctttgggcttgatatctccgtcggaggctacaacgataagatggctgtgctcctggaaaaggtcttcacaagcatgcgtgaccttgaaataaacccagaccgcttccggatcatcaaggagcgtctgacccgtagttataagaatgcagagtatcagcagccgtactaccaggttggagactacactcggtatctgactgcggagcgaggttggctcaatgagcagtacgccgccgagctcgaccacatcgaggccgaggacatcaaatgtttcttccctcagatcctgcgccagaaccatatcgaagttctggcgcatggtaacatctacaaggaggacgctctgcgaatgactgatactgtggagtctatcctaaacagccgaactctgcctcagtcccagtggtacgtcaggcgcaatgtgatcattccgccgggatctgactacatttacgaacggcctctcaaggatccggccaatgtcaaccactgcatcgagtattacctctttatcggaagcattgccgatgaagtccttcgcgcaaaactcctactcttcgcgcagatgactgatgagcctgcttttgaccaactccgaagcaaggagcagctgggttatgtcgtctggagcggcgcgcgctactcggcaaccaccattggttaccgcgtgattatccagagcgagcgcactgctcaatacctggaatcccgaattgactctttcctgtccaactttgcaaagactctagagaccatgacggaggacgagttcgagggccacatgcgcagcgtcatcaacaagcgactggaaaagctcaagaacctgagttctgagacatcacgattctggagccacattggttctgaagactatgacttccagcagaatgagaccgacgctgctcgtgtccgcgccttgaccaagtcagacattctcgacttttacaagcaaatgattgaccctgcctctcctacccgaggcaagctctcgatccacctgaaagctcaa

SEQ ID NO: 36855 - DNA, 1042 bp, Aspergillus nidulans
tctagcatcgaggcgggtaccgtcgatgttgttgccgtcaacgaccctttcatcgagacccactacgctgtatgctacttcgaattctagggagctaattatgtttagctaacgtcgtgtgatgtaggcctacatgctcaagtatgactcacagcacggtcagttcaagggcaccattgagacctacgacgagggtcttattgtcaacggcaagaagatccgcttccacaccgagcgtgaccccgccaacatcccctggggccaggacggtgctgaatacattgtcgagtccaccggtgtcttcactacccaggagaaggctagcgctcacctgaagggtggtgccaagaaggttgtcatctctgccccatctgctgatgcccctatgttcgtcatgggtgtcaacaacgagacctacaagaaggacattcaggtcctctccaacgcttcttgcaccaccaactgccttgcccctctcgccaaggtcatcaacgacaacttcggtatcatcgagggtctgatgaccaccgtccactcctacactgctacccagaaggtcgtcgacggcccctcggccaaggactggcgtggtggccgtaccgctgctaccaacatcatcccctcctccactggtgctgccaaggctgtcggcaaggtcattccttcgctcaatggcaagctcaccggcatggcgatgcgtgttcccacctccaacgtctccgttgttgacctgaccgtccgcaccgagaaggctgttacctacgaccagatcaaggatgccgtcaagaaggcttctgagaacgagctcaagggtaatgtgaatgtgcttttgctgttggacatcttcgactaactagttgatttaggcatccttggctacaccgaggacgacatcgtctctaccgacctcaacggtgacacccgctcttccatcttcgatgctaaggcgggtattgccctcaactccaacttcatcaagctcgtttcctggtacgacaacgagtggggttactcccgccgtgttgttgacctcatcagtaag

SEQ ID NO: 36856 - DNA, 1001 bp, Aspergillus nidulans
ggccacgagactgtcggtgtcgttgcagcaatgggtcccaagggcaaaggctttgaaatcggcgatcgtgtcgtcgcgacaattctgagcttttgcgggagtgtttttattgtcgtcggggcattaggtgttttgcgagattttcaggcccacggtgtaaccatgaacgggggcttgcggagtactgcgcctaccctggtacgcacggctaacatctgtggtctgtcacttttgttgacaagagacagctggcagggtcttcaaaatccagaatctctctgacgttgatgccacactcctcgagcctgcttcatgcgcggcccacggtcttgacaagatcgctccgaagatgggctcccgtgtccttctcttcggcgccggtcccaccggcctggtgtgttcatattgaatatccggcatgcataaacatactgacagccctagattctcgcccaactactccgcctgaacggtggatgccacgtcgtagtctgtgctcctgagggtctcaagatggagctcgcaaaatccctcggcgctggcgacgagtatatcggactgtcgcgccaggaccccagtgctcagttcaacaagctcaaggccgacaacccctacggcttcgatattgtcgtcgaggccaccggtaacgtcaaaatccttgaagactccatcaactatgtgcgccgcggcggtaaactcgtcgtgtacggcgtttacgccaacaaggaccgcgtttcgtggccccccagcaagatctgtaagtctttcttgctttatggaggctggaacttacaatgaactgtatagtcggcgacgaaatccaaatcatcggcagcttctccgaagtctacaaattccccgccgccattgactacctcgactccggcaaggtcaaggtttcgggcattgtcaacaaagtgtataaaattgagcagtgggaggagtgtcttcaatcaatgcgaaataagagcgccatcaaggctgctatcgtttttgaatag

SEQ ID NO: 36857 - DNA, 1305 bp, Aspergillus nidulans
atgtctcttcaaacaatcgggatcgccactgtcgcggtggtctattttctcatccgctacttcaaccgcacagacatcccaaagatcaagggtctccctgaagttccaggcgtaccgatctttggcaacctcatccagctcggtgaccagcacgcgaccgtagcgcagaaatgggcgaagaaatttggacctgttttccaggttcgcatggggaataaagtgagttcagtgtctgcatttgtaacagacgacaatattgcgagaataattctgacctaacacagcgcgttgtcttcgcaaacaccttcgactctgtccgtcagctatggatcaaagatcagtccgcgctcatctcccggccgacctttcacaccttccacagtgtagtttccagctctcagggattcaccatcggaacgtcgccgtgggacgagtcgtgcaagcgtcgtcggaaggctgcagctacagccttgaaccgcccggctacccagtcgtatatgcctattatcgatcttgagtcgatgtcgagtatccgggaattgctcagggatagcgcgaatggaacaatggatatcaacccgacagcgtacttccagcggttcgcgttgaacacgagcttaacattgaactatggaatccgaatcgagggcaatgtgaacgatgagcttttgcgcgaaattgtcgatgtcgagcgcggggtgtcgaacttccggagtaccagcaaccagtggcaggactatatcccgctcctgagaatcttcccgaagatgaaccgcgaggctgaggagttccgggtgcggagagacaagtatcttacctatcttttggatgttctcaaggatcgcattgcaaagggaaccgacaagccctgtattactggaaacatcctcaaagaccctgaggctaagctcaatgatggtatgccgtccggtcctgtccgcgcttgaaggaaaataaagattaacagagtctagccgagattaaatcgatctgcttgaccatggtctccgccggcctcgatactgttccgggcaacttgatcatgggcatcgcgtacctcgcctccgaagacggccaaaggatccagaagcgcgcccacgacgagatcatgaaagtctacccggacggcgatgcatgggagaaatgcctgctcgaagagaaagtcccctacgtcacagctttggtcaaagaaacgctccgcttctggactgtcattcccatctgtctgcctagagaaaacaccaaggatattgtctggaacggagccgttatcctaagggaactgccttttgcatggtacctcag

SEQ ID NO: 36858 - DNA, 845 bp, Aspergillus nidulans
aggccttcattacatgacccagcccgcgaccccagagacgaagctgccctcaccccgccggcaacgaccggtagccccaccagcccgtatgcgctgacacctgcgattgattttgatggcctaagctggccatgtgagtatttcgacatatctcggtcccagtcggtttgctgatgcagtttgcctgataggccccggaacacgggcacggcttgagtcaaccccagaggaaaatgaggcgcggattaagaagctctcgggggctgtgcggacaatccttgaatgtcttggtgaagaccccgatagggagggtctccgagaaacacctgaccggtatgcgaaagctatgctctactttaccaagggatacgaggagaacgtgcgggaccttgtcaacggcgcggtcttccatgaggaccatgatgaattggttattgtcaaggatattgatgtattctccttgtgcgagcatcatatggtgcctttcaccggaaaggtaaacctctcccgatctttactttggtccttcgctaaggtgtcatacagatgcacattggctacatcccggaccgccgcgtcctcggtctctccaagcttgcccgcctagcggaaatgttttcccgccgccttcaggtgcaggagcgcttaacgaaacaggttgccctcgctatttcagaagttctcaagccgcgaggcgtcggcgtggtcatggaatcgtcgcatctttgcatggttatgcgcggagtccaaaagacgagcagcagcacaacaaccagttgcatgctcggatgcatgcgctccagcgcgaagacccgcgaggaattcctcaccctcttgaacttaga

SEQ ID NO: 36859 - DNA, 4001 bp, Aspergillus nidulans
cctacaaaaggaagtcgcggccctccgtacgaaagggaccaggaccccaagaaaagctagtcaggcgcctgcagaggagaagcaaaagaggttgtctgagggcaaatgcctacgctgcggtgatcctgaccactttatacaagagtgccctacaaaacctaccaggcgccctaggcaggtggccacagttcaggaagaacaagaccaaatggatgactacagcgagagcgagtcggaaaacaaataacctctgtgcaaagtcgcgtacagaggggttatacagctagagaaatactacttgattggcaagatttcaacagctcgcgcatgaatacccccccattcttggtagaggcactagtcaaccatacctataatgcttgtacaatgatagatacaggctgcctgacctatggggtaatcagtgacaagtttgtcaagatacatcaaatacccactatacctatccacccgaaacctttcaagggagtgactgggaatatagaggagattaataagattgtacgggttcagctagacatcggggcgcatacagaaaaaggagcctacttctatgtgatacccgataacctgggctatgacttgatcttgggactcccctggctggagcaacatgatggaaggttagaggctaagaggggcaggctgtacctctgtactactggagtccgtctatggagtactacaaagaggcccttaccaaagctgaacatagcacagatatccgccgcaaccatgggaggatttatacaaaggaaaaggtgccgtggccaagatattgagatatttgcggtctcattggcagatatacagaaggcactggccccaaagagacatattgacccccgtacaaagctaccaaggcaatactggaaatacctaaggctcttcgaacaagacaaagcagaagaactaccaccgcaccggggagatgggattgatcacaaaatcgagctcgtacaggaggagagtgggaaggatcctgaagtcccctggggccccctttacaacatgacccaggaagaactaatagtcctccggaaaacactctctgaactactacagaaaggcttaaaccgcgtgagccattccccagctgcagccccagtactctttgtacgaagaccaagaggaggactgcggctctacatcgacgaaccgtgctctatatgccattaccaacaatgaccgctatccattgctcctgatccatgagacactgaaccaaattggacaagccagatagtttactaagctggatgtgtctgctgccttccataagatccgcatagccaaagaccaggaatggatgactgccttccgtacgagatacgggctctttgaatggctagtcacccccttttgggttggctaatgcaccgagcaccttccaaaaatacatcaactggaccctccgggaatatctagatgaattctgctcagcctatattgacaatgtacttgtctatactaatagggacctccgccagcactggaagcacatataaatagtcttgaagaaactggaagaagcaggcctatatttagatattaagaagtacaaatttgagtgtaaggagacaaagtacttgggctttataatacaggcagggaagggaatcaaaatagacccagagaaggtgaaagcaataaaggaataggaaacccctactactataaagggcgtccaaggattcctgggctttgccaacttctaccaaaggttcatccctaacttctcagggatcgtacgcccactgaacaacttgacaaagaaagggacacccttcttgtagactaaggagtgccaggatagctttgatctgcttaaggaaaagtttattactagacctgtcctagcaaccttcaacccttcctactatatagtagtagagactgactcctcaggttataatacaggaggagttctctcttaatataataaaaaaggggaattgcacccatgtgcctacttctctaaaaggaattctccagctgaatgcaactatgagatctatgacaaggagctactcacaattatataatgtcttgaagccatgatgcttatactgcgcttatgtaaagaattggagagtatgggggaccacaaaaacctggagtacttcttctccccaaggaagctgacataacaacacatacaatggtccttatttctcagccggttcaacttcaagctagtatataggaaagggtcagccaatcagagagctgatgcactttcacagagagaccaagacatgcctgatgatgaagatgacagggtcaagtctcgtacgatgcaactttttacagaaaaatacttggggaagatggtagttgccaccctccaaccagctgaagagcaaccatgggagccgtacgaaaaaagtgatatgtggaaggaggcactcaaacaggatgaaagatatagtgaagcagtactgtgcctgaaagatggagcaaggagatttcctccacacctataattgaaagtcggaatctcagaatgccagctggacgcccaagaccatatcctcttctgtaggaggaggtaggtgcctgatagtaaacagctctgtacaagtataattcaggctgcacatgactctatattgacaggacatcctggctgagagcaaacatatttgctggttagctgtgaatacttctggcctaacatgtcccgggatatcagaagattcgtccggaactgtgatatatataggaggaccaagtcttggagagaccagagaagggggctattaaagcccctccctgtgcctgatcgtccctggcaggaggtttcaatggatttcattacagacctaccagagagcgaaggttgtacaaacatcatggttatcacagactgattaaccaaaggtgtgatactagaaggaatgtcagaaactgactctgagagtgtggcctgggcactcgtacgagtacttataagcaaacacgggatcccgaaggctatcacctcggacaggggaagccagtttacaagtgatacataggcccgcatatgtaccctgacagggatcaaccgccggctatctacagcctattatcctcagactgatggatcaacagagagaatgaacagcacagtggaaacctacctccgcatgtatacctgctatgaccagaaggactagaacaggctacttccacttgcagagctggcaattaatggccgtacatcaacagcaacaggggtcagccccttctatctaagccatgggtacaacctcagcccatttacccctaccaaggaggtagagcatctagctgaagaaccaaccaagagtcctatccagaaaggggaagccatcgtacagaaagttaaggaagccctagactgggctcaagcctccatggcctattcccaacagaatacagagaatcaggctaataaacacaggagcccggccacaaactaccaagtaggaaataaggtctggctaagtctgaagaacatctgtatggaccgacccagtaagaaacttgactggaagaacgccaagtatgaggttataggcctggtgggcagtcatgctgtacggctgaatacgcccccagggatccatccagtcttccatgtggacctgcttcggctggcttcatcagatccacttccttcccagaagaatgatgatagccagccccctagcatcatggtgaacggtgaggaagaatacatggtagagaaaatcctggacgaacgtcgcaggagatacgggagaggtcaccggctggaatacctagtgaaatggtcaggctatgctcagccaacctgggaagctgccacagctttggaggaagtacaagctctagatgagtggctggattgtacaaaacaatatagacttcaggacggctcactaaacagagatgcatatataaaggctaaagcaacatgacctaccctgtgacctgtacttcctacatagagggaggggggggtactgttatgg

SEQ ID NO: 36860 - DNA, 855 bp, Aspergillus nidulans
gtcgcatctcttttctccctcagtggcaaaactgccctcgttaccggcggaacccgcggcattggcgctgcaatggccattgcgcttgcagaggccggggccgatattatcctcattcaggtgcgtccacccatttcacctccccatatccactacacgacaacgatccactagctaacatgcgacgcgcagagagacaccagtaacaccacgacaagagaccagattacgcgcttaggccgcaaagccacaatccacgccgccgaactttccgaccggtctgccgtaaaggccattatcccaacgctcgtatcgcaagggcacaacccaacaatcctgctaaactgtgcagggattcaacggcggcatccatccgagagattccccgacgaggactgggacgaggttctcaacgtcaatttaacgagcgtcttcacgctctgtcgcgagttcggcgcttacatcctctctctgccagagtcttctttcacgccgaataagaagaagggctcgattatcaatgttgcttccttgttgtcttaccagggtggcattacggtccccgcgtacgcggcgagcaagggtggtgttgcgcagctgacgaaggctctgagtaacgagtgggtgagcaagggcattaatgtgaacgcgattgcgccggggtatattgatacggatatgaatgtggcgttgatcaatgatgcgaatcggaatgcggggattatggcgcgcattccggcgggacgatggggacggcccgaggactttaaggggccggtggtgtttttggcgagcgaggccagtagctatgttagtggagagcttgttacggtcgatggaggttggatggggagg

SEQ ID NO: 36861 - DNA, 1429 bp, Aspergillus nidulans
ctgtcattagacgactttcgcgctcaggccaagactatgcaaggctctcgggatttcggcgctcagttgttctgtgcacttcttcggtcggttgctgtcgaggccaggttggtctgctctttacagccgttgccgttctcgggagccatgcaacctccgcaaaagccagagccggaacctatcgtcatatcttctgacgatcccgactcgctgactgatggttcaaccaaaagtgaggcaaaaccagcgcctattcgcaggattgggcggccgggtttcaagccaacgggagtgcagaataccactgttctctcttcacgtacgtccctcgaccggcttaatggctttactgacaattacaggacccactcggagtgagtcctcatatccggttttctgggtggaggcattcaacgaagccttccagaaatgggtcgttattgatcccatggtgacgaaaacgctcgcaaaaccgcacaaactcgaaccccctgctaccgatccttataaccttctgagctacgtcgtagcttttgaagaagacgcatcagcaagagacgtcacccgtcgctatactagagtgtttaacgccaagacccgtaaactacgggttgaatcgaccaagaatggtgaagcttggtggaaaagggtcctcgaacacttcgagaagccatttttggaagaccgcgatgagctagaaatagccgagctgaccgcaaagacagcctccgagcctatgccgcggaacgtgcaagacttcaaagaccaccctatttatgcgctggagcggcatctacgtcgcaacgaggttatctttcccaagcgggttactggtcatgttagcctaggaaagtctggtgggaagggtcagacggagccgatctatcgtcgctcagatgtccatattctgcgcagtgcgaacaagtggtaccgtttaggccgcgacataaaggttggcgagcaaccgctaaagcggataccagtgagaaacaggggaatggccgtggatgatgaggaagaaggcgaagaaactgctctctacgccttcttccaaacggagctgtataaaccaccaccagtcgtccagggacgaataccaaaaaacgcatttggaaatttggatgtttatgtaccgagtatggttcccgctggtggtattcatatcacacatctagatgctgcgcgggctgcccgaattctagggatcgactatgcagacgccgttaccgggtttagtttcaagggacgccacggcacagctatcatcaaaggggtagttgtcgcaagtgaatataaggaagcagtcgaagaagtcttgaaagcactcgaggaagagaaactgcagaatgagcaggaagaaagagccgtcgaggttctgcgagcatggaagaacctcttaatgaagcttcggattgctgagcgagtgaaa

SEQ ID NO: 36862 - DNA, 4416 bp, Aspergillus nidulans
aagttggcggagctccgcgctcttcgtgccgccggaaagaagcgtctgtcaacatacgaggtcgaggaacagggcgatatttacgaggaagttgacgatgatggttacaagaaaatcatccgcaacagacttgacgaggacgacttcgttgtcgacgataatggcgagggatacgcagacgacggtcgagaagtctggaacgaacaaacgggacaatacagtgatgagagcgatgatgacgacttaccagctagggggaaagctgctaagcgtaagcgcgaggaggagaagcaacggaaggagaagatcaacaatgggatttcaaaatacttcagtagtggagctgcggcgccgactccgaaacccaaggtgagcgagggttgctgaacgaaaatggttgaaggtcgctgggctaacttgtacgcttgcagcctgttgctactgcggaagatgatgcctttctcgcggacctgcttggcgaggtcgacaataatgtagtctcgaacacggttcctaagcacaatgtcgttaagtcggaaacacggcgcaaagtccgcattctatctcctccgctctctgaaaagacgcgcacatcgaagcctgcgattaaagacgaaaatagtggtccagttcctccggttgccgaagagccggttctggacatggacaacggggacgggcctcttgacacaaacgacgatatcccaatgagcgacacgatgccatcctcccccgtcacgaaagcggtcgagaggaaaagcgcagtcctcataaaggaagagccggaagacgatgatgataatatgatggaggtcgtccaagctaccggtcatgacgaagccaaggcaccaagtgtcaacatttctggcagtaggcctccgcccaaaatcaaaaagcagccttacgcgactcctgctagttcgtctccggtcaagtctgcagcagatgttaatgcttcgtggaacgatgtgcgcaacaaattgaacgtgctcaatagcccagcgtcaactgagacacgtgcctttggcaagttacggccccaggatgtggctgagcaagacgggagtctgcgcttcttctggctcgactatactgaagttaacggcagtctctgcttattcggaaaggtgaagaacaagcagaacggatcctacgctagtgcatttgtcaaggtcgacagcatcctccgcaagctttacttcctcccccgtgagtacagacacaagggcggtcgagagactgacgaagaggtcgacatggaagatgtttaccacgaagtcgaccagatgatgtcgagactcagagtgggcatgcacaagatcaaagcatgcacccgcaagtacgccttcgagatgcctggtataccaaaggaagctgagtatttaaagctactctatccttacgacaagccagcgctacccatggacaccaagggagagaccttttctcatgtttttggcacaaacacctcattatttgagcagttcgttctctggaagaacatcatgggcccatgctggctcaaaatcgaagaagccgatttctctgccgtcaacaatgcttcgtggtgtaagtttgaatgtcagacctcgaagcccgggcttatcagcccagtccccgattctgaaaacctcgacccaccaactctcaccttgatcagtcttgctttccgaacgcagctcaatgtaaaagagaacaagcaggagatcttagtcgccagcgctcgagtttacgagaatatctctctcaccgagacgactcctccagagaagcttccttgcaagacgttcactgtgatgcggccagctggttcgtcgtaccctgtgaactttgaggcagaaatccggaagcaacggggcacgtacatgctggagaagagtgagcaaatgctactcagtaaatttctagctctattcgaaagaatggatccggatgtcctgatggggcatcagctccaggaagtcgacctcagtatcttgctcagcaggctcaaagagaaaaagacccctgggtggcatcgccttggacgactcaagcgcggagagtggcctaaaaatttcaacaagggcggtggtttcttcaccgagcgacacctagtagcgggaagattggtgtgcgatgtagctaacgatatgggcaaggtaaggaccctcaccgtatatctagaaaatcactaacgctggtagtcactcatgatgaaatgtcaatcctggagtttgacggaaatgtgcgatctttaccttgggtctggcaacgggcggcaagacctagacatcgatgcggcactaaagacttgggcaacctcgaaagacgggcttgtcaatttcgttacccattgcgataccgatacctactttattgccgccttggtactgaagcttcagatgttgtccttgaccaaggtacttacgaacattgccggcaattcttgggctagaacactaagtggtactcgcgctgagcgtaacgagtacattctgctgcatgagttctacaaaaacaagtacatttgcccagacaagtattcgtctaagctgcagaaggcggaagaaatcgcccaagaaggggacgaggatgacgcaacggataagaagaaaaaggacaaatataagggtggtctcgttttcgagcctgagaggggtctatatgacagatacgtgcttgtcatggactttaacagtctgtaccccagtattattcaagaatacaatatctgcttcacaacggtggatcgcacatcctcggtatgttattttcacgctcatttttggtcaaagctaacatgtccaggccgagaacgagaatgacgaaaaagtgccagaagtccccgcgtccgacgcggagcagggtatcctacctcgtcttattgcaactcttgtcggtcgtcgaggagaggtcaagaagctgatgaaggataaacgggcgacgcccgaacagctcgccttgtgggacacaaagcagttggccttcaaacttaccgctaactccatgtacggatgtcttggatacacacagagccgcttctatgctcgtcccttggccatgctcacgacgtttaaaggtcgtgagattctacgaagcactaaggagctagtagagagcaaacagctgagggtcatatatggcgataccgactccgtcatgatcaacaccaatatggacactatcagtgatgcgctcaaggtcggggaggagcttaagactgccgtaaacgaacggtataagctgctggaaatcgacattgataacgtcttccgccgtctcctcctgcacgccaagaaaaagtacgctgccatcaatatgaccgaagtggacggtaaatacgttgacaagctcgaggtcaagggtctcgatatgaagaggcgtgagtactgtgcgctttccaaggaggcttcgcagcgtcttctgaatgagatcctttccggcgacgaccaggagcttgttctgaatcgtgttcacgattatttgcgtgagctagcaggcaatatgagggagtatactattcctgttcagaaatacgtgatctacacggtatgcctgcccctttgttccttctgagcactcgctgacttactctagaaattatctaaacgcccggaagagtaccccaacaaggaaacgatgcctccagctcaagttgcattacgagaactagcgcgaggcaagacagtccgacccaatgatgtgatctcttacattgtcacatccggcgactcagaaacctcctctcttcccccagccaaacgctcttacaccctccaagacgtaattaagccagactcaaggctcaaacccgacatcgagttctacctcctcaaacaaatattcccccccatcgaacgtctttgcgccccaatacccggcactgacgccgtccgcctagccgaatgcctaggtcttgatgtccgaaaataccaaataaacacaaccaccacaaacagcacccagaataccgagatctttccgttagaatcccagattcctgactctgtccgcttcgaatccgctgccagacttacccctcacctgccgccgctgcaaggaacgctccgtctttgaggggctcgcagcctcaatccacatgtgtaaacccaccggcttgttctgccctaactcttcttgtggaaacccaatctcaactctcaccatcatcgcccagctcgagagtcagatccgcgcccagacctcaaagtactacgagggatggcttgtctgcgacgaatcaacatgcggcaaccgaacacgccaaatcagcgtgtatgggcaccgctgtctgggtccgcgtgggcaggcagaagggtgcctgggacgcatggcgtacgagtattccgagaagcagatgtacaaccagctattgtacttcgccagcctatgggacgtcgataaggcgcgggccgcggcggagaaagagagcaa

SEQ ID NO: 36863 - DNA, 3300 bp, Aspergillus nidulans
aacctgggctatgacctgatcttgggactcccctggctggagcaacatgatggaaggttagaggctaagaggggcaggctgtacctccgtactactggagtccgtctatggagtactacaaagaggcccttaccgaagctggacatagcacagatatcagctgcaaccatgggaggatttatacaaaggaaaaggtgccatggccaagatatcgagatatttgcggtctcattggcagatatacagaaggcactggccccaaagagacatattgacccccgtacgaagctaccaaggcaatactggaaatacctaaggctcttcgaacaagacaaagctgaagaactaccaccgcaccggggagatgggattgatcacaaaatcgagctcgtacgggaggagagtgggaaggatcctgaagtcccctggggccccctttacaacatgacccaggaagaactaatagtcctccggaaaacactctctgaactactacagaaaggctttatccgcgtgagccattccccagctgcagccccagtactctttgtacgaaaaccaggaggaggactgcggttctgcgtcgactaccgtgctctaaatgccattaccaagaaggaccgctatccattgcccctgatccatgagacactgaaccaaattggacaagccagatggtttactaagctggatgtgtctgctgccttccacaagatccgcatagccaaaggccaggaatggatgactgccttccgtacgagatacgggctctttgaatggctagtcaccccttttgggttggctaacgcaccgagtaccttccaaaaatacatcaactggaccctccgggaatatctagatgaattctgctcagcctatattgacgatgtgcttgtctataccaatggggacctccgccagcaccggaagcacgtacgaatggtcttgaagaaactggaagaagcaggcctatatttggatattaagaagtgcgaatttgagtgcaaggagacaaagtacttgggctttataatacaggcagggaagggaatcaaaatggacccggagaaggtgaaagcaataaaggaatgggaaacccctactactataaagggcgtccgaggattcctgggctttgccaacttctaccgaaggttcatccctaacttctcagggatcgtacgcccactaaacaacttgacaaagaaaggaacacccttcttgtggactaaggagtgccaggatagctttgatctgcttaaggaaaagttcattactggacctgtcctagcaaccttcaacccttcctaccgtacggtagtagagaccgactcctcaggttataatacaggaggagttctctctcaatataatgaaaaaggggaattgcacccatgtgcctacttctctaaaaggaattccccagctgaatgcaactacgagatctatgacaaggagctacttgcaattgtacgatgtcttgaagcctgggatgctgaactgcgctcatgtggagaattccaagttattaccgaccacaagaacctggagtacttcttctccccaaggaaactgacagagcggcacgtacgatggtccttatttctcagccggttcaacttcaagttagtatataggaaagggtcagccaatcagagagctgatgcactttcacggagagaccaagacatgcctgatgataaagatgacagggtcaagtctcgtacgatgcaactctttagtaaaaaacacttgggaaaaatggtagttgccacccttcaaccaaccggagagccaccacgcgagccgtgtgagaaaggtgacatgtggaaagaggcactcaagcaggataaagggtacaatgaggcaatacagtgcctgaaggatggagcaaggaaatttcccccacatctacagttgaaagtgggaacctcggaatgccaattagacgcccaaggctatatcctcttccgcggaaggaggtgggtacctgggagtgaacagctccgtacaaatataattcaagctgcgcacgactctatgttgacaggacatcctggccgggagcaaacatatatgctggttagccgtgagtatttctggcctaacatgtcccaagacatcaggagattcgtccgaaactgtgatgtatgtggaaggacgaaatcttggagggaccagagaaagggactattaaagcccctccctgtgcctgatcgtccctggcaggaggtttcaatggatttcatcacagacctaccagagagtgaaggttgtacaaacatcatggttatcacagaccggttaaccaaaggtgtgatactagaaggaatgtcagagattgactctgagagcgtggcctgggccctcgtacgagtacttataagcaaacatgggatcccgaaggctatcacctcggacagaggaagccagtttacaagtaatacatgggctcgcatatgtaccctgacagggattaaccgccgactatctacagcccatcacccccagactgatggatcaacagagaggatgaacagtacagtggagacctacctccgcatctatacctgctatgaccagagggactggaacaggttactcccacttgcagagctagcaattaatggccgtacatcaacagcaacaggggtcagccccttctacctaagccatgggtataacctcagcccatttagccctaccgaggaggtagagcaactagccgaagaaccagccaagagtcctatccagaaaggggaagctattgtacggaaagttaaggaagccctagactgggctcaagcctccatggcctattcccaacagaatgcagagaatcaggctaataaacacaggagcccggccacaaactaccaagtgggagataaggtctggctaagtctgaagaacatctgtacggaccgacccagcaagaaactggactggaagaacgccaagtatgaggttataggcctggtgggcagccatgctgtacggctgaatacacccccagggatccatccagtcttccatgtggacctgcttcggctggcttcatcagatccacttccttcccagaagaatgatgatacccagccccctggcatcattgtgaacggcgagaaagaatacatggtagagaaaatcctggacgaacgtcccaggagatacgggagaggtcaccggctggaatacctagtgaaatggtcaggctatgctcggccaacctgggaagctgccacagctttggaggaagcacaagctctggatgagtggctggatcgtacaaaacagtat

SEQ ID NO: 36864 - DNA, 3162 bp, Aspergillus nidulans
atttaactctttagatatcagttggcatctccagtgcgatggtgggctaccatactcccccacccttatattctactgatccaagcagggtcgaaacgcagcagcagctctttcggggcgagccgtgcattcaacgattcgtcgagatagggccccggacaattctctcgacaatggcgaaaaggtctgccagtatccagaaagatcagcgttcttcagcgagttgttacagccccgagttcctttcttaccatgataatcagcccgagatcttgtaccaatatcaaaacgaccaagctatttatccgctttctcagcccacacagccccaattcgaacccacttcaccttctcatctcacgaaacggtcgccatctccctctaaggctttgcctatgagcgccattcccagtgcagaactcactctgcaggcagggcatgtcattctcgccatgacggcccaaaaacttcgtcgacgatttgatcaagtcccagttgagaagaccatccgtgatctatccggaggtatgcactataattgcccaatctgtacttatttctaactgccaaggaaaatccaccctccaaaacgaactgaccggcgaccttgtggctgaattcggtcgtgttcccgaaggtgtcgaagaccaacctctatcatctttggcagagtcatttcagcccgagttcagtggtattcccggcaaggcgatgtctacacttatctcgaggtttatatccggcaagatgccagcagggtttaaccagagtgctattcaagagtacttgaacagccgctgggacttacaaaatcccacgccactatacctctttgctttgcgccgaccatggagcctgcgaggcgtctcgcaaatgccgatgaagcgcgagcttaccttgacgacttggtagagaagcatgccgcctttcaagggatatctctggtgccgtcgaatcaggttgctgacggccatgagtctcttgctccggtcgttatgaacgtagccgatgtggatgagatgaataagcgcaccaagctctacagggcgcagtttgactcgttggcaagctatctcggcgtcgattatttcgcttcagagaaggcaatgtcagagtcggaatcccgcattgctgaactagaagagacgataaggttattgaataccgagttggatgaacaattcattaaaggaatcaagccttcgttcaatattaaacaagtccgcaaatacgactcttggtggaactggtctcgcgaagagcttatacggctcttgaatgagatatgccaggattcttcgagtgcttgccccccagatatggaaaatcgcctgcagaatctgctaaacaaatgggatgcaaactgttcagaaatcgttcgagctcacttgattgggctacaatcacgttctagtgcccctatgaataagcttcaactgatcttggaggaaatttttaccttgggcaaccaaacactttccatcgaccccttgttcgtccacaacctcccgcctatgggacctcaaaccataatcacagatgcgggttgtcttgaatatcatgagcttccacggcaaatcagccattatcccgaagctatggcatatggacctccatggccccaagggcatacttcggctccgtttattcacatcaagacccgagaagacggacaagactggatgtatgattctaaagctactagtatctaccacgctatgttggatgtcggagttacgaccggccttacctttacccataaagcagtcttggtcactggggctgggcctagctcaattgctgcgagcgtgattcaagggctgttgagcggcggtgctcgcattatcgtcacaacgagtagatctatatcgcagagcgcagatttctaccagcagatgtaccgccaatatggcgccaaggggtcttctttaagcctcttccccttcaaccaagcaagcaagcaagactgcgaacagctggtgcagcatatctatggccctgattcccctacggacggtgacctggactatattttaccgtttgccgctattccccaagtcggagaacctgacgcttttggaggtcggcaagagcttgcactaagggccatgcttgtgaacattttgcgtcttatcggcttcgtgcgtcaagaaaaggaacggctgcgtattgagaacaggccaacaatgattgttctgccaatgtcctgtaacgagggtaccttcggtggagacgggctgtactccgaagccaaaatcggtttaaaggctttatttaaccggttttactcggagaactggtcgaaatacttaacgatatgcggagcagtgattgggtggacaagaggcacagctataatgcaaacatcaaacgctgtggctgaagaggtagagaaactgggagtcatcactttcacgcaggcagaaatggccttcaatattcttgcgttgatgacgcctgccttgactgcccttgccgaagatacaccaatatatgccgacttgaccggaggtctaggatcgatgtggaatatcaaacaggaaatctcagccgctcgaaaaaggatatcagagaggcagatcctacaaatcgcaattgcggaggaggatgcgcgtgagcaggctatgatatgttcagcaagcaccgatgtcgaatcaggtttacccacaactagacacgccaggttaggcctacagtttccgccacttccggatgtgaacgaagggtaccctaatattgagggaatgatcgatcttacccgcatcccagttattgtaggctactccgaactaggtccatggggcaatgctcgcacgcggtgggagattgagcatcggggagatttcagcctggaaggctatattgagatggcctggattatgggcctcatcaagcacgtcgatggacacgcgaaaggtcggccctatgtgggctgggtggatgcagacacagagacacccattcaagactatgaggtgccccataagtaccataaacacattatggctcatgccggtctccgtctgataaaaccaactaaactagacagttacgatccgtctcgcaaggatcttctccacgaagtagcagtggaagaagacttagctcctttcatatcatcgaaatcaaccggtgaagcctttccaactacggcatggagag

SEQ ID NO: 36865 - DNA, 686 bp, Aspergillus nidulans
ggcctgggagatgcgatggtcaaaaagtttatggcacaattaatcgagggtatccgtttctgtcacagccacagagtgcttcaccgtgacttgaaaccccagaatctcctaattgaccgtgatggcaatctcaagctggccgattttggattggcaagggcattcggtgttcccctccgaacctacacgcacgaggtatcctccgcctccctatcgtccatggcatgggcttgtcgctaaatttgctctaggtggtaactctatggtaccgctctcctgaaatccttctcggcggtcgtcagtactccactggtgttgacatgtggtcttgtggtgctattttcgcggaaatgtgcactcgcaagcctctatttcctggtgactcggaaattgacgagatctttaagatcttccggtatgccatttcactgctgaatcgctagacgcaagcttctaacgtctgatgtaccaggatcctcggaactccagatgagactatctggcctggcgtcacctcgttccctgatttcaaaccgaccttccccaagtggaagcgcgaagatatccagaacgtcgtccctggcctcgaagaggatggccttgatctattagaagccctgctcgagtacgatcccgctcgacgtatttcagccaagcaggcttgcatgcatccatacttccagcac

SEQ ID NO: 36866 - DNA, 477 bp, Aspergillus nidulans
catgtctccaaaggtagtgtaggaggcaagattcatgtccaaggttcctcttcgaatgtcacgcacacaatcaacgaagatgaaaggaccgaatttacgagacatatcaatgctgtcctagcaggtgatccagacattggccatcttctacctttccctaccgatacattcgagatgttcgataagtgcaaggacggtctggttctcgcaaaacttatcaacgacagcgtccccgatactattgatgagcgcgttctgaacaaacctggcaggaaactcaaagagcttaacgcattccacatgactgaaaacaataatatagtcatcaactcagccaaaggaattgggtgctcagtcgtaaatattggaagcggcgacattatagaagtgcgggagcatcttatcctgggtctcatttggcaaattattcgccgtggcctattagggaagatcgatatcaaacttcatcccgagctt

SEQ ID NO: 36867 - DNA, 569 bp, Aspergillus nidulans
attgctcccgcccttcctgttcttgccaagctcatttacatgcttgatgacgaggtcctcattgatgcatgctgggctatctcgtacctttccgatggtcccaatgagaagatccaagccgtcatcgaagccggcattccccgtcgccttgtagagctcttgatgcacgcctccacctctgttcagacccccgcccttcgttccgttggcaacatcgtcactggtgatgatgttcagacacaggttatcatcaattgcggggctcttcctgctcttctctccctccttagctcaacaaaagatggtatcaggaaagaagcttgttggaccattttcaacatcactgccggtaactccagtcagattcaatctgttatcgatgctggtatcatccccccgcttgtgcatctccttgccaacggtgactttaagactcgcagggaagcttgctgggctatatccaatgccacaatccggggggttgagaagcccgaccagacccgcttcccttgtactcaggggggattaagcctttctgtggccttctagcgggccctgataacaagatc

SEQ ID NO: 36868 - DNA, 1023 bp, Aspergillus nidulans
atctcggctcgttctgatattgatcatccgatatgcacagaatgtacggatatgctggtcgaggggctacaacagcggcttgcggaggcgacgaaggagcgggacgcatacatcacctttctacggaacctgaactcgtcggtcccaacacaggaggaggttgaaacagctgagaagtctcttaaagagactttggaagccgaggaggcggcatacgcagaactggttgcgttggaaaaggaaaatgctgccttggacgaggagattgctcggttagaagaggagtctcgccaactagattacgaagaggaaaagttttggcgcgatcggaatgcgttctcgttggtgcttgctgatttccagaatgagcgggatgcgttgaatatgaaatatgaccacgactctcgccagctggaaagactgcagcgaaccaatgtttacaatgatgccttctgtattggccatgacggctattttggaacaatcaacggcctccgactcggccgcctggcaaacccttcggtcgaatggcctgagataaacgctgcctggggccagactgcgctgctgctggctaccatagcggagaaactgaactttcagttccaggggtaccggctgcggccgatgggctcgatgtccagaatcgataagatcgagtatccgcgaccgttaccggcgcaatcgaccgttgaaggagctagcaatgcccatcaaccagcggcacccaagatcaccagccttgatctgttctcctcaggcgacctgccgctccatatgccatggcttcacagtcggttcgatgcacgaatggtggtctttctggaatgtctacggcaactgggggagtttgtggaaaaaacacgcgtacgctcgagtcggcgggaccaggccggagctggcctgcccggtttgaagttgccatactctatcaaacgagataagattggcgatgccaggattaagcttgcgttcaaccaaaacgacgagacctggacgcgcgcctgctagtataccttgacg

SEQ ID NO: 36869 - DNA, 727 bp, Aspergillus nidulans
ttcctcttcaaagtcgtcctcatcggcgatagtggaacgggaaagtcaaatctgctatcgcgttttaccaggaatgaattcaatctagattcgaagtctactattggtgtcgagttcgcgactcgttccatccaagtggactccaagacgatcaaggctcagatctgggataccgctggtcaggagcgttaccgcgcgatcacatctgcctactatcggggtgctgttggtgcgcttctcgtctatgatatcagcaagcatcaaacctacgataatgtcaaccggtggttgaaggagctccgcgaccatgccgattctaacatcgtcattatgcttgttggtaataagagcgatttgaggcatctccgagctgtcccgacggaggaagccaagcaatttgccagtgagttctccttgcacgcttgcatggattatctcttgacacttacgctcaataggcgagaacaacctttcattcatcgaaacttccgcactggacgccagcaacgtcgagcttgctttccagaacatcctcacaggtatagctccagttggaatttctaaaagacgctcactgaccgctattcttttttttgtagaaatctaccgcatcgtgtccagcaaggcgctcgaaggcgaatccggcggagcctctgtcggggagcgtcgtcagatcatcgatattgagaagacccaagacaccgagaacaagggtggatgctgttga

SEQ ID NO: 36870 - DNA, 675 bp, Aspergillus nidulans
aaaatgactaccgatgattttgagcctctgctctgcttaggcaagggatcctttgggaccgttttgctggtgcgccatgctctcacaggaaagctttacgcgcagaaacagttcaagaaagcctcgattacggttcacaagaaactcgtggaacaaacgaagaccgagcgcgcgattctggaaagcgtgaatcgacaccccttcgttgtaaagctcttctacgccttccaggaccacgaaagactttaccttgtcctcgagtacgcccaaggaggagaactcttcacccacctcgcgatggaacgcatgtttgacgaagacgctgcggccttctacatggccgagatggtcctcgcgttggagcacctacatcagaacgtcggcgtgatctaccgcgatcttaagccagaaaactgcctccttgaccgcgaggggcacctccttctgactgacttcggcctcagcaaaatcgccgtgggcgacgacgaccgctgcaactcttccctcggcacaatcgaatacatggcccccgaagtcattcaaggcaaaccctatggcaaagcatgcgactggtggtccctcggcgctctgggatacgaccttctcaccggctcgccaccctttaaggcaaataaccacgcgaagctgcaagagaagattctcaaacagaaactc

SEQ ID NO: 36871 - DNA, 489 bp, Aspergillus nidulans
aacggcacggcgaagatcaactggccctacctattccgacagcgcaggcgcttggaggagaattggaccaaaggacgattcacgaattttcaacttccgcaccccgcgcatatggaggaagctcatcaggaatgcgtatatgctatccagttcatcgggaaatggcttgtcagtggcagccgagacaaaactgtccgagtttgggaccttaacacaaaaaggctctggcatcgccccttgattggacatacgaaatctgttctgtgccttcagtttaacccgagcccgtccgaagacattatcatatctgggagtagcgacaagaacgtcattgtctggaggttttcgacaggcgagaagatccatgagatcgcccctgcgcatgatgattcggtcctgaacctccgatttgatcatcgttatctcgtgacctgttcgaaagacaaacttatcaagatttggaatcggaagaacctgtcaccagccgac

SEQ ID NO: 36872 - DNA, 332 bp, Aspergillus nidulans
atgtctgccaaagaactcactttcaaggaggttgccgagcacaacaccaagaaggacctgtacatggtcattcacgacaaggtctacgactgcagttctttcgtcgatgagcacccgtacgtctcacgtatcttccagctttttgatgttcaccgcattggacatgccatggactgatttggtataattatagtggtggtgaggaagtcctcctcgacgtgggtggtcaggacgccacagaggcctttgaggatgttgggcacagcgacgaggctcgcgagatcctgcagggtctccttgttggtgacctgaagcgtctggtgcgttccccc

SEQ ID NO: 36873 - DNA, 411 bp, Aspergillus nidulans
gaggcaatctgggccgccagcccctccaccacgaggggtcaacccacccagctttcttccgatgctaaaggcgaacgtctcgcttacgcggtatattatagcacccctgccgagctctcttaggccatgcttaaacacctgtctgacccgagagatgtctttacgaacagtcaaataaatccatcttcctccgctccatagatgaccccgctgtcgctcgtcagtacaccgagcataaggtgcagacaacagtcgcccgcttcgcaccatcaggattctatgttgctagcggagatgctagcggtgttgttagagtgtgggattgcgttggcgaaggcatcacgaagggcgaatacagcattgtgaatggccgaataaacgatcttgcttgggacggtgattcacagcgga

SEQ ID NO: 36874 - DNA, 679 bp, Aspergillus nidulans
ttcaagctcaacacaggctatgagatacccgccgttggactgggaacatgggtacgaacaactacttcatctttcaggaaccaagcttatgaatgtcttattgtgtatagcaatctaaaccgagcgaggttgaggaaccggtaactgcggcgctgaatattggctatcgtcatatcgacgctgctgcggtctacggtaatgagcgcgatgttgggaacggaattaaggcatctggtgtgccgcgtggagagatattcgtgagctctacgttgactttggaagaggtttgtgtgttcaactgacgtgctaagctcacgagcaaattatggaatacccatcatgaccctgagaacgtcgaagctgcagtagatcgatcccttagcgatctccagacggattatcttgatctttaccttgtaagtcattcaagttctgttgtgacagagtgtaaacgtcgctaatacctgctggtcatatagatccattggccagtggcttccgctactcaaccacaaccattcagcctgtcgatgagaaaaccggtttaatcgatgtgatagacgtaccaattaaagatacatgggctgcgatggaggcacttgtagctaaaggcaaagtgcggtcaattggagttagcaacttcaaccggcagaggatcgaggagctcctcaagacgtac

SEQ ID NO: 36875 - DNA, 581 bp, Aspergillus nidulans
gttctacttggcatcacaggcagagactttgtcattctagcagcgtcaaaggctgctatgagaggcccgactattctcaaagctgaagatgataagacaaggcaactgaacgagcacactcttgtcgctttctccggagaggcgggagacaccggttcgttcgcgcttatatatttttgagcttcaacaccagaaaactaatcgaggcccccattacagtacaatttgccgaatatgttcaagctaatgttcagctatacacaatgcggaatgataccgagctgtccccgaatgccgtcgcgaactttgttcgaggagagctggcacgaagcctacgttcgcggaacccctacacagtcaatctccttttgggtggtgtagaccctatctctcagaaaccacacctttactggattgattatctcgcgtcattggccagtgttccatatgccgcccatggctatgctcagtactactgtctatcaacccttgacaagcaccatcaccccgacatcaccctggaacaaggcatgaagaatgttagaaatgtgcacagatgagttgaatcggcgccaaccgct

SEQ ID NO: 36876 - DNA, 423 bp, Aspergillus nidulans
atcaaattgctgttgataggagactctggtgttggaaagtcgtgctgccttctgcgcttcagtgaggattcgttcacaccatcgtttatcacgacgattggtatcgacttcaagattcggactattgaattagatggtaaacgggtaaagcttcagatatgggacacagctgggcaggagcgatttagaacaatcaccacggcttattacaggggtgcgatgggtattcttcttgtttacgatgtcaccgacgagcgttcattccagagtaaaataaccccatcttacgttctcccatacaccggtcgctaacccaagtcacatcacagacatcagaacatggttctcgaacgtcgaacaacatgctagcgagggtgtcacaagaccttattgggacaaatggactgggagagagagactgta

SEQ ID NO: 36877 - DNA, 450 bp, Aspergillus nidulans
cgcctcgacggcgacaacgtgcgcttcggcctgaacaaagatctcggtttctccgacgctgatcgcaatgagaacatccggcgcattgcagaagtcgcgaagctcttcgctgacagttcctcaatcgccatcacgagtttcatctctcctttccgggctgaccgtgataccgcgcggaaactgcacgaggtccctacgccgaatgatagcactggtttgccatttgtcgaggtattcgttgatgtgccgattgaggttgctgagaagagagatcccaaggggttgtacaagaaggcccgtgagggaatcatcaaggagttcacgggtattagcagtccgtatgaggcgcctgaaaacccggaggttcatgtgaagaatgtggatctaccgattcaggaggctgtcaagcagattattgactacttggatagcaagaagttgcttgatgct

SEQ ID NO: 36878 - DNA, 571 bp, Aspergillus nidulans
gccatcagcaatgagctttatgtgatgaacgaggaaaccgttgcagccttctgtttgctcagtgttttcaccgctgttgccaaatacggtggtcctgcatacaaggaatgggctgaggctcaggtccagaagcacaaggacatcctcaacgctgcccgtgccgaccacaccaacgctgttaagcagcgcatggagaatgtcaaggagctgtctggtgttgttgacctcaccaagcagctctttgaggtttccaaggtatttaaacagcaacagctctcttgagcggtccctgctcgaggtgaaagcgtggggagattacagctaacatttgataaaggaaaccgccaagctcgaggcccaggcctacgagctcgagcagcgcaccgctcttgctgccgaggccaagcaggttcttgactcgtgggtccgctacgagggccaggtcaagcagcgccagcagcgtgagcttgctgagaccgtcattggcaagatccaaaaggagctccagaaccccaagaccctccagcagatcctcaaccagagcgttgctgacgttgaacgtatgttacaa

SEQ ID NO: 36879 - DNA, 522 bp, Aspergillus nidulans
cagcgtggactcgttggccccatcatctctcgcttcgagaaccgtgggtgcgtataccttccaacattgctcagtcgcgatactggaccgttacaagcttcaagctcgctgctatgaagctcacctccccctctcgctctctccttgagcagcactacagtgaccttaaggagaagcctttcttccccggcctcgttacctgtgagtttccacgcctcaagtaattgacgcttgtgatcgcaatcttataccagaatagacatgctcagcggccctatcgtcgccatggtctgggagggtaaggacgtcgtcaagaccggccgcaccatcctcggtgccaccaacccccttgcctacgcccccggcaccatccgtggtgacttcgctatcgacgtcggccgcaacgtctgccacggctccgacagtgtcgagagcgccaagaaggagatcggtctctggttcacccccgaggagatccagaactacaagctgaacgctttcggctggatctatgagaaggaa

SEQ ID NO: 36880 - DNA, 572 bp, Aspergillus nidulans
cctgttgctgtcatcaccacacgccagcagacacagccaaaggacgacaagaagggtctaattgagaccggcagagaagtagtcaacagcgaagatggatggtccggtttgtggagaggcctcaaagcgagcttgatcctcgtcgtgaacccggctatcacatacggtgcttatcaacgtctcaaggacattattttccccgggaagaagagcctcaagccttgggaagcatttcgtgagtaacatcatgataccgcttatgggtacttgaaatactgattccggtcacagttcttggtgctctatccaaggccatggccaccatcgcaactcagccgttgattgttgccaaggttggccttcaatcgcgcccgccaccagcccgtaatgggaagccattcaagaccttcagcgaggttatgcgatttatcgtcgagaatgagggaccgctatctctattcaagggcattgggccccagattttgaaaggtcttctagttcagggtctactgatgatgacgaaagaaaggtatactgtttctcctatagcattattatgaacatatgctgat

SEQ ID NO: 36881 - DNA, 1448 bp, Aspergillus nidulans
gctgcctcggaagcactcgtttctcctcccgtggcgcccgtaaagcccgggattttgatagtcaccctacacgaaggccgcagctttgctcttccgcagcattatcaacaagttttcagttcacacattcagaatggctattcgatgcgccctagttcttcatcttctcactcgacgcattcgcagtccagttcgtttgtgccgagcaaccgtcctcaatccacaagttcgggcatcaacgcggctcccactattcacggtcggtactcaaccaagtaccttccgtacgcccttcttgattttgataagaatcaagtcttcgtcgatgcggtctcagggacgccagaaaacccactttgggcaggcgacaacaccgcattcaagtttgatgtgtctcgaaagactgatctgaatgttcaattatatctccgcaaccctgctgctcggccaggtgcccgccggaacgacgaaatctttttgggtgcccgtcaaggttcaccctcgattcgaggaggaaattcagccttacattggcgacccaaagctgagcaaaaaggacaaccagaagaccgctgccgctcacgccgaacaggaacgcgcacttgggcaagttggtgccgaatggcatgacctccaattcggttctggttcactcaaaattagcgtgtcttttgttgagagcaagcaccgtagcctaaaattggaggactttgatttgctcaaagtggttggcaagggcagcttcggaaaggtcatgcaggttatgtgcgtactcatcaaaatcttcctgctcattgatttgtcgtcaagttacacattcacaggaaaaaggacacggcccgcatctatgctctcaagaccattcgtaaagcacacatcatttcacggtcgcaagtcacgcacactctcgcagaaagatccgtacttgcgcagattagcaatcctttcatcgtgcctctcaagttctccttccagtcacctgagaagttgtactttgttttggcctttgtgaatggtggagagctgttccatcaccttcaacgagaacagcgattcgacgttaaccgtgctcgtttttatactgccgagctgctctgcgctctcgagtgcttgcatggcttcaaggtcatctaccgcgacctgaaacccgagaacatccttcttgactatactggacatatcgctttgtgcgacttcggactgtgcaaactcgacatgaaagatgaggatcggacaaacagtaggacattcagcgtcccctttgcgttctaagtagctaatgaggtacagcattctgcggtactccggagtaccttgcaccagagctcctcctcggtcaaggttacaccaagactgtcgactggtggactctgggcgtacttctctatgagatgttgacgggccttccaccgttttatgatgaaacacaaatgatatgtaccgaaaga

SEQ ID NO: 36882 - DNA, 970 bp, Aspergillus nidulans
ccagagggctatccgcctgctgcacctgtgccgcgccctccatctaaggttatgacccagaccaacgtgcgccggtgacgcaagcaaggaagcggacgctctgcgcaaggccatgaagggttggggtacagacgaagcagcgctgatcaatgttctcgcgaaaccggatccgctgcacatggcgctgatccggcacacatacatggatcggcacggtcgcaacctcgagaaggatctgaagagcgaattgtccggtgacttcgagaccatcatgctctctcttgctgcgggaccgcttggccaagacatcaggtaccttcgcgatgcgatgtcgggaattggaacggacgaaacggccataaatgacgtgctgatcgaccgctcgaatgcggacctccgcgctatcaagtacggctacgtccagcggtacaataaggcgctggtcgacgatatcaagagcgacctctccggcaagacggagaaattcttcctcatgctcctgaacgccgtgcggcccgagagcgggacctacttcgaccaggcgagcgtcgacaaagatgtgcacgagctgcacctcgcgacgaacgcgaagaccggaacagacgaactcggcgtctcggccgtcttcctcggcgcaagcgatcagaagcttgttgcaatttcgcaagcctttgaagcaaagtaccacatctcgctcgagaagacgatcaaggatgaattcagcgggcatctggagaaagccctccttgccattctggccagagcaaaggatccgctgaagttcgacgtcgaaactatgctggctattgtgccgccgggcggcgtcaaggcagatatcaagaggctgatctactgggtggtccggttgcattggaacccgccatatcttgcgcagattaaggaggcgctccagaagcggacggggagtaactttgggaagagaattaggggggctctgccgggcggggat

SEQ ID NO: 36883 - DNA, 1543 bp, Aspergillus nidulans
tcggtgcgaaaccaagatgtttacatcatccagagcggcagcgagaagatcaatgacagtgttatggagattctaatcatgatctcagcctgcaaaggaggctctgcaaagtctatcacaggtatgattaccctacttccccgcttatgtcacgttctcggaattcttgtggaggctgacatggtcgtttggtagcggttatgccgtatggatcctagctaggctgattgctactcataatgctgacacagacgaggtacttcccatattcccgccaatccaaaaagaagagccatcgtggatctatcaccgcacgtatgcttgcaaatctcctcacagttgctggggttgaccatgtgatcaccttggatctccatgtgagtgtttagaacgatggattgctgcactagattctgtcactagtggatagacgaagttctaacctggtctttctgctcaggcatcccaaatgcagggatttttctccaagcccgtcgacaacctattcgccgagcctttcattgcacgctggattcggaacaatgttcccgggtgaaaagaagctgtcgtcgttagcaagaacgctggagggacgaaacgagtaacgtcgctggcagacacgctcaagctcaactttggcatagtcgcaacagacaggcgccgcctaaagccaggaccaactctggccgatagtacagtattcgtagaggctttggaccaggaaacagcaccgctgcctaaagagcaagatccgttcattgcgcggacacacattgaaaaccccgacgctctacaatcaagggaatcgcaggcggatctcaatgagcttgactcgttgcgtcctgagaccccgtcgggcgcccggcggccttcggagttggaggctgtaaatgaatacacagatgtcagggtgcgagatgtgatcaccggacggctcgtacaaggtcacctcgtcgatgatgactatccgccatctggtcctacatctatggctgtatccggcgatgcaacccctgggcaactgcccagccaagagagtgaagccatcccagattcaatggtagactcagtcgtctcgaccacatcctcaaagcctggtgaccacgctttaggcggatcattcgatgctgccgactcttctgatgaagaagaaggaagcaccaaacgaaatgttgaacaagagaagactatcactctggttggagacgtccgagatagaactgtcttccttgtcgacgacatgatagacaaatctggatcatggatcgcggcggcagagaccgtggtgaagcgcggcggggccaagaaggtttactgcattgccacccacgggctttttggggactcatcccttgaacaattggaggcttgcgagtctattaactacattgtcgtcactaatactttccccatatcaccgcaagtggcgaggaaatccaggaaattgatcatcattgacatctcaagcctcctctcagagagcataagacgccatcattatggcgaaaggtccgtctctatttatctctatcaaaaaaggagc

SEQ ID NO: 36884 - DNA, 1003 bp, Aspergillus nidulans
caagttaagcagggtacccgtgtgccctcaatataccgactctaccataaatgggaatgctgccagggaagttgacccttggtaatacaacaggtcgttgaaagacccgggacagatcaactttgctggtatcggcggtcatgaatgaccaaattcgtgaactacgtgaagtgattgagttgccgctgaagaaccctgagctattccagcgagtgggtatcaagccacccaagggcgtgctgctttacggacctccaggtaccgtaaagacgctcttggcgcgtgccgtcgcaagttctatggagaccaacttcttgaagggtgagctgattaccagcgttaggtctagcgttccgctaacacggtttagttgtctcatccgctatcgttgacaaatacatcggtgagtctgcacggttaatcatagaaatgttcggttacgccaaagaacacgaaccttgtatcatcttcatggacgaaatcgatgctataggtggccgacgattttcggaaggtacctcggcggaccgagaaattcagcgaacgttgatggagctactcaaccagctggatggttttgactatcttgggaagacaaagattatcatggctacaaatcggccggacacacttgacccggctttgctgcgtgcgggtcgtctagaccggaagattgagattcctttgcccaacgaggtcggccgtcttgagatcctgaagattcattccagtactgtgcaaatggagggcgacattgattttgaaagtgttgtgaaaatgagcgatggactaaacggtgctgatctccgtaatgttgtgacagaagcgtatgtcatgcccttgtttttgtacttggtcattgctaacgttgaaaaggggtctatttgctatcaaggactatcgagatgcgatcaatcaggacgacttcaacagggccgtccgcaaggtagcagaagcgaagaaactggaaggcaagctcgaataccagaagttgtagattagc

SEQ ID NO: 36885 - DNA, 897 bp, Aspergillus nidulans
gaggtcactgcccgccttgagtatctccatctgatgggtttcatctatcgtgatttgaagccagaaagtgggtatcccaaacttgttcgtgaataaacaactgactcattcgtctcgcagatattctgctacatcaatcggggcatattatgctttcggatttcgatctctcgaaacagtcaggaccagggggtgcacctacgatgattcccgcacgaagcggcaattccaacacgtctctccctacaattgacaccaagtcttgtattgccgacttcagaaccaactcctttgttggcaccgaagagtacattgcgccggaggtgatcaaagggtgcggtcataccagtgctgtagattggtggactctgggcatcctgatctacgagatgctctacggaacgacacccttcaagggcaaaaacaggaatgcaacctttggtaatattctccgcgacgaagtaccgtttccagaacaaggaggtgcacaacaaatatccaagtatgttatcaccgaattctggttagtcgcagtactaaccaagttacagcatttgcaaatctttgatccgcaagctactgatcaaagacgagacaaagcgccttggggctcgagctggcgcctcggacgtaaaaactcatcccttcttccggcaaacgcagtgggcattgattcgccatatgaaaccgcctatgatccctcaccaaagccgcggaaatgagacagtcaacttccgcaatgtcaaagaaagcgcaagcgttgacattggcgaaaagaatccttccaagatgaagggagtccccttgaattccggcctcgccacgcccaacggcgaaatagcagacccctttgaagagttcaacagcgtcactcttcaccacgacggcgatttttaa

SEQ ID NO: 36886 - DNA, 324 bp, Aspergillus nidulans
agtgggtccgcgggtgtatcaaagcttattgctgtgctgattgcttaccctcatgaggtacgtacttattcttaccgaccctattatccaacttaaatgggtattcactatttgcacttacaggtccttcgaactcgcctccgacaagccccgatggccgacggccgacagaaatacacgggcgtgctgcagagcctccgattaatggtcaaggtggaagggtttgtcgctctgtacggtggtctgaccgcgcatatgatccggacggttccctcggctgcgatcacgctgggaacgtatgagctggtgctcaagctactgagc

SEQ ID NO: 36887 - DNA, 902 bp, Aspergillus nidulans
attgccgccgctatcgatgaccgtaccaaggccgtctacgtcgagacaataggaaaccctcgctacaatgtgcccgactttgaggtcattgcaaaagtagcccatgagaagggaattccccttgtggtaagtttcccgttgtatggggagtatcgttagctcaccttaacccaggttgacaacaccttcggtgccggaggctactttgttcgacccattgaacatggcgccgacattgtcgtgcacagtgcaactaaatggattggaggtcatggcacaaccatcggaggcgttgtcgtggacagcggcaaattcgactggggcaagaacgccgcgcggtttcctcagttcacgcagccttctgaaggttaccacgggttgaacttctgggagaccttcggccccattgccttcgcgattcgtgtccgggtcgaaatcctgcgcgacctcgggtccgcgctgaacccttttgccgcgcagcagctcatcctgggtctggaaaccctaagcttgcgcgctgagcgtcatgcttccaacgctctggccctcgccaactggctaaagaagaatgatcacgtcagctgggtttcttacgtgggcctagaagagcactccagccacgaagttgcaaagaagtacctcaagcgtgggttcggcggtgtcctatcctttggtgtcaagggtgaggcagccgtcggtagccaggttgtcgacaactttaagctcatctccaatctagcaaagtaagtctggttgcagagcttctataagaggacaaaccaagagctaaccgatctacagtgttggagactccaagaccctcgcgattcaccctggagcaccactcacgagcagttgaccgaccaggagcgaatcgattctggtgttacggaagatgccat

SEQ ID NO: 36888 - DNA, 961 bp, Aspergillus nidulans
atgtcccctcccaccgtcaaactcaacagcggctacgacatgcccctcgtaggcttcggcctatggaaggttaacaacgatacctgcgcagaccaagtctacgaggctatcaaggctggatacccgtctgtttgacggcgcgtgcggtacaccccctcaaaatagcccaatccaagtcagtgaataacaacagctaacgcgtggtagactacggcaacgaagttgaggctgggcagggcgtcgcccgtgccatcaaagagggcatcgtgaaacgctcggatctcttcatcgtctccaagctctggaacagcttccacgatggcgagcgcgtcgagcctatcgcgcgcaagcagctgtccgactggggaatcgactacttcgacctgtacatcgtgcacttccccgtctcgctgaaatacgttgaccccgaagtccgctacccacccggctgggagaacgccgaggggaaagtcgaattgggtaaggcgactatccaggagacgtggacagcaatggagagtcttggtgatagggtcttgcgcggagtattggaatcagtaacttcagcgcgcagttgctgctggatctactccgatatgcgcggatccggcctgcgacgctgcaaatcgagcaccacccataccttacgcaggagcggcttgtgacatttgcgcagcgcgagggaattgctgttacagcgtactcgtcgtttgggcctttgagtttcctggaattgtcggtgaaacaggcggaaggagcaccaccgctttttgagcacccagtcatcaaggatatcgcagagaagcacgggaagactcccgcgcaggtgctgttgaggtgggcgacacagaggggaatcgcggtgatcccgaagagtaacaacccggcaaggctgctgcaaaacctggatgttgttgggttcgatcacgaagatggggagcagaaggctatagtgacggga

SEQ ID NO: 36889 - DNA, 833 bp, Aspergillus nidulans
tacagctctatggccggcaaactcgaccagaagctgcttcaagccctcaacgtgctgggcttcgagtacatgtcgcccgtgcagcagcgagtcctcacagagcttcccacatggcgcaggactgtctcgtgcaggcaaaaacaggcaccggtaaaactgtggcttttttgctgcctgctttgcattgcttaatacaaggccagagccaggtcaggagagggcaagtggcgatcctcatcatcacgccaaccagagagctcgcacagcagatcgccaagtcatgcgatgagcttacctcacagctttcaagaccgctggaatgtcatattgctgttggtgggaccgcgcgagcgtccgcgcactcgcggttcatgaacggggacccgtccattcttgtagctacacctgggcggctgaaggattacctctctgagtctgagactgcagagaagctcaaggatatccagaccctcgttctggatgaagcggacacgatgctcgagaccgggttcctggcggacgtcaagcagatcctcaagctgatcccgtcaaagagcaccggttggcaaggtatgtgcttctcagccactctaccaccaaaggtcaaggatgtggtcagcgttgtcttgaatccagggtacaccagcatttcgacagtggacaagaacgaaccgcccacccacgagcgcgtgcctcagtactatgtccttatgccctccgtagccgaaacattcacgaccctctcctccctcttggcccacgagtccaagaagaataccaagatcatcgtcttcggcgtcacagccaacatggtcgagctttctcacagcgcc

SEQ ID NO: 36890 - DNA, 1773 bp, Aspergillus nidulans
tatgtcggatgaaaaaccagggacgacaggttccttattcactctggcagcgctatacttcggaatgcctcggtaagccgtctaccaaatccacggaaagagaacagtcaaagagatcagcgcgtgtactctacagagactctgcagcaatcttcagacgagtcacttgccggtgtcgacaacagagctcactgcatcgttcggttgggaatcaaggcaaattttcgaacagcaagatgtccaagagctatcacgaaaactgatgcagagacttgaggagaaaatgaaaggaactccagcggaaaaggcccttcccgaatgattagtagggaaatcaaaaacatacatttcatgtgtcaatgttgactatgagtcttcacgggtgcaagatttctgggatatccagctcaacgtgaggaacaacaagactcttgatgacagtttccgcgactatattcaggtggaaagacttgaaggagacaacaaatatgatgcaggggcgccgtacggcttgcaggatgccgacaagggcgaaatattcgagagcttcccgcccgtgctgcacttacacctgaaacgttttgaatacgacattcagcgagacgccatgatgaagattaatgatcgccacgcattcccaatggagtttgatgccgctccctatctgtccaaggacgccgatagatccgaatcgtgggtctatcaattacatggtgttttggtccacagcggtgatctgaacgcgggccactactttgccttcttgaaacctacgaaagatgggttctggtaccgttttgatgacgaccgagtaacccgagcgacagagaaggaagtgctcgaagagaactatggtggtgagtatgagttgcccaacggtgcagtcggagtaagacaaccctacacccgaggactgtcaaccaaacggtcgacgaacgcatacatgttggtctatgtccgcaaatccagggtggatgatgttcttgttcccataacaaaagacgatgtgccatcccacattggtatgcacaagctcctgtgtctttagtatttgctgttaatgtgcctatagaaaaacgccttgtggaggagcgtgccgagatcgcccgtcggagaaaggagaaagaggaggcgcacttgtacacgacggttggggtgctgtctgaggagaccttcaggtgccatcatggttttgacctgactagctacgatccaccggttgtggaggaggcacttccaaaacagtaccggattttgaagactacgactgttggcgaatttgccgaaaagatcgcggaagagaaagggctcaacccgctccaacttcgattctgggtcatggtcaatcgccagaataagacaatgcggccggatcaggtcatccaggatcccgaaatgaccatggatgaggcgtacagcagatatgccaccaagggacacgtgttccgagtatggctagaggtcgcacaaccatctcccgatggaaccgtttcatggccggatagctcaacctcggtgcttattttcttgaagaactttgacgtaccaacccaaaccctgacaggagtcggtgcaacatacgtgcgcaagagtcagaaggttggggagctcgggtcgacaatactcgatctgatgaactggccggcccggaccgagtttgtcctttatgaggagattaaacacaccatgatcgatctcatgaagccccagcaaacgtttcagcagtcagagatccaagatggggacattatcacatccaaaaggtgttcagga

SEQ ID NO: 36891 - DNA, 1547 bp, Aspergillus nidulans
gttcctactgccgggctgataccgcgcttaccctacgttccgtgcacaatgagaacgtccgtcgcgaaatctatcaggctacacgtactgctagctcacggcagattcagcgcctggagcagttgcttgccaagcgcacagaactagctcagctcgcaggtttcgagacttttgcacatatgaccctcaatgacaagatggccagaagccctgcagcagtatccgaattcctgaccactctcatcacaagtaaccgcccggatgtgcaagaagaactagcccagctacaggcgcaaaaggggagtgagctacagccttgggaccacgcatattacgttcaccagcgggtacgacagtatgaaacgtctcagaagactcgcaggtcacgcgagttggctgctatccctgagttcttctctctcggaaccgtaatgcagggattgtctcgtctatttgatcgcctttatggcgttcgtttagtaccccgtgaagctgctcctggcgagacgtggacacctgatgttcggcgcttggatgtagtagatgaggcggaccgcccagtagccgtcatttactgtgatttgttctctcggcctaacaaacaccctaatccagcccactttactctgcgatgcgcgagagagattactcaagaggaaattgcggagtcggcagcgatggacgcttccgcggttgtcgctcacccgaacgatggaatggcgacggctgtcgattcagaatccaagacgctccgtcagctaccgaccatcgctcttgtgtgcgacttccctgagccttcgtcttgcacaccatcgcttttaagcgaacacagcgtgcgcacgctcttccacgagatgggccacgcactgcactccattctgggccagacgcagttacaatccatctcgggtacgcggtgcgtaaccgactttgccgaactgccatcggtcctgatggaacgtttcgcgacggacccgtccgtgctagccctctacgcccgccactggcaaaccgaccaaccgctctctgaaaccatgatccaccacatggcccaggatcgggccgcgcacggcgccatctacggcgccgtcgagaacgaggcccaaatcctcatggcgctcgtcgaccaagcctaccacaccaccaagaccgggaactccttcctcgacaccacaaaactttaccagcaggtctactcaaggcacgccagcctcccagaccccgtagacgaacacggccgcccttcaacttcctggcagggattcttcggtcacctgtacggatacggcgccacatactacagctacatcttcgaccgcgcaatcgcgaacaagctctgggaagacgtgtttggcgctggagctgcggctgttgaccgctctgccggagagcggtacaagaacgaggtcctgcggtggggcgggggacgcaacggctgggaatgcgttgctggtgttctggggccgcagaatctgtccaatgccaacggtcgccttgtcgaaggaggggatgaggccatgcgtgaagttggacggtggggactcggc

SEQ ID NO: 36892 - DNA, 1395 bp, Aspergillus nidulans
ggcgcatatcaactctgggctgaccgagtaggcgacgacagctacacttgggacaattggctgcctttcttcaagaaaagcgtgcagttctcaggcccactgacgaaccctcgccccgccaacgcaacggcctcgaatgacgtctcagcatttgcagcaactgcagaagaagaggggcccgtccaggttgcgtatccgtaccttacgaacgccatttcgtcgtgggtagacaaggccctcgaaaagatggggtttcctgaagcccagggattctccaacggccagctgctgggccgctcatacatcacgcatactattcatcctaagactcgtcgacgggatactgcgtctacctcgtacttgcagacggcccttcggacgagtaatagtctgaatgtgattacacatactctggtgaagaagatcgactttgacgaggagaagcgagcgacaggcgtcgttgtcaataccggcgggttcgagtggcagattggcgcaaagaaggaagtcatcctgtcggcaggagtaatgagatctcctcagctgctgatggtctctgggcttggccctagagagacactcgagaagctggacattcccgtcctgtctgatctccctggcgtcgggcagaacatgcaggacaccatcatcctgggccccacgaaccctgtgaaagtcgagagccacagccagttgatgggcagcaaggagactcttcctcgctcgatctacgaatacaacaacttccgcacaggcttgctcaccaacccggggcaagactactttgccttcgaaaagcaccagccaggaaaccttagcgaggcgactgctgccgatatcgacaaggcctttccggctgattggccgaccttctcatatattgcgctggatgacacatttgtgcctcagtatgacggcaagaactacttcagtatgtcggctgcgctgctggccacgtttagccggggcaccgtcaccatcaacaccaccaacacggccgacaaccccgtcgtggacccgcggtggctggacgacccgcgcgacaaggagatggctgtggcagcgtttcgccgatgccgcgagattgtcgcctcagagacgatgcagcaagtcattgacggacccgagctgctgccggggttcgagtatcagaccgacgaggagatcctaaactacatcgccgagacttcggacgcgtactatgcgggagtcggcacatgtgccatgggaaaaccggatgatccgcttgcggtgctcgactcaaaggcaagggttaggggcgttaaaggactcagagttgtcgacgcgtctgcatttccgactgcaattgacggccagcccatggcgactgtctatgcattagcagagaaggttgccgctgatattattgctgga

SEQ ID NO: 36893 - DNA, 1362 bp, Aspergillus nidulans
ccacacaatcagcctgaggaggccgttgatgagaccgagttcgttgatgaccaccaccatgctcatcaccgggactccgtccaccaccgtctgcgggccaattcggccatcatgcagttccagaagatcctcgtcgccaatcgtggtgagattcctattcgtatcttccgaacagcccatgagctatcccttcagaccgtcgccatcttctcccacgaggaccgactttcaatgcaccgccagaaggctgacgaggcctatatgattggaaagcggggccaatatactcccgttggtgcatacctggcaattgacgagattgtcaagatcgccctggaacatggggtgcatttgatccaccctggttatggtttcttgtcagagaacgcagagttcgctcggaaggtcgaacaatcggggatggtctttgttgggccgacccctgagacgattgagggactgggtgacaaggtctccgccaggagactggccatcaaggccaatgtcccggttgttcccggtactgagggtcctgttgagcgattcgaggaagtcaaggcgtttactgacacctacggcttccccatcatcatcaaggccgccttcggtggtggtggccgtggtatgcgtgttgtccgtaaccaggccgatctgcgtgactcttttgagcgtgctacttcagaggctcgctcagctttcggtaacggcacagtcttcgtcgagcgtttccttgacaagcccaagcacatcgaggtgcagttattgggtgacaaccacggcaacgtcgtccacctcttcgagcgtgactgctctgtccaacgtcgtcatcagaaagttgttgaaatcgcgcccgcaaaggatctccctcaaaacgtccgggacagcatccttgcagacgctgttaagctggctaaatccgtcaactaccgcaacgccggtactgccgagttcttggtcgaccagcaaaaccgctactacttcatcgaaatcaacccccgtatccaagtcgagcacaccatcacagaggaaatcaccggcattgatatcgttgctgctcagatccagattgccgctggtgctactctcgagcagctcggcctgacccaggaccgtatctccacccgcggtttcgctatccagtgccgtatcaccaccgaggaccccgctaagggattctctccggacactggtaagattgaggtgtaccgttccgccggtggtaacggtgtccgtcttgacggtggtaacggtttcgctggtgccatcattactccccactatgattccatgctggtcaagtgcacttgccgtggttccacttatgagatagcgcgcaacaaggtcgtgcgtgccttggtcgag

SEQ ID NO: 36894 - DNA, 1365 bp, Aspergillus nidulans
atgtctaccgaggataatcacgattcgcaaattttgacggcaagacatcgctcggacgccagcgagcagtcgttcaaatccctgttcggcggcccatcgagtgaagacggaaaagagacggagcccgatacccacgatcataaccatagcttcagcaacgcaaaggcgcccgcaaagtttgcaaaccagaatgtcgcacccttcctcgccagacacatccctgaacaatatgcacccttaggtgctcagtcgattctaccagcagatctcagcagcgcaaactccaaatactgttatcgccatcgcccagatcagaaatgtagacggcaagccgacgagccatctatggataagctacagcgggtgagtaaccccgcttcactcaatggtggttgtgtgctaattagtaggaactggaatcgcttcctcaaggtgatcagcagagcatatcacatgtctggtccttgttctctgctgcgcctgccaaacatcggaaactcattctgcagggaatcatggctcaatgctgtttcccgcaactctcttacatctccgccaccgtccgtgacctcatccgaatcgatttcatcaccgcgctccctcccgagattgctttcaaaatcctttgctatctggatacaacctctctgtgcaaggcttcccaggtctcgcgcggatggcgtgcgctagccgatgatgatgtagtttggcacagaatgtgtgaacaacatattcatcgcaagtgcaaaaagtgtggttgggcttaccgcttctggatcgcaaacgattgcgtgagtcgaagcgtgagattgaacttcgtgctacaacgtgggacaagggagtggtgggcccacgatcccctgatgcttcggcagagtcacctccttcgggcaaacgaaagcttgaggatgacgaggttgctgttgttaagcggcactgttcatcgctcgggtcagacgcaggagtcgacaaagatagtgatttcttcaagacccgctaccggccatggaaggaagtgtacaaagatcgcttcaaggtcggcacgaactggaaatacgggcgatgctcgatcaaaccatttatgggacatactaacgggctcatgagtctgcaattcgaggataacactcttgccagtggctcctacgacactacaaccaaaatctgggacactgaaaccgtagagggagctgcgcacactccatggacacgagtctcgggtccggtgcttacagtatgactacaccaagttgatcagcggcgagatggaccgcactatcaaggtctggaactggcgcactgatagagagcgattacacatatactggtaccaggggggattcatagagcttgatatgatgattc

SEQ ID NO: 36895 - DNA, 681 bp, Aspergillus nidulans
tggcgttcacagtttatctcatcccgcggcaacgaatacttttgtgagatcgacgaagaatacctgaccgaccgcttcaaccttaccggcttgaacaccgaggttccctactatcagtacgcgctcgatctggtgacggatgttttcgacctcgatgccgacgacgacctccgagaacaaattgagaaatcggcgcgccacttgtatggccttgtccatgctcgctacattgtcaccacccgtggcctcgcgaagatggtacgtatcgagtgtcactttttgaggtgttactgacgaattcgtcattaggtcgagaaatacaagaaaggcgactttggaaagtgcccacgcgttatgtgtgaaggccaccctctcctcccgaccggtcaaaatgatgtgcccaacatgagcaccgtccgcctctactgctccaagtgcgaggacatctacaaccccaaatcgtcgcgacatgcatcgattgacggcgcatatttcggaacctcttttactagcatgctctttcaggtataccctgctctcctgccggagaagagcatccgccgctacgagccccgcatatacggtttccgtgtccacgctagtgctgctcttgcgcgctggcaggaccgctaccgcgaagagaccaggaaccgacttcgcgatgctggggtggaggttaga

SEQ ID NO: 36896 - DNA, 683 bp, Aspergillus nidulans
gaggaagctactgcgctgaaggtgcagggtaacaaggcctttgctcagcatgagtggcccactgctgtagatttttacacccaggcgatcgagaaatatgacaaagaaccgtcattcttcagtaaccgggctcaggtacgttgcgatattttcagtcccgccggagtcttcatggcgccataatcatggctaatattgtgattacatgactgtagtgccatatcaaactcgaagcatatggattcgcggttgcggacgccacgaaggcactggagctggatccgaactacatcaaggcgtactggcgacgagccttggcaaacagtgcgattctgaactatcgcgatgcgatgcgagatttcaaagccgttgtgaagcgcgaaccgggtaaccgcgatgcgaagttaaaattggcggagtgcgagaagctggtgcgccggttggaatttgagaaggctattgaggttgcagacccgccgtcggcttttgagagtttggatattgacgctattgctgtggatgatggatatgacggtgtgagactggggtcggagatgacgcaggagttcatcgacgacatgattgagcggttcaagaacgggaagaaaattcaccggaagtatgcgttccagattgtcaaggctgtgaaagaaattgtctatgccgagccgacgatggttgag

SEQ ID NO: 36897 - DNA, 570 bp, Aspergillus nidulans
tatcactgcgacataacagacctccacgaattaaaggctactgcatcgaaaatcctagacgagcacggtcccgtgcacgtgctcattaacaacgcggccgcaacaggctcactagcacgccaggccagtctagatgtcacacctgaaacctgggattttaacgtgaacgcaaaccttcgacacatcttcttcctcacacagtgcttcattccatctatgaaaagctctggtggcggaagcatcgtaaatctcggctcgattagctggcggattcctgaagcaacgacgcccatatatgggacatgcaaggcggctattaacggcttgacgcgtatccacagcagggagttcggtactcacaatatccgcgttaattgtgttatgccgggcgctattgcgacagatagacagagggcagaagtactcacggaagagtaccggacgcatgtgtttgcccagcagagtctgaagagggacttggagccggaggatgtggccaaggtcattgtttttctcgggagtgaagaagcgagtggagttacggggagttgctatgtcgttgatggggga

SEQ ID NO: 36898 - DNA, 854 bp, Aspergillus nidulans
atgatgttcagccgatttttcaaggcggtccccgccagggctccggccttttcatcccctttgcctgtctaccaggctcgcactatggctactgtccggaaccagaggcccgttgaaagggcaaccttcacgatccgagatggtcctatcttccacggaaaatctttcggtgcccgtaccaccatttccggtgaggcggtcttcaccacgtctttggtcggatatcccgaatctttgaccgacccctcctaccggggccagattctggttttcacccagcctttgattggaaactacggtgttccgtccaccgagagggaccgccatggtcttctcaagtactttgagtcgcccaatctccaggccgctggtgtcgtcgttgccgacgttgcggagcagtactctcactggaccgctgtacagagtcttggtgaatggtgcgcccgcgagggtgttcctgctatctctggcgtcgacactcgtgccattgtcacttacctccgcgagcagggttcctcccttgctcgtatcacagtgggtgaggagtatgatgctgatcaggatgaggctttcaccgatcctgaacagatccaccttgtccgtcaggtcagcaccaaggctcccttccacgtgagcgcagccgatcctcagtgtcatgttgccgtccttgactgcggtgtcaaggagaacatcctgcgtacgctggttagccgcggtgctagcattacggtgttcccttcgattatccatccacaaggtcgctcaccacttcgatggcgtcttcatttccaacggccccggtgaccccacccactgccaggacaccacctaccaccttcgccgcctgatggaga

SEQ ID NO: 36899 - DNA, 1794 bp, Aspergillus nidulans
gagtacagtacaatagaccggtcaaaagggatcacgacagcgctgatggaaaagggtaaaaacctcatcacaccacagcggcaattctccataaggaaatcatcagcacaaccggaaccccagcaagcatcgatcatacgaaccttcacaggcgggctaaaccagctagagcagcagctggctgatgatcctcttcagaagcgccgtatccgtcttgctcaccgcgccttcctacggcactccttcaaccgactggactttgtcgcggtgcttgcatattgggtgagcttcgtcttaaacttaggaggcgtcgagaatacgcaccagctctacgttttccgaatgctcagctgtctgcgtatcctgcgtcttctcgcgttgactagtggaacatctgtaggctatcacgccagcgtcttgcaccttatttactgacttgaatcaaggttatccttcgaagtttgaagaaagctgctcccttgctggtccacgttgcttttctaataggtttcttttggcttttgtttgccattgtagggattcagagtttcaagtcgagtttccggagaacatgcgtctggcttggagaggaatacggcgagcaaaacttcaccatgaatgatccgttcgggacacttcagttctgtggtggctggcttgatgaaacaggcactcagaggccatggtattcttccgatggatttgaaagcgactcgaaacccaaagggtttatttgtcctcaaggatcgatatgtgtcgaaggaggcaatccttacaatacgaccatgagtttcgatgacatcttgcattcgctcgaactcgtatttgtcataatgagctccaacaccttcactgatatcctctataacaccactgacagcgattaccttgtagctgcacttttcttcgcctgcggctttgtgattttgagtttgtggatggtgaatctgttggttgctgttataacccactctttccaggtcattcgtgaagaaagcaagcgaagcgccttttgcatctcaaaagattgaggcgtccgaggaggaggaggagtcttcccgcaaagttagcacgttgaagcgcatctatgacgcgacgtattggttctggattgccgtcatcattttcgaccttgttatgcaagcccagaggagctctagcatgggtgatggtcgggtccagctcattgacaattgcgagattgtcgtcacagttgctttactcggcgagattttactgcgattcatatcggattggcgcaaattccatcagagccgccgcaactgggtcgatttggcacttgcaataatcacctgcatcattcaagttcctgctattaggaactctaaacgaacttatgatatccttaccgtctttcaaatcctccgattctatcgagtcgttctagcatttgccgtcacaaggaatctcatcacgctcgtctttcgcaatgccgttggtctactgaacctgatcctctttgtgtttctcatcacattcctcgcctctatatttgcaacgcaactcttccgcagtcagattccgcgagaggatgacgacggaggtacgattgagatcactttctctgacctatacaactcattccttggaatgtatataatactatccagcgagaactggacagaaaccctttacaacgtcacctcatacacatacagcttcaatacggcctggatctcagcaacatttgtgattttgtggtttattgtggccaactttatcgttctgaatatgttcattgcagtcatccaggaaagtctcgacgtattaaag

SEQ ID NO: 36900 - DNA, 666 bp, Aspergillus nidulans
gttcgtggagacgaagtccattgggacgatattgccgggttagagggcgcaaaaaaggcattgaaagaatccgtggtatacccattcctccgaccagacctcttctccgggctccgtgaaccagctcgaggtatgttactcttcggacctccaggaactggaaagacgatgcttgcacgggcagttgcgacggagtccaagtcaacatttttctctgtatcagcatcgacgctcacatcaaaatggcatggcgagagtgaaaagcttgtgcgagctttgttcggcctggcaaagtcattagcaccctccataatcttcgttgacgaaattgactcgctcctttcatcgcgttcgtcagggacggagaatgaggcgtcgcgccgatcaaaaaccgaatttctcattcaatggtctgacctccagcgtgccgcagctgggcgcgagcaaccagtaaagtcgggtgacgccagccgtgttctcgttctagcagccacgaacatgccgtgggatattgacgaagccgcgcgccgccgctttgtccgccgccagtacatacctcttccggagcatcatgttcgggaacagcaactgcgcagattactgagccatcaagtacatgaccttagtgacgaggatattgaggttctcgttcatgttacagaaggt

SEQ ID NO: 36901 - DNA, 910 bp, Aspergillus nidulans
cttgcagatggccgtcgctttacagcgcgaaaggaagtcatcctggcagctggagcactgcgtacgccccagcttctaatggtgtccggaatcgggccaggggacaccctggccaagcacgggatttcgtctgtcgttgaggcacccgaggttggcaggaacctcatcgaccattttgcgctctatcagttgtacaagctgcgcgagccagaacgtggcattgcgctagggagctccaagctactctcacccagctcttacccaaggctttcccgttgactgggccgtcaaccaaagagtcccccgggatgtgcttgacccggccgtgcagaaggacaaggaacgatttggttcaagcaccgatgaatcggtcttgatcccgggtcgacctcttgtcgagacattgattctgtacgccccgatcggcatgcccaccgatggcagcctcctcatgacgtcggtcatgctcctctccgcaacgtctcgtggcaccgtcagtatcagctcagcctcgccgagcgatccgcccctcgtcgattccaactactacgatacggaaacagaccgggcagtgcttacttacggttctcgccgtacagcaaaagctctgttggaaacctcagctctcaaaaattacgtggaatgcgaggtgcccccaccggacatgccagctctgacgtcgcagtcctctgacgaggagttcgacgctcgtattagagctacgggaatggctcatcaccatcctgcgggcacagccgccatgggtaaggttgtcgacacggagctgcgcgtgattggggttcggaatctgcgggtggtggacgctagtatccttcccgtcagcatagggggtcatccgcaggcgactttatacgccgttgcggagcaagctgcagatcttatcctgcag

SEQ ID NO: 36902 - DNA, 1733 bp, Aspergillus nidulans
  unsure (1)..(1733): unsure at all n locations
atgcatccatggttttcctggatattctggatcaatccattggcttacggctacgaggcgatccttagcaacgagtttcacgggcagctaataccttgtgtcaacaacaatttggttccgaacggccctggctacaccaattcagaattccaggcgtgcacaggaattcgcggtgtccccgcgggtgcttctgtcatcactggcgatcagtacctgcaagggctgtcatatagccatgctcacgtctggcgcaacttcggcatcatgtgggcgtggtgggtcttattcgtcattctgactgtctacttcacaagcaactggagccaagtgtctggaaacagtggctacttggtcattcctcgtgaaaaggcaaagaagacgaagcatctcacaatggacgaggaagctcagcctggacttgacttgcacgactcgagccatcgaggtggaacttctcccatcgatgatgagaagggaagccatacaaatagttcctctaaagtcgatgctcagcttatacgcaacacatccatctttacgtggaagggtctctcgtataccgtgaagacaccatcaggcgatcgcgtcctcctagacaatgttcagggttgggtcaagcccggcatgctgtgcgccttgatgggttcttcaggagcaggcaagacaactctgttagatgtgcttgcccagcgtaagacagaaggtacaattaggggaagcatcttggttgatgggagagacctccccgtctccttccagcgctctgcagggtactgtgagcaactcgacgtccacgagccactttccaccgttcgagaggccttggagttttcggctttgttgagacagagcagagacacgccagtagtacaaaagttgaagtatgtcgacactattatcgatcttttggaaatgcacgacattgagaatactcttattggcacaactgctgctggcctctcagtggagcaacgcaagcggcttactatcggcgttgagcttgtttctaagcccagcatcttgattttcctcgatgagccctccagtggattggatggacaggctgcgttcaacattgttcgttttcttcggaaacttgcagacgtcggacaggctgtccttgtcaccatccatcagccctcagcttccctgtttgctcagttcgacacactacttctgttagccaagggtggcaaaactgtagttttccttcctgtccgtggagaaatatgctaacgcgtgcgctcaggtatactttggtgatattggtcataacggcgcaactgtcaaggagtacttcggccgtaatggagctccttgccctcagaataccaacccggctgagcacatgattgatgtcgtctccggaagtctcagcgtagggaaggactggaatgaagtctggctcaccagcccagagtacactgcgatgacccaggagcttgaccgtattatcatggaggccgcatcgaaacccccgggcacccttgacgacggtcacgaattcgcaacgcctatctggacgcaattaaagctcgtcacgaaccggaacaatgcttcactctggcgtaacacggattacatcaacaacaaattcatgcttcacgtcatctcaggcctcttaaatggctttttcttttgggaaactaggcaactcagtcgccgatctacagatgcgcctttttaccatctntaacttcatcttcgtcgcaccaggagtcatggcccagcta

SEQ ID NO: 36903 - DNA, 1005 bp, Aspergillus nidulans
aacgccaacgataacatcacttcgtttgagcctccagccgagtgcgctctcccttcgccgatgccctcttccacaacaagacaagatgtttcgtatagtgagtggaatgcgatcctgggtagtcaattgcataaactgacggcaatcatagcggtatgcagccccgggctgtccagggtatgctggatttcgacttcatctgcaagcgttccactccttccgttgccggtatcatctacacattcggcggtcaattcgtcagcaagatgtaggttgcatatacaaggatcgatgctggttcatacagctgacaatatgtccgtaggtactggggtaccagtgaaaccctcctccctgtttaccaggacaccgcaaaggccatggccaagcaccccgacgttgacaccgttgtcaacttcgcctcttcccgttccgtctacagctctactatggagctgatgcagtaccctcagatcaaatgcattgccatcattgcagagggtgttccagaaagggtatgtgagctgtgtgctgcacaattgaagagacctcggcgctaacatgaaaacagcgagctcgtgaaatccttgtcaccgctaaggagaagggcatcaccatcattggacctgctacagtcggtggtatcaagcctggcgctttcaaaattggtaacactggtggtatgatggacaacattgtcgcttccaagctctaccgcaagggatccgttggttatgtgtccaagtctggtggaatgtccaacgaattgaacaacatcatctcccaaactactgacggtgtttacgagggtgttgctattggaggtgaccgttaccccggtactactttcatcgaccacctccttcgttaccaagccgagcctgagtgcaagatccttgttctgctcggtgaggttggtggtgttgagaaataccgtgtcattgaggctgtcaagaacggtgtgatcaccaaacccatcgtcgcctgggccatcggtacttgcgc

SEQ ID NO: 36904 - DNA, 1049 bp, Aspergillus nidulans
gcttccgctcctactgtcggtggcggctctcccgtgagcggctctcctaaaggtggcctggcggcgaaacgcatgaagcccggactcaaactatcagatgctactggaccaagcaatccggcagctggaggtcagtccccgccggtggaccgattggaggtggagagtcagctttcagcaagtattcggagtacattgacacgaaatcgggaaccctgaagttcaagaacaaagccgtcctccacggaggcgggatcgagttctcgtccggccaaagtttcagcatctctctagatgaagtggatcgtatggatgaattgggcaagggaaattacggaactgtatacaaggttcggcatagccgcccgcacatgcgcaaacctggacaaggcttgagtgggattgtcagcagacctcaagggtctgacggttcagataccgaattgaagccgcaagattccctgactggcgccgtcatggctatgaaggagattcggctggagttggacgagagcaagtttgcgcaaatcatcatggagttggacatcctccaccgatgtgtttcaccgttcattatcgacttctacggtgccttcttccaggaaggtgctgtgtacatttgcgttgaattcatggatggcggctccgttgacaagctttacggcgatggtatacccgagaacattcttcgcaaagtggcgctttctactgttatggggttaaagtctctcaaggatgatcataacatcatccacagagatgtgaaacccacgaacattcttgttaacacacgaggtcaggttaaaatttgtgactttggagttagcggaaatttggttgccagtatcgccaagacgaacataggctgccagagctacatggcacctgagcgcattgcaggaggtggagtgcagcagtcaggggcctctggcggcacctacagtgtccaaagtgacatatggagcttgggattgtccattcttgaatgcgccatcggccggtacccttaccacccagaaacttacaaaaacatcttcagtcagctacat

SEQ ID NO: 36905 - DNA, 1736 bp, Aspergillus nidulans
ctgcagcaggagtcaatcaacacgttttcaagctcgagcaagaagaatatgtgcgagagcagatagactggacctttattgacttctcagacaatcaaccgtgcatcgatctcattgaagcaaagttggggattctttctcttttggacgaagaatctagactgcccatgggttctgatgaacaatttgttactaagctccatcataacttcgctgctgataagcagaagttctacaagaaacctagattcggaaagtctgcattcacaatatgccattatgcggtcgacgtgacctacgagtcagacggctttattgagaaaaaccgggacaccgtcccagacgagcatatggaaatcttgcgcaattcgtccaacaactttgtgaaagagatcctggatactgctgcctctgtgcgtgaaaaagattcagccgccgtctcatctaagccagtcaccgctccagggcggaagattggagtggcaattaaccgcaagccaacattaggtgggatcttcaaatcatccttgattgagctcatgagcactataaattctactgatgtacactatatccgatgtatcaagcctaacgaagcgaaagaggcgtgggtatttgagggcccaatggtcctaaatcagttaagggcttgtggtgtcctagagaccgttcgtatcagtacagccgggtaccctacacgatggacttacgaggagttcgcgatccgttattacatgctttgccactcatcacagtggacttcggaaattaaagatatgtgccatgctattctaagaaaggcgcttggtgatgccactcagcaaaagcatgacaagtaccaactgggcctgagcaagatcttctttcgggctggcatgctcgcattcctggaaaaccttcggacttcaaggttaaatgagtgtgcgatcatgatacaaaagaccctacggtgcaagtactatcgacgcaggtatcttgaggcgcgcttgtcagtcctcgccacccagtcgttagtcagaggattcctcgctaggcagcgcgcagccgaaatacgtcgcatcaaagctgccacaactattcaaagggtgtggaggggtcagaaagaaagaaagagatataatcagattcgcgataatgtcatccttctccagtcgctgtcaaagggcttcctttgtcggcgcaacattttgaactcgattcatggcaatgcagcgaaaaccatacaacgtgctttccgttcttggcgccaactgcgtgcatggcggcaataccgccgacaagttattattgttcagaatctttggagaggcaaaaaagcgagacgggagtataaggtcctgagggaagaggccagagacctgaaacagatttcgtacaagttggaaaataaagtggtcgaattaacgcagtacctggaatcactgaaacgcgagaacaagtctctcaattcccagctcgagaattatgagactcaactcaaatcctggaggagtcgtcataacgccttggagaaccggtctagagaactccaagccgaggccaaccaagcgggcatcactgctgctcggctcacggctctggaagaagaaatgagcatattgcagcagaaccatgctgatggacaagccactattaagcgccttcaggaagaagaaagaatctcccgagactcgatacgttctgcaaaccaggaactggaaaagctcaagcaactcaatgcagaaactaagagtgag

SEQ ID NO: 36906 - DNA, 960 bp, Aspergillus nidulans
accgtggcttcctcaatgtcgttgagattaattaactcttgtcaggacgcacatgacatcgcccaagcgcatctcgatgacgaaagggcgaaattaacgggttttgacgacgagctacgggaccttgaacaaacgatgcagtccaagaactctcagatcactgaggagggcttggaaatgcagaaacttgggcatcagttggaaaaattacagaaagagcagaacgccgccgagcaggcagtagcccaccttgaggcagagcacgagtggattgcggacgagaaggacaattttgggcgcccaaacacggtatacgacttcaagaaccagaacatagccgagtgcaaggctacactgcgcaacgtcacggaacggttccagggcatgaagaagaagatcaaccctaaggtcatgaacatgattgacagtgttgaaaagaaggaagcggccttgaagaacatgatgagaactgtcattcgtgacaagagcaagattgaggagaccatcatcaacctgaacgagtataagaaggaagctctccacaagacgtggactaaggtcaacgctgattttggccaaatcttctcggagctcctgcccggcagtttcgccaagttggaccctcctgaaggcaaggatattaccgacggtctcgaagtcaaggtgtctttgggtaaagtgtggaagcagagcttgacggaattgagtggtggtcaacgatcgctcattgccctctctctgatcatggctctcctgcagttcaagcccgcaccaatgtacattctcgacgaggttgatgctgcgctggacttgtcccacacgcagaacatcggccgtttgatcaaaactcgcttcaaggggtcacaattcattgtcgtctcacttaaggatggcatgttccagaacgcgaatcggattttccggacaagattcagcgaaggtacaagtgttgtacaggct

SEQ ID NO: 36907 - DNA, 426 bp, Aspergillus nidulans
aatggtcagattcctccaaacactataagcagactctcagctctcagagttcttagtctcagagccaatctaatctccggcgagtttcctaaggatttcgttgagttgaaagatttggcctttctttatcttcaggataacaacttgtctggtcctttgccattggatttctctgtttggaagaatctcactagtgttaatctctcaaacaacgggttcaacgggacaatcccgagttcgttgtctcgtcttaagcggattcagtcgttaaatcttgctaacaatacgctttctggtgatattcctgatctgagtgtgctctctagtctgcagcacattgacttgtccaacaattatgatcttgctggaccgataccagattggcttcgaaggttcccgttctcgtcttatacaggcattgatatt

SEQ ID NO: 36908 - DNA, 532 bp, Aspergillus nidulans
aacaagaggagcctcgattatgtcttaaggagtggactcgctggagggctggctggttgtgcggtaagtttgacatctcaccgtcagacggagcagagatagctgacaagcgaacttgaaggccaagacagtggttgcgcctcttgatcgagtgaagatccttttccaagcgtcgaatcctcagttcgccaaatatacaggaagttggactggacttgtcttcgctattcgggatatcaagcggcacgaaggtgcccgaggcctgtaccgaggccactcagcaacattacttaggatttttccttacgcatccatcaagttcctcgcttatgagcagtttcgagcaatagttataccgtcacgggacaaagagactccatttcgtcgccttgtctcagggagcttggcaggcattacctccgttttcttcacgtacccgttagagttgataagggtgcggctagcgttcgagaccaagaagtcttcgcgttcatcccttgtggataccatccgacaaatctatggagagcaa

SEQ ID NO: 36909 - DNA, 880 bp, Aspergillus nidulans
gcttaccgatgccacggttacgcgatgatgcgcggtggtactatccgctcgattattggagagttgctcggtcgtcgcgagggtattgcttacggcaagggtggttctatgcacatgttcgcccccaacttctatggcggtaacggtattgtcggtgcccaggttcctgttggtgccggtcttgcctttgctcagcagtacaacgaggagaagtccaccagtgtggttctgtacggtgatggtgcttccaaccagggtcaggtctttgaggctttcaacatggccaagctctggaaccttcccgttcttttcggttgcgagagtaagtttcgcatggcatattcattttaatttccactggctaatgatcgcagacaacaagtacggtatgggtacctccgccgctcgttcctctgccttgaccgactactacaagcgtggtcagtacatccctggtatcaaggttaacggtatggatgttctcgccaccaaggctgccgtcaagtacggtaaggactatgccatctctggcaacggtcctctggtctacgagtacgtcacctaccgctacggtggtcactccatgtccgaccccggtaccacctaccgtagccgtgaggagatccagcgcatgcgcagcacccaggatcctatccagggtctcaagcagaagatccttgactggggcgtcatgagcgaggaggaccttaagggtctcgacaagagcgcccgtgctcacgtcgacgaggaggttgccattgccgagaagatgcctctgcccgagaacaactctcgcatcctgttcgaagacatctacgtccgcggcagcgagcctcgatggatgaggggtcgcactgttgacgagactttctactactag

SEQ ID NO: 36910 - DNA, 789 bp, Aspergillus nidulans
ggtgattatgtcgacccgtggctactacttctgtcgagactgtaacactccatgtttgcttgaaaatccgctatccccagcgtatcaccatcctccgcggaaaccacgagtcccgccagatcacacaggtgtacggtttctacgacgaatgcctgcgaaaatacggcaatgccaatgtctggaaatacttcaccgacctcttcgactaccttccccttaccgccctcatcgagaaccagatcttctgtctgcacggtggtctgagtccgtccattgacactctggataacatccgatctctagaccgaatccaggaggttccccacgaaggtcccatgtgcgatctgctctggagtgacccagatgatcgttgcggctggggaatatctccccgtggtgctggatacacatttggacaagatatctcagaggctttcaatcataataacggcctgacacttgttgcacgagcacaccagttggttatggagggatataactggtcacaggaccggaatgtcgttacgatcttctttggtacgttccctgggtttgtgtctgatgatgactaacggtgtgagcccctaattactgctaccgctgcggggaaccaagccgccattatgggaattcgatgaacaccctgagtatacgttgtatgtgtcccccattcagccttgacatgacagcactgactctgccagcttacaattcgacccttgcccgcgcgcaggagagcctatggtctcgagacgtaccccagactacttcctgtgattaatagtgata

SEQ ID NO: 36911 - DNA, 839 bp, Aspergillus nidulans
aggaaactacatcttggaatgtttgaaatcggaaagccactgggaaaagggaagtttggcagggtgtacctcgccaaagaacgctcatctgggttcgtatgtgcactcaaagtgttgcacaaatccgaattgcagcagggcggggttcagaagcaggtcagaagggagatcgaaattcaaagcaacctacggcacccgaatgtccttcgactgttcggacacttccaggacagtaagcgaatcttccttattttggaatttgccggtcgaggagagctgtacaagcacctacgcaaagagcaccgattccctgaatggaaggctgcgcattatatcgcgcagatggcatccgcattgaagtacctccacaagaaacatgtcatgcaccgtgacatcaaacccgagaatatcctggtagggattcacggagagatcaagatcagcgactttggctggagcgtccatgccccgaacaaccgtcggcaaacaatgtgcgggacactggattatttgcctcccgagatgctcacttcaaacccccagggcaacttctataatgagaaggtcgacttgtggagtttgggtgttctgacttatgagttcctggtcggagaggcgccattcgaagacactccggttatgacacaaaggaggattcagcgaggagatatgcaagttccttcttttgttagccccgaggctaaggatttaatcaaaagggtataccactgtcgtcattatatgcttttcattgggtgactaaccttccttagctgcttgtgcttgatcccgaaaaacgcatttcgcttgatgagatccagaggcatccctggattctt

SEQ ID NO: 36912 - DNA, 561 bp, Aspergillus nidulans
cgtcctccgccctcgtcacgtccgcccccgagcgcgcagccgctaggccttcccaacgacgatcagctctttcccctagttcgcgccgcgaacgcatcgaattccggggcacttactgagcaggagctaggatctgctctcgtgaacggcgactatacctcattccacccgaagacagtgaagatgatgatcaacatgttcgaccggaacagaagcggctcgatctcattcgatgagtttgtggcattatggcgatatttggcggcatggagggacttgttcgacagattcgacgaagaccgtagtggacgcatcagtctgcgggagtttgagaaggcgctggttacgttcgggtatagtctcagccagccgttcgtgacggtccttttcaccacatttgagaacaaggggcggcaagttggcaagcctcgagcctctggcatgagtttcgatctttttgttcaggcgtgcattagtcttcggcgtatgacggaatcgtttaagcggtacgacgatgatcgtgatgggtatatcacggtcagctttgaggagtttctaacg

SEQ ID NO: 36913 - DNA, 1035 bp, Aspergillus nidulans
agtgctgatttcggtctcatcggtctggccgttatgggccagaacctgatcctcaacgctgctgatcacggtttcactgtttgtgcctacaaccgtaccacctccaaggttgaccgtttccttgagaacgaggctaagggtaagtttgcaaatcccggcgcatccggagacttgacagagcttgagcgggaactgattggttataggcaagtctattgttggcgctcactccgtagaggaattctgctccaagctcaagcgccctcgccgtatcatgctccttgtcatggccggaaaccccgttgaccagttcatcgagtctcttctgccccacctcgaggagggtgatattatcatcgacggtggtaactcccacttccccgacagcaaccgccgcaccaagtacctgaaggagaagggcatccgcttcgtcggcagcggtgtctccggtggtgaggagggtgcccgctacggtccctctctcatgcccggtggtaacgaggaggcctggccttacatcaaggatatcttccagagcatcgccgccaagagcgatggcgaggcttgctgcgactgggtcggtgatgagggtgctggtcactacgtcaagatggtccacaatggtattgagtacggtgacatgcagctcatctgcgaggtaaggcgtgaaatttatcttaagaaaccaggctaattgttacaggcttacgacatcctcaagcgtggtgtcggcctctcctccaaggagattgccgatgttttcgccaagtggaacaacggtgttcttgactctttcctgattgaaatcactcgtgacattctctacttcaacgacgacgatggaacccccatggttgagaagatcctcgacaaggctggtcagaagggtacggcaagtggaccgccgtcaacgctctcgacctcggcatgcccgtcaccctgattggcgagtccgtcttcgctcgctgcctctctgctctcaaggacgagcgtatccggccagagcctcctcaacggcccactcccgagttcacg

SEQ ID NO: 36914 - DNA, 969 bp, Aspergillus nidulans
gagatggtgctggcggatgggagtattgtcaaagtgtccgagaacgagaatcgggacttgtttcgtggtgctgcaggcgcggttggaagcttgggtgtcacgacgctgatggagctgcagcttgtggaggcgaagaagttcgtcaaggcgacgtatctcccacagcggagtgtgcgggactctattaccaatgtccacgccgcgacgctgaacgatgcgaatgactacgttgatggaatcatatacggccccgaccacggcgttgtcgtcgccggcgagatgacgaatgagatgcccgatagcgcaaaaattcagacatttagcaaggcgtgggacccgtggtactatctacatgttaaggccaagacgcgcggcaactcgcccgtcacagactatatcccgctggcggagtatctgttccggtacgaccgaggcgggttttgggttggccgggcggcgttccactacttccatttcccgttcagccgggtgactcggtggtggctggatgacttcttgcacacgcgcatgctctataaagcgctccatgcgagtggggaatccagccgcttcgtcattcaggatctagcgctaccgtatgcaaacgccgagaaatttatcaactataccagcaataagctaggcatctggccgctctggctgtgtccgttgaaacagagtccagcgccaaccttccaccctcactcatccgtgcaaagccccggcttcaccgaagatcaaatgctcaatatcggcgtgtggggattcggcccgaaagacccggaggctttcgtgactgcgaaccgagagctagaacatcgactccgcgaactgggtgggatgaagtggttctacgcccatacgtattacggagaagacgagttctggagtatgtatgaccggaaatggtacgacgagctgcgggagaagtataacgccaccactcttccgagtgtgtatgataagatc

SEQ ID NO: 36915 - DNA, 1401 bp, Aspergillus nidulans
cgaacagagtacgaagagaaacttcaagttgttttgaaaaagccctttgaagcagacgacggcaaaaagcagacagagcgagagatccgagcgaaagagctgatctcaaccctcaagcggatctttcctggtgtcaaagggcgtgttagtgatctgtgcaagcccaaacagaaaaaatatgccgacgccgttagtactgttctgggccgtcattttgacgctattgttgtggacaacgagaagactgccaaagagtgcattcaacaccttcgtgatcagagggccggccaggctaccttcattcctctagagactattcaggttaaagctctgaactctaacctgaagggtatgcatcgcgccatgcgtcctgcaattgaaacagtggactacgacgattccgtggcaagagctattacttatgcttgtggcaatgctatcgtatgcgatgatctggcaactgccaagtacctgtgctacgagagacacgtggatgcaaaggctgtcactctggacggaaccgtgatccacaaggggggcttgatgaccggtggccgcggtccacagcaaaactccaagcgttgggaagactcggaggtagagagcctcttcaagctaaaggacaagatcatggcagacctagccaacctacctaagggtcaccgtcgaggaaccgaggaggaaactctgcagggtgaattggttggtctggagcaacgacttgcatacgctcgtgaggaactcaaagcccttgaacgaaacctgaaggataaatataccgaattggactttgtcaagaggcagctcgaggatctccggccaaagtacactgaaaagcaagaagtactcgatgagctcgatgaggccatcgctacttctcaagacgctgtcagtggtgttgaagatgagatctatagaaaattctgtaaacgtcttggttacagcaatatccgggagtacgaagtgcaacaaggttccctacacgaggaggctgcacagaagaagcttgagttcacaacccagaagagtaggattgagaatcagctcagcttcgagcaacagcggctgcaggctactaccgaccgcattgccagtctgcaggctcaacaccagcgtgatgcaaatatgattggggaacttgagtccgagcaggagagagtacggaataagcttgatgagcttaatgccgaactcgatattttgcgcgaaaagcttgaggagcagaaggagaagtatggacagtccgctgaaaatttggctcatcaccgtagagaacttcagaaacgcagcaaggaggtggaatccactctgagattcattaacggcctggaaacagagattcaacgcaactcgtctagtcgatatgctctactccggcggtgcaagctcgaggatcttgag

SEQ ID NO: 36916 - DNA, 1357 bp, Aspergillus nidulans
ccccgtagggacaactctccccagaaagctccttacggcttatatgccgaaaagctctctgggaccgctttcactgctccccggcacgagaacaaacagacttgggtctaccgtatccttcccgccgcagcgcacgagaacttcgttgaagaggatgcgagctcttaccacacgctctcagatgccaaaaagcttcagcatatccccaaccagctacggtgggatccattcgatctggacgagaccgtcgactgggttcatgggttgcaccttgtggctggttctggagaccctaccgtaaaacaaggcctgggcatcttgctgtatgcggcggggaaagatatgggaaaggaagctttctactccgcggatggcgacttcctgatcgtagcacagcatggcgtgctcgatattcagactgagcttggccgcttgctggttcggccgaacgagatttgcgtgattcctcgtggtgtaaggtttgtactacgcgctgacaaaccatatttgagatcatgagcttacggaataagataccgtgttaccctacccgacggtcctgtgagaggctacatttgcgagctctaccagggccactatcagctacccgaattaggacctattggatccaacggtcttgcgaatgcacgagactttcaagcaccagtggctgcctttgacgacgaggaaggaccgacggaataccgactgtacagcaagttcaacaaccacctcttctccgcgcgccaggatcacaccccttttgacattgtcgcatggcatggcaactactacccctacaaatatgaccttggccgcttcaacaccatgggctccgtatcattcgaccaccctgacccctccatctacacggtgctcaccggcccgtccgatcatgtgggcactgctattgctgactttgttatttttccgccgcgctggttggttgcggagaaaactttccggcctccctggtatcaccgcaatactatgtcagaattcatgggtttgatcaccggaaactatgatgcgaagactggtggcggcttccaacctgctggcgcgagtctgcacaacatcatgagtgcacatgggccggacatgcatgcattcgagggagcaagcaacgcggacctgaaacctacgaagattggggatggcagcatggctttcatgtttgaaaggtaggtcaacctgtcttttttccaagttcgaaatactaactttgcatagctccctcatggttggcgtgtcggagtggggtcttaagacatgccagaaggtgcaggaggagtataacgaacatagctggcagcccttgaagaggcacttcaaggatccaaggaaggcccagtga

SEQ ID NO: 36917 - DNA, 942 bp, Aspergillus nidulans
ctcgactactcgtacttttcgacagtgaacattgggaccccggggcagccggtatggatgatgttggatacgggaggtgcgaatacctgggtgtttggggcagactgcacgtctgaaccctgtcagatgcataatacctttggcgataattcctcatcgactgtgaaaacgacgagtgatactttcatggtgggatacgggtcgggtaaagtcagcgggaatcttgttacggatcgcctcaagattgctgatatcgatgtacaaatgacctttgggttggcgactaatgcgacggacgactttcgggattaccccatagacggaattctagggcttggtcggtccaatgatacttccatgggcggcaggcgtgcgttcatggacctggtcacgcaagagggggatcttgattccaacattgttggtttccacatgtcccgcaactcggacggagaaagaaatgggactgtcacgtttggtggtgttgataagaccaagttcgagggtgacatctcgtacactaacgttgttgagtcaagcatccattggagtattcctttggatgacgcgagcgtgaatggcgaatcctgcgggttcatgggcaagacagccatcatcgacacagggacctcgtactcactgtttccaccggacgatgcaaagaccatacattcactcattccaggctcgaagcaactttcggacgagaactaccttgtcccatgcgactcgacagctaaagtgcaattcaccttttccggtgtgagctacaccatgtctccaaaggattatattggagcaaacctggaatccggtgacggctgtgtctctaccattattgcccaggccatatttggtgacgatgtcatgatactcggcgacacctttctcaaaaacgtatacagtgtttttgactttgataatgaccgcatcggctttgcg

SEQ ID NO: 36918 - DNA, 1425 bp, Aspergillus nidulans
atgcgtcaaccatctcgagcacgcgctgcagccgcgcaacaactgtcggggtcgccctatgggacggaaaatggtccgatgtcaagcagcgatgagtggcaggagcgtggtgccgctgtcacagtaagacaggagattgatgctaatgggaagccggtcgcgcggtacattaagaaaggggttcgggatttctccttcggtcagaccctcggtgagggctcatatagcacggtcgtactggggacagaccgtcaaaccctcaaggaatacgcaatcaagatcctggacaaacgccacatcataaaggagaaaaaggtcaagtatgttaacatcgaaaaagacactctcaaccgcctcaccgatcacccaggtgtcgtccgattatattatacatttcaagatgagcgctcgctatatttcgtccttgacctctgcaaaggcggcgaattgctaggcgtcttgaagcgaatgaccaccttcgatgaagagtgtacgagattttatggcgcccaaatattagatgcgattgactacatgcacaagcgcggcgtcattcaccgagatctgaaaccggaaaacgttctgcttgacagtcaaatgcatatcaaagtcactgactttggtacggcgaagatactcaagggtaatcaagcctctcagaattcgagcggcatcccgtcgctagactctgatatgcctgaggaggagcgtgccagttcatttgttgggacggctgaatatgtcagtcctgaattattaacagacaagaacgcgtgcaaagcaagtgatttgtgggcattcggttgtattatttaccaacttctcgcaggccggccacctttcaaagccgccaatgagtacctgacattccagaagattgttgcgctagagtacgaatttcctttgggcttccccagcgtcgcccgcgatcttgtcgagcgcctcctcgtcctcgacccaacacgtcgtctccctatcgaacatatcaagaaccatgaattcttcgagggtatgacttggggacccgacttgtggaaacaaaaagcgccccgcctgaaagcttataccccgccaccccgcgaacccattaaacttaatgggggctcagatggagacagctttccccccagcattaacacagcaccatcaaatgcgagctcccgagtaatgcccaggctgattaccgaattgccggctcctagccaattggacattgagtggtctcctgtgctgacaaaaaacaacgaaaggattctgaagttagggaacctggttgtcgtgtcatctgcagcctctcacagtcccgtctccaaaaatggggagtacgaagcgccaaagaagttttcacgattcttcggcggtagcactacgaagaagcggcaacgcctggtaatgattacctcctccggtcgaattatcatggct

SEQ ID NO: 36919 - DNA, 1282 bp, Aspergillus nidulans
tgcgcttctccgcattctgagttcgccgtgcttcgttaactccaaaccactcctagcacacaacaatatgagctttcacatcgaaattcctccatctacaatcctttgaataccttccgacttcctcccggtcaggaacgacaataccaacagcaatatggagatatgtacttcttgcggctcgcgaagctgaaaccagcggtcgaggcggttgcagtcgaggcctgggaaggattcagtgtacaaagcccctcgcatttggttcctgccgccgtttcctgtgtactgactctttgtggattgcagattgcaggagaacatgcccgtcgcgtggaacgagtactggatgtccgacaaggagagctttgctgggttgcgggcacaatatatatggagatgccattaaaacccaatattcttgatgaccttgcaaaagatgcaagttgaccggtttaccctcgtgaggcacgtactgacagttggcagaacttcacatcagcgcctccccctcgacgaacctaccaagatcccgcacacccagagctaacggagatcatgctggaagacgagtccggacgactgcgacttacaggaagtaagcttcagtcagttcaactagcgacaggggtaattatcgcggtgcttgggacagaaaacgcaaatggagattttgaagcgatcgatatcaaggttcctgatctcgctcggcaaccacggcggtgggaaagagatgaagcgaaggcacccaaagaagcgaagaagggaaaaattgcaatggtcagcggccttggaataacggggacctcaagtgacaccctcgcccttgagctcctgacagactatcttctaggctacacgggatcatctaagggcgaagagggttctccgccagatgctagtaggattacgaggttgatcatcgccgggaactcactcggcgcgagcaccatcgaggcagcaccggcaacggatggagtaccggcgaaaaagattgcgcaccagaagaagtacggatatgacgcttcagcgtataacgcatcacctattacacaactggattccttcttggcagagctcctgcctagcataccgattacacttatgccaggcgagacgacccagcgaatttcgcctgccccaacagccaatccaccgggcgatgtttctcggtcaagggcatactgttccgcaccgcaatcggagaagacaaagtagagccgggctggttcgacagcgtgacgaatccttgggagggagacgtagagggatggcgattttgggg

SEQ ID NO: 36920 - DNA, 1289 bp, Aspergillus nidulans
gggatcgaccccgatgtcaagcaatacacggggtatctggatgacaatgaaaatgataaacatttgttttactgtaagttgatattattgtcgtgattgggagagtaatatactaacgagctgaagggttctttgagtcacgaaacgaccccaaaaacgatcctgtggttctgtggttgaacggtggccctggctgttcttctctcactggactcttcatggagcttgggcccagcagtattgatgagaacatcaagccggtttataacccgtatgcgtggaactccaacgcttccgttatcttcttggaccagcccgtcaacgttggctactcttacagcggcagtactgtcagcgacactgttgctgctggaaaggacgtttacgccctgcttactctgttcttcaagcaatttcctgagtatgccgagcaggatttccacatcgctggagaatcctatgctggccactacattcctgtttttacttctgagatcctctctcaccagaagcgcaacatcaacctgaagtccgtcttaatcggcaacggcttgaccgacggtctcacccagtacgaatactaccgccccatggcctgtggcgagggtggctatcctgctgtgttggatgagagcagctgccgctccatggacaatgctcttggtcgatgccagtctatgattgagtcttgctacaacagtgagagtgcttgggtctgtgtccccgcctccatatactgtaacaacgccctcctcgctccttatcagcgcaccggacagaacgtgtacgacgttcggggcaagtgcgaggacgagagtaacctttgttacaaaggtatgggttacgtttccgaatatctgaacaagcctgaagtccgtgcggctgtcggtgccgaggttgatggttacgactcctgcaattttgacatcaaccgcaacttcctcttccatggtgactggatgaaaccttaccaccgccttgtccctggcattcttgagcagatacctgttctcatctatgctggtgatgccgatttcatctgcaactggctcggaaacaaggcctggactgaggcccttgaatggcctggccacaaggagttcgccgcagctcccatggaggatctaaagatcgtcgacaacgaacacactggcaagaagatcggccagatcaagacccatggcaacttcaccttcatgcgcctctatggtggcggccacatggttcccatggaccagcctgaggcatcccttgagttcttcaaccgctggttgggtggcgagtggttc

SEQ ID NO: 36921 - DNA, 1340 bp, Aspergillus nidulans
ttttcataacacccggggaaatccattgacaagtctgctgggaagctataaaaagcaattggtctattgcacaggctgttgcagccaagtcagggatgccgctttaatttggtgcatgactaccatttaatgctcctacatgaaatgctcccagaacaaattggaaacaccaagaaaatcatcaagattggtttcttcctccacactccattccccagcagtgaaatttaccgaattctgccggtacgaaacgagctattgcttggacttctccactgtgacctcatcggtttccacacttatgactacacgagacatttcctcagtgcttgctcgcggttgctgtatgtgcgattctatgtctattctgtttggcatagaagctaatattggttctaggggactgccaaccactcctaatgggatagaattccagggaaagataatcgcttgcggcgctttccctattggcattgatccggagaaattcaaggaaggcttgaagaaagaaaaagtccaaaagcgtattgcaactttggagcagaaattccagggcgtgaagcttatggtaggcgttgaccggctggattatatcaagggcgttcctcaaaagctccatgcccttgaagtattcctgagtgaccatcctgaatgggtgggcaaggtggttcttgtccaggtcgccgttcccagtcgtcaagatgtagaagaataccagaatttgagggctgttgtgaacgaattggtgggcaggataaacgggaaatttggttagtcgtcctcactatatgcagcgagttcattctgactgtaatcaggaactgtcgaatttatgccgatccattttctccacaaatcggtgaatttcgatgaactcattgctctctacgccgtgtccgatgcatgcgtcgtttcttccacccgagatggaatgaacctcgtttcgtacgagtacatcgctacccaggagaagcgccacgggtcgttagtcctgtctgaatttgctggtgccgcccagagtctcaacggaagcataatcgttaacccttggaatactgaggagcttgcagcggcttaccatgaagccgtgacgatgagtgatgaacagcgagcgcttaacttctcgaaactggataaatatgtcaacaagtacacaaggttagtttctcctttcactggtcctaaacagaatcatcttgctaattctaactagtgccttttggggtcaatcctttgttaccgaattgacaagaatttcggagcaagccgcagggaaacttcccaccaaagagactcctgtgaacggagagacgtcaaagctagagattcgtcacagtaga

SEQ ID NO: 36922 - DNA, 1041 bp, Aspergillus nidulans
gaagaccgtcgccagatcggtgtcgtcagtgcatcgttcctgatcttcaatcgcgtcattggaaccggtatcttcgctaccccgagtacgatcctgtcgttgtccgggagtgtcgggctatcgctattcatgtgggttgctggcactttgattgccgtcgccggtactgcggtctacctggaatggggtactgccattcctaagtatgtttgttccatacaatgttcaaagttagggcttgtactaaccagactaggaacggaggtgagaagaactatctcgaatacgtctacaagaaacccaagttcttggccacggccatgtttgctgcctacgccgttttactcggatgggccgcaagtaacagcgtcgtcttcggccagtatatcctcaacgccgccgaggtagaagtcgaccgatggaaccagcgaggtattggccttgcttgcatcactgctgcgttcctgattcacggcttcgcgctgaactggggtctccgtcttcagaacctgcttggtattgtcaagctcatcattatcatcttcgttattgtcactggctgggtggctttggctggccacacgaagattgagacgcctcacaacttccaaaatgcctttgagggaactactggaagcggatatggtgttgtcatggcattgtataatgtcatttggtcgtttatcggctactcgaatgccaattacgtatggtcccatcctactctcgaccattgctcaagctaacgtcttcaggccctgagcgaaaccaagaaccccgagcgtacattgaagattgccgcccccgtcgcaattgggtctgtcggtgtcctttatatgctctgcaacatcgactacttcgccgcagtcccgaaggaccaattccttgcattaggcaacattgtcgaagcaccttcttcggaacatgttcggctcccgcgcaaggcggtcatgtctgctttgtggcttggcgggcttgggaaccttttctttggatcttttcgagggccgaatttccaggaccttgccgaaggctcctccc

SEQ ID NO: 36923 - DNA, 1733 bp, Aspergillus nidulans
cataagttccttccaaagggttcaaatatggttactcgacgtccaatcgaacttacgcttatcaacacaccaaatgcgcaagcagaatatggagagtttcctgctcttggactggggaagatcacagacttttcacagatccagcggacgttgaccgatcttaatttggccgtgcctgaaaaggactgcgtttccgacgacccaatccagctccatatttactcgccaaacgttcccgatttatctcttattgaccttccgggttacattcaggtgtccggacacgatcaaccaccagagttgaagcagaaaattgcggacctctgcgacaggtatattcagccaccgaacgttatccttgccatctccgccgcagatgttgatctagccaactcgactgctctgcgggcaagtcgccgagtcgaccctaggggcgagaggacgattggtgtgattacgaagatggaccttgttgatccggaaagagggcttagtatcttatcagataaaaaataccctctacgtcttggttacgtgggggttgtttctcgcatcccccaaaccaatgctctattctctagaggaagtggaaacatcacgagcgcaatcctaaaaaatgagaacgcttacttttcagcccacccagcagaattcggcgctgagtcaggcgtatccgtgggtgtctcgactttacagaaaaaactaatgcacgttcttgaacaaacaatggcatcaagtctagcgggtactagggatgctatcagtcaggaactagaggaagcgacttacgagttcaaggtccagtacaatgaccgacctcttagcgcagagtcataccttgccgagagccttgatggcttcaagcattcctttaaagcatttgccgaaagctttggccgtccccaggtccgggaaatgctaaaggccgagttggaccagcgcgttatggacattctggcacagagatattggaaccggccaattgacgatctgactccccccatggctgagccagaccctcttagcgatctgcctaaggcagatccggagtcactatactggcaccgcaagctcgacgcctcgacgtcgtctctcacaaagcttggaatcggccgacttgctacaaccgttgtggcgaatgcgatccaaagccatgttgagcgtctcatcgccaactctacctttgccgcccacccttatgcccaaaaacagattggcgatgcctgcaacagtatcctcaatgaccggtttttcagcaccagcgaccaggtcgagaactgcatcaaaccatacaagtatgagattgaagttgaagatcccgagtggactaaagggcgggaaaatatcagcaaaacgctgaaagaggaactaagagcctgtgaagcggcattaaaaaatgtcgaagacagtgtcgggaaaagaaaactcaaagatgtcatctccttcatcgataaggttcggaaaggagaagttatccttgacggcgacggctctggcggtgcaggcggctttagcgcatctctcatagcacgaggtacgtccttctttacttcaaccttcgaccaaccactaacagatctccaggccgggaaggcgtcttcctccgcgaccgcgccgacatcctgaagatgcggcttcttgccatccggtccaagcaatgcgctaccaaaaataacaaatactactgtcccgaagtcttcctcgacgtcgtcgcggacaagctcacctccgac

SEQ ID NO: 36924 - DNA, 576 bp, Aspergillus nidulans
ggcaaggcaatcgcctcccgacttgcccgcgatggctactccgtctgcgttaacgatatacccagctcccaggcggcaatcgaggcaactgtctctgaaatcaaatcacaatcccaggcaaatgttatcggtatcccagcggacgtctcgtccgcgtcgtccgtctcctctctcgtcagagacactaccgagaagctcggccctttgacgctcatgatcgccaacgccggggtctcgcaggtcaagccgctgctatccgttactgatgaggacatcagcagcgtgatgtccgtcaacttcaacggcgttttcaactgctatacggccgcggcgcgacagatgatcgctcaaggcgaccccaaggcggccgcgggtgtcgaggtgtacaagatcctcggcgcggcgagtatcgtcgccacaagccgtttccaacaatggggatctactcagccagcaagtgggcggtgcgtgggctgacgcaggcaatggccatggagatggcgacgacaagatcacggtgaatgcgtatgcccaggtatcgtggacacgaagatgtgggaggcgattcgatgcgga

SEQ ID NO: 36925 - DNA, 365 bp, Aspergillus nidulans
caccggaacgaccctccagctctgcggatgatgacgtttcgcgccgcaagactacggatattgaggagtggtatctcagaagttcatgcaggttgaccaggagatgctctttgagataatcttggtacgtgaagtcatgcctatttctttgattatttccataatatactaacttcattgataaggccgccaactaccttgacatcaagcctctccttgacatcggatgcaagactgtcgccaacatgatcaagggcaagtcccccgaggaaatccgcaagactttcaacatccagaacgacttcacccccgaggaagaggaccagatccgccgcgagaacgaatgggccgaggagtgagtttta

SEQ ID NO: 36926 - DNA, 496 bp, Aspergillus nidulans
tcccagaccaccatcttctcgccagaaggtcgactgtatcaggtcgagtacgccctcgaagccatctcacatgccggtacggctctggggatcctcgccaaggatggcattgtcctcgcggcggagaagaaggtgacgagcaagttgcttgagcaagacacatctgcagagaagctttacacattgaacgagtacgtattgtctttgggttttaggatttgaggcgttcatcatcggctgatttgcttgcagtaacatgatttgtgctgtcgccggtatgaccgccgatgcgaacatcctgattaattatgctcgacaagcagcccaacgctaccttattacctatggcgaagaaattccttgcgagcaactcgtccgcagactctgcgacttgaagcagggttacacccagcacggtggtctccgtccgttcggtgtttcgtttatctacgccggctacgatcatctccgagagttccagctgtagcagagcaac

SEQ ID NO: 36927 - DNA, 1302 bp, Aspergillus nidulans
agcaagccggtggagtccgccaaacctgccgcgccaaagtcttgggcggacttggttcgaaacaagaaccttgctcgtaacgcagctagccagagtgctccatcgggtgtggtcaacggcgtctccaagagccagtccgttgccgatgtcttactcaatctaggagacgatgtttctcagtatagcgataaagtgaccttccttgaaccccgagggctcgtcaatactggtaatatgtgctacatgaattcggtgcttcagattttggtttcatgcgtgccgttctatcagttcctggatcatattgggaagcgcgcgtcccacagtttccacagcgactttcccatggttgacgctctaatcatgttcatgaaagaatttcgagtcattgatgccgcccgcaacgaagagcagttgcgaatgaggctgaaggcgaacgagctcgagcaatacggagaggcttttattccagagtttgtgtatgaagttatccgccaactaccccgtttccgagacatgcgacgcggccaccagcaagatgcgcaggagttcctgggttttcttcttgaagaaatgcatgaagaatgcgctcgcgctactagtgccaattcctcaaccgagcctgcatctactgatagtgagaacggtgacggctggttggaagttggccacaaacaaaagccagccgtcacacggtcttccggacacattgcctctgaatctccaatcacaaaaatctttgggggcaagattcgatccgagttccgcgtacctggtaataaggcctctgtcactcttgaaccgtatcagccgctgcaacttgacatcggcgccccagagatccataacattgtggacgcactaaagggcttgaccaagccagaaagtattcagggagatttcaattcttcgcgtggtccatatgtgactgcgaccaagcaagtcttcattgagagcctgcccccggtactcatccttcaccttaagcggttccagtatgacagcgtcacccatggcacgcagaagatctggaagaagattgggtatcctttggacttggaaatccctcgagaagtgttcccgcctcacagacgtaatgtcatgatggctcaaggtggacttcccaaatatcgtctcactggagtcatctatcaccacggcaagaatgccagcggtggtcattacaccgtcgatgttcgtcgccaggatggccgcgagtggatccgccttgacgacaccgtcatccgtcggatcaagagcgaagacgttgcagaggccggtggagaagaagatccaaaggtg

SEQ ID NO: 36928 - DNA, 1030 bp, Aspergillus nidulans
atgcccactgttcatctgcttgattatgtcgctggaaatgtgcgttccttggtgaatgccatcaacaaggttggatatgaagttgagtgggtgagatcgcccagcgatttgaaagatgtcgaggtaaggaaattatcgtcgtcaccattgtgccttgtgcctcattatgtatctgttacacggaaattcaggctaacgtgggggctatagaagctcatacttccaggagtcggccacttcggccattgcctttctcagctttcaagcggtggctatttgcagccgataagagagcatattgcttccgggaaaccgttatgggaatatgtgttggtttccaatcccttttcgagagttccgaggaggatccccaacattcctggtttgggtacaatcccagcgcggttgcgcaaatttgacgcaaaaacgaagagcgtacctcatatcggttggaactcggcaacagatacccgcattgactcgactggaggccagaccttctatggattgagcccaagcagcaagtactactacgtacactcatacgccgcgccatatgagccgggaattcttgagaaagatggttggttggtcgccacggcgagttatggggaggagaaattcatcggcgcgatagcacgagataacatctttgcgacacaattccatcccgagaagagcggccaagcaggcctacgcacccttcgcgctttcttggacggagctcagctccattctgtcacattagaagactcgattttgacaggagagaaaaacggtcttacccgtaggatcatcgcctgtcttgatgttcgtacgaatgatgtcggcgatctcgttgtgactaagggcgatcaatatgatgttcgcgagaaggatggtgcggatgctggagggcaagtgaggaacctgggaaagccggttgatatggctaagaaatattacgaacagggggcagatgaggtgacgtttttaaacatcacctctttcagaaactgtccgttagccgacctccctatgctcgagattc

SEQ ID NO: 36929 - DNA, 760 bp, Aspergillus nidulans
cctaaaacacacactcagtcgccagcagttactggaacctcggtcatcgccgtcaaattcaatggaggtgttgctattgctgccgataacttgggtacagtctcgcttctgtacacgtttatttcacgaccatgctctgacacttgatctcttagcatcatatggatctttggcccgattcacagacgtcaaacgcctacgcaaattcggcgacgccgctgtcatcggattcagcggcgacgtatcagacatgcagtacatcgaccgccttctagagtccattgatatccgcgaaaactactcagtgcatggtaatcagctcaacgcgaagaatcttcacacctatctgtcgaaagttttctacaagcggcggtctgattttaatccgctgtggaaccatatccttgtcgctggatttgattcggaaaagaagccttttctgagctctgccgatttgctcggaactacgttttcagccccgcaccttgctactggctttggtgctcatctcgcgatcccaatccttcgtcgattgttcccagaggagcgccctattgaggaaatcagcaaggaagatgcagtgtcggctttgaaggactgtctcaaagttctctggtaccgtgatgcgcgaagtatggacaagtactctctagccttaattacgcaggagggaattgagatgcatgaagatcaacaggtcgaggctcagaactgggcgtttgctgagagcatcaagggatatggggcacaagctgtttag

SEQ ID NO: 36930 - DNA, 833 bp, Aspergillus nidulans
tcaacgtaccgagtctatttatggctgatcctcctggacattcctccccttcccaccgatcgctatctatccctcattcatcggggtcgttctcctgcgtatacgaaaatccgcaacgataccttccgcactctagccacagatccgcttttcaaacgccgcgtcacggaagccagtctcatccggttgctcaacgcagtcgcatggaagatccacgatgcgaaaaacagaaacaacctcaagactcgttcgtcctctcggaggcgtgaaatggaactcctcatcaacaccccgccgagcatcgctgaagaagagccgtctgcggacgatatgactcccgacagcatgatcagcagcaacagtagcacgtcagcagtcagccctggtatcaccaacgagactgcaatatatgtgcagggcatgaatgtcctctgtgcaccttttctttacgcggcccgtagcgaagttgaggccttcgcactctttcatactttcatcacccgcgagtgccctggctacatccgcggcgctatggatggtgttcatagaggcctcaacctcgtcgaccgatgcctggagattgtcgagcccaaactcgcggcctacctcttctccaaaggactacaagcgaagctatacgcattcccgtccgttctgaccctctgcgcctgtacacctcccttaccggaggtccttcatctttgggactttctgttcgcttacgggccccacctgaacatcctctgcatcgtggcacaactaatcttgatgagggacaccctcctcaaaagccaaaagtacgtagagtctcccgttatgcttttcccccttca

SEQ ID NO: 36931 - DNA, 701 bp, Aspergillus nidulans
taccctaccgaatacctggaaaaccaggcagcaattacaagctacagcagctggagtacgagtttcgccatggcggctgtttaccaccacgattcggcagcatggcctgtcacacatgtacaccggtagcgcggcattctgcgtctccaacgcaagcaaatccggagtccagttcttcgcattcgagacagcacgccaattgatgcccacggacacttccgcaaggtccaccgcacggggaatatgggggctggaataatcgcgggtgcagcagagagtattcttgtcgtcactcccggcgagacgctaaagaccaagatcatcgacaacgaagccggagcaaagcgatatacgtcggctcgcgcgctatccggtcggcggttgccaccgagggagtcgccggtctgcaccggggcgtagtgacggtgacgtcgaaacagtcagccaatgcaatggtgcgattcaccagctataacttctttctccgacaccttcaggccatgtccgggtcagactcgaacaactccgtcatcggagctactgttgttgccggagcactcgctggagtagtcaccgtatacgcgacgatgccgttcgacacgctcaaaacaaggcttgaagctttagatgctcggcagcgctttaacgagactctagattgcttgaaaaccattcgtttctttgagggggttttgtccatg

SEQ ID NO: 36932 - DNA, 1230 bp, Aspergillus nidulans
gacttcactgtcttggcaaaggctgtcgttaaagagcttgcgggtgctttcggcctcctgatcaagtctgtgcactaccctcacgaagttattgccgctcgtaagggttcccctcttgtgatcggcgtgagaacttccaggaaaatgaaggtggatttcgtggatgtggaatactcagaagacgtggctctccctgctgaacaggcttcccaaaacgcggcgatcaagaactctgctaccggtcttctcgcccctcctgacaaatctctccttcatcggtcccagtctcgtgctttcctgtctgacgacggaattccccagccagctgaattcttcttgtcatctgatccttccgctattatcgagcacactaaaaaggttctgtaccttgaagatgatgacatcgctcatatccatgagggtcaactcaacattcatcgcttgactaaggatgatggcacttcaaacgtccgtgctatccagactattgagctcgaattgcaagaaatcatgaagggcaaattcgaccatttcatgcaaaaggaaatttttgaacagcctgaatccgtagtgaacacaatgagaggccgtcttgatgttgctaacaagcaagttactttgggagggcttcgacaatacatctcaaccattcgtcgctgccggaggattatattcattgcttgcggtactagttaccattcgtgcatggcagttcgtggagtgttcgaagagctcactgagattccgattgcggtcgaactggcctcggactttttggacagacaggcgccggtcttccgcgacgacacatgcgtgttcgtctctcaatctggagagactgcggactcgcttatggctctccgttactgtcttgaacgtggagctttaaccgttggtattgtcaacgttgtgggatcttccatttcccttctcacacattgtggtgtccatatcaacgctgggcctgaaattggtgttgcttcgaccaaggcatacacttctcagttcgttgctatggtaatgttcgctctctcgctcagcgaagaccgagcttcaaagcagaagagacgtgaggaaatcatggaggggctctctaaaatatccgatcaatttagagaaattctgaaactcaacgagcccatcaagcagatgtgcgagcgctttttcaaaaatcagaagagcttgcttttgctgggcaggggtggccaattccctactgcacttgaaggt

SEQ ID NO: 36933 - DNA, 603 bp, Aspergillus nidulans
tcgcttccctcccggacaatcaaatttgagatctgggataccgccggtcaggagcgctttgcttcgctcgcccccatgtactaccgtaatgctcaggcggcattggtagtctacgatgtgaccaaaccctcttctctgaccaaggccaagcattgggtggcggaactccagcggcaagccagtcctggcattgtgattgctctcgtaggcaacaagttggatttgacgaacgacggcggggagacaccagctgagaccgaacgcgaggcgggtacagagggcgacgacgctgacgacaaccaagaagagcaggaggataatacacctggagatgctcgcaaagtacccacacgggaggcgagtacgtatgcagatgaggagggacttctattctttgagaccagcgccaagacgggcctgaatgtgacagacgtctttactgcaattgccaatgccattcccgagagcagtctgaagagtggacgaggcgctggcgcaggcaccggtcagactacgctagggggtggcggccgatctactgacgactcaagagtcaacctgggagatcgcggcgccgcgacagccaaggagggatgcgcctgt

SEQ ID NO: 36934 - DNA, 477 bp, Aspergillus nidulans
aagcaacggcaattcttacaggcatatgagtacctttgccatatcggagaagccaaggagtggattgaagaggtaatccagcaacagattccgcccatcgtgcaactagaagaagccttacgtgatggtgtcaccctggcggagatcgtacaatcaatgtaccctaaccggccgttgcgaatatttagacacccgaggctgcaataccgacactcagacaatatagccttattcttccggttcctcgatgaagttgagctaccggagctcttccggtttgagcttattgacctgtatgagaagaagaatattcccaaagttatacactgcatccacgccctgtcgtggttgcttttcaaaaaggggcttgtcgactttcggatgggtaacctagttggccagctggaatttgagcaccatgaacttgagcagacccagaaaggcctagacaaagctggcgttagcatgccgagcttt

SEQ ID NO: 36935 - DNA, 1073 bp, Aspergillus nidulans
tacgagtcatcattggccaatgcctgtggagtcaacttaaacactcgtatcctcgccttcaagccgccgcctcctgagtcatcgaagccgattgatctgcgtgctcagtacaaccgtcccctcaagtccaccaagtctaactcggctcagttccgccgaagagtccagaccgctccagaacgtgttttggacgctcctggccttcttgacgactactacctcaatctcttggattggagctctggaaaccaagttgctatcggcctagagcgaaatgtctacgtctggtctgctgattctgggtccgttagctgcttgttagagacttctcccgatacatacatcagtagtgtcaagtggagtggggacggcgcctacgttggcgttggcctcggtacaggtgaagtccaaatctgggatgtcgaagagggcaccaagcttcgcagtatgttcggacatgaatcaagggttggcgtaatgggctggtccaaacacaccttatcaactggtgctcgcagcggtcttgttttcaaccacgatgttcgcattgctcagcacaaggtcgccgagctggtctcgcacacatccgaagtctgcggtctggagtggaggtcggatggtgctcagcttgccacaggcggcaacgacaacttggtcaacatctgggatgctcgatcattgagtgcccccaagttcactaagacaaaccaccgcgcggcggtcaaggctcttagctggtgtccctggcaactcaaccttctcgccacgggtggtggttcctacgaccggcacattcacttttggaacaccaccactggagctcgcaccaacagcatcgacactggctctcaggttaccagtctccggctgagcaaccactatcgcgagattgtcagctcaagcggttccccgataactccctcagcatctggagctacccgactctagtccgcaacattgagatccccgctcacgaaacccgtgttctccacagctgccttagccccgatggccagcttctagctactgcagcggccgatgagagcttgaaattctggaaggtgttcgagcgc

SEQ ID NO: 36936 - DNA, 1032 bp, Aspergillus nidulans
ttgaaacgcaaagacctcttccagcaacatgggctcatcggcgacaaatgggtctcgtcgtctggcggcggcacattcaccgtcacaaatccagcaactcttgagactctcgctactcttcctgagatgaacggtgcagacactgaatctgccatcacagccgcgcacactgcgttccagtccttcagaaagactactgcccgccaacgcgctacctggctgcggaaatggcatgccctctgcgtcgagaatatcgatgacctggcgctcatcctaaccgtcgagaacggcaagactctcgccgaggcgaaaggcgaggttctatacgctgcatcctttcttgaatggtttgctggtgaagctgagcgagttcacggcgaggtcgtccctgcttcaaatgccaaccagagaatcttgactgtcaagcagcccctcggtgtggctgcttgtcttgcaccctggaattttcctatcgccatgatcacgcgcaaggttggcgctgcgctggcggccgggtgcacgaccgtctggaaaccagcgggtgagacgccgctgagtgcgcttgcgcaggcggtccttgcaagagaagcagggtttccaagcggtactatcaacgtcattacgacgctgaacagtgtcgctgaagtcggagcggcattatgcaattccaagcttgtgcggaagctcagctttacgggctcgacacgcatcggcaagctcctggcaagccagtgcagccaaaaccttaccaagctgtctctggaactcggcggaaacagcccttttattgtttttgatgatgcgaaggttgagacggctgtcgaggcctgtattctcgccaagttcaggaactccgggcagacctgtgtcacggcgaaccgcattttcgtgcaggagggtatctatgaccggttttcggcagcactggtcgagaaggtcaaggcgctgaaggttgggaatggtgtcgaggagggtgtgatcattggacctctgacgcatgagcgcgctgttgaaaaggccgtcgcccatata

SEQ ID NO: 36937 - DNA, 723 bp, Aspergillus nidulans
gattttaaacgagatgcccccggtccgcacattgttgagcgcattgagcatgaccccggacggagtgctcatattgcgcttcttcgcagtaaagaaactgggaagctgagctatatcctggctgcagacggtatgagggcaggagatgttgtgcaaagttacatggctgggattcccgacgacctttggcagagcatgggaggaactgttgatcctggtgtgatggctgccagaactgcctggagaggaaactgcttgcctttacacatggttccggtggggtcgctcatattcaacgtcgggttgcgtcctggcggaggtggacagctgtgccgtagcgccggtacgttcgcgacggttatctccaagggtgtcaatcaggtggctgcagccgatcaagagagcaaagaaagccaagcggctggcgaagagaagaaacccatgacccagcgcgagaagcaagcccgtgagcgcactctccagcatatcaccattcgcctttcaagtggggaggtgcgccttattcacaaagattgctgtgccaccattggtgtcgctagcaacccaaacaagaagtatgcccaactaggaaaggctggaagatcacgctggcttaacattcgaccaacggtgcgcggtcttgccatgaacgctcaagatcaccctcacggtggtggacgaggaaaatcgaagggtaacgttgatccaaagagtccttggggt

SEQ ID NO: 36938 - DNA, 1382 bp, Aspergillus nidulans
cgcaaatctacagctttccctcctcacactatcatcagcatgcctgccctgtcgccaacaatgacggcaggaaacattggagcgtggcagaagaaagctggtgatgctttgcaacctggcgatgttctggttgagattgagaccgataaggcgcagatggactttgagttccaagaggagggtatcttggccaaggtgctgaaggaatctggcgagaaagatgtgtctgttggctctgtaggtgttcctttcctttgaccatgacaagatacgtttgctaattgtgaaatctcagcctattgctgtcctagttgaagagggcaccgacgtcgcggcttttgaatcgttcagcttggaagatgctggtggcgagggtgctggtgccgctcctccaaaagaaactcaagaaactcctaaggaagcccctaaggcttcagagccatctacgccccagcctgctgctggtgcttatgagcccgatacctccggtgagaagctccagcctagtctggaccgcgaacctgcgatcagcccggctgctaaggctttggctcttgagaagggtgtgccaatcaaggctctaaagggtaccggccggggtggccagattaccaaggaggatgttgagaagtacaagcctactgctgcggctgcggctgctgggcctgcttctgaggacattcctctcacatcaatgcgcaagacgattgctagccgcctccagcagtcttggaaccagaaccctcactttttcgtttctactactctgtccgtcaccaagcttctgaagcttcggcaggcactaaacgcctcctctgagggcaagtacaagctctccgtcaatgacttcctcatcaaggcttgcgctgccgctctccgcaaggttccccaggtgaactccagctggactgaggagaacggccaggttgttattcgccagcacaacagcgttgacatcagcgttgctgttgctacgcccgttggtctgatcactcctattgtgaagaatgcccagggtcttggtctttccagcatttctaaccaggtcaaggaccttggcaagcgtgctcgtgacaacaagctcaagcccgaagagtaccagggcggtactttcaccatcagcaacatgggcatgaaccctgctgttgagcgcttcaccgctatcatcaacccccctcaggctggtatcctcgctgttggcactacccgcaaggttgcccgtccctgttgagaccgaagagggtacctcagttgagtgggatgatcagattatcgtaaccgctagcttcgatcaccgggttgttgacggtgctgtcggtgctgagtggatcaaggaactcaagaaggttgtcgagaaccctctggaactccttctatagttg

SEQ ID NO: 36939 - DNA, 1024 bp, Aspergillus nidulans
ggtctctcgccaaatgtcgagtccgtgacggtgaacaaggtctgcgcgtcgggtctcaaggcagtggtgtttgcggcgcagaatatccagcttgggcttgctgaggcccagattgcaggtggaatggagagcatgtctcgtgtgccgtactatctcccgcgttctagccagctgcctccatttggagagatcaagttggaagatggtctgatcaaggatggactgtgggacgtctacaaccagttccacatgggcatctgtgcggagaacacggcaaagaagtatgagatttcgagggagatgcaggatgagtatgccattgcgtcatacgagcgggcacagaaggcctgggctgagaacaagttcgccgaggagattgcgccagtgaccgttaagagcaagaagggcgacactgtcgttgagcgtgacgagggttatgaaaacctgcgggctgataagctgaggactctcaagcctgcgttcctgagggacggcacgggtaccgtgactgctgggaacgcttcaactatgaacgacggtgcatccgccctcgttctggcgaacaaggagctcgcccgcgagttcggtgccggaaagcgcgccctcgcccgcattgtctcctccgccgatgcggctattgacccagtggacttccccgtcgcgcccgcgaaggccgtccccatcgctctcgagagggcgggtatcaccaaggaccaggtcgctgtatgggaattcaacgaggccttcgctgccgtcatcgaggccaacaaaaaggttagttcttttcgggtcaggcttaccgaacgcttgctaacaggaacagattctcggtctggaaggtgcccgtgtcaacgagctcggaggtgccatttctctcggccatgcccttggtagctcaggctcccgtattctgacgacgcttctgcaccagctgcaggctggcgagtatggtgttgctgccatctgcaatggtggcggcgctgcaactgcggttgttgtgcaaaaattggaccgagtggattaa

SEQ ID NO: 36940 - DNA, 1221 bp, Aspergillus nidulans
cgcggccttcgccaggtcctccaaaaatcgccttcggacatcgttatcctctcatctctccgcactcccgtcactcgtgcaaagaagggcggttttaaggatgcttatccggaagagcttctcgctcatgttttacgcgcgacgctggaggccaacccaaatcttgaccccgctctgatcgaggatgtgtgcatcggctccgtgcttcaagaactcggaggcgcgaaggcaggccgaatggcccagatccacgccggtttccctcacagcgtccccttccacacaatcaaccggcaatgttcatctggtttggctgctatttcaactattgggaacagcattcgggcaggagctctcaacattggtgttggtggaggaatggagtcgatgaccagaaactacggctcgcgcgctatccccactgttctgtggcctgagctcaaggaatcgccctcaaaggattcgagggattgtatcatgcctatgggaatcacctctgagaacgtcgcttctcggtacggtatcagcagggaggaccaggacgcgttcgctgccaactcgcacaagaaggctgcggctgcgcaaaatgctggactattcgactcggagatcgttcccgtaaagactctttcctacgatgctcagaaccctgaagccccgcctacggagataactgtcactaaggatgacggtgttcgcgccaacatttctgtcgagaagatggcctctttgaagccggctttctctgaaactggctccagcactgccggaaacagctcccaggttagcgatggtgctgccgctgctctgttgatgcgtcgatctaccgccacggaactcggcctgacttcgtccatcaaggcccgctgggtcggcacagccgttgctggttgtgcccctgatgagatgggtgttggccctgcagttgccattcccaagctccttcagatgcttgacgttaatatttcggacgttggcatctgggagctcaacgaggctttcgcgtcccaggctctgtactgtgctcgtaagttgggtattgatgaggccaagattaaccccaagggtggcgccattgcgattggtcaccctcttggtgccactggagccagacaggtcgcgaccctgttacctgagcttgagcgtaccggccaggaaatcggtgttgttagcatgtgtatcggaactggcatgggtatggccggcatgtttgttcgggag

SEQ ID NO: 36941 - DNA, 1077 bp, Aspergillus nidulans
atggcatcccttcgctccgtactcaagagccagagcttgcgacacaccgtgcgatcctactcctcgcaaaccatgcctcccgcctcaccctttgctccccgccacttcctctccattgcggacctctcgccctccgagttcgcaacccttgttcgcaatgcctcctcacacaaacgggctatcaagtcggggtcaatgccccaaaacttgcagggatcactccttgggaaaactgtggccatgatcttcagcaaacgaagcacgaggacaagggtatctacagaaggggccgttgtgcagatgggaggtcatccgatgttcttgggcaaggatgatatccaactaggtgtcaacgagtccctatacgacacctccgttgtcatttcgtccatggtatcctgcattgtagcccgtgtcggtaaacatgcagaggtcgcagatctggcgaagcactcttcggttccagtcatcaatgctttgtgtgactctttccaccctctccaagccgtggccgatttccagaccatctatgaagcattcacccccaaggcgcaccacctttcaagtctagggttggaaggattgaagatcgcttgggtgggtgacgccaacaacgtcctgttcgatatggccattgctgctacaaaaatgggtgtcgacattgctgtcgctactcccaaggggtacgaaatccctcctcacatgctggagctcatcaagtctgctggagagggtgtctcgaaaccaggaaagcttctgcaaaccaatattcccgaagaagcggtcaaggacgccgatattctggtcacagacacctgggtctctatgggccaagaggaagagaaggctcagaggctgaaggagtttgatggtttccaaatcactgctgaactcgccaagcgaggaggagctaaggagggctggaagttcatgcactgtctcccgcgacaccctgaggaggtcagcgacgaggttttctacagcaaccggtcacttgtcttccctgaggctgagaaccggttatgggctgcgatttccgccttggagggtttcgttgtcaataagggaaaaattgaa

SEQ ID NO: 36942 - DNA, 961 bp, Aspergillus nidulans
aatagactgcccgagttcagtctggccggaaaggtcgtttgcgtttccggtggtgctcgtggccttggattgacccaggcagaggctctgcttgaagccggtgcccgcgtctacgctcttgaccgtctcgaggagcctgtgtgtaccccaggtcccttggattgaaataaaagctaacatattgcctacaacagtctcccgatttctacactattcagaagcgtgccagagaggaactcggcactgagctccagtaccgccgcatcgatgttcgtgacacagagctcttgcacagcactatcgaagcaatcgccaacgccgagggtcgcatggatggcttggtggctgctgctggaattcagcaggagacccctgccctggagtacacagcccaagacgccaacaggatgttcgaagtcaatatcaccggtgtcatgatgaccgcgcatgcggttgctaaacagatgattcgctttggaaacggaggaagcattgcactgattgccagtatgagcggcactattgccaatcgcgtaagtccttcatatcttagccccctcacccgcacaccccgggtcactcccccgctttggcgccctatcactgcatgtctctagggatagttcactgacatttccacgtatagggtctcatctgctctgcctacaacgctagcaaagcggccgtcatccaactcgcccgcaaccttgcctccgagtggggccagtacaacatccgtgtcaacactatctctcccggttatatcgtcaccgctatggttgagcagctcttcgtccagtaccccgagcgccgcgacgagtggcccaagcacaacatgcttggacgtctgtcctctccgcaggagtaccgcggagcaactgtcttccttctcagcgatgctagcagtttcatgaccggaagcgacctgcgcatcgatggaggccacgccgcgtggtagttg

SEQ ID NO: 36943 - DNA, 562 bp, Aspergillus nidulans
agtgtccaggttcaggatgaatgcattaccgcattcaacaacctccgcatgaccggtggtcagaagggatctaagcccaaattcattatcttcaagatctcggacgacaagaaacaggttgttgttgatgagacctccgacgaccctgattacgagactttcctcaacaaactcggtgacgccaaggatgccaacggcaagcccgctccccgctatgctgtctacgatgtcgaatatgacttgggtggtggtgaaggcacaaggtattatcactagtaccccgagctggacaatgtgcctgactgacaacctttgtttctgcaggagcaagatcattttcatctcttgggtgccttccggtacctctatcaacgtatgtttttgttactaaactctgattattatcatataggctgctcacaaagaacaacagtggtccatgatctacgccagcactcgagaggttttgaagaacgctctcaacgtcgttacatccatccacgccgacgacaagggagatctcgcttggaagtctatcctcgccgaggtcagcggtggtaag

SEQ ID NO: 36944 - DNA, 465 bp, Aspergillus nidulans
gcctattccaagaagttcgtggtggtgggagacggaggttgtgggaagacctgtctgttgattagttattcgcagggttactttccagaagtacgtatcgtcctttgagctaattatgggatactgacggatgcagaaatatgtcccgacggtatttgaaaactatatcacacaaacgcttcatagaaggtctgggaaaactgtggagttggcgctctgggatactgctggccaggaggaatacgaccgattgcgccctctctcatatcccgagaccgaccttctctttgtttgttttgctattgattgtcctgcatctcttgagaacgttatggataaggttagacccccgaccttcgcgctaggattatctaaccaggacagtggtatcccgaggtgttgcattaatgccctacgaccccaattatcctcgttgggctgaaatcagacctgcgcaacaagcga

SEQ ID NO: 36945 - DNA, 686 bp, Aspergillus nidulans
caccccgaagtaatgtcacacctcgttcatcagcttggtctctctccctcctaggcttcacagacgttttctccatcgacgagccagaccttctcgcgcttgtgccgcgcccttcccaagctctcctcctggtattccctgtctcaaaaagctacgaatccagtcgtatcgccgaggacagctctctccctgagtacacgggctccggaccaaatgagcccgtaatgtggttcaaacagacaattcggaacgcgtgcgggctgattgggctcctacacgctgtgtcaaatggcgaggcaaggaaacatattctgccaggctcagatcttgagaatctgctaaaagaggcggagaagctagatccgatcagacgggcagatctgctgtacgaaagtaaggcgttggagagtgcacatgctgatgcagcgaaattgggggataccaaggcgcctggggcggaagatgacgtggatctgcattttgtggcatttgtaaagggggaggatgggaggctgtgggagcttgatgggcggaggaggggcccgttggagaggggggtacttggagatgaggaggatgccttgagtgaaagggcgttagagttaggggtcagaaggttcttggatgttgaggctaaaggagggaatccggatttacggttcagccttgtcagcttgggggctgtc

SEQ ID NO: 36946 - DNA, 1518 bp, Aspergillus nidulans
agcctcgtcgtctacggctaaattatgtgctccggcagcatggataccggaattataggccctgtgacgaccatggacagcttcgtagaagaattcggcaatcgatccgcaacagtacacggtctattagtgtcttcaatcctcatcccggcagctatctcctcgttctttgctggttaccttgcggacaagtttggccgcccgcaaggcattagtatcgggactctgatcttcgggctcggcgcacgcttggaggccggagctgtccacgtctcgatgtttgtcctcgggcgctgcattgagggaatgggtgaggggttgtatttgggcacattggttgtgtatgttgaagccgtcatgttgaatgccagacccctttctgactgcggataggtatatctgcgagatttctcctccaggcgtcagaggagctttgacgactggccctcagttgctgataactctgggcctggtagtaggattcttcacctgctatggaactgcccgaattcagtcctcaatgtcgtggcgaacaccgttcctcattcttgcttgtctctcattactgttttccgcagcggcattcttgtggcttgtgccttctccgaggtggctcactatccacggccgtagagaggaggccaacgtcgtctgggatttgctgggtgttagccatgcagagcgcgagaaaagcgagatagaacaagccagagggtccgtcatccagggtccagtttctcaagaagtggccgtgaccaacgtctcgagtatggatcttactgtggccactccccaagtcgaagataaatccataagacacaagcttttcgacatcttctcgaaagacgttcggtctcgtactgcgctggctgtatttttgatggcaatgcagcagctcagcgggatagatggtgtcctttacgtaagttggcttttccaaggaacttgatcaacagctaattaaatcttctcagtatgctcctttgctcttcgagcaagcagggctcgcatccgcagatgccagcttcttcgcgtccggtgtttcggctcttgtcatttttgcagtgactatcccagccttaatttgggcggataaatggggccgccgccacagcgtcatttacggtggtgtcgtaatcagcctaaccatgttcttaatgggcgctctctatgcgggaaatgcggtgcacagctcagccggtgctggccgctgggttgtcatagtttccatctatatcttcgccgtgatattctcactcagctgggcagttgggatcaagatttatgcggccgagatccaaccacaaagaacccgcgcctcagcaacgagtctggcgcacgggagcaactgggcgacgaattttctggttgctcttacaaccccgattctgctggataagagtagttttggggcttactttctcttcggcggttgttcgttgatcacggcttgtggtttgtgctatctttatgcctgagaccaagggcaggtccttggatgagattgaagacgcgttc

SEQ ID NO: 36947 - DNA, 990 bp, Aspergillus nidulans
catcaagggagcgtttgggcagtgttggcctacgataagaacactataatcacaggtaactccgccttgcacggagcacggcacaggtgctaatcagaacccaggttgcgcggacaatataatccgaatattcaattcgtctgggaagctgctcaaacgcattaaagattctcgggacgttgttcgggctctgtgcaaactgccgcctacacatcccactggtgccaacttcgtctctgcaagcaacgacggggtgatccgcctattcacgctgcaaggagatcttgttggtgaacttcacggtcacgagagcttcatctattcactggccgttttaccaacgggtgagctggtcagctccggggaggatcgaacagtacgaatctggaacgaaacgcagtgcgtacaaactatcacccaccctgcgatttctgtctggggtgtcgctgtctgtccagagaacggcgatatcgttacaggggcaagcgatagagttacgcgagttttcactcgggctcccgaaagacaagcgagcgcggaggtgctgcaacagtttgaaacggctgtcagggagtcggcaatccccgcgcagcaggtcggaaaaattaacaaagagaagttgcctggccccgagttcttgcagcagaaatccggcaccaaggacggtcaagtgcagatgatccgcgaagcgaacggcagtgttaccgctcatacatggtcagctgcgttggggagatgggaatcggtcggcactgttgtggattctgccggtagcagcggaaggaagactgaatatctgggtcaggattatgactttgtttttgatgttgacgttgaggacggcaagccccctcttaaactaccctacaatctttcgcagaatccatatgaagcagcgaccaagttcatcggtgacaacgagttaccaatgagttaccttgatcaagtcgctcagttcatcgttcgaaacacccaaggcgcgactatcgg

SEQ ID NO: 36948 - DNA, 186 bp, Aspergillus nidulans
atgtctagcccgccattcacggtcaaggcggttttcgaatacgtttcggaccacgaggatgaccttaattttaccatcggccagatcataacagttactggtgtggaggatgatgagtggtactatggcgagtacctcagtgagtcggggaacaaggtagaaggcatcttccccaaaaactttgtg

SEQ ID NO: 36949 - DNA, 1351 bp, Aspergillus nidulans
ccgacaacgtctgcagtcaattcgtccatcaccggaatctccgtttctttcttacaagcgtcggcagctgttggtgctctgattgcaggtcgtctaggtgatatcgtgggacggaagaagtgcgtccgtctcggcggtttcatctacttcttcagtgcattcatccagatgtttgcgcctgggttcgctacttttcttgccggtcgaacaattcagggccttggtgttgggtttctttccatgacggtgccgatcattcagacggaaatcgcgtccccgcatagccgaggtctgatggtcggtatcgaatatacgattttgattgcaggttacatgctcagttgctgggttgattatgggttcaattttatgctgccaagtgaaatgtcatggaagggtccattcatcgtgcagataggactttcattcatcctgctcgcgatgtcgtttttccttccagagacaccacgttggttggcgaagaatggctttatggaggagagtctacagactgttgctgatctccatgccaatggtgatacgcaggctgagcacgtacaacaggtttcaccgaaaatcaagaagccgtcatctacgagacgaatctcggcaaatctacttggacggtaagccaaccccacaattgaggggttgatgaagctgactgaggcaggaaatgttcacgcgctatcgaaaacggacgatcgttggcatcactgtccagatgtttgcccaactgaacggaatcaatatcatctccttctatctcccgagtactctcgcctcggctgggtttgacaacaggaaatctcttctctttactgccgccaatgcaattccctacacagctgccaccattgctacttggtggctagcagataaatggggccgaaagcctctattaatcttaggaggtgagtccagagccttttaaaggtcacaagcagaaaatctgacattttcattaggtcttggcatggcagtactcctcggcatcgtctgcgccttcaccgaagcctcgctccccgttcaaaccaaagctgatggacaatacgccttcgtcatgctctacaatatcgtctatggctttacctggggccccatgccttggcttctgcccgccgagatcttccccctccgcggacgcagtaaaggaatggcgttggcgactacgagcaactgggtcttcaacttcattatcggcatggtctcgcctgatgcgttttccgggattcatgggtacttctatcttattatcgcgggattctgtctgttttcggccggactggtatatttctattatgtggaaacggcgaacagtagcctcgaagagattgcggcgctatttggc

SEQ ID NO: 36950 - DNA, 1216 bp, Aspergillus nidulans
tcggttgagcccttgtccactggaagccctgtatcgcggtatttcgatgctaccgtgtcagcagatactgtctcctacttcgctgaggctggttggacggtccaggggacatctagcttgaacacgcccggccaccttaacatgaccgtcaagcagccgtatggcgtcgttgcttgcattatcccctggaacgtgcccatggcatttttcgcattcaaggttgcgccggctctggcggctggaaacacggtcgttctgaagagcagcgagaaggcgccattgactgtaagacatcttaaaacccatgccgtctgctcttatctaacacactaagtccgccctggcagccacgctgatcgccgaagccggcttcccacctggcgtcatcaacattctgtccggcttcggtacccccgccggcagcacgctagcatcacacatggacgtgcgttgcctcagctttacaggctcctcgttcacaggccaaaggattcaagcagcggccgccgcatcgaacatgaagattgtgcacatggaactcggcggaaagtcacctgctctcatcttcgaggacgccgacctagaaaacgccgcccaagcgacacagttcagtatccagtgcctgagcggacagacctgcatggcgaactcccggatatacgtccaggagtctgtggctgacgagttcttggccttgttcaaggaaaagttcggaagcgcggtccttggtaacccgctcgaatcaggcacaacacacggtccacaggtcgatgggctgcagtacgagcgtgtaaagtcttatatcactatcggtgaacaggacggaaaacttagcatgggtggtgatgcaggcaatgggtactttgtcaagccaactgtctttgagggtgtccctgaggactcgcgcatcgtgaaagaggaggtttttggtccagttgttgtgatcaacaccttcaaaacagaggaggaggccattaagaaggctaatgcatcggagtttgggctgtatgcatccgtcttcacaaaggatctagaccgcgcagtgcgtacctcgaagctcctggaagctggtactgttggcgtcaacactacaagtcctaatgtcgccaaggacatgccgtttggtgggtacaagatgagtggtgttgggcgtgagggcttcatgcacagtcttgacaacttccttgagaccaagacgattttgatcaagatgagc

SEQ ID NO: 36951 - DNA, 218 bp, Aspergillus nidulans
  unsure (1)..(218): unsure at all n locations
acctccgccctcgacacgtatacagagcaggccttgatgcaaaatatcaatagcattttgaaggagaagggcgnnacaagcgtgttcgtcgcccatcgctacggacgatatatgactgccgccagatattggtcttgaaggatggccaggtagcggaacttggctcacatcgcagactgctttccttggacggcatctacgccaagctatggagtggt

SEQ ID NO: 36952 - DNA, 1668 bp, Aspergillus nidulans
cagggtgactggggaactaagcttcgtgtagggacagccttatcgttgctcgttggtgcgaaggtgagattgacagagtggacttattattccgacagtgacttaccttgttggacttaggttctaaatgtcgaagtccccttctatttcaagagcatcgttgattctatgaatgtggactttgcagccgtcggcggaaccgcttatacagtggcgggatccatgatcattgcctgtgagttggtcgatcggtctcagagcttgcgagtggctaaccctgcttcgcagatggtgcaacgagaattggagctacttttttccaagagcttcgcaatgctgtcttcgccagtgttgcccaaaaggcaatccgcaaagttgcgcggaacgttttcgaacatcttttacgactagatctcaatttccacctctcgcggcagaccggaggtttaacgagggctattgatcgcggaactaaaggcatcagctttcttctgacatcaatggtgttccacgtcgtacccaccgctttggagatctccctcgtttgtggtatcctggtatctaagccctcgccataatgcatgtcagcacatctaacgcgtgcaacagacgcatcaatatggcatcaagttcgctgcgattactgccacgacaatgctggcttactccgcctttacgatagcgacaaccgcatggcgaaccaagttcaggaagcaagccaacgcagcagacaaccggggcgccacggttgctgtagactcgttgatcaactacgaggcggtgaagtacttcaacaatgaaaagtttgaggttgcacgttacgacaaagcgctgaaagcgtacgaagatgcctcgatcaaagtcacgacgtccttggcttttctcaattccgggcagaacatgatcttctcaagcgcacttgctgctatgatgtatcttgccgctgatggagttgccacaggcagtctgactgtcggtgacctggttatggtcaaccagcttgtcttccaactctccgtgccgctgaacttcttgggttccgtctaccgcgagctgcgccagtcgctgctcgatatggaaacgttattcaacttgcagaaggtcaatgtcaacatcaaggagaaacccgatgcgaaaccgttggagctcaaacaaggtgggcagatccgctttgagaacgtgacctttggataccacccggagcgtcccatcctaaagaatgctagctttacgattcctgctggacagaaattcgctattgttggccctagcggttgtggcaagtcgactattctcaggttgctcttccgatattatgacgtgcaagaaggacggatcctggtcgatggtcaggatattcggcacgtcacgatagaaagtctgcggaaagcgattggtgtggtcccccaggatacgccactgttcaacgacaccatcgaacacaatattcgctatggaaggctagatgcgtccgatgaggaagtccgcaaagccgcgcgccgcgctcatatccatgaactcgtcgagagactccccgagggctaccggacggctgttggcgaacgtggaatgatgatctccggtggagaaaaacaacgactggctatttcccggttgctcctgaaagacccacagttgctcttcttcgatgaagcagtaagtcatcct

SEQ ID NO: 36953 - DNA, 1158 bp, Aspergillus nidulans
  unsure (1)..(1158): unsure at all n locations
atgccagccaggnaccgattcgcgccgtcgccgaccggataccttcatctaggatctctccgcactgccttatacaactatttgctggccaagcgcacaaatgggaagttcatacttcggattgaagatacagatcaggtgcgcggagcgataccccatgagaatcggacgctgatggattgggtacattagaaacggacgatccccgacgcggaacaaagactgtatgatgatcttcattgggccggattacaatgggatgaaggtacaaaatgctgcgatcagccctggcggggccaacgctgatggagctgtaggtcccattgttggaggggattacggtccgtatagacaggtgagttttctcggcgcctcattattaactttattatctttaccgtggggactgactgattgtacattcagtctgaacgaacagaaattcatcgcaagtacgccgagaagttgattcagcgcggccacgcataccgatgcttttgctccccggagcggctggacgcccacgcgagacatcgaagccaagcgggccttcctccggggtatgataggaaatgcgccagcctgttgcctgcacattcggaagaacgggcagctctaggggagtcgcacgtcattcggttgagagttgaggaccacccgtacagataccctgtttacgatgatcttgtgtatggcgagacaggacacaagggcccgcccaccaagttggatcttatcgaccgtgtttacgatgatcctatcctgatcaaatccgacggctatcctacctatcatttggcgaatgttgtggatgaccatctcatggaaattacccacgttattcgtggcactgtaagtttaaaaaaaaaaaagctagtgggcgggtattgacgcgcctaggaatggatgtcgtcgactcctctgcatgttctgttatataaatgttttggctggaaggcgccacgcttcgcccacgtacctctgctggtggaccattcagggcaaaagctcagcaagcgcaatgctgatatcgatctgtcacatttcagagatcagggcgtatttcctgaacctttgctaaattttgccgcgctgttggggtggtcacacaaggagaagaatgatatctttgaccttaagaagctggagcaccgtgta

SEQ ID NO: 36954 - DNA, 807 bp, Aspergillus nidulans
cagatcgacaacagcttaacatcaacaagggcctgcgcatctcgcgtcagctcttcgtcgacttgaccaacaagggaatgccaattgccagtgagatgctggacactatctccccgcagtttctggcggactgtctctccgtcggtgcggtcggcgcacggacaaccgaatcgcaggtccatcgtgaattggcctctgggctctcgttccccgttggcttcaagaacggtacagatggctcgttagacgtcgcggttgatgcgattggatccgtaaaacaccctcatcacttcctgtccgtcaccaagcctggtgttgtcgccattgtcggtaccgttggcaatcctgattgctttgttatcctccgcggcggcaagaaagggccgaactacgatgctgctagcatcaccgaagcaaaggagaagctcatagctaagggtctggcaccccgtctgatggtcgactgcagccacggcaactcacaaaaggatcacaagaaccagcctaaggtggcagctgttcttgcggagcagattgctgcaggcgaaaccgcaatcatgggcgtcatgatagagagtaatatcaacgagggtagatacctccccaacctaatcctaaacctttttccgctaacattgaactctcaaaggcaaccaaaaggtcccacccgagggcaaggccggcctcaaatacggcgtcagtatcaccgacgcctgtatcaattgggaagacaccgagtcaacgctagagacccttgcaaaggctgttgcgactcggagagaaaagctcgcccccagttcatagtcg

SEQ ID NO: 36955 - DNA, 627 bp, Aspergillus nidulans
cagcagccgaagccacaagctctcgcaagcaaatctggtccctccgcgatactagtctcaacgcgtcaaaaaggaaatccgatcctgaatcacatcaaatttcagccgtgggagtacgccgacattccagccgactatgtcatcggcgcaaccacctgcgccctcttcttgtcccttaaataccaccgactccatcctgagtacatctattcgcgaatcaaacagctagcggggaagtatttactccgtgtgctgttgattatcgttgatatcccaaaccacgaagaccctcttaaagagctatccaagacgtcgatcatcaacaacctcacccttatcttgtgctggtccgccccggaagccgcgcactacctggaactctttaagtcatgcgaacattcccagcccactgctatacgcacacaacaagcacaatcctacaaagactcgctggttgagtttgtcactgcgccccgaagcatcaacaaatccgatgctgccagtcttatatccacattcggcagcttacagaacgcaattaacgcccagccagagcagatcagcgctgtgccgggatggggcgagaagaaagttagagcgtggtgcaatgccgtgcgagaggaattc

SEQ ID NO: 36956 - DNA, 1431 bp, Aspergillus nidulans
atgatccctgtgatcaataagattgttcggcatcaccatacgcatccagaagagcgtggcatctttgccgtcgttgtcgccccgacaaaggagctcgctagccagattgtcaacgaggggaggaagctggcacttggaacaggtgtaaaggtaacgctgatgaagaaggggatgcgggtagtggaacgtgagaacgaagatgaagatgtcctagatgagagtaattcagaatcatcagaatctgagagcgacgaaaggactcccaacaacaagaacaagggacccgttcctattaccaaaagtgacattcttgtttcaacacccttgcaactagtcaatgcgctctccgacaacaagacgaagcctctcgcaaccctaccattggtaaggaacttggttctggatgaagccgatgtcttgttagatcccttgtttcgtgaccagacattggacatctggcgctcctgcactcatccagagctccgtgccagcctttggtccgcgactatgggttctagcatcgaggacatggccaagacaacgatcaaagagcgaaagctgtctttgccgcaaaccaagtcataccccctacttcgacttgtcgtcggcttaaaagactccgctattccgaatattaagcacaagctagtctacgccgccacagagcaaggaaagctcctcggtctcagacagctcatccaccccacagctgcgacaacatcagatgtccgtcttcgaccacccttccttatattcacacagacaattcctcgagctattgcgttacattctgaacttctttacgacattcctcctgaggccggtggctctgcgcgaatcgcagtgcttcattcggacttatcggatacacagagatcagacatcatgaaaggcttccgtaaaggcgagatttggatccttgtcacgacggatttactcgcccgtggtgttgacttccgcggtataaatggggttgtcaactacgatatccctaattccccagctgtctacgttcacagggttggacggaccgggagagctggtcgcgagggtggcgtcgcagtgacctactacacaaaagaggacattccttatgtcaagagcatcgccaacatcatcgatgtcagtgaaaagctacgaggagaaaacggtgaacgatcagtgcagaaatggctactagatgcattgccagatctcagcaagaagaacaagaaggaattaaagaagcacggcgtcaaggctaggcaaacgggtctcaagggtgccacggatgaaaaggagcaacgccggacgagaatcagtaccaagagcgggttcgatcgccgaaaagaatacaacaagaagatgatgattgccgccagccagaagaaaacacaagcccgaaagaacggagctgattccgacagtgctggtgacgacgacgacgaagac

SEQ ID NO: 36957 - DNA, 2097 bp, Aspergillus nidulans
aaaagtgatcgccctaaaacaattatcaacttctcaaaatcacttccagcaggtgccacgcgagccgaagcagtgcacgccatctcacccgcgaagattcaacatcatcaacggcctctttcgctacgcctgagaactacaaacttgtcaaaccgctcccagctgcgttcatgtctactggcctcatctcgaagaaaaaccgcaatgccgacgattctcatagcctattaggatttagcaagaacatgcccgacaccccttgcaaaaggcctgtcaatctcttcgctgccagtcaaaaggctcaaccagatggaccacttggaaggccggcttggagcaatgctgtggacatgccacctccatcccccttcaacccatcaagcgcacggcctaaacaaggcccatttgcgcgaggcatgggaatatttgggactaacttcaatcgacaaggggcctcgcggcgtggaagcttggctagcattgatggcgatgatggatatgggctacagacacaatctccctctaaccgtcagaacagccagccactcagtgaatcggatttccctccaacaccaacgaaacaatcatttttcccgtctcgaacctaccctcctactgcatcacaaatcgcttctctcgagcgtttgtccgaggcaaggggcaccaattccagccctctacatgacagattccaacatgaatcacctcgtacgcctcaagaacatttctgccctcccgatcccagtggtctaactatttcaggacctaatgaccggcaatccgcccagccagacttcaatcctttaaacctgccagcgaccccgaccggtcctcgtgattctttcgttggaaaaaggcccagtctcccattgaacatacataatactcccgacgtggatgcgtgcctcacatctcgctttgaacgcgtggagcttgtgggcactggagagttttcgcaagtttaccgtgtttctcagccgaacggagtatctctgccatcaatattctcgactacccccaagtctttaaactcgctgcctgaccaggtctgggcggttaagaagtcaaaacaaccttactcaggcttgaaggaccgtgaacgccgtattcgagaagtcgatgcactgaaggcccttaccaactacgaccatattatatcatttgccgacagctgggaagataatggacatctctatattcaaacagaatactgcgaggaaggtagtttagacgtcttccttgctcaagttggactcaaagcaagactcgatgatttccggatttggaagattttgctcgagctgtctacggtaattgcccacctcgtttacatgtaactaaaagtatactaactataagaagggcctgaaacatatccacgactccgggttcattcatcttgatctcaaaccagccaatatactggttacctttgaaggtgttttgaaaattgctgatttcggcatggcaagtcggtggccagccgaagaggggattgaaggcgaaggtgatcgtgaatatatcggaccggagattctgatgggaagatatgacaagcctgcagacatcttctcactgggcttgattatattcgagattgctggtaatgtcgaacttccggacaacggcctttcgtggcagaagctcaggaacggcgacatgagtgatgtcccgagtttaacttggagctccgagaccaccgttttccgcgacgcgtcaggcaatcccatttcagaggagccatcgtttgaggaactgtgcgcgtcggactttggggacgacgattttggcacaactgatctctttggcagcaatagggaacgaaagccagtcccattcacccgtagtagtgagctcgcagaccctcccgcctttatgatcgatgccggccatgagcagtcgcttgataagatcgtgcggtggatgatctcccctgaaccgcttgatagacccacagctgatcacattctggagtcttatggagtccaatttgtcgcatcacggcgtcgagctggcgccaccgtgtacgagggcaactggggccctgccgatgatgttcttgcggaagatgccgaaatgatcgatgtttgattaata

SEQ ID NO: 36958 - DNA, 910 bp, Aspergillus nidulans
ttctacgcgattcaacgaggacacaaacccggggtgtataccaattgggccaatgctcaggagcagatcagaggatttcagaaacctcgatataagaaattttcaacaagggaggaggcggaggaatttgtgaagctcggcggggagcccgctcggtttgcgacttctacagacaccaaacttccaggggctccgggcttgacgagcgatatcccgaaagatcagcagggcaatccgtacgaaccgggcgagggccctttaccccccggtgtggaggatgggttcgatccgaatgtgatcctcgatccaaagaccggcaaggttgtctacaagacaccagagcagaaagcagctaccaaaacacagccaaaaggaccacccggcatgctccgtatttacaccgatggcagttcactgagaaatggaagggtacaagcgatggccggcgttggggtatactttgggcccggcgactcacggtttgtctccttcaggatgtcaaaagtatacctactaacaataccttcccagcagaaacgtctcagaacccctcaaaggcagtcgtcaaacaaatcaacgcgccgagctcacagcgatcctgcgtgcccttgacattgccccgcgacatcgagatgtgacaattgtcacagacagccagtatgcgattaactgtgttacggtctggtttcaaaaatggcgaagcaataattggttgactgcggacaagaaaccagtggaaaacaaggatctggtagaatccatcctgagcaagatcgacgagcgtacggagctccgggtcaagactctttttgaatgggtcaaaggacatgatgcggatcctgggaatgaagctgctgaccgtcttgcggtaaatggagcccagcgaggagcatctgagcaagagctcggc

SEQ ID NO: 36959 - DNA, 1395 bp, Aspergillus nidulans
caggacgttaccgctaccaaaggcctagaattcgaagacttctatatcaagcgagagttaatgatgggaattttcgaggctgggttcgaaaagccatcgcccatccaagaggaaacgatcccggtagcccttaccgggagggatatcctcgccagagcaaagaatggcacaggcaaaacagctgctttcgtcattcctacactcgagcgcatcaatcccaaaagcactaaaacacaggcgcttatcctcgtcccaacacgagaactcgcactacaaacttctcacgtctgcaaaaccctcgggaaacacctcgggatcaacgtcatggtaactaccggaggtaccggactgatggacgatattatcagactcaatgatgctgtccacatccttgtgggaacgccaggcagagtcctcgacctagccagtaagggtgttgcggacttgtctgaatgccctaccttcgtgatggacgaggcggacaagttgctttctcccgaattcacccctgtcattgaacaacttctctcatttcaccctaaagaccggcaagtcatgctcttcagtgctacgttcccaatgattgtcaagtccttcaaggtaagttgagtttccttgggtaccttcttgttcgcccgcgttctgacgcccagctcaggatagacacatgcgcaacccctacgagattaatctaatggacgaactcacccttcgcggtatcacacaatattatgcatttgtggaagagaaacagaaagttcactgtctcaatacacttttctcaaaattacagatcaaccagtccattattttctgcaattcaacaaatcgagtggaacttctggcgaaaaagattacagagctcggctattcgtgtttctattcacatgcccgaatgctgcaacaacatcgcaatcgcgtgttccacgatttccggaatggcgtttgccgcatttagtgtgctccgacttgctaacccgaggtatcgacattcaagctgtcaacgtggttatcaactttgactttcccaaaaatgccgaaacctacctacatcgcattggtcggtccggtcgttttggacatctgggtttagcaatcaaccttattaattgggatgatcgcttcaacctgtataagattgagcaggaattaggaaccgagatacaaccaattccgcagaatatcgataagaagctttatgtgtacgattctcccgacaccattcctcggccaatctcgaatccgcctcaacaatcccagggtgccactgcagcatcaaaccccagtgaccgccgtcataatcaccacacgaacgggggacattatcagtccaagggacgaggtccataccgaggtggacgtggacaaggccagcgtcgcaacatgcaaaatgat

SEQ ID NO: 36960 - DNA, 827 bp, Aspergillus nidulans
gacgggacaaaggtcgtcggagcggtgcagacaaggcggctcgtatgctcgatctcgctgccaatgctactgcgcctattcaggtcgccgctcacgacgccccgatcagatgttgccacatgatcccaaatccggccggtggcacgcctctcctcgtgacgggctcctgggacaaacaggtcaaatactgggatttacggcagtcaactcctatcgcttcgttagagtgtcaggaacgtgtttacacgatggatgtcaaggataaactgctagttattgggacggcggaccggtacatcaatatagtcgacctcaataaccccacaaaattctacaaaaccatgcagtcacctctgaaatggcaaactcgggtggttagctgcttcacagacgcaaatggttttgccgttggaagtatcgaaggccgctgtgctatacagtacgtcgaagacaaggattcgagctcaaacttcagttttaaatgccatcgcgaaacaccgcccaaccagcgtgatatcaacaacatctactcggtcaacgccatttctttccaccccgttcacggtaccttcagtacggccggtgcagatggcacttttcacttctgggataaggatgccaaacatcgtcttaagggatatcccagcgtcgggggcacaatttcaagtactgccttcaatcgcacaggcaacatattcgcctatgccgtgagctacgactggagcaagggttactcggcgaacaccccacagcttcccaacaaagtcatgcttcatccggttgcgcaggaagaagtgaagccaaggcagaacgctaggaggcgataa

SEQ ID NO: 36961 - DNA, 1072 bp, Aspergillus nidulans
ttcgaatcagaggccgttcccggcacaattccacatggccagaacagcccccgcaatgtccgtttcgggttgtacgcagagcaggtcaccgcgacggctttcattgccccccgtcattgcaacaagaaggcttggctgtaccgcgctcgtccggccgtagcgcatgaaggattcgtacgcagtaaccgatcgattccaggccgaacttggtgctaacagtgtcctgtttcagaccgaactccccgacaacaaagacaccgagtgcagtttccttcccctcaatcctcgcatccatgtctcccccactcagctcgcctggcacccgtttgacatcgaagagtctgagaccgatttcgtcgccggtctcaagactgttgccggctccggcgaccccaccctccgtgagggcattgcaacacacgtttacacagctaacaagagcatgacaaagagggcctttgtcaactccgacggcgagttccttattgtcccccagcaaggcgccctcgacatccagaccgagttcggtcctctatttgtccagcccggtgagattgtcgtcatccaacgtggtctccgcttccgcgttgagcttcccgatggcccttcgagaggttatatccttgagatctggggctcgcagttcgagcttcctgaattagggcctctcggtgcgaacgggctcgcgaatgcgcgggacttcctatacccgactgcgaaatacgaagtcgttaaggagccgtgggagattatctacaagctaggtggcaaattcttcaagagcacccagcagcacagtccattcgatgttgtggcgtggcatggaaactatgtacgtcatgcgcttccgaaccttcttccttcctcttatggtaaacgtaactgacagttattgcaggtcccatacaaatacgacctgacaaaattcgtcaatgtcggctccatctccgttgaccacatcgatccatctattttctgcgtccttactgccaaatcccgcgaccttaatgcccctctcgccgatgtcctgatcttctcgccccgctgggatgttgcatcgcgtatgttccac

SEQ ID NO: 36962 - DNA, 1410 bp, Aspergillus nidulans
tacagcccctactacaaggagtcccaccgacgcctgcaaaaggaagcccggtcgtatatcgacacccacatagccccatattgtgacgaatgggaaaagaagggttccgttcctgtagaagtatgtactcaacacactctgaagtccttgataatatgcattcctaacgttgcacaggtgtaccagcgccacgctgcgcttggatatacagcggccaccccatttcccctagccacggactatctgcgtggccagaagctccctgcgggaatcaaagccgaagaatgggacggcttccacgacttgattgtcatcgacgagattgcgcgatgcggctatcttggtgttatctgggcactgggatgtggcaattcaattggcgggccgcctgtcatcaactttgggaatgaagagcaaaagaaccgattcctgcccgatatgctaagtgggaagacacgattttgtctgggtgttacagagccggatggttcgtactcttatctacgcatagttttatgctgtgggctaattgggacagctggatccgatgttgcgggcatcaccacgaccgcagaacgccgcggtgacaagtatatcgtgaacggggcgaagaagtggattaccaacggtatttttgcagattattgtacagctgctgtgcggacaggaggcgagggtatcgctggggtgtcggccctggtgattccactcaatgcgtccggcgtaacgcgcaggaagattgacaactcgggtgtccttgccagcggtatgcatgtagtctacatgtgcgagaactatcctgaactgacgcattcatgaagggtctacgtatatcgaatttgacgacgttgaggtgcccgtgtccaaccttctcggcgaagaaaacaaagggtttcccattatcatgaacagtatgccctgcgactaccctaccaccagttgtcgtgcctgacatggatagactttaaccacgaacgtctctggcttgcttgtacatcgctgcggatggctcgcgtctgtgcggaagatgcttatcgtcacgccataacccgcgagacgttcggtaagaagcttatcgagaaccaggtgatccgggccaagttcgcagcaatgggacgaagtctcgactcagcatatgcatggatggagcaactcgtgtacatggcggagacagcaaaggccaatcacaccgacgcggcaatgggaggcctgtttgccaaccttaaggtccttgcgggacggaccctggagatggtaaatagggaagcccaacaggtcctcgggggtctcgggtactcgaagaacggccggggggctcgaattgagcagatcagtcgcgatgttcgggttatggttgtcgggggtgggagcgaggagattctgtcggaactggccgtgaaccaggaaatc

SEQ ID NO: 36963 - DNA, 1019 bp, Aspergillus nidulans
aatgtgctcgcttcggtcaagatacttatcctgtttttgatcattgttgccggtctgcgtgctcttcaaggcgatctcccccagatccctgacccggctagtagcctgaagtcgccctttacaggctcttcatcttatgtatcccgttacaccaatgccttgttcaaaatcctggccacctaccaaggctggtcaaatgccgcatacgttcttgacgaggtgaaggaccctcgcaaggttctaaagatagctggcgtcgtgggcgtgggattggtagggatactctataccctcaccaatatttcctactttattgtcgctactccagacgagatcagcaagactggagtcacagttgtcgcactcctgatcggtaaagtatttggagatactatgctctggttgacagctaccctggcggccttatcgtcattcgggaacctgatgacagcatcttttacaatgtcgagagtagttcgggaattcgctagggaggggatagtcccctattctcggttctttgccgctacgacgtcctccggctcgccttcagcagcgattcttcttgtattcttgtcatcagcagttatgattctatttattccatttggtcagtttttatctctccttggcctcagcgtactgaaactgaaattcttttgataggggaagtatataatttcctcctagatgtcagccagtacgccatcgccctagtcaacgtccttgtcgtcatcgcacttttcatcattcgtcggaaacaaccccacaggcgcactttccgagcttggactcccgtcatctatttatttcttgcgtcccaagtgtttttgctcgtcacgccgttcattcctgcagcgctagacacgggcagagctctgccgccttggctgtactccgtggttgcgcttctagtctttttcggctctggagtctactggtttatgtcatgggaagttcttcccaggcgcggccagtttgtttggactgcgcgggagtcagtcctcgcagatggatct

SEQ ID NO: 36964 - DNA, 1570 bp, Aspergillus nidulans
gaacatagtagaggtatccttctgtatggtcccaagggaacaggcaaaacaacacttcttggccagatcaggcaggccggttggcgaaggacgtttgaccttagctcctcgtcaatcggtagaaacgccggagatggagaccagaggctgcgccatatattccaagaggccgttcgttatcaacccagcgctgtgataatagatcaacttgacttcattgcacccaagaagcaatcggtggactcgtactctctagcgccggtattgtgcgaatgcatagagtcagcaaaatcggcgcgtgttttagtagtcggcgctactcgccatccaaacgacgttgatgatgctttgcggactcctcaccgatttgcaactgagattgagctacaaattccaacagcacacgatcgatccgaaataattgctgctatatgtgggggtccctctccctttttgagcaaagccttggtcgagcttatagcggagaagacgcatggctatgttggagcggatatattcgctttgctgcagcttgtatgccgcaaagcccgtcaaagacaaatcagtagcaatggggaaagtcattcagaagttgcggatacaatttctgagggtgtcaaatcattgcgtctagatggagaaccagctatcggtctgaggattgaggaaggcgacattatcttggccttacaggaaaccagaccaactgccatgagagaagtgttcttggaaactccgaaagtgcggtggtcggacatcggtggtcagcatgacatcaaaagacgacttcagaaggctgtcgaacggccactgaaggtaagtgcttacaccaggacaaaatgcggcttatggtgcttactacgctagtttcccgaacgaatgaaacggcttaatgtaaagagcaaaaagggaattcttctctatggacccccaggttgttccaaaactctgacggtgaaagctttggctaccgaggcaggattaaatttcatggccgtcaagggtgctgagattttgagcatgtacgtcggcgaatctgaacgagctctgcgcgaggtattcagaaaggcacgctctgccaggcctagcatcattttctttgatgaaatagatgctatcgcctcgaagcgtggaagctcacctcaaagcggcgtgaatgtgcttacaactctgctgaacgagatggacggtatcgaggagctcaagagcgttttggttgttgccgctacgaacaaacccgaggtactcgatccggccttgatgcgtccagggcgtttggacaatatactatatattgggcctcctgactttgaggcacggaaggagatcctaagcatttggttctgcaagtcgatagtccaccctgaagtgaaagttgaggagctggccatgatgaccgagggatatacgggtgcggagatagtgagcatctgcgagactgccggggacgctgcgctggacgaagaggatgagagtggtcaggaacaagatgtttgtagagcgacattttgagtatgctctgaaacaagttagaagacaagttactgaggatgtcatccaagattatagc

SEQ ID NO: 36965 - DNA, 1822 bp, Aspergillus nidulans
caactcatccaccaccttatactgcgatcgtttgtagtagggtacgctctttctaccgccgacattgctctgtggggtgccctccgtggaaaccgtgtcgccattggtaccatccgaaaggaaacattgattaccctccctcgctggttcaacttcttggaggagctttgcccatgggctgttgctgccttgcaggctctgaatgcctctgccaaggacaagagggccgcgaaggcaaaggaaggtgccagctatgacattgcactcctaaacactgacaaaggggtcgtcacccgtttccctccggagccttctggatacctccacatcggacacgccaaggccgcgcttctgaacgactacttcgcccacgagaagtacaagggaacactcctggtccgcttcgacgacaccaacccttcgaacgagaagcaggagtttcaggacgctatccttgaggatctcgcccttatgggcatcaagcctgacaagactagttacagcagtgactactttgacgaactccagcagtacgctgtccagattatcaaggacggaaacgcctacgctgatgataccgacaaggagacaatggcttcccagaggatgaacggcgagcccagcaagcgccgcgatgctacagttgaggagaatctggctcggttcgaagagatgaccaagggcaccgaggagggtgcccgctggtgtatccgtgctaagatgtctgttgacaaccccaacaaggccatgcgcgacccggttatctaccgctgcaacccggccccccaccaccgcactggcaccaagtacaaggcttatcctacgtacgacttctgctgcccaatcatcgactctctggagggcgttacgcacgctcttagaactattgagtaccgcgaccgcaaccctcagtaccaatggttcttggacacactcaagctgcgtaatgttcagatctgggactttgcccgaatgaactttgtccgcaccctactttccaagagaaagctcacaaagcttgtcgagcagggcgttgtcgacggctggtcggaccctcgcttccccacaatccgtggtatcaggcgccgcggaatgaccatccctgctctgcgtgagtttatcctcaagcaaggtcccagccgaaacattgtcaaccttgactggacctcgttctgggccaccaacaagaagtacattgacccggtcgccccccgccacactgctgtcctcaagaaggatgccgtgaaggcgactatcaagggaggtcccgattcgccatacactcaggacaagcctaagcacaacaagaatcctgatgtgggtactaagaaggtgacctacagcagctcgatcctctttgaccaggaggatgccaagagcttcaagcaggacgaggaaatcacgcttatgaactggggtaacgccttcgtccgcaagatagtgacagatgcctctggtgttgttaccgagctggagctggacctgaacgagaagggtgacttcaagaagaccgagaagaaggttacttggttgtctaccgaccaagacctggttcccgttgaccttgtcgattttgactaccttctcaacaaggattccatgcaggaggaggacagtctcgaggacgtcttgaaccccaagaccgagttccacgaggatgccgtcgccgacagcaatgtcgctctcctggctgaaggtgatatcattcagttcgagcgcaaggggtactatcgcctggacaaggttgcctcacctggcaagcctgctgtcttctttaacatcccctccggtaagactggtaaatagattaacagttcagtgg

SEQ ID NO: 36966 - DNA, 672 bp, Aspergillus nidulans
tttgccctccccaaggcggactacatcctcggactcccaacagggcagcatgttgccctccgacaaccgtcgatggaaagaccgtccagcgcagttacacgcccatctcgaacaacaccgaccgcggcacattgagcttctgataaaggtttacccaaagggcctcttgaccaaccacctagcgcagatggaggtcggagagacgatcgaaatgcgcgggcccaagggcgccatgaagtactctgctcaatacgcctaccggatcggcatgattgccggcggaacaggatcacacccatgtaccagcttatccgggcaatctgcgaagatgagtccgacaatacacaagtcagtctgctgtacgccaacaacggcgaggctgatattctcctccgtgaggagctggaaagctttgcggggcgtttcccacacaagttcaagatggagtatgtcctgagctttcctgatgataactggaagggatatagagggttcgtgaatggggaaatgatcgcgaagcatattgggtcgccggcggatgatgcaaaggtattgctctgtggaccaccgccaatggtcgaggctatgaagaagacgctggccggcatgggctgggacatgccaggggcaattgcaaacgggacagatcaagtgtttcttttttagaccaaa

SEQ ID NO: 36967 - DNA, 1098 bp, Aspergillus nidulans
atgggctctcttggaccgtataagcaaaagcacaaggtgactgtggtgggatcgggtaactggtatgtaccggcctggcggcttgcctgcagaatttcaataattttggtactgatagcacaaaaggggcaccgctatagccaaaatcgtcgccgagaatactgccagcaaccctgcggtctttgagaaggatgttcagatgtgggttttcgaggaaaaggtcgagattccgaaatcgtcgaagcattatgatcctgcctcttctctttgccagggcccgcagaatctgacagatattatcaaccatacccatgagaatatcaagtaccttcccggaattacccttccggaaaacttgattgccaatccatcgctagtcgacgcggttcaagacagcactatcctcgtcttcaacctaccccatcaattcatcatcaatatttgtgaacagatcaagggcaagattgtcccatacgcgcgtggaatttcttgcataaagggcgtggatgtgaatgaggaaggagtccacctgttttccgaaacaattggaaagattctcgggatctactgtggcgccctgtccggtgccaacatcgcgaatgaggtcgcccaggaaaagtggtccgagtctagcattggttatgatccaccgcattttgactctaaagccccttctcctcccaaccgatccccttccgcatcgtctgacaatatcctgcacttcgagcacaaagacgtttcgggtcaactttcgcgggtaaagttacaggctctaccttccgaatttcctcccatcggccatgcccttctcaagtcgctattccaccgtccttacttccatattggtgtggtaagtgacgtcgcaggtgtttcgttaggaggtgcccttaagaatgtcgttgctgtcgcggcagggtgggttgtgggcaaaggatggggagacaatgcgaaggctgcaattatgcgagttgggcttttgcaaatggtgaagttcgccccccagtttttcggtgctaccatcaacacaagaaccttcactgaagaaagtgctggtgttgccgatctaatcccgacttgcagtgcgcacaaaacttccgc

SEQ ID NO: 36968 - DNA, 753 bp, Aspergillus nidulans
aaagaagaaataactctgcagacaatcaaaaatgcgattcccaaacactgcttcaaccgctctctcctcatttcctctgcatacgtcgtccgcgatctcctctacgcctccgtcctcttctactttgccctgcacattgacaccctcttttcctcgcaactcctccgcatcctcgcctggaccgcctacggtttcatgcaaggctgcgtcggcaccggaatctggatcctcgcacacgaatgcggccatggagctttctccccataccaaacgtggaacgatgtcgtcggatggacattgcactccctcctgatggtcccgtatttcagctggaagatcacgcacgctcgacaccaccggtacacaaacaacacagagcgagatacagcatttgtcccctggacagagaaggaatacgacactcgcccgcgctacttccctgcctggtttgagatgtttgaggacacgcccgtctacaaccttattagcctactggcgcatcagatcgcaggatggcagatgtatctctgtttttacgttagcgccggcgcaaagagtaagcctgtaccgcagggaaaacagagcgggtggtttggaggccagcagagcgccagccactttgatccgggcagttcgctgtggacggaaaaccagcggcatctgattgcgatttcggacctggggttgctgcttgttacgacggcaaattggtaccttgcgcagcaagtgggcgtgctccgcatggtgctgatc

SEQ ID NO: 36969 - DNA, 1546 bp, Aspergillus nidulans
cgagtccttcgttatgcaagaggcaaatgtttgggtggcacctctgcgcgtaacttgatggtctatcaccggtaagtgctccgtaagcgttctacatcagtctcatcattcaatactaaccacttgatagtggaacccagaaaacctatgatcaatgggcagacatcacaggagattcctcgtgggcttgggaatcggtgctgccctacttcaagaagagctgcacgctgacgccaccggatatgaccaagcgcaacaagaattcgagcgtgacttataatgcagatgcattcgacaacgatttggatggccctctccacgtcagctggcctaattatggctccccattctccacgtacgtggaagttgggctagaaaaaatcggcattctcccagggcaagacacgaacagcggctacctcaatggctctgcttgggcagccgcaactattgaccccagcgccgaaacaagaagctcttcaaagacaagctttctacctcaatttacgttgaacttcaacgtctatgcgcacacccttgcaaagaagatcatctttagcggaactaaagctcgaagcgtcaaggttgagactctcggcatatcttacactctcacagcaaagaaggaaataatcgtttctgccggagccttccagtctccccaaatcctaatggtttctggaattggaccaaagtcaaccctgcaagagctcggtataaaagtcataaaggacctcccaggcgtcggtcaaaacctctgggatcatgcactcttcggagtcgtcaatagagtcaatgtcgttactgctagccgccttgtgaacgacgccctcgccgccgcagaagctttagccaatacgccttccaaaagggacccctcactgctcccggtttcggcgtcctaggctgggaaaaacttcctaacgatatccgcaagcatctcacaaacagcactcgtgaagcgctctccgcctttccctcagactggcccgaagtcgagtaccttagcctcgatggcattctagatggttggcacagcgccgatgaccagaacttaggagacggctacgaatacggcaccattgcggccgcccttgtcgcccctctctcgcgggggtctgtctctataaacagcacagacaccgccgaacccccccttatcgaccttggttacctcactcaccccgcagaccgggaagtcgccgttgcagctctcaagcgcgcccgacaggctttcaacgcatctggtgtcacaattcccggggttgacgagcatcgccccggcccggatattcagaccgacgaggagatcttggattttatccgctcgactatcgtgcccgtttggcatgctgcagggacgtgtgcgatgggtaactctagcaaccctgatgctgtggttgactcgaatggccgggttattggagtacagaacttgcgcgttgttgatgcaagtatctttccaactttgccgccgggacatccgcagagtacgtgctatatggttgccgagaagatcgcggacaatatcaggaacgggaattaa

SEQ ID NO: 36970 - DNA, 867 bp, Aspergillus nidulans
gacctcacagtcgccgtcattggctgcggtacgtacactctcaatgacacgagaacgaaactgatacaactaggtaccttgggaactgccatcgcggctggtatcctcgatccaaaagacaagagtggcatcaacatcaagcgcttaatagctacagtgggcacagagccctccaaacagcgtgtcagagatgcgctgtccacgcacgagtcgcgattgacagtccttacgcatgggggcaatgttcgcgccatccaagaagcagacgtcgtcttacttgctgtgaagcccttcaagcgagcagaggtcttctgtgctccagggttcaaggaggccatccgcaacaagctcgttctcagcattatggcagggattacgacaaaggagttcgctcgtcttgcgattggtgacggcgttgttccaggcattctgcaagttgtccgtgcgatgcccaacatggctgccaaaatccgtgaggccatgacgctctacacccccagccccggcacgagcccagagaatctaagtatcgcgtcctggatcttcggccaggttggcgaatctcatcagatccccgaggcttccttcgacatctgcgccgttctagtgggatgtgcgggctctttgctgcttcttgcagtcgatggtctcctagatgccgctgttgcagaaggtgtcaggagatccgaggtgcagaacctggtcgttaacagcgctatcggtatgctgaagcttgttcctgctggagatcaccccagcgtcttgagagagaaaattgcttctcccggtggatgctcgatccaggctctgttggaattggagaggctgggggcacgctcggcctttacgagggctattatggcggcc

SEQ ID NO: 36971 - DNA, 1026 bp, Aspergillus nidulans
tctacgggacacagcatccctgctgttggcctaggtacctgggtatgcggaccagccagctataccttgaacaagtactgttaacatagctctctcagccccatggaattgaaaaaggggttgaggctgctctgcgcgctgaataccgtcacattgacgatgccacctgctatctgaatgagaacagagttctgaatagatggaggacgccccgtgtaccttgagacaagagttcgttggtggtcaccttggttacctttcaaacagcagtcaggagctgagcctgcctgaaatcacaaggttctggaattcgcagcatcaccctgaccacatcggagaggcgcttgacaaaacactgcagggcttgcagagggaatatcttgactaatgtctggtacgcttgacactcaggactccctgaccgctcgctgatgggcttcgagatttactgggccgcgctttcgagcgtatgtgaactcttaagctgatggagtctattataaagtggtcttgtttggccaatatctcgatgatgacatctggatagcgctagagagagtcgtctactcgagcaaagtcaacagcattggcgtcacgaatcatacaatcgaggaacccgagaagctactgagtatgcggagatacctatcgcagtgaacaaaattccaagcttttccatagctccagcaacaaacttacgcagtggttagagggcaagaagattttacggttgcctatagaccgctagatataacatctagcatgtacctcggtaactctctttttcgttgggggacttcgacaggtttagatagctatcgccgctattgatcatatgacggagagttcgctgatcctatcgtgcaggtaatcgctgctgggctcaataaagacccaggaattgcccgatcccgtgggcaatgcagcatattacagacgttattgccaaagggtgtcacatcatcccgcattgagggcaactttcaatgtacatatcgtttttcagtgccgtattgaaacagtgaa

SEQ ID NO: 36972 - DNA, 1456 bp, Aspergillus nidulans
cgagtcaactcggagaacaacatgtacgtaggataccggaaccaaaaatcatttcgtttcttagggatcccatacgcggatgctccaactcggttttcttatgcgacgcatactctgaaaagttccgcacaatcaaggctacggagtatgggtccagttgtgcccaggttgccggtggcagcgaggactgcctgtacctcaacatccaaacgccatatatcccgaagaagaactctacagctggcctacggccagttcttttctggatccacggtggtaatttcgttgctggcgctggttctgaccctgcgacggacggtggcaatttagcctcacgagaagacgtggttgtcgtgacattcaattatcgactctcgacgttgggctttttagcggtgccagggacagacatccaaggaaaccaagggatcgctgatcagatccttgctcttgaggtagttctatacaggaactggaacgtggattcaggcagtgctgatgtgtgcagtggacaataaaaaatattgctcaatttggtggcgaccctcgacgcatcaccatagctggtgaaggagcaggtgctaggtctgtaaaggctcttctaggctcacctcttgcatatggaaagtttcaaggcgccattgcgatgtcggacgtgagaaatggcgctggcattaagtacgaacatcgtgaagcgtcatatagctcatacctgagcgtctcagaatcatatcaaacagccggccagaaaatattattcgaagctggctgtaatcaggacacgactgagcagcagatatcatgcttgagggaccttcctgcgtctactcttgtcaatttgccaacgattgcacaccacatcgttcaggacgggaaatatatcaatacaacagacctaaacctcagtgagagacatgcaggcaccgctcacgtcccggttatattcggaaatgtcgccgacgaaggtgcatcattcatccctttctccaataacatcgagtctgagctcgagggtatccaagaatttttgaatatcagcaccacccaggccctcaaaatcatcgattcaaacctgttccccagtcccaacacaggtaatataaccttggattctttcgctgttgcccaacgcatagcgacagacattaaaatccggtgtataaaccaagccgccctatatgcaggtgtatccaccggcgttttcaaaccatcatactactatcaggtgcagcgaacaattggcggcaccgacccaaataacctcggcggaccaccatcatcgtctgagtatccactcggagatccagaccttttctatttccgtcttcacggttcagacctaccttttgtctttggcaatctcgatgctgctcgagatcctctagacctcttcgctgcacagctcatatcatcctatttcgctgagttcgtacgctccggacagcccaatcctgac

SEQ ID NO: 36973 - DNA, 925 bp, Aspergillus nidulans
ctcgacgtgcccaccattcgaaaacacgccgtacgcctcgcgaaggccggactcgttggccttgtcgccatgggctcaaacggcgaagctgttcatctcacactcgaggaaaagcagaccgtcatccgcgagaccaggtccgccctcgatgaggccaacttcacgaacgtccccgttatcgcaggtgcatctgagaacagcatccgaggcacgattcaattgacgaaagaccttgccgctgctggcgcagagtacgcgcttattgtcccgccaagctactaccgctacgcgacggggaacgacgagacgctgtatgagtacttcacatccgttgcggatgggtcgcccattcctcttattctgtataactaccccggagccgtcgcgggaattgatatggactcagaccttatcattcgcatctcccagcacccgaacattgtagggacgaagttcacctgtgcgaacacaggaaagttgacccgtgttgcgagggcgttgcatgctatcaaacctgagtcaccgcttgcgccgaccaagtccccggtgcctgtgaccaagagggctgcgaaccacccctatgtggcatttggaggtattgccgacttcacgttgcagacgttggcgtctggtggatcagccatcctggccggtggtgccaatgttatccctaagttgtgcgtcaaggtgtttacactctggagcgagggaaagtataacaaaggcgatggaggtgcagagtctccttagccaggcggactgggtgctgaccaaggctgccattccgggtacgaagagtgcgattcagtcttactatggatacggcgggtatcctcgtcgaccactggcacggcttagtgatgcgcaggtcgaggctgttgcagctgggattaaggaagctatggacgtggagcgtacattgccc

SEQ ID NO: 36974 - DNA, 3720 bp, Aspergillus nidulans
gtgggtatctataccgacagcgtcctcaattcctaccgagggaagaaccggctcgaagtccctccacatgttttcgcagttgccgaatcagcctactacaacatgaaatcgtacaaagacaaccagtgcgtgatcatttctggcgagtcgggtgctggtaaaaccgaggcggcgaacgggatcatgcagtacattgccagtgtttccgggggaagcgattcatctattcagcagacgaaagacatggttttagcaaccaaccctctactggagtcgttcggtaacgcgaagacgttgcgcaacaacaattcctcacggtttggaaagtacttggagttggagttcaacgcccaaggcgagcccgtcggtgctaatatcaccaactatctactggagaagtcgagagtggtgggacaaattaccaatgagcgcaactttcacatcttttaccagttcgccaagggcgcgccgcagaaatacagaggtaaacttcagtggctttgatctggtattgcgcttgctaatctgatacagactcgttcggtgtacagcagcctcagtcctacttatatacgagccggtcgaagtgtttcgatgtccctggcgtcgacgatgtggcggagtttcaagatacgctaaatgcgatgtctgtcattggaatgtcggaagctgagcaggataacgttttccgtatgctagcagcaattctgtggatgggtaacattcagttcgccgaagatgattccggcaatgctgcgattacagaccaatcagtggttgacttcgtcgcatacttattagaggttgacgctggtcaagttaaccaggcattgaccattcgcatgatggagactagtcgaggtggtcgccgtggctccgtttatgaggtgccactgaataccacccaagctctggccgtacgggatgctctggccaaggcaatttacttcaacctcttcgactggattgtaggacgcgtcaatcaatccttgactgccaagggagcagttgcaaattcaattggcattctcgatatctacggtttcgaaatctttgagaagaactcgttcgagcagctatgtatcaactatgtcaatgagaagctgcaacagatcttcattcagttgacactcaaggctgaacaagatgagtacgagcgtgagcaaattacgtggacgccgatcaagtacttcgataacaaggttgtgtgttcgttgattgaagataagcggccccctggtgtcttcgctgccctgaatgatgcttgcgcgacggcgcacgctgactcaggagccgcggacaacactttcgttggacggctgaacttccttggacagaacccgaatttcgagaaccgtcagggccagttcattatcaaacactacgccggcgatgttagctacgctgtccagggaatgacagacaagaacaaggaccagctgctcaaggatttgctgaatcttgttcaatcgagtagcaaccatttcgttcacactcttttcccggaacaggtcaaccaagatgacaagcgccgaccacctacggcaagtgacaagatcaaggcttctgccaatgatctagtagcaacgctcatgaaagcccaaccgtcatatattcgaaccattaagcctaatgataataaagcgccgaaagagtttaacgagagcaatgttcttcaccagatcaaataccttggtcttcaggagaacgtccgcattcgtcgggctggtttcgcgtaccgccagactttcgacaagttcgttgaacgtttctatctgctgtctccgaagacgtcctatgccggtgattacacctggacgggcgacgtggaaacaggagcgcgccagattctgaaggacactcggattccggccgaggagtaccaaatgggtatcacaaaggtatttatcaaaacccccgaaacgctctttgccttggaggctatgcgcgaccgctactggcacaacatggctattcgtattcagcgcgcatggcgaaactatttacggtaccgtaccgagtgtgccatccgtatccagcgcttctggcgccgaatgaatggaggacttgagttgctcaaattacgtgaccaagggcatacgatcttgggtggccgaaaagagcgtaggagaatgagcattcttggttctcgacggttccttggtgattacgttggtatcagcaacaaaggtggtcctggagagatgattcgcagcggcgcggctattagtagtatgtattttcatgaggtttcgggatgatttttctgacttttttagcctctgatgatgtcctattctcctgccgcggagaggttcttgtttcgaaattcggtcgctcaagcaagccttcgccacgcatcttcgtcttggtatgtcccttattcgctgtaagagttctctctaacatgcacagaccaatcgacatgtttacattgtgtcccaaaacttcgtcaataaccaacttgtcatttcatcggagagaactatccctatcggagccatcaagaccgtcagtgcttctagctaccgagacgattggttttcgttagtggtgggcggacaagagccagatccgctctgcaattgcgttttcaagactgagttttttactcatctgcacaatgctcttcgaggtcagttgaatttgaagatcggcccagagtaagttccgttcaacctggatggcggcccttattaacaacggtaggattgaatacaacaagaaaccgggcaaactagccactgtcaaggtagtcaaggacggatcgcaggttgacagctacaagagtggaacgatccacacaggtccaggcgaacctccaaactctgtctccaagcctaccccacgagggaaacaagtagctgcccggcccgtcacgaaaggaaaacttcttcgtcctggcggtccaggcggtggcccgtccaaactggcttccagacctgtaccagagcgtcggcctataccacagcccacgcctcaaacagccgcggcgcaaccgacaccagcgtccagacccgttcctcaaccagtggcagccgttgcagcatcccattcacgtacttcatctactgcctccgcaagggcaccacccccgcctcctcccgcaccacctgcagctgcaggaccgaagaaagcaaaggccctgtacgacttcagcagcgacaacaatggcatgatatcgattagcgcaggacaaattgtggaaatcgtttccaaagaaggaaacggtcagtatatcttttcccaaattattgaacatcttcctaacacttcccaggctggtggctgtgcatgaacctcgaaacctcagcgcaaggctggacacccgaagcatatctcgaggagcaagttgcacccacgcctaaacccgcacctccacctccacctccagttgctccccgagcaagcccagcaccagtgaatggatccgccgcagttgctgcagcgaaagccaaagcggcgcctccgccccccgctaaaaggcccaacatggcaggccgtaaaacagcacctgcgcctccacctgcaccccgcgatagtgctgtcagcatgaattcgcaaggagattcttctggtgcaagtggtcgcggcaccccaagcagcgtttccaatgctagtcttgctggtggtcttgccgaagccctgagggcacggcagagcgcgatgcaggggaagcaggatgacgacgacgactggtgatcgttttacttcttcttt

SEQ ID NO: 36975 - DNA, 602 bp, Aspergillus nidulans
ttcactcccaaacctttcgaggaaaccgacattgaagtccaaataacccactgtggcatctgcggcagtgacatccacaccatccgctctggctgggccccagcagactatccctgcgttgtcgggcacgagataatcggcacagcaacgcgcatcgggcgcgccgtcaataataagcaaaacatccaacccggcgaccgcgtcggcataggcgcacaatgctcctcctgcctacgtccagactgcgaagcctgcgccgacggtgaagaatcctactgcccgaagatggtgggaacctacaatagccgtttccccgatgggagcaaagcctatggtgggtatgcgaatcggtggcgcggcctggccactttgttttccgcatccctgagcaattgagtagtgcggaggccgcgccgttgctctgcggtggtgttactgtattcgcgccgctacgacgctttggcgctggacccgggaaacgcgtaggaatagtgggtatcggcggactagggcatatggggttactgtttgcgagggcgctggggagtgacgcagttgttgcaatctcgcggtcttcgtcgaaaaagagtgatgcaattggg

SEQ ID NO: 36976 - DNA, 2847 bp, Aspergillus nidulans
ttcatcattagggctctggtcgaccgtaagctccacaggtcggaaccgaggattgaccgcagtcgctcaatcagagagctgtgtgcggcaaagtccacactacagaatgaactgattggcgagctggccaatgagttccagacctctctccctgatcgcgcgcaggacgtctccctagcggacttggatgctgccctgggcgaggtctcgctaggacccacgtcggtttctcttctgcagagagttttcacggcgaagatgccggcccgcatgacagtgtcgaatgtgcgtgagcgtttgaccgaaatctggggccttggatttcatcggcaaactgcagtcttggtgaccgcacttgcggctgagcctcactcccgactcacctccttggaggcggcatatcagtattgggacggtttgaccgaggcctacgggcagtcattgggtcttttcttgcggaaagctatctcacagcaagctgcacggagtgacgaccaaggcgctcaagctatagcccctgcagactcgctcgggtctaaggatcttgcacgaaagcagtacgaggctcttcgcgagtacctagggatacggaccccaactacgaaacaggatggtctagatcttgcagacctacagcagaagctggactgctggactgccgaattttcggacgacttcctcagccagatttcgcgtcgcttcgacgcacgaaagacgcgctggtaccgcgactggtggaactcggcgcgccaggagcttctgacaatctgccaaaatagtaatgtacaatggacagacaaaatgcgtgagcactttgtccagcgcgctgaggaaggccttgttgagattgctcgggcacattcactcgcgaaaccccttgtgccggacctcatccaggccatttctctccctcctgtcgtccggctagggcgtttggcgaccatgatgccacggacggtggtgacccttaagggggagattcaatgcgaggaacatgaacgggagccttcttgctttgtggagttcttcagcagctggatccaggcaaacaacattcgatgcaccatacaatctaatggggaagacctcacatcagtattcatcaacagtctggtacatgccagtcaacaaggggtttcttttgccaaccacacataccttataacaggggcgggaccaggatcgatcggccaacatatcgtccgtcgcttgttaacaggtggtgccagggtcattgtaaccacgagccgcgagccattgcctgccgctgccttcttcaaggagctgtatagtaagtgtggaaatcgcggatcgcagttacatctagtgcctttcaatcaggccagcgttgtggactgtgagcgtctgattggctacatttacgatgacttggggctggatctagatgcgatcctcccctttgctgccacaagccaggtgggagctgaaatcgacggactggatgccagtaatgaagcagcgtttcgactgatgctggtgaatgtactacgtcttgtagggttcgtggtatctcaaaaaaggcgtagaggtatttcctgccgaccaacccaagtcgtgctgcctgtgtctcctaaccatggcatcttgggtggtgacggtctctacgcggagtccaaacgcgggcttgagacattaatacagcggttccattcagagtcatggaaggaagagctctcaatatgtggcgtcagcatcggctggacccggtcaacgggcttgatggcggccaacgaccttgttgctgagacggcagagaaacaaggccgcgtgctgacattctctgttgatgagatgggagacctcatctcactgttattaactccgcagttagccacccgctgcgaagatgcccctgtcatggcggacttttctggaaatctctcgtgttggcgcgatgcctctgctcagcttgctgctgcccgtgcaagccttcgtgagcgcgctgacactgcccgagctctagcacaggaggacgaacgagaataccgttgccgacgcgcaggaagtactcaagaaccagtggaccaaagagtctcgctccatctcgggttcccatcactccctgagtatgacccactgctacacccagatctcgtgcctgctgatgcagtggttgttgtcggcttcgctgagctgggcccatggggaagcgcgcggattcggtgggaaatggagtcgcgcgggtgtctttctcctgcaggatacgtggagacggcatggctaatgaatctcatacggcatgttgacaacgtcaattacgtcggatgggtggatggggaagatgggaagcccgttgcagatgctgatattccaaaacgatacggcgagcggatcctatcgaatgcaggcatacgttcactgccatctgacaatcgagaggttttccaggagatcgtgcttgaacaagacttgccgtcatttgagactacacgggaaaatgccgaagctctgcagcaacggcacggcgatatggtgcaagtcagcacactcaaaaacggcttgtgtctagttcagctacagcacggcgcaacaatccgcgttcccaaatccatcatgtctcctccaggtgttgccggccaactgccgacaggctggtcgccagaacggtacgggattccagcggaaatcgtgcagcaagttgaccccgttgcccttgtgctgctctgctgtgtagcggaggctttctacagtgccggcatttccgatccaatggagatatttgagcacattcatctatcggaactgggcaactttgtaggctcctcaatgggtggggtggtgaacacccgagcgctatatcacgacgtctgccttgataaggatgtg

SEQ ID NO: 36977 - DNA, 1143 bp, Aspergillus nidulans
aagcccaagaatatcgccatccatacaagtcccgtccacgatctccgggtggtcgactgtgagatcccccggcttgctcccgacgggtgcctgatccatgtccgtgcaactggtatctgcggctcagacgtgcatttctggaaacatggccgtattggccctatggtcgtgacgggggataatggcctggggcacgagagtgccggagtcgtcctgcaggtgggcgacgcggtcacccgatttaagcctggtaagagccacctcttgctgattttctgggaattgagaaggacccgcgctgaagcgcatgacgacaggcgatcgggtggccatggaatgtggcgtaccctgctccaagcctacctgtgacttttgccgtacaggcaagtaccacgcctgcccagacgtcgtcttcttttcgacgcctccccaccacggcactctgcgacggtaccacgcccacccagaggcctggctgcatcgtctccccgaccacgtctcctttgaagagggcgcccttctcgagccgctaacggttgccctggctggcattgaccggtccgggctgcgtctggccgacccgctggtcatctgtggtgccgggccaatcggcctcgtcaccctcctggcggccaatgcagccggggcagcaccaattgtcatcaccgatatcgacagcaaccgtctcgccaaggccaaagagctcgtgccgcgcgtgcagccggtgctggtccagaaacaggagtctccacaagagctggctgggcgtatcgtccagcggctcggacaggaggcgcgactggttcttgaatgcactggggtggagagcagtgttcatgcagggatctatgtaggttttgggactgcgacggcgtttctgaagaaaatcctctgacgatctcaatgcaggcaacccggttcggaggcacggtgttcgtcatccgcgtcggcaaggacttccagaatatccccttcatgcacatgtcggccaaggagatcgacctgcggttccagtaccgctatcatgacatctaccccaaggcaatcagcctggtcaacgcggggctcgtcgacctgaagccgttagtgtctcaccgatacaagctggaggacggccttgaagcgtttgctaccgcaagcaat

SEQ ID NO: 36978 - DNA, 912 bp, Aspergillus nidulans
ggtatgatccgctccctctacgccacaatgcttgcaggcggcgccaccatatgctgcgcctcctttgaccccagtcttttctgggatctggttgaaacctggaagccaacttggtactacgccacgccaaccatgcaccagatgattcttgccgagtccgagcaccgcccggacgctcttcgacagagcctgatccggtttatcatcaacgccggcggtggtctccctgctactctggccgtgcaactgcgagaggtcttccagtgcacagtcctgcccagttacggtatgaccgagtgtgcccccatcgtggctccaccgacagactacaagcttgagcgcgaggggacatccggccgacctgttggtcccgacgttgctattctcgacggcgccggtaagcatgcgcctaccggtgtgactggccggatctgcgtacgtggattccctgtattcccaggatacctgaccgagcaaggcgttatcaacaaggatgcctttgatgagaacggttggtttgataccggtgacttgggtcacctcgaccaggacagattcctttatatcacaggacgaagcaaggaggttatcaatcgtggtggagagattatctcgcctatcgaagttgaaaacggcattctctctgcggcccgcgatccctcttccattctttacgggcgtgtcaccgaggcacttgccttctcaacgccacacgatgtcctccaggaagccgtcggtgcggtcatagtcacaccccccggcaaagcgcgacctgatctgaggcagctccatgaggcactgggtgaaaggcttctgcagccaaagtggcccgccctcttggtgtacatggacgagggagtgccgaagtcgaacaacaagctgcagcggatccggttgagtcagagattaggg

SEQ ID NO: 36979 - DNA, 481 bp, Aspergillus nidulans
acagagcctaaaagcactctatgggctttagaccgtataaccttccgacgcattctcatggactcggcattccagcgacgacgcatgtatgaggctttcttggaagaagtcccgctcctgtccagtctcaaaccttacgagcgggcaaagatcgcggacgctctcgacacaatcaagtttccggccggggaatatatcattaaagaaggtgatccgggagacgccttttacctgcttgaatccggcgaggccgaggcttttatggagggcgtcgaagaacccgtgaagtcatacaaaaggggagattacttcggtgaactggctctactagacgacaaacctagagcagccagcgttcgcgcgaagacggaggttaaggtcgccaagcttggtagagatggattcaaacgtctgttgggcccggtggaaaaacatcatgagaaggacggaatacttgttgaggccatttacagttacataa

SEQ ID NO: 36980 - DNA, 577 bp, Aspergillus nidulans
gagatgaacgcaaaatcactgcgtaggaaaattggtgttgttgcccaggagcctgttctcttctctgggacaattgctgaaaatatctcttacggaagcccgcattcgacccgttctgagatcgtggcagcggcgaggaaagcgaactgtcaattcatcagcgactttgtgagttatctgatatcccgcctctacattactcttatactaacatgaccctagccggatggcgtcgatactcaagtgggaccacgcggggcgcagctttcgtggggggcaaaagcagcgaattgctattgctcgtgcccttattaaggaccccgatattctgattcttgacgaagcaacttccgccctcgacgcagaatcagagacattagtcaatagtgctcttgctgcacttcttcgcggaaacaacaccactatcagcattgcccacagactctctactataaagcggtccgactcgattgttgtcctcggtaatgacggaacggtcgccgaacaaggaacttacgaagaactaagcgcacgccctgatggtgccttcacaaaactcatggaatggcagctaagt

SEQ ID NO: 36981 - DNA, 786 bp, Aspergillus nidulans
ttaacttcataccttcctaactgacagcccccaggtgtcggcggcgtaggaaccgcttttctcaaccaactggcacgcctcccaaacgccccaaaactgatcctcctcgcccgttccagccaaaccctcctctcgcctaccccctcttactcccccaccatccccgccgcggaatggaagaccgccgtcgaaactccctctcttaccaaatccggcgcattgaccccagatgagattgccacgtaccttgcctctgcccccggtcgctctattcttgtcgacaacaccagcgatcccgccctggcatccaactatccggtatttctgcgcaagggtatcagtgtcgtcacgccaaacaagaagggattctcctcggacttgagcttgtggaaagagatcttcgctgcggctgctgaagggaaggcgcttgtttaccatgagagtacagttggtgccggtctgccggttatttcgacgttgaaggatctcgtcaacaccggtgacgaagtcacgcgcattgagggagttttctcaggaacgctctcgttcttgttcaacactttcgcgccggcgtccggatcttcgagcgcgaagtggagtgaagtcgttagccaggcgaaggaattaggatacacagagcctgatcctcgcgatgacttgaacggcatggacgtcgcccgcaaactgactattcttgcacgtattgctgggctggatgtgcagtctccggactcgttccccattgagtcgctgattcccgccgaactgacgagcctgccgtcgtct

SEQ ID NO: 36982 - DNA, 682 bp, Aspergillus nidulans
cgggaagccagagtgtcacttctgtggtgaactcgctcgatgtacaacctgctgtcaattcgttgtttgacgatcttcgggtcgggaccatcttgatgcaggcatacgataaagtcattcctcatagtgtcaactgtaggcatgtcaacaaacctccggcatctgggcaagagatgatgcgctttaaggcagtcgagaataccaattatgctatcgaactaggcaaacatcatggtttctctttggtgggtgtgcagggtgccgatattactgatggtcagcggaccctcacgctagggttggtatggcaattgatgagcgggatatcaccaataccctctcaagccttgcaagtcgtttgggcaaacacgagatcaccgactcagaaatgattaaatgggccaatgacatgactcgcaaaggtggccgcagctcttcgatacgcagtttcaaggaccagtcaattggatcaggcgtgttccttcttgatgttcttaacggcatgaaggcttcctacgtcgattatgatctcgtgactcctggtcagactgatgaacaggcgtatgcaaacgcgaaattaagcatcagtatcgctcgcaagctgggtgcaaccatctggttggtgcctgaggatatctgtcaggtccggtctcgcctggtgactacatttattggtaagtgt

SEQ ID NO: 36983 - DNA, 1519 bp, Aspergillus nidulans
atccaggaacgggtgtcgcgggtaaagaagacgttcctggagcacaagactcgagacgtcgaattccggcttgtccagcttcggaagctttactgggcgtgagttctctgaaattccccggttgtatcatgcaattgtgactgaccctgccggtagcatcaaggaccacgagcaacagatcgtcgaagccctccggagcgacctgggaaaaccgcagttcgaaacagaagtcagtgaaagcgtctggttggaaaatgacattgttttcatctcgaagaatctccacaaatgggtcaaggatgagaaggccgatgatatcgaccttacattcaaatttatgaacccgaagatccggaaggatccgctgggtaccgttctagttattgggtgcgatataccccggcgatcgtgtagtcctggtctaacagacagacagtgcctttaacttccccttccagttgactcttggacccgttctcggtgcgatcgctgctggaaacactgtggtgatcaaacctagtgagaatgcgccaaagagcgccgttgtaatgcaacagatcgttgaggctgcacttgacccgtcctgctacaccatcgtccagggagctattcctgaaactcaggctttacttgcagaacgatgggataagattttcttcactggcggtgcgactgttggacgcatcatcgccaaggcagctgccccccatttgactcccgttgtgctggagttgggtggcatcaacccggctataatctccaagtccgcaaaccctagactagtcgcccgcagactactttggggtaagcttatgaatgcaggccaggtctgcacttctcaaaactacctcctggttgacaggagcctcgtcccggctgtggtcgaagagttcaagaaggcatacaaggaattctatcctaacggagccaaggcgtctccggattatgctcgaatcgtcaacgaaggtgccttccgtcgtttgaaggggatgatcgataactcccagggcaagatcctcatgggcggcactatggacgagaaggacctctttattgaacccacgctcgtccaggtcgaatcccccgacgattccatgctcgtgcaggagagcttcggccccctgatccctattcttcccgtcgataacattgacgaggccatcaacatcgcaaacagcattcaaagcacccctctcgggctctaccccttcggctcgaaagccgacaccgaaaagagtacgtcccctacaattgccgttaaagtaaactaccaagctaactattcccagttctctcgcagacccgctccggcggtgtttccgtcaatgacgccgccctacacattcccaccctcccctttggaggcgtgggcgaaacggtctatggcgcgtaccgtggccgtgcgagctttgacgtcttcgtgcaccgccgccccatcacgagtagtacgggctggctcgagtctatcctggcgatccggtacccaccttacgcaggtaaactggccaagttcaaggcg

SEQ ID NO: 36984 - DNA, 623 bp, Aspergillus nidulans
cgtgaggcggttttcccgacccgccagtcgctcgggttgatgaagagtaaactcaaaggtgcggagaccggccacagtttactaaaaagaaagagcgaggctttaacaaagtgagcctcctatgtctaattgctaagtccccaatactgatactatgtaggcgtttccgaggtacgcccgtctagttctagtttccgacgacttctccgcatcaacagcattaatcaataccagagataaccaggcgaattgatgaggccaaacagaagatgggcagggtgatgcaggttgctgcattctcccttgcggaagtgagctacgctgtcggtggtgacatcggctaccaagtccaggagtccgccaaacaggcgcggtttcgagtgcgagcgaagcaggataacgtttccggagtattgttaccacacttcgagagttatacggaagaatcaatcaatgactttggcttgactggtcttgggaaaggaggacagcaggtgcagcgctgccgcgagacatatgctcgcgcagtcgaaaccctggtggaacttgccagtttgcagacggcatttgttattttggatgaagtgatcaaggttgttaccgaagaggtgagtgtcatccca

SEQ ID NO: 36985 - DNA, 1194 bp, Aspergillus nidulans
gtggaaaagtaccgcccgaacaccctcgatgatgtctccggccacaaagatatattagctacgattaatcgatttgttgaggcgaatgtgcgtgtctaatccggtattgccaacccaatagctaactttatctcagcaattaccacaccttctcctctacggccctcccggtacgggcaaaacgtccacaatcctggcccttgcccgacggatatacggcagcaagaacatgcgacagatggtgctcgaactcaacgctagtgatgatagaggaattgatgttgttcgggagcagattaagactttcgcgagtaggtctagcggctctaggaagtgggattgcaggctaatcaagtctcgcaggcacaaaacaaatattctcaatggcaccgtccgctactggtaaatcgtcgctcgcgtcgttcaagctgattatcctggatgaggcggatgccatgacatccaccgcgcagatggcgcttcgccggattatggaaaaatacaccgccaacactcggttctgcattatcgccaactatacccacaagctttctcctgccctcctttcccgatgtactcgcttccgcttcagtccgctcaaggaacaggatatccgggtcctgattgatcaggtaatcgagaaggaagacgtgcgcattcaacctgaagctgtcgatagcttggtcaccttgagtcgtggtgacatgcgtcgtgctttgaatgtgcttcaagcctgccatgcaagcagtacgcgtctctattccatcatgaaactctcataaagctcttgtactgaccatactaggcaaaccgcttccaatcaagaacgcgccccaagatcaagccgtccccgagccggaaacgattacaaatgagacgatatacgactgtattgccgcgccacatccagccgatatccaacagattgtgaccacactgctcgcgaccagcgacgtgacatcatgtctcaacactttgaacacattgaaaatcaataaaggccttgccctagcagatatcctttctgcacttggggagcagctgtatcgactcgaggttccggcgcagacgcggatcacttggctggaaggcttagcagagattgaatggcgtctgtccgcaggcggatcggagaccgttcagaccggcggcctggttggagtgatccgaaatggatgtgagctgatgggggat

SEQ ID NO: 36986 - DNA, 816 bp, Aspergillus nidulans
ccttcaaactgggacgccatctactcaatcgtcaaaaagatgcgcgaagacaacccgactgcgcccgtagatacgatgggctgtgcagagctgtactggcgggcttcttctccgcgagatagacgctttcagacgctgattgctttgatgttatcttcccagactaaagacacagttaccgccgtggcgatgcagcgtttgcacactgagctgggcgaaggcggtgctccggctatcaagctggaaacagaacatgcggagtcaattgtcaagcaggaagcggagaatggcgagccagctatcaaacaggaggcgaaagatggtgtaccaccagccaatccctcccacgatagcacactgaacttggaaaacatcctggctgtctctccagagcgtctcaactcactcattggcactgttggcttccataacaacaaaaccaagtatatcaagaaagccgccgaaatcatccgcgaccagtataattccgacattccttccacccccgctgaactcatgaagttgcctggcgtcggtccaaaaatggcgtatttgtgtatgagtgcggcttggggaaagcatgagggcattggagttgatgtgcacgtccatcgtataactaatctatggggatggcacaagaccaaaacgccggaagagactcgcatgtcgctggaatcgtggctgccaaaggataaatggcacgagattaacaaattgttagtaggcttggggcagacggtgtgcttaccggtgggcagaagatgtggtgattgcggtcttgcagggacaaagctctgcaagagtgaaattaaa

SEQ ID NO: 36987 - DNA, 505 bp, Aspergillus nidulans
tcacaaactaccacacgcctcctccgcgaattaaaagagtacaccgcgtcccccaatgaagctctccttcacctcggtccaacgaatgaagacgacctttttcactgggaagccgtgctcaaaggcgtaaaaggaacaccctacgaaggtactctctcctagatctccagtttcagattaagaccacccctgctaacctttatggctgcccacagatggcctctggtccctttccatccaaataccgtcgaactatcccctcgccccgcccaagatccacttcaccacgaaaatcagccatcccaacatctccttcacgacgggtgagatctgtctcactctgctgacgaccgaacactggagtcccgtgtacaccttatccagcacgctgacggcgattcaccagctgctgactgatccgcagccggactcgccgctgaatgtggatgttgcggcattgttgagggagggagatactccggcctgggagagtattgtgcggtac

SEQ ID NO: 36988 - DNA, 292 bp, Aspergillus nidulans
atgtctgactttgctcgcaaggatttctccacaagtgagttcactctcctatgatagtacagagacctggatactcatgagccatgcagaggctaaggaggagatcactcccgacgccagcaagtccacccaggaaagggtgaaggagaccgtcaccgataccaccgaccgcatctcccgcggcgtccagcccgatgaccagaaaagcaccacccagcaggcctttgacaagagccagcgtgtgagcgacagggagggccacggcagtacccctcagtctatgtaagtaacc

SEQ ID NO: 36989 - DNA, 683 bp, Aspergillus nidulans
aactgtatccatgtctttgacggccttcattccacgatctataaatcctcgtcggagagcggcgctctcgttgcgctgaagatcacgacccctcatctactagagccgccacacgacgcccaccgcgaggctcaactcttgcgtgaggcagctaacgagcacataattcccttattagatacattgaaactcgatgggggccggttcggcctcgtgttcccatacaagaagcatgatcttgaaactctcttccggcgggacgtgttgaccgccgcgcagacaaaatctgtcctacgcgacatgttcagcgcaatagcgtctatccacagtctaggaatcatacatcgtgatatcaagccgtcaaatattttactcgactctccaatcggccagcgtatctcgcggatttcggaatagcctggagagaagggagtattgaagctgaaccggccgataagaagatcactgacgtcgggaccacatgctatcggccaccggaagtcttatttggccataagggttacaacacggctctcgatctttgggcggcagggtgtgtcgacgcagaggctattactgttggacacaaacagcttttcgatgccgggcctgtcggaagtgacctctcacttatccagtctattttcactactctgggcactgcagatgagcaaacctggccg

SEQ ID NO: 36990 - DNA, 1477 bp, Aspergillus nidulans
gactcgtgcctcagaggtttggtcgtttcaatgttcacagtaggcgctttctgcggtgctgcatttgcaggtcctactggtgattatctgggtagacgttggactatcataatcggttgtatcgtcttctgtctgggtggtggtctgcaaaccggcgcccagactattgagtacctatacagtggacgtttctttgccggcgttgggtaagttgtgttgaaactttggccgccgagtacacttgctaaactgacttagggttggtttccttaccatgatcgtgcccctatatcaggccgagatctgccacccgaatatccgaggtcgtgtcactgccttgcagcagttcatgctgggtgtcggagctctctgcgccgcatggatttcgtacggaacatacgtcggcttcgatgatacgaacgatgctcagtggcaagtctctcttggtctgcaaatcgtcccagccgtcttcctggggctgctgatcatgcttttccctgaggtaagatacgagcccaagccagtcatactgctgctaacgtgcatgcacctagtcccctcgttggcttatcgaccatggccgccaagaagagggcctgaagaccctggcgaggcttcacgcctacggtgatgtgaatgacgcctgggtccgtgcggaatacactcagatccaggaatttatcctccgtgaacacgaggaggaggccaaatcctacttggaactcttccagtcgcgctcgtcgttccgtcgtcttttcctctgctgtgcactccaagcctccgtgcagatgactggagtttccgcgattcagtaagtactctttggcccttacctcttctctgtatggtgagttattaacggcctgtctcgtacaggtattactccgtcacgatttacgcgcagatcggtatctctggcgatgaaaccctacgctaccaggcaattaactccatcatcgctctaatcgcccagttcttgtgtatgatgcttatcgatcgtttcggtcgccgctggagtttgatcagcggaaacttgggcaactgccttacatttatcatcgcctgcattctgctagccagattccctccagaggtcaacaacaccggagctcactggggctttattattatgacttggctctacaacttctctttctcgtgcacttgcggtcccctgtcttggatcatcccagccgaggtcttcgatactcgtactcgttcgaagggtgtctcgcttgcgaccatgacctcctacgccttcaacaccatgatcggccaggtaacgccactcgcaatggaagacgttggctacagatattactatctgtttatcatctgcaattttaccaatgccgtgttcttctggttgctcctgcccgagactaagaagttgccgctcgaggagatgaactatttattctcaaacgctccttggattattccaggcacaaagaaggaggactacgtccgcacgacc

SEQ ID NO: 36991 - DNA, 1906 bp, Aspergillus nidulans
attgatggccgagtacagcttgctctttggctcccaaatctgacgccattgcctttgttcgagacaacaatttgtacttaaggaagctttcttccgaacgcgttgtacccattaccaaggacggtggggaacagctattctacggtgttcccgactgggtatatgaagaagaagtcttctcgggaaacagtgtcacctggtggtctgaagatggttctcaaatcgccttcatcaggacgaatgagtcggcggtacccgaatttcccgttcaatatttcctatctcgaccgtcaggaaagaagccacagccagggttagagaactatccggaagtaagagaaatcaagtatccaaaggctggcgcgcccaatccgttcgttaatctgcaattttatgacgtcgagcaaggtgaagtcttctccgttgatacgcccgacgactttgatgatgacgatcggcttatcattgaggtgatatgggctgctaagggcaaggtccttgtccggacaacgaatagagaaagcgacattttgaaagtgttcttggttgacactgaatcaagagaaagcaagcttatcaggatccaagatattgccgagcttgacggtggttgggttgagcctacacagtccgtgaggttcatccctgccgacccagataagggccgaccatttgatggatatcttgacactgtggttcatgagggatacgaccatctggcttactttacccctctcgataatccagagcccatcatgctcacttctggcgaatgggaagttgtggacgcgcctactgctgtagacctgactcgtggtctggtgtatttcatcgctactaaagaagcgccgactgaacgccatctataccgtgtccgcttagatgggtctgatctcacgccgttgactgacacgtctcaacccggctattacagtgtctcgttctcggatggtgctggatatgcattgcttagttaccagggtccttccattccctggcaatctatcatcagcaccgaaggtgaaaagacaacaacactcagaattatcgaggacaacacagatttgtcaaagttggtggctcaatacgctttaccaacagagaactaccagaacatcaccattgatggcttcacgctgcaagtcgtcgagcgacgtccaccccactttaacccagcgcgaaagtaccctgttctattccacctatacggaggcccagggtctcaaactgtggaccgccgtttcaatgtagatttccagtcatatgtcgcagcaagtcttggctacattgttgtcaccgttgacgggagaggcaccggcttcatcggtcgagcagcacgctgtatcatccgtggcaacatcgggcactacgaagccattgatcaaattgccacggccaaaaattgggcacaaaagccgtacgtcgacgagtcccgaatggcgatctggggctggagctacggcggctttatgacgttgaagactctcgaacaagacgccggcgagacatttcagtacggaatggctgttgcgcctgtcacagactggcggttctatggtaaggcgctcaaacccacccatttcctacttggaccatgtatagtcaactaacccaaagcccaatagattccgtctacacagaacgctacatgcacaccccgcagcacaacccaacaggctatgacaacaccagcatatcggacatggccgcccttcataacaatgtccgcttccttgtcatccacggtgcctcagacgacaacgtccatatccaaaacacgctcaccctaattgataagctggatctcgcgagcgtccagaactatgatgtgcatttctaccctgactccgaccatagcatcttctttcacaatgcccatactatggtttatgaacgtatgtcacca

SEQ ID NO: 36992 - DNA, 1832 bp, Aspergillus nidulans
gataatcgtgatgtattgctgaaagactccctctattcagccattggattggccgccgcctgcttagagaaaaacctcgattttatcaatttcctgcagaccaccctcgtcccggaagttcagattcaagaacctgggtacaacgtcctcaggagaagaattgcaatccttcttggccagtgggtgcctgtcaagtctagcgagatgaactgggaatccatctaccagatattccagcatttgctcaataatcaagatccattgaatgacctcgtggtccgaattactgccggccggcagcttaagcatatccttgatacctttgaatttaccccagaaggtttcaagccttacgcgccgtcgatctttcagagtttgatgtccctggtacaagaagttgaaagctctgaaacaaagatgggccttctcgatacagtgcgattggctgtcacccggatggaagataacgttcgtatcccctttcacaatatctggactagttgctaatgtttctccaagattgctccattctcagatgcaatcctcgcattactaccgccactgtgggaaagctccggcgaggaacatctactaaagcaggctattctcactttacttggagcattgatatattctcttaagcaagaatcggtcagatatcactcagtcattttgcctctaatccgcaattccgtcgatccgacttcggtatgttatatccgaagctttccagttatggaccaattacttacaattaatggataccatgatttacctactagaagatgccctagaactctggagcgccattttgttgcaaaccccatcgcccccttctcccgagattctttccctcatccctgccctcttccccatcttcgaatccgccatcgacggcgtgggtctggccctccagattgcggagtcctacatcatcctcgcaccccaggagatccttagcgaccgcattcgtctcccactctttacctcgttcgagtccctcctccaacccacgctccgccagcgcggcggcgtatgtaccccgcctcgtagaactagctatccgcggcgccgacgccgtagacaacggcagtgaaaacacataccgtgtcatcatcagctctttactcgatagctccctcctatcttcaatcctcgaaggcctctactccgcttatgaatccagccaaacaacagggccgaacaaaaaacaaacgagcatctacggtggcgttgaaacagactacttctctgtccttgcacgtctcgccctcgcacacccgacgctcttcgtttccggcatcacacccgcttactccaatagcaacatcagcaacaacagtcaaactccagaacaggcgcaggaacatctcatcacctggctcctaaccgaatggtttctgcactacgacaacatcggcaccgcaacgcagaagaaactgcacgcgctggctttaacccagcttctcaccctcagtgggcctaatacccagccaccggcctatatcctaaaccacctgcaatcgtacctcaatgtttggacggatattattaccgagttggcggagggcacgacggagggtgatccaagtgatcctcgcggtggggattatctcatctactggaataatgcgcagacggggacatatgaagataacgagccgccagaaaacatgcgacggcgtgagtgggaaagctcggatatcgttcacaagacaaacattcgagagtttgtgcgcgacgggctgcagtccttgattgtgagttgtggtggtgaacagcggttccaagaggattggctgctcaatgttgatcgagatgtggttgcggct

SEQ ID NO: 36993 - DNA, 594 bp, Aspergillus nidulans
ggcggcatggcaaccgccctcctcacatctcctcttgacgtcctccgaacgcgccttcaatccgactactaccgctcccagctcaaatccaccacaacttcctcacacgctcgcttttccctcgcccgttccttcattcagcattttagcgaaactttcgaaattctcttttccatccaccgcgtcgaaggctggcgcagcctgttccgcggccttggtcccagtctcacaggtgtggtcccggcgacagcaatcaaattttacgcatacggcaactgtaagcgcttatacccggaggtctttggtctggacagagatgcgacgtcgacacatgcgctgtccgcggccaccgcgggcgttgtgacagggacagcgacgaatccgatctggctggtcaagacgagattgcagcttgatcggacacatgtaaatagtgatgggactacgagaccgccgcaatatcggaatagctatgattgtgtgaaacaggtcattcggcaagagggtattaaaggtctttatcggggtttggcggcgagttatctcggcgttattgagacgactttacatttggcttcgtatgagcggataaag

SEQ ID NO: 36994 - DNA, 1856 bp, Aspergillus nidulans
atattcggctatgacactggtcagatctccggctttctcgaaatggacaattttaaacgacgattcggccagcggcagctggatggaacttacgctttcaataacgtgcgatcagggctgatagtgtccatggtaagtaaagatatcctcaaaactacatctttaaattgattcgagccacggtagttgtccatcggtacgcttctgggagccctgatggctggtccactggctgaccggcttggccgcaaatggtccattgcattttggtgcattattcttcatgttggcctcatcattcagatctcgtcgccacaccctaagtggtaccaattcatgatgggtcgtttcgtgaccggttttggtgtgggcgcttgctctttactaggtacgcgcagccttctccttccaggtcttggctaatggatttgaatagtgccattatatcaaggcgagacatccccaaaacagatacgtggggccatggtctggtaagctgttcattcaagacaagatattctttgtccccgatagtacctgactgctgacagtagccttctagctcgtaccaattgttcgttaccctgggtatctttgttgcctactgcataaactatgggacagagggcatgagcaactcggcatcctggcgtattcctctcggaatcacgtttctgtgggctttgcttctcggtattggaatcatatttttcccagagagccctcgctatgacttcaggcacgggcgcgcggacaaagcccgacaaaccatgtcaaaactttatggcgtgccccagaaccaccgggctatcatagaggaacttactgagattagggaacaactcgaggctgaaagctcctccagaggtggttttcatgggtggatagagatgttccaggggcctcggatgttttatcgcataaccctaggcattgtactgcaggcactacaacagctgactggagctaactatttcttctattacggtacgtctacatcagtttttaaggcgtatagtcacgtagtgccatgtggttacaccatgtagtgatatttcacatatatggatgtggctttctggtccctggaccagattcaaatcgaagatgcttcgggaaaacggactgatccattattctaggtacaactgtcttcaatggagcgggtatctcaaacgtgtttgtcacgcagatgatcttgggcggagtgaacttcggcactactttcttcggcctttatgttgtcgagcattttggaagacgaaaaagtttggtgacaggaggaatatggatgtttgtgaatttcatggtttttgcctcagttggccacttttctctgaatgtggaagatccttctgctactcctggcgctggcaaggcaatggttgtcttcgcctgtttgtttattactggtgagatataccccatactttctgggtggatactccactgcggggacacaacgcttatctgtaattttaggtttcgcgactacgtggggccccatgatttgggctatcgtggcagagctttacccatcccgctatcgagctaaggctatggccatggccacggcttcgaactggctgtggaatttcttattgggcatgtccattatacacccatgctatgcagtagtatgctagcagcgggaaatcaggttctttacgccttttatcacgggagatatcgatttcgcttatggctatgtgttcgccggctgccttttcgcagccatactcatagtctacttctttgtactcgagggcaaagggaagacgcttgaagaaatggacatgatgtatgtgatgcgcgtacctccctggaaaagcagcgaatgggtccctccccccccg

SEQ ID NO: 36995 - DNA, 1059 bp, Aspergillus nidulans
agaggcgagattgctgttcgaattctccaagctacaagagaagcctgtccatcgattaaaacatacgccttgtatacagacaatgaccgcacccattgcgatattgggcgcccccatcatgcgttgcacattaccccagatgggtatttggacatcgagcttttggttcgactcgtccagcaacacgcaatcgatgcaatccatccaggatatggcttcctgagtgaaagtgccgagtttgcaaggcgtatgcaagatcttggagtcattgttatagggcctggctgggaagcattggatcgcacgggagacaagctcagagcgaagcaactggcggtggagaacaacgttcctgtattaccgagcctggaatacgacatggccactccgcgtgcaacaggccttggaaagatcaaatcattcgctcataatgtgggatacccggtcatgatcaaggccgtcgacggcggcggaggacggggcatccgactcgtccatagagacgacgacctggggcacgccgtgcgcgcatctgcagctgagtctccatcacaaacagtatttgtggaaaaagcagccatagacgggtttcaccatatagagatccaaatcgtgggtgatggtaaagacgtgcagcatctgtgggagcgcgactgtagcgtgcagcgacggttccaaaagattgttgaaatcgcgccatcattgatccgcgatagaaatcaggagctggtcagcagaatagccgacgcagcagtacgcatgatgaaggccatccgttatcgatctcttgggactgtggagtttctggtcaacgaacaactcaatgaattctacttcctcgagatcaacccgcggatccaggtggaacacactatcacggaagccatcacgggcgttgacctggtccagacccagctactcatagcacaaggatacttccttgcgcaacttggcttggacacttgccccaaagcccgcggtcactgcattcaacttcggctatgctccgaggatccgcgcgccaatttctcgctgagtgtgggaaaggtgatggacttt

SEQ ID NO: 36996 - DNA, 2740 bp, Aspergillus nidulans
  unsure (1)..(2740): unsure at all n locations
ttcgncccacgcccgaaccccatctaggaactttgacggtaactggcgccagcccaacaaccaatctcaaggccaggaccaatctaaaggtctcggtcagcagaactcaggatttcagtccggacaccgtgcacgtgcgtctatgaaccagtcaatcggctgtatcggttccttccaataccctggccagcctcagctcattcaattgccccaaggccaggtggttatggctcccccacaaatgtttggtggagcccagcagctgaaccccttgcaactcgctcagcttcaagccctgcagcagagtgggcaactaaacggtcaaggtctaggtggcctccaagctagtcagcacgccccccagccgctgtctgcccagcaaacccaacagcagcagcagcagcagcggaagactctgttcactccctatcttccccaggccaatcttcccgcgcttttgtctaacggtcaactcgtctctggtgtcctgagagtgaacaagaagaatcgttctgatgcgtatgttacgactccagacttagatgccgacatcttcatctgcggtagcaaggatcgaaaccgtgctcttgagggtgatttcgtggccgtcgaactacttgacgttgacgaagtctggtcccagaagaaagagaaagaagagaagaagaaacgcaaggatatcacggacgcgaggtccgctagtaatgctggaacagacaagatgtcccgctcagactctactggggaccgtcaagaggtgggacctgacggtagcattcgtcggcgtggcagtctccgacagcgtccaacccagaagaagaatgacgatgtcgaggtcgagggtcagagcctgcttctggtcgaagaagatgagattagtgatgaacagaagcccctatacgctggtcatgtcgtcgccgttatcgaacgtattgctggccagatgttctccggcacacttggtctactccgccctagcagtcaagcaacgaaagaaaagcaggaagccgagagacttgcgagagatggtgcccatggtcgtcatcaagaccggcaacaagataagccgaagatcgtttggttcaaacctaccgacaagcgtgtgcctttgattgctatccccacagagcaagccccgcgcgatttcgtcgagaagcatcaagactacgctaatcgtattttcgtcgcttgcatcaagagatggcccatcacgtcgctgcactccttcggtactctggttgaacaactgggcgaaatgggtgatctaaaggtggaaactgaggctctcctccgcgacaacaactttggctccgacgagtttactgatgccgtgctgaagagcattggctgggagaactggtcaatttcaagtgaaggtgatttgtcttcccgtcgggacttccgccaggaaactacattcactattgaaccgaccgggaccagcgaactcgacaacgcctaccatttcaaagctctgcccgatggaaaggcggagatcggcatccacgtcactgacatcgctcattttgtgaaacccaattcgctggttgatcgagaggccaagaaacgcgacactgccgtttatcttgttgatcgtctagtgaaaatgctgcctccgcgtatcgcgactgaactatgcgctttgctcccaggtgaggagcgcttgacagtcagtgtcgttttcaaggccaacccagaaacgggggccattgacgacgatatttggatcggcaagagtattatcaagagcagcggcaagctaggattcgatgaggttgagtctgtaattaagggaacgtcggatgttccattgtctggagtctcggtggatatcatccgtggtttacaggtgaaaagctcccactaagttcaatacatcagatctcttttggctaactttaaagcagcgcaccgcctcgaaattccgtgaagcgagactcggaaatcgtgtttctcagatccctcctctccgtcttcttcattctctcgatgacgagaacgtgccggtggaaagcaacatctttggctcttcggctgtccgtgaactcgtggaagaattaagctgcaaagcgaacttcctcgttgcccgcaagttggttgcagctctgcctgacaaagctttccttcgccgccagcaatcaccaaacccccgtcgcctccactcatttgtcgatcgcatgaacagactcgggtttgggtttgacgaatctagcagcggaagcttgcagagtagtctctgcaaggttaaggacgatgatttgcgcaaggttagccatcttactcaagaccgtcccttggttattcggttgtatctaattgacgacagggaatggaaacaatcttcgtgaaatccatgcagcgtgcgaagtactatgtggcaggcactgtacaggatgaaatgcgccctcactatactctcaacttgcctgtgtatactcacttcactaaccctctccgccgctatgctgatgttattgtccaccgccaactggaagccgttctgtctgatggtgctatcgagttctcagacgacgtcgaatccctcagcaagaccgctgatatttgcaacaataagaaggattcagcgcacaacgcccaggagcagagcgttcatatcgaagcctgtcgcaatatggacaaactacgccaagagattggtggtgacctcattagcgagggtattgtgctttgcgtctacgagtccgcgttcgatgttctcattccagaatacggcttcgag

SEQ ID NO: 36997 - DNA, 1113 bp, Aspergillus nidulans
tttccccatgctgttctaacttcgcaaatagtcctcccgatgatcgtgacatccatgatcctcgctgtacaacgcctccgcgaactttcgaacggaggccacattctggcccgctggacgatcagctactacgtgctcaccacacttttggcaatcgtgcatagcataatcttgacttctctcgtctggcgacggcttatgacgcaagcgagttccgaatcgctcaatgtggccgaagaagatgaggagacattcgctgagcgcgaggaaaccaacatccctgacgtggtcgtgcagatgttcgagtcactagttccgttaaatatcgtcgacgccttggccacagatagcttgctggctgtactcgtcacagccgtcgtagtggggtatatgatcgacagggagcgctcatacattctcaaagccgttgaggagatcgaaacaatcattatgaaggttatcatgatactaataaaactcgccccgatcggcgtcttctttctgatcctgccgaatatgttccgccttgatattcgtgatattggccagaatctcggtgtcttaataggaggggcgctctgcaacctcgcgatacatcttttcatcgtcctcccagcgttatacttcattatcacgcgcagaatgccttatactttctggctgagatgctccccttcctggacaacagcctgggggaccgcctcgtccgctgcaacgctgccgctgagcctaagagtcgtgcgccaaaacggcgtttccaacactgtgtccagattcaccgttccgctgggctgtctcgtaaacatggacggcacggcaatctacttccctctgtgcgtcgtgtttctcgccgagacacagggtcacagcctcagccccacggattatgttatcatctgtctattgtcgactctttctagtattgggacaacgcctattccgagctctagcttggttcttactgttatgattgcggggagtgtagatgtggagattacgggcatgtatgcggtcattattgctattgattggtttatagatcggttccggacaatgacaaatgtcagtggtgacctctatgcggcggtgatcattgaaaagcttagtgggttt

SEQ ID NO: 36998 - DNA, 1242 bp, Aspergillus nidulans
gatggagtatggcgtggtaaaagttatatcgccaaagctgcaagtccacttccagccggctacaatgatagcttcgctgacgaaaacatttgagaccgctcaagctggttcttctatcagagaaaggtcactgtgcccctggccaacgacaaactttcctgctctttgatgccgccaaccaccgagcccgtctacgtggacgatgagtttgtggttgagcatattggaggatatacgtcattcgaagcagatatctcccatcttaccaccgccggaaaccaattcatgttataacaatcgctgttagcaacgagcttaattgggatacaatacctccggggcggattgaggtctttggaaatggcaagcgaaagcaacactactagcatgattcttaactacgtaactacgctgatttgtctcgctcgacgctttgctctgtttatgatgtcttcattgctggtgtcaatatcgtgactaatgttgaagctctaatggtatattgaagcttatcaacaactccaagcaccgcgtggtggttctggacgaggatagtacaacagtgtgcgaacagattggaggaagacaggaaatggtaatagagtcagtgcgtctacggcagccagggatgccctatctctatcaactgcgcgcagaaatcatctctgaagatggcgagtcagttctgaatatctacgagatgccactcggcgtgcgctcaactaagttcaaaggaaacatgttcttgattaacacaaaactgttctgattcacgagtttggaaaaacacaaacgatgcccaattcacggcagggtttttgatccggcattcatccacgaacttagcttatggcctgggcaggcgccaattccttccacacctcgcactatccgtatgcaaaaggggttccggaatatgcagaccggcatggtaccatcgcgataaacgaagcagcggcagtgggtcttagtttggacatattgccagggtctttggctttaaatctccgccaaggttttcgcccaagacatgcaacgaggcaatgcgacgggcgcttggggaggcccttaaggagctaattgcacgagatgagagccaaacctctgttgttctgtaggcgcttgccgatgagcccgcttctagtgaagctggtacatagaatcacttgtactctagcctgacaactcgatccagcacgtccgctctgtttcacgaacatgggccacgcaaccgttgagatg

SEQ ID NO: 36999 - DNA, 1231 bp, Aspergillus nidulans
atgactgcagacatggaaactcaaaatgagttcgatgacagcggactgccaggaccaggagcaccaaccccgctctcgtcactggaggtaagaccactgccgccacttttgtaagcgtcaatcagctaaaactatccagggtatggcaggcctgaccagtcgtgacatcaaactgtttgtcgatgcgggttatcacactgtcgagtcgatcgcgtatacgtacgttcctagcgcggattaagggctcttgtgtttgagaggataatgactgatatatacagaccgaaacggttacttgaacaaatcaagggtatctccgaacagaaagccactaaaatcctggttgagggtgagctctatcaaagaagtactttctttttctgtaattttctctaacctataccggtcgatagcggcgaaattagtccctatggggtttacaacggccacggaaatgcatgctcgacgaagcgaacttatctcaatcacaacgggctccaagcagctggatacgcttctgggaggtggaatagagacaggatcaattacggagattttcgccgagtttaggacgggaaagagtcagatttgccatacccttgccgtcacatgccagctaccattcgatatgggtggcggcgaaggaaagtgtctttatattgatactgaaggaacgtttcgcccggtgcgtctgctagctgttgcgcagcgttacggtctggtaggcgaggaggttcttgacaatgtggcttatgctcgagcatacaactccgatcaccaactgcaactgctcaatcaagcttctcagatgatgtgtgagacccgattctctctcttggtcgtcgactcagctacctccctatacagaactgacttcaacggccgcggtgaactatcaactcgacaaacgcacttggctaaatttatgcgtacattgcaacgtctagccgatgagttcggcattgcagtcgttataacgaatcaagttgttgcccaggttgacggagggccgagtgctatgtttaatcctgaccccaagaagccgattggtggtaatatcatcgcgcatgccagtacaacgagattgagcttgaagaaggggagaggcgagaccagagtttgcaagatctacgacagcccatgccttccggagagtgactgtctcttcgccatcaacgaggatggaataggggacccgagcccgaaggatttagagaatgattgaaagagc

SEQ ID NO: 37000 - DNA, 586 bp, Aspergillus nidulans
tactgtggtgtcggaccggcaaggtctactgccgtgacatcgttgaggcgactaccgcgcctgtctctacgccggtgttaagatctctggtatcaacgcggaggtcatgccctctcaatgggagtaccaggttggtccttgccatggcatcgaaatgggtgaccacctctggatctctcgtttccttctccaccgcgtcgccgaagagttcggtgtgaagatctccttcgatcctaagcccatcaagggtgactggaacggtgccggtctgcacactaacgtctcaacgacgtcaacacgtgccgagggtggcatcaaggccattgagtcgtacatgaagaaacttgaagcccgccatgtcgagcacattgccgtctacggtgagggtaacgaggagcgtctcactggtcgtcacgagactggtaacatcgacaagttctcatacggtgttgctgaccgtggtggctccatccgaattccccggcaagtcgccaaggatggtaagggttacttcgaagaccgccgccccgcttccaacgcggacccttaccagattactggtatcattgctgaaactgtaagtttt

SEQ ID NO: 37001 - DNA, 1842 bp, Aspergillus nidulans
ccgcagattgcgcaagaattctcgattttgaagctggacttgaagttgggagctttgtcgcaagctgaactggtacattctcttgaaaagtcgtcgattgcgtcgctactggatgggaagatcgggcaaagtatcaagcatcttctttcactgcgagacaggattgaagatacctccagcaaggtgctcatcactggagacttgaacgcaggaaagtcaacgttctgtaatgctttgcttcgtcgcaaggtactacccgaagaccagcagccctgtacgagcattttctgcgaagtcctcgatgctcgggaaaatggtgggctcgaggaagtgcatgccgtgcacaaggaccgacaatacaaccgcaatgatgagactacctatgacgtctatgcgctaagtgaactcgagaatatcgttatcgataacacaaagtatatgcagtgcaaggtttacgtgaaggatgtacggaccatcgatgaatccttgttaaacaacggcgtggtcgacattgctctgattgacgcaccgggtcttaactcggattctctgaagaccacggccgtctttgctcgccaagaggaaattgatgtggtggtctttgtcgtttcggctgccaaccactttactctctcggcccaggacttcatttggaacgctgcgcacgaaaaggcttacatgtttatggttgtcaacgggttcgatcagatccgcgacaagcagaggtgtcagcgcatgatcttggatcagattaagaagttgagtccgcgtacatataaggaagctgctgaactcgtgcatttcgtatcgagcaatgctgtccctgttgcgccgcagattcctgttgcaggtcccggtggaggtggcggtggcggtggcgggggatccgatcccaatgggaatgattggccgagcggtgacgacgatgaggacaaacctgaggataagaagggtaaaggtaaagagaaagaaaaagagaagatacaagattttgagaaccttgagagttcattgcgccggtttgtgctcgagaaacggtcacgctcaaaactagctcctgcccggacctatcttcttaacttgctcgcagatattaatgctttggctgctgtcaatcgcgacgtcgcagacaaggaacttcagaatgtgatgaaagagttggcagatcttgagcctgcgtacgagaatggcaaaaagaagaagattcagctacaggaagaagtcgacaagtgcatcgacgactcgtgtgaagacgtttacaagcatacacgaacgactttgacttccgcaattgcgaatgtctccgaggccaacctaggtgttgagtaccctggtatcttctctgcattccaatacgctgaagacttgaaattcgccatgttagaacacatctccgcctcagtggctggatgtgaggattatgcacgtacgaagacggcacagggcgttggtttcatccagaaccttggcctgttacatattggagaagacaagtttactgcgccgactttccgcgccgatctaatgttccgtcgcggacgtcgccatgcacttgcgcgacaggtcgacacagaggtggagctcttggattttttcgatatcacaggcctctgggagcggcaagaaaagctcgcgggaacaggcatggctatgacagccgtgactgtccttggtggcagggcatttggtggtatcagctggctggacagcgccttcagtgccgcaaaattcctgggcccaaaccacatgcggcgtctcctcctccctggtattgtcgctgctggtaagtttactttttgtctgttcgttatcattgttagctaacttgcccagctgccatta

SEQ ID NO: 37002 - DNA, 630 bp, Aspergillus nidulans
aggaagcaatggcgaaaagatcatcctttcgccttttatgccaagcctcatcgtacggcccagggtgttttggatatgaaacgatgggaatgtggcattcccgggaaaaaagggacaatctgggaaggtggacttttcaaattggacgtcacttttcctgatggtgcgtggcaactctataaaagctcaaagcgaagttgttgactgactgttctctttcagagtaccctaccaagccacccaaatgtatgttcctttcgtcccgctcatactcacaaatatctttcacgagaatgtcgcaagactcttaaattgaataccgcttgcttagaagctaatgctgctgtgctgttctgggctaactttatgtcattatgaacaggcaagttcgtgccagctctgtttcatcctaacgtctacccgtctgggactgtttgtctgtcaatcttgaatgaagacgaagcgtggaagccggcaatcacgattaaacaaatccttcttggtatccaagacttgctcgacgacccaaatcccgagtctccagcgcaggcggaagcatataatatgtacaagaaagacagagctgcttatgagaagcgagtgaagcaggttgtcaaggaaaaccccgct

SEQ ID NO: 37003 - DNA, 1404 bp, Aspergillus nidulans
gacgttgtaatagtgggtgcaggagtgctggggtgcgcgctggcggtggcattggggcgccaggggcgtagcgtcctcctcctggaacagtcgctcaaggagccagaccgcattgttggtgaactcctgcagcctggaggggtctctgccctcgagcagctaggattgcgagactgcttagaggatattgatgccatacccacaaatggttactatgtcacctacctgggcaagcccgtcaaaatcccataccccagccaaagtcccggggcgccgccaccggagggccgctcgttccaccatggccggttcgtgatgaagctgcgcgaagctgcaggggcttgtcccaatgtcactatcgttgagacaaaggttacggacctgatcaccagttcccattccaagcaggttcttggtgtggaatgcgtgaccaaggagtccaaggactgctatttcggtcagatcaccgtcgtcgcggacgggtacgcctctaagtttcgaaaacaataccacccttataccccgaaggttcgatcgaagttctgggggcttgagctcattgatgcggaactgccgcagccacactacggccatgtcctcctagagcctgagcgcccgcccattctcatctaccagatcggaactcacgaaacgcgaatcctctgcgatatccccgaaaatctgccctcggcgtccgtcaagaacggaggcgtaaaaggtcatctccgcaacgtcgtgctcccgtccctgcccaaatgcgtgcagccctcctttgctgcggcgttagataaaggtcagctgcggtcaatgccgaactccttcctgccgagcgcgccgaacaagacaccggggttaatagtgctgggtgatgcgctaaacatgcggcatccattaactggcggaggcatgactgtcgctttgaatgacgtcgtcattctccgcgacttgctcagcccggagaaggtgcccagactaagcgacaccagactcgtcctcaaaaagctgtccaccttccactggagacgaaagatgggggcgtctgtcatcaacatcctagctcaggcgctgtactctctcttcgctgcagatggtaagccgcttccctcctaatccattcactatcgaaccaaatactaacctctcgcagacgataacctcaaagccctccaacgcggctgcttccagtatttctccatggggatgtacgaaacccccgtcagcctcctcggcggcatgctcaagaaaccagaagtcctctttgcgcacttcttcactgttgcgttcctctcactgtggatgatcatccgcgactcccccctgtacaaactcccgctcgcattgatccggtgcgcgcttgtcttttggacggcgtgtgttgtcatctttccttatatgttaattgaa

SEQ ID NO: 37004 - DNA, 1861 bp, Aspergillus nidulans
tttctactcaatctagacgcaggcaaagtctactgggatccctcgaatccagccaagcggttctatatcgacgatgtcaaagagattcgggttggtgcagatgcacgcaattaccgagaagagcatcaagtttcccaagatgcggagaatcgatggtttacaattgtgatcgcggatgccgagcgatccaaaggccgaccagtcaagacgatacaccttattgccccaaacgaacgtctgctgaaactttggacgacgactttggagtatatttcgcggtaccgggtggggcttatggctggtctggcagcctcaaaccaaaatgaatcggttctaaaagctcactggcagcgcgaaatgacgaggctttttccaaatggaatgaaagcaggagacacagagacgctcgatttcgcagccgttgaaagcgtttgtcaaagtctgcacattaactgttcccagaatatgttacgcgctcatttcttgaaggctgatactggcaagcacgggaagctcaatttcgatgaattcaaagacttcgtcacacgtctaagagagcgaagggatgtccgagagatcttcaggagccacgccgacgatcatcgtgagggcttgacattggaggagtttctaatcttccttcgcgacgtacagaaggaggatatagattctgaccgcgcgtattggatatctgtctttgataaacttgtcagaaagtcgaaatcgcgcacacaaagccctactggtacgagctctgaggaccagtcttctcgcatgagtctcgatgctttctcctcgtttcttgcctctgcccgcaatggggtgtatgcctctcgctcgcctcagtccagatttgaccggccgttgaacgaatattttatctcaagctcccacaacacctatcttcttggccgacaagtcgcagggtcttctagcaccgaagcgtatataagcgctttaacgcagggatgccgctgtatagagatagattgctgggatggtgcagatggtcggcccattgtgtctcatggaaggaccatgaccactagtgtcttgtttgccgattgtatcaccgttatcaaccgctacgccttcttttctagcgagtttccactcgtcatatcccttgaagtgcactgcaaccctgaacagcaaattgctatggtgaaaatcatgaaggagaccttcggagaaaagctgatcttagagccgctttctaactcattcgttctcccctcgccagaagagctcaagcgtcgtattctcatcaaggtcaagacgtgtgatgagacggaaaatatacgacaagacccaataacttcatttcatggtcggaagccgaagctcaagttctcctttcattcgcccttcgatgtccgatggacctacattacctaaccttccgtcgctttcaagtccacccacaataggtgcagattgcccgggtccattcttggtacccgagaggaggtcattgactaccaccagcatcagcagcgccactgaggacagtgacggtggtcttgtctccgtcaggaaagagagaagaaggcggcaaaagagcaaaatcactaagccattgtccgacttgggagtgtacacacgcggctacaaatggcatagctttgcctctgcggagagccaagcattcaaccacgtttactcctttgccgagcggtcttttgaaagtatttgtcgggagcccagcaacaaggcccttttcgagaagcataattcaaaatatctgacgcgggtatatccctccggttttcggctacgatcgtctaacttcgacccccttaaattctggcgacgtggtgtccagatgcgtgcgctcaactggcagacttatgacattggt

SEQ ID NO: 37005 - DNA, 747 bp, Aspergillus nidulans
gacgtctctgaccggtataaccataccgcgcggacgttcgacgcggacgttgagctctcagagaaactaatgcgcctgggcgcgaagcgccgcgatcttgtgcggcaggcgcgagggaatgtattggaggtcagttgtgggactggccggaatctggagtactacgaactaggagagaaacgggggattatcgatgaaaagagtcaagtgggcgttcgagggtgccggaccgttacatttgtggatttgagtccggagatggtcgcgattgcgagggcgaagtttgagaaactctatcctggtttcattgggagtgagaaggttcagttccgcgcgcaggatgcgagggatgttcctccgccgtcattgtcggcgtcgggttcggtactgccatccgagtcgcaagggcaagggcagggtaaggggcaagggtattacgacacgattgtgcaaacaatgggactgtgctcgatgccggaccctgcgggggccctgcggcacctagggacgatcacagaaccgcagcatggccgcatcctgctcttagaacatggccgatcgcattacgactggctgaatcgcgtgctggataatctggcccccgcgcatgcggaccgacatgggtgttggtggaaccgtgatatcggacagattgttcgagatagcggcttggagattgtcgaggaggagcgctaccatttcgggacaacgtggagatttgttttgaggcccaagcggacgtagaag

SEQ ID NO: 37006 - DNA, 461 bp, Aspergillus nidulans
gcgacttccgacgcagcggctaggctagcgcccgcacaactcagagagattcgggaagcttttcaggttctggatagggacaacgatgggtttgtggataaggatgatgtggccgatgtgctttcgaatgttggtatgtggagtttttgttccagagctcgacgcagtgaaacccttttctaatagcagtgatgatggcaggcctagactcatcgtctctatcgcagttcttccctccgggcagtgcttcaacgataaacttccctactttcttaaacactctctcgcaactcctctccccgctgtcttcaagacaagaactactcaatgctctagcagcattcgatgaagacgacagcggtcagattgatgttgaagaactacgtgatgcccttctacacacagccccagaagacggggagcgtcccctgacagagcgcgaagtcaatgaggttcttaat

SEQ ID NO: 37007 - DNA, 828 bp, Aspergillus nidulans
tcacttttggtagcgcaattcgttcagaatgtttggatcgaaagttatgacccgacaattgaggattcttatcgcaaacatatcgaagtcgacgtgagtcaatcatgtcctgcgcctgcattcgtcgatgctgacattaaatagggccgacaatgtatattagaaatgtatgttagatgattgagtacaggaccgcgggggctcggtgaatgctgacctttgatggcaacagtcttgacacagcgggtacagaacagttcagtaagttcagctcgtcccttagcagccgtttctctcctggctaacgccttcttagctgccatgaggtaaccagacaccttattctggctcgcttgatagtatcggcgacatgttgattttgggctaacccaattcagagaattatatatgaagcaaggccaagggttcttgctagtcttctccatcacgagcatgtcttctcttaacgagctagctgaattacgagaacagatcgtccgtatcaaggatgatgagaacgtccccattgttatcgttgggaacaaatcggacttggaagaggaccgcgcggtaccccgtgctcgcgcattttctctatcccagagctggggcagcgctccgtattacgagacttcggctcgtcgacgagccaacgtcaacgaggtctttatcgacctctgtcggcagatcattcgaaaggatgcacagggaagatcagaggactacgaacttgcgccgcgcaagcgtgagaatacaagccgacaggaaagaaagcgaggaaaacggcgagaacccaaacgaaaggggccttgcgtgattctatgaaga

SEQ ID NO: 37008 - DNA, 1160 bp, Aspergillus nidulans
accatggcgagccccagccttaagcgaagtgccggcgatctggcgaacccagcagttgagtcaaagagacccaagaccaatggcagcatcacatcattctttggcgctcctaagccaaaagaaaacggggcagcaacgaccaagtcagcggttccttcatcggtctcgagtttcaataaacagaaatgggtggctacattgactccagagcagaaggagctactccggctagagatcgataccatggacgagagttggctagcccatttgaaagaagagctcatcaaacctgagttcctggccctgaaacgttttcttcaaaaggagaagcagatgggggtgaaagtcttcccgcccgaagaagatatttactcatggttcgagagagattccaacccagtagctgtgtatgagctgacccttggatgcctaggtctcgtcatacgcctctacacaaagttaaagtggttgtcattggtcaggtaaagttgcaaaaaggaatatgctttgttgcttcactaacatggtatatgttatcgcacaggatccgtaccataattacaaccaagcacacggcctcgcattctcagtccgccctccaaccgcggctcctccatctcttgttaacatttatgcttcgatcaaaaatgattacccgtcattcgtaccgcctccgaacaaaggtggcctgcttataccatgggcagagcgtggtgtcttgcttttgaacacctgtctgactgttcgtgcacatcaggctgcgagtcattcaaacaaaggctgggagcggttgacacagaaggctattgacgtcgtcacccgtgtccggactcggggagtggtcttccttgcatggggcacccctgcagggaagcgtattactggcatcaaccgcgatagacattgcattttacagtctgttcatccgagccctctgagtgcccacaggggatttgtgagtttcagctttcctcccggatattttgccttgaagttagtaggattaacctgttatacagttaaacaatcaacattttaaaaaatgcaacgactggcttgccgaacgatacgggcccgatgaaatcattgattggagtctggtatcgaaacaagaagcttcccctgcctctgccgtcgttcagagctcttccgttacggtc

SEQ ID NO: 37009 - DNA, 950 bp, Aspergillus nidulans
gtcagcggcgggacctcaggatgcgtcgttgccggccgtctggctgagaacaaggatgtgcgtatcctgctactcgaggcgggccagcataaccgtgacctcgagaacgtacacatggccggcggttggtccaacaacttcgactctgagaccgactggaacctgattaccaagcctatggcgggggtcgataaccgccaggtcaagctcagtcgaggccggttcctcggcggcagtagtgggtgcaatggcaccctctgcatccgcggcagcaaacaggactatgatgactggggcttggagggctggagcggcgatgagttcttcgaggcgatgaagaaggtacccctccctttcttttggctttcgtcatccccgcactcgatagatgaaacgtgctaaagagtcagtccgaaacattccatggcaagccctggttcaaggccgacgagtcggcccacggctactctggccctctacacaccgaaccgcacgacctcgcccccatcgctgaccggctgatcgactccttcgttgatcagggccttcccctgcaccacgacatgttttctacgggcgacgtcccccacggctgcggccacgtcccccgcaccgtctacaagggtgtccgcaccacatcggccgacttcatcaccaaggagtacgaccgcaccaatatcactatccagaccgacgcgacggtcgatcgaatcattatcgagcggaaggacgacggcctccgggcagtgggtgcgttaacccgctccgcagacgggacaagcaaagcctactacgcccggcgcgaagtcatcgtctctggaggcgcatactgcagtccagcaatactcatgcgctcgggtatcggagcgcgcgacgagctcgcccaatttggtatcgactgtctcgttgatctcccaggcgtcggcaagaatctgatggaccacctcgta

SEQ ID NO: 37010 - DNA, 1238 bp, Aspergillus nidulans
aatgtcagcccagttcctccggacgaaattttcgccctgaaccgtgcatacatcgacgatgacttcccgcagaaggtcaatctcggtgtaggcgtttaccgcaccaacgagggccagccatggcctctccccgtcgttgaggaagcagagaagcagctcgcagccgaaaacagcgtcttccgccatgaatacacagccattgaaggtgatagggcattcctccctctcgctcgggacctaatgtttgggttcgacggccaagctacttctgatgcgaagcaggaggcagccaaagcacgcattggcaccgtccagacagtcgccggcaccggcgcaaaccatctcggtgccctcttcctcgcaactcacatgaagccacgaaatgtctggctctccaacccctcttgggcaaaccacctcactatttgggaactcgccggagtgccccgcaaaacatacccctattactctgccgccacccgctcctttgatttcgacggcatgatctcaactctcgaatccgaagctcaggaaggagacgtgattcttctccacgcctgcgcccacaatcccacaggactcgaccccaacaaggagcaatggaaagctatcatcgacctctgcgagcgcaagcgcattttccctttcttcgactcagcataccaaggcttcgcctccggatccgtagacgaagacgcctgggctgtccggtacgtcctaaacgagaagccgcagatggaaatgtgcgttgcgcaatccttctctaagaactttggcctctacggccagcgagtcggcgccttccattacgtcctcaacgaaggcgcagaggatctccgcgatacagtcgtcaacaacctttgccacctcatccgcggagagtactccatgggtcccacggcaggctgcaacatcgtcaagaaagtcctcacaagtcctgagctcacggcaaaatggcaccaggatctgaaggtcatgagttcgcggataatttccatgcgcgaagctctttacaatgaactagtcagactcaaaacccccggaacttggaaacacatcgtcgaacaggtaccttgcccaaaccgaaactatagcatcccaacggtctcaggtgctaacactctacgcagaacggaatgttctcctacacaggacttacaccttcacaagtctacgctcttaaagataaattccacatctacctgctcaagtccggcagagcctccatcagtggacgt

SEQ ID NO: 37011 - DNA, 885 bp, Aspergillus nidulans
tccataggcatcaggtgtaaggacggggttgttcttgcagtcgagaagatcatcaccagcaaactcctgaagcccggtgcgaacaagcgaatatctactgtcgatcgtcacgttggcattgtgagtcgtcaccgtttgtcaaagattattgagagacccaactgtttgtactaacacgggttcctgtaattgataggtctcatcgggattggctcccgatggtcgtcattttgtttcccgtgctcgcgatgaagcgtcctcatggcgtgggatttacaaaagtcctattcccgtttcggctctagcgaaccgtcttgggggctacgtgcaagcatacaccttgtactcaagcgttcgaccatttggtgttacttcaattgttgggggctgggactctgaggctgagcttgcagtcgatggtcaagtgggaagtggaccgcagtcaggttctggcgggaaagtcgaaggcgcgaaatcgggaggaccaggtttatatatgatcgaaccaagcggtctgtattgggtatgttatctcaaattgcattggatgttttacgcacgctgatatcgttccaggggtactatggggctgcaaccggtaaaggaaggcaggcggccaaagccgaacttgaaaagctagacctggcttcggagaaactcagcctgcaagatgctgtaaaggaggcggctaggattatctacgttgctcatgaagataacaaggacaaggaatttgagcttgaaatgagctggattagctcactgaatggtccaacaaaaggcagacacgaagaggtgccgaaagaactactcgaggaggcagaacgagcggctaagcgggcccttgaaggagacgacgaggaagaagaagatggttcgaaagca

SEQ ID NO: 37012 - DNA, 1524 bp, Aspergillus nidulans
cttgctagctatgacactggcacgatcagtggaatccttgccatgccgtactgggctcaaaccttttctacaggctaccgagacagcaccggccagttgaacgtaacctctagccagtcctctgccatcgtctcaatcctctcggccggaacattcttcggtgccctgggtgccgcgcctgtgggcgacatcatcggacgtcgttggggcctcattgcgtcaaacggtgtctttgtgctgggtgttgtcctacagacgattgccacctccatcccgccgttcctcgcaggtcgcttctttgccggattgggggttggtcttatatctgcgttgggtgagccacactgcctaattcactactacacatgcagagtactaatgaactcggccctcagttcccctctaccaatccgagaccgcaccgaaatggatccgcggattcatcgtgggctcctaccagttctccataaccatcggcctccttcttgcctcagttctcaacaacgcaacccaccaccgcaacgactcgggctcctaccgcatcccaatcgccgtacaatttgcctggtccatcatcctcgtcggaggcatgcttatcctccccgaaacccctcggtacctgatcaagcgcgacgacaccaaagccgctgctctttccctctcgaagctccgccgtctcccgcaagaccacgagtccatccgccaggaactgtcggagatccaagctaaccaccagttcgaagtcagcctgggcaagtccgggtacgccgagtgtttccgggggagcctcctgaagcgtttgctcacggggtgtggcctgcaagcgctgcagcagctgaccggtatcaatttcatcttctactacgggacgcagttcttcaagaactccggattcaagaacgagtttgtcatcacgcttatcacgaactgtgtgaatgtgggctcgacgatccccggtctgtacgccatcgataaatggggtaggaggcctgtgcttcttacgggggcgattgggatggctgtgtctcagttgcttgttgccgtcctgggaacgacgacgactggccaggatgctcaggggaatattattgtgcacaatgctgcggcgcaaaaggccgcgattgcgtttatctgtctctacatcttcttctttgcggcttcgtgggggccaattgcttggtacgtttctctcctacaccgagcctgatacagcacactcgtcgcaccaactaacaatggagttaatcgaacagggtcgtaacaggcgaaatcttccccctcaaaacccgcgcaaagtctctctccatgacgaccgccacaaactggctcctaaactgggcactgagcttcgcaaccccgtacttggtaaactacggtgacggaaacgcaaacctacagtccaagatcttcttcatctggttcggctgctgcttcctctgtattgggtttgtgtactttatgatctatgagacgaaggggcttacccttgaagaggtggatgagctttatcttgaggttaagagc

SEQ ID NO: 37013 - DNA, 897 bp, Aspergillus nidulans
cttcaatcgagcaagctcgccttcattggcggtggcaacatggcgtcggcaatcatcggcggtctcctcagccaagggatcaacaagcagaacatcaccgtgtctgagccatgggaggtcaatcgcaacaagatcgccgacctgggtgtcaaaactaccacttccaacgtcgttgccgggggtgaagcagacctggtcattatcgcggtcaaaccgcaggtcacaaaggctgtgtgcgaagagctggccgacgcctggtccaagcgtgagacactgccggtggtagtcagcattgctgccggtatcactctgggtagtctacagcagtggctcaagacatctgacggcaggaccacgcatctggttcgcgtcatgccgaacacacctgcgcttgtcggagagggtgcatcgggcctgttcgccagcgcggacgtgactgcggaggagaaggagcttgtcaacgcgcttctcggcagcgtcagcaaggctacggaatgggtggacaaggaggaattgatcgatgtcgtcactggtctttccggtatgttgtttttgcttttacctctagtctggtccatcgtcgtactgacaagaccagggtccggacctgcatacttcttcgccatggtcgagcacctgatcgccagtgccaccgcgctcggcctgccggccgagcaagccacgcgcctggcggcccagacctgtctcggagccggaaagatgctgaccgaatcgtccgacagccctacgcagctgcgcaagaacgtgaccagcccgaacggaacgacgcacgccgctctggagaccttcaatgcgcagcactttgaccaggttgtggataaggctgtgaaggcggctacttcccgcgcggccgaattgggtaacactcttggcaaa

SEQ ID NO: 37014 - DNA, 1369 bp, Aspergillus nidulans
ctgctcctctccaaggctccacccgatacggaagtgacgtcgttctccgattccgagtacaaggtctcgatgaggcagaggcgctgacagaggcgaccaacatccttttcctggatgtttgggcatcaacaacggagtttgtcgacattagactcgcgaaggaagttgtacgtgcgaggccagcccctgacggccgcgatgctgaccctctcagataccttccttactcggcttattgcccgactcccttcagactgcctacgtgccccttattgataacctgccggaggctatctctgctacataccccgctcgccggtcccttggactcaatgaccaatttatgcctagcccgtccactcgtgcgcccgatcttttctttgaagactatcagccgttgtcggtcattacaccctggatgcagctgatggcgtccatgttctcttcgcacgcccgaatgattaacgttggcgtctcttacgagggccgtcaaatccccgctctacgactgggacgcagttcccaaccgggcgaatctcgtccaatgattctcatagttggcggaaatcatgcgcgagaatggattagtacgtctactgtcgcgtacattgcgtacaatttgatgactaggtatggatcatctgccgccgtcacgagtttgttacaggactacgattgggtcctggttccaacggtcaatccagatggatacgtttatacttgggattccgaccgtctttggcgcaagaaccgacagccaactagtttccgattctgccctggtattgacttggaccggtcatggtcttttgaatgggacggcaatcagacgcagacgaacccatgctccgagaattatgcgggagaagagccgtttgaaggcgttgaggcacaacagctggcggaatgggcactcaacgaaacagagcataataacgcgcgatttgtcggcttccttgacttccactcctacgcacagcaaatcctctatccgtatacatattcctgctcatcagtcccaccaaccttggaaagcctagaggagctcggcctcggcctggctaaagtcatccggctaacaacacacgagatttacgatgtcacctctgcatgcgaaggtgtcgtaataccggccagtggtgacaagtcggcaaagagcctcttccctgtaggaggtagttctggcggcagcggacttgactggttctatcatcagcttcgaacccgctatgcctaccagatcaagctgcgcgatcgcggcagctacgggttcctcttgccgtctgaatacatagtccccacaggaacggaagcttttaacgccgttctcaaactcggccaatttcttacagaacaggattatcccgga

SEQ ID NO: 37015 - DNA, 1504 bp, Aspergillus nidulans
tacctcgttatgtgtggtctgggagagatggccacttggttacctcgctcttctggtttcactggttatgccgttcgcttctgcgatcctgccttgggttttgcattgggttatacgtacgtcgccaatgattcgattcgcgcgcaatggctgctgacagcgatcttgcagatattggtttaaatacattattgtcacgcccaatcaattaacagccgctgcgctggttatacagtactggctgcccgccgacaaagtcaatcctggagtctggatcacggtattcctggtcctgatcgtcttcatcaattactttggcgtcggcttctttggagaattcgagttttggctctcctccttcaaggtcgtcgtcatagtcggcctgatcttgctctccttcatccttatgctgggaggcggtcccgaccatgaccgcaagggcttccgctactggaaggaccctggcgcgttcaattcgtatattgacatgggccccgatggtaacggttccgctgctggacgcttctacgcattttgggcgacgctggtttctgccacctttgcctatctcggaacagagctggttggagtgactgtcggcgaagctcagaacccacgaaagacgatcccacgcgcgatcaagctgaccttctaccgtatcatctttttctacgtgatcagtgtcctgctcgttggcacactggtcccctacgacagttcagaactcaaacaggcaaactccgcgagcacctcttcggccgcctccccctttgtcctggcgattcaactctctggcatccccgcgctcccccacatcctgaacgcctgcatcctggccttcgtcttctcggccgccaactcggatctctacatcgccactcgaaccatctacggtctcgccaaggaggggaaagcccccaagatcctcacgaagaccgaccgccgcggcgtccccttcgtagctctaggcctctgcaccctcatcgccctcattgcctacatgaatgtttctagcagctccaagaccgtcttcaagtacttcgtcgacctcgtcagccaatttggtctgctcagctggatctccctcctcgtcacacatatctgcttcgtcaaggcgcgcaaagcccaagaaatccccaagaacgagctcgcctacaccgctcctctcggcgtctggggctcctatttcgcccttttttggtgcattgtcgtctccctaaccaagagcttcgacgtctttactggtgacacattcaactacaagaccttcatcacctcttaccttggaatccccctctacctcatcctcatctttggttacaagttcaccacccggtgcaagcgtgttctgccccacgaggcagacctctacactgacaaggacgctatcgaccgtgaagaggcggcgtatcttgcgcggcaggaggcgaagagggctgcgcagggcgccaaccacaagcaggccaattggttctacaagacttttgtctcgtggctgttctag

SEQ ID NO: 37016 - DNA, 964 bp, Aspergillus nidulans
tttcggcagcagtatcgagtcttgcaacaacttggaaagggacactttgcaacggtctacctttgcgtagaacgcactactggggcaaagtttgcggtaaaagtatttgagaaacgagctgactccaagtctcaaaacgacgcgttgatgcaagaaatcggcctcctgatgagcgttagccatccaaatttgctctgcctcaaggacacatttgatgaaagtgatggggtatatctcgtgctagaacttgctccggaaggggagcttttcaatatgatcatacgcaaacagaagtttacggaaaaagagactcgccacatcttccgtcaactcttcgaaggcctgaaatatctggtatgccccgtcccttacatgggttgttcatactatgattctaacgtagacagcatgaccgtggaattgtccaccgagatatcaaaccggagaacatattagttgccgacaacaaattgaccgtaaaattgggagatttcgggctggccaagataattggtgaggactcattcacgactacgctgtatgttctcccgaaagtataattgaagtacaaataactgaccaaatactacgtccagatgtggcacaccaagttgtaagtacttacgagttcattgtgaatgatgctcattctccagatgttgctcccgagatactccaagaatctcgccgtcgaaaatacaccaaagctgtcgatatctggtcacttggtgtcgtcctctacatatgcctctgtggctttccccctttctctgatgaactctatacgccagagaatccttacacactggcccaacaaatcaagctagggcgctttgactacccatcaccgtactgggattctgtgggagatcccgccttggatcttatagacaggatgcttacagtcgacgtcgataaaagaatcactgtcgatgaatgtcttcaacatccatggctcacaggc

SEQ ID NO: 37017 - DNA, 1325 bp, Aspergillus nidulans
ctcataatcaacaatgagtcagtcatcacggacaatgtagtggaggtccataacccggcaacaggcgaactcctccaccgttgcgctggcgcatccgttgacgatgcaaaccgtgccgtggcggctgcgaaagctgcctttcctatctggagcaagacgcatccgtacgagcgcagggcgatactgagcaaggctgccgatatcatgttttctcggaaggaggagttcatcaaaacccaaatggaggaaacaggagccgggaggatgtttgtggaggtgacattcatggcaagcgtttcgttcttgagggacttcgcagggatgattcccagcgttgaaggaagagcgcctattgttgctgaagaaggacaaagcgcgttggtgataaagcagccatatggtgttgttctagggatcgcgccctggtacgtttgtttcttttggaaggaagcagtgtcactaaccaacgttcgcctccaggaacgctccttttatcctcggaactcgttcagtcgctctccctttggccgctggaaacacaacgatcctcaaaggctccgagttgtctccgaaatgtttctggttgatcggggatgttctccgggaagctggacttcccgcaggctgcttgaacgtgatctatcacaagacctcagatgcgcccgcggtcaccaatgcgcttattgcccacccagacgtgcgcaagattagcttcacgggtagcactcttgttggttcgatcattgcctccaccgctggaaagtatatcaagccggttctgcttgagctgggtggtaaagcctccgcgattgttctagatgatgccgacctggagaaggctgcgatgggctgtacactgggggcttttctgaacgtaagtaactcgttcaatggacatagttcgcggaagcccggtgaatgctaacaccaaccattagtctggccaaatctgcatgtcgacggagcgcatagtagtccaacgccctgtcgcggagaaattccagaagttactcgttgaaacatccgagaagattttcggcaagaacgcgcctgcacctgtccttgtggcgaccgctgcggtcaagaaaaaccaaggtctggtagctgatgcgatcgataagggtgcctctgtcgtttttggcgaccctaaagaaagcgagccatgcgcaaacgctctgcgccccgttatcgttggaggcgtcaccaaggagatggacctctatgccacagagtctttcggaccgacagtgtccctgatcgttgtcgacagtgaggaggaagccattaaggtggccaacgacacagaatatggcctcacacggcag

SEQ ID NO: 37018 - DNA, 527 bp, Aspergillus nidulans
cagacatgtcttctcatttcttatacgaccaatgccttccccggcgaatatattcccaccgtgtccgtcaccgcgctcctcctttccctctagcgcaatgaacctttgttgaccggttaccacagattcgacaattatactgctagtgtcatggtcgatggtagaccgattagcttaggactttgggatactgctggacaggaagattacgaccgacttcgcccattgtcctaccctcaaaccgatgtatttctcatttgcttctccatcgtcagccctccgtctttcgacaacgtcaagtctaaggtatatccccaccctttgcgaaatgctttgtagtatataatacttcagacgatatgttgctgacttcgatgtagtggttcccggaaatcgaacaccacgcgcccaacgttccaatcatcctagttggcaccaagctcgatttgcgagacgaccccgaacagctcgaaagcctccgcatgaggaagcaggagcccgttacttatgagcaggctctggcaaag

SEQ ID NO: 37019 - DNA, 1292 bp, Aspergillus nidulans
tctacgcaggcttggaaggttctgtcccagacactcccatctcgtgggccagatgtcgatgcttggtggcagcttacggggagacacctcgcagttctcttggacgctgctgcgtatcctatcgagaaacagtacgaatgtcttctgtaccattaccactacgctgtatgtttgacgacctcagtatataaggtcactgactaacttgaagttgtctaggcgccttatctaggccccgcgcctcgagaaggggcttcgccaccaacctggaagtccatgctccagttagacggcacgcccttcgaattctcatggaaatggaacaatcccggcggcgagccagatgtccgcttcggtttagagcctataggaccaatggcaggaacgtccttagatcctttgaaccacttggccatgcgcgagatcctctacaagctctcctcggctgtcccaggctctgatctcacctggacacatcatttcctagccactctgttcgatcatgactatgccaagtacactcaaaaggccgctactatgggtagctcgattggcactagcttggtgtattccctcgagtttcaacgcaagtcaactgggctcaagacatactttcacccgcgcaagcttgaccagcaggcgttcctagatatacccagctgggaagcgtccttccggggattgcatccaaattctccatcccgcacagctgtccatgaattcctaagcacgaatccggaaggcaagctcctgaagccattctgtctcagcgtagacaattgcagcccggcaaaagcccgtataaagtggtatttcaacagcccgcacaccaacttcagagcgattcgcgaaatcatgaccctaggcggccgtatcgcagacactgagacccgcacaaaacagttctccgagctcttcaacctacttaaaactgttaccgaggagcacgctgatttcccagagacttcagagtttccatacgtccccaacaacggcgacagcataatccccaacttcgtgacgccccggacatgctcaagggatgcgtgtacttcttcgacatcgcgcctggaaggaatctccccgcgataaaagtctacttccccgtgcgtaaccactgccggaacgacctcgccgttactcagaatctcaaccggtggctcgagtcaaggggccgcgggcagtacggggctgcgtttgggcgggccctggagactatcgccgattatagacgattggaggacagtggcgggttgctaagttttctttcctgtcagttcatggaggacggg

SEQ ID NO: 37020 - DNA, 783 bp, Aspergillus nidulans
  unsure (1)..(783): unsure at all n locations
aaaaanaanncccaaacattcactcttccttcctcacctggtcgcacctacaacattgccggcatgactaaaggcgcgggcatgatccacccgaacatggcaacacttctcggcgtcatcgccacagacgcaacaatcgtcccttcagccctacaatcgctgctcaagacctctgtcgcacgctcttttaacgccatctccgtcgacggcgatacaagcaccaacgacacggttgcgatcctggccaacggagctgcagacggcgcaccgatcaatagcacacagaatgacgattacgtggtcatgcagaatattcttacctcgttccttcaatcgctgtcgcagctcgttgtgcgagacggagagggcgcaaccaagttcgttaccgtccggatccaaaactcccctgactacccctatgcgcagctcattgcgtcgactatcgcaaggtctccgcttgttaagacggcgctgtacgaccgtgatgcaaactgggggcgtattctctgtgccatcggttacacgcagggtgttgcgccgggaactgttgtgcctgagcggacgagcgttaccttcaagcctgctgatgggagccccgtgctcaaactccatgtgaacggagagccccagcaggtctatgaggagcgtgctagtgctattcttccagacggagatgtgcagatcatcgtcccccttggtgctggtaacaagggtgaattaaaatgttaggaaggtgtgtcctggttcatcgacttcacccatagttacgtcactatcaatggt

SEQ ID NO: 37021 - DNA, 477 bp, Aspergillus nidulans
gatgtccccctgatcctgcaattcatccgcgaactcgccgattcgaaaaaagccttgcaagaagtcgaagccaccgagaaatcccttctcgcgaccttgtccttccccgacgacacccccaagcggggctccgtctataccgcactcatcacgccccccgcgacgcccgagaatccgtcacccaagcccgttggcatggctctcttcttctacaactattctacttggcgcgcagccccgggtatctacctcgaggacctatacgtgcagcccgcggcgcggggaaaaggatatgggtttaagctgctgaagtggctggctgccaaggtactcgagattagggggagacgcttggagtggagtgtccttacatggaatgagccgagtatcaaattttataaacaagtaggcgcgaaggctatggacgaatggttgaagatgatggttgagggggaggctctggagcggctggcggaa

SEQ ID NO: 37022 - DNA, 592 bp, Aspergillus nidulans
gactgcttccgccgcaccactcaggccgagggtgttgtctctctctggagaggtaacactgccaacgtcatccgttacttccctactcaggccctgaacttcgccttccgtgacacctacaagtccatgttcgcctacaagaaggaccgtgatggatacgccaagtggatggctggtaaccttgcctccggtggtgtatgtattagcttattttacctttgatgcagccgctaacttctcttagatggctggtgccacttcccttctcttcgtctactctctcgactacgcccgtacccgtcttgccaacgacgccaagtccaccaagggcggtggtgagcgccagttcaacggtctcattgatgtctacaagaagaccctcgcctccgatggtatcgtcggtctctaccgtggtttcggtccctccgttcttggtatcgttgtctaccgtggtctgtacttcggaatgtacgactctctcaagcctgttgtccttactggtgctcttgagggctctttcctcgtctctttcttgctcggctggggtgttaccactggtgctggtattgcttcttaccctctcgacaccgtc

SEQ ID NO: 37023 - DNA, 809 bp, Aspergillus nidulans
ccccgtaagcccggcatgacccgtgacggtaaggaggatgactgtgaaaatctacgaataggcactgatcttttgatgacagacctcttcaacaccaacgcttccatcgttcgcgaccttgctaaggccgctgccaaggcttcccccgaggctaacatcctcgtcatttctaaccctgtatgcgtcatcggaactcggagacatggaactcgtgctgattcttccaggtcaactccaccgtccccatcgtctctgaggtcttcaaggccgctggcgtctacaaccccaagcgcctctttggtgtcaccacccttgatgtcgtccgtgcttcccgcttcatctctcaggtccagggtaccgacccctctaaggaggccgttcccgttgtcggtggacactctggcgtgaccatcgttcccctgctttcccagtccaaccaccccaacattgatggcaagacccgcgatgagcttgtccaccgcatccagtttggtggtgacgaggttgtcaaggctaaggacggtgctggctccgccactctctccatggccatggccggtgctcgcttcgccgagtctctcctccgcgctgcccagggcgagaagggtgtcgttgagcccactttcgtcgagagccctctctacaaggaccagggcgtcaacttcttcgcttccaaggttgagcttggccccaacggtgctgagaagatcaaccccgttggcgaggttaacgaattcgagcagaagctccttgaggcctgcctcgttgacctgaagaagaacatccagaagggtattgacttcgtcaag

SEQ ID NO: 37024 - DNA, 992 bp, Aspergillus nidulans
gtgcagattgttgatgcccgaaaccttcttctcttccgctcagaggatctcgaaacctacgtcaaggaaatcgaccccaagaagcgaaacctactactagtcaacaaggctgatatgttgactgacaacaagcgcgaaatgtgggccgactactttgagcgcaaccagattgaattccgtttcttttccgcacagatggctaaagaggctaatgaagcccgcgagaatgaaggcgaggatgaagataccaagtcgctgacagaaggtacggagaatttgaatctacaggagtccaaggagaaggaagccgacggaggcgtcgatcttcccagcggcacaaaagccccttctcccaagcgaaccaacatactagatgtggatgagcttgaggaacttttcctttcaaacgcgccagatgcaacaaaagacgatgaagatgaacaagatggtgattccaaacctagaaagacagtcattggtctagtcggatatcccaacgtcggaaaatctagcacaatcaacgccctgcttggtgcaaaaaaggtctccgtttcgtccactccgggtaaaacgaagcactttcaaaccctctacctctcacccgaaatcatgctctgcgattgtcccggtttagtcttccccaatttcgcctccaccaaagccgagctcgtcgtcaacggcgtcctccccatcgaccagcaacgcgagttcaccggcccagccgcactcgtcgccaagcgcattcccaaacacttcctcgaggacgtgtacggcgttaccatccatactcgcccgatcgaggaaggtggcacgggtgagccaaccgcccacgaccttctccgcgcctacgcccgcgcccgcggcttcgctacaacaggacaaggtcaacccgatgaatcccgcgcagccgttacatattaaaggattatgtcaatggcaaacttcttttctgccacccgcctcctgccaatgaagcagagggcgaagaacaa

SEQ ID NO: 37025 - DNA, 1357 bp, Aspergillus nidulans
cgagactccctcgacgtacgaatttacgaccctttccgtcagggaggggaggcgtacctcggctctgcggatatggaagtcaagtttgctggaaagctaagacccgatactctatatgatcaggatgagcttctcaactctgttatcaaggtacgtgtaaccctttcctagctctcaacagcctgactaatggtatcagaacttcgaaagccaaatatttgcgccggggcagccggtactgatggatcatcatggcgtaccgcttcagctaacggtcaagacgatccttcgtgtcagcctgacttcagaaaaggataccagtaaagtgccggagacggaacctacagccaggggcatccttacgaagcatacgttgatcaatttcttcaaagatcctcagagtgagatccagataaagccggcaaaaaaccggcctgcagcaaatgccatcattcaacccgacttcaacactgagaagatgggaattggtggtcttgactcggaatttcacacgatcttccgccgcgccttcgcgtcgcgtatcttcccacctgatattgtgcagaagcttggtatccagcacgtgaagggtattttgctcttcgggccgccaggaactggcaaaacgctgctagcgcgacagatcgggaagatgctgaatgctcgagagccaaagattatcaacggcccggaggtactgaacaagtttgtcggacagtcagaagagaacatccgtaaactttttgccgacgcggaacaagagtataaggagaagggcgacgaaagtggactccacatcatcatcttcgatgaattggatgctgtatgtaaacagcgtggcagcggagcaggaggcggcaccggtgtcggtgacagcgttgtcaaccaactgctatctaagatggatggtgtcgaccagctcaacaatattctacttatcggtatgaccaataggaaggatatgattgatgatgctttgttgcgacctggtcgtctggaagtgcacgtcgaaatctcactgcctgacgaagctggtcgagctcagattctcggcatccacacccagaacatgagacagagtgatctaatggatccaagcgtcaatttgtcggaactagcgacgttgacgaagaactattcgggtgctgagattgctggcctcgtgaaggctgctacgtcgttcgccttcaaccgccacattgactccggtaagacagttagggttaaggacgatgccgcggaaatgaaggtcaaccactccgattttattcatgctcttgatgaaatccagccagctttcggtgtgtctgaagatgaaatcaagagatgcattgaacataaaatcataaattattcg

SEQ ID NO: 37026 - DNA, 982 bp, Aspergillus nidulans
aaccgtctactcaaatacctctcaaccaacggcggcattatcgtgcaccacgtcgacactaccaaccccgacaaagtgaaggaagtcttgaccgacaagacagccatggtgtcctgaaaccccgaccaacccgcttatcaagattgtcgatatccctacgattgccgcggcgtcgcacgaagcgaaccctaactgtctagtcatcgtggacaacaccatgatgtctccgctcttgctcagcccgctcgaactcggcgcggacgttgtctacgagagcggcacgaaatacctgtccggccaccacgatgtcatggccggagttattgcagtcaacgacccggccctcggcgagaggctctactttccgatcaacgcgtccgggtgcggactgtcgcccttcgactcttggctgctcatgcgcggagtcaaaactctcaaggtccgcatggatcagcagcaggccaacgcacagcggatcgcagaattcctggagtcgcacggtttcaaggttcggtatccaggtctgcgctcgcacccccagtacgacctgcaccactccatggcccgaggagcaggcgccgtgctttcatttgagacaggcgatgtctctgtcagtgagcgcattgtcgcgaacgcgaagctgtgggctatcagcgttagctttggctgtgtcaacagcttgatcagtcttccctgccggatgagccatgccagtatcgatgcaaagacgcgaaaggagcgtgccatgccggaggatctgattagattgtgtgtgggcattgaagacgtagacgaccttattgatgacttgaggcgagcagtaagtgtttctacgcgtaatcgtgttttctgggttatgctaatattctctagctggtacaagctggcgctgtcaacgtcactctggacggcattgaagcgaacacgccgcagtctgcgtagtcaagtaatgaaggaatatggttatggatgactcatagtc

SEQ ID NO: 37027 - DNA, 1220 bp, Aspergillus nidulans
agaacccaagtgctttcgacagtgaccgcaatttacgatattggctgtttctttggcgcgattgctgcctttacatgtggcgagcggcttgggcggaagaaggctattttgctgggaacgacgatcatggcaattggaactattatcaaggcgagctcatacagtctcgcccagatgtttgttggtcggatcgtccttgggtatgctatttatgcctccctcgagttcaaaaccgtctaatactgagattctggggtccagtataggaaacggtatcaataccacgacggcccctgtctggcagaccgaaaccgcgcaccacaagtggagagggaagttggtcatcttcgagctggtaatgaacatcgccggcttctctttggtgaattggatcaactatgggctctcgttccgtggaggcgcggtggcatggcggttccctatcgccttccaatttgtcttcattgtcattctctttgcaacggtcccctggcttcccgagtcacctaggtacgcgtgtattagagtgtctgtttctttcttggaaccaaggctgacgatctttagatggctcatggaacagggccgtgaaaaagaagcagtagagatactggccgcgattgaggacaagcccgtaactgattcctatatcctgacgcagcgcaatgagattcgcttcagtgtccagtacgaacgggagaatgcgcctacctggaccgaactcttccttcgcaaaaagggaactaacgataccaaaagccttcgacggctcctcctgggcgccggcacacagttcatgcagcaattcgaaggaatcaacatcatgtcctactacatgccgctcattctcatcaacgcggtcggcttgtcggagagtatggcccggcttttatctgcgtgcaattcagtatcgtatctgctcttcacctgccttgccgtgccgttggtcgaacgctggggccgaagagggctgatgctcttctctactgccgggcagggcttttcattcctcgtcatcaccatcctgctgcggtacgcggagacaagccctgacaaagaaaagatcgcctcggcctcgattgcattcttcttcctctacttcatctcttttggaatgggtatgctaggtgttccgtggctctacccaactgagatcaattcgcttcctatgcggaataagggcgccgctgtcgccacggccacaaactggatgaccaact

SEQ ID NO: 37028 - DNA, 1332 bp, Aspergillus nidulans
ttcaaatccggcaagaccaaggagattgcctggcgcaaatggcagctcaagcagatctggtggctcgttgacgacaacgaggctctgattcaggaggccctcaagaaggacatgaacagacacccattcgagacgacctttaccgagtgcgcgaacgtcaagggcgatgtcatcgagcacctgaagaacatcgacaagtggacggcagaccagaaaccgagcgctggaatgctagggctcatgctcaggccaacggtgcgtccggagccgttgggcgtcgctcttattattgggccctggaatttccctttctccctcctggttcagccgctgattgcggcatcactgccggctgtgcggcgttgctcaaaccgtccgaggtcacatcgtcagtccaacagctgtttgttgatctcgtgcccaagtatctggacactagcgccgtgcgtgtcgtcactgggggcccagcggaaaccggttgcctgctgcagcgcaagttcgaccatatcttcttcaccggctccgttcccgtggcgcgtcatatcgctgctgcagcggccaagcatcttacgccgactgtgctggagctgggcggacagtgtccggctatcgtgaccagttcggcggatgtggacgcggcacgaaaggacattgcctggatcaagtatctcaatgctggacaaatctgtctgtccgtaaaccatgttttcgcacatccttctgtggagcggaactcattgaacgaatggcgttctggcttgatcggttctacaagggtgagaaggatgccatgacgcacatcgtcaatgacaagaactatgctcgtatcaaacagctggcggagaagacgaagggaaagatcgagctggacgggacggcagatgccgaaactaggagtctgccggtgagcatcgtgagcaatgtcgaaatgagcgatcctttgctctccgaagagctctttgggaccgtctgcccggtgataaagggttcgacagacgatgcgatcaagtccatcaacaggtatctggcataacctgctactctacacatgctgactgattagcctgccccgacccctcgctctgtatattttcagtcaggaccagaacgaagtcgagcatagtaagtcgtccctctctcccctggtttacttgtactcattcgtcagtaatatcctccaccctctccggtggcgtctgtgtcaacggcgttctcgtccacgcaatggtccctaatgccccttttggcggagttggcgactccggtcacggcgcctaccacggcgagtacggcttcaagtccttcacccactaccgcacaatcgcccgaccg

SEQ ID NO: 37029 - DNA, 945 bp, Aspergillus nidulans
ctatccgcccacgtcatctgccccgagtgcaaagaaatgcccccaaatctggaattcccaggttctcatgagactgtttgcggatcctgtggactggttcttgcggatcgagaaatcgacatgcattccgaatggcgtaccttctcgaacgatgaccaaaacaacgacgatccttcgcgtgttggtgatgctacgaatccgctattgaatggtgatcaattggagacgcaaattgctagtggtggttctggccgggttcgtgatctgtaccgtgcccaaaataaacaatcgagcgacaaggcgaataagtccctccttgccgcatacaaagaaatcggtgctctctgtgacgggtttggaatcccgaagaacgtggcagacactgccaaatatttattcaagattgtcgacgacgcgaaagcattcaagggcaaatcgcaggatgtcatcatcgccggatgtattttcatcgcctgtcgcaagtgcaaagttcctcgtactttcactgagattttcgctgtcaccaaggtctcaaggaaggagattggacgtatatacaaagcccttgagaagttctttaccagccagaatctcgagcgggccaatgcagttgtgtccaacggaggtgttcccgaccccaacgacacgtacactgctacgacctctaccaagcccagcgacctctgcagccgtttctgcaaccttctagatctaccattccaagtcacaagcgtatcatcggccctgtcggatcgcgtgactacggagggcaaccttgccggacgctctccgctctccattgttgcggcgtgcatctacatggcttcgtatctcatgggccaccccaagtccgcaaaggaaatctcccaagtcgctcacgtcagcgacggcacaatccgcggcgcttacaagcaactctacaccgagcgcgagagctgggttgac

SEQ ID NO: 37030 - DNA, 1117 bp, Aspergillus nidulans
gggacaagtgggttagttgccgccaacagactcagaattgagcaatgtcactgtggctgttattgaagccggaggctcggtgctcaataatttcaatatcacttatgttgagggccatagcttggcgtttgacactgacatcgactgggcgtatcaaaccgaggagcatatatatgctggagacctcaaacaaaccattcgcgctggaaaggctatcggtggtacaagcacgattaatggtaactgcaaccataccttctcaattcgtaacatatgtgtttaattcaaccttccgcaggaatatcctatacccgagctgaagacatccaaatcgacaactgggaactggtcggaaacaaaggctggaactggaaaagcctcttctcataccacaggaatcagaaggattcgaggtgcccgctcaagacctaattgcacatggtgccagttacgacgccgactaccaggggcgaaatggtcccgttaaagtgggttggcctacagcaatgaccaacagcatcgtctttcctgttcttaaggagacctttgaacacctgggcgttcattataatcgcgattccggaggaggcaggatggttgggtttacggtccatcctgatactgtggacagagaggccaatgttcgcatggacgccacgagagcgtacttctggccgtacaaatctcgcccgaacctgaaaatcatctcgaacacacaagcgaacaggatcatcaaggcaaataccacccatggcgaaatcagtgctattggagttgaggttactggtccacagggcgtgggtatgatatatgcctcaaaagaagtcatcctgtcggccggagcattaagatcaccagcacttcttgaactgtccggtgttggaagcccagacattcttcgtaagtacagcataccagtaaaggttaatctccccaccgtgggcgagaacttgcaggatcaaatgaacaacgttcttacatgggaaagcaagaattacttgaccggactggcaacattttccgccctgctctcggtcaatcagctctatgggacaaagtttctgaagtggcggcatttgtccaagccaacctagctagctacgcaaggaatatatcg

SEQ ID NO: 37031 - DNA, 810 bp, Aspergillus nidulans
cgcctcgatcagtaccatacagtcaaggttcttggcgagggctcgtttggaaaggtcaagctggcgatccatcagcccagtggccgtcaggtagccatgaagattatctctcgccgcaagctgctatcccgggacatgatcggtcgagtcgagcgggagatccaataccttcagctgctacggcaccctcatattataaaactgtatgtcgatgttcaattgggtctgggccgtgctaacgtcttaggtacactgtcatttcaaccaaaacggatattgtcatggtgctagaatatgctgaacgagagctgttcgattacctagggaagcgaggccgctgcaacgacgcggaagcccgcaagttcttccagcagatcatctgcgctgttgagtattgtcaccgccataagatcgttcaccgcgatttgaagccggaaaatctcctcattgacagggataaaaatgtgaagattgcagattttgggttaagtaatatcatgacggacggcaactttctcaaaaccagctgcggcagccccaactatgcagcgcccgaggtcatctctggcaagttgtatgccggcccggaggtcgacgtctggagctgcggagtcattttgtacgtgctgctggtaggacggctcccattcgacgacgattacatcccggcgcttttcaagaaaatcgccgcgggcaacttccacatgcccacctacatttcctccggggctgcccggctcattcggtaaatgaagcaggtgcacccagtgcaccggatcaccacttgaagacaagcgcggtcatccaggt

SEQ ID NO: 37032 - DNA, 591 bp, Aspergillus nidulans
  unsure (1)..(591): unsure at all n locations
gtccgggacgtgctgcttgctgggggagaggcagtgcgaggtgttaccaaggcggtatatgatgccgctgtagacgcggcgaggaagaactttgctgactctattggcgctccaaagattcctaatgtcagctgggaagacgttggcggattgacgaacgtcaaggatgctctagttgagaccattcagttacctttggagcggcccgaactgtttgcaaagggcatgaagaagaggagtggtatcttgttctacggtcctcctggcactggaaaaacccttctcgccaaggccatcgccacggaattctccttgaacttcttctctgtcaaggggccggaactgctcaacatgtacattggtgaatctgaggcgaatgtccgacgcgttttccagcgggcgcgcgatgcacgcccttgtgttgtcttcttcgatgaactcgactctgttgctcctaaacgagggaatcaaggcgacagtggcggtgtcatggatcgaatcgtcagtcagcttcttgcacagctcgacngtatgaacngcggataggagaacagctgcngcgtgtttgtcattggtgccaccaaccgacct

SEQ ID NO: 37033 - DNA, 2016 bp, Aspergillus nidulans
agaggatacgtttttgcttgtggtgtcggtgttgttgagatgccgtagctcggaaattgctgactgactaccatttgtaccaagggcaacgttctgctcctcatgcgtgacatcaagaagattatggactttttgtcaatcgacaagacccgtcctgcttacgtcgaggatatgatgggcgtgtggcttcgacggaagccatggttccaggaatgcagtaatattcaatattacagccgagatgcttctcccagtgggctggctcgcgcgtccgaggactttaaccggttcctgcaggtagctaccgggcagattgacagcctcagtattatcaaggagaaagagcactctttctttgcgtcgctgactctaccggatctgcgtgaagcaggcgacatcctcgaggaagtgtgtgtcggatctgacgctgtggagctacgggtcgatcttcttaaggatcccgcctcgaacaacgacattccgtctgttgactatgtcgtagagcagctctcttttctgcgaagtcgtgtcacactccctatcatcttcaccatccgtacccagagccagggcggtcgtttccccgataacgcccacgacgctgcgttggagctgtaccgtcttgcattcaggtccgggtgtgaatttgtcgatctcgagatcgctttccctgaagacatgctgcgggccgttacagagatgaagggcttctctaagatcattgcgtcgcaccacgaccccaagggcgagctttcttgggccaacatgtcctggatcaagttctacaataaagcgcttgaatatggtgacattatcaaacttgtgggtgttgcacgaaacatcgacgacaacacagccctgcggaagttcaagaactgggctgctgaagctcacgatgtccctctcatcgccataaacatgggtgaccaggggcagctgagccgcatcctcaacggcttcatgacacccgtgtctcaccctagcttgccattcaaggcagctcccggccaactctccgcaaccgagatccgcaagggcctgtctctcatgggtgaaatcaagcccaagaagttcgccatcttcggcagtcccatatcccaatcccgctccccagctctccacaacaccctatttgcccaggtcggcctcccccataactacacccgcctggagactacgaacgcccaagatgtgcaggagttcatccgctctcctgacttcggcggcgcttccgtaacaattccgctcaagctcgacatcatgccccttctcgacgaagttgccgcggaagccgagatcatcggtgctgttaacacaatcattcccgtgtcgactggcaagaacactccatcacgcctagtcggccgcaacaccgactggcagggaatgattctgtccctccgcaaagcgggtgtctacggacccaagagaaaggatcaagagcagtctgccctcgtcgtcggcggcggcggcacggcccgtgcagccatctacgccctgcacaacatgggctactctcccatctacatcgttggccgcaccccgtctaagctggaaaacatggtctctactttccccagcagctacaacatccgcatcgttgagagcccttcaagcttcgagtccgttccgcacgtcgcgattggtacaatccccgccgatcaaccaattgacccgactatgcgtgagacactgtgccacatgttcgagcgcgcgcaggaggcagacgctgaagctgtgaaggccattgagcatgcgccgcgtatcctgcttgagatggcgtacaagcctcaggtgaccgcactgatgaggctggcgtctgattcaggctggaagactattcctggtttggaggtgctagttggtcaagggtggtatcaggtttgtttccttgcttcaatcatactcattgcatgcgagctaactgaacgtagtttaaatactggactgggatctcgccgctatatgagagtgccagggcatgtagctcccccctcatttaactaaagaataacc

SEQ ID NO: 37034 - DNA, 728 bp, Aspergillus nidulans
atgggtgtcctctccgagcagatggcaaagaccgaaacatctcccgcgccgcacaagacgcctttgccgcgtcatcataccaaaaggccgtaaaggcccaaaaagcaggcctcttcagcgaagaaatccttccccttgatgtcaagtggacagaccccaagacgaacgaggagaagaccattaccgtcaaggctgatgacggcatccgcgacggcatcaccgcggagtcgctcggtaaaatccgcccggcctttgccaaggacggatccatccacgctggtaacgcgtcgcaaatctctgatggcgctgccgctgtcctgcttatgaagcgctcgaccgctgaacgtcttggccagaagatcatcggcaagttcgtctgcgctagcgttgtcggcgtcaagccgctgcttatgggcattggtccctggaaggctatccctgttgcacttcagaaggcgggcatcacgaaggacgatgtcgacatctttgagatcaacgaggccttcgcgtcgcagtgtgtgtggtgcatcaatgaacttgggctacctgaggagaagatcaaccctaagggtggtgctattgcctttggtcacccgcttggatgcacgggagcacgtcagatcagcacgttgctcacggagctgaagcgcacagacaagaaggttggcgttactagtatgtgtgttggaactggtatgggtatggctgccgtctgggttagggagtaa

SEQ ID NO: 37035 - DNA, 605 bp, Aspergillus nidulans
gtaatgtctgtcttttcgtcccttcgctactgcctcggtgacccccatgactatggcgctatctgggcggctcttggatttatgccattcgggctcttcttcgatttcatggacggcaggatcgcgaggtggaggaagaagtcgtctctcatggggcaagaactggattctctcgcggacctggtaaggcataatactttcgttggtagttaccacggctaatcgacggcatctagatttccttcggcatggctccggccgccgctgcatttgcgcttggaattcgaaccccgctcgaccacctatttctcacgttcttcgtcctctgcggcttaacgcgcctcgcccgctttaatgtcaccgctgctgtcctcccgaaagacaagacaggcaagtcgaagtacttcgagggcacgcctatccccaccacactaagcatagttgcggttatggcctactgggtgtcgcaagaatggatcttggaagacattccgcttggcgttgctgcgcagggcaccacgctggagttccacccgattgttctgctccttgttctccacgggtgcctcatggtcagcaagaccctgcatattccgaagccatga

SEQ ID NO: 37036 - DNA, 1459 bp, Aspergillus nidulans
aaagctgcgtcctcggcgtctcgccacctcgcgattctttcggaagcggaccgcaacgaagccctaacagcgttacacgcagcgctttcaaggaacaaggatgccatacttgaagcaaatgctagggatatccaggcggcaacacaggctgtcaacggcggcagtctcaatcatagtgtcttgaagaggctcgatttgtccagaccaggaaaatacgatgatatgttgcagggcattttaagtgtgaggagtttgagggatcccagtatgtttgcgtcagcactcctctcttacgtatctggttttctttatcccggggttttctgattatgttgaagttggaaatgtcacgttgagaaccctcctcgacgacggccttactcttgagaaggtcgcatgtcccatcggggtactgttgatcatttttgaggcccggcctgaggttattgcgaacattgctgcgttgtctatcaagtctggcaatgctgcaatactgaaaggtttgcttcttaagttttggtatgtagttctgaactcctgctaatattcaaaaggagggaaagaatccacggaatctttcgtaacgatcgcgaacgtgatctccgaagctatttctcacaccagggtgccgcagtcgtctattcagcttgtgaagaccagagcggctgtctccgatctactggcacaggactcgcttatcgatcttgtcatacctcgaggctccaatgacctcgttagattcgttaaagagaacacgaaaataccagttcttggtcatgcagatgggctctgctctgcatatatccattccgatgctgacccggaaattgccctcaaggttattgtggattccaaaaccgactatcccgccgcatgcaactcactagaaactttgcttgtacatcaagatgctctcaaggaagttctaccgcctcttgccaaagcacttattgcgaagggtgtcactctccggtgcgacgaatcctctaaggctgcgctcattgaaaacttgactctcaaggaagcggggatgcttcgggatgcctgcgagtctgatttcaggactgagtttcttgatcttacactagccgttaaaacaataccttccaattcgcctctcactgacgtcgaagcggcaatagcccatatcaattcgcattcttcgaaacatacggatataatcattacggaatcagaaaatattgctaatattttcatgaaaggcgttgacagtgctggggtgttctggaatgcgtccactagattcgctgacgggatgagatacgggtttggcactgaagtcggaatcagtaccaataagatacactcgagagggccagttggtttggatgggttgactatctataagtatttgattcgaggcagtggtcacagggctggtgattattttgacggcgaaggaggcagaaagtataagcatcagaacttagagctatca

SEQ ID NO: 37037 - DNA, 1102 bp, Aspergillus nidulans
gctttcctagctgggggagtagctggcgctgtatcgagaaccatcgtatcgccgctcgaacgtttgaaaattcttcttcagatccaaagtgtcgggagggaggaatacaaactatcaatctggcaggccctaaaaaagattggacgggaggaaggctggcgaggctttttgcggggaaatggcacgaactgtatacggattatcccgtactcagcggtgcagttcggcagttataatttctataaaagggtatttcctcgatatggaagtaatgtattgcagaattgacattcgcagttcgctgagccttcgcctgatgcggatttgacgccaatacgccgactcatttgtggaggggcggctgggataacctcaggtttgtataccaaccctacgaaacacattattcttactttgaccaaactaacattgcctacgcaattggcgtgaccagtcattgtaacctatccccttgatttggtccgtacaaggctgtccatacaatctgcctcttttgcggctctcaagcgtgatagcgccggcgagaagttgccgggaatgtttacgaccatggttttagtctataagaatgagggcggctttttagcgctttaccgtggtatcattccaaccgtagccggtgttgccccttatgtatgatttccaggcgtactggacaatcgtccttgagtgacatcagctgactttgcctaggttggcttgaactttatgacatacgaatcagttcgtaaatatttgactcctgaaggggactccacacccagtgctcttcgcaaattgctggccggtgccatctcaggggctgtggcacaaacatgcacctatcccttgtaagagttatcctagtttagtgcactacagagggtattgacgagtttctagcgatgtcctccgaaggcgtttccagatcaacacgatgtccaatatgggctaccaatatgcttcaatcttcgacgccgtaaaagtgattgtggccgaagagggtgtccgcggtctcttcaagggaatcgcgccgaacctccttaaagttgctcccagcatggcgagcagttggctcagctttgagctcacccgggatttt

SEQ ID NO: 37038 - DNA, 1532 bp, Aspergillus nidulans
ttcggcggcatgttgtttggcgtggaaactggaatcatcggcggtgtcctcacaatggacacgttcaaagcgtaagctgttcgtccattccgttttccctgtgactgacgcagtcgacagaaaatacgggttgaatgagttgggtgacacgggaagagctaatctttccgccaacatcgtgtcaacccttcaagctggatgtttctttggtgctctcgcagcgtcttgggtggctgataaatatggaagacggcttggcctgatcgccgcttcttttgtagcgctcgtgggagtcatcatgcaagttgcggcgagcggtcacctggaagctatgtatattggacggttagatccctgtccctcgaaaaaaaaaaataaaataaaaattgacatctaacttccaatagcctgctctgtggtataggtgtcggcttcgcgtctatggtcaatccactctatgtctcggaaaatgcccctcgagccatccgtggtggtctcacaggtctataccaactgttcattacaatgggaattatgcttgctttttggatcaattacggctccctgcttcacatctccggcgcaggtcagtacctcgtcccgctagccatgcaaggtcttccggcaatcctcctcctcgtcggcatgctcctctgcaatgaatcccctcggtggctagccaagcaagaccgctgggaagaagcacgcgcaacactatcccgcgtccgcaacctcccatcgactcacccctacgtcgagaacgaatttcaagacatcgtccgccagctcgaattcgaacgccagctcatcagcggctctagcttcgtcgacctcctcaaggaaatgtggttcatccccggaaaccgcaagcgagctctcatcagcatctggctcatgatctgccaacagatgacaggaactaatgcaatcaactactacgctccccagatctttgagaacctcggaatcaccggcagtgccaacggcctcttcgccacaggcgtgtacggcattgtcaaggtcgtcggttgcgcgtgcttcctcgtcttcgtcgctgactctcttggccgtcgccgttccctcctctggacgtccatcgcccaaggcctcgcaatgctctatatcgggttatatgttcgcattgcaccccccaaagagggtgagcccgttattcctgctggctactttgcactcgtctgcatcttcctcttcgccgcattcttccagttcggctggggccctgtttgctggatctatgtctctgagatcccgacaacgcggctccgcagtttgaatgtttcctttgctgctgccacacagtggctgttcaactttgttgttgcgcgcgctgtgcctaacatgctggctaccgtgggtgccaatggttatgggtacattttcctcatctctatacgccatatggtcactgaactaacaatctatttagggcgtatatcatatttgcttgcttctgtttctccatgtttgtcttcgtttggttcttcgtcccggagacaaaggggtgggtctca

SEQ ID NO: 37039 - DNA, 1464 bp, Aspergillus nidulans
gtccccgccgacaagtactggggcgcgcagactcagcggtaaggcatcgtcacttgagttacgcgaggaaatagagtctaagaggctgacgaatggatagttcactgggcaatttcgacatcaaccagccccaggaccgcatgcccgatgctgttgtcaaggcttttggtattctcaagggtgctgctgctaccgtcaacatgaagtttggccttggtaagctctgtctgataaaatttaggcaagaatgcgttgtttaatagcgtctagatcccaagattggtgaggctatcaagcaggctgccgctgaggtcgccgagggcaagctccttgaccacttccctctcgtcgtctggcagaccggttccggcactcagtccaacatgaactccaacgaggttatctccaaccgtgccattgagattctcggaggcaagatgggctccaagaagcccgtccaccccaacgaccacgttaacatgtccgcttcctccaatgactctttcccaaccgccatgcacattgccgccgttctagagctggagaacactctgcttcctgctcttacgagccttcgtaatgcccttcagaagaaggtggacagcttccagaacatcattaagatcggccgtacccatttgcaggatgccactcctcttacccttggccaggagttctccggatacgttgcccagctcgaccgcaacatcgagcgcgtccaagcctctctgccccacctgcgctaccttgctcagggtggtactgccgttggtactggtcttaacaccttcaagggtttcgacgaggcgattgccgctgaggtgtccaagatgactggcaccgagttcaagaccgctcccaacaagttcgaggttcttgctgctcatgatgcaatcgtcgaggcctccggctcgcttaacacccttgccggctccctgtttaagatcgcccaggacatccgttacctcggatccggcccccgctgcggtcttggtgagctcatccttcctgagaacgaacctggttcttccatcatgcctggcaaggtcaaccctacccagtgcgagtccttgaccatggtctgctctcaagtcatgggtaaccacgtcgctgctaccattggtggcatgaacggtcagttcgagctcaatgtattcaagccactcatgatccgcaaccttcttcacagtgtgcgcattctcgccgatggcatgaagagctttgagaagaacctcgttgttggtcttgaggccaacgagtccagaatcagcactctcctccacgagaggtaggttttacgtacccgccttactgtttcatgtgtgctaactttctcagtctgatgctcgttacctgcctcaaccccgtcatcggttacgacatggcttccaaggtcgccaagaacgcccacaagaagggtatcaccctcaaagagagtgccatggagctcaaggctcttagcga

SEQ ID NO: 37040 - DNA, 1217 bp, Aspergillus nidulans
ccactttataacgccgagctggcctcgcctgagatgcgtggattcttcgtgtccttttatcagttcgctactattctggtatttacagctaagtctggtcagatcagagatctcatgcttacgacatcttagggcatgatgatcgccttctgggtgggctacggtagcaatctgcacatgggcggcactggctcaacgcaatcgaatctagcctggcagctcccatcaatcattcaaggaatacctgctgcccttcttctgcttgggatctggtttctgccgttctctccgcgttggctggccaagagaggtcgagacgaagaagcaagagaaaccctcgcgtatatccgcaaccttcctgttgaccaccccatgatagacttggaacacaaagagatcaaggctgagacgcttttcgaacagcgcgcatttgctaaagcctttcccgggctggcggagaaggagaaacaaagcgtcgtcatgcgcgagctggcgcagtactggcatatcctacgcaagtgggacgcgtttaagcgcgttgcaacagcgtggcttgtcatgtttttccagcagtggtctggcattgacgctatcctctactatgcctcgaatgtgtttcaggatctgggtctcactggcggaacaaccgcactgctggcaaccggagtcactggagtcgtctttctcgtgtttaccatgcctggtatgcttcttattgacaaggccggcaggaaacccatgttgattgccgggtccgtggctatgtggatcttcatggtcatcgtcgccatcctagtcgccaagttcagacacgactggcccggtcatcccgtcgcaggttgggtggctgtagtttgcgtttggctttatgtaggcgcgttcggcgctacatggggccctgttagttggacactagtctctgaaattttccctctctcaattcgctccaagggtgcggcattcggggcatctagtaactgggtaagtcaagccaagccactcgatttactgtaatcagtcagacgctaattcaggattacctacagctcaacaacttcgccgttgcattctacacccccgaaatgttcaatatgtgggcatttggaacgtacatctggtttgcaggcttcttgactgttggtatcttctgggtctggttcttcctgcccgagaccaagggcgctacgttagaggagatggatcgagtcttcaagagc

SEQ ID NO: 37041 - DNA, 1161 bp, Aspergillus nidulans
ctcttcggctacgacagcggtatcattacctccactatctcccttcccaccttcatcgattactttagcaaccccagcagcacggttaccggtgggatcgtctcatcttttcaaggtggcgccattctggggacaatggtcaacatggccggcgccgactgggcaggccgcaaaatgaccgtccttgccggtgccattgtctccgtcctcggttgcgctctccaggctggtgctgtgaatatgacaatgctgatcatcggccgcttcattgctggcgttgcggttgggatgcttacgtccaccattccaatgtatgcggcagagctgtcggagccgaagtggcgagccacactctctgggttgctgcaatggatgcttagttggggatttctggtggcgcaatggctgggatatggatgttcgttttctaccaacgagttttcatgtataaacccccctctgtgcggccaacagattcactgactgagcctagggcggttcccgcttgccttccagaatgtgcccggcctgatcctcattgccggtatatggtttctggacgagtcgccccgttggttgatggaaaaggacaggcatgaggaagcaaaggcagttctcactcggattcggaagggcgcgtctgcagacactgtcgagctggaattccgcgagattcgcgatgtcatcgccgctgatcgtgctgtgggaaatacctcctggagaactattctcacgaagccctcctggcgccgcagactgatcctcggctgtggtgttcaagcattcgggcctctttctggaatcaacgtcatcaactagtaagctggctctatgaaatctgaaagcagaactaacaaacgcagctacggacctaggatctacagtatccttggaattgacaatcagacatccctgatgatcatcggtattagcggtgcactttcaattgtttactgctccattggtctctacctcgtcgacagagtcggtcgtgtcaagccactcttcgtttctgctctcttcctcggcgcggcccttctcgtcaacgctgtgcaagcgcagtacatggatcagaacaacgagaaccagctgcggtccatggtggcaatgaacttcgtcttcagcctattctatacgcctgtcggaatcatttcatgggta

SEQ ID NO: 37042 - DNA, 1308 bp, Aspergillus nidulans
atgtctctcaccagcaagctttccatcacagatgtggatctcaaggacaagcgtgtcctgatccgagtacgttgagcctataaacgccccctaatgacccctctaacgctgaattgtaactaggttgacttcaatgtgcccctcgacaagaacgacaacaccacaatcaccaaccctcagcgtatcgtcggtgctctgcctaccatcaagtatgccatcgataacggcgccaaggccgtcatcctcatgtcccaccttggccgtcctgatggcaagaagaaccccaagtacagcttgaagcccgttgtgcccaagctcaaggaactgctcggccgcgacgtcatctttactgaggactgcgttggcccagaggtcgaggagactgttaacaaggcctccggtggccaggtcatccttcttgagaacctgcgcttccacgccgaggaggaaggaagctctaaggatgcagacggcaacaaggtcaaggccgacaaggacgcggttgcgcagttccgtaagggattgactgctttgggtgacatttacatcagtaagtagccttcaaaccactctcttgcaactgagtccgttattgactgctatatagacgatgcctttggtaccgcccaccgtgctcacagctccatggtcggtgtcgaccttccccagaaggcctccggattcctcgtcaagaaggagctcgaatacttcgcgaaggccctcgaggagccccagcggcccttcctcgccatccttggtggctctaaggtttccgacaagatccagctaattgacaacctccttcccaaggtcaacagcctcatcattaccggaggcatggctttcaccttcaagaagactctcgagaacgtcaagattggaagcagtctcttcgatgaggccggcagcaagatcgtcggtaacatcatcgaaaaggccaagaagcacaacgtcaaggttgttcttcccgtcgactacgtcactgccgataagtttgccgccgatgcgaagactggctacgcactggatgagcagggtatccctgatggttacatgggcttagacgttggcgagaagagtgtcgagtcctacaagcagaccattgccgagtccaagactattctgtggaacggaccccccggtgtctttgagatggagcccttcgctaaggctaccaaggctactcttgacgctgctgtggcggctgttcagaacggtgctaccgtcattattggtggtggtgaactgctaccgttgccgccaagtacggcgctgaggacaagattagccacgtttctaccggtggtg

SEQ ID NO: 37043 - DNA, 1173 bp, Aspergillus nidulans
gtccagcaagtctgcattcccactgcaattctcaatgtcgacgttctctgccaggccaagtctggtcttggaaaaaccgctgttttcgtcctcaccactcttcatcaactggagcctgttcctggagagtgctccgttctagttatgtgccacactcgcgagttggcctaccagatcaagaacgaatatgctcgattcagcaagtaccttcccgacgtgaagactgctgttttctacggaggtactcccatccagaaggatatcgaggtcctgtcgaacaaggacaccttccctaacatcatcgtcggtactcccggtcgtcttaacgctctcgtccgcgacaagaagctctctctccgcaacgttaaggctttcgttctggacgagtgtgacaaaatgctcgaccaaattggtaggtcttttaaccctaattcccaaagccggtcaccgctcaccccattagatatgcgccgcgatgttcaggaaattttccgcgctactcccaccgacaagcaggttatgatgttcagtgccaccctttcgcaggacgttcgacctatctgcaagaagttcatgaggaacccgctcgaagtttacgtcgacgacgacaccaagcttactcttcacggtctgcagcaatactacatcaaactcagtgaggcagaaaagaacaggaagctgaatgagctcctcgacagcctggaattcaaccaggtcatcatcttcgtcaagagcacaatccgtgccaacgagctcgacaagttactgcgcgagtgtaacttccccagtatcgccgtgcactctggtgttagccaggaagaacggtaagtatccttgaccgcagaacacgaagtttagtactaacgacccaccagtatcaagcgctacaaagagttcaaggaattcaacaagcgtatctgtgtcgccacagacgtgttcggacgcggtatcgatattgagcggatcaaccttgccatcaattacgatctgcctgcagatgccgactcttacctgcaccgtgtaggtcgcgccggtcgtttcggtaccaagggtctttccatctccttcgtcagcactccggaggatgagcaggtcctgaaggatatcgagaagcgattcgaagtcgctcttcctgagtaccccgaagagggcgtcgactctagcacctacatg

SEQ ID NO: 37044 - DNA, 1354 bp, Aspergillus nidulans
gcctcgggatgcattgtgttcgcatcaaacatgatcgtcgcatcaggcaaggaggcgaccgaaggggaagagcgcggaatcgccatcgccgtcatcagcttcatcaccctgcttcacgtctttctgcccaactggggtgtgcggggtatgaacgtcatcggcgtcgtcaaggtcgtcctgctgctcttcatcgtcgtcaccggctgggtggttctcagcggtcggttgaacagcatccccgatccgtacgccagcttccattgttcttttgttggctccgcaacctcgagcaacctttatgccaccgcgctgttcaaggtcctgaactcatttgctgggtatgccatcgtccgttcgcgccggactttgtaccgtatatgcataactggtagtactgactgcaatccagctggtcaaatgccgcctatgtcctcaacgagatccgcaacccggtgcgcacgctcaagattgccgccccaacgggcctgggcatctgcggtgtgctctaccttctcgcaaacgtcgcatactaagccgccgctacgccggaagagatcgccaacagcgggacaactgtcgcttcgtactttatgggtaaggtatttggaaccgctgctgagcgggccttaaggtaagtcactccccgtaccttccccttgaagaataaaatctaacgagcgatagcgtcctcatcacgatatcggcctttggcaatgtcatgacggtgacgttcgcccaagcgcgcgtcaaccaaggactcgccaaagaaggggtgattcccttcccgaccttctgggcctcgtcctggcccttcggatctccctctgctggccttttgctgcacttcatcctgtccgtcattgtgattgtcgcgatcccttttggcgacgcctacaacttcatcctcgaccttgaggggtatccatcaccgatcattaaccttctcgtcgtagcggggttgttctacctccgatacagcgagccaagactcccgcgcccgttcaaggtctactggcctgtcgcggttttcttcatggctggccaggctttccaggtggtggcgccgtttatcagactgcctgaaggcaagggggatacgagtctaccgtattggctctaccccattgttgggattgcggtgttgcttgcaggcgttgtatattgggggatttggcagctgttgttgccgtggctgggcggatacaggcttgtccctgaacatcaggttctgaaggatgggacaacagtggcagtctataagagggagaataagagtgagtaggaggacacatgactagagcttcggtgaggggttattgaaaccacgtaataccacatacatagttcaatgtat

SEQ ID NO: 37045 - DNA, 2982 bp, Aspergillus nidulans
  unsure (1)..(2982): unsure at all n locations
atggagcaatcttatattctcgcgccggcggaagtgctgaagcatttcgacgtcactgaacgatctggtttatctagcgcccaggtctctcactcaagacagaaatatggtccaaatggtgagttttttgctctctgcgtaaagtaagaggctcagcttcgaatgctaacctgtcttttccgtcgctagcgctcgcggaagaaccaccaactcctctatgggagcttgtgctcgaacagtttaaggaccagctcgttcttatacttttaggctcagcagctgtttcattcgtactggctcttttcgaagagagtgacgactggactgtcttcgtcgaccctgcggtggtacgtactaggacccgaagagatcatctactccagcatccttctaacatagtttgcgctgttgcagatcttgaccatcctcatcctcaatgcgattgtcggcgtgacccaggaaagcagcgctgagaaggcaattgccgctctgcaggaatactccgcgaacgaggccaaagtggtccgggatggtgtggttcagcgcatcaaggcggaggatctggtacctgnagatatcgttcatgttgcggttggggaccgagtccccgctgattgcagactcctcgccatccacagcaacagctttcgggtagaccaagctatccttacgggcgaaagcgagagtgtagccaaagacactcgtgcggtcagtgataggcaggctgttaagcaggaccaaaccaacatcctcttctcgggtaccaccgttgttaatggaaatgccacagcggtggtggttttgactggttcatcgactgcgattggtgatattcatgaaagcatcacatcccagatttcagagccgacgccgctaaagcagaagttgaacgacttcggtgatatgctggccaaagtcattacggtgatctgcattctggtttgggtcatcaatatcgaacacttcaacgacccttctcatggcggttgggccaaaggcgccatctattacctcaagatcgcagtctcccttggagtggccgctatcccggaggggttggccgtcgtcatcaccacctgtctcgctcttgggactcgtaaaatggcccagaaaaatgccgtggtccgctcgttgccttctgttgaaactctcggaagctgcagtgtgatttgctctgataagacggggactctcaccaccaatcagatgagtgtcggaaagatcgtctacttgagccagttgggaaccggcgttgaggtcatcgatgttgaaggcacaacttttgcgcctgaaggcagcctttcatacaacggccaggtcgttacgaacctggcggcctcttcttcgaccatacgacagatggctgaggttatggctcgttgcaacgctgctgcgatcgcctatgatgagaagactggtacattctcgtgcattggcgagcccaccgagggagccttacgtgtcctcgtcgagaagattggcactgacgatgctgctatgaatgataagcttctcagcttgcccgcttcgcaaaagcttcacgtttcaagcgcctattatgaatctcgtctgcctctgcaggctacttatgagttttcccgggaccgaaaaagcatgtccgttttggtaggtactggaagtaaccggagacttcttgtcaaaggtgctcctgaatctatcctcgagcgttgcttttacgccctccttggtccgaacggtgcccgcgtgtccctgactaaagcccaccttgatcttttgtcgtctgaggtcgtggaatacgcaagccgtggtcttcgtgtgatcgccctggcaagcgtcgatgacgtcggcgcgaacccccttattcacaaggctagcacgtctgaagagtacgcgcagctagaacagaacatgaccctcattggccttgtcgccatgcttgacccgcctcgcgtggaggttgccgattcaatcaagaaatgtgcagaagccggtatccgtgtgattgtcattactggtgataaccagaacaccgcagagtccatttgtcgtgagattggtgtttttggcaaagacgaagatcttaaaggcaagagttttactgggagggagttcgacagcctctctcataatgaacaactcgaggccgtcaagagcgcatcgcttttttcacgtactgagccctctcacaaatctaagctcgttgatctcttgcaatctcttggccatgtggtcgcgatgactggtgatggcgttaacgatgcccctgctctgaagaagtccgatattgggtcgccatgggactggcactgacgtgcaaagctcgcggctgatatggttcttgtggatgacaactttgcaactatcaccactgccgttgaagagggacgatcgatctacagcaatacccagcaattcattcgataccttatctcgtccaacatcggtgaggttgtgtctatcttcctgactgccgctctcggtatgcctgaagctcttgtccctgtgcagcttctatgggtcaacctggtgaccgatggcttgcctgccactgccctgtcattcaatcccgccgaccatgatgtgatgcgacgacccccgagaaagcgcgatgagccgcttgttggcggctggctgctctttagatatctagtgatcggtacctatgtcggtgcagctacggtatttggctacgtctggtggttcctctacaacccagaaggccctcaaatttctttctggcaattggtaagccctaactacgtttttgtttgcggtcttccgctaactcggtaatagtctcacttccataaatgttccaccgagttcccagagattggctgtgaaatgttctcgaatgatatgtcgcgctctgcatccacggtctcgctatcgattcttgttgtgatcgagatgctgaacgcgaaaaaagccctctcgtccagcgaatcgctcctcacgtttggtctctggaagaatatgatgctcgactaagccatcagc

SEQ ID NO: 37046 - DNA, 662 bp, Aspergillus nidulans
gcgctcgatggcaaggttgctctcatcaccgggggtgtcaagaatctcggtgcccaaattgcgcgagagctcgctgcttccggggctaaccttgcgctccattatcattcgtccagcagccagtcagatgccgctaaggtcgaagctgagctgcagcaatctgtcaaggttgtgacctaccaaggtaacctgacctccgccgcggccgtcaccaagctgtttgaggacgtcaatcgcgattttggcaagattgatattgttgtgaacactgttggcaaggtcttgaagaaacctatcactgagatcacggaggaggaatacgatacgatgtttgcgtatgtaccttcgtcctcaatctcttcatttacctgacattggaacaggatcaactcaaagaccgcattctttgtcctgaaggaagccgccaagcacgtttccgacgatgggaagataatcaccattgtcacggctttgctgggtgcattcaccggatactatacttcatatgctggcagtaaagcgcccgtcgagcactttactcggtaagcgtccatggattccacttatgaccactactaacattctgtagtggcgtctgcaaagaactccagtcccgccgtatcagcgttaacaacatcgcccctgggccgatggatacccgt

SEQ ID NO: 37047 - DNA, 848 bp, Aspergillus nidulans
gcttgcggcccgacacacacctcagtaacgcctcttgatcttgtaaaatgtcgtcgacaagtcgatccaaaaatctacacttcaaatatctccgcatggcgctcaatcatttccaaggaaggcgtgcgcgggatcttcttcggttggtcgcctacatttatcggatactcattccagggagccggtaaatatggcttttacgagtattttaagtacttgtatggcgagcgcatgttccccaacacaaaccgcacggttatgcatctggcggcaagtgcctcagccgagtttattgccgatattgcactctgcccgttcgaagcgatcaaagtgcgcatgcagacaacattgccgccgtacgcccatagtctgcgcgaggggtggagtaagatcattgcgcaagagggcgtctccggcttttataaggggttatacccgctctgggcgaggcagattccatatacaatgaccaaattcgcgacattcgaggagacggtcagcatgatctataagacgctgggaggccccaaggaaagctacaacagccttcagcagacggggattagctttgcaggaggatatattgcgggcatcttttgtgcgattgtcagccatcctgccgatgtattggtgtccaagttgaatgccgatcgaaaaggtatgtttcccatagctggcaacgtggtgcatatgtgctgaccagattagcgggtgaatcagcaatgaaggctgtctcccgcatctatgggaacattgggttctcgggcctgtggaatggccttccagtaagaattttaatgcttggaaccctaactggtttccaatggttgatgtgagttgccttttat

SEQ ID NO: 37048 - DNA, 600 bp, Aspergillus nidulans
tttaagactttggctgcagatcctcggaatgcggtctggatcattagtggtcgcgttcagtccttcttagacgagtggatgggccagatccctgagcttggactgagcgcagagcatggttgtttcatccgaatgccacggtccgacaactggcaaaacttagcggagacaaccgacatgggctggcagaaagaagttatggagatatatcaacactttactgagcgcacgcaaggatctttcatcgagagaaagaaagtcgctctaacgtggcactaccgacgggccgacccggaatatggtgcattccaggcgcgagaatgtcggaagcagctggaagagcatgtatccaaaacctgggatgtggaagtcatggccggcaaagccaatctcgaggttcggccaaggttcgttaacaaaggctttattgcgacgcggcttgtgcaggcatacgaggacgggaaagtccctgaatttatcctgtgttccggagacgactttacagatgaaggtatgctctttccttttcttgccacccctaagcttcgccatgaattgctgctaacatatcttagatatgttccgtgccttgaagaaatt

SEQ ID NO: 37049 - DNA, 1259 bp, Aspergillus nidulans
gagaccactgaacccgtcgccgacaaggcccaactggatggtgctgcatctaaccagggtggctcggatctcgcagagccggagtacaatgtcgaggttaagctcagcgatcttcaagccgaccccaacaaccccctctattcagtgaagaatttcgaagatctgggactgtgagtcgtgcagcgccaattcattccggcaatgtccgaactaatacatctcacatagagatccgcgcatacttcaaggactgtccgctatgaacttccgcaaaccttccaaaatccaagagcgagccctacctctgttgatgggcaaccctcctaagaaccttgtcggtcaatctcagtccgggactggtaaaacagctgcatttgtcctaaacatcctcagccgcttggacctgagctccgaacaggctcagaagacgccgcaggctctgatccttgcgccaacgcgagaattggcccgtcagattgttggtgttatacaggtcatgggaaagttcctggatgggctacacattggcaccgctgttccggctgatacgaatgcgcgcccaactcggatggaagcttcggtcgttgtgggcacacctggaaccgtcatggatatgatcaaaaagcgtatcatggtggccgcgaaactcaaggtcattgtcttggacgaggcagataacatgctcgaccagcaagggttgggtgaccagtgcattcgggtgaaagcgtgagttcttgcttttccatgccagaggcgctactaaactcttgaacagcctgttgcccagggacatccaagtcgttcttttctccgctacgttccctgcccacgtacaccagtatgcttctaaattcgcccctgcggccaacgaacttactctgcagcacgaggagttgacggtggagggtatcaaacaactgtatcttgactgcgctagcgaggaggacaagtatagaactcttgtgcaactctacgggttacttaccgtcggctcgtcaatcattttcgtcaaggtgtgtttatacgccctagttatcagtcccaactaacagctttagacacgtgcatccgccgtggagattgagaggcggatggtcgccgagggccacactgtcgcttctttgaccggtggtattgagggttcacagcgtgaccagattatcgaccaattccgcgccggccatgccaaggttctcatcaccaccaacgtgctcgctcgtggtattgatgaagacacagtgtccatggtcatcaagtaa

SEQ ID NO: 37050 - DNA, 3554 bp, Aspergillus nidulans
aagttcggcaaacaaattcagcgcagacagcttgatctgccggagtacgccgccagcttcgtgaattataaggcattaaagaaggtcaacagcagtggatcctgagatcgtgtataccgcaggtgctgacgtcggacaaaccagcttatcaagcaattgagtgcaacgccgaccatccccgctcagagctctgtgcccatctctcaaaatgcttccgaagcacaggctgcactccgtgcgaacaaggaggtcttttttttccgactggtaaggcgtggtgtgaaaggtgtctgtggctcggggcttttctaagtttcgtaccaggaacgtgaaattgagaaagtcaacactttttatttgcaaaaggaggccgaggtctgtcccactgtccaggaccgctgcacagaaacctgacattaggcgacagttctcccaacggctaaaaaccttggtcgataagaagcgagtcgcccagtcacggacggtgactaaacctaaagccccggcgaatcttgtcgctctccttgaaggctttcagcaattcgatggcgacctgaataaactacaggtgagttcgtatgctgactgaatgaagtctttcttatgcatcggtgtaacatgcagcaattcgtcgaaatcaatgagacggccatgtccaagatcctcaaaaaggtttgtcgaaaggatatgttacgatctttgagagtcgattccgctaacggagtaatctagtgggataaaacatcgaaggtctatattcctcgccgtccaacttccgcgtccaatcagcttaccatacatctataatagtctcgcatgaaggaattatatctccaccgtgccgttgaagtacaaccatgtttcaatcgggatgtattgcgcgatctttctgatcgggcgaccaccgctcgtatagagcttgaagcttgggcggaaggagagaatattcaattcgacacgacccgaccgaccgaccgcacgaccacctttcaaggttttgggtccgaggaagaagaccttgaccttcaagttctacaatctgccaattcagggaatctgtatgcattacgcgaatgggcagacaaactacagaaatcgggtgattcgcgagagcgtgccacacgcacgtttctagccgcgatcagtgaatattccgacgatgtcctcgctgtcctcctcgaaactggtttagtagatattttcgccgaggatgatattaacgagcggaactgtttacatgaggcggccatatctggccgcgagttcgttcttaaagctggcctcgaggcgggtgtgcaggtatctaggaccgatgtttacggaagaatcccactacattatgcttgtatccatggccgtgtgggcatggtacaacaactgttggcaacagatcctagcactgttgacattatggatcatgacaacttcacgcctctgatacatagcattgtcaagaaccagcttgactgcgcggagcagcttctccgcaataatgctcgcatcgacccggtgtctgaatcggaccatattccgctcaacctggcatgccagcatggatcgcttccaatagtcaagatgctcttagaacgacaggctcggttactccccgatgcggaaggcctctaccctcagcacatggtggcgcgcgcatcacaatcccctgacattctattgctgctcaaacggcatggtgctgatctcaatcagagagacaagttgtaccagtggactccactttttcacgcagctagcgaaggctgcgtaaactgcctgcggacacttctggagctgggcgtggatgcagatgtcaaggacgagaagggtctagcggcggtgtattacgctgcgtgggagggtcatttggaatgcatgctgctgctctggtctcatcatacagagtcacagccatcgcagcggccattagatatcttgaacggcttaaggctccatgagccgagttccactattgcctggcaagagcatactccggcagaagcacaagacatggagacggtagatgggattccggatctatctctccctccgccaatcatcccgttgcgacgctatgggcataatttcctcgacaagaaggttttcgtacaaatattattcgaccccggtagctccatttcgtttgatcaagctgggcgctaccctgctgctcgattgaccatatcttcgaagttatccgaactaataccgcgaactgtgatgcttcccattcaggaagacgcccggatgatctcctttcatgtcgacaccttgcaaacattcaccgttgactttgagattttccctacttttggctccaaggtgatcgcaaaaacagttgccctcccgacagtgttcggggcggaggagtccagcgctggctcatgttgtttaccccttttcgacccccggttacgtgccattggacagcttcgtttctggttccaagtcatcaagccgtaccacggagatcctcttgaaatcacgcatttcgcaacttactggaaggccacaagcactggcgaatctgaccacagcggcttagtcactgggtcgagcttgtcgggagatcatgtccagctttttgtacagctcacaagagacaaagtcccagtagtgcacccacagtacatggtgaaacactatggcatcgatatacccatctgccatctcaccttctctgaattccaagctgttggcggtgagaagaatgtgaaccgaccagaattactccaattcttgcaggctcatgctgccgatgatctggccctgacccatcgagtgctcgcggcgtcattcttatcattgcgtgaggtcttcgagaatctcccagttgacgtaaatgtcaatatctctgttctctatccatcagctgctgaggagcaagcattgaagatgacgtctatgacagatgtcaatacgttcgctgacgccatattgacggttgtttttgaccatgcacgcgtcgcacgggataagaatccagaattcatgcgttctgtcgttttcacatcttataacgccaacatatgcgttgctctgaattggaaacagccaaactgtaagcagccagtccccgtaaacctctcaccaatcactaataatcagaccccgttctcctttgcaatgaccttggccagattcgtgacttggcccgcaatgccggcactcacccagacgttgacagcagcggtcgagcatcaatgtccataaaggaatcggcccgcgtagcacagagcaacaattttatgggcctgatatgccgttctagtcttttggtatgcttacacaaacttccgttaattcttgaccgccacagatactaatggaggctgctctagaatgttgtgccagctctggtagcaactatgaaggaacttggacttgtacttgtagccgacacctccgacgaagccgaacaaccggaaactcaagctttgtcagctgcaggctctatgggcgtggctgaactggcataccgcatgcccgaaggtgtaaatggcttgatgaaagccaatggcatactgaggttcaatgacatgattgacatgtgatgcaac

SEQ ID NO: 37051 - DNA, 747 bp, Aspergillus nidulans
caatactgacagctctctttcaatgtgcagcaagaatggaacaacacaacccttcgccccgtaacaatcaaacaaatcctcgacgcaacgcagccctacccggaagcaaacttcacaatcgacggacaagacgtatccagcatcgtcttcataggccaagtccgcaacatcagcacacaagccacaaatgtcacatacaaacttgacgacggcacgggcgaggttgaagcgaagcagtggataaatccgtccgaggcgatggacacgaccgaagatttcggcaaggaagggaaggacctgaatggtgtggagatcaacggctatgcgaaggtattcgggaagctgaagagtttatttggagaccgcaaggtcgttaacacgcattgcgtgcggccgttaacggatatcaatgaactgcatgttcactttttggaggccgccgcggtgcacttgtttcatactagaggcgctccagggcccgctgcaggtgctaccgggaaaatcgatggtggtgatgcggcgatgggagggcttgatggggccggggttggtggcggtggtgggttcccggcgaatatgtctgcaactgcaaggagggtttataacctgctcaggacggagccgcagaataatgagggcctgcatgcgcaattcattgcggcgaagctgggccttcctccgcaagacgttgtgcgtgcaggtgatgagctgatcaatgctggcatggtgttctcgaccgtggacgat

SEQ ID NO: 37052 - DNA, 1303 bp, Aspergillus nidulans
atggcgctcgacaactactaccgcaacaagatcgagagcatgaagctcgagattattcaagggcaagctgtactacgacgacttgaagcgcaacgcaatgattataactcgcgggtgcgcctactgcgagaggaactaggcctacttcaacagcctggctcttacgttggagaggtggtgaaagtcatgagcacaaagaaagtcttggtgaaagtacatccagagggaaaatatggtaagccacccttttgctttcctccaaactctctagcttggtggcttggtgctaactaagtccaacagttgttgacatcgcggatggcgttgacattggcaagctgaccgtcggcaagcgtgttgccctgctctcagattcatacaaactggaaaagatgctcccgtcatctgtggacccgctggttttgctcatgatggtcgaaaaggttcccgacagtacatatgatatgattggtggcctcgaccagcaaattaaggaaatcaaggaggtcattgaacttggcttgaaacaccccgagttgttcgagtctctgggaattgcacaaccgaagggagttcttctttacggcccccccggcaccggaaagaccctcctcgctcgagcggtggctcatcatacggactgcaggtttatccgtgttagcggatcagagcttgtacagaaatatattggtgaaggtagccgtatggtccgtgaattattcgtcatggcccgagagcatgcgcctagcatcattttcatggacgaaatcgacagcattgggtccagccggatagactccgcgggctcgggtgactcagaagttcaacgtaccatgctggagcttctcaatcagttagacgggttcgaaccgacgaaaaacattaagatcattatggctacaaatcgactcgatattctggaccctgcattactgcgccccggaagaattgatcgcaagatcgagtttccacctccatcgtaaggctatacctttgtcgtatgagaaatgctgttactaactgtcctcttacccacaacagtgtggaagctcgtgcggatatcctacggatccattctcggtcgatgaacttgacgcgtgggatcaatcttacgaagatcgccgagaagatgaacggatgctcgggagccgaactgaagggtgtatgtacggaagccgggatgtacgcccttcgagagcggcgagtacatgttactcaagaggactttgacttggccacggccaagattctcaacaaacatgacgacaaggaggtagctgtgtcgaagttgttcaagtagatg

SEQ ID NO: 37053 - DNA, 1266 bp, Aspergillus nidulans
tcacagatcctgttccactttgctgggcttgacgcgccgtctgggcgtctttcccaaaaggatttctccaaggtcattgatgcctcatggcgcattcctgttgccgccgccgagcaggctattaccactgcttccggtgctgcgcacaaggccgctgatgccgggaaatccatgcttcacggtgtcttggagtctgtccaccatttcgctcttggcagtttggctggtgcttttggcgcgttcatggtctaccccattgaccttgtcaagacgcgtatgcagaaccagcgatccagccgtgttggtgagagactgtacaataactcgattgactgcgcgcgcaaggtcatccggaacgagggtttcaccggtctgtactcgggtgttattcctcagctgatcggtgttgctccggagaaggcgatcaagctcaccgtcaacgatctcgtccgtggatatttcgctggcaagcagaacggcaagctcaagacctggcaggaggttctcgctggtggttccgcgggcgcttgccaagttgtacgtatacattccttatgcttccagacttaagcgtactaactgtatccataggtcttcactaacccccttgagatcgtcaagattcgccttcaagtccaaggtgaaattgcgaaaaacgccggcgtggaaggtgctgcgcctcgccgctccgccctctggattgtcaggaacctcggtctcgtcggcctttacaagggcgccagtgcctgtctcctccgtgacgtccccttctccgccatctactttcccacctactcgcatctgaaatccgacttcttcggcgagtcccgcacacacaagctcggcgtggtgcagctgctaactgctggcgctattgctggtatgcccgccgcgtacctgacgacaccctgtgacgtaatcaagacccggctgcaggtcgaagcgcgcaagggcgaaaaggcatacaccggtctccgccatgccgctgtcacaatatttagggacgagggtttcaaggcgttcttcaagggcggaccatctcgtatcttgcgttcgtcgccgcaatttggcttcacgctcgctgcgtacgaggttctgcagaagtggctgcctatgccggggtctgaacatgatgtttcaccgacgggtcaggtggagcctggtgtgggcgttccagttgccaaggagccgctgccttatctgaggagcagaaatgcgctcaagcttattctggatctcgacgagaatattggccgcctgccgatc

SEQ ID NO: 37054 - DNA, 3857 bp, Aspergillus nidulans
ttcgtatccatccacgttgaccctcctcttcggcccgaaatttatcaggacccggatgaagaggtgcaagacaagattttgttcgtgctgaataatgtatcggagcaaaatattgacgaaaaactgcgggatctgacagacgtcctcaaagacccccatcatcaatggttcgcctcctatttggtggaggaacgcgctaagctgcagccgaatttccagcagttgtatcttgaccttttggaccgcattgatgacaaaatactttgggttgaagttctccgagagacatacgctagcacgtcaaagcttcttaattcggaagcaactctgggatcctccaccgaaaggggccatcttaaaaatcttggttcatggcttggatctttgactatcgctaaggataagccgatcaaacacaagcatatctggttcaaggggcttctattagaagcttacgatagccaacgactgacgattgtgattccttttacctgcaaagtgcttgttcaggctacaaagtccaccgttttcaaaccaccaaatccttggctaatggacatcatcgccctgctaatggagctctaccacttcgcagagttgaagctgaatctcaaattcgagattgaggttctgtgcaaggacctagaaatcgaccacaaggctatcgagccttctgttatcattcgtgaccgttcaacgaccattgaagagtcgttgtcaacagccaatatcccagaaggcctcgaagcttttgaggatatggctcttaccagcattagccagagcatccgcaatgagagactctcccctgctgctatcctgtcgacacttcctagtttggataagatcttggtcctaccgccatcggcaagcagtatggtggattcgaatgttcttaggcagattgttcactccgccgtggaacgcgcgattgctgagatcattactcctgtcgttgagcggtctgtcaccattgcctcaatctccactgttcagttggtttccaaagattttgccatggagcttgatgaggagaaattccgacacgcggctgccaatatggttagacaacttgcgggtagcttggccctagtaacctgcaaggagcccctgaaagtcagcatgaccaactatattcgaatgatccagcaagaatattcagatcaacctatgccggagggacttattcttatgtgcgtcaatgacaacctcgacgctgcttgtggcatcgttgagaaggcagctgaagaaaagtcacttcctgaaattgagaaagtcattgaatctcagctggaagctcgtcggcgccaccgggcagcccgcccaagcgaaccctttattgatccgtctatgacccgctggggtctctttatccctgaaccttaccggcagactccaggtggtctaaacaaggagcaactagcaatatatgaggaatttgcccgtcaggctcgtggtccaggaaccacccacgctcagaatgtctctactgattctggtcggcaattgccggacgttctccaagaaccatatcccccaatcccgaatctttccacccctgcagagcagcctgctgtgcctcacagaacgccgcagccgcagcaagatacccgactgcaacagtccgccctggttggaacttcctctcaactcaacggcttccttgaaacgcagaatccgcgtgacagagtggagagtctcgtctccgatcttcagcaagcggcacgcaacgctaccgaagagcacgtgaaaagatctcggacgcgacagtgctgttcttcaagaatagcaaccaagcattgcgatccattgtagcatcgccaaatggcgaggaggtggcccgactgacagcactcaaggcatgcacaagcctttactcacagactaaaagcactttagagattgaagtacttgtgcacctgctggccaagttgtgtgacatgtctgccttggttgctcgctatacctggactgtcttggccgaagtcgatgatgagcatatgttcaacgtccctgtcaccgtggctcttatagatgccggacttttggatattcgtcgtgttgacatgatcttgtcgaggcttatcctccagaagaacgctgctgcattggacgtcttagccgaactaatggaccaaattctatttaacgaggagccgtccgctctaaggtctgatttctctggcagccttgaagcgatgagcaaatggcttgccgaagattcaggtcttgcccgggccaaagaaatcatcaagaagctacgggactctggaattcccgaggtcgtgaacccgctactctcggacaaggctcgatcgaaacgagatcagatggagtatatcttcactgaatggattggtatctataaggcgccgggcgctgttgatcgtacatactatgctttcttgaaagatatgcaccagagacaggtgatggccaaccaagaggattctgcgctcttcttccgtcttagcatcgatatctcggttgcacgatttgaacacgagtcccagaacccgagcggtagcttggacgaggcgttcctctatatcgacgctcttgctaagttggtcgtcttactagtcaagttccagggcgagggcaccggtcccgtgaagaccagcaaatcggcgtacttcaattcaatcctgtccgttctgcttcttgtcctgaatcatcatcaggtaatgagaggtgaagcattcaaccagcgggttttcttcaggcttttctcaagcatactctgtgaatactccatgagcggtctgcagcacagcgaccagcaccaagagatgatgttcaccttggccaacaaactgctgtctcttcaacccaagtactacccatcgtttgtttacggatggttctcattggtttctcatcggttcttcatgtccagcatgctcaacatgccggaccgagcaggctggggaccatactgtgaaatcatgcaagttcagctgtcctacattggcgagcagttgaagtcaacgaccatgactcttgttacaatggatttatacaggggcatgcttcgcattctgttgatcctccatcatgacttccctgagttcgttgctgaaaatcactttcagttctgcaacgttatccctgcccattgcgcgcagcttcgcaatttggtcttgagcgcttacccttcctcgttccagaaacttcctgatccattccgcgaaggtctgaaagtcgaacgcttggaggaaatgcgagaggcaccaagaatagcaggtgatactgccggcccattgctacgtgccggtatcaagaacgtcattgataatgcactccagagcaacaatgtgtccgactcagttatccagcaaatccgtgacgctgtctatgatacggaaagcaaggaatcaggtctctttcacgctccaatcaatatcaacttactgcttgtcaacgcactggcactttatgttggccagggggcagtctctgtaaatgaatcaaagggaaatactcgagcagcatttgagagttctgcccactcagcactgctagagaagctcgtttagatcctgcggcctgaagcccgctattaccttctgagcgcaatggcaaaccaactccgctaccctaacagccatacctacttcttcagttttgcgatcctgcgccttttcggtacagattacacggagcaggatgagtcggatattcgccagcagataatccgcgtgctcctggaacgacttattgttcaccgtcctcatccatggggactaatcattacccttcaggagttgctacaaaatagtagctatgcattcttccatcttccttttattcaggctgcgcctgaggtaagtcactaggtccctacactatcaggt

SEQ ID NO: 37055 - DNA, 1368 bp, Aspergillus nidulans
ggagcagcgtggataaatgatgtgaatcagagcagggtctatgcgctggctaagagattcggcgtcgagattttggagcagaatacaaccggactgtgcgtgctacaagacgtcgacggagactgttcaacattcgaatacggggaactgccaaaggtatttgttctttcatcgagcagcgagaggtatgaactaacgtggtttagttcgacgctgccactctccaagatatcgcccggatccgcgatatggtcgaagcagactgccactctcgatccagttcgtcctcgaaacacagagtgggatcccgatgacttttgaggcctatctttggtcccgcagtgctggcaaggagactctcgcgacgtccgctgtctggatccgtgccatgctggggcaggatctacgcgacatctctgctctctggttcattgcatactgcaaagctggcggtggtttactccagatgcgatctgacagaaagggtggaggacaacaccttcgaatccggcagggaatgcagatgatttccaaagtaattgctgagactcttcctcaggatgtcgtttgtctcgcccgtggtcagcgtcactcaagggcgcaatcccggggttgaggtcgtgcggcagacaaaaagacactgcaagcgtgcaaagctattatcaccgttcccagtcctgtcctcaagatgatggacttctcccccaagctccccgcgctgaagcagctgtgggccgagtcctccaattacggctactacacaaagccatgatgattttccgcactccattctgggtagagaagggctactgcggtcttatccagtccttcgccagcccggcgtctgtgatacgccacaccagcagtctcccagacaagaaatatatcctcacgtgcttcatggcctctgatttgggccgtgcctgggctgcactgcctacggatggtcgcaaagcagcactcattaaacaaatcgggaaactgtttgacgccaaaaccgaagccgctggtcatttggtagacctggtgatttacgaatgggtgaatgacccgtactctggatggggatgtccctgtattgcgctgacccctggggtgatggatgctgtcggagagaccattcgagagccagcagggaatttgcatttcgctgggaccgaggcggcggttaggtggaggggatatatggaaggagctatagagagtggtgagcgggcagcggcagaggtgatacagaagctaaacgctgcctctgcgcggttatagatgagtatttaatacatcttcaaggtgaagccatggatagatcgccttgaaccgcaaagctgcaaccctgatacatatcccttttctaggacattcccatgt

SEQ ID NO: 37056 - DNA, 2557 bp, Aspergillus nidulans
aaggaggctgccgggtatcaggcgaaactggatagtattagcgcggatgagggcgctcaagctgctcttgagtctaatgccgaggacattcactcccggctggaccaggctaaagagcgtgaacgatccgcctcccgggacaaacagattgaagatataaactcacaaattcgcgaactcgaagacgaaaattctcgcctaaatgctgagttgatcgaagcaaccaagaaagctggagacctggctcgcttggatcacctaaagaaggaactgaaagatcgagagcgaagcttggaaacaatgaagagtgctcacggtgagcgcctttccaagtttgttaaccccaactggaagatcgacaccttagagcaagactttcagcgcactctagaagataaatccaacgcggtaatcatggctgaacgtgcaaaggacagccttagccgcgagcttgagcaggtggaatacaagttgaaagatgttgaaaaatccctgacgcaaaggcaaaaagagctcaaggaatgtgttgaggagatacgcgaagccattgacgatgaagcccggagaatatcccgacgttgtcagccaacggcagaatcagctggacatggcgaagagtactgctgagcaaggggccggtatcgaagagtacatgagccgatgcctagcggccgcgaaagaggacaaaatctgtcgagtgtgcgctcggtctttcaagaccgataacgatttgaggacttttttcaataggctcgaaggtctaatcaagagagcaaagctgcaagcacaagctgaagacgtcgagcaattggaacaggatctcaatgtcgcccgtgccgctagcactgcctatgatacttggaagcgtctcaaagagactgagattccagagttgcagcaggaagacgaaaaatacactctagagcgtgatgagcttctgggccagctggaggaccgcgacaaagccgtcagtgagatggtcgagaagaaacgcgatattgaagctctgtccaaaacggtcagcactattgtcaggtacgatagtgacatcaaatcgactcgcgcacagatacaagatctttcctccaagcagcagcaaaatacagcggctcctcgtacgctcgaggatatccaagatgagatagctagcatcggcgagaaaaccagagctctcaaaaagactctgtcaaagcttacaaatgagagggagcatgcgcgtgcagaaattaacagcctggaactgcagctcagggacgtgaaaagcaatctcgacaatgtcaagtttcagctcgaaaggaaagctgatctcctttctcgcatagaagagtataagactcttaataatcagcaacgggaagcaattgccaaagcggacagagatatcgaggatctgaatccagagctcctgaagtatcaagccatatatgacgatatcagtcaacgggccgaggcgcgcgagagagagctgcaacaaataatctcccaactgtctgacagcatacaccaggtagagctcgcaagcgaagagattgacgcatacaatgagcgaggtggcccacatcaacttgatcggagtaaacgcgagctcaagtccatcgaaaatgagattagtcaactcgaaactgaacaggcagccctcaccaggacgatcaacaagatctccacacagctcaaggacagtgagaacacaaagcgtcagtatgcggataatctcacatatcgccaatcagtgcgagccttcgataaggtcacaagcgagatcagggaattggagagtaagaacgcagaggtcgacaggagccgattcaaggaagagtctgaacgccggtcccgcgagcataacgcactatctgcaaagcaatctagcaagatgggagaaatgaaatccaaagacgatcagctgatgcagctaataaaagactgggacacggactacaaggacgcagcctacaaatataaggaagcacacatcaaagtcgaaaccaccaaagccgccgttgaagatctagctcgttatggcactgccctcgacaaagcgatcatgaaatatcacggcttgaaaatggaagaaatcaacgccatcatcggcgagctctggcaaaagacttatcgcggtacagacgttgacaccatcctcatccgctccgacaacgaaaacgcccgcggcaaccgctcctacaactaccgcgtctgcatggtcaaacaaggcgcggagatggacatgcgaggccgctgcagcgctggccaaaaggtcctcgccagtatcattatccgactcgcgttggccgaatgcttcggtgtcaactgcgggttgattgcgctagacgagccaacgacgaacctcgatcgagacaatattcggtctttggcagagtcgctgcatgatattattcgggcgaggcagcagcaggcaaatttccaacttattgtcattacccacgacgaggagtttttgaggtatatgcagtgtggggactttagtgattactactacagggtttcgcgcaacgagaggcaaaaatcaattatcgagaggcaatctattgctgaggtgtgt

SEQ ID NO: 37057 - DNA, 391 bp, Aspergillus nidulans
ggcattcgcatcaaggccaagtccggcgagaccggtgagatcaagggcgtcacctactctggtatcagcctcgagtccatatccgagtaggctccccttccagcccagttctgaatccagctctaacctcgtccagttatggtatcctcattgaacaaaactatgacggcggtgatctcgacggcgaggtgacctcgggcatccccattaccgacctcaccattgagaacatctccggctccgcgccgttgactcagatggatacaacattgtcatcgtctgcggtgacgacgcctgctccaactggacctggtccgacgtcgaggttaccggtggtgaggattacggcagctgtgagaacgtccccagtgttgcatcttgcagcacctaa

SEQ ID NO: 37058 - DNA, 665 bp, Aspergillus nidulans
aaactccggctttctgatagcatggcaatcaacttcaaagacggcgtcatcctaggtgcggacagtcgaacaacgactggagcttacatcgccaatcgagtcaccgataaattgacgcaagtaaatgataccatttggtgctgccgatctggctccgccgcagatacacaggccgtggcggacattgtctcctaccacctgaatatgtactccatcgtcaataacgagccgcccagcacacaggttgcagccgcgctgttccaggagctatgctatgagaacaaggacatgctaaggtatgccattcttgtgccatctcagaatgcattgtttgattaacttgcgcatcaagtgccggaataatcatcgcgggctacgatccccggcacggcggccaagtgtattcgataccgctgggtggatcgctgcacaagcaggcatactccatcggcgggtccgggtcgacttacatctacggttactgtgacgcgaactggaaagagaacatgactgaagaagagggtgttgagtttgtcagaggggcactgcgggaggcaatcaagtgggatggcagctcgggcggcgtgatcaggatggtagtcttgacgaagaatggagcgcaacgacacctgtatctgccggacaacggctacactgcacccgga

SEQ ID NO: 37059 - DNA, 1044 bp, Aspergillus nidulans
gatgaggtccgtatccagattgcctactgcggcatctgcggctctgacatccacgagtaccttggcggccccgtcttctcgcctcccccgggcaagaagaacccgtatactggcgccgaactcccagtgacgctgggccacgaaattagtggaacgatcgtcgagctcggctcgtcagtgccagcgtccgatccaaatctcaagctcggcatgagagtagccgtaaacccagccatgaatgatcgacaccatggggtagagaaatgcaccgcatgccaactggggttgcccaatatctgcaagcggtatacatcgtacgggttcagtgccgcagggggcgggctcgcgagcgaaatcgttgtcaagcattatgcctgcattccgctccctgattcaatctcgttgaaggtgggcgcgctcctggagccgctcgcggtggcgtggcactgtattcggatttctgggtttcaaagggaccagacggttctcatactcggtgccgggcctatcggcctagcgattctgatgattctaagggtctggggggtcaagacggtcgttatcagtgaggtggcggcgtcacgaaagcggatggcgagggagctgggcgctgatctggtgctcgacccaactgagttggggagctctaaggatggactggatccagtggtcgtggctacgcaaaaggccatgaaggcagacggggccgacgtgacattcgactgtacggggctgcaatccactctggacacggccattgctgcgaccagaccagggggcactgtcttcaacgtcgccatccatgaaaagcccctgatggtgaatctcaacgagctgactctgggcgagaggcgcctgactggtggaatctgctacacggacgttgatttccaggagctcattgctgctctggaagcagggaagattcaggccgagaggctgattacatcgatcgtggatttagacgacgttattgacaaggcgctgatggagttgatccataacaaggctgcgcatgtcaagatcttggtcaagccaaaccat

SEQ ID NO: 37060 - DNA, 704 bp, Aspergillus nidulans
gaactatataactctgtgctggtcgaaactccgctggctggctttttcaagggcagcctaagccaccaggacttggacgaactcaacattgagattgtgcggaacacactgtacaagaactacctggaagacttctacaaatttgtcaccacacatccagacttcaagggaacgccaacacaagaagtaatggcggaaattcttgaattcgaggcggatcgacgtgctattaacatcacactgaactctttcggcacggagctctctaagcctgagcggaggaagctctaccccgaattcggcaaattatatcccgaagggtcactgatgctttctcgggccgacgatattgaagctgtctcgctggccgtcagtatatccgcggactacaaggcattcttcgatgccgtcggtctcacccaaggcggaggtggtcttggcggcatgggtggctctgatggaaagagcctggaggatttattctatcaaaaggaaatggagatgagcaagctcgttttcacccgacagtttactcctgctatagtatacgcctggatgcggctaaaggaacaggtgagggatccagctattctagaagcttgcttaactaacaagttcaggaaattcgcaatgtcacctggatctctgagtgtattgcccaaaaccagaaggagagaatcggaaatttcatatccgtcttctga

SEQ ID NO: 37061 - DNA, 924 bp, Aspergillus nidulans
gatatgtcgtcgtccgatggcgctccggagtcatggatctcctcgttttgccagcttatgggtcacgagtttttcgcggaggtctcggaagattttattgaagacgactttaatctgaccgggctgcagtctcaggtgccgatgtacaaggaagccttggaaatgatactggacgtggagcctgaagaggatgaagaggaggaggaagaggaggaagaggaggaagatgaggatgagatacttggtgatgagaagccgcccggttaccgaagagagcgaagacacacaagggttgcaagcgacctgagtatgatcgagacctctgcagagctgctttacggtttgatccaccaacggtacatcacttcacgtcccggtatccagcagatgctagagaagtacgagttgcaacatttcggagtctgcccgcgagtgcactgcaatgggtgcaaagtgcttcctgtgggccgttccgacacgccaggccaagagaccgtgaagctcttctgtcctagctgccaggacctgtatacgcctcccaacagccgatttcactcggtcgatggtgctttcttcggcaccacattcggctgtttgttcttcatgacgttccccgatttggagattggaccccgttttgatgcgcccttgtcaaacatatcaccaccgcgctcagcctctttgccttcgactgccacgacgaccacgaccacgacaactacttcagcgggcgctagcaatcaagttacatctgatacaccccgtcctgtataccccgtagagctcaatggcgtgcggacggtcaacttctgccctggcctcggagaaggtagggtatacgaatcgcgcatctacggttttcgagtttcagagcggtctcgggctggcccgcgtatgaagtggttacgaatgaagccagcagat

SEQ ID NO: 37062 - DNA, 945 bp, Aspergillus nidulans
cagactcgcatgcaagtcttgcatcccaccaccggaggtctctatacagggttgacgcatgcggtttccacaatttaccgaattgaagggtggcggacactgtggaagggcgtatcgagcgtgattgtcggtgctggtaagcagacgaggccaaggtcgatacgattggcgcatcctacgggctaacttttgggctctactttttaggccccgcgcatgctgtctatttcggtacatatgaggttgttaaggagatggctggtggtaatgtggatgatggacaccatccattggcggccggtaagactgtaacttacaactttacggagaaaatgctgactatttcaagcaatgagtggtgcggcggcgacaattgctagcgatgccctgatgaaccctttcgatggtgagttttgacaacgcgtgcgactattaaaaagagagctttttctcacataagcagtaatcaaacaacgaatgcaggtacacggctccatacacaaaaccatcttccagtgcgccaagtctgtctacaagactgaaggtttccatgctttctacgtctcctatcccacgaccctctgcatgacggttccctttacagctactcagtttgtcgcctacgaatccatctccaaggttatgaacccgtctggggattacgatcccttcacgcattgcattgctggtggtcttgctggtgctgttgcggctggtatcactacgccgcttgacgtggtgaagactctactgcagacccgtggcctcgcgcagaatgaggagattcgcgcggtcaagggactattcggcgccgcgaccgtcatcaagcgccaattcggttggagaggattcttgcgcggtgctcgcccccggatcatctccacgatgcccagcactgccatttgctggacttcgtacgaaatggccaaggcttatttcaagcgc

SEQ ID NO: 37063 - DNA, 506 bp, Aspergillus nidulans
aaggaactcgccgagctcacagagtctcctccagcgggcataacagtcgaactcgcgaacgaatccaacctctatgaatggaaggtgttcatggatggtcccgagggttctccctaccacgtaagttgcacctctttccctcagccaaccctgcagcgattcaagaacggccaaagtgaccttatgttcatatagaaaggccgtttcgaactaaagctcaccctccccaccgagtaccccttcaagccaccaagcgtctcgttcgtcacgaaaatttatcaccccaatgtaacgaacgacgacaaaggtagtatgtgtctgggaatgctgaaagcagatgagtggaagccttcctccagactttccgccgtcctggagtttgcgcgctcgttgctcggcgagccgatgccggatgatgctgtcgagggacgcattgcggagcaatatcgtgaggaccgaagcgatatgaagagattgcaagggagtggacgaggaagtacgctggt

SEQ ID NO: 37064 - DNA, 642 bp, Aspergillus nidulans
cgtggacacacagattgggtcaatgcagtcagagtcgacacttcctctcgaactgtcttctcagcatctgatgactgtactgttcgcctttgggacttggacacgaaaacctgcattcggactttccatggacacgtgggtcaagtgcagcaggttgttcctctgccccgcgaatttgagttcgaagaacatgatgccgagtgcgagaacgacgatctcagtaccacctccggcgacgccgacccgccgtcaatccaggcttcgatgggtttggaacccaacgcagcgtacagccaatcctcggcctttgggacttcgttcgataacggccgtgccgcgccgccacgatacatggttacaagtgcgctggattctacgatccgcctctgggaaaccaccaccggccgctgcttgcgtacgttcttcggccacttggagggagtatgggcgctgggagccgacactctccgcatcgtctctggcgctgaagaccgtatgatcaagatctgggaccccagaactggtaaatgcgagcgtactttcaccggccactctggccctgtcacttgcattggccttggtgacagtcgattcgctactggcagcgaggactgcgaagtacggatgtacagctttcagagt

SEQ ID NO: 37065 - DNA, 1127 bp, Aspergillus nidulans
tcaatgagtatttacagttttctcatcgctgtacgctccgaaggccagcagctcatgagcgataccggcgagaccacgtcacatctcatggggatgttttaccggacgctacgcatggtggataatgggatcaagcctctatatgtttttgatggagctccaccgaaactcaaatcgggcgaactagccaagcggagcgctaggaaacacgaagccactgaagcgcatgaagaagcgaaggagacgggcacggcggaagatgttgagaagttctcgcgacggactgtgcgagtaacgagggagcacaatgcggagtgcaaaaaactcttgaagttgatggggattccgtacatcgatgctcctaccgaggcagaggcgcaatgtgctgtgctggctcgcgcgggcaaagtctatgccgcagcatcggaagatatggatacgttatgcttcgaggcgccgatcctgctgaggcatctgactttcagtgagcagaggaaagagcctattcaagagattcatttgaaccgtgctctggagggactgggcatggatcgaaaccaggtaatttcttcccacgcaggttggcgcgttgaatgcttacttctggacgtgctacatagtttattgatctctgcattctacttggatgtgactatctggagcccattcccaaagtagggcccaataccgctctaaaactgatccgcgaccacggtaccctggaaaaggtggttgagtccatcgagaaagatcctaagcagaaatatgtcattccggaatcttggccgtatcaggatgccagagaactcttcctgaacccagatgtccgagatgccaacgaccccgaatgcgacttcaagtgggaggcgccggacatcgaaggccttgtagattttctggtgaaggataagggattcaatgaagaccgggtgcgcaacggtgctgcccgattacagaagaacttgaaaaccgcacagcagtcgcgtttggaaggattttttaagccggttgctaagacagacgcggagaaagcaaccctgaagcgcaacgacgacgagaaaatccaagaacagaagaagcgcaagaaagaggaggctaaggcgaaaaaggaagcgaaggctcgacca

SEQ ID NO: 37066 - DNA, 709 bp, Aspergillus nidulans
aaacaacgcaagatagctattgtcggcagtcgctccgtgggtaagtgttgcgcgcaaaggtcaccgcactcataactgacactaatcacaaaaggcaaatcctcacttacggttcggtttgttgaacatcattttgtggagagttattacccgacgattgagaacaccttcagtcaaatcatcaaatacaacggtcaggattatgcaacagagatagttgatacagccggtcaagtgaggacttatcgctgcgcgcattcatcgcaaacgctaaccctgagcaccaggatgagtacagtatattgaactcaaaacatttcatcgggattcatggatatattattgcctattccgtggcgtcccgccaatcttttgatatggtaagggtcatcagggacaagatactgaatcatctcgtaagttttccatgtttacaatcaatgctttcttgcactgaagcattattgtagggagcggactatgttcccctggtcgttgtggggaataagagtgacctcaagcctgaacagcgccaagtttccttagacgaaggccgacagttaggtgaagagtttcgctgtgcatttacggaagctagtgctcgtcttgatttcaacgttgcgagactttcgagttgatgattggggaaattgaaaaatcccagaatccatctcaaccaactggtggtaacaaatgtgctttaatgtga

SEQ ID NO: 37067 - DNA, 414 bp, Aspergillus nidulans
ttagggaagatgcagacgagagttgacgattcaccacagctctccgacgtcgaaaaatcctccaaaggtcacgcagcttcgctcggcgcctccctgcaaacatttcagtcaaaccatgaaggtgccattgttgaccgaatccatgccgctcgcgggaacaccgacgcgatcatcatcaaccccggtgcatatacacacacctctgtcgctattcgggatgccctgttaggagttgagattcccttcatcgaactccatgtgagcaatgtccatgcacgagagccgttcagacatcacagttactttagcgacaaagcgtcaggcatcattgtgggactgggtgtgtatgggtacaaggtcgcagtggagcatgttgcgttgaacttcaagcctctggagaaaaaggctgctctt

SEQ ID NO: 37068 - DNA, 1415 bp, Aspergillus nidulans
tttctatcgctcgacagactctatcgcttgaccaagctggccagaaaccgcaagttgctggaaaacaacgttcagcggttcaaggaatttggcaatacccatcgagccaaacgcatcaccacgccgatgatcgtgacgcgcgatccgcaaaatataaaggctattctttcactgaagtttggtgactatagcatgggcgataggatcaggatttttggccctctcctgggccacggcatcttcacctctgacggcgaggactgggcccgatcccgccatatgatccgccccaacttcgtcaaagaacaagtcgcgcaccttgagattttcgaagaactcatggacgacctctttgcccttataccgaccgacggcagcactgtcgatcttcaggaactatttttcggcttcacgatcgactctgcgactgaatttctttgcggccataatgttcatagtctgaagaagcggcgatcaggggttatagatgacgagccggacttcgctgaagctttcaactactcgcttgacaacatctcgaagaatggccgttttggcccactgatgtttctgaatcgtgacccgaaagctgttgaatcgcatcgcatttgtcacgagagcatggaccagttcgtagacaaggctatcagaatgcgcgagagatataatgaagagaagattgtcgacgaggctgcagagcgcaggtacatgttcctttacggattggctcagcaaaccggcgaccggaggcgaatccgtgatgaagttttgaatatcctcttagcaggtcgcgacacgacggcttcgcttctgagcaacatgttctttctgctggcaaaacatccaagcacctgggcgaaactgcaggaggaggtcgctacacttgaaggccgtgctccgacttacgagcagctgcggaatatgaagtaccttaaatactgtctcaacgaaagtgagtgaagccgtctaatagctggacccaagaaaactaacatccgcagcgctccgtctcttccctgtcgttccggtcaactcacgcaccgccatcagagacacggtccttcccgttggtggtggcccagacggccagtcgcccgcttttgtcccaagggcacgatggtcgcgtacagtgtctacgccatgcatcgccgagaagattattatgggctgatgccgaagagttccgtcccgagcgttgggccgatctacgacccggttgggaatacctgccgtttaatggaggccctcggatttgcgtaggccagcagtatgccttaactgaagcagcgtatgtcacaacgcgactcgctcagcgatactcaattctggagagtcgtgatcctggcccatgggaggaaaagctgacgttgacgttgtgctcgtataatggaacccaagtcagtcttcggcattaa

SEQ ID NO: 37069 - DNA, 1262 bp, Aspergillus nidulans
atgagtttaaagggcttccagaagagcattgtccgcgccccgcaaacgttcaaggccaggttcaacattggcgacaacaccaaggatcctgtctacactgatgccgagcgccgatttcaggaactcgaaaaagagacaaagaaactccacgatgagtctaagaagtacttcgacgccgttaatggtaggtttcgtccggacaccttccgtctccactccggctaataccccgcttagggatgctggatcaccagattgagttctccaaggctatgacagagctttataaaccaatttccggccgtgcctccgacccgagcacttatacgattgaaggaaaccccgaaggcattcgggcttgtgaggagtatgaagtgattgtgcaggatctgaaggaagcactagcaccggagcttgagatgattgattctcgtgtcgtcagccccgcgcaacagctcttagaggtgattaaggccatccgcaaggttgctgtgaagcgagaccacaagaagctcgactacgaccgccacaggaacactctgaagaagctccaagataagaaggacaagtcgctgaaggatgagaaggccctttacaaagccgagggggacgtagaacaggctactcaggagtacaacctatacaatgatttgctgaaggatgagctgccgaaactcttcgccctcgaagcagaattcatccggccgcttttccaatccttctattacatgcagctgaatgtcttttacacattgcacgagaagatgcaaggcatcaacattggttactttgatctgacacgcgacatcgaagaagcgtatgaggagaagcgcggggacgtcaaagagcgcgctgaagaactcaccattgttcacttcaagaccacaggtggtcgtcggccgggctcaaagctcactggcaaagataaactagctgcggagcacaaaggccgcttcggatcacggcccagtgaccccgatgttgtcgaaaacccgccgcctccgtactctcctggcgccagtggaagcgccctcgcagcagccgcagccaaaaagccggcacccccacctccaaagcccaagccatcgcagttccgtgcgcccgtcgagacagttacggcgttgtatgattacgaagcacaggcccacggtgatttgagcttctcggccggagacgtcatcgagattgtgcaaaggaccgataaccaaaacgagtggtggacaggccgtgttgacggacgagaagggcagtttccaggtaag

SEQ ID NO: 37070 - DNA, 1834 bp, Aspergillus nidulans
cggagagcggaggctctgaaggtgaacatcaacgctggtgaagggcttcaagatgttctgaagtcaaaccttggtccctcggggactctgaagatgtacgtatcaagctcatatttctgggtctgcaaagcttaagctaactaatagtcaggctggtagacggtgctggtggtgtacgaattatccatgccactgaaacgaccacaatgtctaatggtgcacaaacagattaagttgaccaaggatggaaacgtgttgttacgcgagatggtaagttgatcctcagcagcaagatgtggtcggactagctaacaatcgcagcaaattcaaaaccccaccgccgtaagacttaccttccactctttggagacgatatcctgtattgactttcaaaggtcatgattgctcgggctgcgactgctcaagatgatatcacaggtgatggaacaacgtcggttgtgttgttggttggagaacttcttaggcaggcggatcgtcacatctcagaaggattgcacccccgagttataaccgatggttatgaaatcgcaaagaatgaagctctgaaggtgaggaaagccaaacatcgctctgactagcgctaagtggtttgatatagttcctcgataagttcaagatcgaacgggcgattgatcgcgaacttcttctttccgtcgctcgaacctcgctcagcacgaagctgaacagcgccctcgccgagaagcttactcccgatattgttgatgccgttcttgcgatccaccgagctccggaaaagccagacctgcacatggttgagatcatgaccatgcaacaccgcacttcttccgatacacagcttatccgtggtcttgcactggaccatggtgccagacacccggatatgccgaagcgcgtcgagaacgcctttattcttacccttaatgtcagtctcgagtacgaaaagtcagagattaactctgggttctactattcatcggccgagcaaagggataagctggtggaaagtgagcgtaaattcgtggatgcgaaactgcagaagattgtcgaacttaagaagcaggtctgtggcgatgaccccaagaagggcttcgttgttatcaaccagaagggaattgatcccctgagtttggacgtccttgtgaagaacggaataatggctctgcggagagctaagcggaggaacatggaacgccttcagctgatttgcgggggtaccgcccaaaacagtgtagaagatctcagccctgaggttcttggatgggccggccttgtttatgagcaccagctcggtgaagagaaatacacctttgtggaggaggtcaaggaccccaagtctgtcactatccttattaaaggtcccaacggacacaccattgcacaggtcaaggatgcggtacgggatggtcttcgatcagtgtacaataccatcgtcgatggctgtgtcattcctggagcgggagccttccaagtcgcctgccatgctcacctaacatcggacagcttccgcaaatccgttaaggggaaagccaggtggggtgtcgaggcattcgctgacgctcttctggttatccctaagactttggcggataattctggacacgacatccaggactctctggccttattgcaggaggaacaggcagacggcaacgttgtcggcctcgacctcactaccggtgaacctatggatcctgtgcaggaaggcgtgtttgactcgttccgcgttctgcggaactgcatcgcttccagtacaggtatcgcctcgaacctacttctctgtgacgagcttctgaaagccaggcagatgggtaaacaaggtggacccggcggc

SEQ ID NO: 37071 - DNA, 1739 bp, Aspergillus nidulans
cccaatacacatctcgcatctcttcttctcacatcacccactgaacctttgtctaaaacgcaccgatgcttctccgaagcggctcgtccagatacgcactacttcacgacccatgactttcgcctctggagccagagattcgcagccgggctgcgcaagtcgggcctccagaagggtgaccgggtgttgctcttctcgggcaacgacatattcttccctgtaatattcatggggatcatcatggcgggggggattttcaccggcgcgaaccctacctttgtcgctagagagcttgcctaccagttgcaggatagcggggcgatttatctcctctgtgcagaagatagtctagacactggtattgaggcttcgaagattgcggggttggatatggacaaggtgtttgtgttcaacaatgcactttatgatggaaagggggaggggatgaaagggtgtcgatattggggggagctggttgccagcgttgaggagggggcaggatttgcgtgggaggagctggacacaccggagaaagctaacaccacgcttgcgctgaattacagtagtgggacgacggggaggccgaagggggttgagatctcgcacaagaattatgtctcgaacatgttgcagtacaaccaccttttttacctgaacccgaactggagggagaaggcgaaacgggcaagatggctatgcttcctgccgatgtaccatgcaatggcgcagaacatcttcattgcagccgcactcaaccggggagtgcctgtgtacgtgatgccgaaattcgatttcattaagatgctggagtatacggaaaaatttcgcatctcggactatattctggtccctccggtggtggttgcactggcgaagcaccctgctgtgaagagcgggaagtacgatttgagcagtgtggaagatattggtagcggacgtgcgccgttgggtcgagaagtctgcgaagaggtcgaagccttatggccacctgggaaaatcaatatcaagcaaggctggggaatgacagagtaagtgaccttgtcttttgagcattgccggtatggttatatgccagcccactaaccgattctgctttggcagggccacatgctccatcctcggctggagtcccatggagaaatgccgttacggcatcagttggagagctcaatcccaactgcgaacgaaagattgtcgccgacgacggggtaacggaattaggcaagaatcagcgcggagagttgttggttcgcggcccgaatgtcatgaaaggatactggcggaacccgcaagcaactaaggagaccctgacagaggacggatggttgaggacgggagatatcgcctttgtcagtaatgaagggtggttccatgttgttgaccgaaagaaggtatgtcccgatccaattgttcctagctgaactgatgaatcgtgcctggactgaccatacgcactgtacaggaactcatcaaagtgaaaggcaaccaagtcgcacctgcagagctagaagccatcctactcgaacatccagccgttgccgatgcggctgtcatcggtgtgccaaagtatgacgaagatcatgttgagaagatatgtcaagagctaacgcaggattagggacgaagatgaggccccgcgagcgtatattgccctgaagccagggaagaatgccactgccaaagacattacaaccttcatggagggcaaggtatcacggatcaagagaatcactggtgga

SEQ ID NO: 37072 - DNA, 996 bp, Aspergillus nidulans
gatagtatccctatcgtcgatctgtccaccttaaacagtcctcatattcagaacgccagaaactcgcagagtccgtcaggaaggcctgcattgaggttgggttcttctacatcaaggtttgagaaccacccacaatgaggaagcctagctcacactagcagaaccatggaatcgctggggagctaatcgttcgtaccttcgaggctgcgcataatttctttgctcttagcaaagaacagaaaatggaatgttacctggcaaagtccaaagtctgtttggagttacaagagattgatgaagtctagagtctgactgcgatagaacttccgcggttacagccccttgtacggcgaaaagcgtccaacccagagctcgagaaaccagctgagggagccctgtccgaggcattcgacattggttacgagctggcaggggatattcgaaaaggccccggtgacccgcctccccaagatgagtacgggctatacggggacaaccagtggccggatgagcgtctcctcccgggctttcgcaaaatttaccttgaatacttctcccaaactcttgagctctctcgaaagctgatcaagatgaatgccttggcccttggccaggaagagcatctcttcgattcggcagtggagtatccaggagttctctcgagaatgctgcattacccgcctcagccagtggaagggcaagagattccagggcaggcggctcatacagtaaggtcatgccccgactacgtagagaagtcactgatgggtgaaggactgggagtgcttcactatcctggcgcaggaccatgtcccagctctgcaagttcgcaataatcagggtcactgggtggcagcaccaccaattccaggaactttggttgtgaacataggggactgtctcgctacctggtcgaataatcgattcaaatcaacgattcatcgtgtggtaaacttgactggagaggaacggtactcgattccgtttttcttcggt

SEQ ID NO: 37073 - DNA, 1275 bp, Aspergillus nidulans
cagacattggagcagttgatcagcgcaggcgcgactttaccgctaattgaagcactagattgggcggagggacaaggaaaggagcaagtggcatatgtattgccaactagctggacatctggtctgcgggtaatgcttagttggaactgcggctcgatgaatccgcgctgactgtgaagaaactcgccatgatcacgcattacaacatcattgccaatatcattcaggcgaccacgtttgaagctggcccgaagaaggggcgcaccgaggtcgccctcgggtttctgcctctcagtcacagctacgggctgatcctggcacacttgacggcctggcggggggatacctatatcctgcatgcacgcttcgatatgcaagccgctctggcgtcgatcgaaaagtaccgaatcgagcgcctatatctagttcctccgattatctctgctctcgtcaacaatccctttctcctcgatctctgcgacacttcctcggtcacttccgtcgtgaccggctcagggcccttcgggccccggttggcagaggcgctgagccgcgtgcggccatcgtggcaagtgctcccaggatacggtaagcttatgataataggtaacgaatgtgcgatatctgaccgttgtgaaaggactcactgaaactgccgtaattatctccatcaccgaccctaacatcacctatcctggtgcagacggctgtctcgttccaggcgtcgaagcgcgactcatcaactcaaacggcaacgaggtggaggcgtacaatgaacccggcgagctgctcctgaaatcgcccagcatcatgaaggggtacctcggacaggagacagccacccgagaagtctttgacgagcagggctggctccgcactggcgatatcgctgtcttccggctgacaggccaagacggcaaggttactcctcacttggatattgttgaccgcaagaaggatatcatgaaggtcaagggactccaggtagcaccggtagagatcgaatcacatctggcggcgcatccggccgtggctgaagtagctgttgttggagtccgcgacgaggacgctggcgagcgaccgtatgctttcatcgtgcgctctcccagaactatggccgatctggacgaggaggcgctgaaggccgatctcaaccgccatgtagaggccaccctcagtgagccgcactggctgcgcaagaacatccggtttgtagaggagttccccaaaagcagtaatgggaagccgctcaagtacaagttgaaggaaagtctg

SEQ ID NO: 37074 - DNA, 444 bp, Aspergillus nidulans
ttcgacaggcgcggccccgcctgtgtcgccctcgaatctctcggcgacttgttacgcgcctgcggccaaaacccgacgcttgcggagattgcggacctggagaagaatgtcggcggcgacttcgactttgagtcctttttgaaagtcctgaaccgccctgggggctttagggagcccggtgagccggaggagtactgccgtggctttcaggtgttcgataaagatatgacgggggttatcggtgtggggcagttgcgttatagtacgttcttcctttttccccttcatggactgggagctcgggttgattcattgagttgggttggttgtatgttgctgacggtgtattcgacagtcttgacgaacttgggcgagaagatgaccgatgaagaggttgatgagcttctcaaggcggttgatactagctctggcgagatcaactat

SEQ ID NO: 37075 - DNA, 763 bp, Aspergillus nidulans
ttccaacaatgtggcaaactcgagctgagctgccagactagttaccacggtcaagatacctgttgtttcaactaccagcggtgggcagatgctgcagacacaattctgggatgcggatccagcagttggacctgagaattcttggacaatccatgggctatggtgagccaggctttctggagggtaacatgccagtgaacttgccaaactgattatgacaaaggccagatcattgcaacggcggcttcgaccagttttgtgactctcataggaagtacagcaacatctccttgatactaatcgatgcgggtcgaagggacctgctagacgagatgagtacatactggaaagactacagaggcgacgacccgaacctctgggagcacgagtggaacaagcacggcacttgcgttagtaccttagagacgcactgctactccgagtactacccacaacaagaagttgttgattactttgacaagaccgttgagttgtttcatgaccttcctacttacatggttcgttcctccatcatacgaaccgagtaatcacaactttactaaaacgttagactctcgccaatgctggcatcgtcccgtcgtacactcagacctacacccggcatgaagtcgaggatgccctctctaaagcgcacggtgcaacagtcacagtgcggtgtcgatctcaacggctgcaagaagtctggtacttcttcaacgtagagggacccctccaaacagggaaattcgtgccatctgaacca

SEQ ID NO: 37076 - DNA, 1719 bp, Aspergillus nidulans
gatgacgcgtcagggtcgatgaagagcagatgggtcggtcagcccactgacgtcgccatcttagatctgcttgatgcttttggggaggacgacgtgcgggaccgcataagtgcccgggttgcagaaactcccttcagttctgagcgcaaatggatgggcgtagttattggcagtggtgttcctggcgattcaactgctccaataggtggacctagcatggcctacatcaaaggcgccttggaacaggtgctggcgcgttgtgatacttaccttaccaaggatggccaggaggttatattggacgagcgtcggcggcaggtcgtgcgacaggctgcggaacaaatggcatcagaaggacttagggtcctgtcttttgctagtggtgcagtaagagagtctagaggaagggcactcggtagtagatccggtacgccttcttcgaaggttagctccggcgatgaggacgatcgctacagcggcttggtctttgcagggttggtaggcatgaacgaccctcctcgcaaggacgtgcacaaggcaatccgccgcctgatggccggcggcgtacgggttatcatgattacgggcgatgccgaaaccacggctgttgccattgcgaagaagctcgggatgcctatcgtggagactcctggagtacgaaatgtcctctgcgggcaggaaattgaccgcatgggcacatctgaattatctcaggcgttatcgtcagtctcgatatttgctcgcacaagtcccgaccataaaatgaagattgtgcgtgccttgcagtcccgcggtgatgtcgtcgcgatgacaggagacggcgtgaacgatgcacccgcattgaagaaggccgacattggaatcgcaatgggcaagcttggcacggacgttgccaaagaagcagccgacatgattctcacggacgacgatttttcgaccatcctgcgagccatcgagcagggcaaaggaatcttctacaacatccagaactttatcacgttccaactcagtaccagtgttgccgctctgagtctagttttgctgagcaccatgttcggattcaagaacccgctaaacgcgatgcagattctgtggattagtatgactgccctataactgcgccggtgttcttttgctaatatttgactagatatcctcatggatggtccgccggcgcagtccctcggagtagagccagtagacccttcgatcatgggccggcctccccgacccaagagcgctcgagtgctcacgaaaccgcttatccaacgggtcctcacctcagcgtttatgattatgatgggcactttggccatatacatctatgagatgggcgatgatgacgacgtactgacgggaaagcgctcccgagtagtgacggcccacgacaccaccatgacattcacgtgcttcgtcctgttcgacatgttcaacgcattgacatgtcgcagcgaaggcaaatccgttcttcggggcgagatctctctttttgggaacaagatgttcaactatgccgtgctgggctcgcttgccggccaggcttgtgtcatttacctaccgttcttgcagcgggtgttccaaacggaaccactaaacgcagcgcacctgttcaagctggtgtgcattgccagcacggtgttttgggttgacgaggggaggaagtactaccaatcgctgcagcgacggcgggcagttggggtaggatatagcgtgaatgtg

SEQ ID NO: 37077 - DNA, 904 bp, Aspergillus nidulans
tacgacattctcgcgtctcttggtttgctcaacaagcatgccaagctcttgttcctgggtcttgataatgctggaaagacgacccttctgcatatgttgaaggtatgttaacagtatttgtggcttggattgagagtattcggatgggaaatagagtttactccgcttgaagaatcggttagaagtgaaacaaaagctgacgaggtgaactcattcagaacgaccgagttgccatcctttcacccaccgctcacccaagtacgttatcacatcgactcaccgcatctcagattacgatagagagtgcggaggattggatcaataatggagactaactcagacacagcatctgaggaacttgtcattggaaacaaccggttcacaacctttgacttgggtggtcaccagcagggtgagtctagccgaatccatgcgttccaaactttgattctgaacaacaatactaatgctgttaacatcagcccgccgcctgtggaaagattatttcccagaagtcagcggaattgtcttcctcgtcgacgccaaggaccacgagcgcttccccgagtccaaggcggagctcgatgccctcctcgctatggaagagctctccaaagttcctttcctcgtccttggaaataagattgaccaccctgacgccgtcagcgaggacgaacttagacaccagcttggtttgtaccagacgacgggtaagggtaaggtgccgcttgaggggatccggcccatcgaggtgttcatgtgcagtgttgttatgaggcagggtgagttctacctcgcgattatttgtgcatttctcttttgtgggtggtgaaaaactaacttttatcctttgttaggatacggcgaaggtataaggtggctatctcaatatgtctagacaagc

SEQ ID NO: 37078 - DNA, 1817 bp, Aspergillus nidulans
atggcctacttccgcctctacgccgtgttgcttgccgtggcgtcctcggtcgccgccgtcaaggtcaatcctctaccagctccacgccacatttcctggggtcattcaggcccaaaaccgctatcggatgtcagtttgcgcactgaacgagatactgacgatagtatccttacgaatgcgtggaatcgcgcttgggaaactattgtttctctagaatgggtccctgccggaattgaagcacccattccagaattcgatgagttcccaacttcaaccccatctgccagtgccgctgctactagaagcaagcgcgccaatgtgcctattcagttcgtcgatgttgatgtggaagattgggacgccgatctacagcacggggtggacgaatcttacactctagacgccaaggctggttcggacgcgattgatatcactgcgaagacggtctggggcgcccttcacgctttcactacgctccaacaattggtcatctcagacggaaacgggggtctgattcttgagcagcccgtccacatcaaagatgcgcctctctacccatatcgcggacttatggttgatactgggaggaacttcatctctgtccgcaagctacacgagcagctcgatggcatggcactgtcgaagctcaatgtccttcactggcatctggacgatacccaatcatggccggtgcacattgatgcttacccggagatgaccaaggacgcatactccgcgcgcgagacttactcccatgatgacctgcgcaatgttgtggcgtacgcgcgcgcccgtggaatccgtgtgatcccggaaattgatatgcccgcccactctgcctctggttgtgcaacaggtctgaccccgatattgtagcctgcgccaattcctggtggtccaacgacaactggccgttgcatactgcagtccagccgaacccaggacagctcgatatcatcaatcccaagacgtacgaagtcgttcaagacgtgtacgaagagctatcaagcatcttcaccgatgactggttccatgttggtggcgacgagattcagcccaactgctacaacttcagcacctacgtgactgaatggttccaagaggacccctcgcgcacttacaacgacctcatgcagcactgggtcgacaaggccgtgcctatcttccgcagcgtcagcgactcccgccgcctagttatgtgggaagacgtcgtcctcaataccgagcatgctgacgacgtcccgacagacatcgtcatgcaaagctggaacaacggcctcgaaaacatcaacaagctcaccgaacgcggctatgatgtgatcgtctcctccgcggacttcatgtacctcgactgcgaccgcgaaggttccgtcaccaacgacgacagatacaacgagcagaccaacccagaccctgacaccccgagtttcaactatggcggcattgacggctcctggtgcggcccgtacaagacatggcaacgcatctacaactacgattttaccctcaacctcacaaatgcccaagcaaagcacgtcatcggcgcaacagcaccgctctggtccgagcaggttgacgatgtcaacatctccaacctgttttggcctcgggctgcagctctcgctgaactcgtgtggtcaggcaaccgcgatgcaaaggggaacaaacgcaccactctcttcacccaacgaatcctcaacttccgcgagtatcttcttgccaacggcgttatggctgctactgtcgttccgaagtattgcctgcagcacccgcatgcttgtgatttaaattatgaccagacagtccttcactagtgt

SEQ ID NO: 37079 - DNA, 865 bp, Aspergillus nidulans
gtcgatgttgccactgtggagaaacatgccgcctacctcgcaaagtccggggttgccggcatttgttgtgcaaggaagtaacggcgaggccgttcaccttgaccgtgaagagcgcaatctcattacctctgcgactcggcatgctctcgactctgtcgggccacctccatgcccgtaatcgtgggcaccggtgccccctccactcgcgaaaccatcaacctctgcaaagacgcctgcggccgccggcggtgactatgtcctcgtcctcccgccgagctattacaagagtcttgtgtcatccgctgccttactcgaccacttccgcgccgtcgcagacgcttctccgatccccgtcctcatctacaatttccccggcgcgtctgcggggctcgacctctcttccgacgacatcctcgcgctttcttctcaccctaatatcatcggcacaaagctcacctgcggcaatacgggcaagctgacccgtatcgttgcgcaggctggaccctcgttcctcaccttcgggggctcgtgcgatttcactcttcagactcttatcgggggcggcgcaggggttattgccggtactgccaatatcatccctcgtgcctgtgtccggatcatggaactctaccgtgccggccgtgtcgaagaggcgcaaaaagtgcaggctatagtggcccgtgcggactggctcgcaattaagggcgggtttgtggctgttaagagtgcactgcaatcctatcgcggatatggacagcagccgcggcggccgtgcgttgcgccttcatcggaggaagcagcggcattgaaggaagctttcagcgagagtatcgagctggagaggcagctggaatcgcaataaaac

SEQ ID NO: 37080 - DNA, 2340 bp, Aspergillus nidulans
gtacctgatgtatatcctcaagtcatggcaattcctatcgccaaacgcccgttattccccggtttctacaaggccattaccatccgtgacccaaatgttgccacagcgatccaagagatgatgaaacgcggacagccgtatgtaggcgcttttctgttcaaggatgaaaacgcagacggcgatgtgattgagagtactgacgatgtttacgacaccggtgtcttcgctcaagtcactgctgcatacccgcttcgtggcgagcaaagcggcgttacggccgtcctttatccccaccgacgtatcaagatctcttctctgattccgccgggtgattcaacgaaaagtgggaactcggaggataagactacagagaagcgtggtgacgttgtagcaagctttgaggagaacgcagcggagcttgtaacgaaggatcactacgagcctacctctttcttacggaaatacccggtcagcctggtaaatgtcgagaacctaacggaggagcctttcgataaaaagagcgccattatccgcgctgtgacaagcgagattgtcaatgtctgcaaggaaattgctactctcaatcccttgttccgcgatcaaatatctgctttctacactgaccaattccctggaaaccttagcgatgaacctgccaagctggcggatttcgcggccgccgtctctggtggagaactgcatgagcttcaggaggtccttgagtcaatgaatattgaggagagactgcccaaaggattggttgtgctgaagaaggagctgatgaacgcccagcttcaaacgaagatttcgaaggatgtggaagccaagattcagaagcgtcagcgggagtactggctgatggaacagatgaaggggatcaagcgagaactgggaattgagtctgacggcaaggacaaactcgtcgagaagttcaaggagaaggcagagaagttagcaatgcctgaagctgtgaagaaggtgtttgatgaggaactcaacaagctcgctcaccttgagccggctgcgtccgaattcaatgtcactcgaaactatctggactggttgacccagatcccttggggccagaagagtgtagagaactttggaatcagccatgcgacggatgtcctgaacgaagatcactacggtctgaaggatgtcaaagaccgaattctcgagttcatcgcagttgggaagctccggggaactgtggaaggaaaaatactctgtcttgttggccctcctggtgttggtaagacgagtatcggaaaatctatcgctcgggcactaaaccggcagtactaccgattctccgtaggtggattaactgatgtcgcggagattaaaggacaccggagaacctatgttggtgctcttcctgggcgtatcattcaagctctcaagaagtgccaaaccgagaatccccttatattgattgatgaagtggacaagatcggccgtggtcatcagggcgacccgtcgtccgcactgcttgagcttctggatcctgagcagaactcgtcgtttctggatcactacatggatgtacctgtcgacctttcgaaagttctgtttgtttgcactgccaatgtcactgacacgatacctcggccgttactagaccgcatggagcttattgagctatctggctatgttgcggacgagaaaatggccatcgctcaaaagtatcttgcgcccgctgccagagaactaactggcctcaaaaatgtggacgttactcttaccgaggaagccattgaagagcttatcaagtcgtactgtcgggaaagcggtgtgcgaaacttgaagaagcagattgaaaaagtgtaccggaaggcggccttcaagatcgtttcggatcttggggaagacgtattagcggaggacaaggctctcacagccgaggggaaggctgcgcaagaggagtcggagaaggagacaggccccattgaatcaacgagcgaacaggagaaagccacaactgaacacccacgggtgtgactgaatgtacccgatagtgtacacctcagtattgctaaggacagcttgactgattacgttggcccgactatcttcaccaccgaccgcctgtatgacacctttccgacaggtgtcaccatgggtctggcttggaccagcatgggaggtgcggctctctacgcagagtccatcttgaaaaatgcatcgacacacaagtcacaacctggtcttgacatcaccggcaatctgcagaacgtgatgaaggagtgaactcaaattgcctactcgtttgtgaagtcggcgatggcgaagcagttcccggagaatagattctctgaaaaggcaaagctgcacatgcac

SEQ ID NO: 37081 - DNA, 2051 bp, Aspergillus nidulans
cagctgttgtcatatcctctgggaaaggcagcagagcagcttctgcctgatgtgggattcagcttctgcggcgtgcgacacagccttaaccctggaccgttcagcccgaaagcgcatttactgattactatcatggcaaatgtgggaactagtcgaccgtactcaaatgtcatcagttgagttaatcccgttcctctccgttcgtacctcaattgttcggagcttacgtgaggctccctagtctggactcaggtcatacaccagtactacggccagtcctatgcttcagcctttagctaccaggtcctgctttccctgtcatcggacttgatgggtaggcttggctcattcaacttaattcagaccattagctaacgttcaccaggatatggccttgccggtctagtccgcaagttccttgtatatccgtccttctgcctattcccccagtgtctgaccacgcttgctctcactaaagccctgcatggtggtgagtacggaccgcttagatacgggtgagcccgtctaatattcgtgacaatgactagataagaattcgccagccttcgggccattccggaggacgtacaacatgtcccgctcccggttctttatgtatgccttcgtaggaatgttctgttacgcgtggtttcctggctacctgttcgaaagattgagtatcttcaactggctcagctggatatctcccagcaatgtgaacctggccgcaatcacaggtatccaaaccggtttgggcctcaatccatttccaacgtttgattggaatatggtcactgcggcactcgatccgcttgtggtacccttgctggccaccctgaacgtgttcgccggcgccatcgtcagcggggtcctcattgccattttttggttcactaacatatactgggcttcttatctgccaattaatacgaacaggctctttaatcgctggggaacggcatacaacgtttcagaaatactagactcccacgcgctcctcgatcaggccagatacgaacaatattcaaccgcctttctggcaccgagcagtctagtccggtatgcgttcttcttcgcaacatattccgcgacaatctcgtattccatcttttatcatggccaggcaatcatggccggatttcgtaacctggttcgcagcttctatggcgtgacggccagtgctaccgacatccattccaggctcatgcgcacgtataaagaaggtgatcatgccatatctaaacagttagcggacacccaggttgctaatcggctgttgcacccagtttcagagatatggtatgctgcgctgaatgtgcttgcccttacccttgctgtcgtcatcatcacggcctggccaacatccgtaagttgttgccacaacgcctctttagattcaaattattgagattgaccttgtatccttgacatgcagacaaatgttggagtcatctttgtggcgttctgtgtttcagcagccttcttggttccagtcggtcagatttacgctctcacagggattgctatcaacctaaagtacaaccatcctcctctcttttcccattgaagtatatggaagctgaccttgggcgcgcatagtgtgctgtcggaatttttagggggcctatggacgccaggaaatcccctttcagtcaactttttcaagctatacgggtacgtaccagaaccctgctgcttcagattctagtccactgatgtgaccgcacccttcctgacaaccagatacaccaccctcgccaatgcgctgccattcattagcgatctcaaactggcccactatgctaagcttccaccttggcataccttttcagcccaggtcattgccacggtcgtatcggcggttgtgtgcacagccatgcttaactatcagatcaatgagattcctgatatttgccaaaggtttgatccaactccacccggcgttatcccactaactctctatcgttcataccaacagcactcagaaggatcgttttacctgccctggaaataatacatattttagtgcctcggtaatatttggtagcacc

SEQ ID NO: 37082 - DNA, 1332 bp, Aspergillus nidulans
tttgccaaagactatggagagcaagacccagacggttcatactcgcttggaacggcgttcctctcgctgtctgccagtatcatctatgtgggcgagcttgtcggcgccctggccgccgccccgatcaacgaggcattcggtcgacgcgctgtcttcttctcggcctctctctgcatcatcgccggagccatcgtccaggcctgctcgttcggctcgcaccctgtgttttacgtcggccgtgtcctgattggtctcggtgttgggcagttcactgccacctgtctgatttatatcggcgaggttgccccatcggccatcagaggtcctgccctcatgtgcttccagttcatgcaatctatttcccagctcgtcggtgcctgcgtcaaccagggcacgcagagcatccagagcgctcagtcctaccgcatccctatgtgcctcctcgtcgtcctccccggcacaatgctgctgtgcctgatcttcacacccgaaagcccggtgtggtacatgacaaaagacaagcgcgatgcggccatcaaggcgctccgcaagatcaaccgcagcaaccgcgactacgatccaactatggacatccagaccatcgaaaaccaggtccagctcgaacgtgagcaagctaaggacgccacctgggcttctctgatcacagaccctgtcgagcgccggaaactcttctacgcgtgcggcgccatgttcgtgcagcagatcaacggtatccagttttggtatacctacggcgttgtctttgcgcagtccatcggtgttgcggaccccttcaccatcaataccattatctacgtgctgcaaatcgtcacagtcgctatctccgtcctcttgggaaacaaaatcaaccgccgcacaaaccttatcgtctgctcaatcggcatcctcgtttccctgatcaccgtcggcggcctaggcaccacccgctcccccgatggctccttctcccgcggcgtcggtatcggcatcgtcgtcctcgcatatatcaacattatcttttacaacttctctatcggcacgctctcgtactccatcgcatcggagatgtccgttggtcggaacagaaacaagatcacctcgtgcgcgatgggcgtattcttcgtgaccgtctggctcatggtctttacgagtccgtatatctactatgacggcaacctaggtcccatgattggctttgtctacggcggcacaacgctgttcttgctggcttactcgtggttctgcgtgggcgagacggcggggcgcagcaacgcggacattgagcggttgttccaggatcgcgttcctgctaggcagtgggcgacatatgtc

SEQ ID NO: 37083 - DNA, 1469 bp, Aspergillus nidulans
gctgttgtcccgtcggcgccagaggatccgctctttggtctcgcgcaggcttatcgccaggacccctcagacaagaaggtcgatctagtcattggtgcttatcgcgacgataatgcgaaaccctgggttttgcctgttgtcaagaaggtgcgtttctctcatgggcctctgcatggatccttgccatgtccctgtcatgggtgcctctgccgacagccgatcgagcgttgatcgagcgttcgatagagcgtccgaaggatcggggcccaattccggcttttcaaatgatagtgctgacagaccacaggcagatgagctcatccgcaacgaccccaaccttaaccacgaatacctcccaatcaaaggcctcgctgaatatacaaccgccgcccagaaactcatcatcggcgccgactcgcccgccatcgcggagaaccgtgtctgcacattccagaccatctccggcacaggcgccgtccatctaggcgcgctcttcctcgcccgcttccaccccgcaacccccaaaccgaccctctacctctccagcccgacctgggcaaaccaccaccagatcttcacaaatgtcggcttcacgcttgcgaactacccgtacttctcgccgcagacgaaaggcctcgatttcgacggcatgatcaacgcgttgcgctccgcgcccgccgggtcgatcatcctcctccatgcctgcgcccacaaccccacgggcgtggatctcacccaggagcagtggaaggaagttgccgtggtcatgcgcgaccgctcgcatttccccttttttgactgcgcataccagggtttcgcatcgggcgatctggcgcgtgacgcctgggcgatccggtatttcgtcgagcaagggttcgagctctgcatcgcgcagtccttcgccaagaactttggcttgtacggtgagcgcacgggcgcctttcatttcgtttccgcgccgggcccggaagccgctcagtcctcggcacatgtcgcctcgcagctggccattctgcaacgctctgagatctcgaacccgcctgcgtacggtgcgcggattgcgagtaaagtgctcaatgaccctgagctgtttgcgcaatgggaggacgatctgcgaacgatgagtgggcggatcgtcgagatgaggaaggggctcaggcagcgccttgaggagaagaagacacccggctcgtggaaccatattaccgaccagatcggcatgtttagctttacggggctcagtgaggcacaggttaaggtgctgcgtgagaagtggcatgtctatatggtatgatacctgtcatgtgttgtgtttggatgagtgctgactgattgaaccctagaccaagaacggtcgcatctccatggctggtctcaactcccataacctggattactttgccgaggcggttgatagcgttgtgagggagacatcgtgatcttcctatccacctattacgaacatacac

SEQ ID NO: 37084 - DNA, 1554 bp, Aspergillus nidulans
tcattagactacggcaaaaaggaactgcagatgggtgggagcatgaacggcggaattgcttctggggaagtattcgaacatgggacaacaaagcgaggactgaaaccgcgtcactcgcaaatgatcgctctaggaggctgtgtcggtaggagttcttgctatgaatactataacaagtttgactgataatctaggaaccggtctcttcgttggcacgggggcgtcgttggctttgggtggaccagcctttctactcggctctttcgtcctaatgagtatcgttgtgtatatgatcgtcacggccatcgtcgagattgccgcgtatcttccagttgctggagcgtcaatgtcgtactacggcacgcgatacgtctcccggagcctggggttcgcgatgggatggttgtatgtttattcattgggcatcttggtgccgtacgaggttacggccggtgctttggtaatcgattattgggacaggtgagcatctctccttaatttcgttttcctcctcaatattgctaacttagaataccagtccggttaatgttggagtctggatcaccgttttcatcgtggtcattgtcgctctaaacttgctgccagtggagtactacggagaggccgagttctggtttgcatccatcaaggtcttcacaatcattgggttgttgattctctcgttcatactcttctggggaggcggtccaaatcagtcgggcattcttggttttcactactgggaggatccaggggctaccaaaacgtggctggccgagggagcaacagggaggttcatcgccttcgtcggaaccctagtcctctgtgcatttcccttcaccttcagccctgaacttctcatttccacgagcggtgagatgcaaaaccctcgaaaagacctcaagaaagcagccaatcgcttcctacttagactggtcgtcttctacgtaggcgcggcattagcgatgagtgtcatcagtccgtcgaacgatgaagccctttctaacggaggcaacaacgcaaagtcctcgcccgtttgtcgttgggatcaggcatgccggtatccgtggtttgagcagcgtggtcaatgcgtcaattcttacaatggcgtggtctgctggcaatgcgtacctctatatgagctctcgcgctctatatgcactagcgatttccggtcaagcacctaaagtctttctgcgctgtactaaaggcggagttccttatgcagcagtgctcgcatgtggcttgtttggctttctagcttacctgaactgcggtaatagcagttctactgtattcacttggtttgtcaccatcactaacacctccggattcgtctcctggatttgttgctgtatcgtgtacctgcgttttcgagcggcctgcaagcgtcaaggtgtgcatgaactgccgtatcgcagttggctgcagccatacggcgcatggtttggcctcgtcttctttattgtcctagcactgatcaacggcttcaacgtcttctttcctggccagcttacagcgtcaagcttcttaactgcttatattggcttaccg

SEQ ID NO: 37085 - DNA, 666 bp, Aspergillus nidulans
atggccacaacaccagcaggccgcatgctggcccgtcagttacaacatatgcaatcagacaaagacctccccgggattagctgtggacttgtagacaacaatgtgttcgaatgggaggtcatgctcatgatctctgacgatgttaaactatatggcggtaagttcaatgtcttccatatttccgaaccggcagcattcagcatctcccgttccaacattacgaccatttattgactatggacgccatatcaggtggtttcttccgtgctcgactttccttcccccccgagtaccctcatatgccgccgaagatgaagttcgagccgccgctttttcaccccaacagtacgtgttgatctcccttctgtgaacacaagcccagaatgcactgttccgtactcaccagtcacgtcagtctaccctaacggcgaggtttgcatctccatcctgcacccaccggaagaagataaatatggctatgagtctgccgccgagcgctggtcacccgtccaaacacctgaaacaatcctcctttccgtgatttccatgctctccagcccgaatgacgagagcgcagcaaacgttgaggccgctcgtctgtggcgagacgatcccaaggaattcaagaggcgcgtccgcaagtgtgtccgcgagagccttggagag

SEQ ID NO: 37086 - DNA, 780 bp, Aspergillus nidulans
caggtcgtcgacgccatcaaagatctcgtgcagtactgcaatttcgactgcaatgactccggaatcgccctacaggccatggacaattcccacgttgccctggtatcaatgctccttaaggcagagggtttctctccataccgctgcgaccgcaacatccccatcggtatcgatctggtctcgctgaccaaagtcctacgcgccgctcaaaacgaagatatccttactctgaaggcggacgactctcctgatgtcgttaacctgatgttcgagagcgcagagacggataggctgagtgaatacgatataaaattaatggacattgaccaggagcacttggctatcccggagacagagtacgctgctacgattgagatgccctcggcggagttccagaggatttgcagggatctgaatgccctttctgagtcaggtgcgtggctggctgtcatctctccaattacatcgagttttactgattagcgtctagtcgtcatcgaagctacaaaagaaggtgtcaagttctcctgccagggtgacatcggcagcggctccgtcacaatccgccagcacaccagcgtcgacaagcccgagcaaaatgtctccattgtcctcagtgaacctgtcgccctcacattctccctcaaatatctcgtcaacttctgcaaggctaccaacctttccagcaccgtcagcctctccctctcccaggaggtgcccctgctcgtcgagtacggtcttggaagcggccatctaaggttctacctcgctcccaaggtg

SEQ ID NO: 37087 - DNA, 731 bp, Aspergillus nidulans
ctcaaatactaacagcatacatagtacatctaccaggttctcctgtttggctgccgcctgggcttctatgagcccatccgtaacgggcttacgaccgccgtttataatgattcgcatgtccagtctctcggcatcaatgttttcgctggcgcttcgtcaggtataatcggcgctgctgcaggctcaccgtttttcctcgttaagactcgtctccaatcattctcgcctttccttcccgttggcacgcaacatcagtacaggaactcattcgatggtctgcggaaaatcttcgcttcggagggagtaggtggattataccgtggagtgggggcggccatggtgcggactggtttcggtagctccgttcagttgcctacatacttcttcgcaaagagacgcttggttaagcatctcggcatggaggacggtccggcacttcacttggccagcagtacggcctccggtttcgttgtctgctgcgttatgcatcctcctggtaagttggcactgggcacctaaaccaccgaatttgatcgatctaactgttctcagatacaatcatgtcgagaatgtacaaccagactggaaatctgtacaagggcgtattcgactgcctggcgaaaacgatccggacagaaggtctttttgctatctataagggctactttgctcacttggcccgtattctacctcacactgtaagtagtttctctgggattttgcaaacagac

SEQ ID NO: 37088 - DNA, 1032 bp, Aspergillus nidulans
ttacaatgacctgaacaggccgccagctctctagagaacctcaagatgaatgattcccccgtcaagaagctcaattttgaagctgccggcaaagagaacgctcccgtctcgaaccccatggtcgacgtgccggccaccaagcccgctacagagaagcctgttgagccttctaaggctgctcttgacgtcaaggctattgaggccaatgaacctctgcttcaagagaaccctcaccgttttgtcttgttccctatcaagtaccatgaggtcagtactatgcggcatctcacgcgtcacgcgtaaattggaaaattcttaccgcctaatgaaccacctccactgacgcatgtctccgcgatatatagatctggcaaatgtacaagaaggccgaagcttctttctggactgccgaagaaattgatctctccaaggatcttcacgactggaacaaccgtttgaacgaggacgagcgctactttatttcccgcgttttggcttttttcgccgcttccgatggcattgttaacgagaacctgctcgagcgcttcagcggtgaggtgcagattcccgaggctcgttgcttctacggtttccagatcatgattgagaacatccacgccgagacctactctcttctgattgatacttacatcaaggagccgaagcagcgcacctacctctttgatgccattgataccagtatgtttcttggctagttttgttgatcgcgctctaacatgatatagttccttgcattcgcaagaaggccgactgggctattaagtggatccaggacaaggagtccaccttcgctcaacgcctcgttgcctttgctgccgtcgagggtatcttcttctccggctcttttgcctcaattttctggctgaagaagcgaggcttgatgcccggtcttaccttctccaacgagctcatctctcgtgatgagggtcttcacaccgactttgcctgcctgctcttctcgcaccttaactggcgcccatccaagaaagttgttgaggacatcatcgtcga

SEQ ID NO: 37089 - DNA, 1215 bp, Aspergillus nidulans
tattcgggccgggttttgaaagacaatgatactttagcgacgtacaagatcaaagacgggcacaccattcatttggtaaagagcgccgccagcaatcaacgtcccgcagccgccgccgctgccaccccgagcaggagcaccccaaacccaacaaacaccggagtcccaacgaatctcgccgccggctcagggaacaaccctcttgctggcctaactggcgcgcgatatgccgggtttgctcagcttccaggcgctggtatgtttggcccggacggcgggtaagtgaccattgattggaactcagttggtccttcaattagacgggctagtccgctaacacagtggcattcatagatgggacctcctccggatgccgaatcgatgttaaatatgcttgagaaccctcaagtgcagtctttgatgaatgaagcattacaaaacccggccatgatcgacatgatgattcaacagaaccccctgctacgcgataatcccatggcccgtcaaatgctgcaaagtgaggggtttcgccgtatgatgactgaccctaacacgatgcgtcatatgatgcagatgcaacgagcaatgggaggatttggtggcggtagtgctttccctgccccgggagtcaccaatacaacgcccgaggaaaatagaactgcgcaaaccaacaccaacaacaataatagtaatgctgccaatgccctcccaggaggtcttttcaacccttttatgccccagggccttggcgctggcaacccattcgcagctctttttggagggaaccagggaagccaaggaggaaaccagactgatcagactggcgcggcgcaaccagagtcgggaggagcaagtgaaactggtaccgcatctgagcagaatagaccggctcctggcttcttcaacccattcaatcctggtgcgaatcctttcgaccccgagcaaaatcccctcctccgcaaccctgcgttgctagaacagttgatgcagtcaatgggaagccctgcgggcggtgctgctaacccttttgcatcactgttcggtggccctagctttggtagccctgctccccaggacaacaggcctccagaagagagatacgcggaccagctgcgtcagctcaacgatatgggcttctttgaattcgaacgaaacatcgaagctcttcgccgagcagggggcagcgtacaaggtgcggtggaatacctgctgagc

SEQ ID NO: 37090 - DNA, 777 bp, Aspergillus nidulans
cttagtatcgcagtcgcctttctggcgttgtttacagggctctacaggttcttcgacgcccgcctggagcagttctacatcttcgaccaccaccatctgcacgacctgtcccagcgcgcaatcgctgcccatggaaacgacactcgcgccattgtccagtacatcgtttctgagttagacgagaaggtcggctccacgcacctgaacaaggacgaggaatgggttttcaacaacgccggaggcgcaatgggcgctatgtacattatccacgctagtatgtgcccttttctctcccgaacctgcttgcactcgcaacggcctatgctaatgatctctttcctacaggtatcactgagtatcttatcatcttcggtacgctcgcgctctccgtccactcgtccacccatcgtctcccaaagtacgcacaaaacatgtgtgaaaccaactaacagaactcaggcaccgccattggaactgaaggacacactggccgccacaccgcagatgactacttcaacatcctccagggcactcagctcgcctacgtccccggttcgtacgagcccgaagtctacccggccggttccgtccaccacctccgccgcggcgaggttaagcagtacaagatggactcgtcttgctttgcgctcgagtacgcccgcggctggattcctcccatgcttttcttcggctatgccgataccttctcgagcactcttgacttcccgactctgtgggctacctcgcgcattaccggccgggagatgatctccaacc

SEQ ID NO: 37091 - DNA, 742 bp, Aspergillus nidulans
gctcaggtttatatcaagcgatactacacgaagaacgagatcaggaatacaaacccgtatcttgttctgacgacggccttctatctcgcctgtaaaatggaagagtgtccgcagcatatcagattcgtcgtcagtgaggctcgagctctctggccaggtgcgtgaatgtggaacagcatatggtcattgctaatgcaccacagagtttatcgtccctgacgtctctaaagttggcgaatgcgagttctccctgatatctgagatgcaagcccaacttatcgtacatcacccgtaccgaactctatcggagctccagcctgagttatcccttacgtccgatgaggtcgcgcttgcgtggtcagtgatcaacgatcactatctcaccgacttatccttactatacccgccacatattatcgcagtcatggcgattattgtagccgttgtcttcaagcccagcagccagacggcctttcatggctctgcagctccaatcgcaggggcaatgcgagacggcggcatgaatattctcgcggcccttagcgataaggggggagctggtcctcctcctaggatacagaaactcatcgcatggcttgctgaaagtgaggtcgacatcaaggcggtcattgaatctacgcaggaattggtctcactatacgaagtctgggaacaatatagtgagaagaactgcaaagagcttctagggcggatgatcaggagcaaaagtttggacaaataa

SEQ ID NO: 37092 - DNA, 1470 bp, Aspergillus nidulans
ttgcgcaatgacttcttccatggatatgccacggcggcggcgcaggttgaaggagcgtggaacaaggatggcaagggtccttcgatctgggacacattcgggcatactccaggcaaagtcaaagacaatagcaatgcggatgacgctgtgaggttctacgacttttaccgcgaagatgttgccctgatgaagtcgtatggtgtcaacgcttatcgattctcgctatcctggtcgcgcataatcccactcggaggcgccgacgacccggtcaatgagcaagggatcaagtactaccaggacctggtagacgagctactcaataatgggattacgccattcgtaaccctctttcactgggatgttccgcaggctttggaggatcggtacgggggcatgctgaaccaggagaggttcattcctgactttgtccgctacgcgcgtgtctgtttcgaacgcctagggccaaaggtccgtcactggattacattcaatgaacctggtgtgtactcgctggcaggttatgcggcaggtgttcatgctcctgcacggtcatcgtttcgcgaactcaatgaagagggtgattcctcgacagaaccgttcatcgtcggccacacaaaactggtgacccacggccatgtttccaagctttaccgagaggtgttccaaccgcagcagaaaggaacaattggcatcaccctccatggcaactggtcggaaccttgggatgaagacgatccgcgggaccaggaagcagcagaacgggccagggaattcgagatcgcttggttcccggaccccttatacaagacaggcgactacccagcctcaatgcgggctcaactcggggaccgtctaccgcgtttcactcccgaggagtcaaaactggtactaggaagttcagaattttacggtatgaactcgtacacgacctttttcgtgcagcacaaggatacgcctccagatatcaatgaccacaaaggcaatgtcattgttcacgatacaaacagcaaaggcgtctctcgaggcgaagagtccgatacgccttggctgcggacggcacccactggatggcgcaagctgctcaattggatttggaaccgatatcatgtgcctatatatgtcacggaaaatggcacgacagcaaaaggagagacagctcccacaccagaggtactcatcgacactttccgtatgcgattcttcgaaggctacgttggtggattggcccgtgctgtcaaagaggatggagtggatatccggtcttactttgcctggaccttcaccgacaactggggtatgttcaagttccctttccctctcgaatctgactgacacagggtagaatgggccgctggctatactgatcgatttggatgcacgttcatcgactttgattctccaatgaagactcggtatcccaagcaatcggcatattatctgaaggctctgtttgagcatttgattgcttca

SEQ ID NO: 37093 - DNA, 618 bp, Aspergillus nidulans
tacaccagcaacggcggcgccacattaggcgtctcaggaccagatttcgccatccttgctggcgatacccgctcaacagcagggtacaacatcaacacacgctatgagcccaaagtcttcaccatccaggatgcccgggaccgctcgatcgttatctccgtcattggctttgctgctgacggacgggcgttgaaagagcggctcgacgcgatcgtagctatgtacaagtaccagcacggaaagaacatcggtctgcgggcctgcgcgcagcgggtctcgaccatgctctacgagaagcggttttttccctaccagctgcagacgatggttgccggtattgatgcagacggccaaggggccatctattactacgaccccgccggctgtattgagaagcggagccactgtgcggccggagaggcgagtagtctgatgctgccgttcctggacagccaagcaccgcggctacagccgttgagcttacagacggcccagcagctggtgcgggacgcatatacgggggcgacagagcggcatattgaggttggagatcacctacaaatgttggttgtaacgcgggaaggggttagcgagcagcttgttgatttgaagaaggac

SEQ ID NO: 37094 - DNA, 1256 bp, Aspergillus nidulans
aacccatctttcgtcctccgcgcagtcaaagacgtcgccttcgaggacagagttattccccctctaaaagacccctgggatgtgcgcgtccaagttgctcagacagggatatgcggcagcgatgtgcattattggcagagggggaggattggaggtacgccgcctgctgggccattctcaaaccatcagctgagctgtcgatacctagcttacaccggttaatgcagactttatcctcgagtcacctatcgtcctcggccatgagagctccgggatcgtgacggagattggatcagcggtcaaaaacctcaaagtcggacaaaaggttgctattgaaccaggggttccttgtagacagtacgtccgattcctgttcgtccgggggtttctcacctgaaaagaaaaaaaataaaataaaaaaagaaggaaagaaggaaagaactaatgtacatggtacagttgcgactactgtcgctcaggatcgtacaacctctgcccagacaccgtcttcgccaaaacgccaccccacgatgggacgctgcaaaagtactatatcacccaggcagactactgctacccgttgccctaccacatgggcctcgaagaaggcgctatggtggaaccagtcgcagtggctgtacagataaccaaagtgggcaatgtccggccgaaccagacggtcgtggtatttgggtcgggcctatcggtctcctctgccaggctgtgtccaaggcgtacgcatgcaagaaggttcataggggtggatatcagtcaatcaaggcttagactttgcacaggcgttcggcgcagatggggtctttctccctcctcccaggccagagggcgttgaggagacggcatggagcgagaaagtggcggcgctgatcaaggagaagttcgggctgggcgagggcccggatgtcgtcctggaggcgaccggtgcgcagagctgtatccagaccggggtgcatttggtcaagaaaggaggcacgtatgtgcaggcagggatgggcaaggagaacgtcgtcttccccatcacgacagcctgcatccgggacctgacgatccggggctcgatccggtacagcacggggtgctacccagttgccgtggacttgatcgccagtggcaagattgacgtcaaaaagctcattacgaaccggttcaggttcgagcaggcggaggaggcctttgagttggtgaagcaggggaaggacagtgtgataaaggttgttattcagggataccaggacaag

SEQ ID NO: 37095 - DNA, 1029 bp, Aspergillus nidulans
aaagggccgaccgcgatggtgttcctgaacatgggaggtccttcgacgacggctgaggtcgaagattttctaagcagactgtttgtgcgtttgtccagaccacacggattgttaagagcatatcctaacaagaacgtccatgatataggccgacggcgacttgattccccttggtcgtctccaaaactatctaggtccgctcattgcgaagaggagaacgccaaagatccaaagacagtatgcggatatcggaggaggttcgcctatcagaaaatggtcagagtaccaatgcgcagagatgtgtaaattgctggaccagctcagccccgagtctgccccgcacaagccgtacgtcgcattccgttacgctgcgcctttgacggaggaaatgtacgcgcagctgctagcagacggcttcggcaatgggaaaggtggccgtgctgttgcattcacgcaatatccgcagtactcgtgttctacaacgggtagttcattgaatgagctgtggaagtggaggacccgactggaaggaaagcgcgcaaattgcgacgtggatgcgacaggaactatccagtggagtgtcattgaccgctggcctacacacccgggtcttatcgaagcgttcgcaagaaatattgaagaccaactgaagacgtaccccgaggaaaagaggaacagtgtggtgttattgttctcggctcacagtttgcctatgagtgtggtcaacagaggtgagacgatgactttctactctgtacggccatatatctaacagattatcattaggtgatccgtatccagcagaggttgccgcaaccgttcacgcagtaatgcaaagactgaacttcagcaacccgtatcgattatgctgggcagtctcaggtttggaccgtctggcttggctcggcgcctcagaccagcgatacagtccaggaatatgttaagaggggacaaactgatcttgtccttgttccaaatgcattcactagcgaccacattgagaccctgtacgagctggatctggaagtg

SEQ ID NO: 37096 - DNA, 2027 bp, Aspergillus nidulans
cagggttttaaatcagtgagagatgctgtcctttttgccattgaagttagcgattcgatgcttcagccccgtccgtctgcagaccccaaaagacagagttatgagtcgcccgccacggctgcgttgaagtgcgcataccatcttatgcagcagaggattatctccaacccccgggacatgataggagtactgctatatggaacaaaacaatctaaattctatgacgaggacgagaatagtcgcggtgacttaacataccctaattgttacctcttcacggatcttaatatcccctcagcgcacgaggttctggaacttcggtcgctggttcaggatgaagaaaatgcgaagaaaatactcgaaccgtcaaatgagcctgtttctatggccaatctactgttctgtgtcaatcagatattcaccttaaaagcgcccaacttcttatcgcgacgactgttcatagttactgataacgacaaccctcacggagacaacaaatctttccgttctgcggcaactgtgagagcgaaagatttgtacgatcttggcgttacaattgagctgtttccaatctctcagatagagcatgaatttgacacctccaaattctatgacgtgagtacagttcctgcacgttcggagcactaaaactcacaacggataggatattatatacaaagcctcgcccaacgaccctgacgcccctgcctatctaaaacctgatgcgaagatgaatgatgcccaagatggtatctcattactcaacggtctcctgtcaagcatcaactctagatctgtgccgcgccgtgcgcagttctcaaacatgtccctcgagctcggaccaaacttcaaaatctcagtatcgggttatattctcttcaaacgtcaagagtcggcgagaagttgttatgtgtggctcggcggagaaaaaccacagattgcaaagggggttactacacagattgcggatgattcggctaggacaattgagaaatgggagattaaaaaggcatacaaattcggcggggaccaggtttgcttcacccctgaagaacaaaagtcattgaaagactttggcgaaccggtaatccgaattattggcttcaagcccttgtctacccttcctttctgggccaacatcaaacacccgttatttatttacccaacagaggaagactatgtgggttccacacgagtattctcggctttgtatcagaagctcttgagagatcagaaagttgcgcttgtctggtacattgcacgcaaagctgctagtccagttcttggtgcaatgatggctggtgaggagaaggttgacgagaatggcattcagaaaatacccccgggcatgtggattataccgctcccctttgcggatgatgttcgacagaaccctgaaaccgcccttcaggttgcgccagagccacttatcgatcagatgcgaacagtcatccagcagttgcaacttccaaagggcgtctatgaccctcagaaatatccgaatccatgtacgtgctgaatcaaagtcagaccgttcgcgaccctactaatcaccaaatagcacttcaatggcattaccgcatcctacaagcgctggcgctggacgaagatgtccctgagaagcccgatgataaaacaatacctaaatatcgacaaatcgacaaggtgagctttcttacccaacatattgatcatataagaactaacacttttttcagcgcgctggcggctacgtcttggactgggctgatgaattagaaaagcaatacgcgaagataaccgccgatcaacccaagagtaccacgcttgcgaaacgacctgcaaaagcagataacccagataaagccgctccgccggcgaagaaagtcaaggctgaagctgggtctggcaacatacaggatgaagtccagaaacattttgagcagcacacattgtccaagctcactgtggctaccctcagagatttccttgcatctcagggccgtgccactgcgggtaaaaaggcagagctgctggagcgggtggag

SEQ ID NO: 37097 - DNA, 1582 bp, Aspergillus nidulans
tctttcaaaagagcgcattgcgctatcagatatggtgtctttcggccctcctgagcggcttagggccggtgtcaggttcttttcgaagtctcgcccttcttacaataataaccaaaagcagaactcgtcgaccaaaagctcttttggatcccgactacgttttgctctacgaaataccaaggtcgaatggtatccaattccggttgggttgggaattggtctactaggtatactgcattattacaagtctcagcggaatgaacgaatacgacaagaaagggaagctgaagctgctggggaatcctttgatttctcgaaaccacccccgcggccaaagatccgacctagcgggccatggcaagttcagattatgtcaaccctgccattgaaggcaatgtctcgattatgggggcggttcaatgaaatagaacttccctactatttgcgcgtgccgggattcaagctatactcttggattttcggcgtcaaccttgacgaagtggccgagcccgatcttcacgtatatccaaatctggcagcctttttctatcgcaaattgaagcctggagtccgtccattagacccagacccgcatgctattctttctccctccgatgggcgtatccttcagttcggactcatagagcgaggggaagtggaacaggttaaaggcgtgacctatagcttagatgcgctcttaggttccgccactccatctcaggcagatcattccaagaagtttatggatcatcacaacgagccctcgcaaaaggatgccgccagtattgcggctgatgaacagtttgctaccatgaacggcatttcttacactttgccatctctcttttctggggagaccggaggtctaaggaaacgctcatcgtctaaagatgcgtccactgaatcccaaataacgtccgaaactctggtgcgagaagaccttgcccgtggcgatggcaccccttggtatgctccaaaacctacgtctaataatgctctctattacgtggtcatttacctcgcacctggtgattatcatcggttccactcccctgttccttgggtcgttgagagccgtcggcattttgcaggggagttattctctgtgtcgccgtatctacagcgacatctgcctggccttttcactctcaacgagcgggttgtgcttttgggccggtggcgctggggattcttcagctatacaccagtgggggccacaaatgtaggctcgatcaaaatcaacttcgactccgagcttcgaacgaatagccttctcaccgacactgcggcggatattgctgctgcggaagctgcacgacgtggcgaacaataccctggctttgctgaggctacttaccttcacgccagtcggacactcgggggccacccccttcaacgaggtgaggagatgggtggattccagttgggaagctctattgtactggtcttcgaggctcccatgggcacccgcaagtcattcgatgccggctggaaagagggccagcgagacggtgggttgaattggacgattgagaagggccagcgcattaagatgggtcagaaggttgcatacgttgatatc

SEQ ID NO: 37098 - DNA, 2170 bp, Aspergillus nidulans
  unsure (1)..(2170): unsure at all n locations
agccctcgggccccgaacggacagaggaaagtcggttcgagtcagcagaaaagtcaatttgaggaggaggtgctcgagaaactgacgcaagatatcagcggcttaaaagagaacaactcggaaaaggaccaacaatgggaacgaccgccgctcggtgagtttgaccctacgaaggacaatatctgtttccaacagattgatgcggaggagggtacaacgatgggaaaaccagctatcaggctgtttggtgtaacagaggtatggccctcgcctgctccattaccctctcatatttttctgacccccaaaaggctggccagtcagtacttctccatgttactggatttcagcactatttgtatattgccgctcctgttggttttacaaaagaggattgcgacccctaccgagcgttcctagagagcaagattgggcaatttcctcccgtcatccagtcagttcaaattacgatgagagagaatatatatggctttcaagggaacaagaagagctactatttgaagatcacagtgacggagccaagacatatctccaagcgccgaagtgctcttgaaacaaaagcccagacggtcaactacaaaggattgtggacaaatgctgatggtggtatactaaccttcgacaatattcaatacctgctcaggtttatgattgatacggatattcagggaatgtcatgggtcgaagcaccagcgggaaagtacgaactcattgctccccaggacaaggtctccaactgccagctcgaggcgcgcattgattaccgcagtctaatatcgcatgctccggttggcgactgggcgaaaatggcgcctttgcggatcctctcctttgatatagaatgtgccggccgtaagggaattttcccggaacctaatcacgaccctgtcatccagatcgccaatgtcgtcacccgctacggagaatcgaagccctttatccgcaatgtgtttgtaatgaacacgtgcagtttgatcgttaatacccagattctggaatttcaacaagaagaaaaaatgcttatggcttggcgggatttcatccaaaaggtcgatcccgatgtcattattggatacaacattgccaacttcgattttccgtatcttttggatagagcaaagcatctcaagtgcacaaatttcccttactggactcgactcaatggcatgcgatcggaagcgaaggacacaaatttctccagcaagcagatgggcaaccgcgacacgaaggcaacgaacaccaacggacgactgcaattagatcttctgcaactagttcaaagagatcacaatctgcgaagttacacgctcaactccgtctcgtacgaatttctaggcgagcagaaagaggacgtgcatcatacgatgattactgagctctataacggaacgccggattcgagacgtcgcctggcggtttactgtttgaaagacgcatatttaccgcaacgcttaatggacaagctgatgtgtcttgtcaactacactgaaatggcgagagttacaggtgtccctttcaatttcttgctctcccgtgggcaacaagtcaagttcctcagtcagctctatcggaaagctttgcaacagcaactggtcattccaaatatgaaatcaacggacgaacaagattacgagggtgctactgtcattgaacccattcgcgattattacgacgtgccgattgcaactcttgactttgcctctctatatccttctattattcaagctcacaacttgtgctacacgaccttactcaataagaatagtgtcgctgggatgaagaaggatgaagactacattgtcacgccaaatggtgatatgttctgtacgcctaaagtgcgaaaaggtcttctgtcccagattctggaggaattgctgagtgcaagaaagaaggccaagaaagagctggctcaagagacggacccatttaagaaagccgtcttgaacggacggcagctcgctctgaaggttagcgccaacagtgtttacggtcttactggagctactgtgggaaagttgccgtgtcttgccatcgcgagtagcacaaccagttatggtcgtcaaatgattgagaaaacgaagcaggaggtcgaggcgagatatcncattgcgaacggttattctcatgatgcgaaggtcatctatggtga

SEQ ID NO: 37099 - DNA, 1361 bp, Aspergillus nidulans
atggcggccaaatcacggttcacaaggctagatgccttcgcgaaaacagtcgatgaggctcgcatccgcaccacctccgggggaatcatcactatcgcctcgctgcttatcataatatggcttacgtggggagagtgggtggactacaggcgggtggcagttttgccggagctcgtcgtcgacaagtcaagaggagagaagatggagatccacctgaacatcacattccctcgacttccctgtgagctcacaactctcgatgtcatggatgtctcgggcgagcagcaggttggtgtcgcgcacggtgtgaacaaggtccgccttgcgcctgctgcggagggcggccgcgtccttgacgtccaggcactgcaactgtaagcggagtagcttccaatccatcagcctcccatagaaccccgctaacaggtccaagccacgccgaagaagccaagcacctcgacccagactactgcggtgaatgcggcggcgcgcccccacctcccaacgccatcaagcccgggtgctgcagcacctgcgacgaagtgcgcgaagcgtacgcccagaaacaatggggattcggcaaggggaccaacattgagcaatgcgagcgcgagcactactctgagcggattgacgcgcaacgccgcgaaggatgccggcttgaaggcgttatccgtgtcaacaaggttgttggcaactttcacattgcgcctgggcgcagcttctcctctaacaacgtgcacatccacgacatcgcgaactacgaggaaaggggtctgtcgccggctgagcagcacacaatgtctcatatcattcacagcctccgcttcggaccgcaattaccagacgagctctcggatcgttggcaatggacggaccaccaccatactaacccactcgatagcacgagccaagaagcacctgagcccgcttacagctttatgtacttcatcaaggtcgtctcaacatcctacctgcccctcggctgggaccctctctattctgcatctctccacgctgcggccgacacaaacaccccgctcggcgcgcaaggcctcagcgccggctcacaaggcagcatcgaaacacatcaatacagcgtaacctcgcacaagcgatctctgcgcggtggcgatgcctcagacgaggctcataaggagcgcatccacgcagcgggcggtattcccggcgtctttttcaactacgacatctcgccgatgaaggttatcaatcgtgaggcgaggccgaagaccttcactggtttcttgacgggtgtatgcgcaatcgttggtgggacgcttaccgttgcggcggctattgatcgcacgctttacgagggagttagtagggttaggaaattg

SEQ ID NO: 37100 - DNA, 1210 bp, Aspergillus nidulans
gggtaaaagaacaaaaaatacggtccgtggagaaaggcacaagaaaaacctccaaagaaaagccctaaggggttgatagaagccataaacccaatcccccaaggccttccgaaaagccctccacaaaaggcctccccaaaaaggtaaaaataaaaggtgggaaaacaggctaggctgtttcgtaaaggggatataaagcaggggcccaacaaaaaccttaaaagcccaagatttggttccgaccaaaccctagggaccgggcgacccctaaaggttcctaaaaacgggggaggatcttcgattaccttccaagctggaaatgaagacgtttccaacccctattacatcgatcaccagccagcccatgagtggaagatgcgcggcatcctggttgactggctcatcaaagttcacactcgcttcggtcttcttcctgaaacgcttttccttgccgtcaacattattgaccgtttcctctctgccgaagtggtcgccttggaccgtctccagttggttggtgttgctgccatgtttattgcttccaaatatgaagaagttctctccccccatgtcgccaatttcagccacgtcgccgacgaaaccttctctgataaggagatcctggatgccgaacgtcacattctggccacgcttgaatacaacatgagctatcccaatcctatgaacttcctgcgccgtatttccaaagcagacaactacgacattcaaacacgtactcttggaaagtacttgatggagattagcctgcttgatcacaggtttttgggctaccctcagagccaaatcggtgcagcagccatgtacttagctcgtctgattttagaccgtggtccttgggtatgctccgctaagtattaatcatccatgggatttcatacactaactgatgcataggatgccactcttgcccattacgctggctacaccgaggaagagattgatgaagttttccggttgatggttgactacctccaccgtcccgtctgccacgaagcattttttaagaaatatgcaagcaagaagttccttaagggtaaggtttttatcctgaatatcctgttcgtgcgttaacgtctgagcagcctctatcatgacacggcagtgggccaaaaaataccaccatctgtacattgacagcgcgctcacagagccgtacaactccatcaaagacaacgaatagagaaaagtg

SEQ ID NO: 37101 - DNA, 1183 bp, Aspergillus nidulans
tcagtctttgtcaaatacctcgaccaaaccaatatcagcaatgcgtatgtcagtggccttaaaggagatttccggctttaaggggatgaactgaattactccaatgtctgctattacactgcgtatgtggtgttccaggtgccagggttgctcctactatcaagacccaagctgtacggcctgttttcgaccttttgagtgttgggactattttgaccatggattgtagagcgcgctggcttcttcccactcttgagatcctctggggaagttgcaccttcgcccagagccgcgtcagaaacgtgcatcagctctatgccttgcggtttctggtaggcatgttcgaagccccagtcttcgcagaaacgcacttcatcttgggtaagttccaactctggtcattactggatacaagtttgacaggacaaatcaggctcttggtactccggctccgacctattcaatcgcgccgggacctggttcatctgcaatccacttagccaaataataagcgggtatctccaagcagccgcatacacgaatctctcgggagttgggggaatgccagggtggaggtggctctttatcatcgacggaattttcaccattcctgtggcactgatcgggtttcttgtttttcctggcgtacctgactctccagcgcctttcttcctgacgaagcgagatatcgagattgcgaaggattggctgagcagagcgaagattcggcgaccggggagtttggggcccgacgtgttcaaaaggaccgcgaagcgctggcatatttatatcttcttgttctcctacgcgtacgtcttcgccaaagataccaataaaggaagataagattggacattagctaacaagaatagttgcatgatcctttcatcctacccaagcagctacatgaatctctggttgaaggatgaagggtactctgttacgaaaatcaaccagtatcccaccatcatccaaacaatcacgattgtctcctcgtggctcggaacgactctggcttcaatctatccttcgtggattatctacaccatcatctcgacgttttcgttgttttcgaccctctgcatgtgcatctgctgcatcccgacaggcttgaagtatgttccgctttcctgcctgtcatggacagcaaaatgcatagcaatggaattgggccgtagctaaa

SEQ ID NO: 37102 - DNA, 839 bp, Aspergillus nidulans
atgtctaaccttcccgttgagcccgagttcgagcaggcctacaagggtacgaccaccgttaatgaatggccaatgatcacagctaatgttggcgcgcagagcttgcgtcgaccctcgagaactccaccctctttgagcagcaccctgaataccgacgggctctccaggtcgtctccgttcccgagcgcgttatccagttccgtgtcgtttgggagaacgacaagggcgaggttcagatcaaccgcggttaccgtgttcagttcaactccgctctcggtccctacaagggtggtctccgtttccacccctccgtcaacctttctatcctgaagttccttggcttcgagcagatcttcaaaaatgctctcacaggacgtgcgtaaccgttacttcattggatgtttgccaagagtactaattggtattagtaaacatgggtggtggcaagggtggttccgacttcgaccccaagggcaagtctgactctgaaattcgtcgcttctgtaccgctttcatgactgagctctgcaagcacatcggcgcggacactgacgttcccgctggtgatatcggtgttactggccgtgaggttggtttccttttcggccagtaccgcaggatccgcaaccagtgggagggtgttctcactggcaagggtggcagctggggtggtagcttgatccgccctgaagccactggatacggtgttgtctactacgttgagcacatgatcaagcacgttaccggtggaaaggagtccttcgcaggcaagcgtgtcgccatctccggctccggtaacgttgcccagtacgccgctctcaaggtcatcgagctcggtg

SEQ ID NO: 37103 - DNA, 3319 bp, Aspergillus nidulans
gcaccagatcgttttcttgcgatattcgccgacgtttgtccgactgctgaaggcgatcttctgaatcccgaagatatatcgttcttcctaatgcaatgcaagactccggggcgaaaaccggtgaattttattccagcccttgatgatgactttgagttttacttcaagaaggactctctgtggcaggccgaagacgttgatgcggtgctagatcaagacgcggagagagtgtgcatactacatggtcctattgcagccaggtactccaagtccgacagcgaaccggctggatatattctggactccatacttaatggagttgttgcccgtttacgcgaaacctctacggcagagatgctgcttcccaaactggaaaggggccataccacgccagcgtcatggtcaacgttatcattgaccgaaagggacactagtgaggaaacctcagatacttctataacttccttgtcagaactcatagaaaaccactctttctcttcaggaggggtcgatagcgttcccaggccgagtcatccactttggatgcgagccctactggaggatgatgtggtattgcaggggacattgcgtcaaaaaaaccctttccgagatcttatacaaagttcaccgaacactgttgtgaattacaatcaggactcctcagagttaatggtgactgcgcaggagccataccacatatcgtcatttatgagagctgtttgccacgatggcgtcgacattcaaattgatattagctcaccaaaggggtcagagcctttgaggctactctacaagttcagcgacacgaataatatcaggttaagcgaggttatggataagcgcaacgagcgtatcaagtcattttacagcctgttatggtttggccatgactgtgacacaagtcaatcgctcaatggtgtcttttatgggccagatataacgctgacagaggatctattggacgaatataatgcgactataggcccggcttatagcgatcaccggcagatggtccctagcaccgatgtcctaccaataagcatgggaataatcatagcctgggacgttatatcgcggccactaatacttcgtcagattggaggcgatcttctacgcttggttcaccggtcgaacacgtttgagtattattctgatacgcgcctccgactcggtgatagcgtgagtagcaggtcggaggtccaggcggtttacgatgacgatggggggagggttgtcatagtagaagcgcagatccttcggtcccgagtaccggtcatgacagttacttcgactttcctgtttcgtggctccaaaggcacgactgttcctgcatttcgaagagcaagagagcagaaatggacttacgacgtgacgtccgaattcgaagaatccatactcttgagcagaaattggttcagaccgtgcgatccttctctaacccttgtcgggaaatccatgattttcgatctcaacagcctggtcaaataccatgacgatggaaatatggagttgcacgtccaaggcactgctatgtctcagacaaatgggcaacaacaaaaactagcgatcgtagatttcaggaacacttgcactggaaatccagtgctggactttctccagcgcagagggaaactggcagaaccacgcactgagtttaagattcctggctgggccggaaagtccaccatggatatccaaatgcctccgagcaacgagccgtacgctcaactttcgaaagacttcaatcctattcatacgtcccccatattttccagtttggccggggttcctgggacactatgtcacggcatgtgtacctccgccattgcggagagggtcctagagcatttagggcttggaggtgaccgcgagagactccgccggtttgaggcgaggttcactgatatggtgatgcctctagaaaagctcgttgtggagatcaagcatacaggaatggtcgatggccggatgtgttttagcattctcgccaaacggaaagaaactgacgaacgagtgcttgagggtgatgcggaagtagaacagcctaggacagcatatctattcactggccaaggaagtcagagcaaaggaatgggcatggacttgtacaagacgagttcagttgcaaaggctgtatgggatgagattgaccagcaactttacaatgcctacggtatgttttactcaaggtactggtcaattcttgctaaccaataagggtggtctgttctggacatcgtgcaaaacaacccaaagtcccttaccgtacactttggaggtccaaacggtcgcaggatccgccaaaagtatctcgatattactacagaagtcgtccttccaaacggaaaacgagtccaaaagccagtattccccggactaacacctacatccacatcctacacgtttaggcatccacgagggctgctctactcgacgcagttcgcccagccggcgatcctactattcgaggccgccgcgtttgccgaactacgtgccaagggctacgtgtcacacggtgccgtgtatgcagggcattcgctcggagaatttggagccttgtccgccttgtctcggtccgttcctacgggggcgttggtcgagctggcattctaccggggctcggtcatgcaggcttccgtggcgagcgacaacgacggagggacaacatacggaatggttgcgatgaacccgaagagggttgggacatgtaggtttcaggctccctttggtcgtgatgcgagagctaagattgtaagtctttacccaaactacgctggatcgcctagttagccagatcgcggcccaaagccaagaactactcgagatcgtaaatttcaatatcgagggggagcagtacgtctgctccggaactgtaagtcgcctaacctgtacgagactcttctaacaattaaaggccgcgaacttgtacgttcttggaagattgatcgaccaattagcggaggcacctggccaagcttgtctggctgaagaacagaacgaactacagcctatcatcgactcgcttctcaccaaagcaaaagcgcttccacgtccaatccaacttcagcgcggaaaggcgacagtcccactagaaggaattgacgtaccattccactcaagccttctgcggaacaccgttgatcggtttaggcagtgtctcttgcgtccggggttcttggtggacaatattgacgtggagcagctagtgggcaagtacatcccaaacgtgatggcgaggcctttttcattagagagggagtatattcaggaggcgtatgagttgacgggaagtccgattctgaagaagatgctagctgag

SEQ ID NO: 37104 - DNA, 1761 bp, Aspergillus nidulans
gatgcagacgacacggcgaaggctttgatagcctttcaactccggggaagacgctattcgccgcaagcgttgattgatcaattcgaacgagaacatcattttacgacatacctatacgagacgcacacgagcgtaagcaccaatgccaatgttctgactgcactggtgttgctctcagacgatggacgctaccaaccacagatcgaaaaatgcatccgctacctctgcgaggcatggttccactgtgaccgaatggtaaaagacaaatgggtatgttgagctctatcaacggaaaggattctgcttactgaatgctagaatatctctccttattatccaacgatgctgttgtgcgagggcctgatgtcttacattcatcgctggagcgaagggcacctggctgcattgcctgacgaattgatgaatttccaacttcccattacgttgtttcaggccctgatccgaacattgcgcactcaaaattcaaatggatcctgggggagctcgaactctgctgaagagactgcatatgctatattaatcctgaaaaatgtggcatcctttaacttcactgacgagatatcggccgagctcgagagtgccatccggaaagggatccagttcattctctctaaaagccaacggtctcagacagatgaccagctttggctggacaaaaccttgttcgccataccaactgtatcggactcgtacatcgtggctgctgtgcaggctgaggctactgactttgtgtctggcgatacactaaataagctcgtcgacacgtcaacaccgacggtgcaaaaattgacatcatactttgctcgactaccatctcagacagaaacaccgaagtgggtgatccaggcttccgttatagagggaatcctcttcagctgcaggttgaagacgttggacatcttttcgactggaaaagccctcggcgacagatatattaaatatgccgccatcttttggacactggccaacaacgcacgtcctgagtatcttctcagtacgtcggtgatctatagcatggtggaactttctgttgggatatttcaggaagacgaagaaatggagaagtccttggtcaacctaccggatgctgctaccgacgccgtagctgactatatcgataaatcgtgccacgagacagctttttgcaacaatgtcgcttcccacgcgacaccgcatggatcggatatctctggatatgatgtagaaactcgaactcaactcatgaccatccagcacaacataaggctttggctgcgttttgctttggtagacaacctcccggcgaatgccaattcccatgacatatacgatctcaagcaagaagtcaagatggcaatgattgctgctctacaacaagctaaagcacacaaattcctcaacagcagccaaacattctacgcttggctccacacatgtgccgtccacgacgccaaaagcgctgtcgtctccaagtccctgatttgcaagatcgggcacgggtcaaatgtcttccgcacagccaaggaaaaatatctcgccgaaaggttatggcggcaggtttccatagagggcagactttggaacgatcttgggagcattgagcgagacagactcacagcaaacctcaattcggccgactttctcgagtccgggccagctggtgatgtgtgggaacagctagttcagctcgcggactttgaacacaagtacgctctactgtgcttggacaacttgacgcagctcctggaagcatccggccgc

SEQ ID NO: 37105 - DNA, 684 bp, Aspergillus nidulans
tctgttcttctcggctacgccccctcggccgcatccttcttcatcgtctacgatggcgtcaagtgctccctatcaacgaacctcgagtcacagtcccgcagccatacaatcctcgcacagtcgcttgcgtcgtcgatgggcgagattgcagcatgcgcaatcagagtgccaacggaggttgtcaaacaaagagcacaggctggccttttcggcggctcgagtctgcttgccctaaaggatatcttagccctgcggcatccagacccgacgagaggcgcaaggggtggctatggacaggttgtacgggaactgtaccgaggcgcggggattacaattgcgcgtgagattccattcgcggtcctgcagtttagcatgtgggagacgatgaaggaaacatatgctagacggaggcagttggaagggccggtgccggcgtccacgagcgcaatctttggaagcattgccggtgcgatctcggctgggttgacgacgccgctggatgttatcaaaacgcgggttatgctggcgcggcggggcgatggtgcggagggcaaagccggggttcgacttagggaagtcgtgcagggaatctctgcggaaggctttggcgcgttcttcaggggtatccagccccgcgttgcgtggatcggtattggaggtgcagtgttcttggggagttaccag

SEQ ID NO: 37106 - DNA, 935 bp, Aspergillus nidulans
tggcgcttaaccgtggagaatggccatgaacgtttgagatgggaatatctcaagacggggaaggaacgaacagcccagccacaggatccagcgtcgcgattctacctcaatctcccaacggtgcgttcccctgtccacgtcttggatgggttactgacagtgacaagtctatcccaggttgcgcacgcgccaaaacgccctcggccgccgtgctgaatggtgccctgtatcacagccaggttcaagtgaaagagctcggctgttgggcagccgacctgagctgtatcttcttcgtaacgcctatgcttattattgcctggtatatcacacaagcagtcatcgatgaagcatacgctgttgagctcgtgaactttatattgggagttcagaatgcggacggtggctggcccacatatagcggcgaaagcactacgcttatggggacgattcttacctatgtcgcattaagattgatgggactgccggcggatgaagatcacttggtcaaggcgcgcctctatcttctcaagatgggtggcgccgtttatctctctggctgggccaagttctggctggctatgttgggcttgtataaatgggaaggcactgacccctatcctgttgagatgtggctacttcctgaatggtttccaatcagtccctggaaatggtacatcattccgcgacaggtttatctggcgatgagctacttgtccgcgaaacgattcactatgcccaccaacccactacttgacgagatccggaaggagatctttgtgcagccatatgagaggatagacttcctcgcctatcgcggtgtcagcctgcagtgctctcgggagctacgcaagccctggccgctaatattgctgaattggatcctacagaatatctggatcccctggctaccggccatattgctcgcggaggaaagg

SEQ ID NO: 37107 - DNA, 1299 bp, Aspergillus nidulans
tcattcaaggccctgaatgtggcgccgtggttggttggctctttgaccaccatggcagtgcgcaagccgaccgctatccagcgggcttgtattccggagattttgaaggggagggactgtattggtgggagtcgaacaggttccggaaagacgattgctttctcggtgccgatcctgcagaagtgggcagaagatccttttgggatttttgcggtgattttgacgccgactcggtatgttttcctcctcataccaaccgggacaaaaagctaattgtgtagtgaacttgcgctgcaaatcttcgagcagatcaaggcgatctccgcccctcagagcatgaaaccggtccttatcacaggcggcacagatatgcgctcgcaggcaatcgagctcgcaggccgaccccacgtcgtcgttgccacgcccggtcgtctagcagaccacatcaacacctccggtaccgacacagtcgcgggcctcaagcgcgtccgcatggtcgtcctcgatgaagcagaccgccttctttccccggggccaggaagcatgctcccagatgtcgaaacctgtctctccttcctcccgggcccctcacaacgccaaaccctcctctttaccgcaacactcactcctgaagttcgcgctctgaaatcaatgccccaaacgcccgggaaaccgcccatcttcgtcaccgagatctccacagaagctaaagataccgtcccccccacgctgagaacaacatacgtccaagtcccgctcacccaccgtgaggccttcctacatgtccttctctccaccgaatcaaatatcaccaagtccgctattgtcttcacaaacactaccaaatcagcggacctccttgagcgcctcctccgctcattaggccacagggtcacctctctacactccctccttccgcaatccgaacgtaactccaacctcgcgcgcttccgtgccagcgcggctcgagtcctcgtcgctacggacgttgcatctcgaggtctcgatattccctccgtcagcttggttgttaatttcgaggtccctaggaacccggacgactatgtgcatcgtgttggacgaacggcgcgtgctgggcggactggtgaggcggtaacgcttgtggggcagcgcgatgtgcagctcgtgcttgcgattgaggagcgtattggcagaaaaatggtagaatatgaagaggaaggggtcaatctcgaagctagggttgccaagggttcgctgctgaaggaggttggggcggcgaagagggaggctatggttgagattgatgaggggaggggt

SEQ ID NO: 37108 - DNA, 879 bp, Aspergillus nidulans
gaagcagaggtcgtccttgtatcaaacgacgatttcttcactgctcttcccaaaatccagccatcttccaaacgggagggctttgccaccattcccgacacaacttgggcggacatcggtgccttaagcggtatccgcgatgaactcgcaaccgcaattgtggacccgatcaagcatcctgaactctacgctagcgtcggcatcacagctcctactggtgttttgctctgggggcccccaggttgtggtaagacgctcctcgcaaaggccgtggccaatgaatcccgagcgaacttcatcagtgtcaaagggcccgaacttctcaacaagtatgttggtgaatctgagcgcgccgttcgccaagtctttgttcgggctcgttcctccataccatgtgtcattttctttgatgagcttgatgccttggttccacgccgcgatgatactctttctgaggcatcagctcgcgttgtcaacacccttctcactgaattagatggcctaggtagcagccgccaaggcatctatgtcatcgccgccacaaaccggccggatatcattgaccccgccatgctccgacccggccgtctggaaactcttctcttcgtaaacttaccatcacccctggagcgcgttgaaattctgcagactctcgtgcgcaggctgccaattgagttcaatgaagatctgcggcgtctggcggaggagtgcgaagggttcagtggtgcagatcttaccagtctgttgcggcgcgctggatacaatgctatcaagcgtcgggatactatcaaatttgatgactttgttgctgccaagtcattcattcggcctagtgtgacggatatgaagaagtatgataagttgaggagggagtggagt

SEQ ID NO: 37109 - DNA, 1441 bp, Aspergillus nidulans
tcccttcctccggtctatatcgtgtcttacgctcgtactcccgtgggctcatttctggggtatgattatgcggtccaaggatttcatgagaggagatgctaacacatgatccttcccgtaggtctctttcaagccaaactgccccgcagctgggttcgcatgcaatcaaaggtatatgccatatctagctcggccaccaaaggcgttcttgactcaccttcatttagctgcgcttgaaagagccgatgggatcaagccttccgatgtccaggaagtgttctttggaaacgtactctctgcaaagttagctcgcccaataccatgtccatgagcgttactgacccctttaatagtgttggccagaaccctgctagacaatgtgcactcggtgctggtcttgaaacatcaaccgtttgtactactgtcaacaaggtgtgcgcctcgggattaaaggctgtcattcttggagcccagactatcatgactggaaacgcggatgtcgttgtggctggtggaactgaatccatgtcgaacactcctcactatcttcccaatcttcgtactggagctaaatatggcaaccaaaccatggtggacggcatcgtgaaggatggcttgacggacgtgggcaagcaggagctcatggggctacaagcggaagagtgtgcgcaggaccacggtttcaacaggcaacagcaggatgattacgccatccgatcttacgagaaagctcaagctgcccaggctgctggtctttttaacgatgagattgctcctattgatctacccggttttagaggcaagcctggtgttactgtaactcaggatgacgagccaaagaacgtaagacttcaagctgtcactctatacgtatacagctgctcacctactttaacagctcaaccatgataagcttcgcgctatgaagcccgcttttatccctggcaccgggacagtgacagctcccaactcgtctcctgttaacgacggagctgccgcagttgttttagtatccgaggccaagttgaaggagcttaacctgaagccggtcgcaaagattcttggctggggtgaggcggcacagcaacccagcaaatttacaactgccccagcactcgcaattccaagggcgctcaagcatgccggtgtctctcaggatgcagtcgatgcattcgagattaacgaagctttcagtgtagttgccctcgctaacttgaagctccttggactttctgaggacaaggtcaatattcacggaggagccgtggctatcggtcaccctcttggtgcgagcggtgcccgtatcctgacaactttactcggagtcctcaaggctcggaagggcaaggttggctgtgcaggtatttgcaacggtgggggtggtgccagtgctctggttgttgagtacatcgcttgataaggtcatttgtgccttgacact

SEQ ID NO: 37110 - DNA, 1633 bp, Aspergillus nidulans
cactattgattaggcttcatcatgaagttccctaagatctacaacagtacttcgtggctttcatcgccacagttggcgggatgctctttggtttcgatatctcgtccatgtcagcaatcatcggtactgatcaatacaatgactacttcgacaacccctctggacttcgtcagggcgctatcgactcttccctcgctgctggatctgtagtcggttccgccattgcaggttatgtctccgacaagattggtcgccgcgactcaattgcgttcgcttgtatatggtggcttgtcgggactgctgtccaaaccgcgaacaacggttttgggtccttgattgcaggtcgggttttaaatggagtctgcgttggaattaccagttcacaaatacatgtctatcttgcagaaatcgccaaaaaggaaaagcgtggacagccgatcgtcagtcagcagttggccattggtaaggctttggtctaccatcaatgaatccgctcttcaattaactaaagctgctacagaatggggtattctgatcatgtactttgtcggatatggatgcagcttcattcccggtaccgcctctttccggaccgcctgaggaattcaatttgtgccctgcgtctttctcatagttggcctgccattccttccgcgatctcccagatggctcgcgaaggtcgaccgcaccgaggaagctattgcgactttggccaacatccaggccgacggcaatcgtgatgacccgcttgtcgttgccgagtgggaggagatcacgatggtgctacaggcagagcgcaacgcgctaccagggtggcgcaagttcgtctacaatgtatggctatctaggttgattatctgaatagagcgtgttaacacgatggcagggcatgtggaagcgcaccctcgctggctttacagtgcaaatgtggcagcagaactccggcgctaatgtgatgacctatgtaagatcttccttgacagtactgacatccaaaatctaacctggcgcagtatgtcgtgtacatcttcatgatggccaatttaaccggcaacatcaacctcatctcctctggtatacagtacgcgctcttcatcatcttcacgaccttcatcttcttctacatcgacaaaaccggtcgtcgtccgctcctgatctatggtgctctcattatggcactctgccattttgtcgttggcggcattctttcctctggcgagtacgtccccggcggtgttgacggcaatggaaatgtgttgatccgagtaacgggccaaagtctcacaccgttatcgcgttctcctacctcctgatcatcttctacgctctaaccctcgcccctgtctgctgggtctacgccacagaagtgtggtccctagaaacccgtgctacaggcatgggtattgctgcgattggtaattggctcttcaacttcgctctaggtctctacattccgctaggattccagaacatcacctggaagatgttcatcgttttcggtgccatgtgtgtcctcgcagctattcatttcttcttcacctaccccgagacctgtggcaagacccttgaggagatcgaggagatgtttgcgcctggaggaccgaagccttggcatacgaagcctggtggctcg

SEQ ID NO: 37111 - DNA, 1318 bp, Aspergillus nidulans
  unsure (1)..(1318): unsure at all n locations
atgcagttgaaagataagtctttgtttattcagaaagccttcgtcaatggtgaatgggtagatgcggaatccggaaaaacattcgaggtccacggtatagagccccaaatagcctatgaatctggcgatagcgcacatcgatgctaatgggtggtatctcgatgttttgacagatcctgctacgggaaaacttattggaacatgcccggaatttagcgcatctgacacagaganagccatccaggcggccagcgcggccttccctaagtttcgtgcaactttcgcccgtgagcgagctcgcatgctccgacggtggtaccagcttatggtagacaatgccgaagatctggcaacacttattacgtgggagaacggaaagccgctcgcagacgccaaaggagaagtgaattacgccgctagcttcttcgaatggttcagcgaggaggctcctcgcacctacggcgacactatcccggcttctgtacctggtaaccgcgtaatcaccgttaaacagcctgtcggcgtttgcggtctgattacgccctggaacttcccagctgccatgatcacacgcaagattggacctgctcttgctgccggctgcactgtagtcacaaagtcaccgggagagactcccttcactgccaacgctctcgcagaactggcaaaccgcgctggtatccccaagggagttgtcaatatcgttacagccatgaagaacacccccgaagtgggcgagatgatcaccacacacccagacatccgcaaggtctctttcactggctcaacaaacgttggcagactcttgatgaaacaatcatcctcaactatcaagaaggtctcctgggaactcggcggcaacgcccccttcatcgtcttcgacgacgtcgaggacctcgatgccgctgttaccggagcaattgcctccaaattcagaagctccggtcaaacttgcgtttgcgctaaccgaatctatgtgcaaaagggcatttacgacgaattcgtccagaagtttgtcgagaaggtcagaaacttcaaagtcggtgctggcttcgaagatggtgttacccacggcccggttattcatgatcgtgcagtcgacaaggttgaccagcacgttcaggacgccatctcaaagggtgccaagcttattgctggtggccagagacgttctgacttgggtcccaacttctatgaccttacagtccttgcgaacatgaccaaggatatgaagattgcctcggaggagaccttcgggcctgtggctggactgttcccgttcgagactgagaaggaagttgtcgagctggctaacaag

SEQ ID NO: 37112 - DNA, 621 bp, Aspergillus nidulans
  unsure (1)..(621): unsure at all n locations
caagtctacttagcatcgaatgtgcaacctccccgcggtgtattgttgcatggtccgccaggatgcgggaaaaccatgattgctaacgccttcgctgcagagctcggggtgcctttcatatccatatccgccccgtcaatcgtttcaggaatgtcaggtgaatctgaaaaggcccttcgagagcactttgaagaggccaaacgattagctccgtgcttgatcttcattgatgagatcgatgccattacgccaaaacgagaaaactcacaaagagaaatggagaaaagaattgtcgcccagcttctcacatgtatggacgacttggccctagaaaagacggacggaaagccagtaatcgtcctcgcagctacgaatcggcccgatagcctagacgcggcactgcgtcgaggaggcaggttcgataaggaaatcaacatgactgtgccttcgagccggttcgcgagcagatacttcgtgcactaacccgccagatgcgcctcgntggacgacttagacttcaagaccctagcatagagaacgnctgggttcgttggcgccgatctgaacgacctggtttctactgcggggctcacggcatttaaaagataccttgatctactn

SEQ ID NO: 37113 - DNA, 973 bp, Aspergillus nidulans
ctatacaataaagtcgccatcgtgaccggcgcatcctcaggcctcggtcgagctatcgctacccgatacgctcgcgaaggggccaaagtcgtatgtgctgatgtatctccaacagcgcgatcgctcgaggagtccgatatcaccacacacgacttgatactgaaacacggtggagaagcgctcttcatccagactgatgtcggcgacgcggctcagatggagagtctcgtcaaagccacggtccagcactatggccgactggatatgtaagtatccactggacaaactaagctcgaattaagtgaacttgactgaacatcagggagccttgtcaacaatgccggcataagccttgaggcccgcaaaccggcagtgctgcatctcaccgacgaagaaacctgggatacgaccatgcgcgtcaacgcaaagtcggtgttcttgggatgcaagtatggtctcgcgcagatgctgcgacaggagccgcatccctcgggggatcgggggtggattgtcaacatctcctccattatggggatgattgtcggaccagaaaatcgtacgtcgcgcccgtttccgggttggattgcccactagtgagtgatgctgacgaaatgtgtactcagcttcctattgcgcatccaaaggcgccgtcagccaactaacccgacagatcgccctggattacgcgcctcaccggatctatgcaaatgctctctgtcccggatgtaagttctacattttcaatactaccttgtaatgctgaagataagctgaacgcgaggtagatacacaaactgcgatattcaaagagacgacaacccacttaacgccgtgggaggatttgaatcggcgacatccactgaaggggccgggattgccggatgatgtggctaggatggctgttgttctggcaagtgaggacgcaagctgggttactggggtctgtttgccggtagacgggggatatactact

SEQ ID NO: 37114 - DNA, 2338 bp, Aspergillus nidulans
ggaaaatcctctggttttggaaaaaaaggtggccaagacctccctcctagaggaaagtggaatgtccactcgaagcccgtgaattttccacctataaatatacccagcgaacgacatgacaaaccagagaccgacgaggtccacgttcctcatacagctgccagtgtggccgggcaaaacgagtgggcggaatttcatcatcaaccgggccgaaagtttgacgacttcgctcttgtgaaacaagagatcgaggctgagacagcgagaatagccggaaataacaagggcatcaatcgccagccgattaacctcaaaattttttcgccgcatgtgctcaacctcactatggttgatttgccaggcctaactaaagtgccaattggggatcagccatcggatatagaaaagcaaactcgtgccctaatactcgaatacatcgcgaaaccgaacagtataattttagctgtttcaccggcaaacgttgacctggttaattccgagtctttgaaacttgctcgccaggttgaccctatgggacgaagaacgatcggtgtcctaacaaaattggaccttatggaccatgggacaaatgctatggacatcctatccggccgcgtctatccactgaaacttggctttattggggtggtcaacaggtcccagcaagatattcaatcgggcaaatctctctcggaggccttacaggctgaactcgatttttttcgacaccatccagcttatcgaaatatggccaatcgatgcgggaccgaatttcttgctaaaacccttaattcgaccttaatgtctcatattagggatcgactaccggacatcaaaggctcgttttaacacactgatgggtcaaacgcatgaggaactcgccagtacggcaacaagcagttcagcgggaaagaacatcgaggatctcttatattacagcttatgacgaggtttgcttcctcctttatatcttcaattgacggaacttcatcggaaatatccacgaaagaattatgcggtggtgctaggatatattatatattcaactctgtcttcggcaactctcttgacacgattgatccaactcaaaatctttcaatttcagatatcaggactgctatccgtaactcaacggggccgcgtccaagtctttttgttccggagctcgcttttgatcttctcgtgaaacctcagatcaaattgcttgaaccccctagccagcggtgtgttgagctggtttacgaagaacttataaagatatgccacacttgtggctcgcaagagctgttgcgctttcctcgtctccaggccaaactcattgaagtcgtgtctgacctcctgcgcgagaggctaggtccctgctcctcttacgtggagtcgttgatatctattcaaagggcctacatcaacacgaatcatccaaatttccttggtgcagccgccgcaatgtcgtcaattatccaaagcaaacaggaccaagagaggaaagccgcgctcgcggaggaacgacgcaagcgagagaagagacgaatcaaggaactcggtggtccaaacggaaacgcaccaacacatccggaagacgaggaagagcaaccggaaaccaaaaaccttcccatcaggactcaatctagcaaagggacccgcagcatgtctcctcatattggaaaaatatcagacactggaatcacggcaactttgaacgggacgcattcgaatcctccaaccggctttggcggtgctaataccacccgcgattccttcctgaactacttctttggcaaagatggtgcccagccccaacttactacctcagcctctcccaatcaaaaccaaactaggcagtccatccatgaggtcaatgtgagctcaaacgctcgacgcaccgagatgctttctccggtggatgattataccacggtgcccgaatataacgaagcgagttctgttgtaagtatctgttcccaattgtatatgaagcactctattgacacaccacgaaattgtctagttgaaggacgattctgagccggcaatatctgagcgagagctcatggagacggaattgattcgtcggttgatctcttcatatttcaccattgtgagggagacaatcgccgaccaggttccaaaagctattatgcatcttcttgtcaaccacagtaaagatgttgtgcagaatcggcttgttagtgagctctacaaggaagagttcttcgctgagcttctatatgaggatgatggcatcaaagccgagagagagaagtgtgagaggttgttagaaacatacaaagcggcagcgaaaattgtcggcgaagttttgtaaacataacgcctgtct

SEQ ID NO: 37115 - DNA, 2300 bp, Aspergillus nidulans
ttttatgaagacggaggtgacccgaaacaaatcaatcaagagataaagcagttgctggaaactatccgacccgatgccgacctttcagcgaaagaccgcgaaggaactccggcggcactcaagtacccattgttagatcaccagaagctgggtttagcctggatgagatccaaggaagaatgtgatcagaagggaggcatcttggccgatgacatgggtctaggcaaaactattcaagcaattgctcttatggtgtctcgtccgtcaagcgaccccgagcgaaagacgacattaatcatcgctcctgttgcattgatgcagcagtggaagcgggaaattgagaagatgctttccccgggtcatcgtcttcaagtgtacattctacatggggacaaaggccgaacgagtttcagtgacttgaagaaatatgatgtcgtgctcaccacatttggaatgttggcttcagagctcaagcgtgtaatcaaatacgaacagctactcaaagacggcgctgaggagccaacgctgaccagacaatacctgaaaacgctaccttgccttggacctacgagcaaatggtatcgggtgatcattgacgaagcccagtgcatcaaaaaccgagctacccagtctgccattgcttgctgccgactgaatacgacctaccgctggtgcatgagcggaacaccaatgatgaacaatgtcgaagaattgcattctttattgaaatttttgcgaatccgtccttacgctaacctggatcgtttcaagagagtgagtggtttagttttcccggaatttccgctacgtatcgcagactaattgaggccaattaggacttctctgcaccgttgaaaaccaacaacaagcacctccaagagaaggcgatgacgcagcttcgcattctcctcaaagcagttctactacggcgcactaaacattcaaagatagatggcaagcccattttcgacattccccctcgattctcggaaaaggtccatgccgtttttagtgaagatgaactggaattatacaaagcactggaagcgaaaactcaacttcaatttaacagatatctcgaggccggaacagtggggcgaaattattccaacatccttgtccttcttcttcgtcttcgacaagcctgctgtcatccgcacttgattactgattttagtgtcaagctcaacgaggcttctgaaggagtcgatttcatcgccaacgcagagcaatttagcaacgaggttgttgctcgcttacgggataatgagaatcttgagtgcccggtctgtattgatgcagtggacaatccaatcatttttttcccctgtggacatgggacatgcagtgaatgtttctctagaatttccgatccgtcgctttccttgcagcaaggcattgatggagctgcgcaagtgaagtgcccaaattgtcgtggagttgtcgaccccaagaaaataaccgatcatgtatcttttcggaaagttcattttcctgatgagtctgaggattcagctggtctggggggcttggggattgcgattaaggaagacggggaccgtgacgataccgatgacagcgacgagggcgcaactttgtccgattttatttcgaatgacagcgactgtgacttaacgcctcccaagagaccgaaagtaagaagcaagggcaaaggcaaaggcaagcccagaaagactcttgccgagctgaagaaagaagcctcgaaaaaccaggaatcgaaacgcaagtacttgcgtcgcctggaaaagacttggattactagcgcgaagattgagaaaaccatggagattatacgcgatattgagcgccgggacaacaatgaaaagatcatcatctttagccagtttacttctctactggatctgctcgagattccaattgcgcgtgaaggtcaccggtatcgtaggtatgatgggagcatgaagccagcggatcggaactcggccgtgctagactttactgatgaccccagctgcaaagtcatgctggtgtctttgaaggcaggcaactccggtctgaatctagtcgccgcaaaccatgtgattatttttgacccgttttggaacccttacgtcgaggagcaggcggttgaccgtgctcatcgcattgggcagttgcgagaagtccatgtccatcgaatccttgtaccagaaactgtcgaagaccgtatcatcgagctccaggataaaaagcgcgctatcattgatggtgcattggacgagaaggaatcgaagaacattgctaggttgagcacccgtgagcttggctacttattcgtg

SEQ ID NO: 37116 - DNA, 1421 bp, Aspergillus nidulans
gatgaggatgacgatcttctagacgaggaaatcctgaattcaagcacagcggacattatcaagcggcggcgaatgctggagaacgagcttcgcataatgaagagcgaataccagcggctgacgcacgaacaaaatacgatgaaggagaaggtcaaggacaatcaagagaagattgagaacaataggtgagacttctagctcttctagatggcgtggcgatttggaactccaccggaaaccaggaactgggcgcagagtttcctgcgaataggggctagtagtcctcgttcatttctaacattcatatcataggcaactaccgtatctcgtcggaaatgttgttgagctgctagatttggacgtcgaagctgaagctgccgaggagggcgccaacatcgatctagacgccacccgagtaggcaaatccgctgtcatcaaaacgtcgactcgtcagaccatctaccttcctcttatcggcttagttgatcatgagaagcttaagcctggtgaccttattggtgtcaacaaggattcatacctcattctcgataccctgccggcagaatacgacaaccgggtgaaagcaatggaggtcgacgagaagcctacagagaagtacacagatattggtggtctggataagcagattgaggagatcgtcgaggctattgtatggcccatgaaggaagcagagagattcaagaagcttggcatcaaggcgccgaaaggtacttatcaaacagtatctggtgtaaacagactcacaactaatactgctcataggtgctctgatgtacgggcctcccggcacaggaaagactcttctcgcccgagcctgtgcagcagaaactaacgcaaccttcctaaaactcgccggcccccagctcgtgcaaatgttcatcggtgacggcgcgaagctcgtccgggactgcttcgcccttgctaaagagaaggctccctcgatcattttcattgatgagcttgacgctgtgggcactaagcgtttcgactctgagaaatctggtgatcgtgaagtccaacgaaccatgcttgaactccttaaccagctcgacggatttgcctcggacgaccgcatcaaggttctcgccgccaccaaccgcgtcgatgtcctcgaccccgccctcctccgttccggccgtctagaccgcaagatcgaattccctctccccaatgaggaagcccgcgccaacatcctccagattcactcgcgcaagatgactgttgaggactccgttaactgggctgagttggcacgcagcacggatgagtttggtggcgcgcagttgaaggctgtctgtgtggaggctggtatgattgcgctgcgaaaggggcacagcaagatcgggcatgagaactatgtggatgccattgctgaagtccaggcaaagaagaaggatacg

SEQ ID NO: 37117 - DNA, 1543 bp, Aspergillus nidulans
cctaagctctaccagttcttcgttgctctcttcgcctctttcggctctttcctgtatggctacgacctgggcgtgatcgcctcggtcgtggcctcagactccttcattgacaaatttgtccgcggcagcagcaccgtctctggcaccgtggtagccctcttcacggcgggcgccttcttcggtgcattcggcgcagggttcactgacccgctcgggcgtcgaatgacactggtactgggctccgtcctctttatcattgggggaatcatccagacagcttccgtaaatctagggatgctgtacttctcacgtattttttcaggattcggtattgggatcctcgtcgagatggtcccgatgtttcaggcagagatcgcccatgccagaatcaggggtatcctgggctcgctgcagcagaccatgctgggtattggaagccttgccgcaagttggattgggtacgggtgtgagcatcactggtcgaacacgggaaacagtgtgcagtggaggttgccgtaggttgcctgccgttctattccatctcagtgcatcacaacgggcggtgctgatgagactagcctggccttacaggtcgtccccgccatcggactggcctcgtgcatcttctttttccctgagtcgccgcggtggctgatcgatcatgaccggcacgaagaagggctgcggaacctcgccactctgcacgccaacggcaacgagaacgacgcatatgtcctggccgagtttgaactgatcaagcagcaggtagaggaggagcatcggcacggggccaagtcgtataaggagctgttctccaatcgatccaatacccggcggattattctggcttgcgcgtgtcaggcgtcgacgcagatgtatgaccctcctttgtttacaagactggtgttactattacgcacttagagtggcagtcacgagaccaacaccaatactgaccttttacaggactggcgtctctgccatccaatacttctcgcccgccatcttcgcccagatcggcatctctacgtcccaaaccctgctctaccaaggcatcaactccatcatcggcgaactcgcccagtttatcttcttcttcctcatcgaccgcgtcggtcgccgccccctccagattggtggcaacattgcctgcggcctcgcgttcaccatcggtgcagcgctgatggccgtatacccgccctcgtccacaaacacctctgcacattgggcattcatcgtcaccagcacgtggtttttcaatttctgcttctgcgcctccggcacaatgtcctggatcatccccgcggaagtctttaacaccgcgacccgcgccaagggcatctcgctagccacgatggtctcgttcgcgtttaacacaatgatcgccgaggtaacgccggttgcgttggagaatatcggctggcggtactatattctttttattgtgtgtgactttggaaatgctctcttcttttatctgttcttgccggagaccaagggaattacactggaggttatggacgatctctttacaaactcgccg

SEQ ID NO: 37118 - DNA, 705 bp, Aspergillus nidulans
cacctccccagtcctttcgttctcatcaccggcgcaaaccagggcattgggcaagccactgccaagaatcttgcatcacagtacaactaccacgttctaatcggctgtcgcagaatcgaagctggcgagaaagtcgcctctgagttgcgtgccgccggccacaaagctacctctctccagctcgacctcgactccgaagagtctatcaaagccgccgtcgatatcatcgagaaagactatgggtacctggatatcctgatgaacaatgccgctgtcctgctggatcatgacaacaccctctcgccctgggcgctatacagcaggacattcacgccgaatgtcatcggcactgcaacattgacacacttgctgctgcccttgattcggaaggcaaaggcaacgccgccaacgatcattttcgtgtccagcgggatgggaagtctcacatatggattcgacaagagcgtcccatttcatcaagcggataaccgcgcgtacaactcgagcaaagcagcggtcaatttgctcgttgcaaactacaagcgcattctcgaacctaaggggggtaaggttaatgcggtttctccagggcttgtggccacgaatatgacggcgcatatgaatgcgcgggcgactgccgaggttggtgctgcaagtatcgtgcaattgtctgctgctgggaaggatggggagtctgggacattt

SEQ ID NO: 37119 - DNA, 1179 bp, Aspergillus nidulans
catacgatcccgctgacggcgacgctctacggctcacgctacaatgcgcccgtcacgatcggcaacaccgaattcgacctgctcgtcgataccggcagcagcgacaccttcgtcattgaaaccggctacgaatgtttcggccagtccgtgtacactggcgatatcgtcacggccgagcagtcgcagtgcgcctatgcctctgagacctataaccccagcgaaagcgataccttcgagccgatcaacaacgagacgttcatcgccgggtacggcgccggcgtcgcgaccggctcaatggcctatgaggatatcactctcggcggggtgacggtcactgaccagcgtttcgggttggtgaacaggtcctcgcccatggggctgggcgccagtgggatcctgggtcttgcgtacccggtgatcacgtcggcatatgaagtcaacggcaccctggaagactacgtcgacgatctcgcagaggacctcgatgatgatgatgtggacacgtccatcgaacaggaaccgtacagcccgctgttcgtgaatatggcgcggcgcggcctcgtcgagccgtacttctcgctcgcgctggagcgacttgacggcgactctgagactggcgacggcggcgtgctagttctgggtgggctaccggacgtcaagctcgccaacaacttcaccaccgttgcggccgagtactacgaggcggccgagttccgaagcgacaacggcaccagactgcgctcgtactgggcgacgaccgtgcagaggattagctacggcggcgacggcgagtacaccgcgtcttaccagacgatcgtcgactcgggcgctcccatgaactatgtcccaaccgaggtcgccgacgggttcaaccaggcgttcagctcgtccgcccagtgggatgacacacagggtgcctaccgcgtcgactgcgacgccaacgcccccgactttgccgtacagctgggcggaaccaccttcaagctcaacccgacggacctggtcctgcggtcgggcgtcgagtttggcggcgaggagatttgtgtctctgccgttacgcgcggactggagcagcagatcaacgagactgataccacggaactgtacatcctgggcgcgggattcctcaagggggtcgtggccgtgtttgactttggcaactcagagatgcgctttgcc

SEQ ID NO: 37120 - DNA, 1874 bp, Aspergillus nidulans
atgcaatcatcgatgctgcttcgggtgagggctctccccaaaacagcgtcggttctctcccgtacaaagacggcgacatacgccacatacaaggttcctcgcattgacaatgaaccaaacgtgagttatcgtcatgcctttgttcttggttgtcaagggctctgctgattttgcagaaacactacgccgcaggctcgccggaccgaaaggctctacaagaggctttggcgcgaacgcaacgaaatgctcctctgagcgttcctctagtcattgcaggcaaggaggtgggcagcgtccaattcccctcgtagagctcaactgatgtgctcaggtcaaatcctcttcatcactaacacaatcgaaccccgcgtcgcacggcccggtggccacctactccaatgcaaccgccaaagacgtccaggcggcgatcgagtccgccctggaagctcgcaaatcatgggcctccacgccgttcgccgatcgtgccagtgtttttcttaaggctgcagacctgatctcgacaaagtaccgctatgatgtgatggctctgaccatgcacggccaaggcaagaatgcctggcaggcggagattgactctgccgctgagctttgtgacttcttccgatttggcgttaagtatgcggaggatctgtatgcgcagcagcctgtgcaccatgcgccgggtgtttggaagtaggtcacccctcacggcaaggttagggctaggctaacaagacagccgcgtcgaataccgtccgcttgaaggatttgtttacgcgatcagtccgttcaatttcactgccattggaggtaatctcgctggagctcctgcactgatgggcaatgttgttgtctggaagccttccccttcggccatcgcatccaactggctcgttcatcagatcctgctcgaagccggcctccctaagaacgtcattcagttcgtccccggcgaagccgaagaagtgaccaagaccgttctcgaccaccccgacttcgcagcccttcatttcactggcagcaccaatgtcttccgtaatctgtacggtcagatctccactcgtgtcgcagccggcaaataccgcagctacccacgtattgtcggcgaaactggcggcaagaacttccacctcattcataaatctgccgacatccgcaacgctgctgtgcagaccgtccgcggtgcttttgagtaccagggccagaagtgcagcgcaacctctcgtgtctatgtcgcgtcctccatcgccgattccttcctcgaacaggtcgcctcggaagcgaagagcctaaaggtcggccccccttcggactttaccaacttctgcgggccggttatccatgaagcctccttcaccaagctcgccaaggtcattgacgaggcaaagaacgaccccgagctcgaactcctcgctggcggctcctacgactcctccaagggctggtacatccagcccaccgtttaccgcaccactaaccctgatcacccgctgctgacacgtgaactttttggtcctattctcgtggtgtatgcctaccctgacgcgacggaggccgactttgcccgtattgcgcagaagatcgacgcaacaggcgaatacggcctcacgggctcggtgttcgctcaggaccgcgaggcactggcggtagccaacgacgtcctccgcaatgcggccggtaacttctatatcaactgcaagagtaccggcgcagttgtgggtcagcagccgtttggcggggcgagggcgtccggtaccaatgataaggctggtagtgggaacctgctgagcaggtttgtgagcctgcggtcgattaaggaggagtttgttcctacctacaaggttgcttatcctagcaacgaggcgtgacctgag

SEQ ID NO: 37121 - DNA, 814 bp, Aspergillus nidulans
ccgctaacaggtgttcccaaactagagtatgcattcaaagctatcactgccgcgaacattacctcgataggcgtgaggggaaaggactgtgccgttgtgttgtcgcagaagaaagttgccgtatgtcgcccaagtcactccgatataggccgttctgaacgaagtctaggataaattgatcgacccctcgtccgtcacgcatattttcaggctctctccttcagttggatgtgtgatgaccgggtcaatcgccgatgccagagcttccgtcgaccgtgctcgtggtgaggctgctgagtttcgatacaaatacggttacgagatgccatgcgatgttcttgccaaacgtttggccaatatcaaccaggtttacacacagagagtgcgttgttagtccaagttacaggcaaaacctaatagcatataggcatacatgcgcccactcggagttgcgatcaccctgtgctctgtggactcagagaaagggccacaactgtacaaatgtgaccccgccggatactacgctggatacaaggccactgcctcgggcccgaagcagcaggaggcgctcaatcacctggagaagaagctgaagaacaaggattatgcagagggcagctgggaggaggtagtcgagctggggattacggcactgagcagtgtgctgagcgtggattttaagaagcacgaattggaaattggcatcgccggcggtcctcgaacagacggaaaagaaggcacagatcctcatttccgggcactgacggaggaggagattgacgaacggctgcaagccatcgccgagaaggactaa

SEQ ID NO: 37122 - DNA, 966 bp, Aspergillus nidulans
ttccttcgtgcgatgactgatgaccactcaaacccaaactgccccatcaaacttgcccacggaacaacaacactcgccttccgatttcagggtggaattgtacgtcgcaacatccctgtcaaacgctcatatatccggccccgctgatattcgaaacagattgtctgcacagattcccgagctacggctggaaactggattgccagtcagacggtgaagaaggtcattccggtctcccggttgagccgtggagaggataagccaggcagtgcgcctgttcctggtcttctggggaccatggctggtggtgcagcagtacgtgtctatctttatcgtgcctacagtcatgattgtgctgaagtttatgtctaggactgtcaatattggcttagatatctgagtcaacaatgcacactacatggtgtgttgcgtcgtttctgcagtctttgagtgatgctaacttggtacagagattcgtcacaaacgccgtatcacagtggctgccgcttcgaagattctggctaatcttacgtacgcctataaggggtacggtctgagcatgggaacgatgttggcaggcgtatgcggacccgcggagagtgaccctgttttgaagccccagctgactttctgcgataggtaacaccgcaagaaggacctgcgctgtactacattgactccgacggcacccgcctccccggaaatctgttctgtgttggttccggtcaaaccttcgcctacggtgtgctcgacgccaactaccggtacgacctgacggaggaggaggctctcgagctcggacggagaagtattctcgctgccatgcaccgtgacgcttactctggtggtttcatcaatctttatcacgttaaggaggagggatgggtccatcacggcttcgacgatatgaaccccatattctggaagacgaagttggagaaaggcgagttctcgaatgttacgtcg

SEQ ID NO: 37123 - DNA, 504 bp, Aspergillus nidulans
ttgttcgcgaattcagatgcaatagctgattgctctccgctgacggttatgctatatagcgtggcaggacgatctattgcccaaatatcccgcgatacagctgtttgtttatcagaaatagaaaacattgttgctattaaagatgccgagcgcgatgtgtctaacaatgacagaaaccatggaaaaaacagcggacgactttgcggaatacagcggagacgacggattaacgttaccaggtatggctgatggagcgaaaggtatcgctccggttgactgttggggaattagacacccaatgcatgaaatgattactgcatttcaaataggagaatttaaaaaggcccaataattacatcaagtacttgtaagaggtcctgactcagtatttatggcgcccagatccaacttcagtgaaaacaacgtttcacatggggtggattagatgcaggtactgtacgtttaccccgttttcccttaacagcagaagaaagagctaccggt

SEQ ID NO: 37124 - DNA, 1018 bp, Aspergillus nidulans
cagcagcaaagaaacctctccatccatgaatacctttccgccaacctgctgaaatcagtacgtgcacagtcgagcgcgctttagatactcaactgatcttcattcagtatggtgtgggtgtgcccaagggtgaagtcgctcggtcggcagaggaggctgagaaggtcgccaagtcactcggtatatatctgtccttcccccatctggtaatctgtactaagatgcgcgtctcgcaggtaacgatgacatggttatcaaggctcaggtccttgccggtggtcgtggcaagggtcactttgataacggcctcaagggaggtgtgcgcgtgatctactcgtgagtctgagctcctaactccagcttttctgcttgactaacttggtttgtgtctattcagtcccaccgaggccaagatgtttgctggtcaaatgattggacacaagctcatcaccaagcagactggcgccggcggtcgtctttgcaacgccgttttcattgtcgagcgcaagttcgctcgtcgcgaattctaccttgctgtcctcatggaccgcaagactcaaggtcctgtcatcgttgcttcgtcgcagggtggtatggacatcgaggctgtcgccaaggaaaaccccgatgccattatcacgactcctattgatatcaatgtcggcgtgacggatgccatcgccaccaagattgccaatgagctcggtttctccgagcaatgcgttgatgacgccaagaagaccattcagaacctttacaaggcctttatggagaccgatgctactcagattgaaatcaaccctctgtctgagacttcagaccaccaggttttggccatggacgccaagttgggcttcgacgacaacgccgaattccgtcagaaggaaattttctcatggagggacaccacgcaggaggacgctgacgaggtcaaggccgctgagtatgttcattcaatctgttcaagaaactctctaaccagtatagcacggcctgaactttattaaacttgatggtg

SEQ ID NO: 37125 - DNA, 2026 bp, Aspergillus nidulans
acaggcgacggcggcctccatggaaacctccttataaacaacggttttcaaggcgacgacccggggctgactggctataaagccattgggagtgtccaaatcaaacaaagccctagcatgcccttgtcggcggcgataaagtcgtctctgtctgtctccgtgcgtgcggacgcaaaggggctcgtcgggttcgcaaacactgggtacaacgggatcaccgtgctgaagcagacgtactggaccagtttctacatgaagggcgagtacagcgggaccgttttactgaggcttacggggacagacagcggaactgtgtacgggagtcggaatctctcggtgaaaagtaccggtgggaaatggacgcagtatgagacgaccttcgaggcaaacgaaagctatgtcgcggagaatgagtggcagttgctgtttgatgcggccactgcaaagggacatcctttgcattttgggctcgtgcagttgtttccgccgacgtataagaacaggttggttcatttctctaggaatgaagaatgcaaaatagggataactgatatgatctaaactaggactaacggactgcgaaacgacattgcgcggccaatcgcagacctcaagccaaagttcttacgctttccgggaggcaataatatgtgcgcggcgagtctgttaagaacgtatggatcaggctaatgatgcagtgagggactcgatatcgactcacgctggaagtggaacgagaccatagggccactgatcaaccggccaggacgagagagtcagtatatgacccaatccttggtctcctgtgagaaccagacaagctgaccggccaggcgactggcactacccaaacaccgacgccctcggtctggacgagtatctctggtggtgcgaagacatggatatggttcccgtgctgagcgtctgggacggcaagtcttacggggggatcgtctcaggcgaggagctgcagccttatctcgatgatataaaggacgaactcgaggtaacccttccccttactcttctttctcaccctctccgagcctatctaacccccaatactaatgagcagtacctcctcgggcccccatcaacgcccttcggcgccttgcgggcacgcaacggccacccagacccctggccgatccagtatattgagattggcaacgaagacgactacagcggtggttgtgacacctacccagaccgtctcgtccagatctacgacacgatccacgcgtcgtacccaaacctcaccttaatcgcaaacaacatggacgagaactgtctaccagagatccctctgccgggactctggcacgactaccactactaccggtctgctgacgacctcgtcgccatgttcaattactgggataaccacgaccgcggggacagagtattggtgggtgagtacgggtgtcgcaatgacagcaaccccgacggcgtgttttggagcttcatgcaagggtcttgtgcagaggcggtgcatatgattgggctggaaaggaacagcgatgttgttatgatggctgcttatgcgcccttactgcagcatttcggatatacacagtggtcggtgtgtactccctctgcctccctagcctatctagggatacaccctgctgatcgtggtgaggaacagccaacactattcggctttgaatcgcgccccaacagcctaaccctgtcaacaagctactacgtcaaccgcatgttcagcacgaatcaaggctcgaccgtgcacaaggtgcactcaacagccgggtttgggcctctatactgggtcgccacgtccaacgagactgcctatcaggtcaaattggccaactacggcgccgcaaaccagaccgtcaatatccgggttcccggcgtggggaggggagtgctggagatgatctctggtcctaaggatgcgagtaatctgccgggggatatcaagattgtgccggtctcgagaaacattagagctgggaaggaggggtatacggtgcatatgccaccctggggggtggcggttcgc

SEQ ID NO: 37126 - DNA, 870 bp, Aspergillus nidulans
cagctctacaacaagcggatatgtctgctcatcgcgcaccccgacgacgaagcaatgttctttgcgccgacattgctggctttaacaaagccagagctagggaaccatatcaagattctgtgtttgagtagcggtatgctggtctccttcattctatggccttgattccgaaaccaattgatgggttgtgctgtaggggacgccgacggcctgggccacatccgacgcggcgaactccagaaaagcgcaaaacgcctaggcattcgcggagataacgacgtgctggttctcgatgacccacggttccaggatgggatggggaacagttgggcgaagaacgagatcgccgcgctacttactgcaacgtttgcgccgaacgcatcagcatccgcgtccaagtcgatgtcgcgcaaacaagcaaaatctagagacgaagcgcccaccgctacaatcgacgtcctcctgacctttgacgcccacggtgtatcgaaccacatcaaccaccgctcgctctaccacggcgcgcgccattttctcagtatgctgatgaaagataaatccgggtattcgtgtcctgttacgctgtatacacttagaacgacgaatctgctacggaagtatatcggtgtactggatgcgccgtttacaatggtcaagggggttttggatggtttgtttgcagtttcgtcgtctaaaactaggaaaaacgccaaagaccaaatgccggcaaaactgctcttcgttagctccgtgggcgagtggatgacggcacagtcggctatggtgaaggcgcatcagagccagatgatttggtttcgatgggggtggattggaattggcaggtacatggtcgttaacgatttgaagaag

SEQ ID NO: 37127 - DNA, 1355 bp, Aspergillus nidulans
gagaccgagcccagcctccgtgataccttgcgctactaccagccggccgtgatctggtcggttctgatctcgctcaccacggtcatggagtcctacgacatgcagatagtccactccttctatgcgtttccgcatttccagcgggagtatggagtgcagcttaaaaatggcgagtacagcatcccggccaagtggcagctggctctgaactgcgcgagcctcctggggctgatgtcaggcaccttcctcaacggctgggcgtctgagagattcggagcccggaaagtcatcatgatatcgcttattgcattgaccgcgtttgtcgccatcacctttgtatcgccctcggtggaggtgcttttcgtgggcgagctgctctagtaggtagacgcctgcctctccccagccggtgagctctgagccctaaccgtctgatgccagttcgatcccctggggcttttcgccgctgccaccccgtcgtatgcgtcagatctgccctctcgtccgtcgcggatacgtcaccgcattcgtgaacccgtgttgggtcatgggccgactgatatccaccggtgtcctgaccggcacactgaacatcccttcccaggggccctatcggttgccgttcgctctacagtggatatttcctctacccttgttcattgtcgcgtggttttgccccgagtctccgtggaccaatcttcggcgatcagaaatctcgataatcagctggggctgccagcttctcccctgctgggccatccagaactacatcacttacttcttcagtcttgccggattatcgcctggcaacttgttcaagatcacgcttggtattgtttagacgccgtacaaggtccccgccagcaactgacctcgtctaaggaccatctcgctcgccttcatcggcacttgtctctcttggttatttcagacgcatatcggccgacgcaccatctacctgaccggtcttgttgtaatgctgcccttgatgctggccgttgccctcctgggcgtagcgccgcagtcctctggtgtccaatgggcccagtgcgcgctgttgatgatttggttcttctgctacccccaagccccttcttcttaactcttaagtttttcatttgcatttcctcttactcaccccggtatttaacgccttaggatgcctattggaccgattccatacgcaatcgcagcagaaatcggggccagcaatctccgcaacaagaccatctccctgggccggggcacatactacatcctctccgtcgccaactcagtagtgtcaccgtacatgctcaatcgctctgaaagcaatttcaagggaaaagcggcccttccagccgctgtatttacag

SEQ ID NO: 37128 - DNA, 949 bp, Aspergillus nidulans
catccattaagatttgacacagtcaaagtacgattacaaacgagcaaagacgggcatttcaaaggtccgctggattgcgtgctccagacggttaggaaagaaagtgtttcgggtttatacaagggggcgacgccaccgttagttgggtggatggttatggactcagtgtgagttgcgctgcggtctcgatttgagctatgcggggatatctaacaggaactttgcagaatgcttgggtccctaacgttataccgccgtctgctacttgaaaatgtcttctcgaacccttcaatacgtgctatgactccgtttgcgaagaaccagtctgacctacatacactgccgagtttcggacacggcattgccggtattatggcgggcacgacggtcagctttatagctgcccctgttgagcatgtcaaggcacggcttcagatccagtacgcagctgataagtcgaagcggttgtacagcgggccgatagactgcacgcgcagaatcgtacggaacttaccccttccttaccgacggtgtactaataggcccgcagcttagcgcccacggcatcagcggcctctaccgtggcctctgtgcaacaatcctcttccgctcctttttcttcttctggtggggctcctacgacgttctgacgcgtctgatgaaagagcgaacttccctttcagcaccggcaataaacttctgggccggtggtatctcggcccagatcttctggatcacgtcgtatccgtcggacgtggtgaagcagcggctcatgacggatccgatgggcgggacgcttggcgacggggaacggaagttccggtggtggaaggatgcggcgaaggcagtatatcgggagagaggctggaagggctactggaggggctttgtgccttgcttcctcagagcgttcccggctaatgcgatggcgctggttgcgttcgagggg

SEQ ID NO: 37129 - DNA, 1394 bp, Aspergillus nidulans
tactacacctctacacaccacgccctccgcgcctgggtccgaaattatgtagacacgcatatcgcaccttacgcgcaagaatgggaagaagctggcgagatcccgcctcatgtatacaaaacacattgcgagcacggattcgccattgtccacccactcaccacaccagaagactctgcgaacctgactttgcccggcggtgtgaaaagggaagaatgggatacatggtgcggactcattgtcgcggatgaactgaaccgacttggtttcgtcggtgtgatctggggccttggtggtggaaactcaatcgggtgtccgcctattgcgcgctttgggacggccgagcaacggcgaaggtggctgccgaaggtcgccaagggagagatcaggttttgtttggggattacggagccggatggtatgttcctcttattatattgatctgtgatctttgacatggtggatacgagctgacagtgacggccgatagctggctcggacgtcgcaaatatccgcaccaccgcggtccgtcaaggcgagtactacgtcgtcaatgggtcaaagaagtggattacgaacgggatctgggcggattattgcactgctgctgtgcggactggtggacccggacggggtgggattagcttgctggttatcccactgaaagcggagggagttactaggaggaggatgcataattcgggagtaaatgcgagcggtacgttaaattgagacgtcgggggctctgagggacgagtaagctgaccggagattcgcggctacaggatcaacattcattgaattcgatgatgtgcgtgttcccgtggaccatctcattgggaaagagaacgggggtttcccgctaataatgtcaagtgcgtatcctccatgaccagacccaagtccacctcgacggaacccaggtttgcagtttgcaaaatgcaaggagctaacacatagcagacttcaatcctgagcggctttccctagcctgcgcctccctacgtctcgcgcgtgtctgtgcggaagacgccttcaactacgccacgcaacgctcaacatttggggctcccctgataacccgacaagcgatccaggcaaagattttcaagtttgggctcctaattgagcccgcgtacgcattcatggagcagctggtcaacatcttagagaagacaaagaatgagcctagagatgacgtgagaattggcggaatgacagcgctcttaaaggtcatgtccacgagggcgctcgagaagagtgtgcgcgaagcgcagcagattctcggcggggcggggtataatcgggcagggaaaggggcgagaattgaacagattagccgtgatgccagggttcatgttgtcggaggcgggagtgaggaaatcatgatgggt

SEQ ID NO: 37130 - DNA, 825 bp, Aspergillus nidulans
ttcgacctcgaaggccgcgtctacgccatcaccgggggcggacggggtctcggtctcgctatggccgaagcgctcctcgaagccggagctaaaggtgagcattccctctattctctgagcacataagaggagataatcctaacgagccgaaaagtatattgcctcgaccgtctccaaaccccacacccagactttgaggccgccagatctcatgctgaatcggcctacggcggcagcctacactaccaccgcattgacgtgcgcaacgctgctgaaacaaacagcatctttgcaaagatcgcctctgagaactcgcgcctcgacggtctcatcgccgccgcaggcataaaccatctggaacccgctctctcgcacagccccgagaaactccacgaggtcatggacatcaattataacggcgtctttcatagtgccactgccgctgcgcgtcagatgttcaactaccagcaaaagggttccatcctgctcgtggcttccatgtctggccttatcgccaacaaggggatgacgagtcccgtttacaactcgagtaaggcggcagttgtgcagcttgctcgcaatttggcaatggagtgggggaggcatggcattcgggtgaactccttgtgtcctgggcacattgtcacgccgatggttgagatggtcttccagaaggagccggccgcgagggcagtttgggaggctgagaatatgctgggacgactggcgacgcccgaggagtttagaggcgcggcactatttgcgttgagtgatgcctcgagctttatgacagggagtacaatgctgattgatggggggcatacg

SEQ ID NO: 37131 - DNA, 1004 bp, Aspergillus nidulans
caaatccgaacgctcgacgataatgatcgattctgtgacatcctgcggaagacgctcaaagagcacttggttgtgataccaaggctggccatgggagttcttgaatgccgtgggcttttgccggcagaagcaatggaccaattcatgaatacgttgctcagggcggtaaggagattctatccattggagagtacacgtctaatccatgacagaggatttctcgtcgagttattgcggaacagcacctggcattgacggaaacctttaattcgccgtggcacttccctggatcacaagatcggacagacctaaatgcagattttgtcggcgaggtattcctaaagtgcaacgccaaagaagtcgtagagcgatgcggcaagctggtacaagacattattcggcagagttctgggtcagataagatcccagagatatctgtgcaggggcatttggacgccacttttccgtacatgctcagtcacctggagtatatcattggcgaactcctgcgtaattcgatccaggctgtgagcgagagatatcaaggtctcaaccaaacaccaccccccatcgaggtgctgatttgtgaagcacctcaacatgtgattatgcgcgtttcggaccaagggggaggcataccccgagagattctgccatacttgtggtcttttacgaagggtccccacagcaaagtacgactggaaaatttaggacaggtcccggcaatggcagctacactacaggagctctcagtgtctagcgacataaaacatgcagacaaagagacatttcgagagagctctctagacacgctgacttcgcggcctccagatcttaggctggggatagggctgccaatgagcagagtctatgcagagtactgggcaggtagtctggagctgcacagcttagagggatacggcgtggacgcgttccttcagatatcgaagctcggcaacaagaacgagcaagtgacgacaagagcagcaattgatgccgtatga

SEQ ID NO: 37132 - DNA, 1077 bp, Thermoplasma volcanium
atgagcacaatagaagaacgcattaaggaaatagaagacgaaatcaagagaactcagtacaataaagccactgaacaccacatcgggcttctaaaagccaagattgcaaggctccagatggaggctagagcccataaaggaggcgggcactacggcttttctatccctaaatccggtgatgcaaccgttgcacttgttggttttccaaacgttgggaagagcagtctccttaacgttcttacgaattctgaaagcgaagttggttcatacgccttcacaacgctgaaggccatcccaggagtaatggaatataaaggtgctgaaatacagatactcgatctccctggtataatagaaaatgcttcttatggtgccgggcgtggaagggaaatacttagcactgttaggtctgcagacctaattgttattgttacagatgtagaaacagggggattagataaaatagtgaaggaactctataattcaggtatagtagtcaatagaagaaggaaaaatatcgagataaagaagacgacttctggaggcataagggttcacaaaccaaaaaacgttgacattgattcagaatatatcaggcaactaatgaaggagtttaagcttgtaaatgcagatgtatacataagggaacaagtaaacgaagacgatattatagaggctgttcagaaaaattacgtctacataccctcaattgtagcggtaaataaaattgatatgaacggagcttttgatacatccccacttacgagatttggagaggtgttcaaagtatctgcaaaaaacagaataggaatagatgaactcagggaggggatataccgctctctgaaattgcttcgcgtctatttaaggaacaaggcaggagttgttgatttcgataagcctctaatactcacagatggatcgaccgttagggatgtttgcaggaaaataaacaggagtctgatagattcgttcagatacgcgatcatatctggaaaaaataggcccataggagagcagagggttgggatagactatcctcttctagacgaagatattgtcaccataattagcagg

SEQ ID NO: 37133 - DNA, 2034 bp, Thermoplasma volcanium
aacatatataatctcatatacactgattcatgcatgacacttactgtgtgcccttattgtggcactggatgccaaataaatgtggagtaccgcaatgggcattttactgttcatggttacaacaaatccattgtcaaccagggaaaactctgtataaagggatatcagggcctcagttattcttcttcttcacaaagattaaactatcctatgataagaaaaaatggaatactcactaaagtcacttggaacgaggccctcgactacgtttcagaaaagttgaagacaattcgtaataagtacggtgctgatgcagttgcgtttcagtcttctgcaaagtgtacaaacgaagaaaactacctaatgcagaaaatagcaagaatgtttggaacaaataacatagaccactgtgcaagaagctgccatagttccacagttgccggcttaatcaagacgataggtacagcagcggcaactggatctatcaagagcttaaaatctacgaagacttattttatcataggttcgaataccacagagcagcaccccattattggaactacggtgcttaaaggcaaaaaaagtggaagctaccttatagtagccgatccaagaaagacaaagcttgcctcaaatgcagacatttttctccaatttaggccaggaacagatgtagcccttcttaattctattatgtttgttattcttaaggaaaatctctacgatgaggaattcataaagaataggacagaagattttgataaacttgctgcagagatagaaaagtaccctccagaacttacagaagccataactggggtagatgctgaacttgtaagaagagcagcagaaatttatgcaaagtataagccctcggcgatactatatggtatgggaataacacagcatatacatggcacagaaaatgtgatgagtgtatcaaaccttgcccttatgacagggaatattggaaagtacggtgccggtatatttccacttaggggacagaacaatgtacaaggatcaagcgatatgggggcactggcagagttttatcctggttatatacctgtggactccgaaggggttaagcgttttgaggatctatggaaaaccgaactaccaaagaaggtcggtttaactctttctgagatgtttgatgcggcggccgcaggcaaagtaaaagcaatttatcttatgggggaaaacccagtgataactgaagcaaatgtagcagaagttgagaaaggcatagaaaatttggaattatttattgtgcaagatattttccttaccgaaactgccagccttgctgatgtagttttacctgctgccactgctctggaaaaggatggtacatttacgaacaccgagaggagggtacagagaatcgtctctgtaaagagcccgccgggagaggcaaagcaggattggtggatactcagtgaaattgcccataggcttgtcggaaccgaaagatacagatctgttgaagatgttttcaatgagataactcaagctataccaaactattccggaataagataccaagatatatacccaacaggaaagcaatggcctgttaatgaacagaatcccgatgggacagaaatacttcacacagttaaatttacaagaggccttggtagattctatcctgtaagctatgaacctccatcggagattgccgatgcagaatatcctttcatacttacaactggaagaaactactatcactggcattctggaaccatgacaagacgcagtgatatactggaaagggaatcgccttcaccctatgttgaaataagtatgatggatgcaaaacaactcaatataagggacggccaggccatagacgttgaatcaaggcatggcagaataacacttccagcaaaagttacagataaaattccaactgggataatattcgttccattccatttcaaagaagctcgggtaaatcttctggttggagataatcttgatccttactcgaagatacctgaattcaaggtagttgctgctagggtg

SEQ ID NO: 37134 - DNA, 1428 bp, Thermoplasma volcanium
atggctaaaggcatcattgaagagcttgataattcaaagataaattcctttcatctacgcacctggttgattgcaggtatgggattcttcacggatgcatacgatctttttgtaataggtacagttatatcaatactcccactagctgggtgggataaactcaacacatacgatatttcaatattatcctcaatatctcttcttgcttctgtaataggtgcagtgatatttggaaggcttctcgacgcactaggaagaaaaagagtctatggatttgagctgatgttgcttatattgggagctttaggcagtgcatttgtggttccagtaaacggtataaattaccttatagcatggagatttatacttggactaggaattgggggggactacgcaggaagttcaactataatgactgaattttctaatacgaagaataggggacaacttgtaggcatggtcttttctctccaaggcgtcggtcttatagcagggcctttaataacgctaggccttctaagctttatacacaacctagaccttgtatggagggtgctgtttttcataggtgctgtgcctgctttcatagtactgtacggcaggcgggcaataggcgaaacacccagatacgcacttagagtaaagggagatgcgagttcagcaatgcagagtgtcgaaaaaatttcaggagattcaaaggtttcagtatcaagggaagatttagagatgtcaaatataaaatggacggatttattcaaaaacagatactttatgctttcacttattggaacggcagggacatggtttttgcttgattgggcgttttatggaaattcgataatgtctcatgaaatgttgagcgcccttatcccgtcatctatgtcaggcttaaacaagttaaagctatctacgttttacacgcttataatattcgccgtttctgcttttcctgcatattggatagctacttttactgtagacagaatcggaagaaaaaggatgcaggtaattggttttctaataatgggcataacatttggtattctcggcatattcaggtaccttatgtcccctacattcgttacttatttccttttagtgtatggaataagctattttttcacagagttcggcccaaacgtgactaccttcatttatgctccagagatgtttccaacagcaatacgcggactcggatctggaatatcctctgcagggggtaaaactggggcattcataggaaccgcgctaaacgtaattatatttacactttatggggaaggcgaacttttccttatacttgctggaatatcgatgttaggtatgttaatgactttagtacttctacctgaaacatctagaagaaaactcgaggatatttcaggcgagggtagatatatagtaagaactgcttccggatttaaaaaa

SEQ ID NO: 37135 - DNA, 492 bp, Thermoplasma volcanium
ttgagcgaggatctagtcaaatcaggagccataaagtttggagatttcatacttacctcaggcaaacgatctgattattacgttgatattaaggaggcagctacagatccaaatctcctgagtgaaatagcttcagagttttcgaagatgatccatgcaagaaagattgcagggatggagctaggtgctgtacctttaatagtagctacgtctttgaacatggggataccatacgttattgtgaggaaggaaagatcgcacggtaccctcagccttatagtggggcggctaaatcgtggggaagaggtagacgtaatagaagacgtagttactacaggaaactccgtcttgaaggccataaatgtgctgcgggaaaacggcgttgttgtaaaggatgcttattgtgttgtcgacagggaagaaggaggcgcaaagctacttgaaaacaacggaataaagctgcatccaatagtaagaatatctgagctcaag

SEQ ID NO: 37136 - DNA, 1761 bp, Thermoplasma volcanium
ggcgtagcactggaagctccaacagggtcaggaaaaactatgatggccctccttggttctcttaaatatgcgtataacgggcatttgaaaatactgtatcttgtaaggacaaattcacaggaagagcaggtcataagagaacttaggacaatatcaaaaaataggaaaataagagcactacctatgcagggaaggataaatctctgcatactgtacaagactgccgatgatctgaaggaggcaaccgcagaatctctttcaaaattctgcaatagccgcaaaaggcaggtaatggaaggccatcaggaagcatgcccttactacaccataaaggtcagatcaaaagaaacgaaggattttttgtttgaaaacttacctacggctgaagaattttatgaatatgcttttacgaataacttgtgcccatacgagagtattaaggcgtcactttcagatgcagatatagtagtggcgccttacatgtattttctaaataaaactgtcgccgataggttcctctcgcactggggggtatctagggaacagttaataatagttttagatgaggcccacaatctgccggatattggtagatcccttggttctttcaggatatccatagaatcattaaacagatctgaaaaggaggcccaatcatttggagaccctgaacttgatagaggtgtgcacgtaacagacttcatagaaatgataagaagcactcttgaacgtacaataaaggaaagggtaaaggaagacgatgttagaataagatttcaggaattcaaggaatacttaatgataatgaacaagaaaagcgagaagtcaataagggatctcaataactatctctatttgtttggagaatacgttgaaaacgaaaaggagaaagccggcaaggtacctgtttcatactgttcttcgctcgcccaaaggctagaagccatgatggatgaagatgatgctatgtatgcagctatattatcaaagtcagaatctggctatatacaagcgtcatgcctagacccatcatctatattatcatcgttgaaggagtcgaagaccatacatatgtctggtacattggaaccattcgaattttattctgacgtaactggctttgatataccattccgcaggatagaaaatgtttttccaattgaaaaccgatttgtctcctattacgaaggtgtttcaacaaagtatgatactctcgatgagaacgaaataaggaaactagctagcataatagaaaatatcgttaatggcgtcaagaggaatacaatagtttattttccctcctatgcagtaatggacaaagttataggatctggtctagatttcgactttctgcaggagaagaagaacttagatcaaactgaattttacgatgttgtcaaaaaattcagaaacggcgggaagcctctgcttgctgtctctggaggtcgcctgtctgagggcatgaactttcctgggagggaattagagcttatactaatagcaggcataccgtttcccaggccggatgcaacgaacagggcactgtacgattattacgaaatgaagtacaaaaaaggatgggagtatgcagtgcttgcgcctgctataattaagattaggcaggagatagggaggcttataaggggaaaagatgatcacggggcctgcgtaatacttgacaaaagagcaaaacagttcaggagatttataccagaccttgtcaaaacagacgatccagtgaatgacataaacactttcttt

SEQ ID NO: 37137 - DNA, 660 bp, Thermoplasma volcanium
attgagatagaggatctctacatgtattacggtgaaaaaccagctttaaaaggtgtaaatttaactataccttctggatcaatatatggcatacttggtccaaacgggtctggaaagacgactcttatgaagatactggtatccctgctatcaaagaaaagcggaagagtatcagtatgcggactggatgtagataaggatcagatgaagataaaggaaattgccggctatattccggaaactccagttctttatgaatctatgacccctttagagctttttgattttgtgggatcagtgaggcacatccctgttgattcatatgcgagaaggctcaacgcgttgatagacgcattttcaataaaggattatctcaacgagtttattggttctctatcctttggaaacaaacagaaggtggcaataatatcggctctggttcacgatcctaaagttctaatcgttgacgaagggatgaatggattagatccaaggtcagcacgcatattcaaagatatactcatggacatgaaaaacaggggcaaaatagtcgttttttccacgcatatactagagatcgctgaaaacttatgcgactccgtcgctatactttatgagggtagcatagtcgcaaatggcaccataagggatctagaaagt

SEQ ID NO: 37138 - DNA, 1278 bp, Thermoplasma volcanium
gcgaagaagataatagaacttaacgataaatacttggctagaagcacacagtctctgccggttgtagggaagctaggaaagggagtatatgttgaagacgtagacggaaacgtctatctggattttgcgagcggcataagcgtaacaaacctaggccatcttgatccgtacgtaacacaaaaggtagaagaacaattgcacaaactatggcatttccctggtacggatttttacactgagatgcaggttttggcagctaaatcccttatagaggtaactcctggaaaatttaacaagaaggtgttttttacaaacagcggtactgaaagcgttgaagccgcaataaagatagcgaagtcctatactcacagagagaggtttataggttttattggagcattccacggacgaacacaaggttctctgagctttactgcatcgaagcccatacaccacaaagggttcttcccctctatgccgggcgttgaacacgtaccgttcccgaacccgtacagaaatccattcaatatagatggatatgaagaaccagatgagctcgtgaacagagtgatcgactacatagagacgtatttactcaagacttacgtaccccctgaagacgttgctgggatccttgctgaaccgattcagggagaaggaggatacatcgttcccccaatgaacttcttcaaggagctaaggaaactcgcagacaaataccacataccgctcctcatagacgaggtgcagagcggctttggaagaacgggcaagttcttcgcctcagagcactttggagttgagccagatgtcataacactcgctaaatcaatagcatctggcatccccatgggagcagctgtaatgaaagaggagatgaatttcagcgagaatggcctgcactctaacacgtttggaggtaacctcattgcatcggctgcctgcgtggcaacaatagacgagatgaagaaactcaatgccgtagagaatgctgcaaagcagggagcttacatgaagaagcggcttgtagagctccagaataagtataatgagataggagacgttagggggcttggcttaatgcttgcaatagactttgtaaaggataggaggactaaggagccaaactctaagttgaggaacgacgtgataaacaacgccttcaaaaacggcttgatattgctttccactggttccagtgcaataaggataataccaccactaataataacccaggaacaggtagatgagggaatagaggtactcgacaaagcaatc

SEQ ID NO: 37139 - DNA, 723 bp, Thermoplasma volcanium
gtaaatggcttgagagccgtaataaagagtggcggcctcgatctaattcggaacggtgattattttgccatagcaatgcaagaaaccaaggttgacgtaaagagtgtacctgaagagatgtatcatctgggataccacgtttacaacaatccagcaaagaggaaagggtacagcggcacgatgactctttcccgtgaaaagcccatagatgtttcttacggctttgaatcggaagaggggcgcatactaaaccttgagtttgataacttttactttataaacgcttacttcccgaattcgcagcacggcctgactaggcttgatctaaagcttgacttcgataaaaaattccttggatacgctaacgatcttcggaaaaagaaacctcttataatatgcggagacttcaacgtcgcccatgaagagatcgatatagcaaggccaaaggataacgagcacaatgctggtttcaccatagaagaaagaacgtggatgtctcagttcttatcttctggttatgttgatacattcaggttgtttacaacggatggcgggcactactcttggtggtcttacaggttcaatgcaagggaaaagaacataggctggagaattgattacttcgttgtatccgatgatataaaggataaggttaaggcgtcacgcatacttgaaaatgtaaaaggatctgatcatgcaccagtggagctagaaattgatata

SEQ ID NO: 37140 - DNA, 2313 bp, Thermoplasma volcanium
gatgttatgggcaaaattgtaaggatttcaggtcctgtcgttgttgccgaggatattgaaaacgctaagatgtacgatgtcgttaaggtaggggaaatgggccttataggcgaaataataagaatagaaggcaatagatctacgatacaagtgtacgaagatacagccgggataaggccagatgaaaaggttgaaaatactatgagacccctctctgttgagcttgggccaggcctccttaagtccatatacgacggaattcaaagaccattagacgtgataaaggaaacttcaggagattttatagctagaggccttaatcctccgccccttgacagaaagaaggagtgggattttgttccagctgttaaaaagaacgacattgtttatccagggcaggtaattggaactgtacaggaaacttcccttattacgcatagaataatcgtcccggatggcgttagcgggaagatcaagtctatatacgaaggaaagcggacagtagaggatgttgtttgtactatttccacagaacatggggacgttgatgtaaatcttatgacaacgtggccagtgagaaaggcaaggcgtgttgtaaggaaactgccgcctgagataccactagtaacgggtcagcgtgtaatagatgcgctcttccctgtggcaaaaggtggtacagcagcagttccagggccttttggaagcggaaagtgcgtatcaggtgaaacaccagtttaccttgcggatggcaagacaataaaaataaaggatctatacagttctgagagaaaaaaagaagataacattgttgaggctggttcgggagaagagataatacatctaaaagatcccattcaaatatattcttatgtggacgggaccatagtcaggagcagatcaagacttctatacaagggcaagagctcttatcttgtgaggatagaaactattggcggaagatcggtaagcgttacaccagttcacaaactctttgtccttacggaaaagggtatcgaagaggttatggcctccaacctaaaggtaggcgacatgattgctgctgtagcagaaagcgaatctgaagcaagagactgcggaatgagcgaggaatgcgtgatggaagcagaagtttatacgtcacttgaagcgacattcgatagagtaaagtctatagcgtacgagaagggtgattttgatgtatacgatctttccgtaccagaatacggcaggaactttataggcggagaaggacttctcgtacttcacaacacggttatacagcaccagctcgcgaaatggagcgatgcgaacatagttgtttatataggctgcggtgaacgtggtaatgagatgacagaaatccttacaacgttccctgagctcaaagatcctgtaagtggacagccgcttatggatcgtaccgtactaatagctaacacatctaacatgcctgttgcggcaagagaggctagcatatacacaggaataacaattgcagaatattacagggatatgggttatgacgtagcacttatggctgatagtacctccagatgggctgaagccctgagggaaatatcaggcaggcttgaagagatgcctggagaagaaggatatcctgcctatctcggcagaaggatttcagaattctacgaaagatcagggagagcaagactagtgtcccctgaagacaggtttgggtcaataactgtcatcggggctgtttcaccacccggaggagatatatcagaacctgtatctcagaatacgctaagagtaacaagggtgttctgggcgctggatgcatctctcgccaacaggaggcatttcccctcgataaactggctcaatagctactctctatacaccgaagatctaaggcattggtacgatgaaaatgttgctaaggattggggatcgcttagatcgcaggccatggatatactccaaagggaaagcgagcttcaggaagtagcacagcttgtcggatacgatgctatgccagagaaggagaaatccatacttgatgttgccaggataataagagaggatttcctacagcagagtgctttcgatgagatagattcctattgttctttgaggaaacagtatcttatgctcaaagcaataatggaacttaactcataccagtctatggctatcgaccatggcgtgactatggataacctctcctcgctacctgtaagggagaagctttcaaggatgaagatagtcccagaagaccaagtagagagttattactctagcataataaaagaaatccataaagagtatacttcgtttattggtgag

SEQ ID NO: 37141 - DNA, 1347 bp, Thermoplasma volcanium
tataaatctgtatctgaaatcagcggtccgctactgttcgttgagaatgtaccaaacgcggcctacaacgagatggtagacatagagcttgataatggggaaacaaggcagggacaggtacttgatactaggaagggtcttgctatagtacaaatatttggtgctacaacaggaattggtacggaaggtacgagagtaaagtttaggggagaaacagccaggctgcctatatcagaagatatgcttggaagagttttcaacggtataggtgagccaatagatggcgggccagagatactggcaaaggagcgtatggagataaccagcaatgcaataaatccatactcgagagaggagccatcagagtttattgaaactgggatatccgctatagacggtatgaatacactggtaaggggccaaaagctcccaatattttccggatctgggctcccgcacaaccagctcgcggcacagatagcaaggcaggcaaaggtacttgatagctcagagaactttgcagtagtgtttggtgctatgggaataacaagcgaagaagctaactacttcacgaatcaattcagggaaacgggggctctttctagatctgtaatgttcctcaacttatcttccgatccgtctatggagaggataatactgccgaggatagctctgacaaccgcagagtacttggcattccagaaggagatgcacatcctggtcatacttactgatatgactaactattgtgaggcacttcgtgagatttcatcggcaagggaggaagtacctgggcggcgtggttatcctggttatatgtacacagatcttagcactatatatgagagagccggcaagcttaaaggcaacaatggatctataactcagatacctatcctgactatgcccggtgacgatataacacacccagtccctgatcttactggctatataactgaggggcaggtagtcgtttccagagacctaaacaggaaggggatatatcctggaatagatgttttgctatcactttcaaggctgatgaaccagggcatagggaagggccacacccgtgaagaccacaggggattagcagatcagctttattcagcttatgcctcaggaaaggatttgagatctctgactgcaatagttggtgaggaggccctcagccagaatgacaggaagtatcttcggttcgctgatacgttcgaggaaagatatctaaaacaagatttcttcgaagacagatctattgaagacaccctcaacttaggatgggaacttcttgccgaccttcctgaatctgatatgaagcgggttaaaccagaccacattaagaagtac

SEQ ID NO: 37142 - DNA, 1167 bp, Thermoplasma volcanium
atggtaagagtagggataataggctatggcatttcaaagtttggcaagaggaacgacgcgtcaatgtatgacctcatatgggaagctggttctgaagccctgaaaacaagcggagtagacaaaaaggatgttgaatatttagtggtttcaaatatgggcatgtggagctcagaagaacttcctgctgtggttgcaggtgaagtactgggcactgaaagggcgggtactaacagggtagaagctgcctgtgcgagcggcagttcagccatatcatccgcctacgacgctatcgcctcagggcatgtaaggatggctatggccctgggagttgagaagatgagcgaggttgatacaggtactgccatagagctcataggtcgggcaggaaacttcctctgggagtatgagttcttcggtctgacttttcctgggtactatgctctgcacgctaccgcatacttagataagtacggtggcaaagaagaggatcttgcgctggtttccgtcaagaatcatcactacgcacattttaacccaaaagcccagtttacaaatgatataagtgtcgaggacgtaatgtcgagcaggtacatagcttccccgctcaagctgtacgattcttcacctataactgatggtgcagcagccgttgtccttgcttctgaagacgttgcaaagcagtataccgatactccggtctggatagatgctataggatctaacctcggaacttcaaacttaagcaagcggcccgacttcacgggcatagaagccgcaagagaggctgcaaggaaagcctataaagtggctggtattgacagcgagaaaccatataatttcatagacggtgctgatgtgcacgactgcttttctatagcagagctaatggcctatgaagaccttggctttgctggcaaaggcgaggcgcttgaactgataagagaagggcagacatacataggcggtaggatacctgtgaatgtagacggtggcttgatatccaaaggacaccctattggggccactggcgttgccatggcagtcgaagcaacaaaacagttactcagaaaggcagagaatggcaggcagatagatgtgaataaaggaagattccttacacacaatgttggcggtaccggccactatgctttcgttacggtttattct

SEQ ID NO: 37143 - DNA, 711 bp, Thermoplasma volcanium
aaagtagcaatagtaactggcggaagcagcgggataggccttgctgtagttgacgcactagtgcgctatggggcaaaagttgtttccgtatcccttgatgaaaaatctgatgtaaacgtatctgatcactttaagatcgatgttaccaacgaggaagaagtaaaagaagcagtggaaaaaacaactaaaaaatacggcaggattgacatactggtaaacaacgctggtatagagcaatattcacctctacatcttacgcccacagaaatatggcgaaggataattgatgttaacgttaatggttcttacttgatggctaaatatactataccagttatgttggctattggccacggatccataattaacattgcttctgttcaaagctacgccgcaactaagaatgcagcagcttatgtgactagcaaacacgctcttttagggttgactcgatcagtagccattgactatgcaccaaaaattaggtgcaacgctgtctgtccaggaaccattatgaccccaatggtcataaaagctgcaaagatggaggttggagaggatgaaaatgctgtagagagaaagatagaagaatggggcagacagcaccctatgggcaggataggaagaccagaagaagttgcggaagtagttgccttccttgcaagcgacaggtcatccttcatcactggagcatgcctaactgtagacgga

SEQ ID NO: 37144 - DNA, 885 bp, Thermoplasma volcanium
atgacggatcttctccaggaatttgaagaaaaaagagatcttctgaaaaaagccgtagaagagcatataaagaagagagatgaggctgcgcaacaaagccgaagctatgcagagcaaagggatcagcttaacgcaaaagtacatgagatgcgggagcaggtaaaggaaaagatatcccagaagaatgccctgatagaagaggttcagaaagtcagggcggaaaaggaagagcattttaaaaagctctcggatctcaggaaggattacaagaagctttcggaggaatcaaattatactaacattagccaaagagagataaaggcaaaagaaaaggagcttcaaaagcttataactaaacagcagacaatgcagttgacaaaggctgaagaggataagatagtatcagagatcaagaagcttaacaacgaaataaaaaagatgaaagaagaccgtaccaaacaactgaacgaaaatgaaaaggttaaggaactgcttgcagagatagacaaagaaaaaacaatagcaagggatctcaaaaagaaagctgaagagatttcgaataaaatatctgagataagcaacgatattaacaagtcacttcaagatctagatgaggtccggaagaaagcagatgaaatgcatgaaatggctgtaaagtatggcaaggagtctgaacaggaacacgaagcgtttatacaagctaagaacgatctcagggatttagagaaggttatagcaggcctcaggactaaaaagagagcaacaaagaagaaggagaaagacgacgaacttcagcagaaggctgaggtgctctttgaaaaattcaagaatggagaggaactcacaaccgacgatcttctgatacttcagaaggcggggttcctg

SEQ ID NO: 37145 - DNA, 1077 bp, Thermoplasma volcanium
atgaccgtcaagggagttctgatggcaggtggcaagggcacaaggcttaggcccattacatattcgataccaaaacctctcgttccggtggcaggaaaaccggtgatatcctacatattagattcattctataacgcaggtgtcaaggacataataataacaactggatataagttcgaagcgcttataaagggcgtactagaaaacaaattctccgaccagaatatattgttttcagtggagaaagatcccgcaggaacagcaggtggtgttaaattggcagagaacttcatagacgacacttttgtcgttggaagcggtgacatacttatcgatttcgacgtctctaagatgatagaggagcacaagaagaggggggctaacataacaatcgcccttactagggttgatgatccgtcccagtttggcatagctgaagttgacgatgaaggctatgtcaaaaggttccttgaaaagccaaagaagtcagaaactttttcgaataccataaacgcaggtgtttatgtgatcgaaccatctgtattggaatacataccaaagggcgtacagtttgactttgccaaggatctatttccaaaggctatggcgaatggcatcaagatatatacttacgaaataaatggcgtctggttagatgcgggcaggccaggggatcttataaaagcaaaccagataatggttgataaatacggcgataggaatataaatggcagcaggatgatattaaaggcaagaataccggatggcgttaacgtaagcggcccgacttacattggagaaggggtagccataggcaagggatcgtccatagactcttcgactatatacgaaggagttcaaataggcaatgatgtggagataaagaactcggtgataatgtcatcttgcagaatactggatggatcaaaaatatccgattcggttataatgcagaacacggtcataggtgaggcctgtgagattagaaatagcgtactttcccaaaaattaaacctgcaaaaaggctccagggtatttgatgtggccctatcttccgaaataatacaggatgaaaac

SEQ ID NO: 37146 - DNA, 2307 bp, Thermoplasma volcanium
gtgaatatggttaaagaggtagttaaaagagatggaaccgtagtcccattcgagaagggaaaaattgctatggccatatacaaggccatgctgtctgtaaagaatggtagcatgagagatgctgaaacactcgctgacaaggtcgttgaaaggctaaagaacattgaaaggcctacagtcgagcagatacaggatatagtagaagacgtcctcatgacatcaaagattgagggtaaaatatttacagacgttgcaaagtcatacatactttacagggaaaagaggagagctataagagaggaaaaggaaagcctaggagtaaaagacgatctgaaattgacactgaacgctgtgaaggtactggaagcaagatatctgcttaaggatgaagacggaaagataatagagacacctaggcagatgttcaggcgtgtagcttcacatataggtataattgaggcgctatatgattttatggaatacaaaaaaacagggaaaataccagaaaacgcagaaaagatcggcaaagtatccttaactcaggaagaggtcctcagaagggcttttaattacatgaaagaagatggaataatggaaggcaccttcgaggaattcatggactttttgtcgaccaaaggaacgtcagcgcatctttacataaacaagtttgaggagatgatgtcttccttggattttgttccaaattctccaactcttatgaatgccggtacgaaattggggcaactctctgcatgctttgttcttcctgtaggtgacagtatagaggatatttttgaaaccttgaaaaacactgcactcatacacaagtctggtggcggtaccggattttctttttccaggctaaggccgaaggacgacatagtcggttcaacaaagggggttgcgtccgggccggtgtctttcatgaagatattcgatgtaacgactgatgtcataaagcagggcggcaagcgtcgcggggcaaatatggggatactgaactacaaccaccctgacataatggaattcgtgttaagcaaggactctgaaaataaagtgcttagcaacttcaatatatctgttggcgttacagatgaattttttgagaagttggacaatgacgattacgttgatctcataaatccaaggacaaagaaggtaacgaaaagaataaaagcaaaggaattatgggatgcaataattgaccaggcttggaagacagcggatccagggcttatattcttagacgagataaacaggaaaaaccccgtcaagaacgttggggatatcgaatcaacaaatccttgtggggaacagcccctgttaccttacgagtcttgcaatcttggatctataaacctgtcgaagtatgtaaatggaaaggatatagattacgatagattaagggaaaccgtctggctggcaactcgctttttagatgatgtcatagatgctaacaagtttccagtagagcagataaagaaagtaaccaggatgacacgcaagatcggtctaggcgttatgggcttcgcagacctgttgataaagctcgaagtgccttacaacagctgggaggccttggaaatagctgaaaaagttatgagcttcataaacgaagaaagccataaagcctcgcaacatcttgcagaggagcgtggagtattcccagcttggtatggttctgagtgggagaaggaaggcataaagatgagaaattcaactacaactaccatagcccctacaggtaccatatctataatcgctggatgctcttcctctattgagccaatatttgcacttgcctttgtaagacatgtactaaatggacaagaactgctagaagtcaacccactgttcgaagagaagactagaagccttggtctatactccgaggagcttatgagaaaagtcgctgaaacaggaaacctggaaaatatcgagataaacgaagaaataaagaagatcttcgtcacagctcacgaagtagatccgcagtggcatgtacttatgcaggcaacgttccagagatactgtgattcaggcgtttccaagactataaacatgaaaagtgatgctacaagggaggacatagccaaagcctataggatggcaaaggatcttcactgcaaaggtataactgtgtacagagacaagagtaagactgtacaggtacttacagccgggacaacggagacgaaaaaaacggaggagaaagaggtaatagagctagtaacgaagatgcctgacaaatatcttaaaatagattcgaccttcgatcctgcatgcccaacaggaaaatgcgacaaa

SEQ ID NO: 37147 - DNA, 1308 bp, Thermoplasma volcanium
atgtacgacgcagttgtacttggggctgggccaggtggatacgctgcggccattaggcttggccaaagaaaaaagaaggtagccataatagagaaggacaagataggaggcgagtgcctaaactatggctgcataccatctaaggcgatcatcgagcttgctaattcaataaattacctaaaggagatgcccggagtatcgattaattacaatgtagacatgaaaaaatggcaggaatggaaatggtccatgattaacaagcttacaggtggcgttgaacttctccttaaggcgtatggcgttgacatcttcagaggcacaggatacatacaagacaagaaccacgtgaaagtcaacgataaggttcttgagacagatagccttgtcatagctactggttctaagcctgtttcaatcaacgggataaatgatgtgatgtataaccgcgaagtcttagatctcgaccatataccctcttcgattgttataattggcggaggatacatcggtgttgaaataggaatagctctagctaagctcggaagcaaggtgaccatagttgagatgatgccatcaatactgcctggtacggataatgagctagtaaggcacgtagtaaggaggatgtcgcagttaggcataaacgtaataacagggagaaaggttttatctactgcgaaaaacggggaagtcactgttaaattagatgatggacaagaactacgcgccgaaaaggtgctcatgactgttgggaggatcccaaatactgaaggattcggactggagaatctgaagctagccatggatggccgcttcataaagaccgattccaggaagatgacgagtgtgaaaggagtttacgcgataggtgatgtttcaggacagcctatgcttgcacacaaggcatactatgaggcagatatcgctgcggacaatatatgcggcatagatagcgaagttgattacagggccatgccctacgttatatattcagatccggaaatagcctatactggcgtgaagggagcaaagtccacaaggtttcctgtcgctgcaaacggtaggtcactaacaatgaatgaaaacataggcaccttcaacatatactatgatgaaaaaggcatagtgacgggcgcaggaatcgcagcacctcatgcgagcgagctaatctcagagatatcgcttgccgttgaatcagggctaatggcaatggatataggtttaactatacacccgcatccgaccgtttcagaaggcgttaaggagagcgcagaagaggtttacggtaagccattgcacttcaaatta

SEQ ID NO: 37148 - DNA, 1200 bp, Thermoplasma volcanium
ttgtacgaatttaagcttccagacataggagaaggcgtaactgaaggcgaaatagttaaatgggacgttgctgaaggtgatgaagtaaaaaaggatcaggaccttgtagaggtaatgactgacaaagtcaccgttaaaataccatcccccgtaaatggcaagatctctaagatactctacaaagaggggcaagttgttcctgtcggctccacattggtccagatagatacaggcgaagagacctcacagcaaactatggcagaagaacatgccgaattaaagccgcagactacggcagcgcagcagatcgcaattgaaacggtgccagcagggaaagttcttgccagtcctgctgttaggagaattgccagggagaatggcatagacctagctaaggtaaaagggactggcgataacggcagagttacgttggacgatctcgatgcatacatgagaggcgaaactaaggccaaggccccagaaaaacccatagaggctgcaaagccggcagaagtaccgcctgtgcaaagatcaccgggcagagaagagatactggagatgcacggactcaggcgcataatattcgacaagatgacaaaggcaaagcagatcatgcctcatttcaccgtagtagaaaaggtggatgttacaggcatgatatccataatagaatcagcaaaatccagcggaaaaaaggtgactattactggatacatagcaaggatagtaccaattgtgctgaaacagtatccatacctgaacgcaatatacgatgaagcgaacaggagataccttataaagaaatactataatattggtatagctgtagatactcctgatgggctcaacgtatttgttgttaaagacgcagacagaaagagcatgtacgagattaccgcagaaataacggataaagctgagcgggccaggaataatcagcttaagatcgatgaggtgcaggattcgacctttacaataacaaatgtaggcacaataggcggagtgctttctacgccaataataaactatcctgaagttgctatacttggcgtacacagggtaatggatgaaaatgggaaaaagataatgtatctatcgctttcttgcgaccataggctgatcgatggagctgttgctacaaggttcattatggatctcaaaaaaattattgaggatcctaactctttgatatacgagatg

SEQ ID NO: 37149 - DNA, 957 bp, Thermoplasma volcanium
acgcagatgaacattgttcaggcgcttaacaacgcaatggatataaagatggccgaggacaatgatgttgttgtactcggggaagatgttggaaaggacggaggagtcttcagagttacagatgggctcctcgccaagtatggtccagagagagtcattgatactcctctcacagaactcggcatagtgggaatggcaataggcatggctgtcaacggtttaaagccgatacctgagatccagttccaggacttcatttacaccgcaatggatcaaataataaatcagatggcaaagataaggtacagatctggtggagattacacagtgccgcttgtccttaggactcctgttggaggcgggataaaaggtggcctttaccattcacagagcggcgaaacttatttcgcccacacagctgggcttaccgttgtttcaccttccaacccctatgacgctaagggcctcctgatatcttcaatagaatcaccagaccctgttatattccttgaaccaaagaggctttacaggtcgcagaaggccgatgtaccagaagataagtataccgtgcctctgcgcaaggcaaatctgcttagagaaggcaacagcgtcacactagtaacttacgggtccatggttcctactgtgctgagcacagtagacaagaatggtatagatgcggatgtcgttgatctacgaacaatagcgccactcgataaggacactataatctcttccgttaagaagaccggtagggttgttatcgtacatgaggcaccgcgtaccctcggtgtcggtgcagaggtctcggccatgatatccgagagggcaatagaatacctttacgcacccatactgaggattaccggcccagatactccgttcccatacaggctggaagattactatctccccaacgaacaaaggataatggctgctataaagaaagtgatggaa

SEQ ID NO: 37150 - DNA, 1002 bp, Thermoplasma volcanium
atgactgaagttttagatcaggaccagaagagcctgtacgtcaaaggctttacttctatggttctcgggcggttgtttgacaaaaaggttatcacagcacagaggcagggcctcgttggcttctatacccctatgatgggacaggaggcaacacaggcaggggcggccatggcactctcaaagcaggatcttgtctacggatactaccgggacgttactctcctcatataccttggatatccaattgaaaagatattcgaccagataatgggaaatgcagaggatacctccaaggggaggcaaatgcctagccattacagcgctaaggccgttaattttatgtcagtaccgagcccggtagcaacaaaccttccacttgcagtaggtgctgcatacgctaagaaatatagaaaggaggatggcattgtaattaccagcttcggagatggaggcacttcaacgcctgatttccatgcagccatgaatttcgcttcagtgtacgatctgcctgtcgtttttctctgtgagaataacggctgggctatatcgttccctgtagagaggcagactaaggctgaaatctacaaaaaggctgaagcgtacggcatgaagggtgtttacgttgatggaaacgacttcataaaaacttacaatgccgtaaaggaggctgttgaatacgcaagatcaggaaatccgatacttgtcgaggccaggagctataggatgggcccccactcaacttctgacgatccaagcaagtacaggcaaaatgaggtaaaggagggggacgagaacgatccccttgtaatagcagaaaaggcagttatctctaaaggaatattaagccagtcagaagttaacaggataaaggatgaatctagaaagatgatagacgaaaagtttgaagagaggcttaaaataccagccccagacccttcaacgttgtttgatgatgtatactccgagaccacatgggttattgaagaagagaggggtgatata

SEQ ID NO: 37151 - DNA, 1584 bp, Thermoplasma volcanium
atggaatattctatcatgggctataacttcgtgagagatgttattgagagaaacgacaagagaaagactgcagtaataatgtcagatgaaaatcttagctcaaaaaatgagacctatggaacactgttgaaagaatcttacaaactaagcaattttatgcgtcaactaaggctgaaggcaggaaatcgcatccttataatgatggagaactcccttgatctataccatgttgttactgcatctatagctgcagggatggtgtatgcacccacagctccgatactcccagatgatcagataaaatacagggtagagcaactcaaggctaaagctatattcgtggatgctggaacccatcaaaaagcagagcaattcggtgacatcgtagttaacatgagtgatgaaggtacaagggtagagatatctaaaatggatgacacttttaatgattttgaaacagaaatagacggcgagcatgcggttttcttcacctctggaactgaaggtatgccaaagatggtgctacatacgaaccgctatccagaaggccatagaacaacagtcaaatggcttgatttgaacagagatgatgtgcattggaacataagcagtccaggctgggccaaatggggatggtcttcctattattctccatttattgccggttcggcagtttttggcatgagctacaggaggttcgatccagaacgtgctttagacgctatgtcaaagtttcagataactagcgtatgcgcaccacctacagtatggaggatgttccttcagcacgatgttggatctagggcgctctacctgaagaaggcggcctccgcaggagaaccgctcaatcctgaggttatcgaaagatttgaaaaatacacaggcgttaagataaaggacggttacggccagactgaatcgactttgatggtgggcaatttgacaggcatgaaggtgaaaccaggttcgatgggaaaatcgttagagccgtacgatatacgtattgttgacgaaaatggaaatgaactaggcgtaaatagaacaggttttatagctgtgaaagcagaaaaaaggccagaggggcttttcagtgcatatattaatgataaaaagcttacacacgacaggtttaagaatggctactattacacaggcgatacgggatatcgagatgaagatgggtacatatggttcgtttccaggtcagatgacgtaattaaggcatcggattacaggattgggccttttgaagtggaatcggctctgttaaggcatcctgctgtagtagaatcagcagttgttggctcacccgacgatatccgcggcgatattgttaaagcatatgttgttctaaagaaaggatatgagccgagttacgaacttgccagagaattaagtatgctcgtaagaaatacaataggtccacacgctagaccaaagaggatagaattcgttgaagatctccctaagactataagcggaaaaataataaggaaacagctcaggcagatggaaatagacaggtatatgaaaatgaaaaatgggattaatttaaacactagtaacaaagaattcaacatagaa

SEQ ID NO: 37152 - DNA, 1383 bp, Thermoplasma volcanium
gaatccataaatgatgccaaaacaagtgggttccattacaagacatggattgtgtcaggtctaggtttctttacggatgcctatgacctgttcataataggggttgtaacgagcatacttgttctatcaggctggaacaagtttacaacacttcagtcatcgctacttgattccacagcccttttgtctgctgtaattggagcattgatatttggaaggctaatagacaagctcgggagaaagacggtgtatggcctcgaactcataatacttatagtaggtgcacttggaagtgcgttcctgacaccgttaaatggtgtatatgtattgattatctggaggttcatactgggtatcggaataggaggggactatgcaactagttcaacaataatggctgaatactctaatacggcccacaggggaaaactcgtcggaatggtgttttcgatgcagtccctggggcttcttgccgggccgttgataactctcggtttgttatattcaggcatgagcctttcactcgtctggaagcttctcctagcatttggtgccataccagccctcatagtcgtgtatttcagaagaaaaatgcctgagacgccaaggtacctactcagagtcaaaggagatgctgaggcagccgtcaagaactgggagaaatatactggcatagaagcgtctgcagatgctcaagctgaagtcataaagaaatcctggacgcagataattaaacaaaaggagtttctaattacccttgttggaacagcaggggcatggttcctaatggattgggctctttacggtaattccataatgtctagttctatgcttggagttcttgtcccctcatctgtgactggtctggatcatctgataaggacaacaatatattctgcgatgatttttggatttgcggcattccccggatactggctcgcaactttcacaatagaccgtattgggaggaaaactatacagtccataggttttgcagcaatggcactttcatttggaatacttggtgtctttcatcagcttctttctccgtcgtatattgttcagttcctattactgtatggtatgagctatttcttcataaacttcgggccaaatgtaactacattcatatacccacctgaagtgtttcctacaaaggttagggggctaggagcaggcgcttcagcagctggtggaaaaataggggccttcgtcggaacattccttaatgcaattatattacgttcttcaataggtgaatctggtctcttcatgatactagcattgctggcagcttttggcttgatcataacactggttctgcttccagagcctaagaaacttgacctagatgagtcttctggagagaaggcacttcttgtt

SEQ ID NO: 37153 - DNA, 1053 bp, Thermoplasma volcanium
atgtcagggatagtgacctacggttcttacatacccaggtacaggataaaacctgatgagatagcaagggtatggggagagaaccctgagagaataaaaaacggtatttttatactaagtaaatctgttccggctccagatgaggacgtggctacaatatctgttgaagccgctaggaatgccctcaagagaaaaaaaattaacccaaaggagataggtgccatttacgtcggttctgaatcgcacccatatgcagttaagccaactgctaccatagttggatcggccatcggtgtagatttttcactctttgctgcggattatgagtttgcctgcaaggcaggtaccgctggcatgcagaatgtgaaggcaatggtcgacgctggaatgatcaagtatggacttgcaataggagctgacacttcacagggcgccccaggtgatgcactagaatattcagcctcagcaggcggtagtgccttcataataggcaaggatgatgttattgctgagattaactctactttgtctgttgcttccgatacgccagatttctggaggagggaaggtcagccgtacccgagccatggagagcgatttacgggagagcctgcatacttcaggcacgtggtgaatgcagccaagatgatgatggaacgaatggagacacaaccaaaggattacgattacgttgtattccaccagccaaacggtaagtttccgactagggcagcaaagcttcttggttttgaggagaaacagtacaaggacggtttaataactccttatattggaaacacatactccggatcgatgatgacaggcctttcatcaatacttgatgtctcaaagccaggcgatcatatacttgctgtttcatttggatccggcgccggttcagacgcattcgatattacggtaacggatcgcatagaggaaatggataggaataaggctcctactattaagaaaatgcttgaaaaaattaaatgggttgactacgctatatatgccaagtataagaaaaagatagttctaggtgatggaattgag

SEQ ID NO: 37154 - DNA, 1155 bp, Thermoplasma volcanium
aatgacgtttatattatcggtgcaggtgaaacaaaattcggcgaactatgggataagtcccttagggatctggctgtagaagccggccttgaggccataaaagacgcaaatatatactctaaagacttgcagatgctctacgccagcaatagtctggccggaacaataaatgaacagtctaacattgctgcacttgcagctgacttttccggtattgcagagaaccatgttcctgctgtaagggttgaagcttctactgcatctggcggtgcggctgtcagggaagcttatctcgccattaagtccggagagtacgatgtggtaatggtgggcggtgtcgagaaaatgacagatatatacggaacagagataatcgatgtacagtcctcgatattggatcgagaatgggaaagcttcaatggtgccacaccagcagccatggcggcaatagcagcacgcaggtacatgcatgactttaatgttgaaagagaggccatatccatggtcgctgttaacgatcacgctaatgcatcgctgaatcctgatgctcaatacaggaataagataactgtagatcaggtattaaacagcgatcctgttgctgagccacttaacgtattcgattgttccccgattaccgacggtgcttcagcaataatattggcatctgaaggctttgtcaagaaaaacaggattgatggcgtaagaatattaagctctgctatggcagaggactacctagcacttcatagcaggaaatctatctacactctggaatcaacaaagatcgccacagaagaagcacttaagaaggcaggaataaagagggaagacgtatcatttttagagttaaacgattcctacagtatatatggactgcttgaacttgaagacatgggttttgcagaaaagggtaaggcaaaggatctggtttacgacgacataaagctgaacggaaggctccctgttaatccgtctggtggccttaaagctaaaggcaatcctctgggggctacaggtgtttctcaattttttgaagcatacttacagctcaaagggaaggcagggcagaggcaggtaaaggatgcaaggtatgcgctgctccacaatatggctggaactggagcaacttctgttgtacatgttgtaggtgag

SEQ ID NO: 37155 - DNA, 627 bp, Thermoplasma volcanium
gaagttcagtgcggcatagacgaagccgggcgtgggccagtaatcggccccatggttatatcgatagtctgctgcaaagaagaatacctaagagagataggcgttaaagattcaaaaatgctgtcgaggaaacgaagggagtacctttttgacaaaataactaaaaattgcgcatattcatacgttgttgtatcacctgaaacattgaacaaagatatggccagtgaaagcctaaacaagatagaagagaattacatacttgaattgctaagcaaagctgaaggtatcgtttacatagactgcttcgatgttatagaagagagggcagaaaaatatattcgcgaaaaaagcggaaaagaagttgtatgcaagcataaggctgattcaatttacccggctgtatccgcagcctccatcgtctctaaggtcataagggatcgagagatagataaaatagctgaaaaatacggcttttttggatccggatatccatcagacccaagaactatagatttcctcaggaaggcgatgcaacagggattagatcttagaagcgttgcaaggatacattgggagacttataaaaaaataaaagaagacgtcgaatctgggcagaagaagctgttt

SEQ ID NO: 37156 - DNA, 1116 bp, Thermoplasma volcanium
gcggtacaatcgggagaactgcgagaccctaggtttggcaacgtcactacgcctatatttgagacatccacttttgtctttcctaattcagaaaaagatgcctatatcgataacacgagaaatttgccatacatatatacgaggtggggaaacccaacagtccaagcgtttgaagaaaaatatgcttcgctagaaaaggccgaacatgcactctcattctcatccggtatgggtgctataacatcggtaatccttgctttagcagaaaggggagacaagatattgtctgtttctgatctttatggacagacattctactttcttaacaaagttctcccagagtacggcatatccgttgaatacataagcacagataggctaaattcaggggaattcaagccctcggattacgatatcatttatctcgaatccataactaaccccacattaaaagttccagacataaaagcggtttctgaaaggtctaccggaaaaaaaataatagtcgatgctacatttgcatctccatacaaccagaaccctctggaccttggtgcggatgtagttatacacagtgcaaccaagtacatatcaggacacagtgacgtagtaatgggcgtattttctacaaacgataaatctatattcgataaggttgttgtaaggagaaagacttttggatcaaacccggatccgatacagtcttatctggcgcttagaggaataaaaactctcggcctaaggatggagaaacacaacaaaaacggtatggaactagcgaaataccttagaacagaacccaggataagccacgtctactatcctgacactgaaattggcaaaaaagtcctaaggggattcggaggcatgatatcttttgaactaaggccagaactagatgttcacgtattcatgaggaaccttaagatacccatggttgctgcaagcctaggtggtgtggagagcctcattactcttcctgttgaaacttcacactcgtccatgactaaagaagagagggagaggataggcataacagacaacctagtccgattctcaataggcatagaagaccatgtagacttgatcgatgatataaaacaagctttggataag

SEQ ID NO: 37157 - DNA, 1407 bp, Thermoplasma volcanium
atgcaagaaacaaaaaatatcgtaattcacgaaagaagtgaaaggagaacccgagtcagatgggcgattgtctctcttctcttcatagccatattgtttaactatgcggacagagagatctggatagtttcagagccagcctttgcctactcctttggctggtcttattcaccaactcatcttgacgcacttgctatccacaatatctcacttatcctattcttctggtctttgtcctatgccatatttaactttcctggcggttggattgtagacaagctaggcttgaggaaatcaatgactactatgtttgcaatttggtcaatatttaccgctttaactgctgctactttcaattttataacaatggctatagtaaggatagtaatgggtgccggggagggacctgtttggcctataaactctaaagttgtaaagggatgggcatctaggtttgacgagtcgaaatccttcacccttgcaggtgcaggacaggctgtaggcccagtcataggcctgatagccggtggaatccttgttactttattcggatggccttccgcattcatattctttggcgtactgggactcatatttgtagcaatatggttcttttacgttcgggatcgcccgtctgaagacagcaaggtgaatgaaaatgaacttgcctatataatagagggcaagacaaatgaagaaaaggaggagaagatcttgccttcaaaggttaactggaaaatatcggcaaggatgatatttggtacacaagcaggcctgggcacactattagtattcctttcttttggatacgtgctcttcactttcctctattggctaccgccccttatgttctctacgtttgctcacactgtagagaagagcggcctatattcggcggcaatagatgttgctctaatagcaggattcctcggatctggaccttttaatgatggccttctaaagagatttccggataataagccgctggcaaggaggttaggagccataataccaatggttttaatgatagtaatggttggcctttcatactttactggtaaagcccataaccttgttggaacagcaatatttttgggtgtagggtccggtttaatgaacctaaccgtaggttcatgggctgtaaacgcggtagatctcgctccagctggaacgtctgctacggtttacggtatatacaatggctcgctaaactttatcggcgcatttaatgcaataatagaaggtatacttttcatcaggtatgggccggtgctggcttttaccagctcaatactattcatgcttatgttccttggaggatacttagggctgatcaggaagaacacctgggagagggccatgaagtataaagaggaactttcaagagaagcttattcctatcttaag

SEQ ID NO: 37158 - DNA, 2613 bp, Thermoplasma volcanium
acttttgaagtcgatggaagaaagtactactactatccgctcaacaaaattttagatggaaaacggttggaaaagctacctagatccctaaggatattacttgaatcgatggttaggaacctggacgggcgttctataacccaagatgatatagatgcaatagttaactggaatccttcgaacgtacctgacaaagaaattaggttcaaggtttcacgtgtagtgatgcaggatttcaccggtgtccctgctgtagtagaccttgcatctatgagggatacggtaaagaaacttggcaaagaccctgaacttataaacccgcaggttcgtgttgatcttgtcatcgaccattccgtgcaggtagactactacggcgaatcgtttgctatcgaaaaaaatgaggaactcgaattcaacaggaaccttgaaaggtacaagttcctaaaatgggcccaaaagtcattcaagaacttcagagtcataccgcccggaacgggaataatacaccaggtcaatcttgagtatctagcagaagtcatattcgactatgaagaaaaaggaaagaggtatgcatacttcgatacgcttgtaggaacggattctcataccactatgataaatggtattggcgtgcttggctggggtgttggtggaatagaagctgaggcagcgctgctaggccagccgataactatatcgcttcctgaagttataggagtaaggttgcatggggaattaaacccaggtgtaaccgcaacggatctggtattgacaataaccgaacttctcaggaaagttaacgttgtggataagttcgttgagttttttgggccttcagtaaagtatctttcagttccggagagggcaacagtttctaatatgtgtccggaatacggggcaactctagcactgttccctatagatgaccagaccctcgattacctgaggacaacaggaagatccgatcacaaaataaagcttataaaaaaatacctagaactgcaggggatgttcggagaaagtgagggtgtagaatacacaaaagtcatagatcttgatctgtcaactgtcaagccaagcgtagctgggccaaagctgccgcagcagaggctagatttagaccaggtgccatcgagcttcctctcctctgtagaatcgaacagcgacagtcacctagtttctcttaggaaagtcccgctcaagttgaaagggcaggatgtagaactttctgatggcgatatcgtcatagcagctataacaagctgtactaacaccagcaacccctatgtaatgctggctgcaggtttagttgcgaagaaggccgtagagcttggactaaaggtaaatccaaaggtaaaaacaagccttgcgccagggtcgagagttgttacagactatctcactgaatctggtttaatcgattacctagacaagctagggttttacctagtaggatatggatgtacaacatgcataggaaacagcgggccgcttgacaaggatgtcgatgaggctataataaaaaacaatcttaacgtcgtatcagtattatcaggcaacaggaatttcgaggcaaggatacacaaggacgtaaaggcaaactatcttatgtctcctccgctagtagttgcctacgcaatagcaggaaacataactataaacttggataaagacccgttaggagaagttaatgggaaaaagatataccttaaagatatctggccttcaaacaatgaaattaaggatgcagtcaataaatacgtaaagaaggagatgtacgagaagcgctatggaaacataacgaataagagatgggaaagcatagatgtacctgaatcgcctgtatacaactgggacgaatcaagtacttacataaggaatccgccattttttgagaactttaaactcaacgagctcataagcactttctctgtcaaaggggcttatcccctgttgatactcggtgattctgttacgacagatcatatatcgcctgctggatccataccaaaggatagccctgcaggaaaatatttgatcgaacatggcgttaaaccagaggatttcaattcttacggttcgaggagaggaaaccacgaagtcatgatgagaggcacattcgcaaacgttagaataagaaaccttatggtgaacaaggagggtggctacacgatatttattccagacaataaagaaatgtcagtttacgatgctgcaatgaaatacaggtctatggggatacctcttgttgtagtggccggaagggagtatggtacaggaagctccagggattgggctgccaaaggaacatacctgcttggcgtcagggcagtactggcgaaaagctatgaaaggatacacaggagcaacttggtgggaatgggtgttattcctatagaatacgaaagcctcaatccgcaggacatcgactttacgaaaaaaatagatatcgatatagacggcatcgacccaggatcaaaagcaagaatgacttatactgacaagaatggagagagccatactgtacctgtaacgttaagggtagatacccctgctgaggccgattatataagaaacggcggcatactgcagtattctctcagaaagatactt

SEQ ID NO: 37159 - DNA, 1176 bp, Thermoplasma volcanium
gatggaacacttctcgttcctgacaaagttacgataggctacattgagggggatggtataggccccgatatcacgaagaccacgataaatgtaataaatgctgcccttgaggtcgcctatggtggaaagagatcaatagaatggcacaaagtccttgcgggcgatgaagcatatgataagactggaaataggcttccagattcttcgctcgaagagcttaagaagtgcgttgtttcaataaagggcccgctcactactcctattggcgaagggtttaggagcctcaacgtcacgctcaggcagtaccttgatctgtatgctaacataaggcccgtccgttacttccctggagtcccatctcctgttctccatccggaatacatgaacatggttgtcttcagagaaaatactgaggatctttacgctggcattgagtggaggtatgattctgaggacgcggaaaaggttagggcttttctatcatctacattcaacataaatcttacgccagatacgggcataggcataaagcctataagcaagttcaagtcgacaaggttggtgcggaaggcgatacagtatgcaatagctaacggcaggaagagtgttacgctagtccacaaaggaaatataatgaagtacacagagggtgcattcagggactggggctatgaggtagccagaactgagtttggggattataccgtaacggaagccgaatacctgaaagaccctgagaaatacgcaaacaagatagtgataaaggacagaatcacggacaatatgttccagcaggtccttacaagaacccaggaatacgacgttattgctactccgaacttgaacggagactacctttccgatgccctcgctgcccaagttggtggaataggccttgccccaggagcaaacataggcgaccactatgctgtattcgaagcggttcacggtacagctccaaagtatgccggcctagacgttgcaaatccaacttccttgatactgtcagcggagatgatgctcgatcacataggctggaaggaagcatccaagatactcgatgatgctataatgcagacgtaccgcgaccaaaaattgacacaggatatagccaggctccttaatctaaaggccctaaaatgctctgagtttggcgaagaaataatcaacaggatg

SEQ ID NO: 37160 - DNA, 1755 bp, Thermoplasma volcanium
ctggatgaaacagaaataaatgatggtgcaaagagatggatagtaagtattgcaaaacaccttaacccttcatcaatatatgtttgcgacgggacgaaggaggagttcgatgatctggcatctgcaatggtaaaagatggggaaatgataaagctgaacgagaaaaacttcaaaaattcttatttatatagaagcaatgcaacagacgtagctagaactgaagaaaggacctttatttcggcacgcgataagagcttcgtaggacctctgaacaacttccttccccttgatcgagttaagcaggtatggaatcaattctttaaaggcgcgtacaccggcaaaacaatgtttgtaattccttacgctctctcatctccagaatccaagtttgcagactttggcattgaagtcacggacagcaagtacgtggtactgaaccttcattacataacaaggatgggaaagggcgttatagaaaagattggtgataggttcatcaagggagttcatgccactggaaacctcgatccaggaaacaagttcataatacatatgccctgggaaaaaccagaaggagttgatgcagatatactgagcgtgaacacaaactacggtggaaacgctctcctgagcaagaaatgccatgctctccgtatagcttcagtcagagcaagggaagagggatggcttgcagaacatatgctccttcttgaagtaaaagatccacaaggaaagagccatttcataacaggagctttcccaagcgcaagcgggaaaactaatttggccatgatatctccgccaaaggattacagagatgcaggatggtctacgagactgataagcgatgacatatcatggataaagatcgtggacggaaaattcatggctacaaaccctgaaaacggcttctttgcagttgtgccaggcacaaattacaatacgaacaagaacgccatggccactttatccaaaaatactatattcaccaatgttgggcttaccatgtctggcgatccctggtgggagggcctcgaccctgtttatgatgaactgtacgactggaaaggcaataaaaggaagataggcggagagcccatagcacaccctaattcaaggtatacatcacctttaacgaactatccatacctgtcagatttgtacgaagatccggaaggcgttcctgtatcagcaatactctttggagggagaagggctaccctcatcccgctagtattcgaggcattcaactggaaccatggtgtcttcttaggggcaacaatgggtgttgaaaggacggctgcctcagaaggcaaagttggggacctcaggagggacccaatggccatgcggcctttttgcggctacaacataaatgaatatttcaggcactggatagagataggcgagcgatccaagaacaaacccaagatattttacgtaaactggtttagaaggagagctgatggcacctttatatggccaggttttgctgaaaatttcagagttttggaatggatcatctatagaacctcgcacaacgataacgcagttgaaactcctataggttacatacctgaaagcttgaatcttgcaggactaaacataagcgaggaagatgtaaaggagcttttcaggatagataaagaggggtggaaggaggagatgaacgaaatccaaaagtacttcagtgaacttggaaatgtgcctgaagaaatacttaaggaattcgaattagagaaaaagaggttaggg

SEQ ID NO: 37161 - DNA, 2994 bp, Thermoplasma volcanium
agaaaaatatatgaaattatatccttaagcataattgaaataaaggaaataagcaatataaaattaaacaataacaatataaaaataccgtattcaacttttcaagatcctaatgaaattaaggatttctctttcgaagtaaatttagatcaacttgatgatggttataagtatctcttatcagttgaattatctggaaatgcagaattaattattgatggtatgctggatcaatcaatagatgccggtcatacttattcaatatttgatggtccaaaacatgaatttgtccttagagtgggtagtagggaattatttggaaaaaattcttggtatttaaatataaaatctataaaaataataacgataaattataagttatttaaacttggcttgaattttttacaattatttaagtatgcagatactacaagcaggtctaagcttaggatttacaattatatgttgaaatatctgcttacattatatgaatccccgaatatagaacaaattatgggaataggttcaatatttcttaataaaaacaaagaagaacttgtagattttttatctgatgtatatggttatcctataattaatcatatgattaaagattatccaaggaaagatataaatctctataagtatactaatgtattagaacatataattaaaacaatagcggctagtgataataagtataaaaccaataaagtttttgcctttggtcattgccacatagatgttgcatggttatggccatattctgagaccttaagaaaaatagaacgatcatttctaaacgttttaaaactttacgaaatgggttttaattttgtttttgcacaaagtacagcattatattattatgaaatagaaaaaagaaatgtttacatcttcaataaaataagaagactagttaatgatggcaaatggttcattgttggtggtatgtgggttgaatctgatacaaatttgattagaggagagtcactagcacgtcaattgctatacggtcaaggatatttcaaagaagtttttaacagatattcgaggattgcgtggttaccagacacttttggtttttccggtcagttgccgcaattgtttgttaaatccggcatggaggtctttgtaactcataaaccaatgtggaatgatacaaccgaatttccgtaccattgctttaagtggtttgggatagatggtactccaattattactagcatagtcaatttaagctataacgaaaaccttgattttgattcagtcgtaaatgcgtataaatctaataaaaataagaatttaccaattacatatctgtacgggtatggtgatggtggcggagggcctgatatcgaaatgatgttaaaactagagcagataaaagatttgcaattcatgccgaatgtaaatgggagcttttctgaacaagaatatatagatagctttaaagaattttacaaggaaatgcccagttacttcggtgaaatttatctagaaaatcaccgcggagtttatactacgaatcttgaaattaaaaaatacgttgcaaatatcgaagacaaattgattatgcttgactttataaattcaatgatttataactctaaattgtatataagcaatactaaaaaattatggtatggcttattaaaggcacagttccatgatatattaccaggttcagcctattactatgcatatgaggaagcgtttgctgaattagatgatataatattagagatagataagattacagaatttgcaataaggaaatttatagaagataaaaatattaagaagggcttaattgctataaacaatagtcaatacgagtttaaccattttgtggaaatagacaactcattagcatctgaaattcccgcagataaagtagttaatgttggcgataagaaatttgttttagtcaatgtaccgccattaggtttttctgtaattaacacaaatactgaaaataaatttgaaaacgagattaaaattaggaaaataaaaggtaagtatataatagaaaacaaaataataaagttaataattaattcagtaggtattatatcgttcttttataataataaaagatatatcaaaaaaggaaacatagtgaagatatataatgatatacccgcaaatttcgattcatggaatataaacgcacaaaatatacggaaagatttatttatggacgaaataaaaactgagataagggtaatctcaaaaaatataataggtatggtcgaaattaaaaaaatatttgaagatggatcttctataatacaaaaaattataattagacccggttctagtatagtagagtttgaaaacacgttattactaaaaaatagggaaaaacttgttaaagtagtatttcaaccatattttcatgcggattatattaagagagaaatcccatttggatacataatgacgaaattaaatagtaaaaatgaaaaaactcgtcctgaatttcctgcactgcggtacgtagactatagtgacaatagccatgggttttcaatattgtcgagagaatctcatggatacagttttataaatggggaactaggaataagtatagctaaggttccgttatatcctaatccattttcagatagaaatgaagttagagagaaattttatgtttatttgcacaatgaatattacaacatctataaagatgcaaattttgtttttaatcctataaaattgcacgtaaatgaatatgacggggataacgtcagagagagtttatttaatttttcaggagaaaacataatacttgaaaatataaaagtggcagaagacaatagcggtctagttacaaggttttataattgttccgataaaatgtctacactcgagttaaattttccagggggtgatatttatgagacggatatacttgaaaataaacaggtaaaatataataaaaatattatatttaaaccattcgaaatcaagacattattgatagaa

SEQ ID NO: 37162 - DNA, 1752 bp, Thermoplasma volcanium
atggtagaggtaaaaataattaaatcagatgggttctttaatgaagtgcttatttcttcggacaaaaaaattcactttgacactgcttatgcggaaggtgattttaattgttttggggaagggagtattgtctccgaaacaacagatgatttaaagtttaaaattgcaaatcttatacctggaaagtaccatttcaagatagctatcgatcagtataaaatccttagagaagctgagaatagatccggctcatactcgttttcaatatggttggaaaaaccttatcacaatccagattatgcacagttttgcgcgattattgacaaaaaacttatggacgttcgaatagcagtaccaaaacacagcatttccgtatctatttttacgaaagatactttaaaacctgtatattcccgaagagcatcttttgatacttttgatgcagttgagtatgtttttgatggtatgtcagattattattttgaagtagataattccaggttacctaaggaaggatatttctcaccaaaagtgcacatcgaacacgaaggcggatcaaagatcatttatcacatatttccagataggttttttagagtaggcccgcatctgccaacactatcaagatggggagataaacctactttttcaagcttctttggaggaaatttgagggggataaccgaaaaaataggttatattaaggccctcaatgttgatacgatataccttaatccagtatataaaagcaagtcgaatcataggtacgatgttgacgattacttctctatagacggattgcttggcggtgaacaggattttatcgagttagtcaacgaagctcatgaaaacggtattaaaatagttgcagacatggtgttcaaccatacctcaacggatttcccctattttttggatgcccttaagaacggaaagaactctaaatactggaattggtacatatttcatggtgaaggcgcagcagtatttgatggtagagcaaaaggaaaaacaaaaccattatacgaaacttttatgggagttgggcgcatgcctaagttaaatcacaagaatgcagaggtaaggaagttctgcatagacgttatgaaatactacaagaacaaatttggagtagatggctttagatacgatgttgcacactcaatctaccctgaattctttttagaagctgtcaaagaatttggaaatgagatgctgcacataggggaagcatggtgtcttccatcaatgttcatgctatctggatactggaatagctttacaaattattatctaagaaatgcgattataaagtttgtccgtgaagaaataaatataaccgagttttataatatgattcaaaatatgataatatcttatggtccgcttattcagcagaatgttatgaatatacttgattcacatgatactgaaaggatattaagggcattcaagggaaataaaaaaaaggtcaagcttgcctattcaatattatttatgttcgatggatttgctacgatttactatggggatgaagttggtcttgacgggggccgagatcctgatgacagaagatgttttccttgggacaatatggatgaagatatgcttcaattcctaaaaaaacttggagaaatcagaagaatgtatcacacaggtagtgccggaataataactgtagaagagactcaggaatgcaaatatataactaggttaagcggtgaatcgataataaaggttgcaattgccaag

SEQ ID NO: 37163 - DNA, 522 bp, Thermoplasma volcanium
atgtctcttgtaaacaaagcggctccagatttcgaagctaatgccttcgttaatggagaagtaaagaagataaggctgagcagctatagagggaaatgggtagttctgttcttctacccggcagattttacgttcgtatgcccgactgaggttgaaggattcgcagaagactacgagaaattcaagaagaagaacacagaagtgatatcagttagtgaggataccgtatatgtgcacaaggcatgggtacagtacgatgagagggtggctaaggcaaagtacccgatggtagaggacaggaaaggaataatagcaagggcctacgatgtatacaatgaagaaactggaaatgcccagagagggctctttataataaacccggacgggatagtgaaatacgttgtgataacagatgacaacgtcggcaggagcacagacgagaccctcagggttcttgaagctctgcagtcgggagggctatgcccagtgaactggcacgagggagagccaacactgaaggtt

SEQ ID NO: 37164 - DNA, 2673 bp, Thermoplasma volcanium
ttgataattgagcgcatacgccttagaaattttctttctcacagtgattccgatatatacttcgatactggaattaacatgataatagggcagaacggcgcagggaaatctagtatcgtggacgccatcaggtttgccctcttttcagacaaaagaacaagaagaaccgaggacatgattaagaaaggagaaagatatatggaggtagaactttattttagaagcgaaggccactcatatagaatacgcaggacaatagaaaggagaggtaaaagcatttcaactgatgctgaaatagaaagagatggatctataataacgagaggagcaagcgatgtttcaaattatgtagaaaaaaatgtcctaaatattaataaggatgttttcttgacctcaatatttgtaaggcagggtgagatggatgccttagtatctaaggacccggccgaacggaagaaaatattagatgaaatactaaatatagatagactcgaagccggatatttattgctaaaggaagtgatagatgatctcaccgcgaatgtttctgattacgattatcttaaaaacgaacttcagtcaaaaataaacgagatcgacaataacaacaagcagatagaagagcttgaatcaaagctaaggttaatcgaacctgaaataaaggccctagaagaggaaataaatataaaggaaaacaaaaaggatcatcttaatgaggaattgcacagattaaatgcgcagcttgaaacgataaaaaaatatgaaatggaacttgcagagagccaaagcaggaaagcaagcatagagatggaagttgtgaaactgccatccatagaggaggaactaaaaaggttagagaataatgcagctgtagttaagcggaacgagataatagaatatatcaacttaaaaaaggatctcggttcgctcagcgaaatcatagagggattaaagtcggatttgagtaaatatgatgaagctcatcggaaattagaagatctgcagagtttccgaagtgaatttttagaaaaaaagaagaggaaagaggatttggataagttgaggtcttccctgaaagaagatgaagacaattaccaaagtgctgtaaggaatattgaaaatataaagaaatggatagagaatgaggaaaaagaaatagaaagaatgagtgcattcatttctgaaatcttgaaaattcaagaaattacccctgaaattataaacagcaggagggccgagataaattcttctcttatgcagatcgagggaaaaatagcctcattgaatgcctctatagatgcgatgagatcgcataagatggaggtagaggaaaatgctgcaatgttaagcggaagaggtgtctgcccggtatgcgggacgcatctaggcacagagaaatcagaagaccttgtaaagcattatggtgaagaggcgtctaggcttgaagaagacatcaataaaacggaaaatgagataaaaaaattggatgaggagagaaaacaccagaagaaattgctagatagaataaatgggaaggacgttgaaagattgatcgcatcttataatctgctatcgtccaaaagggctgagctgaaaaagtttatggatgatgaagcaaggttaaaggaagcacacttaaaagccgaagctgcaatatcccaatacaacagcattgatctaggtgatcttgaggctaaaaacgaagaatggctcaaggcaaatgcagttatttcaagcatagacatagagaacataagatcgagatttgaagaaaagaacaagcagttaaacgacatcattaaaagaatgaacgaaatcgaagttaatataccggatgttgagagttataacgaaaattctctcaaaagaattgacgaagagcttaattctcttcgcaacaaaaagaacgagttgtatgcaaagaaagcagcaatggatgagattcaaaagacaatcgaacactttaaggaagagatatcaaagaaaaaagggatagaagatagccaggcagaggtaaacgcacaacttttgcagattaacgatgatctaaaacaattgtccagtaggcttgataaaataaatgtagatcaatatgaatggaagagtttacataaagttcttttgcaggataatgaaaaactgaacatcgcagtggcagatatccgaaaaagactagaaaagaaagaaacaataatcaaggcaatagccgatcttaagagggttagagaggcctttagcaaggacggcgtaccagccataattaggaagagcgcatctgagttcattacaaaccagactaggcagtacattcagaggttcgaacttgacatagatgatgttgacgtagatcaggacttcaacataactgtcttccgtggtggcatagcagaaggcatagattccctaagcggcggagaacgtatggcagtcgcatttgcgctgagagttgcaattgctcagttcctaaataaagacgttagcctgctggttatggatgagcctactgcctttttagacgaagacaggaggagcgatcttgctaacataatagagtattcgcttaaagattccagcggcataccacaggttataatgatatcccatcacagggagctgctttctgcttcagacttagccttggaagtaaagaagcgtaacggcagttcgatagtc

SEQ ID NO: 37165 - DNA, 1158 bp, Thermoplasma volcanium
atgccggaaacaactgaagaaattagcaagggtttggaagatgtcaacattaaatggacaaggctaacaactatagatggaaataaaggtatccttagatatgggggatactccgtagaggatataatcaataacggcgcacaggcagaggagattcagtaccttttcttatatggagaattacctaatgcacaggaattaaagatctttaaagaaaatgtgcaaaaaggatataacattccagatttcgtaataaattcaattaggcagcttccaagagaatcagatgcagttgcaatgcagatggctgcagttgcgtctatggcagcatctgaaataaagttcaagtggaataaggatacggacagggatgttgctgcacagatgataggcagcatgtccgctataactgcaaatgtctataggcatatcctcggtatgccagctgagaggccaaaaccgtctgacagctatgctgaaagcttccttaaagctgcctttggcaggaatgttacaaaggaggaagtagatgcaataaacactgcgctaatactttacacagaccacgaggttcctgcgtcaacaactgcaggacttgttgctgtatcaacattgagtgatatttactctggcataactgctgctcttgctgcactcaagggcccgctccatggtggtgctgcagaagccgcaatagcgcagtttgatgaaataaaagagccttcaaacgtagagaaatggttcaatgacaacataataaacggcaagaagaggctcatgggattcgggcacagagtatataagacatatgatccaagggcaaagatattcaagggaatagctgagaatctctccaagaataatgcagaggtaaagaaaatatacgatatagccacaaagttggaggacctcggtgttaaacagtttggatcaaaaggcatatacccgaacacagactacttctctggcatagtttacatgtccgtaggtttcccccttaggaacaacatatacactgctctgtttgccctatcaagggttactggctgggaagcacacttcatagagtacgtagaagaacagcagagattaataaggccaagggctgtctatgttggccctgctgagagaaaatttgtaaaactacctgacagaaaa

SEQ ID NO: 37166 - DNA, 2965 bp, Thermoplasma volcanium
gttttaaaattaggagttgatagttgtggaagttggtgaagttatagagttttatgctggcagtaagtcgctcaaaggagaaaaaaatcagacaatattgcaagcgcttttgctaaatggtatcgatattccacacatatgttaccatccaagccttggccctataaacacttgcgatacatgccttgtagatatgaacggaaaaattgtacgttcatgttccacttatttagagcagggagccaagatagattacaattcaaatagggttctagaactgcaaagggaagctgttcaaagaatgctgcacaatcatgacttgtactgtacggtctgcgacaacaacaacggagattgccctcttcacaatgctgtacatgaccttgaaatagataaccagaagtatccctacgaaccaaaaccgtaccctgtggatgattctaatccgttctacgtctacgatccgaatcaatgcatattatgtggccgatgcgttgaggcatgccaagacgtacaggtcaacgaaaccctgagtatagactggagcagggaaaggccaagagttgtgtgggacaacgacgttcccataaatgaatcttcgtgcgtatcgtgtggccattgtgttactgtttgccctgttaatgcgttaatggaaaagacaatgttaggcaaggccggtttcctcacaggtttagaaaagaatacgaagcagaagatgatagacgtggtaaaatctatagagccagaaataacaatgtctccaataatggccataagcaacatcgaatcaaagatgcgctccagcaggataaagaagacaaaaacagtctgtacatactgcggagtaggctgctcctttgagatgtggacaatgggaagggaaattttaaaggttcagccgcagcctgaatcaccagcgaacgggatatctacatgcataaagggaaagtttggctgggactttgttaacagcaaagaaaggctaacaagccccctaataagggatggcgaaaggttcaggagggctacatgggaagaggctttggatctagtggcaaaaaagctaagggagataaaggacaagtatggtggggatgccatagagttcatagcgtcctcgaagggcactaacgaggaagcgtatctaatgcagaaactggcccgccaagtatttggtacgaataacgtcgacaacagctctaggttctgtcaggccccagcaactactggcctttggcgcactgtaggttacgggggagattccggctctatacaggacatatacatggcggatcttgtaatagccattggtacaaatacagctgaatcccatcctgtacttgcaacgagggttaagagggcacacaagctcaatgggcaaaaactgatcgtgtccgatctaaggatgcatgagatggcacggagggcagacttattcctgcatccaaagccagggacggatatcgtatggcttagcgctgtaactaaatatatattggataaaggctgggaagataagagcttcatcagggaaagagtaagtggctttgaagattatgttaagagcctagagcctttcacaatggaatttgctgaggaagcgactggtatcagcaaggagacgctgatgaaggttgctaacatgatacacgaagctaagaacatggttatcctctgggccatgggagttactcagcatcaggccggtagtgatacttctaccgctatatcgaatctgctcctaataactggaaactatgggcgacacggtaccggtgcatatcccctaaggggacacaataacgtgcagggggcaagcgacttcggtgcgatgaatgcttacttgccaggttatcagcctgtctcagatccaactgttaggaagaaatttgaagatgcgtggcactgcactatacctgaaaagccagggcttgataacaatacatgcctggaagggataatgaatggaaaaataagggcaatgtatgtagtaggagaagaactggtagaaactggatcggattcaaacttcatcagggatcaacttgaaaaacttgatttcctagttgtagaggatctattcctctctgaaacggcaaaatatgctgacgtagttcttcctgcttctgcaagccttgagaaggaaggcaccttcgtaaacacagagaggaggatacagagaatatatgaggttatggctccgctgccaggtactaggccagattggcagataatacaggatattgcaaacaggcttggggctagatggaattatgggcatccatctgaaataatggaagaggcggcttctctttcgccaatatttgcaggagttaggtatgaactccttgaaggcttcaaaagtttgcagtggccagtacgtagcgacgggaaggattccccactgctctatgaaaaagaatttaactttccagacggcaaagcaaggctctatccgctcaagtacaacccgccgctttcatcgggcttggaatttgatctgcaccttaacaacggaaggctgctggaacatttccatgagggaaatgaaacgtacaaatcgccagggataagatctaaagtgccaggtacgtttgtcgaagtctctcctgatctagccaaagagcgtggactggaaacaggcgacttggttaggataacctcggagtatgggagtataaaggtaagcgtccttgtatcggacagagtttcagggaaagagctgtatatgcccatgaacgcgtctggagattctgcagtaaacttacttacaggacgcttaatggatccgactgcacacacacccgcctacaaggaggtgtctgtgaggctcgagaagataacgggcaagagaggtccgcctccgctgccatcaacgaatccgagaaatgccataccgcacccacagataggcgtacaggttgagaaaaaatgggccagaaaggattacgttaagcttactacg

SEQ ID NO: 37167 - DNA, 1410 bp, Thermoplasma volcanium
ttgagtgaaaaatacgatctagttatagttggacgtggagccgcagcattctctgctgccataagggccagtgagataacctctgggcaggcaagaatagccatggttggaaatgggccattaggagggacatgtgttaacacaggctgcgtcccgtcaaaattgcttatatccatttccaacagctttcagaactctctcaaaccaaggtaccctggacttccatcagttgaaaggccccccgagaccgaggttataatggatttcatacgcgaatcagttcacggcgagaggaagaagaagtacgaagatgtggtagaatcgtatgaaaacattgatctttacactggaactgcagtttttacaggagaaaaggaaatactagtagattcttcgcattcattgtttggctacaacgtgctcattgcaacaggctctagaccttatgtcccgggaattaaaggcttaaatgaaacaagttacataacaaccgacagtgtctgggaactgaaacatgttccggcaagcatagccatactaggaggcggagcggttggagtagagatcgggcaagcgctgtctaggcttggatctgaagtacatataattgaggtctctaatcagatcttgccaggaatacccgctgatatggcaagcatcattgagaggtccttaagagaggatggtatggttatcaatacatccacttcagtggatgaggtgtctggaggagagggcaaaaaatacctaaaattaaatggtacaaatataaacgatacgttagaggtagaagaaatactcgtagcaaccggtagagcgccaaacatagatctggccttagaaaagacaggtgtaaaatacagcaaaagagggattgcagtagatgaatacctgaggacgtcgaatcggaagatatatgctgccggcgatgttgttgatcagaagtataagctagaaaccttggctgcaagagaaggcttcatctcagccgagaacatgttcaaccatgcgatgcgaacaatcgatatattcaatgtgccgtttgctgttttctgcagccctggttatgcgtctgttggttatactcaggatgaggctactaaggctggaataaagaccgaagcgaggagaatatcaactaaggatgtggcaagcgagaggatacatgctaatagagagggaataataaatatagtagcggaagcagataccaaggaaattgttggcgtacagatagttgctgagaatgcacccgaacttataaacgaggcttctgccatcttatcgaaacgatttaagaccgatgatctgataaacaccgttcacgtgtttccaactgaaaatgaaggcttaaaacttgcaacccaatcattttcaagagatatcaccatgatgagctgctgcatggag

SEQ ID NO: 37168 - DNA, 1062 bp, Thermoplasma volcanium
atgcagatagaatctcagagcccgaccgacgtcgttgcttcgtataaggcgaagattgatgaaagcataagccgtttctttgaccggaaggaagaagagacaaaggatgtactctccaaaagagtgataaaaataataagggactataccgaaggcggtggcaagaggttaaggccgatttttatgatccttggctataggttgttttcgcctgaagaaaagggaatattcgatgcttcaatatcaatagaattagcgcaatcatacctacttattcatgatgatgttatagacaaaagcgatgttcgtaggggaaagccaagcatgcatatacggcttgaagatgcatttgtagcgggttgtccgcaaagtagatcaacagccgaaggactggcaattgttgctggtgacctagctgaatcttatgcacatgaggctttactcagatccggcttctacagtgaaaacttagtaaaggccgatcttgagctaagcaaaactatagagatgactgggtatggccagttcctcgatatcctctcaacaaccatggatgattttaatgaaggcgatttgataagattgcacttgtggaagacagcaaagtataccttggagggcccgcttgccatgggagccatactgagtggtactgaatacgatataacagctcttcgggaatacgggcgagttcttggcatagctttccagcttaaagatgatattttagggttgtttggagatgaaaaaacaattggcaaatccgtttacagcgacgtcaatgagggaaagaagacccttttgatgataaaagcgatggagtggggagacagagacgacgcaaatttcataaggaagatgctcagaaagggaaatgtaaccaatgaggaatttgaaaggataaaaaagttggtcatggatacaggttcatacgactattctatcaatcttatgggtaagcttgtggataaatcaaaggaatatttagccaaggtctccggagacaactatgtaaagaagatacttgattggctctccgattatctcatatccagagatcac

SEQ ID NO: 37169 - DNA, 984 bp, Thermoplasma volcanium
atgaaagctgtctttgtctatgaaccactaggaaacgaaaacgtgaaggtagaagaggtaagcgaaccaaaaaaagagcagggaaaggttatcatagaagtcaaaaaagctggacttaatccaatagattacaatgtaataaatggaaagatagtataccgcctcaacccgctcccgcacataccagggagtgaagtatacggaatagtaaaggaagatagtggttcatttaagaagggagaaagagtaatagtttacaataggatctttgacggtacatgttcgcagtgcatatctggaaacgagcacctatgtgaaaatggcgggatatggggagttgtttcaaatggcggctactcacagctcgtacaaatagatgagaagaacgtgtttagggttccagaagatgcgagtgatgaactggccgccagtataggcgtagcagcccttacctctttcagggctataaggatctctggctgttcgccaggaagatcaatactcatctatggggcgtcaggaaatacagggatgtttgcagtacagttagcttccatgatggggtgtgatgtgtacgctgtttctagaaaagattggatcgaatcgtttggggccatcgaagtcttcaggcctgacaatattccacctgatatgaagttcgatataatcattaaccctctcggaagcttattctggggggatgcccttaagcatctccgcactagagggattctcgtttcttttggcgtacttactggtcgggaaggttctatagacatagcggatctgtacaccggcgaaaagaagatattaggatcgaccggcggcacaagggaggatctacgtggccttctagagtttatgaagacacacgaactaagggtaaaaatagctagagagttcaaaataaacgagataaaagatgcacttaagtattatagtgaaactcacgacggcaggatcctcatatcgatgagagagtct

SEQ ID NO: 37170 - DNA, 891 bp, Thermoplasma volcanium
gtactcgatatgaagaatgacctggatgaaataatcaatctctccatagagcttaagaagaaccggtacaggtcatacgaaagcctaaggaacaaaatgctaggtcttatattcgaaaagcccagtactcgaactagaacttcattggaggttgcaatagaccagttgggcggccatgcagtatacttgaatccgtctgagatgcagctaggccgtggtgaaaccatatctgatacaggacacgtactgtcaaggtttctcgatgctatagcgtacagggccttcgatcacaaaaacgttgtcgaactagccagaagcacaagcatacccgtaataaatgcccttgacgatgttgaacaccccctgcagatagtagccgatttcatgacggtaaaggaaaaaaagggtaaatttagcggcttaaagttctcttacataggggacgggaacaatatggccaattcgcttatgcttggagctgccattcttggtgtcgacatttacgttgcaacgccccacgggtatgagccaaaaagcgagtttgttgataaggcaaaacaggttgctaaagaaagaggcagtaaagtgataattacaaacgatgcaatcgaagctgcaaaggatgccgatgtcatatacactgatgtgtggatatccatgggtgaagaatctaagagaggagagaaagaaaaggcgttcacgaaataccagataaactctgacttagtctctaatgccaagaaagactacatatttatgcattgcttgccggcccaccgtggcttagaagtaacagatgatgttgctgacagcataaacagcgttatattcgacgaagctgagaacaggcttcactctgagaagggagtactttacaagctactctcctac

SEQ ID NO: 37171 - DNA, 855 bp, Thermoplasma volcanium
atggttctgatagataaaaatacaaaggtaatagtccagggaataactggacaccagggttctttccacacaggcgagatgttgaaatttggcacaaacgtagtagctggcatagctcctggaaagggtggcacaaaattcgcagataaggtgccaattgtaaactcagttgctgaggctatgcagtatgaaccagatgcaactatgatatctgtaccagcaccgttcgttaaagacgctgcctacgaggcaatagacaatggcctcaagatcgtatacatacttaccgaacacgttccttaccaagacactatggagatagtaaaggaggcccagttgcgaaatattacagtacttgggccgaatggccctgggatcactgtaccctttgaatcaaagatcggaattatgcctaaccacatattcaaggaaggggatgttgcagttgcttcaagaagcggcacgttaacatacgaaatagtatacgctataacaaaggcagggatgggagagagcactgtcataggacttggtggtgacagggtagtcgggcttagcttcatagacgtgcttaagatgtttgaaaacgacccaaagacaaagaaaatagtgcttgtgggagaaataggcgggaacaatgaagagctagcagctgagtacataaagaaaaacgtcaagaaaaaggttgtagcatacatagcggggcgcagtgcaccacctgggaagaggatggggcatgctggtgccattatagagaggggagttggaactgccgaatcaaaactcaaggccttcaattcagcaggcgtcaaagtagctgattacccgcaagacattccaaaactgctggaggaa

SEQ ID NO: 37172 - DNA, 1128 bp, Thermoplasma volcanium
attacttcatgctataactggtctggtggtgtattgaatctttatgagtacatgggaaaagatatattccgcgaatacggaatccccgtacctaatgggtacgtcgtctcaagtccacaagatgtaaagaagttcacaaaccctgttgctgttaagtctcaaatacttcttggcgggagaggaaaggctggagggattaaatttgcaaagacggatgaagagctaaagaacgctgtaagcaccctgctctcaacaaaagtgaggaacatgacggtgactaaggttctcatagaggatatgctaaacataaagcacgaatactatgtcagtatagccttaaacagggccgcaaagtcacctatgctaattgcaagcgccatgggtggcatggagatcgagaatgtgcccgatgacaagatattcaagaggatcatagacccatcccttggatattccgactttataggaagggaggcctctcagtttatgggccttcctccagaactctcaaagcagttcctagatatacttaagaaattatacaacgtctatagaggggaggactgcgagcttgttgaaataaatccactagtcgaaacaggcgacggaaagcttatagcagctgatgccaaggtagttatagattcagacgctatatatcggcatcgcgagttcagtatacaagatccggagaaaacaccccttgagcttaaagctgaggggaaaggatacgcctttgtagaactggacggcgatataggggtcattgcaaacggtgccggcctaacaatggcgacgcttgacgcccttcttcttcataaaggtaaaccaaggaacttccttgatcttgggggtacagataacgtagacattgtgataaatgcctttgatcttgtattagaggctaagcccaaggcaatactggtaaacatatttggcggtgtaactaagtgtgatactgtagcccagggtatagtagaggccaagaagaaattcgatataaaaataccagtggtcgttaggctaagtggagttcacgaagtagagggaaggaagattcttcaggataacggaatcgaagccttctcggaaatgatgcccgcaatagagagggtaacgaaggtgttt

SEQ ID NO: 37173 - DNA, 1350 bp, Thermoplasma volcanium
cattgtaagaaaccttttatttggtttgcttataatccaagggtaaagatgtccgtgaattattcggaagataacaataggactgcggttgttgtagggcttcagttcggagatgaaggtaaaggaaaaataacggatttcctcagcgaatcatatgatgtcgtagtaaggtttaacggtggtactaacgcggggcatacagtcgttgttggtaacgaaacttacaaattccatctcctcccatcgggttcattgagaacaaaagttgtcgttttaggtagtggaatggtgatcgatccacagtccttaatttcagagatagagatagttaaaaagaataattcaaatcttgccgtggtggttagctctaacgcgcatgtagtaacaaaaatacacaaatacctcgatgtagaagaagaaaaaattagatctagcatggtgattggaactaccgcacaagggatagggccaacatacgaagataaatacgcaaggagcggacttagaatgatagatcttttagattacaagacgataatcgaaaaattagacataatttatagaatgcatgaaaatttactttcaaggtcagaattttcagatccctctgtgagagagaacttagcaaaggaactgtacagttatggccaggagttaaaaaaatacatgtattacacagatatactgataaacaagctatacaacgagggtagaacgatactatttgaaggtgcgcagggagtattacttgatccagatttcggtttctatccttacgttacatcatcgaacacgatcagtgcatcctcttatactggaactggtttctctatgagaaagataaaaaaagtaataggtgtagcaaaagcctatgtctcaaaggtaggtgcaggtccgtttcccactgaattaaacgatgatttggcgaaaaagataagggatgctggaggggaatacggcacaacaacaggaaggccaaggagagttggatggcttgatgtccccctgttgaaatatgctgtgcagatagatgacgttgatgagatagctctaaccaaggtagacacgcttggtatccttcacacaataaaggtttgctactcatatgaacttgatggcaagcagatagactatatccctaaacatatatcagaagtatctcgtgtgaaaccactttatgaggaatttgaagggtggggcgatctatcttcaagcttgttacatcctaagatgagaaaatgggagataccacagcaactaaggagatacatagattttatagaagaacagattgggaggccagtaacaataatatcttcaggaaaagacaggagtaaaactgtaaggata

SEQ ID NO: 37174 - DNA, 369 bp, Thermoplasma volcanium
ttaattatgaccaacgttcctgatggtttgaaatacacaaagacgcacgagtggtacaaggttgataacggtattgcgactgtaggaataacagattatgctcagtctcagatgactgatatagtttatgtcgatcttcctgaggtgggcgataagaagaaggttggtgatgtacttcttacaatagaatccgtaaaatcagcagaagatgtttactctcccctaacgggggagatcactgaggtgaatcaggaattaaccaagcatccagaaaatataaacaaggacccctatggaaactggctcgttaagatgaaagtcgagaaggagggggaatacctaactgctgaacagtacaggaaattgatt

SEQ ID NO: 37175 - DNA, 699 bp, Thermoplasma volcanium
atgcaacagggtcagatggcttatgatagagcgataacggtattctctcccgacgggagattatttcaagttgaatatgcaagagaggctgtaaaaaagggatcgactgcccttggattaaaattttcaaacggcgtccttctgatatctgacaaaaagataaggagcaaactaatagaacagaattcccttgaaaagatacagcttattgatgattatgttgccgctgtgacttcaggtcttgttgctgatgcaagggttcttatcgacttcgctaggatcagtgcacagcaggaaaaagttacatacggttcccttgtaaatatcgagaatctagtaaagagagttgccgatcaaatgcaacaatatacgcaatatggtggcgtaaggccttacggtgtatcccttatatttgcaggaatagatcagattgggccgaggttgtttgactgtgatccagcaggaacgataaacgagtataaagcgacagctataggatcaggaaaggacgcagtggtaagctttctagagaaggaatacaaagaagggctttcggaaaaagaggcagtaacactcggcataaaggcgcttaaggcctccttagaagaaggggaagagctaaaggcccctgaaatagcttccattacagtgggatctaaatacagaatatatggtgcagaagaagtaaaaaaattcctg

SEQ ID NO: 37176 - DNA, 537 bp, Thermoplasma volcanium
atgcgttcagtcattactggtgtagcaggtgtcggtaagaccactgttctcgacatagtagccagagagagtgggataccggttgtcaattacggtaccctcatgtttgaggttgcaaagaggcgtggcctagtagagaacagagaccaaataaggaagctctcaagagaaactcaagttgatcttcaaaaacttgcaggtgaagagattgggaaaatggaaaacgcgatagtcgacacacacatgtccataaagacaccgtttggatatctaccaggtctaccggagtgggtcctcagatctataaatgcttccgtatttgtaataatagaggctgatccagctataatcaaaaggaggagagacaacgatcccactagggccagggatgacgaaggcgtagacagtatacgcgaacatcaggagatgaaccgatactttgcagcagcctactcaatattcagcggcgccacggtaaagattgttaaaaatgaagaggggaaacccgaacaggccgcagatgaaatcgtgagggtg

SEQ ID NO: 37177 - DNA, 561 bp, Thermoplasma volcanium
agaataacgatagctggcaagataggtagtggcaaatcaaccgtcagtcaagaaatatcaaagataacaggttattctgtatactcatccggcacattttttagggaatctgctaagaaaatggggatgagtatagaggatttcaatagatatgctgagacgcatcctgaagcggactatgcaactgatgggatgcaaaaagattttatggaaactcacgacaacataatagttgaaggtcggcttgccggctggatatgcaagatctattcaatatcagcgtttaaggtatttctttacgcaacaagatatacaaggctcgtgagattttccaaccgtgaaggcattgaaatagacgaagcagccaaacttcttgatgagcgagaaatttcagagaagaagaggtacttggatctatatggcatagatatagatgatctttcgatatatgatatagttgtgaacacggaatttatgaagcctgaagaagtagctgttttagtgcttaataggatcgacgagatgtcacgcaaggaagtatatacacctcgcatattgaaa

SEQ ID NO: 37178 - DNA, 831 bp, Thermoplasma volcanium
gagataccaaaagtaacctttgaagatgttgcaggtctagatgacgttaaaaatgagatattaggaaaaattatttacccaatgaaatttaaggaattatcgcaggaatataatatacaattcggaggcggaatgttattgtacggtccgccaggcactggaaaaacctttattgttaaggctatagccaacgaggtaaaggccagatttatcaacgtaaatccttccacactctacagtgaatggtttggtgtttttgaaaagaatatatccaagcttttcagggcagcgtcattgctatctccagcaataatattctttgatgagatagatgctttggtgccaaagagagacacctccaattcagatgctgcaaagagaggagttgcacagcttttgaatgaggttggtggtataaattctcagaagaacaaaaatatattcatcatcgcagcaacaaacaatccctgggaagtagatgaggccatgcttaggccaggtcgcttcgatataaagatatacgtgccacctccagacatagtcgctagaaagaaaatatttcagcttaatctagcgaaaattaaacaggtaggaaacgtagactacgatctgctggcagaggagacagaaggatacagtggtgcagatatagagttcatatgcaaaaaggcagctcagaatgtattcatggaagcggtgaaaacagggaagagcagaccagttgaaacgagggacgtcatagacgttataggaagcatcaaaccttccattgattatgaactgctggaaaaatattcaaagtatggttccgctttttaggcaatagcaatt

SEQ ID NO: 37179 - DNA, 1110 bp, Thermoplasma volcanium
ttacctttgtggtattttagaacaccaaggataatctttggcgaagattcattgtcctttctagacgatcatagttcttctaagatacttgttgtaactgataattttctatcaaatacgccaattcttaaagaagttctttctcatctatcaggcaaggacattaaagtattttctgagataagtccagaaccaagactgtctgaaatattgaaaggccgagagctagcatccagattagatccggacactatcatcggtcttgggggtggttcatcaatggatgcagccaaaatattatttgcattgcacgaaatgcctgatctctctccatttgatatttcgccaataaatagcattaagctgcatcagaaaagcgaacttatagaaatacctacaactagtggcacgggttccgaatgttcctgggcagctgttttttcagatgatacggaagaaagaaaaaatgaaatagcttcacctgagataatggctgactacgctatactggatccgaaattagtcttggatttgcctaagggtataacggtaaacaccgctacggatgctataacccatgcaattgaagcctatacaagccaatggaggaacccttattctgatgctatggctgaaaaggccctagatcttattctgaataatttgcccaccgttctggtaaatccgaaggacatcaatgctagaaacagcgtccacataggcgcgtctatggcaggaattagtttttcaaattcacagataggccttgcacatgcccttgggcatgcacttggcgcaatcttcaagacaccgcatggtgagagcgttggcttataccttcctcatgttactgaattcaattatgaagcagcaaaggatagatacgacaaaataaatagtttcttccctgatgagtatcgaacggataaggtgtgggaaaccatcaggagctatctcaatgctatagggcaggttactaatgtatcggaagctggaatagaacgaagcaaatatgaaaaggaattaggcaagatagtttcactcgcatccgaatcaactggggttataacaaacgctcgtgatgcaagtacgaaggatattgaaaatatt

SEQ ID NO: 37180 - DNA, 1432 bp, Thermoplasma volcanium
caatacggaaaattttggtaatataataaatgggacagaagaaatggttggcgacgaatctattgtgaaaagcccagttgatggatcgcctattgcatcggtttattttgcagatagggatgccgtttcaaaagcaatagattcatcatatgattcttattacaaagtatggtctaagttcactttgagcgaaagaaaaaaacttctagcaaaattagctgacaggatacaggaaaaatccgagcgatacgctacgttggaatcattgaataccggtaaaacgctgaggcagagcatgcttatggatataccgcttggaattgagcatttgcgctacttcgccactgagaccgagttcaagatggaacgtcagattacccatcccgaatatccagattctcacggtatagtgcagtatgtaccaatgggagttgttggtgcaataactccatggaacgttcccttcctaatggccgtctggaaagcagcgccggcccttcttgccgggaatacagtagtgataaagccatctagttttactccgctaactacaatagaaatggccagggatgccatatctgttgggtttccacccggtgtgctgaatgtggtaaatggtcgtggggaaactgtgggggaggaactggctcgaaacaaaaaggtaagaatgttgagttttacaggatcaacatataccggaaagagaattacagaaataacaggcataaagaaagttacgcttgaacttggaggtaaatcaccgaacattgtatttgatgatgctgatctggaaagagcagcattgggtgttatgtttggcatataccttaactctgggcagctctgcgaatcaggcagcagactgttggttcagtcatcaataaaggataagtttctcaacttactgaaatccaaaatcgagaagatgagacccggcaaccctatgagtatggagacagatataagtgcaataacaacaaagaaccaaagagacaagatcgagaagatggtaaattctggactcaaggacggttctgtgatattttatcaaaaaagtattgatggatcagttcctaagggaggattatatttcccacccacgatacttgacaaggtgtccgaagatatggaagtcgctaaggaagaaatctttgggccggtcctgagtgtaatggaatttgatgatgaagcggatgctatagataaagctaacatgacagattacggcctggccgctggggtctggacacaggatagcgagaaggcaacaagggttgcatcatccatagaagccggaactgtatggataaatgagtaccatctcctctctgcagctgctccaaggggtggattcaaaaacagcggtgttggaagagagcttggcttagatggcatcatggagtttactcagacaaggcatctctttgtcagc

SEQ ID NO: 37181 - DNA, 1176 bp, Thermoplasma volcanium
ttgataaacatgcaaaaatataactgggtagatgaagagatctctgctctgaaagccgaaggaagatacgttccaataaggacaatagaaagcgcacagggcgcttgggtcaagataaacggaaagcaagtattgaatatgtgctcaaataattacttaggatttgccaaccatccagaaactaaaaaagctgctattgaagctatagaagaatatggagttggagcaggcgcagttagatcaatagctggtacggatgaaattcacataaagcttgaggaaaagatagcttcctttaagcactcggaagctgcacttgtataccaaggcggattgcttgccaacctcggcacagtacctgcgctggtcggtaaagatgatataatattcagtgaggagctaaaccatgcaagtataattgatggtaccagattgagccctgctaagagaatagtgtacaagcacttatctgtcgatgatctagaaaagcaagccaaagaaaacagatccagtggaaagaaggccttggttataacagatggggtattcagcatggacggtgacatagctcctctgccagaaatagttgatattgctgaaaagtacgacataatgacgtacgtagatgatgcacatggtgagggggttctaggcgaccatggaagaggcatcgtaaactatttccatctagaggataaagttgacatagagatgggcacattctcaaaagcactcggatccatgggcggtttcgtggcaggatcagcagaaatgatagacctcttaaaacagaaggcaaggcctttcttgttcagcagtgcacttaatcctggagacgctgccgcagtccttaaagccatagaaatacttgagaaggatgattctcttgtaaagaagctttgggaaaatgccgatctacttaaaaaatcacttgcggatctcggttataatacgggccacagcaaaaccccaataacaccagttataattggcgatgaaaagaagactgttgaattgagcaccaagctctatgaggaaaaaaatgtattcgcttcacccatagtatatccaacggttccgaaaggtacggcaagaataaggctaatgccgtctgcagtccatacgcacgaagatataatgactgcagttaacgcgttcggagaacttggaaagaaa

SEQ ID NO: 37182 - DNA, 762 bp, Thermoplasma volcanium
atgaacataaaactgctcccagaggtaggcgatctagtagtagtgaagataacagaggttaagaacttcggtgcaaatgggatactagaagagtatcctggtgtcgaaggttacatacatatatcagaggttgcaactggttgggtaaaacacataagaagctaccttagggaaggccagcgcgtggtttgcaaagtcataaatgtaaatcaggagaggaaaaatgtagacctctctttgaagagagttaaccaacatcaaagcagggaaaagatagctgaatggaagaacgaacaaaaggcagacaagctattcgaaatagtttgctcgaaactaaacaaggatcttgaggcctgcaagaaagaatttggtgtaaggttagtagagctctatggtactctattcgctgcgtttgaaagcgctgccgcagcggagggagaatggttacctgacataaacggtgactggaaagacactttcgtggaagtcgcaaaggaaaatataactatacctgaagtttcagtggcgggttacttcgaagcttattctctagcgtctgatggtgttgaaaagataaaggaagttctcacaataccaccagagatcggaaaggcagaactggagtatgtcggggcgcctaggtataggatcgtcgttagggataaagactacaaaaaggctgaggaaacattaaagaaaatagtccagagtgtaacagataaggctaaaaagctacaagtggaattggagttttctaggcaa

SEQ ID NO: 37183 - DNA, 450 bp, Thermoplasma volcanium
atggaactgttaaaggttggtgatcaagcccctgattttgagactgttgatcaaagtggaagcaaagttagattgagcgactttaagggacagccagttgttctttacttttaccctaaggataacactcctggatgcacaacggaagcctgcaactttagggataactttaactcatttaaggaagccggtatcaaggttataggggtgagcgttgattcgccggaatcacataagaggttcgcagaaaagtatcagctcaactttacgcttgcctctgacaaagaaaaggaaatttgtaaaaaatatggtgtgctaggtcttgcaacggctaagagagtgacatacataatagatcgagatggaaagatcgtctacgtatatccaaaagtcacacctaaggatcacgcagtggaagttatgaacaaaataaaggagctaggccttata

SEQ ID NO: 37184 - DNA, 1314 bp, Thermoplasma volcanium
atgggtttctttgatgatatggacagaatgggaataagaccgttccataggaagatagagatacttgcatctatggggatgttccttgatgggtacgatctttcggtcataacaatggcaatactgctgatgccaacacagcttcattttggaaaactagactatatcttggtcaacgtgtctgcgttcatcggaatgataataggcgctccgttgcttggaaggctatccgacaggattggaaggaaaaagatattcggcatagacctacttctattcgttgttttcgccataaccgctggcctagccaccaattttgcgatgcttttcataagtaggctgatgctcggcattggtataggcggcgattatcctataagctctactatggtatcagagttctcacctgtctcgaagaggggcactctcttatacggtatggtcggcatgtactggctcggctcatttttctcagctgtgatgaactatacatttgcgtttaccccatacttctggaggtacacgttcatagtgggcggagtaattgccatacctataatattccttaggatgcgaataccggaatctcctaggtggctcatcgggcatggcatgacgaaatccgcagagtcggtagttgaagatcttactggaaggaagccggatgtcgaagaaggcaaggcagaggcagagcaggaagaatctgtaaagttttcttcacttttctcttccaaatttctcgcttccactatattcgtcctctctgtgtggttccttttcgatgttgcatcttacggtataggtttctattatcctacgcttatagacaagcttggtctagcttctcatgtccttaacacggcagggcttagggcaatagcagaaagcagtatgatagttgcggtaggtgctatattgggatacctagttgcgatgcctttggccgacaggatcggcaggagaatactaactatcagtggtctattcgttatgtttctcttgctgcttcttggatctgttgtgaagataagcacacttttgccggttgtggcattctttttctccttcgtgctatttgaacagtgggtcggagctgcgacgcttttctatcctacagagctgtttccaaccaattacaggtctacaatacagggtatcgctacctctgtatcaagggtaggagcaataatgggcatagtcgtatttccactatatcctgttttccactctatattcatatttgcaatcctgatggcacttgcgctcataattagtgtaatatttgccccggagacgaaaaagactccacttgaa

SEQ ID NO: 37185 - DNA, 639 bp, Thermoplasma volcanium
gaaaagtgaacgtcgttaatcggtgagaaattttcttgaatggatgttgtgcaataaaagggaatatgaagttacctggcgattacagcggaaaatggcttgtattattcagccatttcggtgatttcactcccgtacgtgctactgagttcttctcatttgctcgaagaaacgatgaacccgaaaggttgaacgcttaattaatagggcttagtgtcgactcgaaaatatcgcatatagaatagctcagcttgatacattataatttgaaaatagatgtcaaattccgcgtaatagctgatccgatggaaaatgttgccaatgcacttggaatcatctaagcagaatctgcaacctctatggttaggacagtatttatcgtagatggcaaatatgtggtaagggccaaactttattatcctattaagatagggaggaatttatcagagatcctcagaatgataaaagcgttgcagatggttgacaagtataaagtggaaactcctgcaagcaggccggacaacgaattaataaaagacaagtctataataccgccgccagttactatcgatgatatacctgaaagtatgaaaataatacaagggttatgtgtggtggctaacgtataaggaagcccct

SEQ ID NO: 37186 - DNA, 444 bp, Thermoplasma volcanium
ataatggatcgaacactcgttttacttaagccagatgcagttaaacggcgccttgtcgggaagataatagaaaggttcgaggaaaaaggcttaaagatagttgcaatgaaattcatgcagatgacaaaggaccaggctaaaacccactattctgtgcatcaaaataaaccatttttcaatgatctggtaaattacataacttctggtccaatagttgcgatgatacttgaaggcgcccacgcgattgaaattgtaaggttaatgagcggggccactgacggatcgaaggcacaacccggtactatccgcggtgattattctatgggcatcgaaaagaatataatacacgcttctgattcgcttgaagcgtataatcatgaaatgcctatcttctttagtgataatgagattatagaatgggcctatggagacgaagtcatctac

SEQ ID NO: 37187 - DNA, 1746 bp, Thermoplasma volcanium
agccttcctgcaaagaaattacggcaacctatagtatgtgttcttggccatgtcgaccatggcaagaccactcttttggatataattagaggtacagctgtagccaataaagagcctggtggcataactcaaaggatagctgccacgacggttgacataaacaagattttaaaggccaccgaaaagttaaacaataaagggatgaagataccaggccttctcttcatagatacgcctggccatgttgcgttttccaatatgagggcgcggggcggagccttagcggatatagccgtccttgtgatagacattaatgaaggtataatgccgcagacagttgagtctatagacatacttaaaaagttcaaaacaccttttataatagctgccaataagatcgatctcatacccttctttacagatgttaagactaatcttttcactgaatttatcaggaagcagagacaggaatacgtcaacgagctcgacgccagaatatacaatatagttaacaagctctacgaatacgggcttaactcagaccgctttgacaggatatccgattttaccaagaccatcgccatagtaccagtgagtgcaaagaaaaacataggcgtacctgagatactgatggttttggctggtcttgctcagcgcttccttgaaagtgaaatcgaatataaggacataaacggccacgccactataattgaggttaggcgtgaagaatctgctggaatagcccttgacgcagtactttaccagggcacaatttcggtaggcgataccgttgcagtaaatacaaaaacaggcccggtaactactaaggttaaggcgctattcgtaaatacgggaaagagccagagatccctcaaagaagtagagactgtttctgcggccgaaggaataagggtgcttatcagtgacaagctagacgttatatcgggttctcctctgatagtggtcaaaggaaacatggaacaagtcatgaaagagatcgaggaagcatcgaaggtagacattcccctagacgaaaacggtatatacgtcaaggcagaagctataggttcacttgaagctataagttatgagctgaataaacaggggataaagatccgtgcagctgcagtcggcgacatcacgaagagagatgtgatggatgtacagaccttgcaggatccacttaaccgcataataattggctttaatgtgtcgatactgccggaagcaaaagatgctatagaatcatcggatgttggtgtcataacgggtgacataatctataagatcgttgaggatacgcagaaatggatagaagagcggaaaaagcagcttagccagaagaggaaggaggcgatgcctgtaccggcaaagataaggatacttccacagtacattttcagggcatcgaaaccggtcatagtagggatccgcgtagaaacgggccagattaaagttggggacaatcttatacgatcggatggaaaatacgcaggcacaataaagagcatccgtaacgatgaggttagcgtacgatatcaggacgcgcctgcagaggtggcagtggccatcgacaacgtaacgctgaacaggcaaattttccctgacgacgttctctatgtagatattccggagagcgtagtcaaagaactaagaaaggccccaatggaaaaggaaataatggatacgctcgaagagataatcaaaataaagagaaaagaaaacccgttttggggtacgaaagta

SEQ ID NO: 37188 - DNA, 972 bp, Thermoplasma volcanium
ttgatggaagataatgaagaaaacaaagaaaagaaaactacgcttgaagacctccctggagttggcgaggctaccgctgaaaaactaagggagaatggatacgacgacataatggccatagctgttgcaagcccaaaggatttgtctgatgtgactggcataggtgaaggggccgcagcaaaaataattgccgcggctagaaaatttgcagatataggcaactttgaaactggggaggagatccttgagaggaggaaaacaatacagaaattaactactggaagcaaaaacctcgatgacctcctaggcggcgggttagagactcaggcaataactgaattcttcggtgaattcggatcaggaaagacccagatcatgcatcagcttgccgtaaactgtactatgccaaaggaaaaaggcggttttgacagcgacgtgatgatgatagatactgaaaatacattcaggcctgaaagaataatacagatggcgaagagcaagggactcgatccggatgaaacgctcaaaagaattcacgtagcaagggcctacaattcacaccaccagatactattggcggagaaagcccaagaaactgccaaggaattcaacatacggctgctgattgttgattcgcttaccgcacatttccgatcagagtatgtagggaggggttctttagctgaacggcagcagctgttgaataagcacatgcacgatttgctgagattcggcactatatacaatgcagttattgctgttaccaaccaggtatctgcaaggcctgatgtattcttcggcgaccctatggcaccgataggcggcaatatagttggccacacggcaactttcagggtctaccttaggaagagcaaaggtggaaagaggatagccaggctgatagattcgccttatttaccagagggagaaactgtaatacagattagcgaggaaggagtcaacgatgggaca

SEQ ID NO: 37189 - DNA, 1011 bp, Thermoplasma volcanium
atgattagagtaggtataaatggctatggaactattggaagacgtgtggcaaacgctgtctcaagccaggacgatatgatagttgtaggcatagtcaaaacgaagcctgactacatatcagaagtggcctccaggagattcaaaatatttgtcccggatagcagctacatgaaagcctttcaggatgccggcataaaggttgaaggtacgcttgacaaccttttagatgatgcggagataatagtagatgcgactcccgaaggcatgggtgaaaagaataagccgctctacataaaaaagaaggctaaagcgatatttgaaggcggagaagagcctgatgtagcagaaacaagttttaatgcttattcaaattacaatgacgctattggaaaatcttatgtgagggtagtttcctgcaacacaacaggtttggcgagaactttatatccaattcagcaagcctttggcgttaagcatgttgaagctaccctcatcagaagagcaacggatcaaaacgatagcagcaaagggcccataaatgcggttgagccaagcttaaaaataccttcacaccatgcccctgacctaaagactgtaatgggaaacatagacgtgaatactgtcgccataaaggttccaacaacattaatgcacgtacacgtggttcaggtagatacagagaagaatgcatcaaacgatggtgtgctcgaagcatggaataattataggcgtataatacatgtaaagaaggacgacggaataaagtccactgcccagattatggatcttgctcgagaatttggcagagaccgctcagacctatacgaaatagctatatgggaaggcagcgtttcagcaaaggccaacagaataagttatatccaggctgttcaccaggagagcgatgtaatacctgaaaatgtcgatgcaataagggcaatgttcaatctagctgataaggaaaaatcaattgaaaagactgataagagtcttggaatagaaaaaagggtg

SEQ ID NO: 37190 - DNA, 1095 bp, Thermoplasma volcanium
atggcaaaggattattacaaaatacttggcgtagataggaatgcctctgaggaagatattaaaaaggcattccgtgagcttgcaaagaaatggcatcctgatctacatccagataacaaggcagaagctgaagaaaaattcaaggaaatcagcgaagcttacgaagtcctttcggaccctgagaagaggcgcatttatgaccaaacagggtctgttgattttggcggcggaggcagcaacttcaactgggataactttactcatttcagcgacataaatgacatattcaatgaaatcttcggcggtaactttggatccgatttcttctcagggtttggcaatagacagtctacgaggaacatcgacctcgacatgtatacgaaccttgacatttcactggaagaagcatattacggaacagagaaaaggataaaattccggagaaatgctatttgcccagattgcaagggaactggtgctaaaaacgggaaactaataacttgtccaacctgccatggcacaggtcagcagagagtagttagaggccagggcttttttagaatggtaactgttacgacttgcaacacatgtggtggtaagggtagaatacctgaggaaaaatgcccaagatgcaacgggacgggtacgatagtcgtagacgaggatataactgttaaaataccaaggggtgcaacagataatctgaggttaagggtctctggaaaaggtcagtcctatgatggccgaaccggggatctctacgttatcctaaggataaaacaagacaagaatctacagagaattaacgacgacctattgctcgaccaaaagatcaactttggtcaggcggcgctaggtgcagacatacctatacaaatattcaatgaaaaatataacctaaagattcctgaggggacccaaccaggagatgtgattaaaataaagggcgctggaatgccacacttaaatgggcatggttcaggtgatcttctagttagaattaatgtcgaagtaccaaaaaggctaacggcaaagcagagagaactcataagggaacttttcgatataaaggagaaccacaaatcctggttccat

SEQ ID NO: 37191 - DNA, 1623 bp, Thermoplasma volcanium
atgatagcgggacaaccaatattcattcttaaggaaggtacaaaaagagagagcggcaaggatgcgatgaaagagaatatagaggcagcaattgcgatttcgaactctgtcagatccagccttggcccaaggggaatggacaagatgctggtggattctcttggcgacatagtaattaccaacgacggtgttacaattctcaaagagatggatgtagaacaccctgctgccaaaatgatggtagaggtatctaagacacaggattcctttgttggagatggaacaaccaccgcagtgatcatcgctggcggcctactacagcaggctgaggcacttataaaccagaatgtacacccaacggtcatatctgaaggttacagaatggcttctgaagaggcaaagaggatcatagatgaaatatcaacaaagatcggcaaagacgaaaaggagctccttataaagttggcacagacatcacttaacagcaaaagtgcatctgtagcaaaggacaaactcgcagagatatcctatgaagctgttaaatctgtagcagagcttagggatgggaagtattacgtggattttgacaatatacaggtcgtaaagaaacagggtggtgcaatagatgacactgcgttgataaacggaataatagtagacaaggaaaaggtccaccctggaatgccggatgtagttaagaatgcaaagattgccctcctagatgccccactcgaaattaagaagcctgaatttgatacaaacctcaggatcgaagacccgagcatgatacagaagttcctagcgcaggaagaaaacatgctcagagagatggttgaaaaaattaaatccgtgggtgccaacgttgtaattacccagaagggaatagacgacatggcccagcactatctatcgaaagaagggatatacgcagtacgcagggtaaagaagagcgatatggacaaactcgcaaaagctacaggcgcgacagttgtctcaactatagatgagatttcggctagtgatcttggatccgctgacagagtagaacaagtcaaagttggagacgactacatgacctttgttactggctgcaagaatccgaaagcggtaagtgttctagttagaggcgagactgaacacgttgttgatgaaatggagagatccataactgattcgctgcacgtagttgccagtgctctcgaggatggagcctataccgctggtggtggagcaactgcagcagagatagcagtaaggctcagatcatatgcacagaaaataggtggcaggcagcagcttgcaattgaaaaattcgcagatgccatcgaagaagtgcccagagcccttgctgaaaacgccggattagatcctatagacataatactgaagctgagagctgaacacgcaaagggcaacaaatatgctggtgtaaatgtattcagcggcgaaatagaggacatggttaacaacggagtcatagagccaataagggtgggcaagcaggccattgaatctgcaaccgaagctgcaataatgatactccgcatagacgatgtgattgcgacaaagtcgagcggttcctcttcgaatccacctaagtcgccgtcttctgagtcctcatca

SEQ ID NO: 37192 - DNA, 1068 bp, Thermoplasma volcanium
gtgaaaatcgcgtacttttccgacacctattatcctacgccagatggtgtttcaacctaccttaaagacgtcaaaagggggctagagaaaagagggcatgaggtgtacatcttttcgcttacgggagatccgcatgaaaaaaacgtcttcataccacgtactgtgccctttcctccatatgatcagtatagaatgcctctcatcccatttccattcagggagttcaaaactgcagttgatattatgccggatgtgatccaccttcataacgccttctacatgagttctgtgggttatctggtggctagaagacttggaaagaagcctatatccacattccacacggatatagataaaatgagggaaagcataaggctgccattctccgacttaatcttcgacttagggaagaggtacagtatttatctctacagaaaatgcaaattcgttcttgctccgagctgccaagtcaaggcttatttagaaaggtgcggccttaaaaatatagttactgtacctttattcgtagatacggatgagctttcaccagctaaagcttcaaataagcaggacataatattatatcttggcaggcttacaaaggacaagggggtctatagagtcctagagctagctaatgaaatgaaagggactggatataaattcatcatcgcaggcgtaggaccggagcttgaaaggatgaaggcttacgtaaaagaaaatgatattagtaacgtaaatattttaggctacgttaaagaagatgagaaaaagcagcttatggaagtatctaagttctttatctatccgtcttctgcagatacttttggcatatcagttttcgaagcgctttcaatgggtttgccagccattgtttcaaaggagtttcctgtaaaggaagacacgaacgcaatagtatacgaagatttctcgaacatcaaacacatagcaaataaactattgaacattgatcaagcaacatattccgaaatgtcaacttccgctagaacgctcgccataagcaagtatagcatagacaggcatatagatcagcttcttagcttgtat

SEQ ID NO: 37193 - DNA, 816 bp, Thermoplasma volcanium
atgatagagacccgatccttaaccaaggtctacaaaaacggaaacaacgcgctaaaagatatatcgttggacataggttctggcataacttctgtaataggcagaaatggtgctggaaaaaccactatgatgcgaatattctcaacgcagctaagacctacaagcggttctgtaacgattaacggttatgatgtagttaaggaatccaacaaagttagaaaaattatatgcagcataccgcaggaagcgtcaccaataggtgtattaacaccgcttgagcaggtaaaaatgtacttagttgcaagggggctttctatttcgtctgctgatagagaagccaggattgcactctcctcagtgggcctggaagaaagcatgaaagcgcctgcagacacactttccggcggcatgaagaggaaggtattcgttgctatggctctttcagcaaatgcagatatagtttttttggacgagcctacgaccggactcgaccctatgtctaggcttgaagtttggtccctcataaggaacctgagatcagacatagtccttacaacacactacatggaagaggctgcatcgctgtctaagtacataataatggtagaccacgggactgttataaaagagggaacgttgaaagaactcctatcagaatttgacggcctaataagagtggaatctaggcagccgttgccagatagttctccagtaggcgggatatacataaaatatgtaaatgcttcggaggctaacgagtatataagcatggggtgtgatgtaaagaacattacattggacgatgttttcattaag

SEQ ID NO: 37194 - DNA, 1152 bp, Thermoplasma volcanium
aagatactcataatgggggtagatggctacataggttttccccttgcccttaggctgcttactagaggacatgacgtttacggcatagataatttcataacaaggaaacgtgttcaaaaggtcggttctgactctgcattgcctataagttcatttgcctttaggaattcggtaattaagaagaaatttgggaaaggtataggattcttttatggtgacgcgacaaatccaaagtttatctatcgggtaatcaatgaggtgaggcctgatgctatagtccatctcgccgaacagcgctcggccccctactctatgatcgggttgaaagaagccaatgaaacaatggtaaagaacatagtgagtacgttgaatcttatatatgcagtaaaggatattacgccagaagcccacatactaaagttagggactatgggtgaatatgggacaccgaacatagatataccggagggtttctttgaaatcgaataccacggtaggaaagatgttcttccatttcctagaaacgcaagttcatggtaccattggacaaaggtgcacgatagtaacaatttgatgtttgcaaacaaagtttgggggacaaaggtcaccgatgtcatgcagggtgtcgtgtatggcacaaggactgaggaaatagagaaaactggactttacacccgctttgatatagacgaggtatatgggactgccctaaatcgcttcacggcagaagccataattaacgagcctataacgccatacggaaagggcgggcagacgagaggatttctctcccttaacgacagcatcgaatgccttacgttagcattggagaatccgcctgagttcggtgaatatagggtatttaaccagtttgatgagaaatattccgtcaatcaactagcagaaatggttcgagatctgtataaggagaaatttggaaaagaacctgaaatagtacacgttgataatccgagggttgaaaaagaagaacactactataatccagagcacgaaaaactgaaggctcttggttacaagcggactaaggatataaaatcagagatatatgatgccatagatgatctcaacaagtttaaggaacgattaatgaatttgcgcaatgtaataatgccccgcacttattggaagaaa

SEQ ID NO: 37195 - DNA, 699 bp, Thermoplasma volcanium
ttgcagggtctaataacggcggctggtcttgggactcgttcaggcgcctctcagttctaccggaaggagatgttctcaatatatgacgcaagggatgggaaggtagtaatcagaccaatcatagattgcgtgatatatagaatgaagattagcggtatagacgatattatagtggtgctagatccgaaagatgaagtgacgaaaaaatatatagagttaagctatcccgacgttcaaattgcctatcagactgagaaacgcggttacggggacgctgttcactcggcgctccaatttatacacggcccgtttctccttaatgctggcgatggcgtactatttgatgacaataccgaaaagaggatagtggattcgtacaaatcagggaataggcttatcgccttcaaagtagatgacccaaggagatacggtgtagttgagatggatgagaatggaaatatagcaggcctagaagaaaaaccaaatttgcctaaatccaacctagccttggctgcaatatatatattggataaatccgtcttaaacgaaatagatacaggaaaggcaaacgtagagctaactgacgcaatcgatagaacaataaaaaaaggcgtcaaaagcgatgtaatcgaaatagacagaagcgagtggatcagtgtgggattggctgacagatacgcagacgtagtaagtgaaaca

SEQ ID NO: 37196 - DNA, 1221 bp, Thermoplasma volcanium
atggctgatttctttctcatggattctttcgatctcgcaggaaggactatatatctaagggttgatataaactcacctgtgaatccagtaactggagaaataatgggtacagataggtttagggcccatgtcgagactattaggaagctaagagattcaaaggtcgttattgtggcccatcagagccggcctggaaaggatgattttacgtcgctgaggcagcacgcgcaggtcatgtcgcgtattttgaacaagaaagtaatgtttgtagatcagctcttcggatcacttgtaaacaagactgttgaatcaatgaatgagggagatatagtaatgctagaaaacgctaggttctattcagaagaagttgaccttacgactttagaatcgatggaaaattcaaacatagttaagggtctctctactctcttcgattactatattatagatgcgtttgccgcaatacatagggcacagaccacccttgtaggtttcaggaggataaagccaaacatagcaggtgcgcttatagagaaagaggttacaatgatcgataggttcaggcatctaaacgaatctccaaaaatagccatactaggcggcgcaaagatcgacgattctatcgctgtatcagagaatttcctgaaatccggcttcgttgataaaatactcaccggcggtgttgttgcgaacgcattcctttgggccaaaggcatcgacattggaaagaagaacagggacttcataataaaaaataacggagattacgagaagttgatcgctaagtgtaagggtctgctctccgagtttggtgataggatactggtaccgtcggatttcattttaagtccttcaggagaaagggtctccgcaaacggaaagattcctgacgatcagatacttgctgacattggactcgataccgtggtcgaatactccgaaataattgataaggctaaggcaatatttatgaatggcccaatgggtatatatgagatcgaagcgtattcatctggtactagggagatattttcttctgtagcaaaatcagaggcctttagcatagcaggtggagggcatactcttagcgcactggacaagcttggtctgacaaacaggatagatcatgcgtcaacaggcggaggggcactcataagctatttaagtggtgaagctatgccagtactcgaagcattgaaggaaagcaaacgtttgtttgag

SEQ ID NO: 37197 - DNA, 909 bp, Thermoplasma volcanium
ttgggaggcaatgggcgtgagaaagatcatgcttcagaattaagatctatttttagccttaaaaagatagcggatgctgtaaacggctatgaggaagcaaaatacgttgtatttggaatcccatttgataatacgtctagctatagacgtggatcaaagtatgcaccggattctataagaggagcatacgtgaacttggaatcatacgaatattcctatgggatcgatctcctagcatctggcatggcggatctaggggatatggaagaatcggaagacgtagagtatgtgatagatacagttgaaagtgtggtttctgctgtgatgagcgatggaaaaataccaataatgctaggcggagagcactcaataaccgttggtgcagtaagggctcttcctaaagatgtggatcttgttattgtggatgcgcattcggatttcagatcatcgtatatgggcaacaaatacaaccatgcatgcgtaactcgaagagcattggatctgttgggagaaggaaggattacttctatagggataagatctgtttctagggaagaatttgaagatccagattttaggaaggtatcctttatttcatcctttgatgttaagaagaacggtatcgataagtatatagaagaagttgataggaagagtagaagggtgtatatatccgtagacatggacggcatagatcctgcatacgcaccagctgtaggtactcctgaaccatttggccttgctgatacagatgtacggcgccttattgaacggctttcttacaaagctgttggtttcgatatagttgaattctcaccgctatacgataacggaaatacatctatgcttgccgcaaaattactacaggttttcatagcaagtagagaaaaatactataaagaacacatt

SEQ ID NO: 37198 - DNA, 721 bp, Thermoplasma volcanium
aataaaaatataccaagtaattatatgaatattgatggaggaaatttcactgcaggaaaaaattgagaaattacctttaggggtggcctgcatagacggcctaaccaacggtggccttgaagccggcattataaccgaaatatttggagaaggtgggtcaggaaaatctaacgtgtgtatgcttgctgcctgctctgctttgaggcttgggaaaaaagttgtatttatagattcagaggggttttcgtctgagagatttctttccatatgcaaagctgataattcaaaattaaaggtaatcagagtattctcactcgatgatcaagaagtagcaataacaaagttttcaaagatcatcgagaaggatgcgtcatatggattatttattttagattcattttctgagttttttagactagaaaggacaggagataaccaatcaagggtgatagatttccagaggcagctttctttgctgtcgagcatagcagccaagaggaaaattcctgttcttataactaatcaaatatatcaggacatagccaatggcgacatccttccgttcggaggctatgtggtagatcacattatgaaagccatatacagactggaaaggcttcccgatggaaggagaaaaatgacagtcatgaaacaccgttctgtaaaggagggaaattcggtagaattccgtatagtacaggatggcatatcatgcgaggtg

SEQ ID NO: 37199 - DNA, 1005 bp, Thermoplasma volcanium
atgggaactgatatttctgacatagttgtatctcaccagactagtctaaaggatcaggctaaccaagtattcgctatagatacctacaatattctttaccaacttctgagcaacgtcaggcagtacgatgggactccgctcatggattctagtggaaacgtaacatcccacctctatggcattttttatagaaccgttaacctggtcgaaaacggcattaaaccaattttcgtattcgatggaaagcccagccctttaaaaaataggacgcttgagattaggcagctagcaaaggaaaaggccaaggctgaactagaagaggctatttctcggggagaggaaaacttaaagcagtactattctagaataaactatattacgccgcagatcgtgaatgacacgaaggaacttttaacttacatgggcataccttacgttgatgcgccatccgagggagaggcccaggcatcctatatgactaggaaggatgcagatggtgtgatatctcaagattacgattgcctactctttggcgccaagaaaatacttcgaaattttgctatctatggcaggaggaaggtaccgcggaagaacgtttatagaacggtttatcctgaatacgtgatgctcgacgaagtactgaaaaagaatggaataaaccaggatcagttaatcgaaataggaattttggtgggaacggatttcaatgaaggtataaaaggcataggggctaaaaaagccctcgccctaattaaaaaggaagggaatataaaggcagtgttaaacaagattggtaaaaatatagaaaatttggacgagatcatagacttcttcaagaacccgcccgttgttgacgtcaagtacgtatttggaaaaccagacccaaaaaagattgaagagttcctatgcgttgttcatgacttttcaagggataggatacttgaacatatcaatacatacgtaaagtattataataagtctgtccagttccggcttgatagtttc

SEQ ID NO: 37200 - DNA, 654 bp, Thermoplasma volcanium
gaaagaaatatattagttgatgattttttagctaagttaaggaggtacaagggagcaaagattccaaacaacgtctctagaaatgaaaacttgaatcgtatcgcgctatcattgaaaagatcaggacttatagatgaaatacccttagaagtaatgaagaacgcactaaatatatacctggataatgtttcgcatggcatatcgcggggccgcggatgcactgcggtacttgctgcctgtattctagtcgcgtcaaggtccagcccatctcctgttaccttaaggtatgtctctagggcgttaaaaatagatccttccaggatatggaggacggagagcttagtggtcaaaaatacaaacggcaaaaatatggcagtcaggccgatagattttatagagaggtatgctgaatcgcttaacgtagacgacgatgtgcgggacgaggctattgcacttacaaataaaatcgcctcgcaagtaagccttatgagaaaatcgccatccactattgcgatttcggctctttatttggcgtcaatacttaaggacagaaaactagtacagaggtatgttactaagaagacgggcataaccgaggtaactctcattaggacttacaaagaaatttacagttatcttacggggaatcaagca

SEQ ID NO: 37201 - DNA, 1221 bp, Thermoplasma volcanium
atgaatatagttactttgatttcgtgggactttaaaagaaataatgaatcatttcaaagggcaattattaatggatatgattattggtcacgtatattggacgatcatggagtagaaaaatacgttatactcttgacatgcaacagagtagagctttattataggggcgacccgttcgatgttcaggaaaaaggttataacataatttctgacgatatggcaataaatcacctatttcacgttgctgcaggattagattcaatgagtattggtgaaaacgaagtcttgaaacaggtaaagcaagcctatgaaaagtcttcttctatggggaagagtgacaagtttctatccctaatttttcagcgtgccataagtgttggcaagcttgtaaggtcaaaaacaggcataggcaaggggaaagtatctatcccatcgattgtatatgatattgtccgaaagaatggtggcaataagatacttctcgtaggaaacggaatgctagcatctgaaattgctccctatttttcatacccgcagtacaaggtcacagttgccggtaggaatatagatcacgtaagagcttttgctgaaaagtatgaatacgagtacgtacttataaacgatatagactctttgataaagaataatgacgtaataataacagcaacttcttcgaagacaccaatagtggaagaacgatcattgatgcctggaaaactcttcatagatcttgggaatccgcctaacattgaacgcggaaataatgtaataaccttggacgaaatttatgagatttcaaaaaagaacgagatgttacgggaggagaagataaaccaggctgaaatacttatagagaacgaaatgaaagcaacgatgaacaagataaaggatctaatgatagacgacatattctctcaattctatagatttgcctccgtggttcaaaccatggagatacagaaattcaggaaaatgcatccagaggtaaacgaaaatgatcttgaagctcttgcacattcaataataaacaaaatacttaacgtacctgtaacgacactcaaagcggtttccagatctcagggcaactcagatttcaacagattatttgaatcattctcaagcaatttcaacgatatcgtgtctgctgcccttcagagctacgaaggtcttcgagatacccaaagtctacgagaccgaactcgtcagttattgcaaaaatcc

SEQ ID NO: 37202 - DNA, 1398 bp, Thermoplasma volcanium
atgggttttatagaagagatcaagtcagcattgggcaactacgtaataactgagaagaaagatcttataccatatatgaatgacgcttcctattttaccggtgaaatgccagaggcagtcgtgctgcctggatccgcagaagacgttcaaactataatgagattagcctataaatacgaaaaaccagtggttgtaaagggtgggggatcttcattaactggatcttccatcctaaaggaaagtggcatagtaatgtcgatgctaagaatgaaccgtatattagatataaacttgaacgacaaatgcgtaactgtagagcctggcttgagattgaatgatctgcaactctatctggataaatacgggcatttctatccacctgatccagccagttctatggctgcaactgtgggtggatcaatatctaccaacgcaggtggtctgcgtggcgtagcttatggcgtgacgaaggactggatcctcggccttgatgtggtacttgctgacggcacgatggtaaaattcggaaataaaacattaaaacggacacttggctacgatttaacttccctaatgataggatcagaaggtactttaggagttatcaccaaagcgtatctaaaaatctggccaaagcctcaaaaagttgcaaggctcgttgctttttaccaagacatcgagagcgctggcagagctgtgaacgaactgaaagtttcaacaataccagagatggcagagtttctggataaaatatccctggattccgttccggaagccataacatatccaccaggcacaaaatatgcgctcataatcgatgtgtcagggccacctgaactcttgggcaagaagaagactgaaacggaagagctattgaagaggtatgcgatctctacaaaaagtacgactgatccagcagaaatggagaagatatacagagctagaaaaggactttatgcttcgatacttaaattaaggaaaagcgaaaaggaatatatagttataggggacatagttgtgccggtatccgagctgcctacatccttaaaggagatagagaaaaagagggatgaagacggtgtcagggctgctatattcgggcatataggcgatgggaatatacacgcaaacatattcgcagatttaggtgataattcggcgatggacaaagtaaacagattcatgatggacctcgctatggtggcagtgaagcacggaggtagcgtctctgctgaacacggcatcgggatagaaaagaagcaattattgatagaagagatgaagtacaacaacaatctgcgtacgctagatataatgaaggcgataaagcaggtgttcgatccaaagaacatcttaaacaggggtaatatctttgaatgagatggaactactcattca

SEQ ID NO: 37203 - DNA, 1338 bp, Thermoplasma volcanium
atggcagtggagagactattcggtactaatggtatcagaggaataccaaatgacgatatgtcgccagatttcgcaatgagtgtcggaaaggctataggtacttacgtttcaggagagatcgcctttggaacagatacaaggctaactggcgatatgataaaaaatgctgtaattgcaggcattctttctaccggtattagtgtaatagacctgggagtattgccaactccagcaatccaatactactccaagaagcacggcatatacgctgtcgtaataacagcctcacacaatccgccacaatacaacggcataaaggttatagataaagacggcaccgagctagagcgtcctggagaggaaaagatagaggagatattctactccaaagccttcagagttgtcaagtgggaaaacataggaagaatacgtcaagtaagtgatgcaatagacatatatataaacggggtaatatccaatgtagattctgataatataaaatcacatgcatttaaagtacttgctgatgcaggaaatggtgcggcatactattcaactcctaaattgcttgaaaaacttggatgctcaatcactacgttaaatgcaaatccggatggaagatttactgctagaaacgctgaacctgtacctgaaaaccttgtcaaccttatatcactgatgaaatctggcaggttcgatctcggcatagcacatgacggggatgcggatagggcagtttttatagatgagaagggaaacttcattgacggtgataggatgcttgctttaataactaagtacatagcaaaggcaggggatgtagtagtaacgccggtaagttcttccgacacaattgctgatatctgcaatgctataggcgctaaactcataaggacaaaggtaggggcgcctattgttgctagggcaatgatagacaacggtgctactataggcggcgaggaaaacggcggtgtaatatatggaaagcaccagtactgcagggacggggcaatgactgtttcgcttgtacttaatttgatggcctccactaacaaaaaattatcggaacttatctcagagcttcctgtatattatttgataaaaaagaaggtagagcggcgtgtagattggccgtctcttgcaagggaattgaagaagggggaacgggtcgatgagaccgatggtataaagatattgaaggatgacggatggatacttatacggccatccggcactgaaaaaattttaagaatatatgctcattcttcagatttcgaactggctaacaaatactgcgaacaatacataagaaaagttaacgacattcaggataagtta

SEQ ID NO: 37204 - DNA, 915 bp, Thermoplasma volcanium
atgttaaagaataagagtgttgtctcaatcgatgatgtacaaaatgacgatctctttgaaattttcgacctatccgaatcgatgctgaaaactattgagagcaaagggaacgcccctcttctaacaaataaaataatggcaaccctcttctatgaaccaagcactcgaacgaggctttcatttgagagtgccatgcacaggcttgggggttccgtaataacggtctcggacactaagacaagttctgcggcaaagggagaaacgcttgcggacacagtgagaatggcatcatcatattcggacataatagtgattcggcatccccttgaaggtgcagctagactggcatctaggtttacaagcaagcccataattaatgcaggagatggatcagggcagcatccaactcagaccatactggatctttttactataaagaaggagcttggatccatagacggaaaagtaataacaatggtcggagacttgagatatggtcgaactatacattctctgataatagccctgagcaggttcgatgttaaggttaacttagtaagcccggagatcttaaggcttccggaatacgtttattctatgctacctgacagaaattatgtaaaggagtacaacgatcttgaagaagtgataggagaaacggacgtgctgtacgttactagaatacagaaggaaagattcagtgaccagaatgaatatcagagtgttatcggttcttattccataaattctgaaactgtggaaaagatgaagaaaaagagcgtcataatgcatccacttccacgtgttgatgagatctctccagatgtggataatatgccacaagcagcttattttaggcaggcctattacggagtaccggtaaggatggctttaatatacaagattctgggtgat

SEQ ID NO: 37205 - DNA, 447 bp, Thermoplasma volcanium
gaaaagactctaaagatatcaaagattaaggatggaactgttatcgatcacataccttctggcaaagcacttagagtgctttcgatattaggaataagggacgacgttgattatacagtcagtgttggaatgcatgtaccaagcagcaagatggagtataaggatgttataaagatagaaaacagatcgctcgataaaaatgagctggatatgatatctcttactgcgcctaatgccaccataagcataataaaaaattatgagataagcgaaaaatttaaggttgaattaccgccgaagctaataggaataatcaagtgcaagaatcagaactgcataacaaatacacgggagcctgtaaagccagagttcgaaatagtatcgcgccatccgttggtgctgagatgtgtttattgtcaaagaacaatgaatgaaagggacgtgttc

SEQ ID NO: 37206 - DNA, 675 bp, Thermoplasma volcanium
ttacgtaaattcataatttcgctaaggcccgctgagaaattcgtaaagtttgattcaccgtgctttgacctgataaatataccagtaacaagactcatgccattggatatcaatatagaaaagatacttaaagagagcgctgcggactgtatagtattcacaagcacctttggagttgatcttttcttttcaagagtcaatatgaaaggctttactattttgggtatcggcaaggcgacgtgcgagagggtgcaggcctatggacacaaatgcttataccctgaaaatatggactccgaagggcttgcgaacttaataataagtaagtgcaaagacaagaaaattcttattttaagaagcaagaaggcaaacgaagtccttactgagaagctaaaagaagaggggatcgatttcttagagttcaggatctatgatgcagtaccagacacaaaagatttcgaaaagcattacaaagaccagaactgccttggtgtgataattacctcatcaatggaggcagaaatagtaataccatttttaaaagaagacaaaaaaatggtattctccataggagtgacaaccaccaatacccttatgtctcacggtattatgcccgatattacaggaaactcagactttttagagcttctaaaaaagatcgattattttatctgc

SEQ ID NO: 37207 - DNA, 879 bp, Thermoplasma volcanium
ttaatgaagattaagattggcacaaggccaagcaacttggctgttgcacaggcaaatatggtcgcttcttcgttggaagcaataggaatagatacagagatagtaaagcataggtcagccggagatattgatactaaaaaccccatctattccatcggaaagacaggagtatttgtccaggatctaaacaatatgatactcagaggagaaattgatgtagccgtacatagcgccaaggacataccatcggaaatagaaaacagacttacaatagccgcaaccttgaagagaggatcattcaatgatgcccttgtttcaaagtacgatttaagatcacttcctatttctgcaaaagtaggcacatcaagcataagaagaatctttcaattaaaatacgcaaggcaggaccttaagttcgaaaacataagaggaaatattgaaacaagaatagccaagatgtctgaactcggccttgatgcaatagttatggcagaagctgctatacaaaggcttggccttaacgtggaatattctaagctggatgagaataaatttgttcctgctccaaatcaaggaataatagcagttgtttcaaaaaaagagggaacagttagaaaaattctggaagaaataaacgacgaaaatacatttgaagagatgcaaatagagaggagcgtagttcaacagctaaaacttggatgctcaacaccagttggaatacttagcaggccttcaggcaaaggccataaaattatcgcacagtttttctcgatgcagggagacgatgtctcggtctttgaacaatacttaaacgatttatcagatgtagattctttagtttcttacataagggagaatatcccaagagaatacggatat

SEQ ID NO: 37208 - DNA, 1254 bp, Thermoplasma volcanium
atgtcatcaaaagaactgtttgaactcgcagctaagctgtttcctatgggagtgaactcacctgttaggtactttaaagattacccgttctacgtcaaggagggaaaaggatcaactatcctggacgttgacggaaacaagtatattgattactgccttggctatggcccgcttatacttggtcactctgatccagatgtcacgagagccgtaatcgaacaggcagaaaagggattacttttcggagaaccaagtgagaacgaaattaagctagccgaaatgattaaagagacttcgaagaacatagaaatgatgaggtttacgaattctggtacagaggctacaatgcacgccataagacttgcaagggcaatcactggaagaaaattaatagtaaagatggaagggggatttcatggtgcgcacgactattcactaataaaatctggaagcggtacgcttacgttcggatcaccttcatccccgggaatacccgacgaagtggctcaaacggtgattgttggcaaatataatgacgagaataatatcaaggagatcttccaaaaatatggggataagatagcagctgttataactgaacccataatgggaaatgcaggtgttatattaccaaaacaggggttcctagagtttttgagagacataacgcagaaacacggatcgttattgatttttgatgaggttattacaggctatagatttgcgttttcgccatttcaggatattatgaggatagatccagacatcacaacgatggggaagatcataggcggaggcttgccaataggcttgtttggtggatccgaagaaataatgaagaatatttctccatccggcaatgtctatgaggcggggacgttttcggggaatcctatgtccatggctgcaggatacgcagccatggaaaagctatcgaaacaggattactcgatcctaaaaaaaaggacccaaaaactagtgtctggtatagacgatatattggatagaaaacacataacacatacaattaaatattacggcactatgtttcaggtattctttgccgatcatgtaaacaactatgatgatgccttaaaagcacgaaaagaggtgtatttcaaactgttcaaggctttatcgaaaaacggggtttacctgcctccatcgcaatatgaaactaattttgtgagctttgcccattctgattccgacatagatgccactctagcagcctttgaaaaggcagtggcggag

SEQ ID NO: 37209 - DNA, 1164 bp, Thermoplasma volcanium
atgaatgatgtttacatagtttctgcaaagaggacggcaataggtaaatttggccgaagtttttcaaagatccccgcaccgcaactaggtggtgctgctattaaagccgttattgaagatagtggcattgataaatccgcgatccaagaggtaataatgggaaatgtcatccaagcgggtgttgggcaaaatcctgcggggcaagcagcccgtgctgccggccttgccgatgaaataacgaaatatactgtaaatgttgtgtgtgcatcaggcatgcttgctgttgaaagtgctgcaagggaaattaagcttggggagcgagagattgtgattgccggtggcatggagaacatgagtaatgctccttttctattaccgtcagatctaagatggggaccgaagcatctactccataaaaattataaaattgatgacgcaatgctcgtagacggcttgacagacgctttctatttcgagcatatgggggtgtccgctgagaggacagccaagaagtatggaataacaagagaaatggcggatgaatattctgtacaaagttacgagagagctataagggcaaccaacacaggggaattttccaaggagataaccgtcttttcaaatctgtcacaagacgaaggtataaggaaaacaacgatggaggatctggctaagctgcctccagcgtttgataagaatggcatacttactgcaggaaactctgcgcagctatccgatggtggttctgctttactacttgcatctgaaaaggcaataaatgaatacggtctaaaaccaatagcaaagattacaggatacgaatcggcatcgcttgctccccttgactttgttgaggcgccgatacctgctactcgcaagttattagagagacagggcaagtccatagattattatgacatagttgagcataacgaagcattctcaatagcatccataatagtgagggatcagttgcatatagacaacgaaaggttcaacgtcaacggtggtgctgtagctatcgggcatcctatagggaacagcggttccaggataattgttactcttataaatgctctaaaggaaaggcacatgaagactggattggctaccctttgccatggcggcggcggggcccacactttaacactagaacttgtagac

SEQ ID NO: 37210 - DNA, 1545 bp, Thermoplasma volcanium
atgccatttgaaaatgagaatacttatctccgtatgtcggaggcaggaaaagaggcggagtttcataggttatacgaagaaagcctgaaagaaatagaggcgtatttcaataaggagtatccaaacataatagatggcgatgttatagagtctaagaaaataaaggatataagcccaattgatgggaaggagatagccactttccaactagcatcggattcatccgtagataaagctgttgatatgctgtacaaatcttacaaggcatggtacagcctggggtatatgaaaagggccttgatattcctaaaggccgcagatatgctaagtgaacagaagtttaagtttgcagctatacttacttatgaaaacgggaagaacagatacgaagctattggagatgtggatgaagcaatagactttatgagatattatgccatgaatttgatagaaaaccagggtttcataaggttcacaggaaaagcctataggaatgaagaatccataagcattatgaagccgtacggggtatttggcgttatctctccattcaacttcttttccatcggagtaggcatgagctcagctcccttggtgaccggcaacgccgttatactgaaaccttcaagtgatatacctctctccctctatctctgggttagattgatgcatgaggcaggcgtcccgaagaatgtgttagcgtttgtatcaggttcaggcggcctagtaggaaggcatatagttgagaacaagaaggttgcaggcatcgtgtttactgggtcgagggatgtgggtctggacatccagaggaaatccatagacaacggcccgaaggtagtcataactgaaatggggggaaaagatgctataatagtttccaacaaagccgatatggacaaggctgtggaaggtgttgttagagccgcatttgggtttgctgggcaaaagtgcagtgcttgttcactactttacgtacataaggacatatatgatgaatttatgaagaggctcaaggcaaggacagaggccattaagccagacgatccaaggaagaaggatacattcctcaatcctataataaataaggaagcttacgataagttcataaaattaaagcctgaattcaacaagggcaagatacttacgggcggccacgaacttaacaaacctggcttctatgtagaaccaacaatagtgacggatctgccgaaggatgcatacatagcaaggaatgagatattccttcctgttctcagcgtgttcaagtgcaatagcatagaagaagctgtagatgatatcaacagcatggactacgggctcaccggaggtatattcacggaagacccgaaggagatacagtattacttcgacaatatagaggttggggtaatctacgctaacagaaagagtggcggttccactggatcaatggttggatcgcagccttttgttgggtggaaactgagtggcgtatccggcaaaggaacaggatcattctactatctacagcagttcctgagagaacagtcgcagactatagcccac

SEQ ID NO: 37211 - DNA, 633 bp, Thermoplasma volcanium
atgaatcagactttagaaactggtacaactacagttggtattacgctaacagatgccgtaatcatggcgactgaaagaagagtgaccatggagaacttcattatgcacaagaacggaaaaaaactattccaaatagacacttatactggtatgactattgcaggactagttggagatgcacaggttcttgttagatacatgaaggctgaacttgagctttacaggttgcagagaagagtaaatatgcctatagaggcagttgccacacttctatcgaatatgctgaaccaagtcaagtatatgccatatatggtccaattgcttgttggagggatagatactagtcctcatgtattttctatcgatgccgcaggcggttcagttgaggatatctacgccagcaccggttctggatctccatttgtttatggtgtactggagagccagtacaacgaaaagctatccatagatgagggtgtcgatctcgtaatcagggccataagcgcggctaagcaaagggattcggcctccggtggcatgattgacgttgccgtaataactaaaaaggatggctacgtacagctgccgaccgagcaaatagaggccagaatcaaaaagcttggtttaatttta

SEQ ID NO: 37212 - DNA, 945 bp, Thermoplasma volcanium
atgaaaaccgagagcttaagggatacttatggaaaagagcttgttgagctcggcagaaaggatccggatatagttgtcctggatgctgatttatcctcatcaactaaaactgggtattttgccaaggaatttccagagaggttctttaacatgggtatatcagagcagtcaatggtcactacagctgctggacttgcaatttccggtaaaaagccattcgtttcaacgtttgcaatattcctaatgagaacgtatgaacaaataaggcaatctatatgttataacgatgtgccggtcagatttgtagtaacccacggcggcataacggtaggtgaggacggagcaacgcaccaaatcgtcgaggatgtcgggataatgtctggcctcccgaatatgagcgtaattgtcccaagcgattcagtagagacaaaaagtgtaatcgattacttagaaaatattaaacatcctcattacgtccgattatcaagggagaaattccctgtgataaatgatttaagctacgaattcaagattggacgtggctatgttgtaaaggatggctcagatgcaacagtcatcgcaaatgggataatggtatcgaaggcactagaagctgcaaacgctttaaaggataagggcattgatttacggataatcaacatgccatcggtcaagccaatagataaagatatcataataaaggcagcgagagaaaccggccgtataataaccgcagaggaacactccatatacaatggtctcggcagcagagtttccgaagtagtttccgaaaactacccagttattgtgaagaggatcggtatgcgtgacacttttggaaaatccggaaaagctatggagcttttctcctatttccacatggatgttaaagatataatagactatgttatccagagtttggaggaaaagagctatgaaaatatt

SEQ ID NO: 37213 - DNA, 858 bp, Thermoplasma volcanium
atgaaacttaaaatagttccagttgtcaccccattcaaagaaggcaagatagacggggaaaaatttatccaccactgcatgtcccttttatccgttggcgtaaactatgtctttatatccggaacaacaggcctcggtccttcgttgtcaatcaacgagcgaatggatctaataaaactttcatctaattttgccgacaaggccataatgcaggttggttctatgaacttagaagacagcattaagcttgctagaatggcaaaagagaatggaatatatggcatatctgcactgcccccatactatttcggaggcatacccgaagaatggcttatcaagtattacgtcgaaatctcaaaaataataccaactttcatatacaattatccaaaattcacaggttacgatattaattcctctctcgcgataaagataaacaaagcaggcggaaatataattggagtaaaagataccatagctgatatttcacacatgctttcctacagggatctaggcaacgacttcataatactttcaggcccaagcaatagtatctatgaggcacttaggagtggagtagatggatctgttgctgctgcaggaaactttatgcccaagaccttcatagaactagcagataagtttgaggctgaagcatcgttcaagttgcagaaatacattaatagtgtattgtctatagctaatgaatatggatcttggtcagcttattattctctaataaaaatacttaggagatacagcgcaggcgattctagggcaccattctaccctttgaacgcgctggatgaggagaaacttaggcatgatgtgttctttgtattaccggaggaacaaagg

SEQ ID NO: 37214 - DNA, 1254 bp, Thermoplasma volcanium
gatatgttattaaacgaagaagagaaacaaataagagatctgtgtagaagagttgtgaaagaagtaccccacgagctgataagaaagattgaaagagaggaagtgacctttcccagagagttcatagatttcataacaaaaaacggagttgttgggctcagatttccaaaggagtatggaggaaaaggtgcaagttgggtcgctgaggcctccgcagttgaggaaatgggttaccttggattcactctcagctgcatgtattctttaggtactatcgtaggagaacctatgtatcgttatggaacgaatgaacagaaagaaaagtacctaaaaggcatcacgtctggaaaactttatggagctgaggcaatcacagaaccctcaggaggatcggatctatttggaatgatgaaaacaactgctgtaaaaaaaggaaacaaatatatactgaatgggcaaaaaaggttcattgttgggggcaaaggagctgacttttttgtaacatatgccataacagatcctaatgcaaaatctagaacaaggggcatcagtgcgtttatagtggatcgtgacactcctggcttaaaagtggagactctatacggacttatgggcaataagggcggaggcactgctaggatcgtatataaggatgcagaggtgcccgaggagaatctaataggggagctgaacggaggctacgaagtattcaataggatgatgatccctgagaggctaaccactgctgccggatcgctaggcgtaagcaccgccgcattgaaggtagccacagattacgcactaaagagagaggcttttggatctaagctaattgaacatgagggcataaacttcaagttggctgagagccttacactactccagtcagcttcagcccttgtttatacagcagcaaaggcagctgatctctatgagaaaggacagacaacccaatcctatgcaagaaaacttgtttcaatggcaaaattgcattctacagaggcaatgtggaagatagtcaatgacgccatgcaaataatggggggcattggatatacaacggtatatccaatagagcgcttgctaagggattctaggcttggcctcatttggacggggagtagcgaggtcatgaagatgatcatccagcacgagtacttaaaggaatttactaatccggattactgggagtctagaagagatatcgaaaaagatgctcttgacttcaggttagaagaagaaaaagtatttaaa

SEQ ID NO: 37215 - DNA, 1524 bp, Thermoplasma volcanium
ctgacccttgacagattattttatcaaaccttattgagaaaacctaacgagttcctaaccgaaggtcagagaaagatcacttacaaggaactttttgaggattccgttcgccttgcaaatggcttgagttcctgtgatttatctggtaagagaattgcagttctagattggaattcaattgagtatgccatagccttgtatgggataccttttgcaggatcgtccattcatccaattaatgttcgtcttccgttggaacaaatatcaagaacgattaaaactgcgagggacgaagcattaatagtatcaaaagactttcttccgatcgctgaaaaacttgctgaagcaggattgttaagcaagaaaaagatattcacaattaacgtatctagtgatgatttttctcggttcgaagatctcatagatgatggcgaagaggtttttacccctaaatttgacgaagatacagagatgtctatcctttttacttctggaactaccggaatgccaaaggctgtcagttatacccatagaaagactgtaacggctatatgggctatacttacttctctctccgcctaccaaggcttagcaagacttaattcaggtgatacagtttttcctcttattccattctatcatatatggtcatggggttctttgtttatatcaacgatgattggaactaagtacattcttggaggaaaatttgatcctatatctactttgaaattaattaagtccgaaaaagcaacatggatgaatatggtcccaacaatgttatatgcactattggcgaacgataatgaatccgtgctttccggtatgaaaattctaattggaggttcacccatacctaacggcctagttgaagaagcaagaaagaggaaaattgaattgacttctatttatggctttactgatggattgatcgcatccatcggaaccatcaacgaagcctatggaaaaattgaagatgaaagaaaatacgaaatttcaacaaaatattcaacgccatcacccttggcagagttaaaaatagtaaaagcagatggtgctccccctgagatatttttcagatcgccttggttacctgatggatatgtttcagacgaaactgaaacaaagaatgcttacgtagaaggctggtttagacctggtgattctgggcatatcgatgagatgggcaatctgtgcatagacgatcgtgtcaaggacctaattaagagtgggggtgaatttattcccagctctacgcttgaaagctacatatcaggagtacctggagttgaaatggtagctgtggtgcctagaaaggatgataaatgggtggaaagacctgtagcatttgtaaaatctaataaggactttgacaatttagtacgcaatataaaagatttgttcgattctttagtaaagagcggaaagatatcgagttggtggatacccgatgagttttatagaatagacaatatgccgttaactggtacaggcaagatcgacaagaaggagcttagaaaatta

SEQ ID NO: 37216 - DNA, 2295 bp, Thermoplasma volcanium
aagataattgacaactcaaagcagaatttggcaggcgtccttaggcgcgagatgagccatgttgaggaacttgccatagcttcggcatacttcaatcttgaagggtacaggaatatccaggaaggattgaaaaataagcccctaaagctacttctaggtagagagccttctgaaagcataaagtttgaggaggaggccataaagaaccttgaaagttatgacgaagatttctattctgagcagaaagacgtttttgccagtgaagttttgaacaatgaggacgatgtcagctacttctcagccttgcacaatgccgttgaatttttcaagaggccagaagttgagataagaagggttaaggggaggttcttccacggtaaggcctacatgggcgcacgcacatcattttctaatatggttagtggctttgcaattgttggctcaagcaattttacaggcggcggactttcgggaaacagggaactaaacatgctgacaacagacagggaaggtgtgactgagctcataaaatggtttctggaactttggaaggaagaccgttctgttgatttcaaaaatgagttcctccagttgcttgaaaactatgtcacaacacacagtccttacgaggtcctggcaaaagccctttacgaggtatatggcccgcagcttgatgaagcaagaacaaacggcctcatgaagaccctgtttcctcatcaggtcctatcaacaatacaggcatcaagaatcctcaagacatacaacggcgtagtcatagctgattccactgggttgggcaaaaccagggtagcaattaacctggctgtaatggcgataaacgacggaaggaatcctctcctgattgcgccgaagagcgctcttgaaacaacatggaaggatgagatggacaagacgcatgtccatatcgattcaaaaaggtctgaatacctctcacaacacccggatgaggcaataaaggaaattcagggtaaagatttcataatagtggatgaggcacattatttcaagtcaccagggtcaaacagatatagtgtactacgagatcttatggctgcaggccaaaaacaaattgttctcctaactgccacgccaatcaacaacagtcttatggatctatattcactcctgtccctctatctcagggatgattcgatatcagatatcagcccttctctcaagggttacttttcaatgcagcaaaagctctggagaaatgatgaacctgtagatattgacgcaatactgagaagatttgtggttaggacgtctagggaacttgccaaagtgctaagcgagtcaaaattgcattttccagtgaggaagctggatactgacccggcaaatcgatatgcaaccggagtggactacgaaaagatcgatgcggagtttgaccggttgagtttcatctactatgaatatgcaatcgacaaactgggaaaagtgctgaggctccctgatggtacccccatagcttcaggggtgcaagacaagaagaggaaattcctgaaggaccttgttaagattctgatgaggataaattttttcaaacgccttgagagcagtatccaggcattcaggaaaaccatggaaaccttactaaattatatagaaaagagtatggattatgcaacacgtgagggttattttatcccgccaaagatgagaggggtactcaccgatatgtatgaggatgatgaggagtgggttcccccttctccagatgaactattctctggaaagaatagggaagtgctgaaaagatgcaaactaagcggggaggagagggaggattatgctaaaaaatgtgaaatggatataaatgttatcaaggagatacttggtcagttaccagaaacagatacaaagctgtcccaggtcatagacagaatccagcggattgagctgtccggaaaaaatggcgtcatcctgtttacccagtactttgccactgctgagtatgtttacaatcacatgaaggaaagaataaaagacagggtaatgctggccaccggatccgtctgtagagatagattcggtgtttcaaaaagagacaagactccagttataagggacttcatgaaaaatggcgggattctgataagcactgatgttcttagtgaaagccagaatcttcagaatgcacagtatatcgtgaattacgatttcccgtggaaccctgtggttctgattcaaagagctggtaggatcgacaggataggatcggattacgatgaaattttcattataaatgtgatgcccattaatggagatgag

SEQ ID NO: 37217 - DNA, 1428 bp, Thermoplasma volcanium
aattttccagaggatttcaaatttggttggtcacagtcaggttttcaatcggagatgggctatgataacgcaatggacgataaaagtgactggtatgtctgggttcatgataaagaaaacatccaatcagggcttgtaagcggagacatgcccgaaaatggtccgggttactggaataactataaatcattccatgaagctgcacagaatatgggattaaaaatggcaagaatcggagttgaatggtcaagattattcccggaacctttcccggaaaaaataatggcagatgcaaaaaataattccttagaaataaacaataacattctttcagaacttgataaatatgtcaataaagatgcactcaaccattacattgagatatttaatgatatcaaaaatagaaatatagatttaataattaatatgtaccactggccacttcctgtatggctaagcgatcctgtatctgttagaaaaggaataaaaacagaaagatcaggctggctgaatgacaggatagttcaattgtttgctttattctcctcgtatatagtatataaaatggaagatctggcagttgcattttcaaccatgaatgaacctaatgttgtttatggaaatggttttataaatatcaaatcaggttttccgccttcctatctcagttcagaatttgcatctaaagttaagaacaatatattaaaagcacattctcttgcatacgattctatgaaaaaaattacggataaacctgtgggaataatttatgcaaacacatattttacgcctttggatccggaaaaagataatgatgctattgctaaagcagacagtgatgcgaaatggtcattttttgatccattaataaaaggagataaatcacttggaattaatggcaataaactagattggatcggaattaattattatacaaggacaatgttaaggaaagacggagatggctatatttcattaaaaggctatggtcattcaggttctcctaatactgtaacaaacgataaaagaccaacaagtgatataggatgggaattctatccggagggattggaatatgtaattatgaattactggaacaggtataaattgcctatgtacgtaacagaaaatggcatagccgataatggggattatcagaggccttattatttagtttcacacattgcaagtgtactgagggcaataaataaaggagccaatgtaaagggttatttgcactggtccttagttgataattatgaatgggcattgggatttagcccgaaatttggtttaataggatacgatgaaaataaaaaactatactggaggccaagtgctcttgtttataaggaaatagcaacaaaaaattgcatatccccagaattaaagcacctcgattcaataccgcctataaatggtttaaga

SEQ ID NO: 37218 - DNA, 792 bp, Thermoplasma volcanium
aagttaatatcataccttcaggctatgttatttatgacctccagtgtgattgtctctgcagcatcggcaggaataggaaaaggaatagtggccgtcctattgggatacggatacaatataactgcattttccagggatgaaagcaaattaagagcactgaaggaagagatgaagcttaagtttggcagagaaataaatacggttgtagccgatctatcagttaggagcgatcttgaaaatgtcgtttcaaatcacagagaaaagtacgggtctatcgataacctggttgtaaactatggagatccgaaagtatcatccttcattgagatatccgacgaggattgggattatgcgatttctatgatgcttaaatctacaatatatctcaccagagaggcactgcgtgacatgataaggacgaaacacggctcaatagtgtacgtaacgtctatgactgttagggagcctattgaaggtttctccatatccgcatccttacgttcagctgtaatatcacttgcgaagacacttacccacgaagtctcacaaaacggtataagagtaaatactatagcacagggatacttcaatacagataggtttagagacattatgaagagggaaatagattcattatctgggatgaagaggcttgcaggagagatacccctcaggagagttggcgaaccagaggagattggggagctcgttgagtttctgctatcttctaggtcatcgtatataaatggagcaaatattccgatcgatgggggaataactaaattccccctc

SEQ ID NO: 37219 - DNA, 897 bp, Thermoplasma volcanium
atgcctatagatccacaagtaagaaaatatttagatgcgatgtcgaaggtaagcgttccagaactcaacaagactccaatagaagatcttagaaagatattcgacactccggcctctggtgctcctaaagtgaagatatccgtagttgaggatatgatcttggataccgatgcagctaagcttcctgctagactatacgacgattctaattcagattcacttgtactctacttccatggcggcggtttcgtttttgggagtatagagacgcacgattcgctgtgcaggcggatagcgaagtattctggatcgaaggtaatatcagtaggctataggctaggcccggaaaacaagttccctgtagcccaaatagacgcgtttaattcttatctgtacgttttgaaaagaagcgaggaattaggtgtggacagcgataagatagcattaatgggagacagcgctggagggaatcttgcagccgtagcaagcctgatggcgagggataaaggtataaagcttcctaggctgcaggtcttagtatacccatcaacgggtccagatatgacttctaaatcgtacctggagtatagttcgatctatttgaccaaagagctcttgaactggttttcttcccaatacctaaatagcattgaggacgctttaaatccttacttttcgcctatactagccgatttatctggtcttccagaagctattgtagtaacagatgaatacgatcctttactggaacagggcgaaacttactctgcaacgcttagggatagtggagtgccagttacatcaattagggtaaacggcatgatacacggattcctatcaaatttccatcttttcagggcggcagatgtttcattgatgatgatttcaggtgcaatt

SEQ ID NO: 37220 - DNA, 1065 bp, Thermoplasma volcanium
atgttttatcttggcaatgtactaaagttaagcctatttggctcatcccacggtgaaagcgtcggatccttagtagacggatttcctgttggatataaaattcctctcgactacatacaaaaatatatggaatacagaaggccaggcaatactattataacttcccaaaggaaggaagaggatgttgtaaagataatatctgggatgcacaacggcttcacggacggtagccctataactatgatcatagagaacaagaacgtcatatcctcttactatgaagaactgaaagaaaatccgcggcccggacacagtgattacacattatacgtaaaatatggggatttccgcaattacgaggggggaggtttcctctccgggcggatgacagctccgctggtcgctgcaggtgcattggcaaaatcttacctagattctctaggaataaagataacaagctatatgaagtcgattggagaagttacttgcgatgaaattagaggtgacccatataattttgagacgagaattccagatccagaaaaaaattctctagcaacatcactcttagtagacataatgaagtcaggagacagtattggaggaaggatcgacacaatagttgagggtttgccccctggagtgggagaaccattttttaattctgtggaaagtgagatatcaagggctatgttttcgataccagccgtaaaggctatagagttcggcgatggtttcactttgtctaaaatgaaaggttcagaggcaaacgatccgtttacagtgctcgacggccatattctaactaaaacaaaccacaatggcggcatacttggaggcatgacaacaggcatgccagtaaagttttctatagcagtaaaaccaacgccgtcgattcacaagaagcaggatacaataaacctgatcagcaaggaaaaatccgaaataacagtaaagggcaggcatgatccttgcgttgcgataagggcggtaccggtcgtcgagtgtttaactgcattcgtgttaatggatctcatgatgatggggggctttatagatcgatac

SEQ ID NO: 37221 - DNA, 300 bp, Thermoplasma volcanium
atgttttgccccaaatgtggaagtctgatgactcctgtaaacggcagatatgtatgcccttcatgtgggtatgaagtttcaaagaaaaaggaagatctcaagatagtgaataaaagcaacgataaggaaactataatgatccgagaagaagtatcagctgagccactagattcagatgcaatttgtccacgctgccaccataaaggagcaagatatgtactcaagcaaacaagatcggctgatgagccagaaacaaaattctatacctgtgaagaatgtggatatcgttggagggaatac

SEQ ID NO: 37222 - DNA, 720 bp, Thermoplasma volcanium
atgtcggatgaatttgagtttgaaattaaaagaaaggatggctcgggaaagacttatttccaaaagtacaatgttccaaaagacaaagtttctaccgttctggagggtctactctacatcaaggaaaatctagatcagaccctatcctttagatactcctgcaggatggagatttgcggaagctgcgggatggagatacagggaaagccacgtatggcgtgctccacaataatagaggatttgaagagcgataagataaggatagagccattgaaacactataaggtaataagagatcttgttgttgacattgacccattctttgacaaatacaaggaagtaaaaccgtacgtgattagagacgacgatggaaagtacgataaggaattgtcccagactcctgaacaattccatgaatatgcaaattacgctatgtgcattaaatgcggtttgtgcatggctgcatgtcctatcgaaggttctgatccgtcttatcttgggcctgcaccactagctgccgcttggagatacatagctgataacagggacaaaggcgcaaaatacagggtagaagtagtcgatggagagaacgggactgcacgctgccattttgcaggtgagtgcactgaggtctgtcctaagggtgtaaatccatccttcgctattcagaagcttagaaagaccgctctaaagattgaacttgcaagtatatttgggagg

SEQ ID NO: 37223 - DNA, 1701 bp, Thermoplasma volcanium
gtggagaagataaaagaggatgtcatcgttcttggtggtggaatggctggccttagagctgccgttgctgccgcagagtacaacaaaaatatctccgttggagttgtttcaaagttgtatccactccgatcacattcagtgtctgcagaaggaggcacaagcgcagtactaaatccaaaggatagttttgatctgcacgcctatgataccataaaaggctcagattatctagctgaccaagatgcagtagaggagttcgtcaggctcgtaccagaacaaatatataccactgatcattggggatgcccctggagcagaaatcctgacggtactatttcccaaagggattttggtgccctgagttttcctcgggctacatttgcagcagataagaccggctttcacgttatgcaaacacttttcagcagggccctcaggtacgaaaatattcatttctataatgaatattttgcaacctcaatgttccttgacaatggccgcatgaattccttaactaccataaacttgagaacaggagatttcgtagtatttcagagtaaagcctttattttcgccgcaggaggcgctggaaggctttatcaatttagtacttacgcacattctgtttccggtgacggcgacgccatcgcctacagggccggaatacctctaaaagatatggaatttattcaattccatcccacaggccttgtcccgtcaggcatattgattaccgaaggggcaagggcagatggcggttatctcctaaatggtgaaaataagaggttcatgcaagcttacgccccaaataagctagaaaaagcctcaagggacgttgtctcaagggcgataatgtgggaaattgaagccggaagaggtgttaaaggagaatatggagacatggagtatgtctggcttgacctaaggcacatggctgatgtgcttgatgagcgccttcctatgataactgaaatagcgaagaaattcaatgggatagatgcacatactgaactaataccagtccatcctgcaactcactacacaatgggcggtatagattcaaatgtcaggaccaccacagattacagcggtatatttgctgctggagaaaatgcatgcgttagcatacacggagcgaacagattaggatcaaactctactaacgaatgccttgccttagggaacgtggcaggagtttctgcggcaaaatatgcaatggaacacgatatccccgatctcgtagtttcaaatgttgagaatgaagagaaaaggatatgggatgatctattgaagagaaatggaggagaaaacgtagcgaagataagggaagatctccgtatcaatatggacaaaaatgtaggtattttcagagatgaaaacggcttaaatacgtccttgaagaatataaaacagctaaaggaaaggtataataacatatcaatacaggacaaatcaagcaccttcaacatggaattggaatgggcgctcgaagttggttttatgctcgatatagctgaagtaataacaactggcgcactacttagaaaggagagcagaggagcccattaccgtaaggattatccgaacagagacgacgaaaactacttaaagcacacaatagctacctatacgaaggacggaccgaggataacatataagccagtcgtgataacaaaatggcagccaactgtcaggacgtat

SEQ ID NO: 37224 - DNA, 1263 bp, Thermoplasma volcanium
gtgctttctaaccttgattatttatacaatctcaagagagctggaataaaatacgacttaactgtgatgagggaatttgccgatatgcttggccatcctgagagagactttaggtctattcatataacaggatcaaacggtaaaggatcaacatctgcctttatatatagtatattgaggcagaagttcagtgttggagtatatacatcaccacatctagaaagattcaatgaaaggatcattgttgacaatgaagaagttccagatgaatacatagacggttttatagaaaaatataggccaaagtttgatgaactttccaaggtaaataggaaccctacattctttgaagtaactacaatgatggcttttcagtatttcaaggatcgtaaggtggattatgcgtccgttgaagttggtcttggcgggaggcttgatgctacaaacattatcatgccagaagtttcagttatagcgcaagtcggctatgaacatgcagataagttaggctgttctcttacgtctatagcttatgaaaaagctgggatcataaaggaagggagacctatagtgctccaggatgataagcctgaagttgtaaatgaagtaagaaggatagcgcaagttaagcattcccctttaattacccttgataggaacaagataaaaaatttacatgttgatgaaaacgggacggatttcgattttgacggtacaaacgatacttatcacatacatacttcgctgattggtgattaccaggctttgaacgcagcaactgcaatacttgcagttgaaaactctaaagtccaagtatacaaaaaagatatagagaccggtataagcaggactatatggcctggcaggcttgaaataatagatagatcaccgctcgtaataattgatgctgcacacaacccgccggcggcaaataaaatggtgagaaccgtcaagaaggtatttaaccgtgaaccgactattgtagcaggaattctctcggataaagacgcttattcgttttttagtgttttgaggcagttatccggaaagataatattcactacccccgaagagaaagaaagggcagtagatcctaacatactcatggctcaatatggcaatctattcagatcagctagagtaataccagatcctatttccgcgttcgaacatgctaagaaagtcgatgactttgtatttgttacaggatcaatatatctcatcggagttatacgaggactatatgataaggcgaatgaaaag

SEQ ID NO: 37225 - DNA, 1305 bp, Thermoplasma volcanium
atgtctggaaaagcagatccacttgagatcgccaaggaacaagtggctccagtaaaggaggaaattgaagaagatccttttgagatagccctaaagcagttaaacaaagccgcaaaagttttgaacctagacgagcaggctctagagatattaagttcacctcagaaaattttgcaggtgagcataccagtgaaaatggatgatgggaaggttagggttttcactgggtttagagtaaggcacaacatcgctaggggtccggctaagggagggattaggtaccatccccaggagactctatctacggttaaggcgctttccatgtggatgacctggaagtgcgccatagctgacataccgtatggcggcgcgaaggggggcataatatgcgacccatcaacgctcagccagggagaacttgagaggttaagcagaggttacatcagggcaatagcagatttcataggccctgaagtagatgtaccggctccagacgtcaacacaaatccacaaattatggcatggatgatggatgagtatgaaaacatcgtacgacattctgctgctaatgtaataactggtaagcctttagaagtcggtggttcgttaggtaggtttgattccactggtaagggcgggatgttcgtccttagggaaggcgctaagaagatcggcctcgatctctccaaggcacgcgtagccgttcagggtttcggaaatgtaggtcagttcgctgtaaagttcgtacaggaaatgttcggtgcaaaggtggttgcggtctcagatataaagggaggtatttacagtgaaaatggattcaagttcgatgatctgttggcttggagcaagaaaatagggagtgttgttggcttccctggatcgaaacctattacaaatgaagaactacttgaatctgatgtggatgtactaatacctgcagccattgaagaacagataactgaaaagaatgctgacaagataaaagcaaagataatactcgaacttgcaaacggacctacaacgccagaggcagatgagattctatacaagaaaggaaaactagtactaccagatgttctctctaactcaggaggtgtcatagtttcatacttcgagtgggtacagaacaactacggagaatactggactacagaggaggtttacgacaaattagatcagaaaataactaaagctgcaaggcaagtccttgatactatggacaaataccatgtagatcctaggactgcagcgtacgtgattgcagtaaagaaagtcgctgatgcgatgaaagtaaggggctggtat

SEQ ID NO: 37226 - DNA, 1248 bp, Thermoplasma volcanium
atgccagaaagtatagatccatttgagatggcactgcagcaactggataaggctgcaagggtgttgaacctagatgaacaagctcttgaaatactaagacaaccggagaagatcttgcaggttagcattccagtgagaatggataacggaaaaataaaagtgtttaccggcttcagagtaaggtataatacagcaagaggccctggaaaaggtgggataagataccatcctgacgaaactctttccactgtaaaagccttagcttcatggatgacctggaagtgcgccatagctgacataccgtatggcggcgcgaaggggggcataatatgcgaccctaagtcaatgagccagggagaacttgagaggttaagcagaggttacatcagggcaatagcagatttcataggccctgaagtagatgtaccggcgccggatgtatacacaaatccacaaattatggcatggatgatggatgagtatgaaaacatcgtacgacattctgcaccgaacgtaataaccggtaagcccttagagattggaggttccgaaggaagaggcgatgcgacagcgaaggggggcatgtacgttttgagggaaggagcaaagagagtaggtctcgatctttcaaaagctactgtagccgttcagggtttcggaaatgcaggtcagttcgctgtaaagttcgtacaggaaatgttcggtgcaaaggtggttgcggtctcagacactaaaggaggcatatttaaatcagatggaataaactacgaagcactcctcgatcacaagaggaaaacaggcagtgttgttggcttccctggatcgaaacctattacaaatgaagaactacttgaatctgatgtggatgtactaatacctgcagccattgaagaacagataactgaaaagaatgctgacaagataaaagcaaagataatactcgaacttgcaaacggacctacaacgccagaggcagatgagattctatacaagaaaggaagacttgaccttccagactttctttcaaattcagggggcgtaacggtttcatacttcgagtgggtacagaacaactacggagaatattggactgcagaagaggtttacgaaaaactagacaagaagatgaccaaagctgcacacgaggtctttgatgccatggataagtataaaataaatccaagaacagctgcatacgtaatctcggtaaaaaaggtcgcagacgccatgaaggcaagagggatgtat

SEQ ID NO: 37227 - DNA, 2331 bp, Thermoplasma volcanium
atggatatatcagaatacgatttgaccctcgatcttgatctgcaatctaaaacctttcacggcactgaaacaatctcagcttcctctggagactttgttcttgacgccgttggatttaatatagaatggatcaaagttaatggatcggatgccaaatttgaatacgacggaaacttactgaagataaacgggcttgaaactgcacagaaggttgaaatctcatattctgggaagattagtgattcgctctctggaatatattttgcaggtagggagagcaatggcatggtcactactcattttgaggcaacagacgctaggagaatgtttccctgtattgatcatcctgcctacaaggcagtcttctcaataactcttgtaatagacaaagactacgatgcaatatcgaacatgcctataaagaaggtagagacatctgacaggaagatagtggagtttgagaagactccaaggatgtcaacctatctgctgtacataggtgttggaaagttcaagtatgcatcagaacgttacaaggacagggagataatacttgcatcccttaaggacattaagtcgaagtatccaatcgatatagctaaaaggtcaatagagttctacgaaggttacttcggaataccctatgcactgccaaagatgcacctgatatcagttccggaattcggagcaggtgcaatggagaactggggtgcaataacatttagagagatatacctagatattgcagataactctgctgcttctacgttgaggctctccgcaaatgtaatagcccacgaaatagcccaccagtggttcggagatctcgtcacaatgaagtggtggaacgatctgtggctgaatgagagctttgcaacattcatgagttataagacaatggatactatccatcctgagtggcagttctggggtgacttttttgtttcgaggacttccggcgcacttcgctcagattctctcaagaatacgcaccctatagaggttgatgtaaaggatcctgatgagatatcgcagatatttgatgagataagctatggaaagggtgcgtcaatactcaggatgatagaagactatgttggtgctgaagacttcaggaagggcatatcgaaatacctaaaagaacatgcatatggaaacgcagaaggctctgatctatggaatgcaatagaaacagaatcaggaaaaccagtgaacaggataatggaggcatggataacaaaggcaggttaccctattttgaaagtaagtcaggataaaaccgggattaaagtaatgcaatcccgcttcttcttaggtggaggagaatccaccgatagatggccagtacctgtgaaaatgaggctaaacaatgggatcagccagatgcttcttgaggaggaatctaccgttataacggataaagatgttattaaattaaacgcagataacttgggtttctacagggttaactacgatgatgaaactttttcaaagatcattgaaaatatggacaaattaacacctttagatagagtaggccttgttgacgatctttttgctttcctgatggcaggagtgataacaccagacacttacaagaataggatcaaatcattctttaacgataaagacgcaaatgttatatcaaacatagtgaaccagtttgaataccttcgcataataacgcattattttgatgcagatgcgagggaattccttggcacggccataagatatttggaatcagcagatgacgagaacctgaagatagcctatggaaaggcatctaggcttcttgcgttgctggatgaggcttactgtgaaactctagctccgcgcttttcgaattttgaacagcagactccggaactgaaatcggctattgcgacggcatatgcactttctacaggtgacgttaagggaatggtcgaaaaatacagatcgctggatagagatgaagataaggtaaagatcatatctggctttggaaagctaaagtcctctacggatctttcagtagtaagcgggatgatagagaagggagagataaagaagcaggatatgctttcattttacctttcagctctagagacaatggcaggccgtgagtatatatattctaatttggaaaacattgttaaaaatgtaattaggtactttactggaaacaggacagcttcacgtacagtagagcagatactgcctgtaattggactcacacatcctgatgctgcatcaattatagagaggataggatcgaagaatacaacgatgggcttagccaagggtaaggagcttctggaggtgaacagatcgcttctggagaggatc

SEQ ID NO: 37228 - DNA, 1035 bp, Thermoplasma volcanium
aaaaagattcctatgaaaaaatacctagttatggaagatggaaccgtcttatctggtcaaggctatggttcttacaaagaggcatatggcgaacttgtttttaccacatctatgacaggatacctcgaaactttaacagatccttcgtatgtaggtcagatgcttgtattcgcctctccaaccattgctaactatgcccttgaaatgggaaaaatggaatctaatggagtaaaagtttcggcgttaattacaaaggacgcgcatatagagcttaaaaagggaggctacggtagagagttcgacgaatttcttaaagagcaaggtattcctgggatagatggaatagatactaggatgctcgttagaaagattagggcaaatggagtgttaaggtcatacgttgttaatgatccttcccattctcttgatttcccagatccaatgaacgatgatctagtatctaaggctgtgccgcatcatgatccagtttttgtaaaaggagaggaaggcgggacagtactcttcatagacttaggaagtaagaataccctgaaggagctgatgcttcaaaacttctcacttatagttgtagataaacaaacgaatttagatgaaattgaaggttatgacgcaatattcgtttcgaacggcccaggcgatccatcgcatccttcactatccaatgttataaagttcctctcccataatataggggtaaaaccgttgttcggaatctgttttggtcttcaggcaatatccttggcttatggtgcaaaaacttataagatgaaatttggccatcgaggttccaatcacgctgtcacagatggcactcattcatatgtgacaacgcataaccatgggtacgctgtcgatggatcaacggtaaaggactttaaagtgataggatgggatgcaaacgatggcacagtcgagattatagaaggcgatgatatgtttgcagtccaatttcatccggaggcttctccaggaccacacgatacgaggtggttctttggtgaaatgaagaggagg

SEQ ID NO: 37229 - DNA, 3129 bp, Thermoplasma volcanium
atgcctaaacgagaagacatatctaagatcctagtcattggttcaggcccagttgtaataggccaagccgccgagtttgattattctgcatctcaggcctgtaggtctcttcgggaagaagggtacgaagtagtgctattgaactctaacccagctactattcagactgaccacgaaattgctgacagagtttacatagaacccataactgtggaagcagtagagactataataagaaaagaggaaatagatgcaattgagcctcatatggggggccagacagcacttaaccttgttgtttctcttaagaaaatgggcataattgacaaatatggcataaagataataggcacgccggtagaatccatagaaatatctgaggatcgtcaaaaatttcacgattttcttatctcaatcggagaaagagacccagagcgatacaggatatcacgttccaactataaggaagagatcgaaaagataccttttatgccagtaattgtccgtacttcattttccttaggcggatccggcggcaacatagtcaaaacaaaggaagagctcaaggcctacgcggaggaattatttagaggaatcgatgaagactatatagaggtaaacagatcacttgcgggattgaaagaattagagtatgagatgataagggattctattggaaactgcataacagtatgcaacatggagaacttggatccgatgggagtacatacaggcgagagcattgtggtgacgccatcgcagactctgagcgacattcagtatcatatgcttagggacgcagcaattaagatagtgtctggccttggaatagttggggcctgcaacatccaattcgcattggatggaaacgattactatgtagtagaagttaatcccaggacgtcgaggtcttctgccctggcatctaaagcaactggatatcccatagccaggatcgcggcgaaaatagccgttgggtacaacctaacggagataaggaacccaataactaaaaacacgtttgctgcatttgaaccatctctcgattacgtaactgtaaaaataccaaggtggccctttgataagttttcagtcgatagaaccataggagtacaaatgaagtccataggagaggttatgggtataggccggactttcgaagaagccttaatgaaggctattgcctccctcgacatagatctatcgtatagattgaggctgtacgtctcggacgaagagatatggaacttggtacgtacaccaaatgataggcgtatctttgctatatttgaggctttgtttcgtgattttcctgttgacagaataatggaagaatcaatgtatgaccgttattttattgaaaagatgcagaacatcgtggattatctaaaaacgttggagtttgggcatatcccggaaaatttgatttccctaaagaagctcggcatatctgatgaaattatcggaagaacgtgtggcatagatccagatgagataacaaggtacaggattacgaacagaatactccctgttttcaaagagatcgacacttgttccggggaatttgaggtaattgcaccatacctttattccacgtatgaggatgaagatgaattaccaggcatatctggtttcgttgcgatcataggttccggccctaacaggatcgcccaggggcttgaatttgattatggagctgtaaaggctataactgccctaagaaagatgggtgttggaagtgtaatgataaattctaacccagaaactgtctccacggatttcgatgtatccgatgcactctttttcgagccaataactgtcgagcatgtttccaatatacttgcaaaggctaatttgcgaggccttattgtacaattttcaggacaaaccgggcaaaatatagccagaaggattgaaaacgtcctaggaagtagtgtagttatggggacatcctctgaaagcatagataggatagaggacaggtctcttttttcaaagcgcttagaagcaatgggcatcgatcagccaaaattcgaagtcgccacgaatgccgaggaagctattaacaagtcactggcattaggccttcctgtcatattgcgtgctagccacgtgataggcggccgagctatggatataatatacgattatgacttcctcgtagaaagatcaagggaagttttcgagaacgtaaattccgtgcttgtcagcaagtacctggaaaacgccgtagagatagatgtagactttgtttctaacggagaggactttcaaatatgcggcatacttgttcatatagaggaagctggcgttcattcaggagacgctacgatgatatttggtcctaaaattgtgccacaagcagcggaggaaaagatcaagagtatagtgggaaaactagtcagagaattcaatctcatcggcatatccaaccttcaagcagcaattaaagatgatgaagtctacgtaatagagctcaacgcacgatcaagcaggtcgattccattcatatccaaggctacgggatacaactgggttgaattagcagtctcggctataatgactggaaagcttgaaaaggtatcagtgagttctaaaggatacttcgtaaaggtttcagtctttccattctccaagttcaacgacatggacgtttcgctcggcccagaaatgaaatctacaggcgaggctatgtatccaggttttaccatggaagaggcaataagaaaatcaatcctaagggatatcaagtctgtgttcataagcgtaagagacgatgacaagccgagaataatcgaagcagcgtccattatgaagcaaaacggcctgaagatatatgcaaccatgggtacatcaaggtatctaagggaacggggcatagaatgtgagactgtttataggataaaagacgagagaaagccaaggatttatgacatgatattagctggatacatcgatttggtgatcaatacgcctgagatgaatgcaggatctgtgcgtgacggctttaaaataaggaggctatgcgtgcgcaaaggaataccattggtaaccaatataaacttagctaacgcctattcaaaatgcctatcttatacgaacatagattatcgtgaaatatcctcttat

SEQ ID NO: 37230 - DNA, 1158 bp, Thermoplasma volcanium
gtcgaaggctattctgtaaaggctatagtggaaacctttggaacacccgtaattatctattcggctcctcgaatcgtaaagaatgtgtcttcactattcggtgcaatgccaaaggttacgaagtgcttttactctgttaaggcaaattctaaccccaatcttgtaaggcttattggccgccaaggctgcgggtctgaggtgaccagcttaggagagatacagattgcaatgatatcgtccatcgatccggatgatatccttttcaccccaaacaacgtgtctaaggaagaaatggatttcgcgttagatcgaggtattaagatcacatttaattctccaggtcagtttgaactagtttcgaacagagtagaagaagctacgtttaggataaatcctggcattggacatggagagcatcctggaactacgacgggcggacacggatccaaatttggaatagatccggaaactgcgctaaaattgtacacgagagcaaaagaattaggcattaggaaatttggcatccacatgatggttggttctaataataccgatgcagatctaatgctcactttttacaaaaaattctttgatatggcatcggagatcgaaaaaaccgcacatttgcaattttcttacatcgatataggcggtggcttcggtgttccgtacaatgatgaacagagatcgcttgacattaaaaaacttggcagcggattaaaggaactggtagatcaatacggtattgaaagactttttattgaaccaggcagatacatcgttgcagatgctggcatcctagttggaaaagtttatgacgtttacaatggctttgtgggtaccgatattggtatgaacataaatattaggcatgccctatacggcgcagaacatagattttatgcgctaacgggaagatcagatgaagccgaatacatagtgactggacaaatatgtgaaaatactgacgtaaccggcaggcttacgggaaaagttcaaattggggaccttgtggcaatgtacgacgcgggtgcttatatatattcgatgagttcgaattacaacggaagattcagacccacagaagtgatcgttgatcatgatggagtttataggatcaggagaagagaaactgtgaacgacattttggcaacagta

SEQ ID NO: 37231 - DNA, 3378 bp, Thermoplasma volcanium
atgagctcttatatagaaaggattgaagcttataactttaaatccttcagaaaaaagaaaacaatatacttttcgagagggcttaacgtgataagcggcccgaatggcagtggcaagagcaatataggcgatatgcttttattcgttcttgggactaaatctatacactcggtgagggccgataaactctcggatctcatatcgaaagattcagggaacacatgctacgttatagttacctttaaaaatgatgaaggtaaatctcttgagatttctcgtagacttgttatcgaagatgaacctaaatcatattactatgtaaatggtacgaaggcacgtcaatcagacgttgaagacgctttatctgcctttggcataaattttgggacgtacagcttcgtcttgcagggcgatatcaatgattttgttggtatgtcaggagttgaaagaagaaaactcattgagcgcattgcgggaactgaacagtttgatgtagaactagaaaaggctagaaatgatatagaggaggttggaaagaacttagatatactttcttcgatgatagatataaaggggcaagaagtagaaaaacttagaattgaaaaggagaaaaaggaaaggtatgatatcctttcgaagaggttaagggacataaggtttacagaactatctaaggctaaagaagcaaatgatcgatctatacaggctatcgataggcaggtggattctatagaaaaggaaatcgaaaaaagtaaggtccttatttcagacttgaacttacgctaccacagcatagaacagcttttatccgaggagacgaaaaaactaaacgatctaaccagtggagagataagaactgtacaagaaaaattgaggtcgctagagatctctatcgccagcctggacagtaagatttctgaaaaaaagctaaggatgcaggatatggctaagcaggaagctattgatgatgcaaggcgtgagaagtatgaggcagaagccgaagagatcagaaagtctttagaatctgaacggagagaaagggataaacttcaagaagagtttatagctgcagaagatgagtacaataaactcgtagccgaagcacaggaaaaggagaaggaaaatgcaacgtctagggtaaaaactaaggactatcaggtcaagatctccaaacttaacgatgaaataaatagtttgaaagagaagcttgccgaaattaacatggcgatcaaggggaaaatagatagaatcactgaattagaagagagaatggaagatattgggctaaaagtaaaagcagatgaatggaagctttctcagaatgctgaagatctatcgaagtacagagacaggtactataaacttaagtcagagtacgatgagattcaggaaaaaatatcaaaattaagttcgcagatctctgcggccgaggcaaccgctcgagcttctgttccaaggcagatagatagggcatcccaggttgaagagattaaaaagaatataagtggagtcgttgggcaaatacgtgatcttataagttatggagagagatatgcgatagctgtagaaagcgcagcatcagctaggctgaatgcagtggtcgttgataccgacgttacggcaaagagatgcatagagtatcttcgtgagaagaagatatcaccaatgacatttcttccgctgaacaagatgcgcgcaatgtcaaatttgtccgagccagatatattgtccagggatgctggattccttggcttcctcatagatttcattgactttgacgataaatacaggaatgctgtattctgggtattcagagatactggacttgtctcggacatagatgctggccgcaggctgatgggttcaataaggcttgtttcccttgacggggatgtattcgatcctagcggatcaataaccggcggtttcaggagacaggtacgccagcccgctagatcgccctcagaagatctggattccatgaaaaaggagcttgcatttcttcaatcagaaaaagctaaaataaaaaaagaactagacgaggcccttcaatcaatgtcagatgcctcaaagaaaactggtgaaattgagaaggaaaggcagataataaatgatgaccttgccaaaaacaagcaaatccttaaagatatagcatcagaattatcgaagctgaagcaggaaattgctgaaaataaagaggaaaaggaagctttagagaaagacatctctgacaggcagctggatttacataagtatcaagaagcattgaacgacatatacgatgatcttgggcagtcgataatcgatactatagaaaatagcatgaggaagctcgaagattatagaaagaagatatcagcaatcaccgccgacatagaagtgaaggagaagagagtaagcttccttgacaaagagtcgaacaacatagtacagcagaacatagaattagagattcagagaaaggcagttgaagatgaaatacataatatagaaatccagaaaaggtcaatggaggaagaactgaagaagcacgaattgttccttaaacaactcgaaagcagccatagtgacatagcatcaaaaataaaagacatggaaaatgagatgaaggagatacgatccaaaatagaagagataaattctgatgttgagataaaacgtagcatactgtccgaattaaaggtaaagcgtagcgttgtcgctgacaggaacagcgctatagaagctgagatgcaatccatcccagaacctacaatgatagagggggacattgtacttgagaagagaaaatgtgaagcagacatatctgcactcggagacataaacaacggagcgatacaagagtacgaagaatctgttaaagcttacaacgaacttaaagacaagaagaataggctggagcttgaaaggaggagcctacaagatctgacggattcgctcaataaaaagaagaaggaggtattcgtaagtacttttgaaaaaataaatgagaagatgaactatgtatatggtacaataaatggtggtactgcgagtcttgtccttaaaggagatgatcctctagaatcagctgtcgaggtaagtgtgactccaaaggacaaggcaactgtaaagatccaggcccttagcggaggtgaaaagagcatagctgctatgtctttcataactgctgtccagatgcttatgccaagttctatttatttcttagacgaggttgatatgtaccttgatgcttacaacgccgaaagtatgataaggctgatcagggaaaaagcaggggaagcgcaaacaatactcatatcgcttaaggtatcagttttcgaatacgctgcgaatgcaataggtatcacgtcaagaaatggagagtcctatatcttc

SEQ ID NO: 37232 - DNA, 2193 bp, Thermoplasma volcanium
agagaaggtaagtctgtaagcgccctcttctttggcttcaagccttactttgatgtggtcgagccggataatgaatatctgtcgtccataaggaatgatgatgagtatgtaaaggaagaagacaaggtgctatgggttcatggttcgatgcataacgtcaaaaggatatacataaggtcgccctggaaagtgccagaatatagacgaaggtgcccttttgaggtcttggccgccgatattcctttccatcataggttcatatacgattttgacctcggagcttgcgtaaggataaccggtgaagacataagtggtacagagggaaattttaccacagatcttgttttgaagatagataaaatagagaatatacctgacttcaacgtcaacttgaaagttctgagctttgacgttgaaaatgaaattaatagggagaacgtagaggattacggaaagatacttgtaataggatattccataatgttcggcgatatacaaaagaaaggggaaatacacggggacgaaaaagagatattatatcggttcatcgatctgataagagccgaagatcctgacgttataactggatacaatatagacggatacgacatgcttgttatacaaaggagaatggagcagtacggtatacacctaaatttagggagagatggatcagtcccaaggagaataatggatcaattctggagggttcacggaaggcttataagtgatacgtggtggaatgtgaagaagatactccatccaaaacatgaatcgctcgattatatagctatgaagttgcttggcgaaggaaaagattctatagacaggctgaacatagaggcggaatggcagaaaagacaggatgaggttatatcgtactgcattaaggatgctgatcttactcttcgcatattcgaaaagttacgcgtcctagagagattaatgttcatgagtactgtaacaaaacttcccctggacgatgttgctaacgcaggtacgagcaactatgtcgattctatactgataagggcagccgatagggaaaacataggcgtgcctatgaacgcacacaacttaaaggaggacgaaatacaagggggttacgttcacaccataggggccggcctgtattccaacgtcatagtccttgactttaaaagtatgtatccctctatgatcattaagtataacgtttgctttactactcttgatccaaagggcgaaatagtatccccgacaggcataagattcttgtcgcctgaaaagaaaaaggggctaatcccaaggattctgcaagaactcatggctgacagggatgacgtcaagaagaggatgaaagaggcaaagagcgaagatgagcgtttattctacgatggcatacaaaatgcaatcaaggtattgatgaatacattctacggcgtccttgcctcatccttctaccgctttacagatccgaaaatcggaagtgcgataacagcttttgctagagaaacgataaaacacataatagatgttttggaaagcagcggccacagggtaatatacggggatacagatagcgtgtttgttgaatcaggggacgtaaggcaggaagacgctataaaaaccggtaaagaactcagccagaagctgtcagaggaagagggccttacactggatttccagatggttctagatccatttttttcacacggcgctaagaaaaggtacgctggaaagtgcgtctatccagaggacatgaagggagagataataataaagggttacgaagttcgaaggacagattcctttgatttacagagtactgccctttcgaaggtgatcgatttcatactcgatcgcgatgttcagggtgcaataaattacgccgacgatctggtgaaaaaggtacgcaatggtgatccgtccatagatatcgagagcctcgtaatttctagaactgttaaggacttttcatcctacaaggcaaataccgattcacttgcaaatatcagggcggccagaaagctcatagaaaggggcgaaacatttgtgccgggcatgaaggtatcgtggatagtaacgaacggcaaaaagaccccgcaggaagttgaaccgtacatatatggctctaagttggagtctaaaccagactgggactactatgctaaaaggttatcagaaaccctaaatagggttatagatgtattc

SEQ ID NO: 37233 - DNA, 870 bp, Thermoplasma volcanium
atggagattagtaacataggagttgttggaagcggagttatgggccagggcatagcacaagtctttgccaaggcagggtataaagtgactattgttgacgttaacgaacagatactggaaaatgctttaaaagctatctcggatggcaaatatggactcagaaacctagttaacaaaggtcagatatctgaaaatgacctaaatagcatcatgtccagaatatctacgtcaacggaatacacttcattatcttcctgcgatttcattgtggaagcagtacctgaagaccttcgaataaagagagaagtgtttgcgaagctagaatctaacgttagtaaagacacaatacttgcatccaatacctcaggaataatgatcgctgaaattacctctggcctgagctataaggagaggattataggcatgcactggtttaacccggccccagtgatgaagttgatagaggtcgttaaagcacagctgacatcagaagaaacatttaacacaactatggagcttgctaaggagatcggcaaagtacctataaaggtagcagacgtacctggtttctacactacaaggtttatagaagggtggcttttgtctgctataagatccgctgaacagggcgtagcaacaagaaaggatatagatgctatgacaaagatggcattcggcttccctatggggccctttgaacttatggacatcattgggatagatactgtataccatattgcgacgtacctttacgaagaaacaggcgatccgcagttcatcccgccaataagcttgaagcaaatggtgctaaatggctatattggagacaagaaggtaaaattcggaagcaaaggcggatggttcgatctc

SEQ ID NO: 37234 - DNA, 1236 bp, Thermoplasma volcanium
gaaaaaatagctgtggttggcgccggcataacaggattatttactgcatactacctctccgcaagcggtttcgatgtggaggtgttcgataaaggagacatcgcctcggggacgtctggcaagttccacggtatgcttcatagtggtgccaggtatgcagttacggacaaggtatccgcatcggaatgtatttcggagaataataccataagcagcttcgccagatggttcatcaacgacacaggtggatacttcgtatcttctaatcgtgaagagtcagactatggagatacgttaactaaggcatgcaatgatgctggcatcccgaactatgatatcgatgtagatgaattcaagaaaatagaaccaaatgtaaagaatgtggatcgagttatacatgttccagacaaggtcattagggcctacgaattttcagctgcagtggcagcagaagccttcatgaacggaacgaagttcaggctctattcgccagtagcctcagtaagcgagaagggaggcaaatatgtactaggtattgagagaaacggatctttgcattacgaacattttgatttgatcgttaacgcaacaggcccattttcaggcgaatttcttaagcttgctggttatggcgggtctccagttatgccgtcagccggcataatggtagtgttcagtaaacctatagtgagatcaataataaataggatgagggagccttcagatgctgacataatggttccttacgatggcctctcgatactcgggacatcagccgttatcgttgatgatccggaaaacttttccatagatagcgaggatgttgaagcaatgatagaggacatgtcctctttaatccctttaatccggaatgtgaactattccagaacttattattcggtgaggccgctccttgaagacgaaggcgacgatgctaggaaagcatccaggagtttccgcataataaaaaatggcgaaggcgtattcactgtggttggcgggaaatttacaacagggaggctgataggagagcatgttgcgaaggagatatctaaagaaacaggcgctaccataaggatagagaatcctgacctgaattctacttatgaaaggtttatagagaagtacggcagagacgataagtacatagctaaggcaatgagccgcattggcaccatcgatgaagagaatgcaatgaggagcgtagcttatgctatttccacaataatagagggg

SEQ ID NO: 37235 - DNA, 1122 bp, Thermoplasma volcanium
atgaaaattgccctctttacgaataccaacgtttctcttggtgcaggcatagagaaaactcttttaaattatgttaaatacaatactgatcatcaattagtaatagtccaatctcagttttataaagtccagcgcttgcctaacgacgtactggatcgtatcggcattaagaatgtcgtaactattaaagattacgagcactgtatatcgtttttaaggatgcatcggataactaagccgatatacgctctgattcttcccttgctgataagaataacgaaagtgcttaacattaaaaagttaagatcgataggagagcttgacgtagtctatctctttaaaaacgagtactggccacttttcaaagggaagttgataataggaagcaatcacgcccagtttgcatttgataatacctataacagaatacttgcattgcttgtgcgatccggcctagtatacagaggaatagacgcattccatttattccctaaatccaaaggtatcggaaaattgatgggaaagcgctattttacagggataattggtgtagaaacttcccaatttaaaccaaaggctagagacaacactgttaacgtccttttcgtaggaagactagaatatataaagggcatcgacctatttattgaagtatgcaagaaatttgaaggaaatactggtgtaaaattcaatgtttctggaggtggggaatactcccagatattgaatgacaataaattgcccaatcttacttaccatggagtattaagtgaaggtgaactagcagatctctacggaaagtgtgatatattcttatatcccacaagatgggacgctcaaccatcagttatagccgaggccttatctgcgggcgaatatataattacctctcagagaattagaggcacttacgacgatctctcagaaaagggctttttagagtatagcagtttatctctcgatgatctatccaataggcttctcaaggcaatagatagagtagctgaactaagggcgatctcggatgccgagcacagctacgctgttgaaaaatacgataactctgtagtagtaagagatctttacaaaaatatagaaaatctttacatatcaatgcagagg

SEQ ID NO: 37236 - DNA, 660 bp, Thermoplasma volcanium
tttaagaagttcgctgaagattatgcaaagagcaaatctcacgaaaaaggccaagacctaacagaactgctaggactcataaatactcatagggatacatgcttggatgtagccactggcacagggttcactgcagcgtccatatcacaaatatgtgcgcatgtaacagctttagatgaaacacgtgcgatgatcgaacaggcacaatcattaatcgaatcaagggcaaccaagaacgtaaaattcgttctgtctacctttgaggatttcgatgatggaaaattcgatttgataacctgcagaagagctctgcatcactttaaggataaggaagccttctttaagaaagcgaggactatgcttaatccaggtggtattttggccatagcggatatggtctcacctgccaatgatagaaaagacaacttcaacgtattggaaaggattagggatcctacacacataggcgcactcaaagttgaagaaatgataaaactgttcgaagaaaataatttccaagatataaaatataagatcataactgaagaattgaccttcgaagaatggctatatcctatcacaaaagaatcagaggtaggaaagaagtgtttggagtttttaaattcgctcagcactgaagaacttaaccaaatccgatta

SEQ ID NO: 37237 - DNA, 1047 bp, Thermoplasma volcanium
atgaagggtattattttgcatggagggagtggtactagactgcgccctctcacttatactgatgtaaaacaattgcttccaatagcgggaaagcctataagcgagtacgctcttgagaatttaatagagattgggattaaaaatataaatattgtaataggttcggtaggaggattggaagttaaaaaattctatggcgacggatcaagatggaatgttaacatatcgtatacatatcaacccgagccgcttggaattgcccatgcaatagggttaacaaaagcatttgttgggaatgatgattttgttgtatttttaggagacaattatcttcaaaatggtatctctaatctatatgaagattttacaaatgctggatcggatggccatctaggtttagttccagttgataatccttcccaattcggtatagctgaggtcgacaatggcaagatttctaagctagtagagaaaccaaaaacgcctacatcaaacctggctattgtcggggtttattttttgactccaaaggtatttgaatccatagatagactcaagccttcaaagcggggggaatacgaaataacagaagcataccaggatatgatagacagaggattgaaaataagctactccattatttctggctggtttaaggatacgggcacagtcgatgactttcttgcatgcaatagattaattttagacaagttaggagacaatggtaggagggataacgtttctggaaggttcgatatacatccaacagtaaagatttcttcagattcagaagtagtaggcccttgctttatcggtgaaggtacaagaattgagcactcttacatagggccctatactagcataggttcaaactgtattataaagaatgctgagattgaagactcaattataatggatggctgcgagatagatttgttgaacgaaaacaggattaaaaagtcacttttaggcccaaatgtaagggttgtaagcggatcgaaatacggaatgaggcttgtgctgggacgtgactcaaagttggagctg

SEQ ID NO: 37238 - DNA, 1338 bp, Thermoplasma volcanium
agtgtatcggacaggcttgaaaggatacctttcgggagcccgcaacggaacttccttctgatggtaacgggtggtgaatgggctgagacgcttatgctccttggaaacggagtgatactagcacttgtggcatcagtcctgcacttttcccatgtactggctacgctagtcgttccaaccgcttttttcctgggcgaatttgttggaagtatattcttcggctggcttggagaccagagaggaaggaggacagtctttttatacaacttgcttgtcttctctggtggcatgataattgcaggattaatgtctactgccatacttatagctatcttcgtcttcatcggtgggattggtgtaggcggtgaattccctattgtcgatacttttacgtcagaaatgatgcctggcaaggaaaggggaaagaggcttgcaactgtctacactatagccgtaacagccggtccagtaattgcctttctgacttacgagatgaagatagttgctcctccctacgtatcatggaggatactgttctggttcatgggaatagttggaatagccatttgggctgttagaacacagttgagagaatctccaagatggctcgaagttcatgggaggtacaaggaagctgatgcgattgttaaggattgggagcagagggtaatagaagaaaagcacctacagagcctccctgaaccaaagtcagagacggaagtatcggagaggaagtcccgttacaaggacatatttgcaccagacttaaggaggaggactataatgatgcttatattccaattcttccaaactggtatattctacggcttcacttctttagcccctacattccttctgtataaagggataacactggtacattccctagaattctcctttataatatattccggattcttcttcgggagtatattcaacgttttcataatagataaggttgagaggaaatggggtataatagcatccgccgtgctcgccggcgtttttggaactttgttcggtattatacccaatgttacagctacagtaatattcggcttcatcaccacattcgtactatggaacttctcaaacttctatcatacttaccaagctgagatctttccaacgagggtaaggcctaccgcagcaggaacagtatacagcgtaagcaggatatccacatcaatactcgtaccatttataactgccttcttcctaccgcacgggctactggcatcctttggactaatatgggtgttcatagcaatagttgtttttgaccttgcgctattagggcctaaaacttctaaattaagagttgaggcaatagcccaa

SEQ ID NO: 37239 - DNA, 1152 bp, Thermoplasma volcanium
atgaaagaattactccttttgtattcaggaggattagacacatcagtgatgatcaagtggatgaacgaaaatctaggctacgacgtatcaacccttaccctggacataggtaataacgacctcaaatccataagagaaaaggcggaggccataggtgcagtagaaacattcgtagaagatgtttaacaagaattttcatacgaatacatttctaaatcaatcctcgctaacggaagttacgaaggctacccgttatctacagcgctggcaaggccgcttatggcaaagaaggctgttgaacttgctgaaaaacatggttttgaggccatagcacatggatcaacaggtagaggcaatgatcaggtaagattcgaacttggaataaaggcactaaacccaagcttagagatgcttgccccagtgagagactggaacatgctgcgatccgaagaaatagaatatgcaaagaaaaataatattatagtaccatcagacggcaagtattcagttgatgaaaacctgtggggcagatccatagagggatcggaaattgagaacatgtccttgcctgtaccagaagatgcctatgagtggctcgtaccgccctgggaagccggtcctggcgaagttataaaacttgagtttagcaatggcctgcccgtggcaattaacgacagtgattttgaattacagaatttgatagccaatttaaatataataggtggcaggaattcaatagggcttatagatcacgttgaggataggataactggaataaagagccgtgaagtttatgaatgccctgccgcagagataataacgtatgcgcatggatacttggaatctctcatattaaacaagcatgaaatttctataaaatcgttcttagattcaaaattttcacaatttgtctacaacgggctctggtatgatcctgctatgaaaccattgatagccggagaggagatcttgaacagcgagataaatggatcaatatctcttaaattatataaggggaaaatttacttcaacggatccaaaggagcaaactttagctacaacagtaatgtagccaattatagcacgtatgagtttgatcagaaatcctcaaagggcttcatagacatattcaaaaatgataccgtatactcc

SEQ ID NO: 37240 - DNA, 1245 bp, Thermoplasma volcanium
ttgaagatatggcaaggcggggcagcaaaaccctcggaatatgatccgatggaatacctggtcaaattagatgtttcagctgatacaatactcgaaaagtacgaaataatcaacttgatggcctatcattatgaattaataaaaattggcatcataaacgaagaagatggcaaatgcttactaaatgctttaataaaagcctacgagggaaaaataacgatagatgtaaaggatgaagatgtgcatactgcaattgaaaattgggtaaagggcctatgccccaaaaattgggagaatctaaggctattcctgtcaaggaatgaacaagtccacgcagacatgatactttatctgttggattcattctataagatgaataaaatattccagtcatgcatagaaaagacaataggggtaaatggcgaaggctatctaccagggtatacccatttccagcaggcgatgccgtttactttcaaaagttttatgaattcggtgttactgcttctggaaagaaatattttgaacgttcatgattttttccaaaagatcaggataaacgtatatggatatggttcaggatatggttctccaatttctgccaaatttgataagatgggtgaattattgggtctaagatatgatcataagaaccccatattcttatcttcattgtatcctcaaacccttcttgaagcttcccaactcatcgttaccataatgatgcccctttcaaggttgtcatcagacacaataaattactattcaagaggaataatggacataccagacgaattcacaactggcagttctctaatgccaaacaagagaaatccggattatcttgagatgatccaaggtttagcagctgaatctgtcggtgtatcatcttcaatagcttcaatagccctgaataaacaaattggctatcatagagattttcagattgcaaaagattccatcgtgtttctgattgagaagctaatagcgcacctggatcacttgccggaccttttaggccgtattgagttttttaaggaagcatcggaacgtgctgtagaaaattcttcatatgcaaccatgaatgcgtggaatgccttctttaaaggaacgagatggaaggaggcatacgctcgcatcgggaatatggtaagggaaaacaacgaacttgagaaggtagatttcgagacccctactgataatctggatatcgctaacacaagaaggataatatatgaagaaaaa

SEQ ID NO: 37241 - DNA, 843 bp, Thermoplasma volcanium
atggacatgaaaattatagcaaagaagatcgatcagctcggggaaggcccgacctatgattcgaaaagaaatagagtgtactggatagatataacaggcaagaagtttcactacctggatctaaacgatggcagcatatacaactttgaatcggtaggcatgatatcgtctatagtaccgacaaacatagatctgatggctgcaactataggtcatggattctattcaatagacgatcaggcaaatcacacccttcttttcgaactcaaagatgagagcaatgaaactaggttcaatgatggaaaggctgatccagaaggtagatacgtagctggaacaatggatttgaaggaatcaaggccaatcggctcgctttacgtgttcaacggcaaaggagtaagaaggcttctcagtaacttgacgatatcgaacggcatagcttgggatacaagaaggcggatcttttaccatatcgatacgccaacaaggaaagttagggcatattccttcgatgctgaaatgaacataatatcgaaggatatagcagtggattttaaagaagagcagggatcaccggatggcatgacgatagactcagacggaaatctcttcgttgcccattggggtggatcgaaattatcggtttgggatccagagaggaagagaaagatagatgaatatgacctgcctgctaaaaacataacatcagcagtcttcgcaggaaaaggcttaaacacactctacgtatcatcagcatcaagtggcgatccggaggatttagggggttccttgtttgaattagaaacacagtacaaaggaacgcctactttcgtgtttaagatt

SEQ ID NO: 37242 - DNA, 939 bp, Thermoplasma volcanium
aaaatgccgataataaaaactgagaacctaactaaaatttattcggggaacataaaggccgtatcggatctaaacatagagattgaagaagccgagatatacggtctgctaggcaaaaatggggcaggcaaaacgactacaataaaaatgttgactacagctatagaacccacctccggcaatgcaaaagttgctggttacgaccttttgaaagatcgcgaaaaaataaggaatataatcggtgtagtcccgcaggacttgaccaccgacgctgatctaaagggaatagaaaatctaagaatgatagcggcgttctacgatataccaaagtctgtagctgaatcaaggataaacgatctcctcaacatagttgatttgactgattggggaaataagtatgtatcgcagtactcaggcggaatgagaaagaggcttgagctaatatgcggcctggtaaatgccccaaagatcctgttcctagatgagccaacgcttggtctcgatgtaaataccagggcgaagatgtggaaatatataagggacatacaaaaggagcttggagtaacgataatattgacgtcgcactaccttgaggaggttgacgagctcgcaaacaggatctcaataattgatcacggcaagatactcgttactggtacgccggatgaactaaaatcaagcctcaagggagacattataactatgcagttttcaggatcagatgaagccgaggcggcccgctattatccaaacgccttatattcttctatttctggagaagacaaggtgagaataaaagttgaaaactctgacgtagagctaccaaaaatactctcttatctaacgcagaaaggcatatccccgttgacaataaacgttaagaagccctcgcttgacgaagtatttcttgagtacactgggagctcaattgatgaggat

SEQ ID NO: 37243 - DNA, 612 bp, Thermoplasma volcanium
atgaaaattaaaggagtgatctttgacttcgatggtacactcttggattccgtagacgtcagaataacttcatggcaagaggcatttaaggactttggagttaacgtgcctagggacgtgatcaagccaatgataggatatccaggagtagatcttgccaggaagtttgtcaataatcctttggatgttgagatgctacaagaagactattttcttaaaaaaatagacagcgtaaaactgtttcaagacgtgatacctaccatacacaggttaaaagatcgtggcattaaagtatccgtcgttacttctacgcgtagatctgtgatgaatcgttttgatctgcccgttgatactgtagtaactatagatgatgtatcgaaaggaaagccggatccagaaccttacataattgcattgaagaagatggcagtcgagccaaaggaatgcgtggttgtaggagatatagaaaatgacttggtaccaggtaaaaaaatcatgtgcacaactgttttagttaagcatggaagagacgtccacagcccgtttgccgactatgaaattgaaaacatatctgatttaatcaaaataatagaggaaattgagagtaaatct

SEQ ID NO: 37244 - DNA, 1002 bp, Thermoplasma volcanium
gtgaaagccgctatccttaagaaaataaacgaacccgtaagcatagatgatgtagatatccctgatcctgctgaaaatgaagtcttaataaaacaagaatatgcaggagtatgctaccgtgatttgcttgcagctacaggttttttccctagaattgcactccccatgatccagggccacgagataggtggtacagtggttaaagttggggataaagttgaagcgttcagaccgggtgataaggtctcaagcctcatatacataccatgtggaaaatgcgaattctgccgatctgggaacgagaatctatgcccgtacaaaaagtccttgggcgaagaggtgcagggaggtttcaggcagtacgtgaacattcctgaaataagtttagtaaaagcccctaacaacgttgatggagcttcgctttctcttgctgcgtgcgttactggtatgctataccacgcattgaagagaatgggtaaagcaggcgaaggaaaaaaagtcctaattacaggtgcaggaggtggtgttggcattcatgcagttgaaatggctaaagcattcggtgcaacggtaattgctgaaacaacatcaccggaaaaactcgatttgctagaaaaaataggtgcagattacattgtagacgggaactccaagttcaatgaagatgttaaaaaattaggcggagcagacatagttttggaatgtgtaggcatatacacattcgagagatcactccgcagcctcaacaatggcggaaaaatggtaataataggcaacgtaaagcctgatccggtcagccttccgcttggcctaataatactgaagggaaatacgatcaggggaagcataagctctacgaagaaggatgtcgaggaggccctcaacatggtaagcaaagggatgataaagccaattgtggggaaagagatcgatataagccagataaatgaagcttataaactaatgaaagataaaaaatcaagcggcagaataatgataaaa

SEQ ID NO: 37245 - DNA, 2235 bp, Thermoplasma volcanium
atggataacagcagcggtataatactcagggttgccgaggcaaactcaacagatccaggcatgtctagggttaggcttgatgaatcgtctaggcgcctgctcgatgccgagatcggcgatgtagtagagatcgagaaggccagaaaaactgtaggcagggtatacagggccaggccggaggacgagaacaaggggatagtaaggatagacagtgtaatgaggaataactgcggcgcttccataggggataaggtaagggtcagaaaagtaaggacagagatagccaagaaagtaacgcttgcacccataatacgtaaagatcaacgcttaaaatttggcgaaggcatagaggaatacgtccaaagggcgcttataagaaggccaatgctcgaacaggacaacataagcgtcccaggtttaacgcttgcaggccaaaccggacttttatttaaggttgtaaaaactatgcctggcaaggtaccagttgaaatcggagaagagacaaagatagagataagggaggaacctgcctctgaagtattggaggaggtatctagggttagttatgaagatataggaggtctctcagaacagctgggcaagatcagggagatgatcgagcttccattaaagcatcctgaactattcgaaaggctgggcattacacctccaaagggtgttatactatatgggcctcctggaactggaaaaacccttattgctagagctgttgcaaatgaatctggggccaatttcctgtccataaacggaccggagataatgagtaagtactatgggcagagcgagcaaaagctgagagagatattctcaaaggcagaagaaacagccccatctataatattcatagatgaaatagattcgattgcacccaagagggaagaggtacagggggaggtcgaaagaagagtagttgcacaactccttactttgatggacggtatgaaggaacgcggtcacgtaatagtcataggtgcaaccaacaggatagacgcagtggatccagcgctgagaaggccaggaaggttcgacagagagatcgaaataggagttccagaccgcaatggcagaaaggaaatcttaatgatacataccagaaacatgcctctaggcatggacgaggagcagaaaaacaagttccttgaggaaatggctgactacacctatggatttgtaggagctgatcttgccgccctcgtaagggagagtgcaatgaacgccctaaggaggtatctaccggaaatcgacctagataagccgatacctacagaaatattggaaaaaatggttgttactgaagaagactttaagaatgcattgaagaacattgaaccaagcagcctcagagaggtaatggtcgaagtgcctaacgtacactgggatgacataggcggtctcgaagatgttaagagggaggtaaaggaaactgtagaattgccgcttctaaagccagatgtgtttaagagattaggaataaggccgtcgaaaggtttcttgttatacggtccgcccggagttggaaagacgctgttggccaaggcggttgccacagagagcaacgctaactttatatctattaagggcccggaggtattaagcaagtgggtaggagagagcgagaaggctataagggaaatattcaagaaagcaaagcaagtcgcccctgctatagtattcctcgatgaaatagattctatagcgccaaggagaggtacgacaagcgactcaggcgtcactgaaaggatagttaatcaactcctaacatcgctcgatggcatagaggttatgaacggagttgtagccattggggccacgaataggccggatataatggatccagcactgcttagggctggaagatttgataaacttatctacataccgccaccggacaaggacgcacgcctcagcatattaaaggtacataccaaaaatatgccgctcgcgccggatgtcgatctggacagcattgcccaaaggacagagggctacgtgggtgcagaccttgagaacctatgcagggaagcaggtatgaatgcctatcgagagaacccagatgcaactcaggtttcacagaagaactttattgatgcccttaagactataaggccatccatagatgaagaagtaataaagttctacaagagcatcagcgaaaccatgggcaaatcggtatcggaaaagaggaaggagcttcaggatcagggactgtatctg

SEQ ID NO: 37246 - DNA, 648 bp, Thermoplasma volcanium
gtatctgttgaaaaaatttcgaaatcatacgggaagtttagagctcttgataacgttagctttgaagttgaaggaaacgggtgccttgttttgcttggacccaatggcgccgggaaaactacgttgatgaagaccatgacgaacattattaggcctacatcaggaaatgtgaagataaacgatataaatgtaagagagaatcctaaaaaagcactcatgaatgtcggatcgctgatcgaacagcccgagttttactcatacataactggttacgaggcattaatgtttacttgcatgatgagaggccttgataggaagacctgcgaatcggaagttgaaaaccttgcacgtttaacaaactcaaaggggtatctgactaggaagactagagaatattcaagaggtatgaagcaaagagtaggcttggcatcggcaatgataggcgacccgaacataataatattagacgaaccgacgttcggactcgatccttcaggaatgaaagaggttagggatctcataattaagctgaaaaaggagaagttgataatacttagtactcatcttctttacgaggcccagcagcttgcagactgggtagctatcatcaattctggtaaactgcaatactacggagagcaggaaaaa

SEQ ID NO: 37247 - DNA, 2658 bp, Thermoplasma volcanium
gtggcgcaaacaaaaaaatatatatacctctttgaagagggtggaaaggagttagtcgatctgttaggtgggaagggtgcaggccttgctgagatgaccaaaataggccttaatgtcccgcccggttttacaataacaactgaggcctgcattgatttcctaagagatggtaatttcccaaaaggaatgatggaacagactatggacgcactacatatgatagaggagaaagtaagcagaaagtttggcaacccggagaatcccctgctcgtttctgtaagatcgggggctcctgtaagtatgccgggcatgatggatacagtcctaaatgtagggctaaacgacgaaactgtcaagggcctcgctttcatgacggacaacgaaaggtttgcacttgatgcctatagaaggctcatacagatgtttggagagatcgtttacggactacctcatgaggaattcagggggcttattgagaaggtaaaaagggagaaggggtatgatgaggacaaatttacaacctctgatattactgagataataaagggagaaaatgagatatatcgcaagcacaaaaagagcttcccgcaggatccacaagaacagcttgttgaatctataaaagctgtatttaattcatggaacagcagaagggccaagacctacagagagataaaccatatccctgaaaatatgggcacagctgtaagcatagtcaccatggtatttggaaatatgggaagcgattcagccactggggtcgcattcacaagggatccgaatactggtgagaaaaggatttttgctgaatacctaaccaatgcccagggagaggacgtagtagcgggcattaggacccctaagtacatagatgacatgaagatggagatgccccaggcctattctgatctcattagaatgtgcgatattctggaacaccactatcgggacatgcaggatatcgaatttaccatagaacgcggaaaactgtacatgcttcaaactagaaccggcaaaaggagcgcgaaggcagctataaggatagctgttgagatgtatgaagaaggaataatcagcgaagaagaagccataatgagggttactcccgagatattcgacaggatccttcatccacaggtcaagacaaacggcaaagaaaccccgcttggcaagggccttgcagcttcccctggagctgcaataggttccatagttttttcatctgaaagggctatagagctagggaaatccaaaaagatgatcctagttaggccggagacgacagcagacgatgtccgtggaatggcagtctgtgaagggttcctaactcagaaaggcggcatgacgtcacatgcagcagtggtagctagggcaatgggcaagcctgcagttgttggcgtagaaaccatgcacgtagataccacaaacaacacgctgaccataaacggcaagaccctgcatgagggagacgtagtaacaatagatggaacatctggtttattttacttaggagaattgcctgttgaaaagccagagatcgataagttttcaaaaaaacttcttgaattggccgacaaaaacaggaagctgggtgtaagggccaatgcaaacacaccggaggaagcacacttggccagagaaaatggtgcagaaggaattggattggccagaacagaaaggatgttccttggaaacgagcgcatacctataatgagatccatgataatgagcgaaagcaaggaggagaggcaaaagtatctggaacaactacttccaatgcagatttccgacttcgtggaattcttcaaaactatggagggctacccggtgatcataaggctgctcgatccgcctctgcatgaattccttcctgataaagaaactatattgaacaaaatatacgaaataaaatctggaaagaacggatcagatgaattgcaatactatgaaaagcttctaaaaacggtccgtgatcttgaagaatttaaccctatgcttggcttcaggggctgcagggtaggcttagtgtatccagaaatatacgatatgcaggtcagagccataatggaagctgctgtaagggttcaaaaagaaggaagaaggataatgccggaaataatgataccacttgttggacaccacaacgaattaaagattttgatggaacggttagaaaaaacagcaaaatcagtaaaggactccgatcaagttgactataagtttggcacgatgatagaaataccgagagcatgtgtgactgctgataaaatagcaaaatatgcagacttcttctcatttggtacaaacgacctaactcaaatgacgttcggatacagcagggacgatgcggaaggaaaattcatgttcttttatttagaaaacggcatactagaaaaagatccgttttcttccgttgacgaagatggtgtaggtgagcttatgagaatggcagtggaaaagggaaggaaatcaaacgaaaagttagaagtaggtatatgcggtgagcagggcggagatccagacaccatatatttctgccataaaatcggactggattacgtatcagcatcaccatatagaataccaatagctaggctagccgctgcaagggcaaatatatcggagatgaagccagagcttgcctccacatatagatat

SEQ ID NO: 37248 - DNA, 1203 bp, Thermoplasma volcanium
atggaacttccgatagaagatgttagggtaagaaaagtactggattcaaggggaaacttcactgtagaagcagatgtatacattccaggcggttttggcagaacctctgccccagctggagccagcacaggtgaaactgaggttatagccttttcgaagaagggaattgacgaatcaataaaattttttgagacaaacgtgaggaggtcaataatagggttcaatgccctcgatcaaaagggcttcgacgctttaattaccgatcttgatggaagcggtaatttttctaacctaggaggaaacttgtcaactgccctatctatgtctgtagcaaaggccgtttcggcgcaccttggcattccactttatagatacgtcggtggaataaaccactcgatgcctaggccgattggaaacgttattgggggcgggaagcatgcaagaaatgggacatctatccaggagtttcttgtttcggcccaaggaaaaacgttcatggaatccgcttatgtgaatgtactcgtacatagaaaaataggagatattctatccgagaaaatgaaagacattagcattggtgttggtgatgagagagcttggagcgtcaacatatctgacgaagaagctttcgaagtgctgaaccaagcagtaaatgaagtctcctctgaaacaaaggtaaaaatatatacggggttggattttgccgctgactctctttatgagaatggcaagtacgtctacaagcataccgttagaagcagggatgaacagatagattacgcaatatccataaataaggactttggcgtatactatatagaagatccaatgttcgataccgatttcgagggttttgctgaaataacaaagaaaataggggacaaggcaatgatagtaggcgatgatctatacactacaaacccagacagaataaggaaaggtatcgaactcggttctacgaatgcagtcctaataaaggtaaaccagataggcactctaacgaaggcacaggaagcggcaagcttggcttcttcggctggccttaagaacgtagtttcacacagatctggagaaactacagacgactttctcgcccacctgtctgtcgctttctcttctacgtttgtaaaaacaggcacgatcggaggtgaaaggatcgcaaaactaaacgaactgatgaggatagaagaatgcttaacatca

SEQ ID NO: 37249 - DNA, 1218 bp, Thermoplasma volcanium
aaaggttttttgagacttgaatgggcacgggatcatatgcctgtaattgccgaaataagaaagaggttccttgatgaaaagccattcaaggggataaatatagctatggcgcttcacgttgaggcaaaaactggtatattctcactcttgctcaaggaaggtggtgcgaacgttagaatggcttcatgcaatcctttaagttcagacgattcagttgttgaaagcctgaaaactgattatggaatgcctgtttttgcacgcaaaggggaaacgcaggaagaatattacgaaaaccttcaaagaacgctggaaaagccgccagatataataatagatgatggtggagaccttaccaaactcgtacacactgagagaaaagacctatctaaaaatataatgggcggaaatgaagagactaccactggggtagtaagattaaaggctatggaaaaggcaggagtacttttattcccaatgtttgatgttaatgatgcaaatatgaagcatttattcgacaacaggtatggtacaggacagagcacgctcgacggaataatgaactcgaccaacctgcttatagctggccgaaacgtggtagttgccggttacggatactgtggcaggggaatagccatgaggttaaaagggatgggggcaaatgtcatagtaactgaaatcgatccaataaaagcaaacgaagcgataatggatggctttcaagtcaggagaatgaatgatgccattaggtacgcagatatggttataactgcaacaggtatgaaagacgtagtaaagtacgaagacgcacttgtcgctaagaaaaacatagtattggcaaatgctgggcattttgacaacgaagtagctgtgaaggagatagaaaagcattcgctggaaaaacgtgaagtgagggaattcgttaaaagatacaggcttgagaatggcaatacagtagatgtaatagctgatggcaggctggttaatctagctgctggccaggggcaccctgtggaaataatggaccttagctttgcacttcaggcactaacagctgaatacctagtaaagaaccaccaaaatcttgagaaaaaagtctatcctgtacctccggaaatcgacagatatgtggctgagatcaggctgaagcagtttggcggagagctcgatacattaactgaagaccagataaaataccttaattcatgggatgagggtacc

SEQ ID NO: 37250 - DNA, 1167 bp, Thermoplasma volcanium
gtcataggaggaggccctggaggcagcacagctgccaggtatgcggcaaagtacggcctacggactttaatgatagagaagaggcctgagataggatcacctgttaggtgcggcgagggcctgtcaaagggaatactaaacgaggcagatataaaacctgataaatcgttcatagctaatgaagtaaaaggtgcaagaatatacgggccttcagagaagaggccaataatacttcagagcgagaaggctggcaacgaagtaggatttgttcttgagagggacaagttcgacaaacacctagctgctttggctgccaaggcaggagcagacgtatgggtcaagtctcctgcactaggcgtaataaaggaagacggcaaggtagccggtgcaaagataaggcatgaaaacaatgtagtggaagtcagagccaagatggtgatagctgccgatggtttcgaaagcgaatttggcaggtgggcaggcttaaagagtgtgatactcgccaggaatgacatcatatctgctctccaatatagaatgataaacatagatgtcgatccagactacacagacttctatcttggatcaatagcccctggtggatacatatgggtattcccaaaaggcgaaggtatggccaacgttggtataggatcatccataaactttatacataacaggctagagctcaagaattacttggacagatttatagagaaccacccgggccttaagaagggacaggacatacagcttgtaactggcggtgtttcagtttccaaggtgaagatgccgataactatgccaggcctgatgctggttggagatgcagcaaggctcatagatccaatcacaggaggtggcattgcaaacgcgatagtatctggtatgtacgctgcgcaagtctctaaggaagcgatagagagcaacgactactcgccgcagatgatgggcaagtatgaaaagttagtcaaggatcgctttgaaagaaaacaccttagaaactgggttgcgaaagagaagcttgcacagctatcggatgagactctggacaagcttgttgacatagtatcagaacaggttcttacaacaatatccgtcgaagccatactgaaggcgattgcagaaaaatatccagaagttgtgaaagagcttgaagacctcatt

SEQ ID NO: 37251 - DNA, 1338 bp, Thermoplasma volcanium
atggtagtctccccattagagtatagatacggcagggaacagataaagagaatatttgacgatgaaaaccgcctctactatatgcttaaagtagaggcagcaatatcaaaggcagaagcggaatatggtattataccgcccgaggccgccgaagatattgggaaagtagtcgcagaccgcatagtacagctgcagagagtaagagaaatagaagcagagataaagcacgatgtaatggctatggtgaaagcgttatcagaaaaatgcaaagttggcgccagttacgtacattacggcgtcacatctaacgacgtaaacgatacggcaacagcactgcaaatgcatgatttcttttctttcctgaagcaggatatagaagatattatggagacactcatcgaattgacgttaagatataaatcgagcccaatgatgggtaggacgcatggccagcacgcttcaccaatcactatcggcctaaaatttgccgtttacctttcagagttttcaaggcactatgatcgtatgattgaaatgtcaaaaagagctttcgctggcaaagtgctcgggccggtaggaacaggtgctgccctaggccccaaagcccttgatatacagaatagagttatggagatactgggtatatacgcagaagagggcccaacacagatagtaaatagagaccgatacatagaatatctatccgtaataaacgggatctctgtaacattagaaaagataggtacagagataaggaacctgcagaggccagagatagatgagatgtccgaatattttgatgtggagaggcaggtcggttctagttcaatgcccagcaaggtgaacccaataaattctgaaaatgtagttagtttatcgaggcttataagatccatgataataccggaatacgaggctggcgttacatggcacgaaagggatctgacgaacagcgctctggaaaggtttacgataccatattcttcgatacttgtggattatatccttgttaagatgaactcaatcctatctagccttattattaaggaggataagattaggaaaaatcttgaaatggatgacagcatattttctgagagcttggtagctgctcttactcaggccggcatgccaaggcaggacgcacacgaattcataaggagatgttcaatgaaagcaagatctgaaggcaagacactgaaacatgtagtcgtagaagagggcataaccaattatataagaagagatgagctagatcgcctgatggatcctgcaaacttcattggttccgcaccagaaatatgtgatatagtggtaaataatgcaaggaggaggctg

SEQ ID NO: 37252 - DNA, 1128 bp, Thermoplasma volcanium
ctacaatatgtcaatgaatcagccaccgtttccgccagcaactatgttgaaaagctcaagaaacaggggataaaggtatacaactttggtataggggagccggatttcacaaccccacagcacataatagaatatgcgttcgaaatggcaaaagaaggaaaaacgcattatacaccgtcaaacggcatacacgaattgagggaaaaagtttctgaaaagctcaaaaataggaataatataaatgcatcgccagacgaagtcctgattacgccaacaaaatttggcataaatctcgctatgatggtcatccttaaccctggcgatgaagtgctcattccagaaccttactatgtttcgtatccggacatcgtaaggctcgcaggaggaaagcccgtaactgttagtacattggaagattacagcctggattttgatctaatgcgaaagtacgttacgcctaagacaaaggcaataatattcaacaacccgacaaatcccacgggaaaggtttacgatgagaaggagataaagagccttgtcgattttgcacttgaatacggcctctacatagtatcagatgaaatatacgaagacctcatctataatggcaagttaatttcgcctgcctcttatagcgagatgtggggaaagagtataacactgaacggtttttcaaaaggatatgcaatgactggatggcgcataggttacatggcggcacccagggagattgtggaagcagcaaacgtaatacagcaacagactataacctgcgtttcctctatatcgcagtatgccgcgttacgggcactcgacgatactgaaagcccgaaaaagatgaaagacgaattcaaaaggaggagagatctcatactttccatactcgattcttctgataagctaaatgtaacagaaccagatggagctttctatgtatttccggaatacaacagcgatatttcttctaataaagtatcagaggatctgcttgaaaaataccaggtcgttgtaacccctggttctgcattcgggaggcaaggagaacatcactttagaatatcgttcgcaacctctgaagacattattaaggaaggggctgaaaggattattaaattctttgcatcagtt

SEQ ID NO: 37253 - DNA, 1086 bp, Thermoplasma volcanium
attaaggaccgttttgacgatcatgcacattcactatctttccctgtcttttttacaagttcctatgattcgagaaaggaccgtaaatataggtatagcagggagttaaacccaactgtagaagagttatctagacaactgagtttgctcgaaaatacagagagatccatatgctttagttctggaatgggcgcaattacaggcactatcctcgctcttgcaaaacctggagataagttagttatgccaacagatgtgtttgggagaacgtatctctttgcaaagaatttccttactaagttcgggataaacgttaaatttgtagaaccagggacggactctctcctaggtgctgttgaagaacatgcggacattgtattctttgagagcctttccaatccattactgagattgtacgacgtagataggatctgcagaaaagcctcagatataggggctattaccatagtagacaacaccctagccacacctattttgctgaagccttctctttacggatgcgacataataatagagagcctttctaagtttattggtggtcataacaatgctattggcggttcagcttctggatcgctaatgatggataccattgatgaaaataggagaagccttggatcttccatggacccaatgtcagcatacctctttattcttggactaaaaaccatcgatctccgcataaagagatcttcagaaacagctaaagctatagcgagattcttaaatgaaaacaattttgtatctaaagtctattatccaggtttgagcgataattcggacaacatatctgcaaaaacactgttaaatggttctccccctatagtctcctttttattagatgaaggaaaagatgtgcagaagttcatggaatccttacgaataattacgccagcaaacaccatgggtggttctaattctacaatttcgaatccatacactatgtctcacagaaaccttagtgaagatgaaaaattaaggctaggaataacgaagaatctcatgcggttgtctgttggcctcgaagacctagatcaaataattcaagatttagaacaggcaatt

SEQ ID NO: 37254 - DNA, 1128 bp, Thermoplasma volcanium
ataggcctcataggagaaccaaacgttggaaagtcgacttttttttctgctgcaactgaaaatgaggctgaaataaacaacttcccttttacaactataaagcctaatcttggcatgacctactttgttgtcaaatgcccggaagtagaaatatcgggaaagtgtaatccgcgtgagggctactgcgaaaatggtaacaggcacatcccggttcaaattattgatgttcccggattaattgaaggtgcaagtgaaggcaaagggatgggaaatgagtttctggacaatataagggatgttgattctatactcctcctcttcgatgcctcggctggagatatagccactgttaggaaaagcattgaaatggttaaatccgagcttctaaaatggatctcacaaaggatatattctgattgggatcatttcagcagaaagagtgaggcatctggagaacggagagacattgctcttaaaagaaaactttcattatttggtataagcgagcaccagatatcagagatgatggaaaaagatttttttccagcaaaactaagcatatggacaagggaagacgcagacaagctcgctctttcaataataaaatacgcaaaacctctcctgctagttggaaataagtctgaccttgttagcccgaatactttgtctgagatgaaaaacgccttaggagattcatactttgtttctgctgaatacgaacttgcgctgaaaagagctagaaagtccggcctcgtttcaacgactctcaatgatttcgcaatcttaggtggaaatgaaaaacagaaagaagtcctcgcaaaaataagggattggtttaatacgcctggcataataagaatacacgatctcttgcaaaaagttgtaagagattacctgcattacataattgtatatcctgtatacgatgagagcaaatggacggataagtccggtaacgtgcttcctgatgctttcgtcatgccatacggatcaacatcgcttgacctagcatacaaaattcatacagatataggggagggctttataagagctgtcaacgctagaaccaggatggttttgggtaaagactacattttaaaggatggagacgtaataaagataatctcc

SEQ ID NO: 37255 - DNA, 822 bp, Thermoplasma volcanium
gtaaagctccttaagggagaggagatagcggaaaaaaaggcagaagaattaaaagaaagaatcgaaaaaatgggtgtttcaccaaggcttgtcctacttcaggtcgggaattacagcgcagctacaatatacgcacgtgcaaagataaagagagggaaaaagataggggcggatgtcgtcctcgaaaagtacgaggatcttactaagcaggaattagtaaggagaatagaagagctttcggctgataaagacgtaaatggaataatggttgagaacccacttccgaagaccatagactactacgacattgtaaaatcaattccatactataaagatgttgatgcactctcaccgtacaatcaaggatctattgcgattaacagagaatttcttgtccccgctacggctatggccgtagttgatatacttaaatactacggatatgaaaagactactgccaccataataaacagatcaccagtcgtgggaagaccattgagcatgatgatgttgaacagagattataccgtatcgatatgccacagtaagacgcctgatattaggtctatagcgaaagcctccaaaattatagtagttgcagtaggaagaccaggtttccttgatgacacgtacgtaacagagagttcagtagttatagatgtcggtattaactatgtccaagataaggttataggggacattgattttgataaggtttcagaaaaagtagaggcagtgacgccagtaccaggcggtgtcggcccaataactgcgacaaatatactctctaacctggtaaaggcagccgagtatcagtctaat

SEQ ID NO: 37256 - DNA, 1029 bp, Thermoplasma volcanium
atgtccactataaacgccatagtaactgatgcaccgaaaggtggggttaaatatacgaaaatcgatatgccagaacccgaaaaatatgaagccaaactcaaacctgtatatataggtatatgtggcactgacaggggggaagtggctggagctctttcttttacatataatccggaaggtgaaaattttctggtccttggtcatgaagccctattacaagttctagatgtatcagacaataactatataaagagaggtgatttcgtagtacctctcgtcaggaggccgggcaagtgcgtcaactgcaggataggaaggcaggataattgctccataggagatcctgataagcacgaagccggaataactggactgcacggatttatgagggacgttatatacgatgatattcagaatctcgtgaaggttaatgatcctgatcttggaaagatagccgtacttactgagccccttaaaaacgttatgaaagcgttcgaagttttcgatgtggtctctaagagatcaatattccagaacgatgattctacctttataggaaagaaaatggtggtaataggatctggcagcgaggcttttctttattcgtttgttgggaaggataggggattcgatgttacgatggtaaatagacatgacgagactgaaaacaaaatgaagatgatggacgactttggtgtaggtttttccaactatcttaaggatatgccggataagatcgatctactggtagatacgagcggcgatccttcgactatattcaaatttgtaaagaaggtaaacaataacggtgtagtgatactgtttggaacaaacggaaaagccccgggatatcctgtaaatggcgaggacattgattatatcgtggagaggaatataacgatagctggatcagtggacgccgcgaagatacattatgtacaagcacttgattctctcagcaactggtatcataggcatccgcagacgattaaagatatcataacgtacgaggccaagcctgaggagaca

SEQ ID NO: 37257 - DNA, 1344 bp, Thermoplasma volcanium
accaagatcgtagcaacggtaggacctgcaagtgaagatccgtcgatacttaagcaaatggtaaaaaatggattatccttaatcagaatcaactccgcacacgctgaaatttcctatgtagcaaaaatagtaaaagagatgcgcgatataaatccagatgtaggtgtaatggtcgatctcaagggcccagagcttaggactggaacctttcctggcggttcactgcgcatatctaaaggaaataaatacaccataggaaaagaaatcacgctgaataatgaaaaagccattggaaatattcagactggcgacaaagtcctgatgagcgatggtgaggtggaatttaccgttgatagcacttcgcctatagtgctaatagcagaaaatgatggtgttctacgagacaggagcagagtgaatgtccctgggagatacgttgaaattgggtccataaccgaaagagataagagtttcgtaattgagggtataaaacaaggcgtagacttctttgccttatctttcgtacaaaatgctgaaaatgtgaacagccttagggatttcataatagagaatggcggtaaccagtacataatagcgaaaattgagacaaagagcggccttgataacattgagagcatagttcaggcatcagacggaataatggtagcgagaggcgatctcggagtcgaactccccctgaaagaagttgttatggcgcagaagaagataataaagatctctcatgaggatggggatttcacaatagtcgctacacaggtactggagtctatggttaacaatgcatttccaacaagggcggagatatcagatataaccaatgctataatagacaatgccgatgccctcatgctgtctgaagagagtgcgataggcaaatacccagcacttgctgtacagacactgcgtgacgtatccgattatgtggaaaatctcgttgattttcaatcgtcttacacctttaaaggcaacaaaatagcttattcagtcgcgaaggcagcaaaagtgctttccgatgatataaacagcaatggaattgttgcactgacacacaccggatcgactgtaaaaatgatctcttcgcttaggccaaaggcgctggtctatgctgggactgttgatgactcgctgtctaggaagcttaatatttacttcggagttgttcctctgcatctaaaaagagattcagaatctctcagttttgccgatctgacagaatacatcttaaaatctgcatttttcaagagtggggataagatcgtagtaacaagcggcgatccgtattttacctttggcggcacgaatgacgtccgtgttatggctata

SEQ ID NO: 37258 - DNA, 1419 bp, Thermoplasma volcanium
tacatagatggacaatgggttgattcgtccaatggtgatactttaacgaaatacaacccggttactggcgaagtcattgggaaatttgcagcagcatcaagggatgatgttgatagagcatttgatgcagccgaggacgccttccaaaagtggatggatcttgggtcagtcgagcgttcaaaaatcatatacaaagcgaaggagctcatagaggaaaaccggaaggaacttgaaaatataataatacaagagaatggaaaacctgttaaagaagccgctgaagaagtcgatggtgtgctcgatcaaatgcaatactatgcggaatgggccagaaagctgaacggagaggtcgttgaagggactactaaccaccgcaagatattccaatataaagtcccgtacggtactgtagttgcccttactccgtggaatttcccagcaggtatggttgcgaggaagcttgctccggcactcctcacaggcaatacggtcatattgaagccaagcagtgatacaccaggaagcgctgaatggatagtgaaaaagtttatccaggctggcgttccaaagggcgctctcaattatataacaggcaggggttcggttatcggtgattatatagtagagcataagaaagttgcattaatcaccatgactggctctaccagcaccggccaaaggataatgcagaaagcttctgctaacatggcaaaacttatgctcgaattgggaggaaaggccccctttatggtttggaaggacgccgacataaacaatgcgcttaaaaccctgctctgggcaaagtactggaacgccggccagtcctgcatagcggcggaaaggctctacgtacacgaggatatatacgacacgttcattaacaagttcgtggaactgagcaagaagattgtagtcggcgacccgtcaagggcagacatgggcccgttgataaatactactgcattgaagggaacagaagaggtcgttgaagaggctaaagaaagcggtgcacgcatactatatggcggatccaaacccgatctttctggtccatacaagaatggatacttcttcctgcctacgataattgacaatgtcgatcagaaatcaaagatattccaggaggagatatttgcaccagtaataggcgcaagaaaggtgtctgacgtagaggaaatgtacagccttgccaatgattccaagtacgggcttgcatcgtacttgtttactaaagatccgaaccttatattcgaagccgcagaacgcataaggtttggcgaactctacataaacatgccaggcccagaggcatcgcaaggataccacacaggtttcaggcttactggtcaagcaggggaaggaagcagatacggcatacttgagtaccttaaaataaagaacatatacgtagactactca

SEQ ID NO: 37259 - DNA, 2094 bp, Thermoplasma volcanium
atgatctcacaggagatgcccgttgagaggataaaggacctctggcgggacttctttaggacttacggctacagcgataagataaatagcatacatcaggactatcctgaagtaagaacactctatgtgtcctttaaggacattgaggattacgacaggcaatttgcagcttctatcctggcttctccagaaatatacctcaagactggggaagagatagtgatggaagattatctcctagacaaagtttcgaggaggttcagaatattccatttaaggataaaggatctcgaagatagaaacacatcctataatataagggacataagaagtgcaaacataggcactttaataagcgtttcaggaatagttcgaaagaatacagaggtatttccaaaattaaaaaacgctgcctttgaatgcagcaattgccacgagttaaattacgttgaacaaaacgaatcaagattgacagaaccgctttactgtgctaattgcggacagtctaaggtgaaggacaagatatcattcaaacttaggcccaatctctccgagttcatagatgtccagaagatagagatacaggaggatccggaaactctagaaggtggagcgcagccccagaggttgataattattgtggaagatgaccttgcagggctgctatttccaggcaaccgtgttgtcgttgatggcatactgcaggcagaacaaaggcggcagggaaatgtacctttaacagagttttacacctttctatatgccgttaacataagaaaagatgttaaagagattgaaagcgtaaagatcactgaagaagataagcaaaagataattgagatttcgaagaggccgaacgtaatagacgtaatagcaaaatcaatagcgccgactatacatgggcttgatatgataaagaaggccctggcgctccaaatgttcggaggtgtcaggaaaaccatgaaagatggaacaacgatgaggggtgacatccacatacttatggttggtgacccaggtactgcaaaatctcagcttttaaaatacatggcagaagtatcgcctcgaggaatttttacatttggtagaggatcaagcgctgctggactgactgcagcagcagttagggatgagtttggagaagggcgctggacgcttgaagcaggggctttggtgcttgcagacaacggtttcgtggcaatagatgaactcgacaagatggacgagcacgacaccgccgctatgcatgaagcaatggagcagcagactgttactatatcaaaggctggcatcatggctacccttagagcaagggcatccgttttggctgcagcgaatcctaagtttggcaggtacgatcttaatcgaaacttggccgaacagataaattttccattaccattgctgtcaaggtttgacgttatattcaagatggtagatcagcctaataaggatacagacagccagcttgctgaacacgtccttaaggctcacaggctcggtgaaatatacaagagcatggaaaaaaatgacatagagatagatgtgccagatgaagccaagtatgaaccagatatagacaaggatctgctcagaaagtatgttgcttatgctaaaaataacgtatttccgaggttgagcgatgaggccattgccatactgcaggatcagtacgtaagaacaaggacgggttccagagattctatccccataacggtaaggcagctagaatccacaataagattagctgaagcagcggcgagggccaggctttcaactatagttacggtcgaagacgcaatgctggcaaagaaaatagttgattattacttaactgatgtgtcaaccgaaaatggaaagatggatatcgatataatttatacaggctcaagttccaagcagagaaatgaaatggagaccgtgcttgatataattaaagagataaaggaagaaaaaggtattgctgaggtatcggatgtgattggagtggcggagagtaaaggtataactgctaagaaagctgaggaggctatattgaagttgaaaaatgctggccagatattcgagaggtcatacggtaaattagatgtgatc

SEQ ID NO: 37260 - DNA, 1689 bp, Thermoplasma volcanium
atgggagatttaaatagtgcctcgactgatgctaacatatcctatagcgaaaatcaggacaggaagcttaggaaagctctgtcaacatgggacctccttatgctgagtgtaggaggcataatcggatcgggatggctgtttgcagcctatgcagcttcagttctgtcaggccctgcctccatactcgcatgggtgcttggcggaattatcgtcatctttatcgctttggtatacgcggaactaggtgcgatgattccaaggagcggtgcaatagtaaggtacggccacctctcacatgggagctttgcaggctttctattcggttgggcatatttcctcagcgccgtatcggtgccagcgatagaagctgaagctgtcgttacctatgctgctagttatgttacaaagccggctctaatcgccaatggcattatgacagtattcggaactcttatagcgatgctattgatgatagccttctttttcctgaactatgcaggaatacacttaatgggaaagacaaatcagggtataacctggataaaggttataatacctgtgataacagttatagtacttatagcagtacatttcaatccatcagagatagtaccgcctaatggcttcctgccatatggctgggctcctgtatttgcggctatatccagtacaggcatagtcttctcgtattttggtttcaggcaggctatagactatggcggggaggcaaagaatccgcagaggtctataccaatagcgactattggctcggtgctcattggaatactgctatatagtttgcttcaggtagtgttcgtgggtggaatagactggagcaaaatgggccttgaacctggacagtggactcttctcaacgcctatgcaaccgcagcacacgcgtctactgaacacccccttgcttaccagcttatgaatgcaccatttgctacaatagctctctccgctgggcttgtatggttgacatacacattgtatgcaagtgcttacatagctccttcgggaacccttaacgtatacctaggcacatctacgaggactctctatggaatggcagttaacggccatcttccaaagatattcgcaaaagttgctgataggaacaaaatacctgtcattccacttattactacactgctcgtaggtttcctgttcttccttccgtttccaagctggtacaaaatggtcggtttcatcagtggagcgacggttttcacctacatagttggcggtgccgcacttatgaacctaaggaagcaggccccagaactcaagaggccgttcaagctgtggtccgcaaacgttttggctccgatcgcattcatacttgcgtcagaggcagtttactggacaggctggcctactacgttgtacttagcaatagctatattcctaggcctagttctttatggagctcttgttgggctgcacaagattgaacaaaccttcgataagaagaacgtcaaggctggcctttgggtgcctgtctttatagttatactgactattctatcgtatctgggagaatatggcggcataaatgttctgcacttcccattggatctaatagttgttgctatagccagcgcaataatatacgtttgggcaataaaatctggaataaagacggaagagatagcagctatgatagcgaatgaggaccagtacgtt

SEQ ID NO: 37261 - DNA, 849 bp, Thermoplasma volcanium
gaggccctgaaatctatttctttcaaagtccctgcaagtggtatattatccctaattggaagaaatggggcaggcaagacgacacttatacggatactttcaacagagcttcttccatcgtcaggttatgcagaaattgacggtatcgatattattggagaaccagacgagatcaggaaaaggatcgcaataattcctcaagaagcgagggccatatcttggcttaccccaatccagactataactacattcctgctctacagagggatcaactattcggaagcaaagagaagatcaatggaagtcctgaaaaaactagaattggagcaaattgcaggcaagctaaataggacgttatctggcgggcagaagaggaaggtgcttgtagctgctttaatagcatcagatgcagacattctctttatggatgagccaacgaccggccttgatcccatatctagagcggagctttgggacctacttgcagagcttaagagggaaaaattcatctttcttacgacgcactatctcgaagaggcagaaaggctctctgacaggatagcaatacttgattccggcgagctcaaaggtatcggtacaatatcagaactaagatccagactgcccaaaaaatacagcattaatctgattcaaacctcaaacttagatggcgaaatagaaataaacggaacagtcctaaagacaggcagaaggttattcatagacgaagaagaggcctattcaatcgtacgtgatctcataaataaaaatgcaaagttctcaataaatcctatttcacttgaagatatatactatagcatagctaaaagagacatcggaggcgatgca

SEQ ID NO: 37262 - DNA, 1361 bp, Thermoplasma volcanium
ctagtaaagtattttagtattaccttaatatactgttgatgtgaattggactataaaactggttatgttcaattcgaccagataaggataactcctatttttgtagctgtaaccgtactttcatccatgggagtttttatggatggatttgcgctgagtattttttctgcagcccttccttatcttaagaactatatacttgtgaaatcgatacttgtatcccttgctgcctctgccatttatattggaatgttcgtgggaagtttcgttattgggcatctctcggacaccattggaaggaagagaatgtatacttatgatcttgccataaccagtttgtttctcgtcctaactggaatatcgaggaatttcgcagaatttttcatttttgagctgctggctggaataggaataggggcggactatccacttagttcatcaatagaggcagagttttctcctcgggtatcaagaggcaggtttttagtcttcaatatttttatgtggactatcgggtccatagttttttatctaatatccataccgctcgtaggttactttggttcatcctcatggagatggatgtacttcgtaggtgcaataattcccatcgctgtaataatttcaaggcatgcccttcctgaaagcccttactggctagtgaaagccggaaggtaaaagaagcaaaaaaagtagcagagaacatcgggaaggaagctggcactccgaacgtagatgtcccatctgttgaatctggcagtagttcaattaaatccgtattttctggatcgtacctgcctctcatcatgtttgcctctatcgcctggtttgcatacgatgtttccagctatggggtatggaactataccccctcaatatttgtgtccacaggcatttcggttgtaagcagcatagtttcgaccctgcttgaggacctcccagtcatagctggatttatagtatgtctaatacttatagaccgcataggcagaagggtgctacaggcggccgggtttggcctagctggtatatccctacttactttcggattatattcaatgcaccacacattgcctttcattctcatatttatagcatttgccatgatgcatctcttccataacataggccctactaacctgacttacgtttatcctgtggaaatatttccgacgcgcgtgcgtgggactgcaatgggtatagctacatctgcatccagaattggggcaatacttggcgtattcgcatttccgctgctcataggcacgttcagtctttctgcagggctcctcttttttgctatatttgaattccttggtttcatagttacggtaattctcgctccagagacgaaggccact

SEQ ID NO: 37263 - DNA, 1272 bp, Thermoplasma volcanium
atggcaagtcagaaaccacacctaaatctgataacgataggtcacgtagatcatggaaagtctacgctagtaggaaggctcctctttgagcacggagagatcccggcacatattatagaggaatacagaaaggaagctgagcagaagggtaaggcaacgttcgagtttgcttgggtcatggaccggttcaaggaggaaagagagagaggagttacaatagacctggcacacaggaagtttgaaacagataagtactactttacacttatcgatgctcctggtcacagggactttgtcaaaaacatgattacaggtacaagccaagcagatgctgccatattggttatatctgccagggaaggagagggtgtaatggaacaaaccagggaacatgctttccttgcgaggacactgggtgtacctcagatagttgtcgcaataaacaaaatggatgctactgagcctccattcagtgaaaagaggttcaatgaagttaaagctgatgctgagaagctgctcaagaccattggatacaaggatgctacgttcgtgcctataagcggttataagggagacaacgtaacaaagcctagcccaaatatgccatggtacaaggggccatctcttcttcaggcattggatgcatttaaggtgccagaaaaaccaataaacaaaccactcagagtgcctgttgaggatgtttattctataactggtattggaacagttccagtgggcagagttgagaccggagttttgaaaccaggtgacaaggtaatattcctgcctgcagacaagcaaggcgatgttaagtccatagagatgcaccacgaacctcttcagcaggctgagccaggcgacaacataggtttcaacgtcagaggtatcgcaaagaatgacataaagcgtggcgacgtatgcggtcaccttgattctccaccgacagtcgtaagggcattcactgctcagatagtggttctcaaccaccccagcgttattgcccctggttacaagcccgttttccacgtacacacagcacaggtagcttgcaagatagatgagatagtcaggactctaaacccgaaggatggtacgacgttgaaggataagccagacttcataaagactggggatatagctatagttaaagtcataccggacaagccattggtgattgaaaaggtatccgagataccgcagcttggaaggtttgcggtccgtgatatgggccaaactgtagctgcgggtcagtgtattgatctggaaaagagg

SEQ ID NO: 37264 - DNA, 1437 bp, Thermoplasma volcanium
ggcaagatgcttacagtctatagcccaattgatggaagcgagatagcaaagatttctatggctacccgggaagattatgatgaaatggtcaaaaaagcccaagaggagttcaagaagtggagaatgatcccagccccaaaacgtggcctgataattaaggatataggggatgaattaaggaaagagaagagaaaccttggcaggatagttacgatagaggcaggaaagactccgagcgaaggggagggggagatacaggagatgatagatatctccgatctcgctcttggtctttcaaggcaactttacggacttaccatagccagtgaaaggccttatcataggatgtatgaacaatgggttccacttggcccaattgccgttataacttctttcaacttcccagcttctgtatggtcatggaattcttttatagcagccgtaactggtgatgtcgttatttggaagccatcttcaaaggcagcgctcacagcagtagccgtcatgaaggttattgagcgggtattgaagaggaataatgtacctaacatattctaccttatggtcagttctggaagtgaaggtggggattggataacaaatgatccgagaatacctctcgtctcatttaccggatcagttccagttggtaggaagatatcagaaaatgtagcaaagagattaggcaaatccatactggaactaggcggaaacaatggtgcaattgtgtctgataaagcagatatcgatctagcccttcgtggagttgtattcggtgcactagctacagcaggtcagagatgtactactacccgccgtgtcattgtgagcgaaaagatatacgatgaattcgttaagaagcttgtcaatgcctattccaaagtaaaggtaggcgaccccagggagaagggtgtactagtcggccctctcatagacgaggatgcagttcgtgactatgaaggggcaatcagcgaagccgtgaaacagggtggaaaagtcttatatggcggaaagaaaataagtcttaagggttacgagaaagggcattatgtcgaacccacaataatagaggcaaatcccaacatgccaatagtcaaggaagaaacgtttgctccaatactttacgtaatgaagtataagactatcgaagaagcattggaaatacataacagcgtcccacagggtctttcgtcatccatatttaccactgatctgcgcgaggaagaagcttttctctcgccctacggatcggattgcggccttgcgaacgtcaatactagcactgccggtgcagagatcggcggagcattcggaggagaaaaagatactggcggtggaagagagagcggcagcgatgcctggaagttttacatgagaaggcagacggtgaccaagaactgggggcagactctgccgcttgcccaggatgtggtattt

SEQ ID NO: 37265 - DNA, 960 bp, Thermoplasma volcanium
gaatgggaactagccctccacagcaagattgaggaagtcaacgaaaggctctttgaagtggttaaaagcgaagaacctgatcttgaccgaatggcaaaatataccatagaagccggcggcaagaggttcaggcccctccttacgatcctggcctttgaatccagcacagatgatccttattttaagatattagacctcgcagctggttacgaactaatacacactgcgagtttgatccacgacgatataatcgatgattcacctatgcggaggggaaggccaaccttaagttataaagaaggaataaataatgcaatagttgttgctgattacttgtttgcaaaagcctatgagttaggatctaggtacggccctcttgtttcgaaggtcatggcggatgcatcaagccggttagccgaagggcaaatacttgaagccgttaacttgggaaatcttgatataacagaagatacatactataagattatagagaacaaaacggcacatttctttgaagcttgcgcccttggtgcaacaatagtagccgaagcagatcgtccaacaagggaaatactatcaaattttgcattcaacctcggcatggctttccaagtgacggatgacatactggacatagtaggagatgataggtacacaggcaaacccacttttgtggatataaaacacgatgcactaactctgcctattatttacgcattgagaaactccaatgataacgatagaagggcgatcatagacatgatcaacggaaggagggaaattaacaaatccttgcttaaggacatatttctgaagagcggatctatagactattctttctctgtggctaagcagtacattacgaaatctatggactatctgaaaaaagcaaagaagtctccagacatagatctgttaatggagttagccttcatagtaattgatagaattgaaatattc

SEQ ID NO: 37266 - DNA, 681 bp, Thermoplasma volcanium
ttaatagcaggtactggtgaaaacctaggctactttactgcactaaacttacttaagtctgggttcaaagttagtattattgctagaaataaagagaagcttgaaaatatgggttctgaactcagaaaatacggtgacatcgagtatttcgcagtggatttatctaaaagagaaggacttgcatcacttaagaagcatttttcatccttaaattaccaaataaaaggcgtagtagttgaagttggtggttatgcttcggattccttagattctataactgcatttgaccaaatgatcgaggcaaatctcaaaattcccatacttgtgcttagtgctatcagtggaatgttggataaaggatcctcaattgttttcatcaccagcgtttttgcttctaggaagatcgcagaatcttcagtttcgtatagcctttcgaaagctggattaaataggctagttgaaatttcagcgaaaatattgaggcagaaaggcatcagggttaacggtatttctacctcaatcatatcccagaagcctcacgataaagataagatagaatggcaacctggaacacaaaatgtggatccggagcttatttcaaacgtggtagtattcctcatgagcgatctatctcttggagtaacaggcaacataatatacgttgacaagggttcatccctt

SEQ ID NO: 37267 - DNA, 752 bp, Thermoplasma volcanium
tggtgttagatatgattagaatgaatatttcggttagaaaccttaaggagattacggatctgctcagtactatagtgtcagaggctaaattcaaagtggacgagaacggcatgagcgttactgcggtcgatccagctcacgtcgcgatgataaggcttgaagttccaaaagaagtattcagcgaatttcgatcagatggtacagaagaaatagcattggacatagacaggctaaagtctgtgataagactcgcgaactcttctgaaaatgtgggtataacgaaagacaaagagaaactcaagttcgaccttggaaatataagtaaaagcgtctcactgttggatccatctactatcgtaacgccaaagataccaaatattgcctctgagtattatgcaataataaagagatctgattttgaacgtgggttgagggcggctgaggacatctctgattccataagatttgtactctcctccgagggattcagagcaacctctcactccgaatccgaagaatcagaaatggtacttccaaaggatatgctttcagatttatcctgctccgatactataaagagctcctatccgctcgagtacctattgaagttcatcaaagcagtatcttcagccgatagcttaaaaataagcttcagagatgattatccgctttctatagagttttaccttgatcaaaacccatcagctaaaattaaagggttgttcctgcttgctccgagaatggagcaataa

SEQ ID NO: 37268 - DNA, 936 bp, Thermoplasma volcanium
atggttgagaatcaaaagaaaaagaagatagaagagattgaaagatgcccagaatgtggttcaacaaatctgataagagattacgagcacggggaacttgtatgcggcgaatgtggtgcagttattgaggattcttacatcgatcagggtccggaatggagggccttcgattcagagcagaatgagagcagggctagggccggttctccaatgacctttacgatacacgataaaggactttctacagatatttcgtggaaaaacaaagattcatatgggagatctataccaacaaggaacagggcacagctctatagattaaggaagtggcagaagaggataaaggtttccaacgctgctgagaggaatttatcccaagctttgcaggaattagagaggatggcttttaatctgagtataccgaatgatgttagggaaactgcagctgtaatttacagaaaggccgtcaaacaaaatatgatacgcggaaggagtatagaaggtgtggtcgctggtgctttgtatgcagcttgcagaataacaaatgtgccaaggaccctaggtgagatcgcctcagttactagagtcaaaaagaaggaaataggcagaacttacagaataatgagcagatacctgaagcttaacataatgccgtctaaggccgaggactatatcagcaggttctgttcaaagctaaagctatctatggatacacgcaataaggcgctagagatattgagggatgctgaaaatgtcggattaacatcgggcaaaggccctactggtgttgctgctgctgcaatatacatagcttcattgataacgggtgaaaggagaacacagagagctgttgctgaggttgctggagtaaccgaggttacaataagaaatcggtacaaggaactcaccgaaaaacttaagctaaacgtcgaacag

SEQ ID NO: 37269 - DNA, 1620 bp, Thermoplasma volcanium
attaagaaaattgcactcttaaatgcatatcagcacaatggtaaggcggaacttaaatctgttatcggtaaagtaatggcagaaatagcagatttacgaaaaaaccctaaacttgtttcagaacttgctaaagccgcagtagacagtgtaaattcaatgagcaaggatgatatagttaacatagttgaaaaacagttccctgaggcattaaaaaaggacaagaaacctgaagaacacaggctgccagatctccagggcgtcaacggacatgtggttatgaggcttgcaccgtctccatcagggcctctccacataggccataccaggatggctattcttaacgacgaatatgtcaaaagatatggtggggaccttatacttcgtatagaagacacaaatccaacaaatattgatccagaagcttatgctatgattccagaggatctagagtggctaggggtaaacgtaacgaaaacagtaatacagagtgaaagattcgatctatactattctgtagcaaagaaacttatagaaaatgggcacttgtacatttgtacatgcgatagggaagaatttaaaaggaaaaaactggcctctattccatgtaaagacagagataaccctcctgaaactaacctgtatctcttcgagaagatgcttgatggggaaataaaggctggagctgcagtcgccgttatgaaaacagatttgaatcatcctaacccatctgttagagactggatcgctttcaggataattgatgcaaagcatcctaggacaggagataagtatagagttttcccaatgatgagtttcagcgtggcagttgatgatcattaccttggccttacgcatgtactcaggggcaaggatcagttgacgaacactgaaaagcagaggtatgtcttcgaatacaatggctggaataagccatattattaccattatggcatgataaggttcccaggaaccagacttaaaacctccttaatgaaaaaaggaattcaggccggacaatatgatgggtggtctgacgtccgacttggaactgtgcgtgcaatggctcgcaggggctatcagcctgagacctttagaaggtactggattaactctggtctacgggaaattgatgcagtattttcatgggagatctttaattctttgaatagggaattcgtcgatcctaaggcgtaccgtttttcctttacaaaggacccagtagaaataaaaatggaaggttctaatggtcttactgcaaggctaccatatcacccaagccatccagagtatggtgtaaggaaatacgaaattggcgatacagtttatatatcaaaaggagacgcagataagatcgcagacggagaaagattcaggctaaaggacttatgctacgttgtaaggaaaggggataggtttctgttcgatggcactgagatgaaagaaaagacaaagataataaactggtgtccaccaaactcaagggagttccaagtcctaaaacctgatgggtctattgacaaaggactcatagaacctgcttctaagggctatagaggcatatcgcaactagaacgctatggatacgttaacttctacgattctgatgaaaaagcctacttc

SEQ ID NO: 37270 - DNA, 885 bp, Thermoplasma volcanium
tgtcccgaatgccattcggaacacctgataagggattatgagcatggtgaactgatttgtgcagattgcggggctgtgattgaggattcttttatagatcagggccctgagtggagagcgtttgattctgatcaggatgagaggcgtgccagaacaggctcaccgatgacgtacttgagccatgataaaggcttagccactgaaatttcctggtctaacaaggactactatgggaagagaataccacataagaatcgagctcagatctacagggtaaggaaatggcatcaaaggataagggtgtccaatgcagcagagaggaacctttcacttgcattgcagcttcttaacgacatcggtgctaagcttggtattcctaaggatattaaggagacctcagctctgatttatagaaaagctgtagagaagaatttaattaggggaaggagtatcgaaagcatagtttgcgcttctatttacgcagcctgcagaaaggttaacattccgaggactctagatgaaatagcgaaggcatcggaagtaaataagaagaaaataggaaaggcgtatagacatctagcaaaggaactcgatctaaacttaaggccgacaacacccttctcatatatagctcaattctgcaataagctcgatctggataaacaagctattgtcattagcgaagatattgtaaggcaggccatgtcgatgggaatctcgtctggaaaagggcccacaggaatagccgcagctgcaatttacatcgcatccgtcaaggtcggaaagcctaggacgcagaaggaaatagctagaatatctggtgttacagaggtcactatacgaaataggtataaagagatcagcaaggctttaaacatctcaata

SEQ ID NO: 37271 - DNA, 954 bp, Thermoplasma volcanium
ataaagaaagttggtattgtaggcgctggcaccatgggttctgccatagccgaagtctttgcatataatggatacaatgtcatcctcaaggaccaaactattgaattggctgaaaggggaagggaaaacgccaaaaggatcatagaaggatatgaaaaaatttccaatgaaaaggttaaaaaagaaatcacaaaaatagaaggatatggaattaaacttaccgaagaacaaaagtcctctataacaaaatcactttccgttaatgttcctgtaaaggaagttgaagagaggatcatcgtcacatctaaaaacgacgaaatgtcggattgtgatcttataatagaagctgcatttgaagaccaggcagttaaaaaccaaatattcagggaattaagtgatttttcaaataatgcgataattgcatcaaatacctcttcattaagcataacagagatgtctaaaaacctcaaaaaacctgaaaatggcatcatcatgcattttttcaacccaccctatctgctccccttagtggaggttgtaccttcccttttcaccagcaacgaaaccctaaccgctgttatggatctgctccacggaatgaagaatcatagagaaaatatggttcctgtgcttgcaaaggagagagaaggcttcatagttaatagactactgattccatttataaatgaggcttcaaaaatgctggattatggcatagccacagagaaggatattgatattgctatgaagaagggagctggcttcccaatgggaccgttcgaactagccgatatgataggcattgacgttgtaaaagacgttatgaacgtgttcgaaaaaacttatggagatcagtataagacaagccaactgataagaagaatgtcggaagcaggcaaactaggaaggaaaacaaaggaaggcttttataaatattaaaaaattattttattg

SEQ ID NO: 37272 - DNA, 959 bp, Thermoplasma volcanium
atggcaagaaaaaagatttctgtaataggcgccggcaatgtaggcgcaacagttgcccagtttttagcaacaaaagagcttggcgatgtatacttattcgatgttgttgatgggattccagaaggaaaagctctagatattcaggaaggagcaccacactggggatatgatcttgacgttgtaggctttagtacatcagattcctcgaattacaaaaatatggagggatcagacgttatagtagtaactgccggaatggcaagaaaaccaggaatgagcagagaggacctatttgacaaaaatgtagagataattgcagatgtatctaagaacataaagaagtattcacctgattctataatagttgttgtttctaaccctgccgacataatggcatatgcccttcagaagatttccggtgttgatccgcaaagaataatgggtttaggcggttcattggatagttccaggttcaggacatttcttgctaaggagctcgacgtttcagtagaagacgtaaacgcttttgttattggaggccacggagatgatatggtgccatttataaggtactctagcgttgctggaattccaatagagaagctgcttcccaaagaaaagatagacgcaatcgtaaagaggaccaggtttggcggtggggaaatagtgaattacctcaaggcaggaagtgcttactatgcgcctgggatatccataacggctatggttgaatccgtcatcaaggataagaagagagtcataccatgcgcagcctatataacgggaaaacatgctgagcactacggaataaacaacaagttcataggtgttccaattaaaatcggtgaaagaggagttgaagagatctacgacatagacttcctgccagaggagcttgaactctggaagaagagtgtggcctctgttgaggcaagctcgaagaatgttgacgagtggtt

SEQ ID NO: 37273 - DNA, 567 bp, Thermoplasma volcanium
aaaatgccagttgtattgggacaaaaagctccagactttacagtgaacacctctaagggaccgataaccctgtctaactacagggggaaatgggttctgctcttttcgcatccgggcgattttacgccggtatgcactacagagtttattgcgtttactgagagatatgaagattttcagaaactaggagttgaattgataggactaagtattgatagtgtctttagtcacatagcttggataagggacattaaggagcactttgggatcgatataccgtttccaataattgcagatatagataaggaggttgcaagggaatacaaccttatagatgaaaaatcaggtgcaactgtgagaggagtcttcatcattgatccgaaccagatagttaggtggatgatctattatccagctgagacaggcagaaacatagaagaaataatacgtgtcataaaggctcttcagttcaactgggacaggaagctcgctactcctgcaaactggcagccaggacaagaaggcattgagcctgcgcctaccactgtagattcaagcttcaagagg

SEQ ID NO: 37274 - DNA, 936 bp, Thermoplasma volcanium
agaatgaggcgatacagaaaagatcaaaaccttagggactttattagtgagatccgagtaagtattgataagcttatcatgcctatattcatagatgagaatattaaagagaagacacagatcagttcgatgcctgggattttcagatacccaatcagccagctcgaagactatgtaaagcatcttgaagacataggcataaaatcagtacttttatttgggataccgaagtacaaagacagctttggttcttcagcttacgataagaacagcataattcagaggtcaatatctctcataaaggagacaactgacatagtaaccatagctgatctgtgcttgtgcgaatatacggatactggccagtgcggcctgatcagcaatgattatgtggataatgacaagactctagaagtctacaggaagatcgctgtaagctacgccgaagccggagtcgatattgttgcccccagcgggatgatggatggccaagttaaggcgataagagaggctctagactcttctggttacgtcaacacaatgattatggcttatagttcaaagttctcttctaatctttatggtccgtttagggaggcggctgagtctgccccgaaagtgggggatcgaaagagttatcaattggattaccgcaacgggaaggaagctattagagagatagagctagacatagatgaaggtgcagatatagtgatggtaaagcctgctatattttatctagatataataaggtccgccagggataggtttaatttgccactggcagcctacagcgtgagtggggagtatagcatgatagtgaacgctgtcaatcaagggcttataggcgaagattcagtaaacgaagctttaactgctgtattcagggctggtgccgacattgtcattacgtattttgcagaacgcctcgccgag

SEQ ID NO: 37275 - DNA, 1128 bp, Thermoplasma volcanium
aatttcggagtttcacctgaagaagagatggttcttacttacgttaaaaaatttgcacaagaggagctcaagccgagagcgaaagaaattgacgctaagatggaagttcccagggagataatcgatcgaatgaaacagcttgggttttttgcgacttacataccgaaggaatatggtgggcttgggatgagttttccctttttgatccgtgccatagaggaaatttccaaggcttgcccaagcacagctcttgtcttagacggtgcattaacattgttcgctgaaccaataataatgtttggttcggaagatctcaagaagaggtatcttactagggttgcatctggttcagttggcggtctagcaattactgagccgggagctggtagtgatgctgctggcatctcaactactgctgagaagagaggagataaatatataattaatggcgataaaatattcatatccaacgggcgaatctctgacttcttcgttttcgatgccgtaactgatcctggaaaaagacataaaggaataactgcgttcgtagtcgacgccaatacgcctggcctaaaaataagtagggatatacacaagatgggcataaggggatcaagtacagttgagcttgtttttgaggatatggaggttccagccgaaaatatagtaggtgaactgaatggcgggttcaaggtaataatggagacgcttgatgctggaagaattggcatagctgctcaggcactaggtattgccgaggaggcattcgctgaagctatggattacattaagcagagaaagcagtttggtactactatatctagtttcgaaggaatacagtttatgatagccgatatggcaacggagatagaggcagcgagatatttaacctatgtggctgctgagaaatggcagcataaagaagataccattgaaatatctgctatggcaaagctaaaagcctctgacgttgcggtacgtgtaactactgatgcgctgcagttgtttggaggatacggatatacggtagatctggacgccgaaaggcatatgagagactcaaaaattacacaaatatacgagggaacaaaccaaatacagaggcttgtaatagcaaaagagctactt

SEQ ID NO: 37276 - DNA, 957 bp, Thermoplasma volcanium
ttgtttgagaaatattacagatccacggatatcgatccccctgcattaataacaaaaagagaagtgggatttatgacgtttgagggggaaatcattagacatatgcatctttcaaacaagttcgagcttaacaatatgttaaggaccactgtaccaaggcacgtctacagttctgcagcctattataaaaaaccggacgagaagaagatgccggagaagatatgggaaggcgcagacctaatcttcgatctagattcagatcatttaccaggcgccgaaaagatgacgtacgaagagatgctaaattcaataaaagaacagactaaacgtctagtaaacaaatttttagtttctgatctcggtataagcgaaaaggacatacgaatttatttttctggaagcagaggataccacgtccatgtttcaagtgaagatgtctatccgcttggatcggacgcaagacgtgaaataactgactacgtaagtggaaacagtctttcaatttccgtaattgataaagcattgaaaacgggggaaaagagacctggtggttggattaaggatgttatcagtaagttatatgaattgggaataaacgcagagaaaatatcacaaaagcaaatagaaagagccattgatcaagtaaaaagtcataatgcaaccatggttgacgctcccgttacttacgatatacatagattgataagaatgccccaaagtctccacggaaagagcggaatgatggtaaaagaggtagatctggacaaatttgatgactttgatcctctatcagatgcaataccaaagatttttttagaaggtgattacgatataaacgtacatgaaaaaacgaggaaattacgtttacttgactataaaatagatctacctccaggtaggaatagagtccctcaatacgtggccatattccttgtttcatctgggagggccgatttc

SEQ ID NO: 37277 - DNA, 1647 bp, Thermoplasma volcanium
gtgatcagaaatatgatgactggacaggttccaattctagttcttaaagaaggtacgcagagggaacagggcaaaaacgcacagagaaacaatattgaggccgccaaggccattgcagatgctgtgaggactacactgggcccgaagggcatggataagatgctggtagattcaataggggatataatcatctcaaacgatggtgctacaattctaaaggagatggatgttgagcatcccacagcaaagatgatcgttgaagtttctaaggcacaggataccgccgtaggagatggaacaaccactgcggtcgtgctctcaggagagcttctaaagcaagctgaaaccctcctggaccagggcgtgcatccaacagttatatccaacggatacagacttgcagtaaatgaggccaggaagattatagatgaaatatctgtaaaatcgaccgatgatgaaacccttaggaaaatagctttgactgccctctcaggaaagaacaccgggctctccaatacattcctagcggatctggtagtaaaagcagttaacgctgtagccgaagagagggacggaaagataatagttgataccgccaatataaaggtagataagaagagcggaggcagcatcaacgacactcagttcataagcggcatagtagttgacaaggaaaaagtacattctaagatgccagatgtcgtcaaggatgcaaaaatagcgttgatagactctgctctggaaataaagaagactgaaatagaagcaaaagtccagatatcagatccaagcaaaatacaagacttcttgaaccaggaaactagcaccttcaaagagatggtagaaaagatcaagaagagcggagctaacgttgtcctatgccagaaaggtatcgatgatgtagcccagcactaccttgcaaaggaaggcatatacgcagtacgcagggtaaagaagagcgatatggagaaactggcaaaagctacaggtgcaaagatagtcacggatcttgatgaccttactccatcagtactcggtgaagctgaaaaagtagaagagaggaagattggcgatgacaggatgacctttgtaacaggttgcaaaaatccaaaagccgtgagtatacttatcaggggcggaacagaacacgtcgtttccgaagttgaaagagcactcaacgacgccataagggtcgtagccataacaaaggaagatggcaaattcttatggggtggaggagccgtagaggctgagctagcaatgaggctagccaagtatgccaacagtgtcggaggaagagagcaattagctatcgaagccttcgccaaggccttggagatcatacctaggacgttggctgaaaacgcaggcatagatccgataaacactcttatcaagctgaaatctgagcacgagaaaggcaagatatcaatgggcgtagatctagacagcaacggtgcaggcgacatgtcaaagaagggtgtaatagacccggtaagagtgaagactcacgcactcgaaagtgcagtagaagttgctacgatgatcctgcgtatagacgatgttatagccagcaagaaatccacgccaccttctaaccagccaggccaaggagctggagcgccaggcggcggaatgcctgagtat

SEQ ID NO: 37278 - DNA, 783 bp, Thermoplasma volcanium
ttgactgttatttcaataattggtggaggcacaatagggtcgtccatagcaatcccgcttaagagatccggcttcgaagttatagtgactaggagaaatacagctgtactcaagcatcttgaaagctacggaatatctgttatgagtgataacaaaactgcgtcgaaggaggcagatgttgtattcttaactcttaagcctgttgacataatcccagaagttaggaagatagaggaaaacataagaggcaagctgctcatatctatggccgctgcaatacctctgaagttaataaaggatgcagctcctcattctatagttgtaagggcgatgacaaatattgctgctaaagtaggtgccggattcacacccttctgtgttgatgatggggatcaagaggttgcgaagagggcaagttcaattctttcagcattgggggaagtctacctggttgaagagaaatacatggatgcacttactgcactgagtgggagcggccctgcctatatacttactattattgaggcaatgatgtatggtggcctaaaattaggtttgccacgcgatctagccctaaaggcatcttatcaaactgttatgggatctgcaaagttactcgcagaaagtggtgaacatccatccgagttaaaagaaaaggtcattaccccagggggaactacaattgatggcatatacgagcttgaagacgctagggtaaggacagcaataatgaaagcaattgaagtttcaacaatgaaggcaaataaaatatcagaatctata

SEQ ID NO: 37279 - DNA, 1422 bp, Thermoplasma volcanium
ctcgcacttgatgcgggtactacagacgttaaggcaggagcatatgatcgatcgatgaacctaatcgcttcatgcaaaaggagaataggggtatattatggccaaggcggtgtagttgaacaggatccacatgaaatactcgaagctgctaaatactgcctaaactcaatcttaaggcgcataccgaaaagatacggggaaccaaaggcaatcggtattacaaaccagagggaaagcgtcttggcctgggaacctattgatggaaggccgatcactaaactaataagctggaaggacaaaagaggagcccagttatctcttgatctgaaagagcgttatggtcaagtgataaaggataagacaggcttaataagcgatccctacttttccgccacaaaaataaagtggttggtcgaaaatattaaacggagctctaaccataaaaactacgttattacaacactggattcatggttggtcaaaaatcttaattcgagttcgattaaacctttaacggatcattccaacgcgtctagaactatgcttttcaatatagattcattggaatgggatagcgatcttctcgaaattgtaggtataagtgaagaaatcctgccggaggtaaaacggacaattgagtcagattcatatggaaaagtgaaattgacctacggttcaactacacgtgaagttccaatattatctgttgctggcgaccagcaagcttcgctttttgggaatggctgcctttatccaggtcaagccaaagcaagttatggaactggtgcatttattttggaaaacacgggagttagagtaaaatcggatcgtctattggagacgctattttacacatacaagggcaagaggacatacgctctagaaggaacaatcctttcttctggttcctcaatagattggctagtttccctcgctgggcttaagagcgtgccaagatccatattgagagcggaacaaatcgaaaggagtcatgttttatcagtgccagcattatcaggcttagggtcgccattttattctagcgacataaggggatacatttctgggctatcagaatcaacggatatatatgaagtaataaggtcttttctagaggcgcaggcgtttcttagtacggtgatcattgaagaaatgaggaaacatattaaactattagaaccgctgcacattgatggcggcctatcgaaaagtgacttaatagcagagatgcttgctaatttgcttgatatgaagataatacgcgaaaggaatgttgatgccaccatgaaaggcatagcaatgatgtctatgatcggctattacggtatcgatgaacggaaattaacggtcagtgctggaggcaaagaatttaaccctaatgacaagagggacgaaatagctgaaaaatttaattcttggcgt

SEQ ID NO: 37280 - DNA, 1908 bp, Thermoplasma volcanium
cttccgacagaagaggtgtatcaccctgatatgaatttgtacaagagggcttacgatgattcgttcaaaaatatggaggctttttggtcgtttaatgctgaaatactaacttggtacaaaaaatgggatagggtgctagatgatacaaaaaagccattctataggtggtttgtaggcggtaaattaaacatgtcttacaactgcgttgacagacacatagagcaacacagaaggaataaggcggcatatatatgggttggtgagaaaggagatgaaaagatagtcacttacgatggattgtttcgcaggataaacaacttagctaaagctttaataaacttaggcataaaaaagggtgacaggattgtcctgtacatgccaatgataatcgaggcaccagttgctatgcttgccgcggctaggattggtgccgttttttctttcgtattcgccggttttggagctggtgctctggcagagaggataaatgattcaaaagctgtgctactcataaccgcagatggaagtttcagaaatggaaaggtggttgaactaaagaaaatagccgatgaagctctggaaatgacatctacgattagaaatgtcatagttgtaaagcacgcaggcaacaatgttgatatgaacgaagacagagacatatggtatcacgaggtagtaggggattcttacacatacgtagagccggtccaaatggatgccaacgatccgttgtttatactctacacgtcaggcacaacagggaagccaaaaggagctgtgcatagcacgggagggtatggtgtttgggttgcgaatactttgaagtgggcctttaatccagatgaagacgatagatggtggtgtgctgcggacatcggttggattacaggccacagttatatcgtatttgcacccttgatattaggtcttaccagcataatgtatgaaggatcaataacttatccggaacccgatagagtatgggaaattatagaaaaatacagaataaacatactctacacatcccctacagctataaggatgctcatgaagtttggcgataaatacccgaagaggcatgacttatcaacgctaaaggttctcggtaccgttggcgaacctataaacccttcagcatggagatggtattacgaaacgatagggaactctaagtgccccataatagatacgtactggcaaacagagactggaggctttatgattgctccacaaagggcgctagggcttcctcctttaaaacctggatcagcaacattcccgcttccaggcgtagatccagcgatactcaacgataggggtgaagaagttaaggataatgagaaagggtacatagtgtttagaaggccttggccaggaatgctgatgacagtaaacaatgacgatgagagatacgtgaagacgtatttttccaagttctatggctattacttttgcggagattacgccataaaggattccgacggttattactggctcctaggaagggctgatgaagtcctaaacgtagcaggacatcgcctcggtacaatagaagttgaagacgcattagtttcaacagggcttgccgttgaagcagcagcttttggtaaacctgatcctataaagggggaagttatagtggccttcattgtacccaaacaaattcaggctgaccgaagggaattaatttctgaaattagaaagcgaattagatctgatttagggccaatttacgtaccagacgagatacatattgtaaaactgcttccaaaaactagaagcggcaagataatgaggagagttgtaaaggctgttgcactggatcagataccaggagatctaaccactcttgaggactcaagctctgtcgatgagattagatcagcaatagaggcctttaggaaggag

SEQ ID NO: 37281 - DNA, 840 bp, Thermoplasma volcanium
atggagtacaaggaattcgggaatactggtgtaaaggtctcatctgttggaataggaacatactacgatccaggctggatggccttatcaaggttcaacgttaagagagatgctgagaaaaagatacaggctatacgtactgcaattgacgctggggtcacgttaatagatacagctgagatttatgggagtgaggatcttgttgcaaaggctattgagggccataatagggaggaactattcatcgcgacaaaagtctggataaatcaccttaggtacgacaaggtaataaaggcttgcaaagcaagcctctcaagactaaatacaaaatatgtagatctgtatcaaattcatttcccttcccctactgcaaaccttcaggaaactttcaaggctatggagaagttggttgatgatggcctagtaaagttcataggtgtcagcaatttttctagggggaaacttgagaaatctatggaatacgtgaagaagtacgagatcgtatcaaaccagatccactatagcctaaagaaaagggatgctgaagaggatatcgtcaagttttgcgaaaacaacggaatggccgtgctagcttggtatccacttgagcacggtagccttgttagggaatcagactatccaagtgagattcttgcgcgaataaaagctaaacatcccagcataacacccgcacaaattgcccttagctaccttatatatgggaacaaattagtctttccaatacctagggcatcaaatcctgaacatgttaaggaaaacatagcgtctgtggaacaaaagctagatcaggaagaaatagaagagttaagaaaatatttc

SEQ ID NO: 37282 - DNA, 1275 bp, Thermoplasma volcanium
tattataatttaccattatattcgaatatggtttcatctgaggtatctggattttacaagatgactgttgatgagcgtctaaatttcgtgaaggagttcagcagactcagcgatgatgatattcgcatattgagaaccaatggatccttagctattgacaaggcagataagatcatagaaaacgtgataacaactattgaaatgccattggggatagcggtaaattttttgataaatggaaaggactacctgatacctatggcaatcgaagagccatccgttgttgctgcagcttccaatgcggcgaaggtcgcaaggaagagcggaggtttcaacgcttatgccactgaacctgtaatgataggagaaatccaggttctaggcatagattcgctttaccttgccaagatgaatatacttagggataaatcgaggatactggaactagctaatacaaggagcaaaactctctcttcgcttggagctggggctaaagatatagaggtaaacgtatacgaaaggcctcacaggatgctgatcgtacacctaatcgttgatgttagggatgccatgggtgcaaatgtagttaacagcatgtgtgaatacgtagcaccggaaatagaaaaaataactggcggtagggtcaatttaaggatacttagcaatcttacaaagtatagggtggcctatgcatcggcagttttcagtaaggacattataggcaaggaagcggtcgataacatagttgaggcttataggatggccgtagtagatatatacagggcctctactaataataaaggtataatgaatgggatagatgcagtgttagtagcaacaatgaatgactggcgagctgcggaagctaacgcacattcctatgcagcgctggaaggatatgggccattggcaaagtatgagaagaactcgaatggagatctcgttggaaccatagaaatccccatagcagtaggaacagtaggtggaaccactggcagcatagacaaggcaaggatagccaggaagatcctcggcgttagcaacgcaactgaattcgcaggggtactggctgcggtaggcttggcccaaaacttctctgcagttagggcccttgccactgaggggattcagcgtgggcatatggaactgcatgctagaaaccttgcattatcggcaggtgcatcgccggaggaagtcgacagtgttgtcaatgaaatgatatcctccaaggaaatcaccatgagcaacgcaataaaaatattagagaaaatgagg

SEQ ID NO: 37283 - DNA, 900 bp, Thermoplasma volcanium
atgtctgatatttcgactacacttgccggaataaaactcgtgaatccttttatggtagcttccggcatactcgatgaaaatggctataccatgaaagaattgctggaacgtggggcagcagccgttgtaacaaaatccattggcatatctgagagggacgggtatccaacgcctgtcatagtagagtatggtgatagtctaataaatgcggttggcctatcaaatcctggcattgaaaactttggcgaagagattaacattgcgaaggaggccaaaagacctataattggaagtgtatttgcatataatgcagaagaattcactaaactttcggtgaagatggaggagtacggcgttgacgcaatagaactaaatttgagctgcccccatgtaaaggggttcggccttgaggttggttctgatccagatctagttgaagatattgttaacgaaattaaatcaaaagtaaaggtgcctgtatttgccaaacttagccctaatgtctccaacataattgaaatagcaaaagctgctgaaaaagcggatgcttatgtgctcataaacactgtaaaggcaatggcaatagatatatactctcgctcgccagtcctatcgaacctctatggtggcctctctggaccagctattaagccggtaggcataagatacgtctatgaagttaagaaagaaactggcaaggaaattataggtgtcggaggaatatcaaactacaaagacgcaatagaatatattatggcaggggcatcagctgtccaaataggaactgccctatacaagtacggaaaaggtattttccgtgaaatggagtggcagctccgcacctttatggatgaagaacggtttgaaaaaatagaggaaatggtcggggtggcgatcaaa

SEQ ID NO: 37284 - DNA, 1185 bp, Thermoplasma volcanium
atggatttcgattttacagaggatcaaaagctgctgcaaagtacagcaaaagactttgcagaaaaagttattgcaccaaatattgaaagaatgagaaaagacagacgcataccaaaagaagttttcgatgggttagcaaaaatgggttttttgggcatggctattcctgaaaagtacggtgggatgggaatggatgccgtttcaacaggtattgtcgcagagcaaattgcgagggctgatccaactgcatccataccagttctctttctagttgacaacgcatggtcgtaccttataagcaaatacggtaatcctgaagtcttttccggaatcctgcaaaaggttgctagaggaagccttataactggcataggctctacagagtccggacatggatccgatgtagctggcatagatacagtagccgtgaagaagggcgacgaatatattgtgaatggtgaaaaatcgttcataagccttgtaagggatatcaaggaaatcggaggaggctacgtaacagtggtaaagactgatccaaaggctggcgcaagaggcatttcattgctctacataccctattctgaggaaatagagatcggttatctcgaagaaatgggtagggaagggtcctcttggggcacactaaggtttaatgatctgcacgttccagctaaatacttaattggacaggaaaataggggcttcaatatagtgcatgaaggttttgaatttgccaggggcttaatctcggttatatctgcatcaatggccttaaaatcgatagaaaacggagctgcgtacatgaagcaaaggaaagcctttggaaattccattgcaaccttcgaggggcttcaattccaattggcagacgatgttgcaaagatggaggctgcacttaactttgcatacaaggcactgtggatatacgatcaagagcagagatacgggaaatatagcagattccaagtaagcaaaatgatagccatggctaagctcatatctaccacatggggattcgatgcagtcaatgatgctatgcaatggcaaggagcctatggatattcaaaggattgcccagaagagtgggcattaaggggaataagatccttccagctcgctgaaggctctagagaaataatgaaaatcataattgccagagaaaccttgggaaaggaattcataaaa

SEQ ID NO: 37285 - DNA, 3564 bp, Thermoplasma volcanium
attgttgatgcttattttaaaaaatatggaattgtaaatcatcagctcgattcaatgaattctttttatgcaagctctgataaccccaacagcgttatgcagcagatcgtagacgagactaaggtatcggacgatgcagacccggggttttttgttttggatccagctaagactggtgggcacgacataaggatatactatggccgtgtaagagaaaacgggcattatgtcggagaacaaacaatatttgtcggtaagcctgaaataaaagaagcttccggcgcttcgaaccagataacgccaaatgaggcacgtcttagagacctaaattatatggctccggttactttaaagctcagaatagttgaggacggtatagaaaagggaagcgaaaccataaaagttggagacatacctgtgatggtaagatccaaaatatgcacgttggctgaaggcaatttagatcagtatattgagaagaacaatggcccaattggcctttcgcgcagggaaaaactccaatatgttggtgaagaccctgacgatccaggaggttactttataataggcggatctgagagagtgatcgtttccctggaagatctggctcccaacaagataatggttgaatgggaggatcgctatgagagtaaagttgaggtcgccaaggtattctcacagcgtggaggtttccgtgccctaacatctatggaaaagggctcagacggaactataaatgtatcgattccaagcgtcgccggaacagtgccactagttatacttatgaaagcattaggtcttgaacgtgatgtagacgtccacgatgcaatagcatcagttcctgaaatggagccgatcatatacgccaacatagaggattctaaaaacccaaagattttgccgccgaacggggtaaatacgactgaggacgctatatcatacttagaaaagaggtttgctgcaggccaggcgaaggaatttagggacaagaagatatctcagatgcttgatcattcacttcttccacatctgggcgattcagcatctgataggattagaaaggctatttatcttggaaggatggcccgttctctacttgaactaagcctaggcataaggaaggaagacgacaaagaccacctggcaaataagaggataaagcttgccggggaccttatggacgaactgttcaggagtgcattccaatccgtgatgaaggacctaaaatatcagctagaaaaaacttacaacaggaagagagggataaagattcggccagccgtaaggcaggatctgctgacgcaaagaatactgcatgctatgtcaacaggaaattggatcggtggccgtactggagtatcgcaattacttgatagagtctctaatctaagtacaataagtcacctgcgcagaataatatctccgcttaccaggacacagcctcacttcgaagctcgtgatctacaccctactcagtgggggaggatatgtcccaacgaaactccagaaggccaaaactgcggccttgttaaaaacgcagcccttctcatcaacgtaactcaaggaatagattctgaaactgtgatggagatcctgaaaggtatggacgttaaggaggtcctagaggaaagcccaaacaagggcagagtatatctcaatggagatttcgtgggttaccacgacgatccaaggtatcttgtccggagattaagagaagaacgtcgtgcagggcgtatatcggacgagatcaatgtaaggtatgatgataacacaaatgaggtcattgttaactgcgataggggcaggttgagaaggccgcttcttgttcttaaggacggccgtaccgtgataaccgaagacatgatagagaagctgaggaaggacgagtacagcttcgaagaccttgttaaggttggtgcattagaatggcttgatgcagaagaagaggaagatgcatacgtagcagtgtatgcctataatatacccgaaaaatgcccacactgctcgagttacctatacagatctatggttgactggtctaacccaggctccaataatattatccttgagtgcggattctgttacaacaaattcgaagtcccatcgcttataactccggagcacacacatttagaaatagacccagcaatgatacttggtgttgtagcatcgataattccgtatcctgagcataattcttcaccaagaataactattgcatctgcgatggcaaagcagtctcttggctttgctcaatctaatgtgaggataagacccgatacgcgaggacacctgcttcactatcctcaggttccgcttgtacgtactcgtgtgatggaatacacgcattacgacagaaggccagcagggcagaactttgtagtggccgttctatcctatgaaggttacaacatacaggatgcactggttataaataaggctgcaatagaccgtggactaggaagaagcacattcttcaggacttattcagctgaagagcgaagataccccggcggtcaggaagataagttcgaaattcccactcacgacgtaataggggccagggcggaagagtattataagaacctcgacgaaagtggaataatatacccagaagcatatgtagaaggctctgacgtcctcataggaaagacctcaccgccgagattcctagaggaaggagaggaaaggctcggtccgcagagaagaagggagtcttctgttacgatgagaccaaacgaaagcggttatgtagacaacgtttttctcacagtttcagagagtaatagcagggtcgttaaaataaaggtaaggagcgaaaggattcctgaactaggggataaatttgcctctaggcacggtcagaaaggcgtcattggattagtagttccgcaggaagatatgccgtttaccgaggaaggtataataccggatcttatattcaacccgcactctataccgtcaaggatgaccgttggccatatacttgagatgattggagggaaaatagcctcaaggacgggcaagttcatcgatggtacaattttcagcggggaaccagaaaagagcctcagggacgaacttgtcaaatatggttttaggaagtctggaacagaggttatgtacgacggaataaccggacgtaagttcagggccgacatatttgtgggtgtaatatattaccagaagttgcaccacatggtagcaggtaaattccacgccaggtctagggggcctgtccaaatacttaccaggcagccaaccgaaggccgatccaggcagggtggtttaaggttcggagaaatggaaagagatacgttaattgcgcatggggctgcaatggtaataaaggatcgcttgctagatcagagcgatggcaccgtactttacgtgtgtggtaacccttcatgtgggcatatagcaatatacgacaggagaaagggaactcttcggtgtccagtttgcggcaatacaggtaacatctatccaatagagaccagttacgcctttaagctcatgagggatgagctgatatctctcggtgttgttatgcgtcttatgttg

SEQ ID NO: 37286 - DNA, 1518 bp, Thermoplasma volcanium
atgaagggatatgagatattcgccgaaagcctcaaaaaacttggtatagaagaggtatttggcaacccgggaaccacggagattccaatgctaagatcggtaaatgactatgtattaacgctgcatgattctatttctgtgggtatggctgatggaaaggcacaagtaacaggttcgcctacgctgtgcaacctacatacagttcctggaatagggaactcaattgcctttctgcacactgccttttataatcgatccccagtcatagtcactgctggacagcaggactataggcatatcttttacgagccaatattatccggagaccttactagccttgtatctggactagttaagtataaatacgaagtgaaacaggccgatgacatttacagatcgttaaaaagagcgtatcaaatagcagaggctccaccaaaaggtccagtattcctgagctttcctatgaatgtgatggatgaagaatacaatgaaaaatttgatgatttccataaaatagactacgaatggatagataagaaggctttaagggaaatagcagacatgataaatggggcgaagtatccggccatagtctttggatatgaaatagatctttacgacgcttttgaagaagcaaaggatttcgctcatgcacttggatgtcccgtttattgtgagccgttggcgagcaggggctgttatccatctgatgaccctcagtacgctggggatctcccacctgcatcggccctgttaaacatgaaacttatgcaacacgatcttgtcctggttgttggtggggatataaccctttatccttatactccaccacctccattgcaaggaaaaaccgttatatttgttggtacagacaactcgggaaagatcggtacacattaccagatgaatccaaaaatgttcctaagggagataatgggattggtacaaagaaaatgtaacttctcaagatcacctaattatacagtaaaaacttcaataaccttggctaggaaaaagatgggaacggcatacgtaatgagcaagatagccaaggaatttagagattatgtaatagtagatgaatcgatttcagcttcacaaactttcagaagttttttggtttacgagcataattcgtattttactgctaaaactggacagttgggatgggcattgccagcaggagccggtatgtctttaaaaaaaggaaaagtacttgccgtggtaggcgacggttcattcatgtacactcctcaaaccttatggaccatagaaaggtacaatctacccttgaagattataatattgaacaatggcggatatatgatactaaggagcttttcaaaaagctattataacgaggtagcggacaaagacttcttgaagccaaatattgatgcggagaatcttgtcaaagcatttcatataccggtaaaggttgctgatccaaatttaaaggatctgcagtggctaagggaaggtgatgaggcaagggtattgattataaatatggatcgt

SEQ ID NO: 37287 - DNA, 1056 bp, Thermoplasma volcanium
atggaatttcaaaaatacaggaccatgcattttcctagggacgtttatatagggcatgatgtcctgaatcgcgtgttggatgttgtagatcagaacagtaggacacgcgatgtgataatcgtaaccggaaatacgacatacgaacttgcgggtaagaaaattgtagagatacttgcttcatctccctatgaagttcacttatcattcgcaggcgaggctaattatgaaaacctcaagaaaattgaggaagagacgaatgatgtaaatgctggaataattattggagttggcggaggtactaagatcgatctcgccaaaaagcttgcctacgataagaatctacctttcattagcatacctacttctccgagccacgatggaattgcctctccgcgtgcgtccttaagaagaaatggcatatcctattctgaagaaggtgctatgccaattggtgttatagctgatacatctgtaatgataaaagccccttacagataccttgctgctggagcagctgatgtcatatccaacataagcgcagttaaggactggaaattagcgcataggttaaggggcgaagaattcagttcaagtgcagcggcgatgtccgaatactctgcacaggaagtaatatctcaggttggcgagattagaaagtatgatgaatcatctgtatggcttgtgacaaagaatatactagcttccggtacagcgatggctattgcaggaaattctaggcctgggagtggaagtgagcatctctttgcgcacgcgttagaagctgcaggagtaaataacatgctccacggagagatgtgtgcgatgggaaccatcgtctctctttatctccacgatgataactggcagaagataagggatgtctttgaatcgcttggggtatccgtaaaggccagagactatggcctcaaagaagaagtggttattgaggcccttcgaagagcacatgcgataaggccggagaggtatactatacttggagagagtgatatgtcttacgatgcagctgttaaggctttggaactgactggaattata

SEQ ID NO: 37288 - DNA, 861 bp, Thermoplasma volcanium
atgtataatgggatcgttacacctatgcttactccctttaacagggcaggagaaatagattacgatgcaacaaggctcttaatacaggatttgaaaggttacggtgtatctgggctatttccgatgggttcaactggcctattccctatgttcagcttggaagagagaaagaagtttttgcagtttgtgagcgaaaataggaacaatttgacagtatacgcgggtgttggttcatcaagcacgcaagagtccatagaactgtctaagtttacagaggatgtgggaattgaggtaagggtgctaatgccaacttactacataaagccggacgaagagtggatgtacaagcatttctctgaggtcatatccgcttcctctaacgacctatttatttataatatcccgcagcttgccggctcatgggtacctgagaatgtcataaaaaaacttaaatctgagttttcgcaggtaaaggggataaaagatagttctggtgatatgaggttcttctccaggatagtaactcttgtttcaaaggacttcagcgtatttcaagggcaggatgatcttctgcttacttctatggccttgggtgcaaacggcggagtatgcggtctctcaaatatttcaggaagtatagttgatctttacaaagccttccaatctggggatctaaagaaatctagagaaatacaactgaacaaagttaaccctcttatgtatgcggttaatgcgcctacgttcccttcggggtattattatgctttttataaaaagcataacataaacggtggatacagatcgcctatggttcaaccatcaaaggagcattccagggtaatagatgaggcaacatctcaa

SEQ ID NO: 37289 - DNA, 1764 bp, Thermoplasma volcanium
atgaaattttcactggtaacggacgcttttgagaagatgtcaaagacgactaagcgcacagaacttacggaaatattggtagagctccttaaatccgcagatgaagacttacaatcccttgtttatctaattgagggaaaacttgctccagattaccagggcatagaaactcagatgtctgataaactcataataaaagcactctccatagtttcaaatataccggaggaagctgtatcagaaacttactccaagctaggagatatcggatccgtggcaagagaaattgcagcgaaaaaaaacatgagatctctcgtgaatgaggatttaaccgttaagtacgtacacgatacacttatgagaatggcgaaaactagcggttcaggaagtacaaaggctagaatagatgcctatgtagacttggctcttagcgggactcctgccgatctcatgtatataactcggataataacaggaaaactccgtattggtgtatccgatgcgacaatacttgacgcaataatcctggctttttcagatgaaaagtacagcgaggaaatagagaatgcatataatttccatcccgatctcggatacatagctgtacagttaagattaggaaacttagaatcagtaataaacatgggccccaccccaatggttccgtttaaggtaatgttagctgaacgactacgttctgtagatgaaatagtccaaaaaatgaacggtaaatgtgctttcgaatacaagtacgacggtatgcgaacagagatccatatagtagatgaaaaagtgaggttgttttcgagaggaaacgaagaaactacaggtcaatttcctgatatagtgaaatcggctaaagaaactttccatgtctcttctgttatactggatggggaagctgttccctacaacccagagacaggggaactttatcccttccaggttatttctcagagaaggggccggaagtatgacctcgataaagtttccaacgaaattccaataaccgtttttctcttcgatatagtatatatcaatggaaaagatctgtcaaagactccatatgctgaacggcgcaggatccttgaaggtcttttcaaggaaaatgacaatttcaaactggctaagaggattgtatcaagtgatactggaaccataacaaagttctttaatcaagcaatagaagacggatgcgagggccttgttgccaagagcatggccgatgattcttattataaggctggtgctaggggatggctttggataaaactaaagagagactatcaggcccagctttgggatactattgatctaacggtagttggtgcattcatgggccacggaagaaggagtggaacgtacggcgctttgcttcttgcaacttataacgaaaagaatgatactttcgaaactgtgtgtaaacttggttcgggatttacagatgatgttctattttcgttgccaaaaaggtttgctgagtttgtcagcaaagaaaaaccagccagagttgtaagcactatcgaaccagatgtttggatatacccctcaattgtcatggagataataggcgctgaaataacaataagccctgtacatacgtgtgccttcggcataatagaaaaagatgcaggcttgtctataagattccccaggttcaccggcaaatggagagacgacaaaaaaccagaagattctacaacaactcaggaaataatagaaatgtacaaggaacagaaaaaaacattaacagaagagaagagt

SEQ ID NO: 37290 - DNA, 1323 bp, Thermoplasma volcanium
atgaggtacgtaatagcctccagtaggtgtcccttttcgcatgatgttgtaatgggtagagaacttgtcaaagagaatgttggcggcgtagctaccgcccttaaaagggcaatatctaaacatggtgggacgtggatatgctggggagacggaaaggcagataaccgatacgttaacgaggatgttgggacttataaaataaaaaggataatactgaccccacaagagaagagaggatattatgacatgtattcaaacagaactctgtggccgctcttccattattttagggagagagtacagtatacagataatggatacgagacatacagaaaggtaaatgaaaaatttgcagaggagatacttaataatacgtcacaggaagatatagtttgggtacacgattatcagctttctctcgtacctggaatactacggcaaaaaggccttaaaaacaggatcattttcacttggcacatcccgtgggtatctagagagatgtttgaaactcttactgaaagcgatgaaataaaggaaagcgttggttcagcggattttataacatttcacactgacctatacagaaagaactttgaaagcctctttgaaaatagaaaacatggtaagtctatagctgtgcctcttggtatagactaccgatacttcgaaaaggctaagtcaagtcaaattaaaagttacgctcttaaagacaaaataatgctattctctattgatagattagattacaccaaagggcttacaaatagagttctctctatagagagacttattcgaaatcatcctgaaacatcagggaaatttgtttacgtcatgatagttacaccaagcagaacttctgtatcggattacgtatcaatgaagagagaacttgaaatgaatataggtagagttaatggagaatttggaaccatttcctggatgccaatactatatatgtacagaaaaatttcagatcattcgctagtctcatactataagtccgccgatatcgctcttattaccccgcttatagatggcttaaacttggtcagcaaggaatttattgcatctactgagaaaggcatacttgtattatctaaattcgcaggagcttcaaattgcctcagaggtgcgcttatagttaacccaaatagcccggatgaggttgctgatgctatatacaaggcgatgaacatggaaagaaaggaagctgatgagaggcttttaaaaatgaaggccattgtcaaggcaagagacacggattggtggataaaaagaatatataggttagccatcgctaaagaacatgatagacgggttact

SEQ ID NO: 37291 - DNA, 657 bp, Thermoplasma volcanium
atttttttagactacgatggaacactcgtccctataataatgaacccagagcaaagtttagctgatcctgaattaatagagatgcttaccgaattgagatctaaatacaagctttttatagtatctggccgttccccggaagaaataaagagatttattcccctggatttaaaccttatatgctatcatggcgcctgttctatagtgaacggcaaaacgtactactataacaatgcccagtctttcttaggcatatttaacgagatatatcaaagttcattaaatctagtgaatgaatttccaggtctaaggatctacaaaaagaatcttgccgtactgtatcattttgggcttatgaaaccccaagatgttcccgcattggaaagggttattgtagaaatatcccaaaaagaacacgtagatgtgtacaaaggaaagatgatatttgagctccgtgttcccggcgtcaataaaggcatagctattaaaaatgttagagacgaagaaactgcgcttattgctggagatgacgctacggatgaatgttccttcaaatacaacgaagatgcaataaccataaaggttggccctggtaaaacctcagcacatttcagagttaatgactattccgagatgagagaagtgttgaaactccta

SEQ ID NO: 37292 - DNA, 1296 bp, Thermoplasma volcanium
gcaaaatatttattaattgtaataagttaaagatatatgaaatcgaagggtagagacgtatacatggttgccggaggtgtaacaaagttttccaaggcttctccggacatggattttcgccttcgtgtaaagaaggcatttgactacgccatgaacgacgccggccttacattggccgatatagatggatccgtggcctcctatttttcggaccacttccagaggcagcttatggcgggaataatggtgcaggattaccttggattagtaccgaagccaagcaagagaattgaaggcggtggtgcaacagggggtctggctttccaagcaggatacgaagagatagcatccggaaggatggatgcagtcgtagtttacggattcgaaacaatgtctcacgtaaatacgtggaagggaaatgagttcatcgctctagctagtgatacaaatttcgactatcctatcggcggtttttataccggttattacgcgatgatggcagtccgtcatatgcatgagttcggtacaactgtcgaacagatggcaaaagtatctgtgaagaaccatggcaacgcaattcacaacccctatgcgcagagcccgatgaagatcacggttgaagatgttaggaaagcgcctatggtgtcttaccccttaactaggctagatgtatgtgctatgtctgatggtgcggctgtagccatacttgcatctgaagacaaagcgtttgagataacggatcatccagtccttgtgaaggcaataggtactggtaccgatactatgagactttcagataggccatttggtgaagtacctctcctccccaatgaaagcccatccgattacaaaggtctgaaatatcctggcgtacattcattcagggcaggcagaatggcggcaaaggaagcttacgaaaaagctgaaataacggatccgatcaacgatctagacctgatcgaactgcacgatgcatacacatcgtctgagatccaaacctatgaagatctcggtttgtgcaaatacggcgaaggtggccaattcatagacgaaggaaagccagaacttaaggggaagatccctgtaaatccgtctgggggacttctagctgcaggtcatcctgtgggcgccacaggcataatgcaggctgtcttcatgttctggcagttgcagcacacaatcaagaagcacttccacgacgattatctgcaggtacctaacgcaaagcgtggcctcatacacagccatgccggtacaggtacttatgttactgtaacaataatggaggcggtaaaa

SEQ ID NO: 37293 - DNA, 1755 bp, Thermoplasma volcanium
attgcttctgatctagtttggagaaagaaatgggataccgtaatggaaggcagacttcctgaattttcctttttcaagggaggctatttaaacgttgctgaaaacctcatagatagacatatagaagctggggaagctaatagagctgctttgatatttgagagcgaaacagggcgaagcgctgtatatacatacgcaatgctgcaatctattgtaaacaaactttcaaatgctctaagaagcctaggcgtaaagaaaggtgacagagtctctatatttctgccaaacatacctgaaacattattcagtgtgctcgcgtgctacagggttggtgctgttttcaatacaatattttctggtttctctacgcaggcattggagaacaggttaaagcattttaaccctatgataataataactgcagacggaacatacagaagaggcaaactagtggagttaaagaaaaaagtggatgagattcgagattctaattttgaaaagatcatcgtagtaaaaaatgtagggctcaatctgaattttacagaaagagatttagacttttacagcctaatagcgaagtttaacgataaagacaaagggggagatgtcgaggcaaacgagcctggcatagtcttttatacatcaggtacaacaggtaagccaaaaggagtggtgctttcgggtgccggatttctggtgaacaactacgtgtatgcaaagcaccacctcgatttgagtaaatctgatgtactttggtgcacagctgacataggatggcttactatgcatatatggggtataattggggctcttgctaatggctctacgactctattttatgaaggggcaatcgattacccttctcaagatcgtttctacgaaatagtgcaaaaatacaaagtaacaaaaattttcacagctccaactttgataaggatgctgatgaagtacggctttccagagggcaagtatgatgtttcatccgttcgtgtaataggactagtgggcgagccgttgaatccagaagcgtggcactggatgaataaacacttcagatctgcatacattaataatacgtgggggcaaaccgaaactgctggaactccgcttgcaggatctgcctttgctactggcatgaagccaggatctagcggcatcgagttcctgggagcatccttggatgttgttgacgatgagggtaatccagtgcttgaacgtccaggaaatttagtaataaagaaaccgttccctatgatgatccgcgatctatggaacgaacacgaacgtttcttaaaagaatactatggaaagttagaaggattgtatttcacctatgatgttgctgtaaaggataaagatggccacttttgggttctcgggaggaatgatgatgtaatcaacgtttccggccatagactgagcacgatggagatggagagccttgtagctagcgtaaacggaatagctgaatgtgcagttgtaggaatccctgatgaaatcagaggtctcactcccgttgtattcgtttcattgaagaatgatatatcagcgacaggcattgaagaaactatatcaaagatgattgaggagggcattgggaagtttgcagcaccgtccgatgtaatcgttgttgaagagatgccgaagaccccaagtggaaaaatactcagaaggttccttagggagatctatgtttatggagacattgtcggagaccgtaccggccttgaaaatccggcgtctatagaaaaattg

SEQ ID NO: 37294 - DNA, 1830 bp, Thermoplasma volcanium
tttgtttataagcctgatgaagcggagatagcatcaacgaatttggggatgtttgcttcttctgttggaatcactgtaaaggaactctacgataaagcagattcagacccagaatggttttggcctcaggtgattaaagatactggaattgaattcttttctccatacaaaaaagtttttgacaattcaggcgggccgcaacatacgaaatggtttactgaaggactcataaacatagagtataacgcagtctcaaggtataaggattcgtcaaagcctgcagtaatttaccagaatgaatatctcgaaagggaaacgctttcctattccggactcaatatatatgtatcttctgttgcctctactcttcttgatatggggatacggaaaggcgatagggttggcatctacatgccttttaacttaaagagtgcaatcgctttctattccatacttcgaattggagcagtagccgttcctatgttctcaggatacggctatgaagctgtaaaaacacgcgttgaagatgctggagtgaagcttctctttacatccaaaggatactccagaaaaggaaaatttgtcgacatgatgtctgtagccgagaaggttggcttgcccataatagctgaaggcggtagcaaaaaaggctatagtttcgaagatgctatgcatgggcagaagcggatagagacggagaaaacgggatcggaagacacagccataatgctttatacatctgggacaacaggaaagcctaagggaactgtacacgtccacggtggagccttgattaacatagccaaagaggtgaagtactatatggacttgaaggacggtgacgtgcttcactggataaccgatcttgggtggatgatgggcccgtgggccttaataggtacgaatgtactgcacgggacgatttatctgtatgacggtgctgtagattatccggatgcctctagactcttcaccatacttgaagataacaacgttacactgcttggtctatcgccaactctcgttcgcatgctgaggtataaaaatattgagagaagattcaatacagtaaggctctttggatctaccggcgaaccttgggacgacgagtcgtggagctacttgttcaatgttcttggtggaggcaaaacgcctatttcgaatatctctggaggcactgacattatcggctgcttccttgcatcgaacccggcaataccgattaaaccgaaatgcctctaccgcgggctcggaatgaacgcatccatatttgacgaaaacggaaaagaggtctatggaaaggtcggttatcttgtagcaaagaagccatcaccttctatgacgcggggtttgtggatggcagaggaccgctacctcgaaagctattggtctagatttcagggtgtttggtttcacggcgactttggagaaatggatgaagatggctatttttatctctatggaagggcggacgatgtgataaaggtagctggcaaaagggtcgggcccaacgaattggaagatattgtaatggcagtgaacggcgttatagaggcagctgtaatttccataccagataaaataaagggtgaagctctcgctgtgttttacgttggcgaaccggatctatcaggtaggataaaagacgctatagaatctaagatgggaaagccattctcgccgtcctatgtgctgcgattgagaaaactgccaaagacgaggaatggcaagaccatgaggcgtgttataagatcctcattccttggccaagaccccggagacttgagcaacactgaagacctagattccattaaagaaatagaagaactc

SEQ ID NO: 37295 - DNA, 1143 bp, Thermoplasma volcanium
atgcacagttatgtcgatgcggatgatctgcttaggaactctataaaggaattcgtaaagaaggaagtagaacccataaggatgaagatagacagggaagattattttcctgtggacgttttcaaggaaatgggaaagctcggctacctcggtgtaaccatacctcaggaatacggcggatcggatgcgggatatattacacaggctgtgatagaggaagaactaggctattcatcaccttccctcgccttatcctatggtgcgcacagcaacttgtgccttgataacgtttataggaacggatcccaggctataagggaaaaattcgtacctaaacttgcatccggtgagtggataggttcgttatgtttgacggagccaggttcaggttcagacgcgcttgctatgcatactacgttgcacgatcacggtggtcgaatttttctgacaggaagtaagacgttcataactaatggcccgtatgctgatctgtttctcgtgcacgctaaagatggagattcatacacttctgttattgtactttcatcagataaaggctttgagcgtggaaagaagtttgagaagatggggatgagaggatctccgacgggagaactgtttttcaatgatattgatataggaaatgaaaggatagttggaaagagaggcgatggcaaaaggataataatgtctggccttaattcagagagggtaatacttgcatttatatttgttggactggctagaagggcactagatgaggcagtaaagtactcaagtgaaagaaaacagttctccctgcctattagtgagtttgagctaatacaagagaagctcgcctatatgtatacaaagtacgaaacaagcaggattcttgcatatagggcattggagaagctagaaagcagcagggacgatcctttatacgcagcagcagccataatgcacgcatcagaatcagcagaatacattgcgagggaagcaatacaaatatttggcggatacggatacataaaggatactggtattgagatgttcctgagggacgcaattttgggccaaataggagctggtacgacagagataaggaagaggatcatagcaaagagcttgataaggaaatataagcttggagaggacatt

SEQ ID NO: 37296 - DNA, 1224 bp, Thermoplasma volcanium
atgatcagcaagcttaaaatgcctcagcccactgtaaacataggtatggtgggtcacgtcgatcatggcaagagcactttaactctcgccctgacaggcgtaaagacggatacgcattctgaagaaataaagagaggaatttctataaagctaggttatgctgatacgccggtttataagtgttacgatgcttctgggaatccttattatacaaggcaacccagtgagaattgcgaacttgaacgtgtgatatcgattgtagacgctcctggccatgaaacgcttatggccactatgctatctggttcggccctcatgaatggtgcgctattggttatagcggctaacgaacattgccctcagccgcagacaagggagcaccttactgcattagagataatgggcataaagaacatagttattgtgcaaaataaaatagacttagtaacaagagagcgagcactggaaagttataaagagatcaaggcatttgttaagggcagcattgctgaaaatgcacccataataccggtcagtgcatatcataatacaaatatagatatcttgtttgaagctattgaaaagtatatacctacacccgagtacaacgaaggatccgatccgataatgtatattgctagatcctttgatgtaaataaaccaggtacgccaatcgatcagattaagggaggaataatagggggttcccttacacagggatcactaaaaataggcgatgagatcgaaatagtacctggcatacaaaataccaggggaaataagactgtttggaccaatgttaccacggaagtggtaagccttatggctggaaaatattcctatgatatgataaaaccaggcggccttgccgccgttggtacaaaattagatccattcttgacaaagggagatgcgttcactggcaggatagctggatacataggcaaggtgccgcctatctcgttctcaatgaggctggaagcacacctgcttaagcgtgttgtcgggtcagaccaggaacttaacgttgagcctataagggcaaaggagaccttgatgtttacagtggctactgcaaatactgttggtgtagtaagcaacgtgaaaggtacggatatagaagtttctctaaaatatcctgttgctgcatttaacggaatgcgcgtggctataggaaggcgcgtattgaataggtggagacttatagggtacggtgtaatagaa

SEQ ID NO: 37297 - DNA, 1302 bp, Thermoplasma volcanium
attaagaccttgaatccatatacgggagaggtcatagccagttacaatgaggaagacaaagaacaagtgattaggaaaataaaggatctaagagagtaccaggctaagtggagaaagaatattggtgaacgcatagaggtaataaaggcggcaaaaaagaattttgaaactcaaatagacgatctttcaaagcttatgagcctggaaatgggaaaaccaatttcccagagcatctccgaggtaaagaaatctatttggctaatggactatgtaattgagaacgcagaaaagttcctggcgatcgaagatgtaaagaccgaagcacgaaagagttatgtgagattcgatccaattggagttatcctaattataatgccttggaatttccctgtctggcaggttatgagggctgcaattcctgccttggcagctggaaatacagtcatactcaaacatgcctctatagtttctggaacaagccttaaaattcaagatctgcttaatacagatgcatttagatccgttataacgtctggtgaaactgcttcttcggtaataccagaagtagatggagtgtcttttactggatctacttcgacaggctctaggatagcagagattgcggggaaaaatataaagaagtttgttatggagcttggtggttcagacccatttatagttttggacgattataatttagaagatactgtaaaaaatgctgtttttggtaggcttcagaataatggccaaagttgcatagcttccaagcgtttcatagtaaacagaaagatcggggagaaatttgtggaaatgctaaaggatgaattttcaagggtaaaaataggagatccgctgaactctgatacattcctagggccgctctctagccaggatcaaaaggaaaccgtactaaggcaggtatcggatctcaaaggaaaatcggaattggtaatcggcggagattatcagggtaacatagtaatgccaacaataataaagactgacgtaaggtataatgaggagatctttgggcccgtagcggttgtaaaatactttgacaaaccggaagaagcagtcgagatatccaatgagacaccgttcggtttaggggcttcgatatgggggaatcctgatgaggccgaaaaactcatcccagaaatacaggccggaatggtgtttgtcaacaagatagttgcatcggatccaaggctgccattcggcggtgttaagaaaagcggagttggtagagaattgtccagatatggaatgctagagtttacaaacataaagaccgtctggata

SEQ ID NO: 37298 - DNA, 1251 bp, Thermoplasma volcanium
gcttttgtcataaacgtaccgaaaataaagtttgggatgaatactacgaaagaagttggaaaagacgctgttgggcttaagatcaaaaacgctttggttgttgttgggcccagactgaaagactcaaagcaattccatgatgtgttgtcatcgctctctgaatctggtattaattatgcagtgtttgatgaggttaaaactgagccagatgacgaaaatctaacaaaaggctatgaggccataaagggaaagaagatagatggcttaatctcatttggaggaggctctacaatagataccgctaagatactcaatctgctctacaagtatccccgtgatatcaatgactacattaacaagcctataggaaagggtatgattccagagggggaccttctcccacatatagctatacctactacggccggaactgggagcgagacaactaacgttactatatttgatgtagagcgcttgcatgtgaagacagggataagcaatcccttcataaggccaagcctagccataattgatcctgttaatactctaaccatgccgccgaaggtaacggcatcgacaggcctagatgtacttaaccacgctatagaatcctatacctcacacccatatacagctaggccgcctgtagcatcacctgatgaaaggccagtttactctggaagtacgccaataggagatctctttgggttgcaggccatagagtgggtgcacaagtatctaagaagggcctttgcagatccgcttgatctagaagccagatattatatgactatgggggcaagcatagcgggaatgggcttcggccatgtaggtgtccatataccgcatgcgatggcttatccaattgccggaatgataaagaagtggcatccagatgactacgacttcggctatccaatatcgccacatggaataagcaccgccataccagcagcctacgtttttaggtacctatcaaagtttgtccctgaaagatttgctgatgttctcacagcgctgggttacgatacagaaggtatgagtgcggaagacattggagataccctgtacggctactacatagacctgctccatgccctaaagattccagacaatttatcagatttagactttacatcttcggacatcgaaaaattggtagatggaacaatggctcagcagaggcttataggcttatcaccgaagaaaattgataaatcagatattgaattcctattcaaggaagcgatg

SEQ ID NO: 37299 - DNA, 996 bp, Thermoplasma volcanium
atgaatgcctttttaaaggctcttcatgggctcgaccacgattatattccagtatggttcatgagacaggctggtaggtatttgaatgtttacaaagattatagaaaaaaacttgggctggaaggcatgatgacagacgccgatgttatagttaaaattacacactctcctgtagatatgatcggagtggatgctgctataatctttgctgatataactacacctctaccaggtcttggtttcaaggttaggttcgaagataatgtaggccctattgtgctgaacaatttaagcgataacgggttttccggaattaatgaattcgatgaagcaagttttaatcatcctgtattgaaagcaatatctatgtacagagagatgtacagagaacctttgattggtttctgtgggtctccagttacacttctctcttatcttatagccggatcttttgacaaagatttggccaagacgaagcggcttatgcttacagatccctcaaaatacaaagaaatatcaaccttgcttacagatgcctccgtaaagtacgcaaagctgcaaattaaaaagggcgtggatgcctttcaattgttcgacagctgggcaggatatctttccccacgccagtataaagaattcgccgttccatacataaacgacatactaagtgaaatcgcagggaaggtaccgaccatatatttcagtacaatgacatcctctttcgtatttcaatccggcatcatttccgatttcatttcagttgactggagagtagaaatggataaagtagtaaaagaatcaggcgactatgggctccaagggaatctagatccatttatagtcaactatgattatgcatttgcagaatccgaacatataataaatgccgtgaaaggaaataatagatacatattcaatacagggcacggcatactgcctgatacagatccaaaaaggttaatagaaattgtaaaatacgtccacagcgtgaatcta

SEQ ID NO: 37300 - DNA, 876 bp, Thermoplasma volcanium
aaaacagcagttctgcttctctcctacggaagccctgagaaaatgtcagatattgatgaatacctttcaaaaattttcggaggaaagcctgttccaaagggcgttgcagaagagaattacaggaaatacgaaatgttcggcggactctcaccgtcaaacaggataattcagagcattagggataggcttcagaaaaggttcgatcaaagcggggatgtggatgtattcacagccttcaagcattggtatccctccatcggagaggttgttccagatctgaaaggttacgacaacatagtttctatcccacttttttcctttttttcagaaaatgtaaaagcgagttattataagccccttgccgaagcacttgagaaaaatgacatacgaactaagatggagtttgttaacggcataagcaattacgatctcttcatcccaatgtggatacatctaatagaagagaaagaaaaaggtgattcattctatctcttcgatgcacatagtctcccgcatcctgaaaacgaagaggattatctcttctggctcaggtactcgacgtacaagataacccagataatgggccttcgctcttctgactttggatttcagggaggccatgaaggatggctaggcccgagtatatacaacgtctacagaaaggccaaggagaagaagataattgctgttcccatatccttcctctacgaccacttagagattctatacgatctggattatgaattcaggaaaaagatcgaggaagacggctattcttatgaaagagtgccaatgccaaacgattcagctatcttcataactctgctcgagaggatagtttcatcatctataactcaccttagcggggaattaatt

SEQ ID NO: 37301 - DNA, 2349 bp, Thermoplasma volcanium
atggatttcagtatagaagaatatgatttgaccttcgattttgacctcagtgagttcacctatcgtgggaaagaaaaaataaaactttctggtgaagcaaacgaactcgtacttgactctgtcaggttatccatagatagcgtcaaattgaatgggtcagccgttgattttgatgttaacgacaaggcgctcagaatagaaagcagaattaagagtggagatgtagtagatatcgactttcatgcaaaggtaagcgacacactaatgggattatacctttcgaagacaagagaaggtaccatgataactacacagttcgaatcaacaggcgctaggatggcttttccctgtattgatcatcctgcctacaaggcagtcttctcaataactcttgtaatagacaaagactacgatgcaatatcgaacatgcctgtaaagaaggtagagacatctgacaggaagatagtggagtttgagaagactccaaggatgtcaacctatctgctgtacataggtgttggaaagttcaagtatgcatcagaacgttacaaggacagggagataatacttgcatcccttaaggacattaagtcgaagtatccaatcgatatagctaaaaggtcaatagagttctacgaaggttacttcggaataccctatgcactgccaaagatgcacctgatatcagttccggaattcggagcaggtgcaatggagaactggggtgcaataacatttagagagatcgcacttatggcgactgaagattctggatcccttatgaagcaaaatgcagccataaccattgcccacgaaatagcccaccagtggttcggagatctcgtcacaatgaagtggtggaacgatctgtggctgaatgagagttttgcaacattcatgagttataagacggtcgattcgttcagcaaacagtgggacgtattttccgatttcataaagagcgagactggcggcgcacttcgctcagattctctcaagaatacgcaccctatagaggttgatgtaaaggatcctgatgagatatcgcagatatttgatgagataagctatggaaagggtgcgtcaatactcaggatgatagaagactatgttggtgctgaagacttcaggaagggcatatcgaaatacctaaaagaacatgcatatggaaacgcagaaggctctgatctatggaatgcaatagaaacagaatcaggaaaaccagtgaacaggataatggaggcatggataacaaaggcaggctatccagtattaaaggtaaacaaagacggtaataggataaggctaacgcaggaacagttttacctggacgggacaagtggaaacacggagtggccaataccgctcaccataataacaaaaaaaggcaaggtatctatgctaatggaggatgaagtgtacatagacgaaatgctcaaactaaacgcaaacaacagcggcttctacagggttatgtatgacaatgatactttcaacacggttataagtagcttagacaaattctcaaatctcgacaaatggggcctcttaaacgatatgtatgctttcttagtatccggcaggctctcagtcaacgaatatgtggaaaggataaagaacttcctaaatgatgaagatcacctggttgttgaagaaatagcttctcagcttacctccctatatctgataaaaccatcctctcaagtggtttatcagcttgccaaggactatcttaggaatcaagttcagagacttggaacgaaaaagaaaggtgaagacgacaagatctctaagctaaggggtatagtttaccaggacctcgtaactgtggatgaggattttgcaaaggagctttctccgcagttcgccagcctgagtgaggatcccgatcttgccttggcaaaagcagtagctaaagcgagaacagatggcctaaatgaactcattgacgctgcaaacaagtatacagacgatgaaataagggtaagagtgatagctgccatgggttggtgcagcaaggaccagctctccacaatattcagtcttatcgacaacggcaccattaaaaaacaagacatgctatatgtattttctttcgtggttacaaatccgtcaggaagagatttcttcttccaaaatattgacaaaatcgtctcgctgatggaacatgcgttcgaaggaacaggttacacaagtaggatacttgagggttccattccgtatataggtctcgaaaagtatgaagaaatcaaagctaaagccagccagatcagaagcccaagctacaatgttggaatagataaagggctcgaaactcttgaaataataagaaagttatataataaatta

SEQ ID NO: 37302 - DNA, 2250 bp, Thermoplasma volcanium
cttctcgaagaaattgatgggttcttaaaaacatttggagacggaatgctgaaggataggattagctattcccttactagagatagatacgactctatttattataaaaaattaaatatgaaaaaaataggtcgatttctatctgcagaaaaatcgaataaatatgtatacttccactttgaaaattatgaccttaaggtagaggcaaggggcgacggcgtctttaagttttcctggacagacggcccgaaacttcccgtggagaacatagaatttgatgatctgcagctgcacgataatacggtgtctgtaggaaattattccatctcacttgatgagaatggattgtatctgaaagatcaagacggaaagttgatttatcaggggtatattccagatttcaacgaagtcctgtctcagagcctgagaatattcggtgacgatctattttctggcctaggcgagaaggctggaccaataaacctaagaggtcacgtttatagactctggaaccacgatgcaaaaggatcatacgggccagattctgatccattatacctaaatatacccgttctgctccacttgcatgatgatgtttcgtacctaatctttttcgagaatgcaggagatgcaaccgtagatatagggttctcaagagaagataaagtgacgttttatttcaaatcgaagcccatggtatattatgttataacaggggatataaaatcgatatattctaagttctcagaaatcactggaaaaccgtacaggccgccatactgggctttcgggtttcagcagtcaaggtatagctatatgagctctgcagaggtaaggtctatagtagataggtttaatgagcttggtatacccctgtctgcaatatatttggacatagattacatggatgaattcaaggttttcacctttaattccgatagattctgggacgtgaaagatctaacgaaatacttgggagaaaggggagtccgtctgataacgataatggaaccaaacgtcaagatggaaccaggatacacaatatatgacgaagctgttaaaaatggttatttcataaaataccctgacggaaatatattctatgcacccgtttggccgttgatggcagcttttcctgatttttctcgcaatgatgtaagggagtggtggggaaaaaaatacgacttcatgaaaaagaacggtgtatccggattttggcacgacatgaacgagcctgccatattcgtggcctggggtgacaacagtatggcactatcagcggcgcaatctaatggctctcacagcgaagtccataatctcttcggttactatatggataaggccgcgtatgaccacttatccaaaacggaaagaccattcatactttcacgatccggttgggctggaataagcaggtacgcatggatttggaccggtgatactgaaaccagctggaaagagatgaagcaaaacctgcttactatacttcacatgtcagcttctggaatttcactaactggctgcgatattggtggttttgttggatctcctgacgctgaactatttattagatggctgcagtcagcgattttttacccgttattccgcgttcattccaataaaaagtcaaagaggagagaaccgtgggagtttggagaaaagtacttgggaataatcagagacataattaaacttaggcactcattcctcccccagatatacagtgaggctatatcttcatccattactgggatacctatgatcagaccagtatactggtatagtagcaatccggatatgcttcttgtcgatgatgaatatctctttggcgattccatacttgtagcacctattttttcagagcattcaacttcgaggatagttaagcttccacccggattatggtataacctatacagtgatgaaaaggtatttggtgaaattaaggtagaagcgcctcttaacatgatacctatatacattagatccggatcaataatagcaagggatgaggggaaattaatcctgcacgtattccattccgaagagggagaatctgcaaaaatttacatagatgctggaggagaagactcagaactcgatatttctgtatcaaaagacggaaaaataaatatacatcgtggaagtagcatcaaagcggttacaattaaattccacggagtttacgttaagggcattactataaacggaaatactaagtacatagaagataacttattcgaaatagaa

SEQ ID NO: 37303 - DNA, 1110 bp, Thermoplasma volcanium
ttcgaagaatttaatttaaggaatgaattgattgaaagtataaggggcacgggttatagtgagccgactgaggttcagtctatggcaataccgattgctcttgcaggctctgacttagttgttaggtcaaagacaggctctggaaagacggctgcttatttgatacctataataaacaacacagcaaaggaaaagggaataagagctcttattcttctaccaacaagggagctggcggttcaagttgcaaaggtttctgaggctttaggcaaaagatctggaataaggactgttgttgtatacggtggagtatcaatcaataaacaaattgaactgatattgcgcggcgctaatataatagtcggtacacctggtagaactcttgatcttatagatagggggatcttaaattttgataaggtctcctattttgttcttgacgaagctgatgaaatgcttgacatgggatttatagaggatattaagaagataataaatgtactcccagttgaaaggcagtcatttcttttctctgcaacgataccatcagaaataatcgaactggcaaagggctttatgcataatgaagaaatattatttttatcaaaggatgaggtaacggtaaatggcatagatcataattacgcagtaagcaggagggaaagaaagctccgtacactattctcctacatcgataaatacaagcctgaaaagtcaataatattctctagaactaaggcaggcgccaacatgatatatgaagcgctgattaatcacgggcaagatgccgtaataatgcacggagacttgactcaagcccagagagaaaaagcgctttacaggttcaaaaactttggcaggtttctcgttgccactaacgttgccgcaagaggcttagatattggtggaatttcagatattataaattatgatgtcccagacgaccctagggtttacgtacatcgcgttggcaggactgctagaatgggtgcagcaggtagagcgtttactatagtcgaagacagggagattggcagtatagacatgattagacatgaagctagggtaaaaatgaaggaaatacatcttgaaacaactagaaaaaatttt

SEQ ID NO: 37304 - DNA, 1071 bp, Thermoplasma volcanium
gcaaaattgataaatatagtgatcgatgaaactggtataagaccggaagaaatcaatgatgtaatcacaggatgcgccctgcaacaggatgagaattggacttatggcggaaggcatccaattctactagccaacctccctgacaatgttcctggaatggcacttgacagagcatgctcttcatcattgaacgccataacaattggtgctatggagataatgaccggaaatgcagatatcgttatggctggcggatacgaacatatgacccacgtaccgatgagcaacagtccgtttctgaagccaaatgttaagctacttgtcaggccagaatatatgcactacgatatgaatacgggttattctatggggcttactgctgaaaaactcgcttcgctccaccacattggaagggaagaaatggatcagtatgcccttaggagccatcagctggcatctaaggccttggacgatggatacttcaaaggggagatcgttccaatggaagtcgagataggaggagagacaaagataatcgattcggatcagagtataaggaagaacacgtcgctagaggagatgcagaaacttagacctgcattcaaggacgatggtgtaattactgccgggaattcttccccgttaaatgcaggtgcatccttaacactgctcatgtcggagaagaaggtgaaagaatatggccttaaacctctctcgcgtatagtgtcattcggctgggctggagtagatcccagcataatgggtgaaggcccagtcccagctactcaaaaggcacttgccaaggcaggaatgaaagtagaggacatagattactgggagatcaatgaagccttcgcagtagtcgtcctaaatgcaatgaaggagctcggaatagaagaaaacaaggtaaacattcatggtgggggtatatcgataggccatccgcttggtgcaaccggagctaggatagccggaacgctgtctagaatattgaacgaaaagcaagctgagtatggagttgctacgctctgtgttggaggggggcaaggatactcggtgatttttgagagg

SEQ ID NO: 37305 - DNA, 1113 bp, Thermoplasma volcanium
attaatatgaattttgaacttgatgaaaacctattaaactttaggaaaaagatagaagagtttgcgaaaagagaatttaccgaagatttagcttcgaaatacgatgagcaagaacactacccagaagatgtctttacgaagatgatgtccgaaggaatttttgattacacgaatccctggaacatacttatggcgacagaagctttatgcaagtacgatgctggcatgggaatatctatgctcgtaccattcttcggaaatgaggtaattgcactttttggcaatgatgaacagaagaaaaagtacttgagcagagtttttgctgggaaagcaaaaatgggcctagctgttacagagccaggtggtggcagcgatgtagcaaacataaaaactaccgctgtaaaagagggagatcattatgtactaaatggatcaaagatgtttattacaaacggagacatagcggatttctttgttctccttgcaaggacgtctcaggaaaaaaagaaacaccacggtatgagtgtatttatagtagagagggactttgaaggctttagatctaacaagataaagggtaaactcggagttagagcaactgataccgctgagctcacattggaaaatgtaaaggtacctgaggagaacctggttggtgaacctggcagaggcttttactatataatgacgttctttgacataagcagggcctatgttgctgcacaagctctcggcatcgccgagggaatactcgaaagaactttatccatactacagaaggatggcccgctgacatctcagcctgaaagagtgcagtttactatagcagatatggccactaggattgaggcaacaaaacttttaacttatgaggctgcatcttacatatttaacttcaacccaaaccctgctgtgacgagcatggcgaaggcatacgccgccgaaacagccgtttacgtatcaagaaaggctatggaggtaacgggaatcgacggccttacatctagcattgagagatcgtttagggatgctaaaataatggagatatgggaaggcacgagcgaaatagaaaagcttgtaatagccagaatgcttaaaacaggtgatgtccag

SEQ ID NO: 37306 - DNA, 977 bp, Thermoplasma volcanium
gttagagagttcgccaataaagagatagaaaacatttcgaaggatatcgagataaaaggcatacctgatacacttgtcctcaaactcggcgcccagggtttccttgctgcaactgctcctcaggaaaaaggcggttcaggcttagacgaattaggttacataatagtgcttgaggagctctctagagtttcgccgtcagtagctatgaaggttttcctgaccaacttctatctacagctaaatccggatgacgatgtgaattatatcgcttccggaaagaagagggtatcagtagcattcccagactattatgccaggggaaaatctggcaaggttgaagtctcagcaggcaagataaatgctaccaaggaaaacgtaataaatgcaaatgtcgaagcaatagcattgacggatggtaaagatgtttacgctgtaagcaaggaataagtacaaaggaaaagaggcatatgggcatacgtggccttgatctttcggacttattcgtgtctggtgcttcatacaaaaggcttggctcagaggaaatgatgagatccacattccagaagctcgatagagagatagctgcaattttccttggcttgtccgatggtaccatatctaaggctatagaatattcaaaggtaaggactgcatttgatcatcccctgaaagattattcacctatattcgacgacctagtttccttgaagatggagatcgatgtgcttaggttctatctttatggatcgggtgacgagtattcaagagcactcataaagatcaaggcaaaagatctgtctcttagagccactagggtctcccttcagactcatggcggctatggatacatacacgacttcgggatagaaaaatactatagggatgctatggcactttcagtctatttcggccaggacaagtacgaaaatatggtactatcagatcacatcttcggagaggcagggggcataatctga

SEQ ID NO: 37307 - DNA, 1575 bp, Thermoplasma volcanium
gattaccagctgacaatagacaagatgttagagagcggagtctcttcgaatccaaatcagataataaattatagcggcaaaaaaacttttacttataaagagttcagagagagggtttacaggctcgcaaaagcattaatttccataggggttaagaagggagacacggtagcagtcatagactgggatacatacgtatacttggaggcctactttgctgttccaatgataggggcggtactgcatacggttaacgttaggtatcctcaagatcttatatactacacaatggatcacgccgaggataagtatgttatagtaagggacgaatttgtccctattctctcaaagaataaggaggctttctacttcataaagggctggattatatattccgaatacgggaatgtcccagacgaactttctccaaagtacatctatgatgagttgatgtcgaaaaactacgatatcgaacttccagaaatatcggaaaacgatctagcaacgaccttctacacatccggaactactggaattccaaaaggtgtacagtttacacacaggcagatagttttgcacgcaatatcatccggcttggcactatctgacaggcctattagcctgactgcagatgacgtcataatgccgttggtgccaatgtttcatgttcatgcttggggagttccttatatgacaataatgagcggccggcaatatgtccttcctggtcgttatgacttcgatcatataatagatcttatcgcacaagaaaatatcacggtgatagccatggtaccttcgatcctctacatgatcgttacgaatccaaatgtagggaagatagctgggagaaagataagagcgataataggaggcggagctcttcctgaaggcctccagaaagctgcagaaaagcttggtataatggcaatatctggttatggcctctctgagactgcccctatacttacgctagctacatacaactctgatgtcaagaagctcccacttgaagagcaaaagaagtatcacctcaagactggaataccaataccgcttgtacagctccgtgttatcgatgacaaatggaacgatgtgccaagagatgagaaaaccataggcgagatcgtggtaagggcgccctggttgacgtctgtgtatgtaaagaacaaagagggtactgaagctttgtggaagggcggctggatgcacacaggtgatttggctgttatggataagtttggatacattaagatagttgacagagaaaaggatgcggtaaagtctggcggggagtttataccatcacttatactagaagatgcaataagtgcgtgtcctggtgttgttgaaaacgctgtcgttggaaagccccatgagaagtggggagagaggccggtagccttctatacaggtactgctaagccagaggagataagaaaatgcttggaagatattgtgaggcagggaagaattgcaaaattttggattccagacgacttcataaacgtaaaagaatttgtaaagaccagtactggcaaaatagacaaaaaagtactcagggaaatgttgaaa

SEQ ID NO: 37308 - DNA, 1977 bp, Thermoplasma volcanium
ttggaaataagtaaagtaaccgtgattggatccgggataatgggtcacgggattgcggaaactatagcgcttgctggctatgatgttaatctggaggatatatctgatgatgttctggctaaagccaaagccgaaattgatgcaagtcttgaccggcttgtaaagtctggaaaactatcagacaaaacaaaggtgcttggaaggatacattacttcaccagcatacctgaatctgtaaaagatgccgatctcgtcatagaggctgtgccagagattctagatataaaaaggcaggttttcgcgcagttagatcagagcactaaagaggatgccatacttgctacgaatacttcgaacataaggctgacagagatagctgaaggtgtaaagaaaaagggaaaggtcgttggaatgcatttcttcaaccctccagtagtattgaaactggtagaagtaataaggagtgattatactgaagacgaagtatttgaagcagtttatgatttttccaagaaaattggaaagatacctataaaggtttacaaggataccccaggatttgttgtcaacaggataaacgcacccgaatcactttacttctgccttgtacttgataaagggatagcgaaacctgaggaagtagacagatttgctaggtctcagggacttcctatgggcccatacgagctaatggattacgttggcatcgatactgtataccattccctagaatactacgcgaaggaactttctcctgattatgctaaatgccaggtatacaacaaactctacaacgaaaagaagctgggcctaaagacaggagaaggtttctacaagtgggttaatggtaaggcccagataccagacgcccagcctactaaaaacgttgagcttatggacatatttgcgctcgagataaatgaggctgtgaaaataatagaggaaaagatcgtctcgcctgaagacatcgagataggcgtcaagttgggtatgaacaggccattcggccccataactgttgcaaaaggcctcacaaatgcggagataaaaagcaaattagaatctctatacaacaagttcggagtttcggtattccagcccgccaagtcaatatcagaaggtaggcttaaatcactcatatctgaaaaatttgagcccccagtgcgaggacaacagactgaacaggaaaagccctctatcgtagaatcatctgacccagttattcttgaaaggaatggaaagattgcagtgctccgccttaacaacacaaagaacaatctcataaactcggctgtcctagatgcactggagcagcagataaacgatctgtggcatgatagagagataaatgtcgtcgtaataactggaaatggatcagtattctcagccggcgcacagcttgactcatttttctccagtaccttcgatttccttgaattttctaggaaaggagaaaggatcttcaagcttctgagtgagatgccaaagataacaatagcagagatgaaagggtacgtgcttggtggtggcctggaactatcgcttgcctgcgatattcgagttgcaactgaagacgtgcagatcggtttccctgaagtgacgctaggtctcatacccggctggggaggctcgcagaagctgtctaagctgattggcgaatctagggcgtcttattacgttttaactgctgagcgctttgacggcaaaagggcttatgaaatcgggttagtatctagattatacaagccgcaggagatcgatgctgaaactttgaagtttgcaaaggacatatcggagagggttgcgccaatatctgccgctcttgctaagcgtctgttgcttagaagcgccaatacatcccttgacgatggtctagagatggaatctatggctatgggaactctgtacggtacagaagatctgaaggaaggcatatccgcattcctttcaaaaagaaagcctaattatcagggaaaa

SEQ ID NO: 37309 - DNA, 897 bp, Thermoplasma volcanium
gtggagaaagtcgatgaaagtgagttccagaggatcttcaagaaagcatacgatgcaggtattaatttttttgataccgctaacatataccacggcagggttgagaagaatgaagatcatatagatcacataggaaattccgagagaatacttggcaaagccatcaaaggatacgaaagggaatccttagtcatagcaactaaggttagggggccagtttctaagttcattaacggggaggggctctcacgaaaacacataatgtggcagataaaggaaagccttcagagacttggcctagaatacgttgatctctaccaaatacactggagcgacagccttacgccacacgaagaaacagcgagagtattaagccatatagtcgatcttgatatggcaagatacattggcgaaagcaaccactctgccgaagatatagtggattttatgaacatctcagaaaagctcaacttgcatcactttgtcacgatgcaggagccttacaatatactgcagaggggaatagagaaggataagatccctgtggcgaagaagtatggtatgggtatcttagcctatgtaccacttgcacagggagttctcacaggaaaatacgtatctgggccagaaaaaggatcaagatcatcgtattatcccgaaataattgatttccaccagaagaatcaaaagaagatagacgcgttgattaacttcgccaaggaaaaagacataactggagggcagctggctattgcttggttgataaagaaatcgcagatcgaggggatacccataattccgctgctcggaattactaaggaaaaataccttgaagaaaatctgaaagccttagaagtaaaccttacggattctgatatgagggaaattgataggatg

SEQ ID NO: 37310 - DNA, 1074 bp, Thermoplasma volcanium
gtggatacccagagatttgtaataacgatgaacggcgataatatatcctttatcgtgggagataacgcaatcaaccacttatccgaggaagctgggaagtatgatagtatcgttataatgataagcaagaccgtcgaggagatgtatgcaaaccatatacctgatgtaggtagctttggaaattccgtggtaaagatatccctcaacgatggagaatcattaaaatcgttaagaaactatcaaaagatcgttaaagtgctgctggagagaaaggtagacagacgatccctgctggtatacattggtggtggtacggtaggagaccttgctggctttgtagcttcaacatataaaagaggtgttatgatgatcgcagtgccgacgacattgcttgcacaagtcgatagctccataggtggcaagaacggcttggacttctcggatgtcaagaatgtgatagggactttctataatccgtacatggttattgacgataccgtgttcttgaagaacaattcgttcataataagggaggggatgtctgaagtcatcaagtacgctataatatcgggcggcgacatgtacgataccctgaatagatgttccatagacaattttgatgcttgcgcaactaatataataaaactgagcgtaaagataaaaagtgaaatagttaacagggacttttatgatcgcaccgggataaggagcgtattgaacctaggccatacaatagcccacggaatagagggcgcaacaaagggtagtatttcacatggaaaggcggtagcaactggaatgcttgtcgaagcccacataggagaaaaatacggaaatacaaaccatgaagtcatcgaagcaatacgcgatttaatgaaaagatatgggatagaggaattaaacttaaaggaaattgggccaggaaacatacttaggtatatttccaacgacaagaaaattatggagggctacatcaatatgccagtgccttcagaaatagggaaggttataacgatgaaggcgactgaacgcatgataagcgacggaataaacactttcataaaggaaaatgat

SEQ ID NO: 37311 - DNA, 720 bp, Thermoplasma volcanium
gtatttgggctcataggccatcccgtatcccactcaatagggcagattgtctacaacaggtatttccagaaaaagggattaaatgccatttatctatctattgatatatttccagagacgctaaaatatttcatgtcttatgcatccaagatggatgggttcaacgttacgatacctcataaaataagtataatggattacctagaccaaatagattgggaggcccgttcaataggatctgtcaacttagtaaaaactgaggatggattattaaagggcttcaacacagactactatggcatagaatatatgttcaaaaaaggcggcgtcgatgtaagcggaaagagcatagtcgtagcagggtctggagggatagctagaactgttatacactatttaattaagaacaatgctaaaagtgtgacagtaaaagccagagatgtcaaacttgcgaagaataaacttaatgcgtacgatgtagatataaaagaatatgccaataatgattatgacatatacatcaactgcacaccgctaggcacagaggccgtcggggatccattccctgaggttcaatttggcaaagggaaaatagcagtagatgtggtctataatcctccagttactccattccttaaaagagcaggcatttcgggatcaaaaacattgtctggtcttgatctttacattggccaggctattaaaacactggatatacta

SEQ ID NO: 37312 - DNA, 1224 bp, Thermoplasma volcanium
atgatagttaaggtttcaaatcttggcgggagtggtattgccgaaatgccatcgtcaaagagttttacccagcggtatgtactcgcctcggcttttctaaacaagagcgtagtgctgaatggtataaccataacaaacgatgatgatgttgcaatgaggatagctgaaagcgttggatctacaattacaataaacaatagatcgataaagatctctagcaatttcaagtgcccagaagaaatatatgttggtgaatctggcacttcctaccggctttccataggcctacttgctgcatctggttgtgttacaagaattaagggtgaggatagccttgcaaagagacctattgagcctcttctaatggcattaggggaaaatggagtaaaatttgaaaggaacgaagcgggtttctacaatgtggatggaagaaactctcagaaaaagcacgtcgagatagaggggtctagttcacagttcgtatcatcccttatgctatactatgccaagaagggcggcggcgaatttacggcaagaaacattaaatcgataggatacgtctatataacaaagagagttctctatgatctgggctattttgctaacatagagagaaccataacaataaatccaacaggtgtatggaagactgccatagacgttgaaccagattattcgtcgatggcgttttttatggtgctaggcctgctatctgattcagttgatgtgaggtttaggataaagaggattagccgaatccagcccgattccgtgatactagatcttttcaagaataacattctaattaatggggaagaaatacgcgtaataagcggcataaatgagcctgtttcagttgatgcagatatgaatccagacctctgcccgccattatctgtcataggaattttttcaaagtacggagtgcagataaggaactacgaaaggcttaagactaaggagagcaacaggtacgagggcattattgatcttgcagaaaggttcggtgcaaatgtggaagacaacggccaggatcttttcataaaacctggctcagtaaggtttccagatgttatctcatataaagatcataggatgataatggcagcttccatagcttcgctcataggtggttttccgactgttatagaaaatgcggaaaagactgccaagagttttcctggtttctttgcagaactctcaaagttcgcaaatgtagaggaa

SEQ ID NO: 37313 - DNA, 1350 bp, Thermoplasma volcanium
atgagaactgaaagggatgtaattggagaaatacagcttgaagatactgtattttacggtataaatactgctagggccaaggaaaatttcaggataaccggcctgacctccgattctgaccacatcgtttctattgcacagataaaaaaagcagcagccatggctaatgcggaagctggtgcactggacaaggaaaaagctgaatttatagagaaagcgtgtgatgagatcataagtggaagataccacgaccaatttgttatagatgtttaccaggccggtgctggaacatctttcaacatgaacgcaaatgaggtaattgcaaacgttgcacttacattaatgggcaagaacaaaggagattactcagtaatacaccccaacgaccacgtcaacatgagccaatcaacaaatgacgtttatcctacaatgatgcggctaacggtgacgaaaaaagtgaagaaacttaaggaggccatttccgacttaatagaaagcctggaaaagaaatccaaggaacttaggggtataccaaaaccaggcaggacgcaccttcaggatgcagcacctgtaacggttggattggaattttctgcctacgcatatgcaataaaaaaggatagagatgaaattactgatgcccttgattatataatggaattaaacataggggggacggcagtcggcacgggcataaatacatcaaaaaattatcaggagaacgttgtaaagcatatagctgagataacgagggaaaatttcaggaagagcagcaatctgatgggaattatgcagtttatgactgatttttcgagagtgatgaatgctgttacgaacctagcactagatattgaaaagatagctaatgacataaggcttctctactcaggtcctgggacaggtatacatgaaataataatacccgcggtgcagcaaggttcgtccataatgcctggaaaaataaatccgtccatagcagaggcaatgaacatgatatgccattcggttataggtgcgcaacaggcagtaaacatgagcgtacaggccgggcaactggaactaaatgtaatgatgcctaatatagattacgagctaacgagatcaatcgacataatgagaaacggcctaataatgttcaaagaaaaactcatcgacgggatcaaggccaacgtaaacacatgcagagaacatctcgcaaatagctttggatccgctgcactcttgaatccataccttggctatgataatgttgcaaagatagtcagagaagccgtcgaaactggtaaatcaataaaatcattagtgttagcaactggtaaaatcacagaagagcagtatatgaaaattatg

SEQ ID NO: 37314 - DNA, 1311 bp, Thermoplasma volcanium
aaagtcacaaggttctattggctactgaccttactcgcaactatcggtggttttctcttcggttacgatacttctaatatcggcacagcgttggtgtttattccataccctgtgcagggtttcatagaaggatacctagttgcaggtgcatctctgggggctgccgtaggagctttgattgcagctggtctcacggataggtacggcaggaaatatctattgatagcagatgcagctatttatgcggctggtgcaatactatcagcatttaccatagatctcgccatgcttctcctatcaagaacacttataggtttggcggtcggtgctgattctggtatagctacagcttatatatccgagtatgcccctaaagacaggagaggttcactcggaatactgcagcagtggatgataactataggaatacttggtgcttatattgtaggaatggccacactctatgctgcaccaggtctagcttcagttttagactggaggataatgcttggtgttgcggccatacctgctctcattggcctaggctttaggtttatgatgcccgaatctccaagatggttaatgatcaacggaaaatacaaggaagcctcagaggctttcaagaaactcggattaaatctaagtgttgatgagctaaaggaggttaagtttaggcagagagctaagatcacaaacggtgtgaagagagcatttctagttgtcgcccttttctttgtattccaacagattactggcataaatataccgttctattatgggccaatagtaattgaaaaattacacctgtttggctcggcaacgcaatctttagtatttacacaaatatatgctgtagcagctgcaacaatactcgcagtgattaacgtggcagcaacatacataggcttcaggtacatagatacggtcggaagaaggaagttagccctactaggatactccggtatgacgttcttcggtttactgggcgggcttttgctctaccttaaatttgatgttggtttactaattgcatttgccggcttcataatcttctttgcattcggtgtcggtggtacaggttggatgattcagggtgagtacttcccaaccaatatgagaggcctctatgcatctcttggagcttttgtagattggatcgctaactttgccataatagaaatattccctgtactcgaagcattaataacaataaaaaatgtaatgtttgttttcggcatcctttcattaatagcagtattgatcttttattatataatgccagaaaccaaagaattgtccgtggaacaaatt

SEQ ID NO: 37315 - DNA, 1095 bp, Thermoplasma volcanium
atgttgtgcctttctgaagagcaaagcattattaaaggaagcatcgctgaattcacaaagcgaaggatagaaccgatcgagaagaggatcgaagatgatgattatttcccgatggatatacttagagaaatagggaaaaatgggtttttctccgtcatgctgccaggcataggtgtccaagatacttattcattttccttaatagcagaagagatctcaaaggtttcccctgaagtcgcatggctttacgtaactcacgttgctgcttcatatgctttagataagttagggacagaagaacaaaaagatagttatctaaggaaaatggcggatggtgaaatcataggcactatagcaatcactgaatcatcttctggagctacagcttctgcaattgcttcttccgccaggaagtacgaggaaaattggatacttgaagggtctaagacattcatcactatgggtggagacgctgatctatacgctgttctggccaaaacgcatgaagatccagctgcgtttactacatttattgttttaaaaagtgacgtaggattagaactcggaactcatcttatcggatcagcaatgaaagggataggttggggcgaaataagcttcaataatctcatacttgaaaaacacagaatccttggaaaggagaacgaaggcataaaaataattccaactatagcaaggatattttcaataggcgctgcatcaatctcccttggaataatggaacgtgctttggagctagtttcatcgcatgttaaagagagaaaaatagcttgtaaaagtctcttatctaaccagacagttcaagataagctcttccatttgtatgctgatacagaggcagcaagatctctggtttatagggcatcgataaatgatgatatccgcctagcctattctgcaaagctgttttccacggaaagatcaatagcagttactgaatctgcagtcagtttatttggagccacagggtacgaagaaagcttagctataccgaaattgcttaacaaggcaattgctgttcccttacactttataaataatgcaatcctaactgggctatttataacggccatt

SEQ ID NO: 37316 - DNA, 732 bp, Thermoplasma volcanium
cttgaaggcaaaacagcgctcattacgggtgcttccaaaggcctaggcagggccatagcagaagaattcgccaaagaaggcgcaagagttgctataaattacgcccacgacgagaaatccgctcttgaggttaagaaaataaccggtggagaaatatttaaagcagatgtatcaaacagagatcaagtaaaggaaatggctaggcaaatacatgaaaaactagggaaaattgacatacttgtcaataactccggcatatggtaccttatgccttttgagaattacgatgaggaaaaagtaaggcgaatgttagatgttaatttaatgggtgctatctatacaaccctggaatttttgccagacttaaaggaaaaaaagggaacaattatcaacatagggtcaaatgccggcattggtacagcggcgaagaacacaactttctattctcttacaaaggctgccattattatgttaacaaagaggcttgcatttgatctttccgaatatagcataagggtaaacgccatcgcaccaggatggatagaaacagacctaacaataggcggaaaaactgatgaggaaataagaaaacttgaggaagactttaagtctagaaccacgctgaagatgttcggcaaaccagagtatataggcaaggcggccttgttcctcgcttcctctgattccgtttatatgaacggccaagtaatagtgatagatggaggtaggata

SEQ ID NO: 37317 - DNA, 846 bp, Thermoplasma volcanium
gttgtcccattctacgaaaaatacgttataatcgaaggcaataaagatgctggggaaagattatactcaaaaaaatacagagacaaaaccgtagtagatgtgggtgatattaaaattggcgaaggactcgttttcgctgccggcccgtgttcagttgaagacgaagaccaaataatagagatagctcgctctgtgaaaaaagctggtgccaacatgcttagagggggtgcctttaagccgaggacatcaccgtattcatttcaagggcttggagaagaggggttagaactgctaaagaaagctaaagaagataccgggttacctatagtcacagaaataatgaaccccgagtactacaaattctttgatgatattgatatgcttcaggttgggtctagaaatgcacagaatttcgatcttttgagatttttaggtaggcagaaaaaaccagttctattgaagaacggaatgggcaacacgcttaaagaatggctggaagcttcagaatacataatgtccggtggcaacggcaatgttgtcttatgctatagaggagttaggggaatagaggaagcaacacgcttttctatgaacgtaggcacagtaatagcagcaagatcgatgacgcatctgccaatgtgcgtagaccctagccatgcgtctggaaaacgtgagtacgtagaggcaatgacgcttgcagctgtagctgccggtgcggatatgatagaaattgaagttcacaataacccagactgcgcactatctgattctgaacagcaggtaacgcctgaagtcttcgggagaatagtaaaaaaagccaaacaaataaaaaacatagtttctaat

SEQ ID NO: 37318 - DNA, 1482 bp, Thermoplasma volcanium
atgatagagatagatggggataatttaactctggaggatgtatattcagtttcagtcctgcacgagcctgtagaactttcgacgaaagctcggaataaagttgctgagatccatagaaaattcctcgatcttatatcttctggccagacgatatacggggtaaatacagggttcggagggttgttgaacattaaaataagcagggaagaagagatcgaacttcaacgtaaccttataagaagccattctgcaggtgtggggaagtaccttccgaccgatgtggtcaggtcgatcatggtaataagggccaatacgctagcgaagggttattcagctgtttctacagaattgattgatgccctgctagccatgataaataaagacgtagtgccagcagtgccagagttcggatctgttggcgctagcggggatcttgctccacttgcacacatagggctggcaatgatgggagagggccaggccttcctgaacggggaactaatgagatcggacattgcactttcaaaggttggcctgaaaccatacgagtttaaagagaaagagggcgtagcactgatcaacgggacttcaatgatggcaggcatcatggctctcgtaacctcaagagcatacaggacaattgaaaacgcagtgagatcctcacttctttcctttgaagcgctaagagggacttcaaaggccttttcagattggatagtatcagccaggcctcaccttgggcagatagcaatagcagaaaaaatgagaaaataccttgcaggaagtaaaaatgtagaaaaatcagataaagaaaaagtgcaagacgcttacacactcaggtgcataccacaggtatatggcgccgtacttgatacgttagaatacgtttctagcgtgttggtaacggagatcaattccgcaacagacaatcctctattcaatggcaaggaagttgtatcgggcgggaattttcatggtgaaccaatagcgcttgctgcagatttcctttcaatagcgttaacagacatgggaaatatgatagagaggaggatagccaggcttgttgatacaaacctaagcggtttgccaccattcttagtaaaaaacagcggacttaactcaggatacatgataccacagtatactgccgccgcactctgcaacagaaataaagtactttcttacccgtcctctgcagattctataccgacatctgcaaaccaggaggatcatgtcagtatgggttctacttcaacgttgaaacttttggaaattgaggaaaacctcgaatatattgttgcaatagaatttctgcttggcgcccaagcacttgaattcagccaagacccaatctcccctgtaacaaaagccatatacacaaagatcagggagtatgtgaaaccactcgataaagataggccttcttatcttgacatagaaaaaataagggaaataatgaacaaaaacgaacttatcaatgcg

SEQ ID NO: 37319 - DNA, 912 bp, Thermoplasma volcanium
aacgtggctgaggacattattgaagttgaacatttcaagcaaacttacgatggaaagaaattcgttgtggacgacgtatcattccacgtaaagaggggagagatatacgggctccttggaaaaaacggtgcaggaaaaacaaccacaataaggactctcaccacgatcatgccagtacactacggaaaagtaaaggttcttggtttagacgtctcaacgcaccccgagaagataaggcaaaggatcggcgtagttttgcagagcgaatcctttgattttactaccgttgaaaagaacctaaagatctacggtatgctatgggatgtcccaggtgaagtgcttaaggccaggatagaagaggttatggaagtattcgacctgtcaagattacgcaagattagggccttagaactttccggagggcaaaagaagcggctgcaagtggctagagaattcctgcacgatatggatttacttttccttgatgaacccacagtcggtttagatccaataatgagaagaacagtacttaattacataaaagagaaagcaaaggcaggtcttactgtcctttacacaacacaaataatggaggaggctgattacctgtgcgacaggatcgctataatgaacaatggtaaaatagtagctgagggcacaagcgatttcctcaaatctaagtacggagaccttaaaacgataaagatacacatatcaggaaatgtcaacagagaggatttaaagatgatgttccctgaatttgttcaaatagaaggggacgaagttaggttgatatcaaaaaacgttgaggatgtacttccagacatgatactctattttaaaagatccgggattcacatagagcgcataaatgtagaagaaactagccttgatgatgttttcctgagggtg

SEQ ID NO: 37320 - DNA, 1446 bp, Thermoplasma volcanium
atgtatagggataaattttcaaacataactgaaggttacacttttgacgatgttcttattctgccaatgaagacgggcgtcgaaccaaagaacgtagacgtttcatctcgcctgagccgaagaataaacgtcaaggtcccaatagttagttcgccaatggatacagttactgaggaagcaatggcaatagccatggcccgttatggtgccttcggcattatacatagaaaccagccgagggaaaaagaagtggagatggtacggcgggttaagagggaagaaacgatcataatcagggacgtttatacagtgtccccggaaacgccaatagaagttgcaaggacaataatgaagacaaagaacattgcaggcttgcctgtgcttaaggaggagaagttggtcggtatcctgacaaaaagggacctcgaatttgcaaaacagggatcaaccgtatcagatgtaatggtgaagaacgtaataactgcccctgaaaatgtcgatctggaagacgcaataaatatactgcataagaaccggatagaaaaactgccgcttgttgacaaagataaccacctggttggtttaataacagcaaaggacataataacaaggcagaggttcccggatgctactagggacgacgaggggcagttgatggtaggcgcagccgtcggcccatttgacttagaccgtgcgatcgaacttgagagggccggtgcagatttgatcgtggtggatactgcacatgcagacaacgagaatgtcctaagttcaattaaaaggatgaggaaggagatctctgttgatatagtggcaggaaacatagctacagctggtgcagcagaggatctaatttcatgcgaagttgacggcctgagagtcggcatcggccccggttcaatatgcacaacgaggatagttgcgggtgtcggcgtgccgcagcttactgcaatatctgaagttgcagaggttgccaaagaatacggcatccctgtaattgcagacggaggcattaggtactctggcgacattgtaaaggccattgctgccggggcagacagcgtaatgcttggatctatgcttgccggtactgaagaaagcccgggccaggagatgataataaacggaaggaagtacaaggcatacagaggcatgggatcgattggtgcattatcaacaggcatatccgataggtacagcaagcttggaaacggctttatcgcggaaggggttgagggcgcagtaccgtaccggggcagagtagatgaagtgctattccagctggttggaggcctgcgcactggaatgggctatgtaggagctgaaaacatagggaagttaaaggagagggccaggtttgtaaggatatcatcaaatggattgagggagagtcatccacacgacataaggctgataagcgaacctccaaactaccagatctctaac

SEQ ID NO: 37321 - DNA, 1350 bp, Thermoplasma volcanium
atggaaacttatgatgtcatcacgcttggtgcaggcggtgctgcttatccggccgcattccgcttgaagaagtctggatacagcgtgctgatgatagataagaagggaataatgtctgggaattgccttgctgaaggctgtgttccatcaaaggcaatcattgaaactgtccataactattcaaaattgaaaaagttcggaaaatattcgatagcttacgaagatatagtaaagcacaaggacgatgtccaaaacataaggtacaagcagcacgacgaagaacttcatgaagctggcctcaagatactgaaaggaacggcaaaactgattgatgaaaatactgtagaagttgagacggatacaggtaaagagaggtacagggcagaaagcattattataggcacaggttcagatacctatgtaccgaagataccaggagcagaactcgcttggacaagcagggaactctatgcgcttaacccaaaggtaagaaagcttccaaagagcatagcaataattggtggaggttatatcggcctggagacggcatcgtttatgtcgctgcttggtactgacgtcacagttatagagttgctagaccgcgttcttagcacgatggattccggcatggtaagcaagcttgtcccactccttccaaagatgaacctcattttaagttcaccagtcaaggaaatacgaagaggcggtgacatgttcgaggtatcatacgatcacgagggcaaaactgaaaaaatacgagtggaagcagttttaatggctgtgggaaggatgccaatgttcccggagggcttagacgatcttggaataaagtacgacaagcacgggatcaaggtaaatatggctatgcagactaatataaagcatatatacgctacgggcgatgtcaacggattaacaccactcttccatgcggctaagaggcagtctttagtagcggccaacaatattatggcaaaccatgtgcctgttgactacttcgatcctctatcagtcccgttcactgtatacacggtaccgcaggtagcctatgttggcatactgccagatcaggcgaaaaagttgggaataagttacattgagacagattaccagatggaaaaggatgcaatggcacaagtaaactcagagatggaaggtgagataaggcttttctttgattcaaggatgaagataataggcggatacgttatcggaaatgatgccgggaacctgataaatgagatagcgttaggaatatcaaagggattaagtgcaagggacttcgcagagatggcccatcagcacccgatgagctttgaagggcttgattcagctgctagaaaactatat

SEQ ID NO: 37322 - DNA, 552 bp, Thermoplasma volcanium
atgagtgagagagaaaagataaccattgaaaatatagtagcttctacttcgctggctgaacatctggatctcagcaggattgcgctcgcccttgatggctctgaatacgagcctgagcaattcccgggcttgatatataggcttcaagatcctaagaccgctgtcctaatattcagaagcggaaaggtcaactgtactggagccaagaacatagaagatgtaaaaaggacaataaaaataataattgataaactcaaggccgcaaacattgaagtttatgatgatccggacattatagttcagaacatagtggcagtatacgatcttgaatctgaattgaatctaacggatatagccatgtccctgggactcgaaaatgtagagtatgagccagagcaatttcctggcctagtctatagggtagaagaaccgcgcgtagtcctccttctctttggatcggggaaagtagtgtgcacaggcgcaaaggaagagagtgaaatagagcaggcagtgataaaggtaaaaaaggagctccaaaaagtcggcctgatc

SEQ ID NO: 37323 - DNA, 723 bp, Thermoplasma volcanium
ctgaaggataaggtagctgttgtaacaggatctgggagaggtattggaagggcaatttccgttgcgctagctaagaaccgctgcaaagtgataataaatgtgaagaagagattagaggaaggccaagaaactctccgcatggtcgaagaatactcacaaggtattcttgtaaaggctgatgtctctactagagaaggctgtgcatcaataataaacgaggcaagaaaaaacttcgattcaatagacatacttgtaaataatgcaggcttaggcatagctatgccattcatgaacagtgatgattctctaatccaaaaattgatcgacacaaacataatgtcagtaatacgctgttctcaagagataggaagggtcatggaggatggtggaacgatcataaacgtatcctccgtcgctggtctaaaaccaatgccgctcctacccatatacgggatgacaaaggctgccataatcaatctgacgcaatacatggcctatgactttgcccagagacgcataagggtaaatgcagtagcaccttctgtagtcagtacgaagatggggaacagcctggtagatataagcggcttgaaggaggataaatttgcaaaggaatacacacttacaggaaaaataattgatccggatgaagttgcggatgcagtcatatttcttgcaaaatctgatagtataacgggccaaacccttgttattgattctgga

SEQ ID NO: 37324 - DNA, 963 bp, Thermoplasma volcanium
ggtatcaccatgattgaaatttggactgaaaagtatagaccgaaaagcttatctgaaatttacggtgaagacgaaaatatacaaaagttaaagtctttcgttgagaaaaaagagctcccgcacctcctcttcgctggatctgttggtactggaaagacctcaacggccattgcactcgccattgagctgttcggcgaatcctggaaggaaaacttcattgaaatgaatgcttcaaacgagaacggtatagatgttatacgtaacaagataaaggacatcgcaagaataaggccttctaatccgctgggatttaagatccttttcctagacgaagcggatcagttgacagcggaggctcaggcggcgttgagaaggacaatggagatgtattctgaaacaacgagattcgtatttgcctgcaactattcttccaagatcatacctcctatacagtcaaggactgtggtaatgaggttcaggcccgtccaagacgagtttataaagaagaaattaaacgagattgcaaagaatgaaggcttcaccatagacgatgagagcatggaagcaatggttgaagtttccggtggtgacatgaggaaagccataaatgtgctccaggcggtctacacatcaggtgagatatcaccaaagaaaatatacgagataataggttatgcaagtcctgagagcgtaaacaagctaatatccagagcaataaatggattatttgacgaggcaaggcagattgtggataagatgatgatagaagatggtttgtctggcatagatatagtcaaaagtgtccattcgatagtaagggcgagcgttgtacctccgaagcagaagatagaaataataaaggcgcttgctgatgcagagtttagaattgttgaaggatcgaacgacaggatccagcttgatgcccttatagcaagaatagcagatattggaagcaaaataaac

SEQ ID NO: 37325 - DNA, 1122 bp, Thermoplasma volcanium
gtgaaagatgttatagtcatcggtgcaggcccatctggttcttacgcggcttataggctttctaaaatgggtttagacgtccttcttttagaagaacataaggaggtagggaagcctgttgaatgcaccggacttgtatcaaagcgtgtacttgactttgttaagactagaagtatagcagggaaagtatatggcgcaaatatatattttcctaacggaaaatcgatccacgtggagaagaatgacgaaactatagtactctacagggactcctttgataaggacgtagccgcaatggcgataggcgcaggagccgacatccggatcaatgcaagagctatatcggtaaaggagaataatgatagcgtaaccgttaagtatagagatagcggacagcttaaagaagataatgcaaaggttgttataggtgcagacgggatcaatagtgttgtaagaagagatttgtatcggattaggcaggagaaagtcgtctccaccctccaatacgacatggctggaaaaatagaagacgaaaggagcgttaacgtttaccttggatctaaatacacacacggattctttgggtgggctgttccaggcggtgaaataataagagttggaactggcagctacagggcttcagcatacccatacatgaaggctttgtccaaaaggtttggcacaaacagagtgttgggaataaccggtgctggcataccaataaaaattgctaaaagccttttcacaaagcgatctgtacttatcggtgatgccggaggcatagttaagccactttccggtggagggatttacactggaattttttcagcaaacctagcatcggaaagagtagcaaatgccatagaaaatgaagattattcccagctcaggcattacgataaggatataaggggatccataggagttgagctgaagaaggacggatttatacaatcaatatactccaagataggggatagatcattcgataggatatatggccttatttccagcgagaagataatagatacgataaacagatctggagacatagactatccgtcgaaggtaatatttaaagtacttatccgcaatcctgccttgctgtacagcatgtggaag

SEQ ID NO: 37326 - DNA, 714 bp, Pseudomonas fluorescens
tttggtgaagcctgtgcccgtcgttttgccgaggccggctggaaactggtgctgaccggtcgtcgtgaagaacgcctcaacgcgctgtgcgccgagctgtcgaagcagaccgaagtgcatggtctggtgctggacgtgcgtgatcgcaaggcgatggaggaggcgattgccaacctgccgccatcgttcgccaagctgcgcggcctgatcaacaacgccggcctggcgctgggcgtggaccctgcaccgaagtgcgacctcgatgattgggacaccatggtcgacaccaacgtcaaaggcctgatgtacagcactcgcctgttgctgccgcgcctgatcgcccacggtcgcggcgccggtatcatcaacctcggttccatcgccggtaattacccgtacccgggcagccacgtttatggcgcgaccaaggcgttcgtcaaacagttctcgctgaacctgcgctgcgacctgcagggcactggcgtgcgcgtgagcaacatcgagccgggcctgtgcgagagcgagttctcgctggtgcgtttcgccggcgatcaggcgcgttacgacgccacctacgccggtgccgagccgatccagccgcaggacatcgccgagacgatcttctgggtgctgaacgcgccggcgcacatcaacatcaacagcctggaactgatgccggtgagccagacctgggccggttttgccatcgagcgc

SEQ ID NO: 37327 - DNA, 1146 bp, Pseudomonas fluorescens
atgacgcctgataaaaaggtcaaaatcctcgccaccctcgggcctgccgtcgacggcatcgaagacatccgcgagctggtcgaggccggggtcaatatcttccgcctcaacttcagccacggcgaccacgccgaccacgccaagcgctatcagtggatccgcgaagtcgagcgccagctcaactacccgctcgggatcctgatggacctgcaagggccgaagctgcgggtcggcaagttcgcggacggcaaggttcagttgcatcgtggtcaggccttccgcctcgatctggatgcgacaccgggcgacgaacgccgggtaaacctgccgcatccggaaatcatcgcggcgctggaagccgggatggatctgctgctggatgacggcaaactgcgcctgcgggtcgtcaccaaatactccgacgcgatcgacaccaccgtgctcaacggcggcgaactgtcggaccgcaaaggcgtgaacgtgccgcaagcggtgctcgacctgagcccgctgaccaccaaggatcgtcgtgacctgagcttcggtctggagctgggtgtggactgggtcgcgctgtcgttcgtgcagcgtccgcaagacatcctcgaggcccgcgaactgatcggcgacaaggcgttcctgatggcgaaaatcgagaagccgtcggcggtcgagcaactgcgcgagatcgccgaactgagcgacgcgatcatggtggcacgcggtgatctgggcgtggaagtgcccgccgagagcgtgccgcagatccagaaaaacatcatcaccacctgccgtcatctcggcaaaccggtggtggtggcgacgcagatgctcgagtcgatgcgcttctccccggccccgacccgcgccgaagtcaccgacgtcgccaacgccgtggccgaaggtgccgatgcggtgatgctgtcggcggaaaccgcgtccggcgaatacccgctggaagccgtgcagatgatgagcaagatcatccgccaggtggagaacggtccggactaccagacccaactcgacgtcagccgcccgaaagccgaagcgaccgtgtccgatgcgatcagctgcgcaatccgccggatcagcaacgtgctgccggtggcggtgctggtcaactacagcgagtccggcgcatcg

SEQ ID NO: 37328 - DNA, 1047 bp, Pseudomonas fluorescens
ccgttcaacttcccggcgatggtgccgctgtggatgtatccgttggcgatcgtctgcggcaactgcttcatcctcaaaccctccgagcgtgatccgagctcgaccctgctgatcgcacaactgttgctggaagccggtctgccgaaaggcgtgctgagcgtcgtgcacggtgacaagactgcggtagacgcgctgatcgaagcgccggaagtcaaagcgctgagctttgtgggttcgacaccgattgccgagtacatctatgcggaaggcaccaaacgcggcaagcgcgtgcaggccttgggcggcgcgaagaaccacgcggtgctgatgccggatgcggatctggacaacgcggtcagcgcactgatgggcgcggcttacggttcctgcggcgaacgctgcatggcgatttcggtggccgtgtgtgtgggcgatcaggtggcggacgcactggtggccaaactggttcctcagatcaaggcgctgaaaatcggtgccggcacttcgtgtggtctggacatggggcctctggtgaccggtcaggcgcgcgacaaggtcagcggttatgtggaggacggcgtggcggcgggtgcgaccctggtggtcgacggtcgtggtctgagcgttgccggtcatgaagaaggcttcttcctcggtggttgcctgttcgacaacgtcactcctgaaatgcgcatctataaagaagagatcttcgggccggtgctgtgcgtggtccgggtgaacagcctggaagaggcgatgcaactgatcaacgatcacgaatacggcaacggcacctgcatctttacccgtgacggtgaggcggcacgcctgttctgcgacgagatcgaagtcggcatggtcggcgtcaacgttccattgccggtgccggtggcttaccacagcttcggcggctggaagcgttcgttgttcggcgacttgcatgcctacggtccggatggcgtgcgcttttacacccgtcgcaaggcgatcacccagcgctggccgcagcgtgcgagccatgaagcttcgcagtttgcattccct

SEQ ID NO: 37329 - DNA, 669 bp, Pseudomonas fluorescens
cacgcactgatcatcggcgcctcccggggcctgggcctgggtctggtgaaaaccctgctggccgacggctggcaagtcaccgccacggttcgcaatccttccaatgccgaggctctcgaagcactgggcaacgtgcaaatcgaaaaactcgacatggacgaccagcaagcggtgatcgccctgagccagaagctcaagggcgagacctttgacctgctgttcgtcaacgccggggtcaaaggccccgaagtgcagaccccgggcggcgcgacgctggcggaagtcggtcagttgttcttcaccaacgcggtggcaccgatcaatctggcccagcgctttgtcgggcagatccgcgacggcagcggcgtgctggcgttcatgagttcggtgctcggcagcgtgaccatgcccgacgcgccggaactcgcgctgtacaaggcgagcaaagcggcgctgaactcgatgaccaacagcttcgtcactcaattgggcgagcagaaactcaccgtgctatcgctgcatccgggctgggtgaaaaccgacatgggcggcgaaggtgccgacatcgacgttgagaccagcacccgtggcctggtggatcaggtggatgcgttcgccggcaaggggggccatcatttcgtgaactacaagggtgaaaccattccctgg

SEQ ID NO: 37330 - DNA, 2499 bp, Pseudomonas fluorescens
atgacccgttccccgttccgccgtcttgtgtttggcaccttgcgccgactgttgtatctctgggttcgctccgagacgatcaaccagtcgtcgttcaccctcaacctagaccgcagtcgtccggtgttctacgtcctgcaaaacccatcgctgactgatctggcggtggtcgacaccgagtgcaccaaggccggtctgccgcgcccggtgctgccggtgtccgtgggttcgctgatcgaacccgcggcgttcttctacctgacgccggacccggactggctcggccgccaggacaagcgcggcgcgccgccgaccctgacccgcctggtcagcgccctgagccagaacgctgccgaagatgcacagatcattccggtcagcgtgttctggggccagtcgccggacagcgagaacagcccatggaaactgctgttcgccgacagctgggccgtcaccggacgcctgcgccggctgctgagcatcatgattctggggcgcaagacccgcgtgcagttctccgcaccgatccacctgcgcgaactgatcgaacacaacaagggccacgaacgcaccgtgcgcatggcccagcggatcctgcgggtgcacttccgcaacctgaaagctgcggtgatcggcccggacatttcccaccgccgcaacctggtcaaaggcctgctcaaccagccgctggtcaagcaagcgatcctcgacgaagccgagcgcgaaaacatctccccggaaaaagccaaggcccaggccctgcgctatggcaacgagatcgcctcggactacacctacaccgcgatccgttttctggaagtcgtactgagctggttctggaacaagatctacgacgggatcaaggtcaaccacatcgaaggcgtgcagaaggtcgcccagggtcacgaagtgatctacgtgccgtgccaccgcagccatatcgactatctgctgctgtcgtacctactgttccgcaacggcctgaccccgccgcacatcgccgccggaatcaacctgaacatgccggtgatcggcagtctgctgcgccgtggcggggcgtttttcatgcgccgcacgttcaagggcaatccgctgtacacctcggtgttcaacgaatacctgcacaccctgttcaccaaaggtttcccggtcgagtacttcgtcgaaggcgggcgctcgcgtaccgggcgcatgctgcaaccgaaaaccgggatgctggcgatcaccctgcgcagtttcctgcgttcgtcgcggatgccgatcgtgttcgtgccggtgtacatcggttatgagcgcgtgctcgaaggccgcacctacctcggcgaactgcgcggcgcgagcaagaagaaagaatcgatcttcgacatcttcaaagtcatcggcgcgctcaagcagcgcttcggccaggtggcggtgaacttcggcgagccgatcaaactggcggaattcctcgacagtgaacaaccaggctggcgccagcaggaactgggcccgcagttcaaaccggcgtggctcaacgaaactaccaaccgcctcggcgaaaaagtcgcgcagcacctgaacgaagcggcggcgatcaacccggtcaacctggtggcgctggcgctgctgtcgaccacccgcctggcactggatgatcgggccatggcgcgggtgctggatctgtatctggcgctgctgcgcaaggttccgtattcgccgcacaccaccttgccggaaggcgatggccgcgcgttgatcgagcatgtgaaggacatggatctgctgtccgagcagaacgatgcgctgggcaagattctgtacctggacgagcagaacgccgtcctgatgacctattaccgcaacaacgtgctgcacatcttcgccctgccggcgctgctggcgagcttcttccagagcacctcgcgcatgagccgcgaacagatcctgcgctacacccgcgcgctgtatccgtatctgcaatcggaactgttcatccgctggaccctggacgaactggatgcagtcatcgatcagtggctggaagcgttcgtcgaacaaggcctgctgcgtttcgagaaagacgtgtacctgcgcccggcaccaagctcgcggcatttcgtgctgctgaccctgctgtcgaagagcattgcccagaccctgcaacgcttctacatgacggtttcactgctgctcaacagcggccagaacagcatcagcgccgaagaactggaagacttgtgcacggtcatggcccagcgcctgtcgatcctgcatggcctgaacgcgccggaattcttcgacaagagcctgttccgccacttcatccagaccctgctcgacctcgacgtgctgcgtcgcgacgaagccggcaagttgagctaccacgaactgctcggcgaactggccgagggtgcggccaaacgggtgttgccggcggagattcgcctgtcgatccgtcaggtagccctgcatcgcagcgaagatgcggccgatcaggtcgccccccctgtgcaaaac

SEQ ID NO: 37331 - DNA, 1326 bp, Pseudomonas fluorescens
aacgcgccgtcgccactggccagccaactgaagctggacgcgcactggatgccgtacaccgccaaccgcaacttccagcgcgacccgcgtctgatcgtcggtgccgaaggcagctggctgatcgacgacaagggccgcaaggtgtacgactcgctgtccggtctgtggacctgcggcgccgggcatacccgcaaggaaatccaggaagcggtggccaaacagttgggcaccctcgattactcgccgggcttccagtacggccacccgctgtcgttccagctggcggagaaaatcaccgacctgacgccgggcaacctgaatcacgtgttcttcaccgactccggttccgagtgcgccgataccgcggtgaaaatggtccgtgcttactggcgcctgaaaggccagtcgaccaagaccaagatgatcggccgcgcccgtggctatcacggtgtgaacatcgccggcaccagccttggcggcgtcaacggcaaccgcaagctgttcggtcaggcgatgatggatgtcgatcacctgccgcacactttgctggcgagcaatgctttctcccgtggcatgccggagcagggtggtatcgccctggccgatgagctgctgaagctgatcgaactgcacgatgcgtcgaacatcgcagcggtgttcgttgagcctatggcgggttccgctggcgtgctggttccaccacagggctacctcaagcgtctgcgtgaaatctgcgatcaacacaacatcctgctggtgttcgacgaagtgatcaccggcttcggccgtaccggcaccatgttcggcgccaccaccttcggcgtgaccccggacctgatgtgcatcgccaagcaagtcaccaacggcgcgatccctatgggcgcggtgattgccagctccgagatctaccagaccttcatgaaccagccgaccccggaatacgccgttgaattcccgcacggctacacctactcggcacacccggtggcttgcgccgcgggcctggcggcactcgacctgctgcaaaaggaaaacctggtgcagagcgtggccgaagtcgcaccgcatttcgaaaatgccctgcatggtctgaaaggcgcgaagaacgtcatcgacattcgtaacttcggcctggccggtgcgatccagattgcgggccgtgacggcgacgccatcgtgcgtccgttcgaagccggtatggcgttgtggaaagccgggttctacgtgcgcttcggtggcgacaccctgcagttcggcccaaccttcaacagcaagccgcaggaccttgatcgtctgttcgacgcggtcggcgaagtgctgaacaag

SEQ ID NO: 37332 - DNA, 765 bp, Pseudomonas fluorescens
atggcaatcgttaaatgcaaaccgacttcccctggccgccgttttgtggtcaaggtggtcaaccaggagctgcataaaggcgctcctcacgcaccgctgctcgagaaaaagtcgaagtctggtggtcgtaacaacaatggccgtattaccactcgtcacattggtggtggtcataagcagcattatcgtctggtcgacttccgtcgcaacgacaaagatggcatcgctgccactgtcgagcgtatcgaatacgatccaaaccgtactgctcacatcgctctgctgctgtacgcagatggcgagcgtcgctacatcatcgcccctaaaggcgtgagcgctggcgaccagctgatcgcaggtgctctggcaccgatcaagccgggcaacgctctgcaactgcgcaacattccagttggtagcaccgtacacggcatcgaactgaagccaggtaagggcgcacaaatcgctcgttccgctggtgcttcggctcagctgatcgctcgtgaaggcgtttacgtgaccctgcgtctgcgttccggtgaaatgcgtaaagtactggctgagtgccgtgcgaccctgggcgaagtctcgaactccgagcacagcctgcgttcgctgggtaaagctggtgccaaacgctggcgtggcgttcgcccaaccgttcgtggtgttgccatgaacccggttgaccacccacatggtggtggtgaaggtcgtactctggtggtcgcctccggatcgccaggggctcccgatagggggaag

SEQ ID NO: 37333 - DNA, 1395 bp, Pseudomonas fluorescens
atgaacattctctacgacgaacaggtcgacggcgttttgcccgacgtcgacaagactgcacttctgcaagccctgctgcaccaatggccagacctggaagtgctgcatcagcgcgaagaattgaagccttatgaatgcgatgggctgtccgcctatcgcaccacgccactgttggtggtactgccacgacatatcgatgaagttcagggcgtgttgcgaatctgccacgaacgacgtgtgccggtggtggcccggggcgccgggaccggattgtccggcggcgctctaccgctggaaaaaggtgtgctgctggtgatggcgcgtttcaataacatcctgcacattgatcccgcggcgcgtactgcacgggttcaacccggtgtgcgcaatctggcgatctcccaggccgcggcgccgttcgggttgtattacgcgcctgatccttcctcgcaaatcgcctgctccatcggcggcaatgtggcggaaaacgccggtggcgtgcactgcctcaagtacggactgaccgtgcataacctgctcaaggtcgagatcctcagcgtcgatggcgaacgcctgacattgggatcggacgcgctggattcccccggtttcgacctgctggcactgttcaccggttccgaaggcctgctcggggtgattaccgaagtcacggtcaagctcttgcccaaaccgcagacggccaaagtgctgctggcggcattcgactccgtggaaaaggccggccgcgcagtggccgacatcatcgcggccggcatcatccccggcggcctggaaatgatggataacctggcgattcgcgcggccgaagacttcatccacgccggttatccggtggacgccgaggcgattctgctctgcgagctcgatggcgttgaagccgatgtccacgatgattgcacgcgggtccggcaagtgctcgagcacgccggcgccaccgagctgcgccaggcccgggacgaggccgagcgcgcgcgattctgggccggacgcaagaatgccttccccgccgtaggacgattgtcgccggactattactgcatggacggcaccatcccgcgccgcgagctacccggcgtactgcatgcgattgctcagctttcagctgtacatggcttgcgggttgccaacgtcttccatgccggcgatggcaacatgcatccactgattctgttcgacgccaatcagcccggcgaactcgaacgtgccgaagcgctgggtggcaagatcctcgaactgtgtgtgaaggtcggcggcagcatcaccggcgaacacggcgtgggccgggaaaaaatcaaccagatgtgcgcgcagttcaaccgtgatgagctgaccctgttccacgccgtgaaagcagccttcgaccccggaggcctg

SEQ ID NO: 37334 - DNA, 2577 bp, Pseudomonas fluorescens
ccactagacgaccgaattgcgtacccgatgaccgacgaatcgccctccatcgacaaactgctgaaaaacctcgatcacgccatgctcgccgaccgccaccggctgcggcgacagttgcttgagctgcgcaagaaacccgacgaggccaagctggcccagtgggtggcgcggatgcaggcgtcctgcgatcaggtgctggcacgcaaggccagcctgccggtgatccgttacgacgacagcctgccgattgcggccaagcgtgacgaaatcaagaaggccctggaaaagcaccaggtgctgatcatcgcgggtgaaaccggctcgggtaaaaccacccagttgccgaaaatctgtctggagatcggtcgcggccagcatggtctgatcggccacacccagcctcggcgaattgccgcgcgcagcgtggccagtcgggttgccgaagaactcggcacgccgctgggtgcactggtcggctatcaggttcgattcgaggatcagagcgattccaatacgctgatcaaactgatgaccgacggcatcctgctggcggaaacccagaacgaccggtacctcgagcgctacgacacgatcatcgtcgacgaagcccacgaacgcagcctcaacatcgacttcctgctcggttacctgaaaaccctgctgccgcgtcgtccggacctgaaagtcatcatcacgtcggcgaccatcgatctggagcgtttctccaagcatttcgatgacgcgccgattgtcgaggtttccggccgtaccttcccggtggaaacctggtatcgcccgctgacgcttgagcaggacgaagagggcaaccgtgtcgaagacgacctgaccgtggatcaggcgatcctcgccaccctcgacgaaatcgccgcctatgagcgcagcgaacggcgcagtcctggtgacgtgctggtgttcctgccgggcgagcgtgagatccgcgacgccgccgacatgctgcgcaaggcccagctcaaacacaccgaaatcctgccgttgtacgcgcgcctgtcgccggctgaacagcagcggattttccagtcgcatccgggccgtcgcgtggtgctggcaaccaacgtcgccgaaacctcgctgaccgtgccgggcatccgttacgtgatcgacagcggcaccgcgcgcatcagtcgctacagctaccgcgccaaggtccagcggttgccgatcgaagcgatttcccaggccagcgccaaccagcgtaaaggtcgctgcggtcgggtcgagccgggtatctgcgtgcgcttgtacagcgaggaggatttcctcggtcgcccggaatttaccgatccggaaatcctgcgcaccaacctcgcggcggtgattctgcagatgctccatctgcgccttggcgagatcactgatttcccgtttatcgagccgccggacggcaaggcgatcagcgacggtttcaacctgctgcaagaactctcggcagtggatcgcaacagtcagctgaccccgctcggccgccagttggcgcgcctgccggtggatccgcgcatgggccgcatgctgctggaagcggcgaagctcggcagcctgcaggaagtgctgatcgtcgccagcgccatgtcgattcaggacccgcgcgagcgtccgccggagcgtcagcaagccgctgaccaggcccacgcgcagtggaaggacgccgattcggacttcgctgcgctggtcaatctgtggcgtggcttcgaagaacagcgccaagcgttgaccgccagtccgctgcgcaactggtgccggaagaatttcctcaattatctgcgcctgcgcgagtggcgcgattcccatcgccagttgagtctgatctgccgcgacttgcagctgagcctcaataaagagccggcggattatccgaagctgcacaaagcggtgatggtcggcttgctcagtcagatcggccagaaaaccgaggacggcgattaccttggcgcccgtcagcggcggttctggattcacccgtcttcgggcatcggcaagaagcgcccgcagtgggtgatgaccgccgaactggtggaaaccaccaagctttacgcgcggatggtggcgaagatcgacgccgactggatcgagccgctggccgggcacttgatcaagaagaaccacttcgaaccgcactgggagaagaagcgcggccaggtcgtggcgttcgagcagatcaccctgttcggtctgatcgtggtcggtcgccgaccggtgcactacggcccggtggatcctgtggtttcgcgggagctgttcatccgcgaaggtctggtgcggggcgagattcagtcccgggccaagtgcctgaccgccaacaagcaattgctcgaacagctcgacgaactggaagccaaggcccgtcgccgggacattctggccgacgaagaaacgctctacgcgttctacgacgcgcgactgccggcggagattcaccagacggcgacgttcgatagttggtatagggtcaacagccagaaagatccgcaactgctgatcatgcgcgaggaagacgtgctggcccgcgaagccagcgaagtcaccgcgcagcattacccg

SEQ ID NO: 37335 - DNA, 1359 bp, Pseudomonas fluorescens
gacgtggtgattctgggcggtggccccggcggttataacgcagcgatccgcgccggccagttgggcctcaaggccgcgtgcgtcgagggccgcgccacgctgggtggcacctgcctgaacgtcggctgcatgccgtccaaggcgcttttgcatgcgtcagagctctacgaagcggcgctgggcgcggagttcgccaacctcggcatcgaagtcaaacccacgctcaaccttgcgcaaatgatgaagcagaaagacgaaagcgtgagcggcctgaccaaaggcattgaattcctgttccgcaaaaacaaggtcgactggatcaagggctggggccacatcgacggccccggaaaagtcagcgtgaccggtgatcagggcagccgcatcgaactgacggccaaggacatcgtcatcgccaccggctccgaacccactcccctgcccggcgtggagatcgacaacaagcgcatcctcgactcgaccggtgcgctgtccttgagcgaagtgcccaagcatctggtggtgattggtgcgggcgtgatcggtctcgaactcggctcggtctggcgccggctcggcgcgcaggtaacggtggtggaatacttagaccgcatctgccccggcgtcgacggcgaagccggcaagactctgcaacgctcgctgagcaaacagggcatcagcttcaagctgagctcgaaagtgaccagcgccacttcatcggccaacggcgtacaactcagcgtggagcccgccgctggcggcagcgcggaaatccttgaagccgattacgtgctggtggccatcggtcgtcgtccgtacacccagggcctgggcctggaaaacgtcggcctgagcaccgacaaacgcggcatgctcgccaataaacagcatcgcactgaagcgcctggcgtgtgggtgatcggtgacgtgacctccgggccgatgctcgcgcacaaggccgaagacgaagccatggcctgcatcgaacagatcgtcggcaaggccggcgaggtcaattacgacctgattcccaacgtgatctacacccgccccgagctggccagcgtcggcaagaccgaagagcagctgaaggcggaaggccgggcgtacaaggtcggcaaattcccgttcaccgccaacagccgggcgaagatcaatcacgagaccgaaggcttcgccaaagtcatcgccgatgagcgcaccgacgaagtcctcggcgtgcacctggtcggcccgagcgtcagcgaaatgatcggcgagttctgcgtggccatggagttcagcgcctcggccgaggacatcgcgctgacctgtcacccgcatccaacccgctccgaagcgttgcgtcaggcagcgatg

SEQ ID NO: 37336 - DNA, 1332 bp, Pseudomonas fluorescens
atgactttcgccacccttggcctgatcgaacccttgctgcgctccctcgagaagctcggctaccagaccccgacgccggtgcaggcgcaagctattccggtcgtgctggccggtcgcgacctgatggccgcggcccagaccggcaccggcaagaccgccggttttgctttgccgctgctgcaactgctggcgatggaagggccgaaagtcaccgccaactcggtgcgcgcgctgattctggtgccgacccgcgagctggccgagcaagtccacgaagccgtgcgccagtacgctgagaacctgccattgcgcacttacgcggtgtacggcggcgtcagcatcaacccgcagatgatgaagctgcgcggcggtgtcgatctgttggtcgcgaccccgggccgtctgctcgacctgttccgccagaacgcgctgaagttcaaccagctgcaaactctggtgctggacgaagccgaccgcatgctcgacctgggcttttccgaggagctggcgaacatttaccgcgcgctgccgaagaagcggcagacgctgctgttctccgcgacgttctccgatgacatccgcctgctggccgggcagatgctcaacgatccgcagagcatcgaagtcagcccgcgcaacgtggccgccaacaccgtcaagcagtgggtggtgacggtggacaagaagcgcaagccggaactgttcgtgcacttgatgcgcaagaacaagtggaagcaggtgctggtgtttgccaagacccgtaatggtgtggacgcgttggtcgagaaacttcagggcctgggcgtgaacgccgacggcatccacggcgacaagccgcaagcgacccggcagcgggcactggaccgtttcaaactgagcgaagtgcagattctggtggccactgatgttgctgcccgtggtctggatatcgaagatttgccgctggtggtcaactttgatctgccgatcgtggccgaggattacattcaccgtatcggccggactggccgcgcgggttcgaccggtgaggcgatttcgctggtgtgcgctgatgaagtgaacatgttgtcggcgattgaaatgctcacccgcagcaccttgaagcgcgagatcgaaccggactttgtgcccgagcaccgcgtgccggacaccgatgccagtggtcaggtgatcaagaaaccgaagaaaccgaagaaaccgaaggcttccggtggcggtggtgccaagcgcaatctgggcaagtgggtggacagcggcgagactcaggcgccggagccttcgatcaagcctgtgcgcaaggtgccggtgttcaataccgggccgcgcaagcgt

SEQ ID NO: 37337 - DNA, 4201 bp, Pseudomonas fluorescens
ttgaaagacctactgaatttgctgaaaaaccagggtcaagtcgaagagttcgacgccatccgtatcggattggcctcgcctgagatgatccgctcgtggtcgttcggtgaagttaaaaagccggaaaccatcaactaccgtacgttcaaacctgagcgtgacggtctgttctgcgccaagatctttggcccggtaaaggattacgagtgcctgtgcggtaagtacaagcgcttgaagcaccgtggtgtgatctgcgagaagtgcggcgttgaagttgcactggccaaggttcgtcgtgagcgcatggcgcacatcgaactggcttcgccggttgcccacatctggttcctgaaatcgctgccgtcccgtatcggcctgctgatggacatgaccctgcgtgatatcgaacgcgttctctatttcgagagctatgtcgttatcgacccaggcatgaccactcttgaaaaaggtcagctgctgaacgacgagcagtacttcgaagcgctggaagaattcggtgacgatttcgacgcccgtatgggtgctgaggctgtccgtgaactgctgcacgctatcgacctggaacacgagattggccgtctgcgtgaagaaattccgcaaaccaactccgaaaccaagatcaagaagctgtccaagcgtctgaagttgatggaagccttccagggttccggcaacctgccagagtggatggtgctgaccgttctgccggttctgccgccagatctgcgtccactggtcccgctggatggcggtcgtttcgcgacttccgacctcaacgatctgtatcgtcgagtgatcaaccgtaacaaccgtttgaagcgcctgctggatctgtccgctcctgacatcatcgtgcgcaacgaaaagcgtatgttgcaggaagctgtcgatgcactgctcgacaacggtcgtcgtggccgcgctatcaccggttcgaacaagcgtcctctgaaatccctggctgacatgatcaagggtaagcaaggtcgtttccgtcagaacttgctcggtaagcgtgttgactactcgggtcgttcggtaattaccgtaggtccgaccctgcgtctgcatcagtgcggtctgccgaagaagatggctctcgagctgttcaaaccgttcattttcggcaagctggaaatgcgtggtctggcgaccaccatcaaagcggccaagaaaatggtcgagcgcgaactgccagaggtttgggatgttctcgctgaagtgattcgcgaacacccggttcttctcaaccgtgcaccgacccttcaccgtctgggtatccaggcgtttgaaccggtactgatcgaaggtaaggctatccagctgcaccctctggtctgcgccgcgtacaacgctgacttcgacggcgaccaaatggccgtgcacgtgccgctgacactggaagcccagctcgaagcgcgtgcgttgatgatgtcgaccaacaacattctgtcgccagccaacggtgagccaatcatcgttccgtcgcaggacgttgtattgggtctgtactacatgactcgtgaagcgatcaacgccaagggcgaaggtcgtgtgttcgcggatctgcaggaagttgaccgtgtgttccgtgccggcgaagccgcactgcacgccaagatcaaggttcgtatcaacgaaaccgtgaacgatcgtgacggcaacagcgtgaacaacactcgtatcgtcgacaccactgtcggccgtgcgctgctgtttcaggttgtgccaaaaggtctgtcgttcgacgtcgtcaacctgccgatgaagaaaaaggcgatctccaagctgatcaaccagtgctaccgcgtggttggtctgaaagagaccgtgatcttcgctgaccagttgatgtacaccggttttgcctattcgaccatttccggcgtttccatcggtgttaacgatttcgttatcccggatgaaaaagcccgcatcatcggtgctgccaccgacgaagtgaaagaaatcgagagccagtacgcctccggcctggtaacccagggcgagaagtacaacaaagtgatcgacctttggtcgaaagcgaacgacgaagtctccaaggcgatgatggccaacctctcgaaagagaaagtcatcgaccgtcacggcgacgaagtcgagcaagaatcgttcaactcgatgtacatgatggcagactcgggtgcgcggggttccgcagcacagattcgtcagctggccggtatgcgtggtctgatggccaagccggacggttccatcattgaaacgccgattactgcgaacttccgtgaaggtctgagcgtactccagtacttcatctcgactcacggtgctcgtaaaggtctggcggataccgcgttgaaaactgcgaactccggttacctgactcgtcgtctggtagacgtggcgcaggatctggtcgtgaccgagatcgattgcggcaccgaacacggtctgctgatgactccgcacattgaaggcggtgacgttgtagagccgttgggtgagcgcgtattgggtcgtgtcattgcccgtgacgtattcaagccgggtaccgaggacgtcatcgttcctgctggcactctggtagacgagaagtgggtcgagttcatcgagctgaacagcatcgacgaagtgatcgtgcgttcgccgatcagctgcgaaacccgctatggcatttgcgccaagtgctacggccgtgatctcgctcgtggtcaccaggtgaacatcggtgaagcagtcggcgttatcgctgcccagtccatcggtgagccgggtacccagctgacgatgcgtacgttccacatcggtggtgcggcaagccgtacttccgcagccgacagcgttcaggtgaagaatggcggtaccgtccgtctgcacaacctgaaacacgttgagcgtgtggatggcaacctggttgctgtgtcccgttccggtgagctggcaatcgctgacgacttcggtcgtgagcgcgagcgttacaagctgccgtacggtgccgtgatttcggttaaagaaggtgacaaggtcgacgctggcgcaatcgtggccaagtgggatccgcacactcacccgatcgttaccgaaatgaaaggtaccgtgacctacgtgggcatggaagaaggcatcacgatcaagcgtcagactgacgaattgaccggtatgaccaacattgaagtactcgatgccaaagaccgtccggctgccggcaaggacattcgtcctgcggtgaagatggttgatgacaacggcaaggatctgttgctgccaggcactgacgttatcgctcagtacttcctgccagccaacgccctggtcggtgttgcggacggtgcgaagattgcgatcggtgatgttatcgctcgtatcccgcaagaaacttcgaaaacccgtgacatcaccggtggtctgccgcgtgttgcagacctgttcgaagcccgtcgtccgaaagaagcgtcgattctggctgaagtcagcggcaccatcgcgttcggtaaagagaccaagggcaagcgccgtctggtcattaccccgaacgacggtagtgatccgtatgaagagctgattccgaagtggcgtcacctgaacgtgttcgaaggcgagcaggtaaaccgcggcgaagttatctccgacggtccgagcgatccgcacgacatcctgcgtctgctgggtgtgagtgcgctggccaagtacatcgtcaacgagatccaggacgtttaccgtctgcaaggcgtgaagatcaacgacaagcacatcgagaccatcctgcgtcagatgctgcgtaaggttgagatctccgagtctggcgattccagcttcatcaagggcgaccagatggaactgactcacgttctggtagagaacgagcgtctgaacgcggaagacaagtttgtctccaagttcacccgcgttctgctgggtatcaccaaggcgtcgttgtcgaccgaatcgttcatctcggcggcttccttccaggaaaccacccgcgtgctgaccgaggcggcggtaaccggcaagcgcgattacctgcgcggccctgaaagaaaacgtggtcgtgggtcgtctgatcccggccggtaccggtctggcttatcacagcgagcgcaagcgtcgtcgtgatgcagacaagccgttgcgcgtaagcgccagtgaagtggaagctgcactgaccgaagcgctgaactcgagcggtaactga

SEQ ID NO: 37338 - DNA, 1074 bp, Pseudomonas fluorescens
atggctgatttaccgatcaacgacctgaacgtcgcttccaacgagaccctgatcactcccgatcagctcaagcgtgatatccctctgagcgacgctgccctgcgcaccgtcacaaagggtcgcgaggtcatccgcaacattctcgatggcaccgaccatcgtctgttcgtggtgatcggcccctgctcgatccacgacatcaaggctgcccacgaatatgccgatcgcctgaaggtgctggcggcagaagtctcggacaccctgtatctggtcatgcgcgtgtatttcgagaaaccacggaccaccgtcggctggaaaggccttatcaacgacccgtacctggatgactcgttcaaaatccaggacggtctgcacatcggtcgccagttgctgctggacctggccgagaaaggcctgccgaccgcaaccgaagccctcgacccgatctccccgcagtatctgcaggacctgatcagctggtcggccatcggcgcccgtaccaccgaatcccagacccaccgcgagatggcttccggcctgtcttcggcggtcggcttcaagaacggcaccgacggcggcctgactgtggcgatcaacgccttgcagtcggtttccagcccgcaccgtttcctgggtatcaaccaggaaggtggcgtgtcgatcgtcaccaccaaaggcaacgcctacggtcatgtggtgctgcgcggcggcaacggcaagccgaactacgactcggtcagcgtcgccctgtgcgagcaggcgctgaacaaggcgaagatcaagccgaacatcatggtcgactgcagccacgccaactccaacaaggatccggccctgcaaccgttggtgatggagaacgtcgccaaccagatcctcgaaggcaaccagtcgatcatcggcctgatggtcgaaagtcacctgaactggggctgccaggcgatcccgaaagacctcgccgacctgcaatacggcgtgtcgatcaccgatgcgtgcatcgactggtccgctaccgaaaacaccttgcgcagcatgcacgccaagctcaaggatgtcctgccgaaacgtcagcgcggc

SEQ ID NO: 37339 - DNA, 828 bp, Pseudomonas fluorescens
atgctgctgcgttttaccaagatgcatggcctgggcaacgacttcatggttctcgacctggtcagtcagcacgcgcatattcagcccaagcacgcgaaaatgtggggcgaccggcacaccggcatcggtttcgaccagttgctgatcgtcgaggcgccaagcaatccggacgtggatttccgttaccggatcttcaactccgacggctccgaagtggagcagtgcggcaacggtgcacgctgcttcgcccgcttcgtgcttgataaacgcctgaccgccaaacggcagatccgcgtcgagaccaagggcggcatcattgagctggacgtgcgtaacgacggccagatcggcgtgaacatgggcgccccgcgcctggtgccggcggacatcccgttccaggcgccggagcaggccctgagttatcaggtcgatgtcgacggtacgccggtcgatctggcggcggtgtccatgggcaacccccatgcggtgctgcgggtcagcgatatcaacactgcaccggtgcatgaactggggccgaaaatcgaacaccatccgcgcttcccggcgcgggtcaacgtcggttttctccaggtcatcgaccgccatcgcgcgcaactgcgcgtgtgggaacgcggcgccggggaaacccaggcctgcggcaccggtgcctgcgctgctgctgtagcggcgatcagtcaggggtggatggattcgccactgttgatcgacctgccgggcgggcgtttgtccatagagtgggcaggccccggccaaccggtgttgatgaccggcccggcagtgcgcgtatacgaaggacaagtgcgtctt

SEQ ID NO: 37340 - DNA, 1245 bp, Pseudomonas fluorescens
atggacgcttttaactaccgtggcggggaactgttcgcggaaggtgtggcgctgtccgccatcgccgatcgcttcggcactcccacctacgtttactcccgcgcgcacatcgaggcccagtacctggcctacgccgatgcgctggccggcatgccgcacctggtgtgctttgcggtcaaggccaactccaacctcggcgtcctgaatgtcctggcccgtatcggcgccggtttcgacatcgtttcccgcggcgagctggaacgcgttctggccgccggcggcagcccggacaagatcgtgttctccggcgtcggcaagacccgtgacgacatgcgccgtgcgctggaagtcggcgtgcattgcttcaacgtcgaatccactgacgagctcgagcgcctgcaagtggtcgccgccgagctgggcgttcgcgcgccgatttcgctgcgcgtgaacccggacgtcgatgccggcacccacccgtacatttccaccggtctcaaagagaacaagttcggcatcgccatcgccgacgccgaagacgtgtacgtgcgtgccgcgcacctgccgaacctggaagtggtcggcgtcgactgccacatcggttcgcaactgaccactctgcctccgttcctcgatgccctcgaccgcctgctggatctggtcgatcgcctcggcgattgcggcatccacctgcgccacatcgatctcggtggcggcctgggtgtgcgttatcgcgatgaagagccgccattggccgccgattacatcaaggctgtgcgcgagcgtctggtcggccgtgatctggcgctggtgttcgaaccgggccgcttcatcgtcgccaacgccggcgtgctgctgacccaggtcgagtacctcaagcacaccgaacacaaagacttcgccatcgtcgacgcggccatgaacgacctgatccgcccggcgctgtaccaggcctggatggacgtgaccccggtcaagccacgcgagaccgctgcgcgtacctacgacgtcgtcggcccgatctgcgaaaccggcgacttcctcgccaaggaacgcgaactggcgctggaagaaggcgatctgctggccgtgcattcggccggtgcctacggtttcgtgatgagctccaactacaacacccgcggccgcgccgccgaagtgctggtggatggcgatcaggcctttgaagtgcgtcgccgcgaaaccgtggccgagctgtttgccggcgaaagcctgctgccggag

SEQ ID NO: 37341 - DNA, 2640 bp, Pseudomonas fluorescens
ggagagatgctgatgaccgatattgatgcacgcttgcgcgaagacgttcacctgctcggtgagctgttgggcaacaccattcgtgaccagtacggcgaggcgtttctcgacaagatcgagcagatccgcaaaggcgccaaggccgaccggcgtggctcgatggacgccgaactcagcgccagcctcaatcaattgagcgaagacgaactgctgccggtggcgcgggccttcaaccagtttctcaacctggcgaacatcgctgagcaataccagctcatccatcgccgcgaagagacccaggctgcgccgttcgagtcccgcgtactgccggaactgctcgcccgcttgcgcaacgaagggcacagcgccgaatccctggcgcggcaactggcgcggctggaaatcgaactggtgctcaccgcgcacccgaccgaagtggcccggcgcacgctgatccagaagtacgacgcgatcgccgcgcaactggcggctcaggatcaccgtgacctgaccacggccgagcgcgagcagatccacaacaccctgcaacgcctgatcgccgaggcctggcacaccgaagaaatccgccgcacccggccgactccagtggacgaagccaagtggggttttgcggtgatcgaacactcgctgtggcaggcgattccccaccatatgcgcaaggccgatcaggcgctgtttgcggccaccggtttgcgtttgccactggaagccgcgccgatccgcttcgcttcgtggatgggtggcgaccgtgacggcaacccgaacgtgaccgctgccgtgacccgcgaagtgttgttgctggcgcgctggatggcggcggatctgtacctgcgcgacgtcgatcacctggccgccgaactgtcgatgcagcaggccagcgacgcgctcaaggcccgggccggcgacagtgccgagccgtatcgggcggtgctcaagcaattgcgtgaacggctgcgcgccacgcgcaactgggcccatgcatctttgacggcgaccacgccggcgcctgccgatgtgctgcacaacaaccgcgacctgctcgatccgctggagctgtgtttcaactcgctgcacgaatgcggcatgggtgtgattgccgacgggccgttgctcgattgcctgcgccgggccgtgaccttcggcctgttcctggtgcgcctcgatgtacgtcaggattcgtcccgtcacagcgcggccatgaccgaaatcaccgattacctcggcctcggcaaatacgaggagtgggacgaagaacagcgcatcagcttcctcactcgcgagctgcaaaaccgtcggccgttgctgccggcgcatttcaaaccttcggccgacaccgccgaagtgctcgccacctgcaaggaaatcgccgccgcgccgggcgcttcgctgggctcctacgtgatctccatggccggtgccgcttccgatgtgctggcggtgcaattgctgctcaaggaatccggcgtactgcggccgatgcgcgtggtgccgctgttcgaaaccctcgccgacctggataacgccggcccggtgatcgagcgcctgttgctgctgccgggttaccgtgcgcggctgcaaggcccgcaggaagtgatgatcggctattccgattcggccaaggacgccggcaccactgcggcggcctgggcgcagtaccgggcgcaggagcggctggtggaaatttgccgcgagcagcaagtcgaactgctgctgtttcacggtcgcggtggcaccgtgggccgtggcggcggcccggcgcacgcggcgattctgtcgcagccgccgggttcggtggccggacgtttccgcaccaccgagcagggggaaatgattagattcaaattcggcctgccggacatcgccgagcaaaacctcaatctgtatctggcggcggtgctcgaagcgaccctgttgccaccgccaccaccgacgcctgaatggcggcatttgatggacgaactggccgctgacggtgtcgccgcctaccgcgcggtggtgcgggagaatccacagttcgtcgagtatttccgccagtcgaccccggagcaggagttggggcgtttgccattgggcagtcgtccggccaagcgccgtgccggtggcatcgagagcctgcgggcgattccgtggatcttcggctggacccagactcgcctgatgctgccggcctggcttggctgggaaaccgcgttgagcaaggcgctggagcgcggcgaaggcgaattgctcgggcagatgcgtgagcagtggccgttcttccgcacgcgcatcgacatgctggaaatggtgctggccaaagccgacgccgacattgcgctgtcctacgacgaacgattggtggagccggacttgctacctttgggtgcgcacttgcgcgacctattgtcgcaggcgtgttccgtcgtcctcggcctgaccggccagtcgcagctactggcacatagcccggacaccctggaattcatccgcctgcgcaacacctacctcgacccgctgcatctattgcaggccgagttgctggcgcgttcgcggcgacagaatgtcgagcagggcagcccggtggaacaggcgctgctggtgtctgtggcggggattgccgccggtttgcgaaataccggc

SEQ ID NO: 37342 - DNA, 1008 bp, Pseudomonas fluorescens
atgactcttcgaatcgcaatcaatggttttggccgcatcggccgtaatgtcctgcgcgcactgtatacccaaggctatcgtcaggatttgcagatcgtcgccatcaacgatctgggcgacagcgcgattaatgcgcatctgctcaagtacgacaccgttcatggcacattcgacgccgaagtggctcatgacaacgagagcctgaccgtcaacggcgaccgcatttcggtcagcgccatccgcaacccggccgacctgccatgggccgcggaaaagattgatgtggtgttcgaatgcaccggtctgttcaccgaccgggccaaagccgctgcgcatattaccgccggcgcacgcaaagtgattatctcggccccggccaaaggcgccgatgccaccgtcgtttacggtgtgaaccacgacattctgcgccagtcgcaccagatcatttccaacgcgtcgtgcaccaccaactgcctcgcgccagtcgcgcaagtgctgcaccgcgagttgggcatcgaaagcggtctgatgaccacgattcacgcctataccaacgaccagaacctgaccgacgtttatcacaccgacccgtaccgcgcgcgctccgccacccagaacatgatcccgagcaagaccggcgctgccgaagccgtgggcctggtgctgccggaactggccggcaagctgaccggcatggccgtgcgtgtaccggtgatcaatgtgtcgctggttgacctgaccgtgcagctgaagcgcgaagcctcggccgatgaagtgaacgccctgatgaaagccgcgagccagcattcgaagatcctcggcttcaacaccctgccgctggtatcgagcgacttcaatcacaacccactgtcatcgatcttcgacgccaaccacaccaaagccagcggcaaactgctgaaagtgctggcctggtacgacaacgagtggggcttctccaaccgcatgctcgataactgcctggcgctgtgcaacgcggaataatccccc

SEQ ID NO: 37343 - DNA, 1362 bp, Pseudomonas fluorescens
gaacgcatcgccaagggcgcgcggttcctcgattcgctgctggacaaggaaggtgtgatctacggcgtgaccaccggttacggagactcctgcgtggttgcggtgccgttgcatcacgtcgaggcgctgccgcgtcatctctacacgttccacggttgcgggctgggcaaactgctcgacgcccaggccacccgcgcggtgctggcggcgcgtttgcagtcgttgtgccacggcgtatccggggtgcgcatcgagttgctggaacgcctgcatgccttccttgaacacgacattttgccgctgattcctgaagagggttcggtgggcgccagcggcgacctgacgccgctgtcctacgtcgccgcaaccctgtccggcgagcgtgaagtgatgttccgtggcgaacgccgccaggctgcggacgtgcaccgtgaactgggctggacaccattggtgctgcgtccgaaagaagcgctggcgctgatgaacggcaccgccgtgatgaccggtctggcgtgcctggcttacgcccgcgccgactacctgctgcaactggccacccgcatcactgcgttgaacgtggtggcgctgcaaggcaatccggaacacttcgacgagcgcctgttcgccgccaagccgcatccgggtcagatgcaggtggccgcgtggctgcgcaaggatctggcaatcgacgcgccgaccgcgccgctgcaccgcttgcaggatcgctactcgctgcgctgtgcaccgcacgtgcttggcgtattggccgacagcctgaactggctgcgctcgttcatcgaaaccgaactcaacagcgccaacgacaacccgatcatcgacgccgaagccgagcgcgtgctgcacggcggacacttctacggcgggcatatcgcgttcgccatggacagcctgaaaaacctcgtggccaacgtcgccgacctgctcgaccgacaactcgcgctgctggtcgacgagcgttacaaccacggtttgccgagcaacctgtccggcgccagcgccgaccgcgcgatgctcaaccacggcttcaaggccgtgcaaatcggcgccagtgcctggactgccgaagcgctgaaaaacaccatgccggccagcgtgttctcacgctccaccgagtgccacaaccaggacaaggtgagcatgggcaccatcgccgcccgcgacgccattcgcgtgctggagctgaccgaacaggtcgccgccgccacgttgctcgcggccaatcaaggcgtgtggctgcgcggccgcgatgaagacgctcgcccactgccaccgtcgctggccgccatgcatgaacaactggcccaagacttcccgccagtgatcgaagaccgcgccctg

SEQ ID NO: 37344 - DNA, 1804 bp, Pseudomonas fluorescens
atcgcttacgccaacgatggcgaaatcctggtcggtcagtcggcacaagcagtcaggctgtgaccaacccagcacaagacccttttacgcagtgaagcgtctgatcggtcgccgattcgaagaagaagttgtacagaaagacatcaagctggtgccttacaagatcgtcaaggctaacaatggtgacgcttgggtcgaggcctccggcaagcagatggctccgccgcaaatcagcgccgaagtcctgaaaaagatgaagaagaccgccgaagactatctcggtgaggatgtgaccgaagcggtgatcaccgttccggcgtacttcaacgacagtcagcgtcaggcaactaaagatgctggccgcatcgccggtctggacgtaaaacgtatcatcaatgaaccgaccgctgctgctctggcttacggtatggacaaggccaagggcgatcacaccgtgatcgtttacgacctcggtggtggtactttcgacgtctccgtgatcgagatcgctgaagttgacggcgagcaccagttcgaagtgctggccaccaacggcgacaccttcctgggtggcgaagacttcgacatgcgcctgatcgactacctcgtcgacgagttcaagaaagagtccggcatggacctgaagaacgatcctctggccctgcagcgtctgaaagaagccgctgagaaagccaagatcgagctgtcttcctcgcagtcgaccgacgtcaacctgccgtacattactgcagacgcgaccggtccgaagcatctgaatgtgaagatctcccgtgccaagctcgaatcgctggttgaagatctggtgactcgtaccatcgagccatgccgcattgctctgaaagacgccggcatcgacgccagcaagattgacgacgtgatcctggtcggcggtcagacccgtatgccgatggtgcagaaagctgtttcggatttcttcggtaaagaagcacgtaaagacgtgaacccggacgaagctgttgccatgggtgctgcgatccagggcgccgttctggccggtgacgtgaaagacgttctgctgctcgacgtcagcccgctgaccctgggtatcgaaaccatgggtggcgtgatgaccgcgctgatcgagaaaaacaccacgattcctaccaagaaatcgcaagtgttctcgacggccgacgacaaccagggcgccgtgaccattcacgtcctgcaaggcgagcgcaagcaagccgcacagaacaagtccttgggcaagttcgacctggccgatattccacctgctccacgtggtgtgccgcagatcgaagtgaccttcgacatcgacgccaacggcatcctgcacgtaggtgcgaaggacaaggcgactggcaaagagcagaagatcaccatcaaggccaactctggtctgtcggatgaagaaatccagaagatggtgcgcgacgccgagctgaacgccgaggaagaccgcaagttcgaagagctggccgctgcccgtaaccagggtgatgcactggttcactcgactcgcaagatgatcgccgacgctggcgacaaagtgactgcagaagagaagactgcaatcgaagcggctgtggttgccctggaagctgccgtcaaaggcgacgacaaggctgccattgacgccaaggttgaagagctgtcgaaagtctctgcaccggttgctcagaagatgtacgccgaacaggctcagcctgctgaaggcgcagcaccgcacgacgagaaagctgaaaaggctgacgatgttgttgatgccgagttcgaagaagtcaaagaccacaagtaa

SEQ ID NO: 37345 - DNA, 1122 bp, Pseudomonas fluorescens
atggctaagcgtgactattacgaagtgttgggtgttgagcgcggctcaagcgaagcagacctgaaaaaggcctatcgccgtctggcgatgaagcaccacccggaccgtaatcccggtgacaaggcgtcggaagatctgttcaaggaggccaacgaagcctacgaagtgctgtccgattccagcaagcgtgcagcgtacgatcagtacggtcatgccggcgtcgacccgagcatgggcggcgggggtgccggtttcggcggtcagaacttctccgacatcttcggtgatgtcttcagtgacttcttcggtggcggtcgcggcggttcccgtggcggcgcccagcgcggcagcgatttgcgttacaccctggagctgaacctggaagaagcggtacgcggtacgaccgtgaatatccgcgttccgacactggtcaattgcaaaccatgtgatggatcgggtgccaagaaaggctcgtcgccatcgacgtgcccgacgtgcggcggcatcggtcaggtacgcatgcagcaaggcttcttctcggtgcagcagacctgcccacgttgccatggtcagggcaagatcatttccgatccgtgcgactcatgccacggcgacggtcgcgtcgaagaatacaaaaccctttccgtcaaagtgccggccggtgtcgacaccggtgaccgcattcgtctgtccggtgaaggcgaggcgggcactcagggtggcccgaccggcgacctgtacgtggtgatcaatgtccgcgaacacgacatcttccagcgtgacggcaagcatctgttctgcgaagtgccgatcagcttcgtcgacgcggccctggggggcgagctggaaattccgaccctcgacggtcgcgtcaagctgaagattccggaagggactcagaccggcaagcagttccgcgtgcgcggcaaaggcgtggcgccagtgcgtggcggtggtgcgggtgacctgatgtgccgcgtggccgtcgagacgccggtcaatctgacccgtcgtcaacgtgaactgctggaagagttccgcagctccctggcggacgacaacagccactccccgaaaaccaccggttggttcgacggtgtgaaacgcttcttcggcgatctg

SEQ ID NO: 37346 - DNA, 804 bp, Pseudomonas fluorescens
atgcgacgtatagctgtgatgggcgctgccgggcgcatgggcaagattctggtcgaggcggtgcagcagcgcgcgccactgaccggtctgacggccgcgattgtccgccctggcagtacgctgatcggtgtggatgccggtgagctggcttcgctcggtcgaatcggcgtgccgctgtccgggaatctggaatcagtggcggaagagttcgatgtgttgatcgacttcaccctgccggaagtgatgctgaaaaacctggccttctgccgcaaggccggcaaggcgatggtgatcggcacgaccgggctggacgctgcgcagaagcagttgctggccgaggcgggcaaggatattccgatcgtgttcgccgccaacttcagtgtcggcgtcaacctgtcgctgaagctgctcgacatggcggcacgggtgttggcggaagatgcggacatcgaaatcatcgaagcccatcaccggcacaagattgatgcgccgtcgggtacggccttgcgcatgggtgaagtgatcgccaatgcgctggatcgtgatctgcagaaagtcgcggtctatggtcgtgaaggccacactggtgcccgtgagcgtgaaactatcggctttgccactgttcgcggtggtgatgtagtgggcgatcacacggtgttgtttgcctgcgagggcgagcggctggagatcacgcacaaggcttcgagtcgcatgacattcgccaagggcgcggtgcgtgcggcgttgtggctggatgctcgcgagcctggtttgtacgacatgcaggacgtgctcggcctgcat

SEQ ID NO: 37347 - DNA, 1134 bp, Pseudomonas fluorescens
ttgactaagccagccatactcgcccttgctgatggcagcatttttcgcggcgaagccattggagccgacggtcagaccgttggtgaggtggtgttcaacaccgcaatgaccggctatcaggaaatccttaccgatccttcctacgcccaacagatcgttaccctgacttacccgcacatcggcaacaccggcaccacgccggaagacgccgagtccgatcgcgtctggtccgctggcctggtcattcgtgacctgccgctggtagcgagcaactggcgtaacacgatgtccctgtccgattacctgaaagccaacaatgttgtggcgatcgccggtatcgacacccgccgcctgacccgcatcctgcgtgaaaaaggcgcacagaacggctgcatcatggccggcgacaacatctccgaagaggcggccatcgccgcggcgcaaggcttcccgggcctgaagggcatggatctggcgaaagtcgtcagcaccaagacccaatacgaatggcgctccactgtctgggatctgaaaaccgacagccacgcgaccatcgaagcctccgagctgccttaccacgtggttgcctacgactacggcgtcaaggtcaacatcctgcgcatgttggtcgagcgcggctgccgcgtcactgtcgttccggcacagaccccggcggccgacgtgctggccttgaagccggacggcgtgttcctgtccaacggtcctggtgatccggagccttgcgactacgcgatccaagcgatcaaggaagtgctggaaaccgaaattccagtcttcggcatctgcctcggtcaccagctgctggctctggcctccggcgccaagaccctgaaaatgggccacggccaccacggtgccaaccacccggtgcaggatctggacactggcgtcgtgatgatcaccagccagaaccacggtttcgcggttgacgaagaaaccctgccagccaacgtccgcgcgatccataaatcgctgttcgacggcaccctgcaaggcatcgagcgcaccgacaagagcgcgttcagcttccagggtcaccctgaggcgagcccgggcccgaacgatgtggcccctctgtttgaccgcttcatcaacgagatggccaagcgacgc

SEQ ID NO: 37348 - DNA, 3216 bp, Pseudomonas fluorescens
atgccaaaacgtacagacattaaaagcatcctgattctcggcgctggcccgatcgttatcggccaggcctgcgaattcgactactccggcgcccaggcctgtaaagccctgcgcgaagagggttaccgcgtcatcctggtgaactccaacccggccaccatcatgaccgacccggacatggccgacgcgacctacatcgagccgatcaagtggcagaccgttgccaaaatcatcgaaaaagagcgtccggatgccgtgctgccaaccatgggcggccagactgctctgaactgcgccctggacctggagcgcgaaggcgttctggagaagttcggcgtagagatgatcggtgccaacgccgacaccatcgacaaggctgaagaccgttcgcgtttcgacaaggcgatgaaagccatcggcctggaatgcccgcgttccggtatcgcccacagcatggaagaagccaacgcggtgctcgagcgcctgggcttcccgtgcatcatccgtccgtccttcaccatgggcggcaccggtggcggtatcgcttacaaccgtgaagagttcgaagaaatctgcgcccgtggtctggacctgtcgccaaccaaggaactgctgatcgacgaatcgctgatcggctggaaagaatatgaaatggaagttgtccgcgacaaaaaggacaactgcatcatcgtctgctcgatcgagaacttcgacccgatgggcgtgcacaccggtgactcgatcaccgttgccccggcccagaccctgaccgacaaggaataccagatcctgcgtaacgcctcgctggcggtgctgcgcgagatcggcgtcgagaccggcggttccaacgttcagttcggtatctgcccggacaccggccgcatggtcgtgatcgagatgaacccgcgtgtatcccgctcgtcggctctggcctcgaaagccaccggtttcccgatcgccaagatcgcggccaagctggcggtcggttacaccctcgacgaactgcagaacgacatcaccggcggtcgtaccccggcgtccttcgagccgtccatcgactacgtcgtgaccaagctgccgcgcttcgctttcgagaagttcgccaacgctgatgcgcgcctgaccactcagatgaagtcggtcggtgaagtcatggccatcggccgtaccttccaggaatccctgcagaaagctctgcgcggtctggaagtgggtgtttgcggtctggacgagaaagtcgacctgagcaacccggaaagcatgagcgtgctcaagcgcgaactgactgtgccgggcgccgagcgtatctggtacgtggcggacgctttccgcgccggcatgaccgtcgaagaaatcttcggcatgaacatgatcgatccgtggttcctggtgcagatcgaagatctggtcaaggatgaagagaaggtcaagaccctcggtctgtccgctatcgaccgcgatctgatgtacaagctcaagcgcaaaggtttctccgaccagcgtctggccaagctgctgggcgtcaccgagaagaacctgcgcactcaccgccacaagctggaagtgttcccggtctacaagcgcgtcgacacctgcgcggccgagttcgccaccgacaccgcctacctgtactcgacctacgaggaagagtgcgaagccgcgccgtccggtcgcgacaagatcatcatcctcggcggtggcccgaaccgtatcggtcagggcatcgagttcgactactgctgcgttcacgcggcactggcgctgcgcgatgacggctacgagaccatcatggtcaactgcaacccggaaaccgtttccactgactacgacacttccgaccgtctgtacttcgaaccggtgaccctggaagacgtgctggaaatctgccgcgtcgagaagccgaagggcgtgatcgtccagtacggcggccagacgcctctgaaactggctcgcgccctggaagcagccggcgtgccgatcatcggcaccagccctgacgccatcgaccgtgccgaagaccgtgagcgcttccagcaaatggtcgagcgtctgaacctgcgtcagccgccaaacgctaccgtgcgcagcgaagacgaagccgttcgcgctgccgcgaaaatcggttacccgctggtggtgcgtccgtcctacgtactgggcggccgggcgatggaaatcgtctacaaggaagaagaactcaagcgttacctgcgtgacgcggtgcaagtgtcgaacgacagtccggtgctgctcgaccacttcctcaactgcgccatcgagatggacgtggatgcggtctgcgacggcaaggacgtagtgatcggcgcgatcatgcagcacatcgaacaggcgggcgttcactccggtgactccgcgtgctcgctgccgccgtactcgctgccggcacgcatccaggacgagatgcgcgaacaggtcaagaaaatggccctggagctgggcgtggtcggcctgatgaacgttcagttggcgctgcaaggcgaagacatctacgtcatcgaagtcaacccgcgtgcttcccgtaccgtaccgttcgtgtcgaagtgcatcggtatttccctggcaatggtcgcggctcgcgtgatggccggtaaaaccctgaaggaaatcggcttcaccaaagaaatcatcccgaacttttacagtgtgaaagaggcggtgttcccgttcgccaaattccctggcgttgacccgatcctcggcccagagatgaagtccactggtgaagtgatgggcgtcggcgacaccttcggcgaagccttcgccaaagcccagatgggcgccagcgaagtgctgccgaccggcggtaccgcattcatcagcgtgcgcgatgatgacaaaccactggttgcaggcgtggcccgtgatctgatcaacttgggcttcgaagtcgtcgccactgccggcactgccaagctgatcgaagccgcaggtctgaaagtgcgtcgcgtgaacaaggtgaccgaggggcgtccgcacgtggtcgacatgatcaagaatgacgaagtcactttgatcatcaacaccaccgaaggtcgccagtcgatcgccgattcctattccattcgccgtaacgccttgcagcacaagatttactgcaccaccaccattgctgctggcgaagctatctgtgaagcgctgaagttcggtcccgagaagaccgtacgccgcttgcaggatctacacgcaggattgaag

SEQ ID NO: 37349 - DNA, 1821 bp, Pseudomonas fluorescens
atggcaaagaatctgatcctgtggttgatcatcgcggctgtcctggtgacggtgatgaacaacttctccagccctaacgagccgcagaccctcaactattccgacttcatccagcaggtcaaggatggcaaggtcgagcgcgtggccgtcgacggctatgtgattaccggcaagcgcaacgatggcgacagcttcaagaccattcgtccggcaattcaggacaatggcttgattggcgacctggtcgacaaccacgttgtagtagaaggcaagcagcctgaacagcaaagcatctggacccagcttctggtagccagcttcccgatcctggtgatcatcgcggtgttcatgttcttcatgcgccagatgcagggcggtgcgggtggcaagggcgggccgatgagctttggcaagagcaaggcgcgtctgctgtccgaagatcaggtgaaaaccaccctggctgacgttgccggttgcgacgaagcgaaggaagaagtgggtgagctggtcgagttcctccgtgatccgggcaagttccagcgcctgggcggccgcattcctcgcggcgtgctgatggttggccctccgggtaccggtaaaaccttgctggccaaggcgattgccggcgaagccaaggtgccgttcttcaccatttccggttccgacttcgtcgaaatgttcgtcggtgtcggtgcgagccgcgttcgtgacatgttcgaacaggccaagaagcacgctccatgcatcatcttcattgacgagatcgacgccgttggtcgccatcgtggcgccggcatggggggcggtcacgacgagcgcgaacagactctcaaccagttgctggtcgagatggacggtttcgaaatgaatgacggcatcatcgtcattgcagcgaccaaccgtcctgacgtgctggaccctgctttgctgcgtccgggtcgtttcgaccgtcaggtggtggtcggcttgccggacatccgtggtcgcgagcagatcctcaaggttcacatgcgtaaagtgccaatgggtgacgatgtcgctccggccgttatcgcacgtggcacgccgggtttctccggtgccgatctggcgaacctggtcaacgaggcttctttgtttgctgcccgtgccggcaagcgcatcgtcgaaatgaaggagttcgaactggccaaagacaagatcatgatgggcgccgagcgcaaatccatggtcatgtccgagaaggaaaagcagaacaccgcttatcacgaagcaggccacgccattgttggccgcgtcgtgcccgagcatgatccggtctacaaggtgtcgatcatcccgcgcggtcgtgcgttgggtgtgaccatgttcctgccggaagaggatcgctacagcctgtccaagcgtgcgctgatcagtcagatctgctcgctgtacggcggccgtattgccgaagagatgactttgggctttgacggtgtaaccacgggtgcttccaacgacatcatgcgtgcgagtcagattgcgcggaacatggtgaccaagtggggtctgtcggaaaaactgggtccgttgatgtacgccgaagaagagggtgaagtattcctcggtcgcggcggtggcggtcagaatgccagcttctcaggtgagacagccaagctgatcgactccgaagtgcgcagcatcatcgatcagtgctacggcaccgccaaacagatactcacggacaaccgcgacaagctcgatgccatggcggatgccctgatgaagtacgagacgatcgatgccgagcagatcgacgacatcatggccggtcgtacaccgcgcgagcctcgcgactgg

SEQ ID NO: 37350 - DNA, 1335 bp, Pseudomonas fluorescens
atgagcaagaaatactttggtactgacggcattcgtggtcgtgtcggggaatacccgatcacgccggacttcatgctcaagctcggctgggctgccggtatggcctttcgcaagatgggcgcctgcaaggtgttggtcggcaaggacacgcggatttccggctacatgtttgaatcggcactcgaggctggccttacatctgcaggtgccgatgtaatgctgctcggccctatgccgactccggccattgcctacctgtcgcgtacattccaggccgaagccggaatcgtgatcagtgcatcgcacaatccccatgacgataacggcatcaagttcttctctggtaaaggcaccaagttgcccgatgagctggagctgatgatagaggaattgcttgatacgccaatgaccgttgtcgagtcgagcaagatcggcaaggtgtcgcgcatcaatgatgcgtcaggccgctatatcgagttctgcaagagctccgtgccgactggcaccagtttctccggcctgaggatcgtcatcgactgcgcacacggtgccacttataaggtagcgccgagtgtttttcgtgagctgggtgccgaggtcgttgttctgtcggctcagcctaacggtctgaacatcaatgacaactgtggctccacgcacatggggcaattgcaggcggcggtgttgtccgaacatgcggatctgggtatcgccttcgatggcgatggcgaccgggtgttgatggtcgatcacaccggggcgattgtcgatggtgacgagctgctgtacatcattgcgcgtgatctgcatgagcgcggcaagttgcagggcggtgtggtgggtaccttgatgagtaacctcgggctggagctcgcgctcgcagatctgggtattcctttcgtacgcgccaatgtcggcgaccgctatgtgatcgccgaactgctggagcgtaactggctggtgggtggcgagaactcggggcatgtcgtgtgtttcaatcacaccaccacgggtgatgcgatcattgctgctttgcaggtgctgatggcgctgaagacgcgtaacgaagggcttgctcaaactcgccaggcgttgcgcaagtgtccgcaggtgctgatcaacgtgcgtttcggtgggggggaaagcccgctggagcacccggctgtcaaggaagcgagcgctcgcgtaacccaggcgatggcgggtcgtggtcgcgtgcttttgcgcaagtccggaacagagcctctggtgcgtgtgatggtcgaaggcgaggacgaatcccaggttcgtggctatgccgaggaactggcaaaactggtaactgaagtttctgcc

SEQ ID NO: 37351 - DNA, 753 bp, Pseudomonas fluorescens
atgcgtcgccctatggtagctggtaactggaagatgcacggtacccgcgccagcgtcgctgagctgatcaacggccttcgtcatctggccttgccaagcggtgttgatgtcgcggtattcccgccttgcttgtatatcaatcaagtgattgatggcttgaaaggtaaatcgatttcggttggtgcgcagaattctgcggtggaatccatgcaaggtgccttgacgggcgagattgcgccgagtcagttggtggatgcaggttgttccctggtgcttgtcgggcactccgagcgtcgccagatcatgggcgagcgagacggaatgctgaatcgcaagtttgcagcggcgcaggcatgtggcttgattccggtgttgtgtgtaggggagaccctggagcagcgcgaagccggaaagactcttgaggttgtcgggcgtcagctgggcagtatcatcgaggagctgggtgtcggtgcttttgccaatgcggtgattgcttatgagccggtctgggcgattggtaccgggctgactgcaacgccgcagcaggctcaggatgtgcataaggccattcgtgagcagttggcggcagagaattctgaagtggcacgaggtgtgcgacttctatacggcggcagcgtgaaggcggccaatgcggtcgaactgttcggcatgccggatatcgatggggggctcattggtggggcttccctgaatgcagatgagttcggtgcgatttgtcgcgccgcgggaaac

SEQ ID NO: 37352 - DNA, 720 bp, Pseudomonas fluorescens
atgaataacaagaaggtcgtattggtcgtcggtgcaggtgatgccacgggcggtgccatcgccaaacggttcgccagggaaggattcatcgcttgcgtaacgcggcgcagcgccgacaaattgcagccgttggtggaagccattcaggcggccggcggcgaagcacacggctttgcctgcgatgcgcgcaaggaagaagacgtcattgcactgattgaggatatcgagacgcgtctcggaccaattgaagcattcgttttcaacatcggcgccaacgtgccctgcagcatcctcgaagaaaccgcccgcaagtatttcaagatctgggaaatggcctgcttctccgggtttctcaatgcccgggaagtcgccaaacggatggtgacccgtagccgcggcacgatcctgttcaccggcgcgactgccggattgcgcggtgcctccggcttcgccgcgtttgccggagccaagcacggtatccgggctctggcacagagcatggccagagagcttggcccgatgaacattcacgtcgcccacgtcgtggtcgacggcgccatcgataccgatttcatccgcgacaatttccctgacaaatacgccaccaaggaccaggagggcattctcaatccagagcatatcgccgagaactactggtatctgcatagccagccacgggacgcctggacgttcgagctggatctgcgtccgtggaacgaa

SEQ ID NO: 37353 - DNA, 2553 bp, Pseudomonas fluorescens
atgcgtatagaccgtttaaccagcaaattgcagttggcgttgtccgatgcccaatccctggctgttggccacgatcatcctgccatcgagccggcgcatttgatgcaggccatgcttgaacagcagggtggttcgatcaaacccctgttgatgcaggtgggcttcgacgtcaacagcttgcgtaaagagctgaccaaagagctcgatcaattaccgaaaatccagaatccgaccggcgacgtcaacatgtcgcaggatctggcgcgtctgctcaaccaggccgatcgtctggcccagcagaagggcgatcagttcatttccagcgagctggtgctgctcgccgcgatggacgagaacagcaagctcgggaagttgctgctcggccagggcgtgagcaaaaaggctctggaaaatgcaatcaacaacctgcgcggtggcgaggcggtcaacgacgccaaccacgaagagtcgcgtcaggcactggataagtacaccgtcgacctgaccaaacgcgccgaagaaggcaagcttgacccggtgatcggccgtgacgacgagatccgtcgcaccattcaggtgctgcaacgccgtaccaagaacaacccggtgctgatcggcgagcctggcgtgggtaaaaccgcgattgccgaaggtctggcccagcgcatcatcaatggtgaagtgccggacggcctgcgcggcaagcgtctgctgtccctcgatatgggggcgctgattgccggtgccaagtatcgcggcgagtttgaagagcgcctgaaagcgctgctcaacgagctgtcgaagcaggaagggcagatcattctgttcatcgacgaactgcacaccatggtcggcgccggcaagggcgaaggctcgatggacgccggcaacatgcttaaaccggccctggcccgtggtgagctgcattgcgtcggcgcgaccacgctcaacgagtaccgccaatatatagagaaggacgcggccctcgagcgacgcttccagaaagtgctggtggacgagccgagcgaagaggacaccatcgcgatcctgcgtggcctcaaggagcgttacgaggttcaccacaaggtggcgatcaccgacggcgcgatcatcgcggcggccaagctcagccatcgctacatcactgaccggcagctgccggacaaggcgatcgacctgatcgacgaggcggccagccgcatccgcatggagatcgactccaagccggaagtgctggatcgtcttgagcggcgcctgattcaactgaaggtggaatctcaggcactgaagaaagaaagtgacgacgcggcgaagaaacgtctggagaaactccaggaagaaatcgatcgccacgagcgtgagtactccgatctggaagaaatctggaactcggaaaaagccgaggtgcagggctctgcgcagattcagcagaagatcgaacagtcccgtcaggagctggaagccgcgcgccgtaaaggcgacctgaaccgcatggccgagttgcagtatggggtgatcccggatctggaacgcagcctgcaaatggtcgaccagcacggcaagagcgaaaaccagttgctgcgcagcaaggtgaccgaagaggaaatcgccgaagtcgtttcgaagtggaccggtattccggtgtcgaaaatgctcgaaggcgaacgcgacaagctgatgaagatggaaagcctgttgcatcaacgcgtgatcggccaggacgaagcggtggtggcagtagccaacgcggtgcggcgttcccgtgccgggttgtccgacccgaaccgcccgagcggctcgttcatgttcctcggcccgaccggtgtcggtaaaaccgagctgtgcaaggcgctggccgaattcctcttcgatacggaagaggcgatggtgcgaatcgacatgtccgagttcatggagaaacattccgtggcacggttgatcggggcaccaccgggctacgtcggctacgaagagggtggttacctgaccgaagcggtacggcgcaagccttactcggtgatcctgctggacgaagtcgagaaggcgcatccggacgtgttcaacatcctgctgcaagtgctggaggacggacgtctgaccgacagccatggccgcacggtggacttccgcaataccgtgatcgtcatgacctccaatctcggttcgatgcagatccaggaactggtcggtgatcgtgaagcacaacgggcagcggtgatggatgcgatttccacccacttccgtccggagttcatcaaccgcgttgacgaagtggtgatcttcgagccattggcgcgggatcagatcgcgggcatcaccgagatccagctgggccgtctgcgcaaccgtctggccgagcgcgagctgaagctggaactgagccctgaggcgatggacaagctgattgccgtcggttacgacccggtctatggcgcacggccgctgaagcgggcgatccagcgctggatcgagaacccgttggcgcagttgatcctgtcgggacgcttcatgccgggcgagaccgcaaccggtgtggtggagaacgacgagatc

SEQ ID NO: 37354 - DNA, 1008 bp, Pseudomonas fluorescens
atgtcccgcgttaccctgagtcgctatttgattgagcagacccgcagcaacaacactcctgccgatctgcgtttcctgatcgaagtggtggcgcgcgcctgtaaagaaatcagccacgccgtgtccaaaggcgccctgggcggtgttctgggcagcatgggcacggaaaacgtgcaaggcgaagtgcagaagaagctcgacgtgctgtcgaacgaaatcctgctcgaagccaacgaatggggcggtcacctggccggcatggcgtccgaagaaatggacaacgcctaccagatcccgggcaaatacccgaaaggcgcctacctgctggtattcgacccgctggacggttcgtcgaacatcgacatcaacgcgccggtcggcaccatcttctccgtgctgcgttgcccgaacgaatacctgagccagaacgaagccctggatgaaaaggccttcctgcagccgggcactcagcaagttgccgccggttatgccatctatggcccgcagaccatgctggtgctgaccctgggccacggcgtcaaaggcttcaccctggaccgcgaaatgggcagcttcgtcctgacccacgaagacatcactattcctgaaagcacccaggaattcgccatcaacatgtccaaccagcgtcattgggaagctccggtacagcgctacgtttcggaactgctggccggtgaagaaggcccgctgaaaaagaactacaacatgcgttgggtcgcggcgatggttgccgatgtgcaccgcatcctgacccgtggcggtctgttcatgtacccgcgcgacagccgcgagccgtccaaaccgggcaaactgcgcctgatgtacgaagccaacccgatgtcgttcctggtggaacaggcaggcggcgcttccaccgacggtcaccagcgcattctcgatatcaagcctgaaggcctgcaccagcgcgtagcggtgttcctcggctcgaaagaagaagtcgcccgcgccacggcgtaccacaaggaa

SEQ ID NO: 37355 - DNA, 906 bp, Pseudomonas fluorescens
atgacgacccgcaccgacgccgtaaaggcctatctgctcgacctgcaagaccgcatctgcgccgcgctggaaactgaagacggcggcacgcgcttcgtcgaagacgcctggacccgtccggccggcggtggcggtcggacccgggtgatcgagaacggcacggtgatcgaaaagggcggcgtcaacttttcccacgtcttcggcagtggcctgccaccgtctgccagcgcccatcggccggaactggccgggcgtggtttcgaagcccttggtgtgtcgctggtgatccacccgcacaacccgcatgtgccgacgtcccacgccaacgtgcgctttttcatcgccgagaaggaaggtgaagaaccggtctggtggttcggcggtggtttcgacctgaccccgtactacggcaacgaagaagactgcatacactggcaccgcgtcgccgaaaaggcgtgcgcgccgttcggtccggacgtctacccgcgctacaaggcctggtgcgacacctatttccacatcaagcatcgccacgagccgcgcggcatcggcggcctgttcttcgatgacctgaacgagtgggatttcgacaccagtttcgccttcatgcgcgccatcggcgatgcgtacatcgacgcttacctgccgatcgtgcagcgccgcaagaacgacgccttcaccgccaggcagcgtgagttccaggaattccgccgcggccgctacgtcgagttcaacctggtttacgaccgtggcaccctgttcggcctgcaatcgggcgggcgcaccgagtcgatcctgatgtcgctgccgccgcaagtgcgctgggcctacgactggaaagccgaaccgggcagcgaagaagcgcgcctgaccgagtacttcctgcaagatcgcgactggctagcc

SEQ ID NO: 37356 - DNA, 816 bp, Pseudomonas fluorescens
atggatcgttacgtcgttttcggtaacccgatcggccacagcaagtcgccgatgattcacaaactgttcgccgaacagaccgggcagagcctcgactacagcaccctgctggcgccgctcgacgatttttccggctgcgccacggcgtttttccaggaaggtcgcggcgccaacgtgaccgtgccgttcaaggaagatgcttatcgcctggccaacagcctgaccgcccgcgccgaacgcgcgggtgcggtgaacacgctgagcaaactggctgacggcagcctgctcggcgataacaccgacggcgccgggctggtgcgcgatctgacggtcaatggcgggttcagcctcaccggcaaacgcattctgctactcggcgccggtggcgcggtgcgcggtgcactggagccgttgctggcggagaaaccggcctcggtgatcatcgccaaccgcacagtggacaaggccgagctgctggctgaactgttttgtgatctggggccggtgtcggccagtggttacgactggttgcgtgaaccggtggacgtgatcatcaacgccacctccgccagcctcaccggcgatgtgccgccgattgcagaaagcctgatcgaacccggcaagaccctgtgctacgacatgatgtacggcaaggaaccgaccgcgttctgccgctgggccagcgagcatggcgcgggcgtggtgatggatggcttgggcatgctggcggaacaggcggcggaagccttcttcctgtggcgcggtgtgcgtcccgacactgcgccggttctggcggagttgcgtcgacaactgacg

SEQ ID NO: 37357 - DNA, 1488 bp, Pseudomonas fluorescens
aacattcttttcatcatggccgatcaaatggccgcgccaatgttgccgttctacggcccgtcgccgatcaaactgccgaatctcagccgcctcgccgaacaaggcgtggtgttcgatgccgcgtactgcaacagcccgctgtgcgcaccgtcgcgttttaccttggtcagcgggcagttgccgagcaagatcggcgcctacgacaacgccgccgatttccccgccgacattcccacctacgcccattacctgcgccgcctcggttaccgcaccgcgctctccggcaagatgcacttctgcggccccgatcaactgcacggttacgaagagcgcctgaccagtgatatctacccggccgactacggctgggcggtgaactgggacgagcccgatgtgcggccgagctggtatcacaacatgtcttcggtgttgcaggccgggccgtgcgtgcgcaccaaccagctcgacttcgatgaagaggtggtgttcaaggctcagcaatatctgtttgaccatattcgcgaggacggcgaccagccgttctgcctgaccgtgtcgatgactcacccgcacgatccgtacacgattcccaaggcattctgggatttgtacgacgatgcggatataccgcttccaacgacgccggatcagcattcactcgatccgcattcccagcgtttgctcaaggtctacgacctgtgggacaagccgctgcctgtggataagattcgcgacgcgcgccgtgcctacttcggtgcttgcagttatatcgacgccaacgtcggcaaacttctgcaaaccctcgaagattgtgggctgatggatgacaccgtcatcgtgttttccggtgaccatggcgacatgctcggcgagaagggcctctggtacaaaatgcactggttcgaaatggccgcgcgggttcccctgttgataagtgcacccggtcagttcaaatcgggccgtgtcagcgctgccgtctccaccgccgacctgttgccgaccttcgtcgagctggcgggcggcagcctggaaccgaatctgccgctggacggccgctcgttggttccgcacctgaacgggcagggcggtcacgacgaagtgttcggcgaatacatggccgaaggcaccgtcagcccgctgatgatgatccggcgtggcgcgtacaaatttatctacagcgaaaccgacccttgcctactcttcgatgtggataacgatccacgcgagcaggaagaactcagccaatcgccacaacatcgccaactgttcgacgattttctcgccgaagcgcgggccaagtgggacatcccggccatccaccgcaaagtcctagaaagccagcgccgtcggcgtttcgtcgccgaggcgctgacgatcggcaaactgaagagctgggatcaccagccgctggtggacgccagtcagcaatacatgcgcaaccacatcgacctcgatgacctggagcgcaaggcccgttatccacaaccc

SEQ ID NO: 37358 - DNA, 1275 bp, Pseudomonas fluorescens
cgtcagccactgtacaaatccctgtatttccaggtgatcgtcgcaatctgtatcggtattgcgctcggccactactacccgcagttcggcgtggccgtaaagccgctgggtgacgggttcatcaaactgatcaaaatgatcatcgccccgatcatcttctgcaccgtggtcagcggcatcgccggcatgcagaacatgaaatcggtcggcaagaccggcggctacgcactcctgtacttcgaaatcgtttcgaccatcgcactgctggtgggcctgatcgtggtcaacatcgtgcaaccgggcaacggcatgcacatcgacgtcagcaccctcgacgcctcgaaagtcgcgacctatgttgctcaaggcgcagaccagagcgttgtcggcttcctgctcaacgtgatcccgaccaccatcgtcggcgcgttcgccaccggtgacatcctgcaagtgctgatgttctcggtgatcttcggtttcgccctgcaccgcctgggtgcctacggcaagccgatcctggacttcatcgatcgcttcgctcacgtgatgttcaacatcatcaacatgatcatgaagctcgcgcccatcggtgccttcggtgcgatggcgttcaccatcggtgcctacggtgtcggctcgctggtacagctgggtcaactgatgatctgcttctacatcacttgcctggcgttcatcctgatcgtgctcggcggtatcgcccgcatgcacggtttcagcgtgctgaaaatgatccgctacatccgtgaagaactgctgatcgtgctgggtacttcctcttcggaatcggtactgccacgcatgctgatcaagatggagcgtctgggcgcgaagaaatcggtggtaggtctggtgatcccgaccggctactcgttcaacctcgacggcaccgcaatctacctgaccatggcggccgtgttcatcgctcaggcgaccgacacccacatggacatcactcaccagatcaccctgctggtggtgttgctgctgtcctccaaaggcgccgccggtgtgaccggttcgggcttcatcgtgctggcggccaccctgtcggcggtaggtcacctgccggtggccggtctggcgctgatcctgggtatcgaccgcttcatgtccgaagcccgtgccctgaccaacctggtcggcaacgccgttgccaccatcgttgtggccaagtgggtcaaggagctggacaccgacgtgctggacgccgagctggcctcgggcggtcgcggtatcgccgatacccgtcct

SEQ ID NO: 37359 - DNA, 642 bp, Pseudomonas fluorescens
atgagtctgcaaggtaaagttgcactggtcaccggcgcaagccgtggcatcggccaggctatcgcactggaactgggtcgtcagggcgccattgttgttggcaccgcgacttccgcttcgggcgccgagcgcattgctgcgaccctgaaggaaaacggcatacagggcgcaggtttcgaactgaacgtcaccagcgacgaatcggttaccaaagtgctggcgagcatccaggagcaattcggtgcgccggtggcgattctggtcaacaatgccggcatcacccgcgataatctgatgatgcgcatgaaagacgacgagtggtacgacgtgatcgataccaacctgaacagtctgtatcgcctgtccaagggcgttctgcgcggcatgaccaaggcgcgttggggccgaattatcagtattggctcggtggtgggtgccatgggcaacgctggccaagtaaactatgcagccgccaaggccggtctggaaggtttcagccgtgccatggcgcgtgaagtcggttcgcgttcgattacggtcaactcggtaaccccagggttcatcgacaccgatatgactcgcgagctgcctgaagcacagcgtgaagccttgcagacgcagattccgctgggtcgtctggga

SEQ ID NO: 37360 - DNA, 906 bp, Pseudomonas fluorescens
ctcgcattcgtctttccaggacagggttcgcagtccctcggcatgctggccgagctgggcgcgcaacatccactgatcctcgaaaccttcaaagaagcatccgatgctctgggctatgacctgtgggcgctgacccagcagggtccggaagagctgctcaatcaaaccgacaaaacccagccggccattctgaccgcttcggtcgccttgtggcgtctgtggctggcggaaggtggcgcgcgtccggccttcgttgccggtcacagcctgggtgaatacagcgcgctggtcgctgccggcagtctgagcctggctgacgcggtaaaactcgtcgagcgccgtggccagttgatgcaggaagccgttccggccggtcagggcggcatggctgccatcctcggtctggaagatgccgacgtgctggcggcctgtgctgaagcggcgcaaggcgaagtggtcagtgcggtgaacttcaactccccgggccaggtggtgatcgccggtgccaaggcagccgttgagcgcgccatcgaaggctgcaaggcccgtggcgccaagcgtgccatgccgctgccggtcagcgtgccgtcgcactgtgaactgatgcgcccggctgccgagcgtttcgccgagtccatcgctgccatcgactggcaggcgccgcagatcccggtggtacagaacgtaagcgcccaggtgccggcggatctggaaaccctcaagcgtgatctgctggagcagctttacaagccggtccgctgggtcgagtccgtacagaccctggccgccaaaggcgcgaccaatctggtcgagtgcggccctggcaaggtgctggccggtctgaacaaacgttgcgccgaaggcgtttcgacttccaacctcaataccccagacgctttcgctgct

SEQ ID NO: 37361 - DNA, 1341 bp, Pseudomonas fluorescens
aatcaattgttcgatgcctactttactgcccgcgatatgcgcgacgtgttctgcgatcagggccgggtgcaggcgatgctcgacttcgaagcggcgctggcccgggccgaggcgcgggtcggcttgattccggcggatgctgtcgcggccatcgaaaacgcctgccgcgccgggctgtttgatttcgcagcgctgggcgaggcgattgccacggccggcaattcggcgattccactggtcaaggcattgggcaaacagattgccgcgaccgatgccgaagccgagcgctatgtgcatctgggcgccaccagccaggacgtgatggattccgggttggtgctgcaattgcgtcaggcgctggaattgattgaaagggagttggggcaactggccgacgccctcgccactcaggcgcagcgccatgccgcgacgccgctggcaggacgtacctggctgcaacatgcgacgccggtgacgctcggcatgaagatcgccggttggctcggtgcgatcacgcgcagccgtcagcgtctgcgcgagctcaaaccgcgactgctggtgctgcaattcggcggcgcgtccggcaccctcgcggcgctcggcgaacaggcgttgccgatcgcccaggcgctggccgaagaactgcacctgaacctgccggaacaaccgtggcacacccagcgcgatcgcatcgtcgagttcggcgcagtactcgggctgatcgccggcagcctcggcaagttcggccgcgacatcagcttgttgatgcagaccgaagcggcggaagtgttcgagccgtcggcgccgggcaagggcggttcctcgaccatgccgcacaagcgcaatccggtgggcgcggcggtgttgatcggtgccgcgacccgggtgccggggctggtctcgacgctgttcagcgccatgccgcaggaacacgagcgcagccttggtctgtggcacgccgaatgggaaaccctgccggaaatctgctgcctggtgtcgggcgcactgcaacaggcgcggctgctggccgatggtctggaagtcgatgccgcgcgcatggcccgcaacctggagttgactcaaggcctggtgctggccgaagcggtgagcatcgtgctcgcgcaacgggtcggtcgtgataccgcgcatcatctgctcgagcaatgctgcaaacgagcggtggccgaacagcgtcacctgcgtgcggttctcggtgacgagccgcaggtgaccgccgaactgagcgcaagcgaactggatcatctgctggatcccgcccactacctcggtcaggcgcaggtctgggtcgagcgggcagtagccgaacacaacgcattgtct

SEQ ID NO: 37362 - DNA, 1200 bp, Pseudomonas fluorescens
atgcgcgacgtttatatctgcgatgcgattcgtacccccatcggtcgttttggtggcggtctggcggcggttcgcgccgacgacctggccgccgtgccgatcaaggccctgatggaacgcaatccgtcggtggactggagcgccatcgacgaggtattcctcggctgcgccaaccaggctggcgaagacaaccgtaacgtggcgcgcatggcgttgctgctggccggtctgccggagagcgtgccgggcgtcactctcaatcgcctctgcgcgtcgggcatggatgccatcggcaccgcgttccgcgccatcgccagcggtgaaatggagctggcgattgccggcggtgtcgagtcgatgtcccgcgcaccgttcgtgatgggcaaggccgacgcggcgttttcgcgcaacatgaaactggaagacaccaccatcggctggcgtttcatcaacccgttgatgaaggcccagtacggcgtcgacgcgatgccgcagaccgccgacaatgttgccgacgattacgaaatttcccgcgaggatcaggacgctttcgccctgcgcagtcagcaacgtactgccgctgcccaggctgccggctacttcgccgaggaaatcgtcgaagtgcggatcgcccacaagaagggcgaaaccgtggtcagccaggacgaacaccctcgtgccgacaccactattgaagccctgaccaaactgaaaccggtcaacggcccggaaaagaccgtcaccgccggcaacgcgtcgggcgtcaacgacggtgccgccgcgctgattctggcctcggcggaagcggtgaaaaaacacggtttgactgcccgcgccaaagtgctgggcatggccagcgccggggtcgcgccacgggtgatgggcatcggcccggtgccggcggtgcgcaaactcaccgaacgcctcggcgttgcggtcagcgatttcgatgtgatcgaactcaacgaagcgtttgccagccagggtctggcggtattacgcgagttggggctggcggacgacgcggcccaggtcaacccgaacggtggcgcgattgccttgggccacccgttgggcatgagcggtgcgcgactggtgctgaccgcgctgcatcagctggaaaaatccggtggcaagaaaggtctggcgaccatgtgcgtcggtgtcggccagggtctggcccttgccatcgaacgcgtc

SEQ ID NO: 37363 - DNA, 1176 bp, Pseudomonas fluorescens
tacctcaatgccctcggcgtgatctgtgccctggggcgcgacaagcaaaccgtggcacgcaacctgtttgccggcgactgctccggcatgcgccgcgagtccggctgggtgccggagcgcgaactgccggtggccgccgtacacggcgatctggcgccgattcccgaggcgctggccgaccagcgcagccgcaacaatcaactgttgctggaagccgcgttgcagattcgcgatgacatcgagcaggcgatccagacgtacggccgcgatcgcatcggcgtggtgctcggcaccagcacttccggtatcgacgaagccagccgtggcctggcgcactacattcgtgaccagcagttcccggccgattacgactaccggcaacaggaactcggcgccccggcgaatttcctcgccgactggctgcaactgagcggcccgacctatgtgatttccaccgcctgcacctccagcgcacgcgccttgatgagcgcccggcgcctgctcgatctgggcctgtgcgacgcggtgctgtgtggcggtgtcgacagcctgtgcaaactgaccctcaacggtttcagtgcgctggaagcggtgtcggacgagcgctgcaatccgttttccgccaaccgcaacggcatcaacatcggcgaagcggcggtgctgttcgtgatgagcaaagaacgcggcgcagggccgggcatcgccttgctcggcgctggcgccagctccgacgcgcaccatatttccgcacctgagccaaccggccgcggcgcgctgcaagcgatgcaaaaagccctcgatcaagcccacctgcaagccgacgacatcagctacctgaacctgcacggcaccgcgacccagcacaacgacgccatggaaagcctggccgttgacgcgctgtttgccgacggcgtgccgtgttcctcgaccaaaccgatgaccggtcataccctcggtgccgccggtgcactggaagcagccttctgctggttgagcctgagtgccgacaaccccgaccacgccttgccaccgcacatctgggacggccaggccgatcccgacctgccagcgctgaagtgggtgaccgcaagcgaacgcctggcgtccattgcacctcgctacctgatgagcaactcgtttgccttcggtggcaataacgtcagcctgattatcgga

SEQ ID NO: 37364 - DNA, 723 bp, Pseudomonas fluorescens
atgactgaatccatcctggtcaccggctccagccgtggcatcggccgcgccatcgccctgcgcctggccagcgccggccacgatatcgtcctgcattgccgcagcggcgtgacggaagcacaagcagtgaaagccgaagtcgaagccctcggccgcaccgcgcgcatcctgcaattcgacgtggcggatcgcgaaacctgcaaagccatcctcgaagccgacgttgaagcccacggtgcctactacggcgtggtgctcaatgccgggctgacccgcgacggtgcctttccggccctgagcgacgatgactgggacgtagtgctgcgcaccaacctcgacggtttctacaacgtcctgcacccggtgatgatgccgatgatccgccgccgcgccgctggtcgcatcgtttgcatcacctcggtttcggggctgatcggcaaccgtggccaagtcaattacagcgcctcgaaggccggcgtgatcggcgcggcaaaggcgttggcgatcgaactggccaagcgcaaaatcacggtgaattgcgtcgcgcccggtctgatcgataccgccatgctcgatgaaaacgtgccggtggaagaactgctgaaaatgatccccgcacaacgcatgggcacgcctgaagaggtggccggtgcggtgaatttcctgatgtcggcggaagcgtcgtacatcacccgccaggtgctggcggtcaacggaggcttg

SEQ ID NO: 37365 - DNA, 1227 bp, Pseudomonas fluorescens
ctgatgaagcgcgtcgtcgtcaccggcatggccggcattacctcgctgggcagcgactgggacaccatcgccggcaatttcgccgccaaccgcagcggcatccgccggatggacgagtgggatcgcttcagcgagctcaacacgcgcctggccgggcctatcgatgatttccaggtgccggcgcactggactcgcaaacagctgcgcagcatgggccgtgtctcgcggctggctgtcggcgcggcggaaaaagcgctggccgatgccggcctgctcggcgacgagtcgatcaaggacgggcgcatgggcgtggcctgtggttcgtccaccggcagcaccgacgaaatcaaggcgttcggcaacatgctgctcaactcggtggccgagggcctcaacgccaactcctacgtgcgcatgatgccgcacaccacggcggcgaacatcagcatcttcttcggccttaccggccgcttgatcccgacctccagcgcctgcaccagtggcagccagggcatcggttacgcctacgaggcgatcaagttcggacgcctaccgctgatgctcgccggcggcgccgaagaactgtgcccgacggaagccatggtgttcgacgcgctgtacgccaccagcctgaaaaacgatgcaccgcacacctcgccacgcccgtacgacaaggaccgcgacggtctggtgatcggtgaaggcggcggcatgctggtacttgaagaactggaacatgccctggcgcgcggtgcgcacattcacgccgagatcgtcggtttcggcagcaacgccgacggccagcacaccacccgccccgaacaaatcaccatgcgccgggcaatggaactggcgctggaagatgcaggccttgcgccggacgtcatcggctacgtcaacggccacggcaccgccaccgaacagggcgatgtcgctgaaaccctggccaccagtgccctgttcggcgaacgcatgccgatcagttcgcaaaagagcttcctgggccacaccctcggcgcctgcggggcgctggagtcgtggttcagcatcgagatgctcaaccgcgacctgtacgtgcacacgctcaacctcgacgaggtcgacccgcactgcggcaaacttgactacctgcgcggcgaattccgccagatgagccacgactacgtgatgaacaacaacttcgctttcggcggggtcaacacctcgctgattttccgtcgctggccc

SEQ ID NO: 37366 - DNA, 1062 bp, Pseudomonas fluorescens
atgactgccctgaagaacgaccgtttcctccgcgccctgctcaagcaacccgtagacgtcaccccagtgtggatgatgcgccaggccggccgctacctgccggaataccgcgccagccgcgcccaggccggtgatttcatgagcctgtgcatgaatccggaattcgcctgcgaagtcacgctgcaaccgctggaccgctatccgcaactggacgcggcgatcctgttctccgacatcctcaccattcccgatgccatgggccagggcctgtacttcgagaccggtgaaggtccgcgcttcaagaaagtcgtcagcaccctggccgacatcgaagccctgccgatcccggatccgcacaaagacctcggttacgtgatggacgccgtcagcaccatccgccgcgaactgaatggccgtgtaccgctgatcggtttctccggcagcccttggactctcgccacgtacatggtcgaaggcggttcgtcgaaagacttccgcaagaccaaggcgatgctctacgacaacccacaagccatgcacctgctgctggacaaactggcgcagtcggtgacttcgtacctgaacggccagatccaggccggtgcgcaagcggtgcagatcttcgatacctggggcggcaacctgtcggcggcggcatatcaggaattctcactggcctacatgaagaaaatcgtcagcggcctgatccgcgagcacgacggtcgcaaggtgccggtgatcctgttcaccaagaacggcggcctgtggctggaaagcatcgccgaggctggtgccgacgcactgggcctggactggacctgcgacattggcaacgcccgcgctcgcgttggcgacaaggtggcactgcaaggcaacatggacccgaccgtgctctacgccaagccggaagcgatccgcaccgaagtcgggcgcatcctcgccagctacggcaaaggcagcggccacgtgttcaacctcggccacggcatcacgccggaagtcgatccggaacacgctggcgcgttcctgcgcgcggtgcacgagttgtcggcgcagtatcac

SEQ ID NO: 37367 - DNA, 1287 bp, Pseudomonas fluorescens
atgggtaagaatgtcgtagtcctgggcacccaatggggtgatgagggcaaaggcaagatcgttgatctgctgaccgaacatgctgccgccgtagtgcgctaccagggtggccacaacgccggtcacactctggtgatcgacggtgaaaaaaccgtcttgcacctgatcccgtcgggcgtgctgcgcgaaggcgtgcagtgcctgatcggcaacggcgtggtggttgcacctgacgccctgctgcgcgagatcaccaagctggaagagaaaggcgtaccggtgcgcgagcgcctgcgtatcagcccttcctgcccgctgatcctgtccttccacgtggcgctggaccaggcccgtgaaaaggcccgcggcgagctgaagatcggtacgaccggtcgcggcatcggcccggcttacgaagacaaggttgcacgtcgcggcctgcgtgttggcgatctgctcaacatgccgcgctttgaagacaagctgcgtgaactggtggactaccacaacttcatgctggtcggttactacaaagagcctgccatcgagttcgaaaagacgctggccgagtgcaaggaatacgccgagctgctcaagccgctgatgctggacgtgactgccgagctgcacgacctgcgtcgcgccggcaaagacatcatgttcgaaggcgcccagggttcgttgctcgacatcgaccacggtacctatccgtacgtgaccagctccaacaccaccgcgggtggcgttgctaccggctcgggcgttggcccgatgttcctggactacatcctgggcatcaccaaggcttacaccactcgcgtaggttcgggcccattcccgaccgagctgttcgacgaagtcggtgcgcacctggccaagcaaggtcacgagttcggcgctaccaccggccgtgcccgtcgttgcggctggttcgacgccgttatcctgcgtcgtgctatcgatgtgaacagcatctcgggcatctgcctgaccaagctggacgtactcgacggcctggaaaccatcaacatctgcaccggctacaaggatgcgcaaggcaacgcggttgccccgactgacgctgacagctacgtgggcctgcagcctgtgtacgaagaagtgccgggctggagcgaatcgaccgtgggcgccaagactctggaagagctgccggccaacgctcgcgcctacatcaagcgcgttgaagagttgatcggcgcgccgatcgacattatttcgacgggcccggaccgcaacgaaaccatcgtgctgcgtcatccgttcgct

SEQ ID NO: 37368 - DNA, 570 bp, Pseudomonas fluorescens
atggaagcattgcaccagaaaatccgcgaacaaggcattgtgctttccgaccaggtcctgaaggtcgacgccttcctgaaccaccagatcgacccggccctgatgaagctgatcggcgacgaattcgccacgctgttcaaggattcgggcatcaccaagattgtcaccatcgaagcctcgggcatcgcgccggcgatcatgaccggtctgaacctcggcgtgccggtgatcttcgcccgcaagcaacagtccctgaccctgactgaaaacctgctgtcggcgaccgtttactcgttcaccaagaaaaccgaaagcaccgtggccatctcccctcgccacctgaccagcagcgaccgtgtgctgatcatcgacgacttcctggccaacggtaaggcctcccaggcgctgatctcgatcatcaagcaggccggcgccaccgtcgcgggcctgggcatcgtgatcgagaagtcgttccagggcggccgtgcggagctggattcgcagggttaccgcgtcgagtcgctggctcgcgtgaagtcgctgaaggatggcgtggttaccttcatcgag

SEQ ID NO: 37369 - DNA, 2856 bp, Pseudomonas fluorescens
atgctcgagctcactgtagagcagatatccatgggccagtcggctgtggataaacccgccgctttgcaattgctggccagtcatctggtcgccgatggtctggtcgccgacggctacctctccggcctgcaggcccgagaggctcagggctcgaccttcctcggccaaggcattgcgatcccccacggcacgcccgaaacccgtgatcaggtgttcaccaccggcgtgcgcctgatgcagtttcccgacggcgtggactggggcgatggccagatcgtttatctggccatcggtatcgctgccaaatccgacgaacacctgcgcctgctgcaactgctgacccgtgcccttggcgagaccgatctgggccaggccctgcgccgcgccagttcgcccgaagcgctgctgaaactgctgcaaggcgcgccgcaagagctggcgctggatgcacagatgatcggcctcggcgtatcggccgacgatttcgaagagctggtctggcggggtgcgcgtctgctgcgccaggccgattgcgtgagcaacggtttcgccggggtattgcagcaggtcgaagcgctaccgctgggcgatggcctgtggtggctgcacagcgagcagaccgtaaagcgtccggggctggcgttcgtcacgccggacaaaccgatgcgttacctcggccagccgctcagcggtctgttctgtctggccagcctcggtgaagcgcatcaggcgttgctcgagcgtttgtgcgcgttgctgatagaaggtcgcggccatgaactgggccgtgccaccagcagccgcaaagtccttgaagtgctcggcggtgagttgcccgccgattggccgagtgcgcgtatcgcactggccaacgcccatggtctgcatgcgcggccggcgaagatcctcgcgcaactggcgaaaagttttgacggcgaaatccgtgtgcgcatcgtcgacggtcaggacagcgccgtatcggtgaaaagcctgagcaaattgctgagcctcggcgcccgtcgtggccaggtgctggaaatcatcgccgagccgagcatcgccgccgatgcgttgccggcgttgttggcggcgatcgaggaaggcctcggtgaagaagtcgaaccactgcccgcagtcagccaacagcgcgaagtcatcgccgacatcgccgaagtcctgagcgccccggcctccggcagcctgctgcaagcgattcccgccgcccccggcatcgccatcggcccggcgcacattcaggtccagcaagccatcgactatccgctgcgcggcgagtccgccgccatcgagcgcgagcgtctcaagcaagcgctggccgacgtgcgtcaggacattcagggcctgatcgaacgcagcaaggccaaggcgatccgcgagattttcatcacccaccaggaaatgctcgacgacccggaactcaccgatgaagtcgacactcgcctcaagcagggtgaaagcgccgaagcagcctggatggccgtgatcgaagccgccgcaaaacaacaggagtcgttgcacgacgcgttgctcgccgaacgtgccgccgatctgcgcgacattggtcgtcgggtgctggcgcaactgtgtggtgtgcagacgcccgccgagcctgagcaaccgtacattctggtgatggatgaagtcggcccgtccgatgtggcgcggctggatccggcgcgggtggcggggattctcaccgcccgtggtggcgccaccgctcacagcgccatcgtggcccgcgcgctggggattcctgcgctggtcggtgcgggcgctgcggtgttgctgctgaaaccgggcacgccgttgctgctcgacggccagcgcggtcgcctgcatgtggacgcggatgccgctaccctgcaacgcgccagcgaagagcgtgacacccgcgaacaacgtctgaaagccgccgccgaacaacgccatcaaccggcgcacaccaccgacggccacgccgtggaagtgttcgccaacatcggtgaaagcgccggtgtgatcagcgcggtggagcagggcgccgaaggcatcggcctgctgcgcaccgaactgattttcatggcccatccgcaggcgccggacgaggcgactcaggaagccgaataccgccgcgtcctcgacggcctcgccggtcggccgctggtggtgcgcacgcttgatgtcggcggcgacaaaccgctgccgtattggccgatcgccaaggaagaaaacccgttcctcggtgtgcgcgggattcgcctgaccttgcagcgtccgcagatcatggaagcgcagttgcgcgccttgctgcgttcggcggacaaccgtccgttgcggatcatgttcccgatggtcggcagcgttgaagagtggcgtcaggcccgcgacatgaccgaacgcctgcgtctggaaatcccggttcccgatctgcaactggggatcatgatcgaagtgccgtccgccgcactgctggcgccggtgctggccaaagaggtggacttcttcagcgtcggcaccaacgacctgacccagtacacgctggcgatcgaccgtggtcatccgaccctgtccgcccaggctgacggcctgcacccggcggttctgcaactgattgacatcaccgtgcgcgcggcccatgcccacggcaaatgggtcggcgtgtgcggcgagctggcggcggatccgctggcggtgccggtgctggtcggcctcggtgtggatgaactgagcgtctccgggcgcagtatcgccgaggtcaaggcacgcatccgcgaactcagcctgacccagactcaaacccttgctcaacaagccctggccgtgggcagcgccaacgaagtgcgcgcattagtggaggcc

SEQ ID NO: 37370 - DNA, 2479 bp, Pseudomonas fluorescens
  unsure (1)..(2479): unsure at all n locations
gtcaaacacccggtagagcgcctgttgcagcagatgcgtgaggcaggtctgccgcacaccgccgccgaagaaaatgggactgacagtgagaagcaatccctgctgacccacttgaaaagcagccacaaggcgaaagtggaagaaccacgcaagatcacgctgcagcgtaaaaccaccagcaccctgcgtgtggctggcagcaaaagcatcagcgttgaagtccgcaagaagaaagttttcgtacagcgtagcccggaagaaatcgaagccgagcgcaagcgtgaactggatgaacgtcgcgcagtagaaaatgctgcccgtcagaaggctgaagaagaagcccgcgtgcgcgccgaagaagaagcgcgtcgccagcctgccgcgccgtccgctcctgccgaagccgtcgctgcacctgcgccagtggccgaaccagtgcgcgaagccgcgccggttgtggctgctgccccagctgccgacactcgcaagcgtgacgagcagcgccgcccggacaagccacgtgccgacgacaacaaccgtcgtggtggtgatggcgagcgcaaaaacgctccgcatcgcgcatcggtcaaggaaaaggctccggcaccacgtgtggcgccacgcacgaccgacgaagaaagcgatggattccgtcgcggcggtcgcggcaaggccaagctgaagaatcgcantgcctagtgtttcatgagcgcgatcggtcctgtcgtgcgtgaagtgaagatcggcgagtgcatcactgttggcgatctcgaccagcagatgtcngtcanggctgctgaagtcatcgagttcatgttctaactgggtactccagcgacatcaacaggtgcttgatcaggaaactgctcaactggtagccgaagaactgggccacaaagtgaccctggtcagcgacaccgccctggaagattccctggccgagtccttgaagttcgaaggtgaagcggttcctcgtgcgccggttgtgaccgtaatgggtcacgttgaccacggtaagacctcgctgctcgactacatccgtcgtgccaaggtagctgctggcgaagccggcggtatcacccagcacattggtgcataccacgttgaaaccgaacgcggcatggtcaccttcctcgacaccccgggtcacgccgcgtttaccgccatgcgtgcccgtggtgccaaggcgaccgacatcgtgatcctgctagttgcggcggacgacggcgtcatgccacaaaccatcgaagccgttcagcacgctgttgctgccggcgttccgctggtggttgcggtgaacaagatcgacaagccgggtgccgacctcgatcgcatccgtagcgaactgtcggcccacggcgtgacctctgaagactggggtggcgacactccattcgtcccggtctccgcgaagatgggtaccggcgtcgacgaactgctcgaagctgtattgctgcaggctgaagttctcgaactgaccgccacgccttcggctcctggccgtggtgtcgtggttgaatcgcgtctcgacaagggccgtggcccggtggcgactgttctggttcaggacggtacgctgcgtcaaggcgacatggtgctggtcggctcgaactatggccgcgtgcgcgccatgctcgacgagaacggcaagccgatcaaggaagcgggcccggccattccggtcgagatcctcggcctggacggtacgcctgacgctggcgacgagatgagcgtggttgccgacgagaagaaagcccgtgaagtggctctgttccgtcaaggcaagttccgcgaagtcaagctggctcgcgctcacgccggcaagctggaaaacatcttcgaaagcatgggtcaggaagagaagaagacgcttaacatcgtcctcaaatccgacgtccgtggttcgctggaagccttgcagggcgctctgaacggcctgggcaacgacgaagtgcaagtgcgcgtggtcggtggcggcgtcggtggtatcaccgaatccgatgccaacctggcactggcttccaacgctgtactgttcggcttcaacgtgcgtgccgatgccggcgcacggaagatcgtcgagcaggaaggtctggacatgcgttactacaacgtgatctacgacatcatcgaagacgtcaagaaagccctgaccggtatgcttggcagcgacgttcgcgagaacatcctcggtgtggccgaagtccgtgacgtattccgttcgcctaagttcggcgccatcgccggctgcatggtgatcgagggtactgttcaccgtaaccgtccgatccgtgtactgcgtgaagacatcgttatcttcgaaggcgagctggagtccctgcgccgcttcaaggatgacgcttccgaagtacgtgccggcatggaatgcggtatcggcgtgaagagctacaacgacgtcaaagtcggcgacaagatcgaagtcttcgagaaggttcaggttgctcgcagcctctgactc

SEQ ID NO: 37371 - DNA, 915 bp, Pseudomonas fluorescens
atggacttcaaagactattacaagatactcggcgtggagccgacggctgacgacaaggcaatcaaggctgcctatcgcaagctggcgcgcaaataccaccccgatgtcagcaaggaaaaggacgccgaggccaagttcaaggacgcctcggaagcctacgaagcgctgaaaagcgccgacaagcgcgccgaatacgacgaactgcgtcgttatggtcagcacggccagccgtttcagggcccaccggggtggcagagccgtggcggctttggcggcggcggtggcgacaccggcgacttctcggacttcttcagttcgatcttcggcaatcgcggccccggtttcggtggcggcgctggccggcaatcccgcagcgccggacggcgagggcaagacgtggaactggaactgccgatctttctggaggagacgctttcgaacgaatcgaaaaagatcagcttccaggtcccgcaatacaacggttcgggccagcacgtcagcaacaccagcaaaagcctgaacgtgaagatcccggcgggcgtgaccgatggcgagcgcatccgcctcaagggccagggtgcaccgggcataggtggcggcgccaatggcgatctgtacctgaccatccgtttcgcgccgcacccgaaattcgacgttgaaggcgaaaacctgatcatcaccttgccgctggcaccgtgggagctggcgctgggcgccgaagtcgccgtgccgaccctgaccggcaagatcaacctcaaggtcccggccggcagccagaacggccagcgcatgcgtgccaagggccacggtctgcagaacaaggcgggcgagcgcggttatctgttcgtccagctcaaggccgtgatgccgaaagccaacggcgatgacgtcaaggcgctgtggcaggaactggcg

SEQ ID NO: 37372 - DNA, 231 bp, Pseudomonas fluorescens
atgagcaccatcgaagagcgcgtcaagaaaatcgttgccgagcaactgggtgttaaagaagaagaagtggtcaacaccgcttccttcgtagaagacctgggtgccgactcccttgacaccgttgagctggtgatggctctggaagaggaattcgagaccgaaatccctgacgaagaagctgagaagatcactactgtacaagctgcaatcgactacgttactagccaccag

SEQ ID NO: 37373 - DNA, 1239 bp, Pseudomonas fluorescens
gtgtcgcgtagacgcgtcgtagtcaccggtatgggtatgttgtcgccactgggcacggatgtgccgagcagttggcagggcattctggctggccgcagtggcattggtctgatcgaacacaccgacctttctgcctattccacccgctttggcggctcggtaaagggcttcaatgtcgaggaatacctgtcggtcaaggaagcgcgcaagctcgacctgttcattcagtacggtctggcggccggctttcaagccgtacgcaatgccggtctggaagtcaccgatgccaaccgtgaacgcatcggcgtggccatggggtcgggtatcggcggtctgaccaacatcgaagaaaccagccgcaccctgcacgagactggcccacgccggatttctccgttctttgtgcctggctcgatcatcaatatgatttccggtttcctgtccatccacctgggtgcacaggggcctaactatgccatcgccacggcgtgtaccaccggtacgcactgcatcggcatggcggcgcgcaacatcatgtacgacgaagccgacgtgatgattgccggcggtgccgagatggccgcgtgcggtctgggcatgggcggcttcggtgcttcccgtgcgctgtcgacccgcaacgacgagccgacccgcgccagccgtccgtgggacaagggccgtgacggcttcgtgctgtccgacggcgccggtgcgctggtgctcgaagagctcgagcacgccaaggcccgtggcgcgaccatctacgccgagctgatcggtttcggcaccagtggcgacgccttccacatgacttcgccacccgccgacggcgccggtgctgcacgctgcatcaccaacgcgctgcgcgatgcgaagatcaacgtcgatcaagttcaatacatcaacgcccacggcacttcgaccccggccggcgaccttgccgaagccaacgcgatcaagtcggtgttcggtgatcacgcctacaaactggcagtcagctccaccaagtccatgaccggtcacctgctgggtgcggcgggcgcggtcgaggcgatcttcagcgtcctggcgatcaacagccaggtggcgccaccgaccatcaacctcgaagagccggacgaaggctgcgacctcgatttcgtgccgcacaccgcgcgcaatatggatatcgatgtcgtgctgtccaactcgttcgggtttggcggcaccaacggcacgctggcgttccgtcggttcgcc

SEQ ID NO: 37374 - DNA, 618 bp, Pseudomonas fluorescens
gtgactggcttgtttattaccctggaaggcccggaaggcgccggcaaaagcaccaaccgcgaatacctcgccgagcgcctgcgcgccgccggtatcgaagtggtgctgacccgcgagcccggcggtacaccgctggccgagcgcattcgtgaggtgttgctggccccggtcgacgaagtgatgaacccggacaccgagctgctgctggtgttcgccgcccgtgcccagcatctggccgaagtcattcgcccggcactggcccgtggtgcggtggtgctgtgtgaccgtttcaccgattcgacttatgcctatcagggtggcggtcgcggtttgtcgctggagcgcatcgcggcgcttgagactttcgtgcagggcgacctgcgtcccgacctgacgctgattttcgatctgccggtggaaatcggcctggcccgcgcaagtgcccgaggtcgtctggatcgtttcgagctggaaggccgtgagtttttcgaggccgtgcgcaatgcgttcctcaagcgtgccgaagacgatccggcgcgttacgtgcggatcgacgccggtcagccgttggtcaaggttcaacaatcgctggataccctgattccgaatttgctggag

SEQ ID NO: 37375 - DNA, 888 bp, Pseudomonas fluorescens
aaaacaggaggttgcatgacgtggactgcggtgacagagcatcgggcgcaactgggcgagggcccgttctgggacgcactgacccaggcactgtactgggtcgacattgccggcaggcaggcgctgcggctgatcgggcagaacgtgcagatctggcagatgccggagcacgtctcggcgttcattccctgcgccagcggcgacgcactggtgaccctgagcagcggcgtataccggctcgatctcgattcccccggactcgagccgcgactgacgctgttctgcatcgccgatccgcaaccgggcaatcgcgccaacgaagcacgttgtgatggccagggccgtttgtggctcggcaccatgcaaaacaacattggcgagcagggcgaggatctgccgatcatccgtcgttccggcgggctgttccggattgatccggataaaagggtcacacccttgttacgggggctgggcattcccaacacgctgctctggagcgacgacggcaccacgctgctgttcggcgacagcctcgacagcactttgtaccgctatttcattcacaccgacggcaacctcgacactgcccagccctggtacagcgccgatcagcacggtggcccggacggttcggcgatggacgccgaaggctacgtctggaacgcccgctgggacggcagctgcctgctgcgcctgacaccggatggccagatcgaccgcaggatcgaactgccaatcagccgcccgaccagttgcgtattcggcggcacagacctgaaaaccttgtacatcaccagcgccaaaagtccgctgaaccatccgttggacggcgccgtgctgtccctgcaggtggatgtcgccggaaagctctgtactcgattcgctggt

SEQ ID NO: 37376 - DNA, 744 bp, Pseudomonas fluorescens
cgtctgaaaaacaaggttgtgttgctgaccggcgccgcccaaggcatcggcgaagcaatcgtcgcgaccttcgcctcccagcaggccaaactggtgatcagcgatatccaggccgaaaaggtcgagaaagtcgccgcccactggcgcgagcagggcgccgatgtgcaagcgatcaaggccgacgtatcgcgtcagcaggatctgcacgccatggccaaactggccatcgaactgcacgggcgcatcgacgtgctggtcaattgcgccggggtcaacgtgttccgtgatccgctggaaatgaccgaagaagactggaaacgctgcttcgcgatcgacctcgacggcgcctggtatggctgcaaggccgtattgccgcagatgatcgagcagggcatcggcagcatcatcaacattgcctcgacccattccacgaacatcattcccggctgcttcccgtacccggtggccaagcatggcctgctcggcctgacccgcgcgctgggcatcgagtacgcgccgaagggtattcgggtcaacgcgattgcaccgggctacatcgaaacccagctcaacgtcgattactggaacggtttcgccgacccgcacgccgaacgtcagcgcgctttcgatctgcacccaccgaaacgcatcggccaaccgatcgaagtggcaatgactgctgtattcctggccagtgatgaagcgccgttcatcaacgcctcgtgcatcactatcgatggtggt

SEQ ID NO: 37377 - DNA, 1530 bp, Pseudomonas fluorescens
atgactgcgctgaacctgatccccggccaactgagcctggcccaactgcgtgacgtttatcagaacccggtcaagctgaccctcgacaacagcgccagcgcgcagatcgaagccagcgtggcctgcgtcgagcagatcctcgcggaaaaccgcaccgcctacggcatcaacaccggtttcggcctgctggcctcgacccgcatcgccagcgaagacctggaaaacctccagcgctcgctggtgctgtcccacgccgccggcgtcggccagccgatcagcgatgagctggtgcgcctgatcatggtgctcaaggtcaacagcctcagccgtggtttctccggcatccgtcgggtggtgatcgatgcgctgatcgccctgatcaacgccgaggtatatccgcacattccgttgaaaggctcggtcggtgcctccggtgacctggcgccattggcgcacatgtcgctggtgctgctgggcgagggcaaggcgcgccacaagggcgagtggatggatgcgaccgaagcgctgaaagtcgccggtctgacgccgctgacgctggcggcgaaagaaggtctggcgctgctcaacggtactcaggtttccactgcattcgcgttgcgtggtctgttcgaaggtgaagacctgttcgccggcgcgctggcgctgggcggtctgacggtggaagcggtgctgggctcgcgttcgccgttcgatgcgcgcatccacgccgcccgtggccagaaaggccagatcgacgccgctgccgcttaccgcgatctgctgggcgagcgcagcgaagtctccgactcgcaccagaactgcgagaaggttcaggacccgtattcgctgcgttgccagccgcaagtcatgggtgcgtgtctgactcagttccgccaggccgccgaagtgctggccatcgaagccaacgccgtatccgacaacccgctggtgttcgcggccgaaggcgacgtgatttccggcggcaacttccacgccgaaccagtggccatggccgctgacaacatggcgctggccattgccgaaatcggttccctgagtgagcgccgtatctcgctgatgatggacaagcacatgtcgcaactgccgccgttcctggtggccaacggtggcgtgaactccggtttcatgatcgcccaagtgaccgctgcggccctggccagcgaaaacaaggcgctgtcccatccgcattcggtggacagcctgccgacttctgccaaccaggaagaccacgtctccatggccccggctgccggcaagcgcctgtgggaaatggccgagaacacccgcgggatcctcgcggtggaatggttggcggcggtgcagggcctggacctgcgcaacggcctgaagacctcggccaaactggaacaggcccgtgggattctgcgtcgcgaagtgccgttctacgagaaggaccgcttcttcgcgccggatatcaacgcggcgaccgagctgctggcttcgcgcatcttgactgaactggtcccggcgaaactgctgccgagcctg

SEQ ID NO: 37378 - DNA, 1479 bp, Pseudomonas fluorescens
atgtcccaggctgaaaaaatcgttatcgccgacgctccgatgcgttggcaggatgtggtcgcagtcgcccgtcacggcgcgcagctcgagctgtcggcgcagacctgggcgcgcattgaaaacgcgcagggcatcgtccagcgtatcgtcgccagcggcgaacgcgcctatggcgtgaacaccgggctcggtgcgctgtgcaacgtctcgctgaaagacgagcagctcagtcagctgtcgcgcaacaccttgctcagccatgcctgcggcgtcggtccggtcctggccgacgagcagacccgggcaatcatgtgcgccgcgatccgcaactacagccacggcaaatccggcattcatcgccgggtggttgaagcgctgctggcgctgctcaatcgcggcatcaccccgcaagtgccgtcccagggttcggtgggttacctgacccacatggcgcacatcggcatcgcgctgctgggcgtgggtaatgtcagctatcgcgggcaagtggtttgcgcgcagcaggcgctggccgaagagggcctgcaaccggtgcagctcggggcgaaggacggtctgtgtctggtcaacggcacgccgtgcatgaccggcctcggttgcctggcgatcgccgacgccacgcgcctgctgcaatgggccgacgtgatcggcgccatgagcttcgaggcccagcgtggccagatcgccgcgttcgatgccgagatcattgcgctcaaaccgcatccgggcatgcagcaggtcggcgtcaatctgcgcgccttgctcgatggcagtgaagtgattgcgtcgagcaaaggcattcgcactcaggatgccttgagcatccgttcgatcccacaggtgcacggcgccgcccgcgatcaactggaacacgcaatcaaacagatcgaaaccgagctcaacggctgcaccgacaacccgttgctgctgggcacgccggatgacttccgtgtcatgtcccaggccaacccgcacggacaatcggtggcgctggcggcggatctgctggcgattgcgatggccgaaatcggctcgattgccgagcggcgtctggatcgcctgatcaacccgcacgtcagcggtctgccggcgtttctggtggccaatccgggggtgaactccgggatgatgatcgtgcaatacgtcgccgcgtcgctgtgcgcggaaaaccgccagttggcgcaaccggcggtgctagacaactacgtcacctcgggcctgcaggaagaccatctgagcatgggcaccaacgccgcgctgaagctgcatcgcgcgctggaaaactgcacgcagatcctcgccatcgagtacctgctggcggcccaggcgtttgaatttctcaaggaacagcgattcggcgccggcaccgataccgcctggcgactgctgcgcgaaaaagtcccggcctacgatcaggaccgctggctggcgccggacatcgccgctgctgcaagcgttctg

SEQ ID NO: 37379 - DNA, 1950 bp, Pseudomonas fluorescens
atccataaaatcctgatcgccaaccgcggtgaaatcgcctgccgcatccagcgcaccgcccaggccctcggttatcgcaccgtcgccgttttcagcgatgccgacgctgacgcactgcatgtcgaaatggcggacgaggccgtgaacatcggtccggcacccgtgcaacagtcctacctgaacatcccggccattctcgacgccgcccgccgcagcggcgccgacgccatccatccgggctacggttttctctcggaaaatgccgaattcgcccgcgcctgcaaacaggccggcctgaccttcatcggccccagcgtcgaagccatcgaactgatgggcagcaaacgccaatcgaaaatcgccatgctcgccgccggtgtgccatgtatcgccggctatcaaggtgccgagcaggacgacgcaaccctgacacgcgaagctgaacgcatcggttatccattgatgatcaaggccagcgccggcggtggcggacgcggcatgcggctggtgcacagcgccgaagaattgccggcgcaattgcgcacggcgcgctccgaagccttgaacggattcggcagcgatgaactgatcctcgaacaggcgctgatcgagccgcgccatgtcgaagttcagctgttcggcgatcaccacggccagctgatctacctcggtgagcgcgactgttcgattcagcgccgccatcagaaagtcattgaagaagcgccctgcccggtgatgaccgaagaactgcgccaggcgatgggcgaagcggcactcaaggccgggcgtgcggtgaactatgtcggtgccggcactgtagaattcctgctcgacactgatggccggttctactttctggagatgaacacccggttgcaggtcgaacacccggtgactgaactgattaccgggctggacctggtggcatggcaactgtcggtcgccgaaggtcagccgctgccgctgacccaggcacaggtgaaactcgatggccacgcgatggaagtgcgcctctacgccgaagatccgacccagggttttcttccacagaccgggcgtgtcgaagcctgggcgccggcactggatcgcggttcacggattgatcacgggctgatcgaagggcagtcgatctcaccgttctacgacccgatgctcggcaaactgattgctcatggcgcaacccgtgaagaggcccggcgcaaactgctgtgcgcagttcaggacagcgtgttgcttggcgtgcaaagcaatcagcggttgctcgccagcctgttgcagcatccgcaattcatcagcggcgagttcggtactggcttcatccctcaacatttcgccgatcacgattgcctgcacgcctattcgcccagtaacgaagagctggccatcgcggcgctgctgttttaccgatccgccgcacagcaacaccgcgccacgttgtccggatggcgcaacaacgccggtgcgccgttgctctatcgcatcggtctcgacgcccgcgactggaacgtgcaactgcgcgccagcccggacaacgctttcgaagttcaggttgtggagcgcgttatcgaactcaaactgatcgagcacaccgccggggccgtgacgctggaggtcgatggcctgcgccagcgccgcgcttatcgcctgtgcgacgagcagctctggctgttcacccatcccggcagcctgcacctggtggatcgaactcatgcggtgatcgacagtcagaccagcgtcagttccggcacgttgaaagccccgatggatggcgccatcatcgatgtgctcgtcagcgaaggcagcccggtcagcaagggccagttgctggtggtgctggaggcgatgaaaatggagcacccgctcaaggccggcatcgacggcgtgctcaagcgggtgcaggtcaaggtcggcgatcaggtgaaaaatcgtcaggttctgttgcaggtcgag

SEQ ID NO: 37380 - DNA, 3951 bp, Pseudomonas fluorescens
atggctaccaccacccttggggtcaaacttgacgacccgacccgcgaacgcctgaaggccgccgcaacctcgattgatcgcacaccgcactggctgatcaagcaggcaattttcaattacctggagaaactcgagggtggtgcaaccctgaccgagctgaacggtttgaccgccaaggacgccgacgacgcgggcgaagtccataccgatcacgctcaccaatgcttcctcgaattcgccgaaagcatcctgccgcaatcggtgctgcgcgcctcgatcaccgccgcttaccgacgccccgagccggaagtggtgccgatgctgatcgagcaggcgcgcctgccggcgccgatggccgaagccaccaacaaactcgccgcaaccatcgcggaaaaactgcgtaaccagaagagtgccggcggtcgtgcaggtattgttcagggcctgttgcaggaattttccctgtcgtcccaggaaggcgtggcgctgatgtgcctggccgaagcactgctgcggatcccggacaaaggcactcgcgatgcgctgatccgcgacaagatcagcaccggcaactggcagccgcacttgggcaacagcccgtcgctgttcgtcaacgcggcgacctggggtctgctgctgaccggcaaactggtttccactcacaacgaagccggcctgacttcgtccctgagccgcatcatcggcaagagcggcgagccgatgatccgcaagggcgtcgacatggccatgcgcctgatgggcgagcagttcgttaccggcgaaaccatcgccgaagccctggccaacgcgagcaagttcgaagccaagggtttccgctattcctacgacatgctcggtgaagcggcgctgaccgaacacgacgcccagaagtacctggcctcgtacgaacaagccattcactcgatcggcaaagcgtcccacggccgtgggatttatgaaggtccgggcatctcgatcaagctgtcggccctgcacccgcgttacagccgtgcccagtacgagcgcgtgatggacgagctgtacccgcgcctgctgtcgctgaccctgctggccaagcaatacgacatcggcctgaacatcgacgccgaagaagccgaccgcctggagctgtcgctggatctgctcgagcgtctgtgcttcgagccgcaactgaccggctggaacggcatcggtttcgtgatccaggcctaccagaagcgttgcccgtacgtgatcgactacgtgatcgacctggctcgccgcagccgtcatcgcctgatgatccgtctggtgaaaggcgcgtactgggacagcgaaatcaagcgcgcccaggtcgaaggcctggaaggctatccggtctacacccgcaaggtgtacaccgacgtttcctacatcgcctgcgcccgcaaactgttgtcggtgccggaagtcatttacccgcagttcgctacgcacaacgcccacaccctgtcggcgatttatcacattgccggtcagaactattacccgggccagtacgaattccagtgcctgcacggcatgggcgaaccgttgtacgaacaggttgtaggcaaggtttccgaaggcaagctgaaccgtccgtgccgcgtgtacgctccggtcggcacccacgaaaccctgctggcgtacctcgtacgtcgtctgctggaaaacggtgccaacacctcgttcgtcaaccgcatcgccgaccagtcggtttcgattcaggagctggtggccgatccggtggcacagatcgagcagatggcgaccgtggaaggtggtttcggcctgccgcacccgcgcatcccgctgccgcgtgacctgtatggctccgagcgcgccaactctgccggcatcgacatggccaacgaacatcgtctggcgtcgctgtcctgcgccctgctggccaccgcgcacaacaactggaaagccgcgccgatgctcggttgcgcctccagcaacgaagcgccggcaccggtgctgaacccgtccgatctgcgtgacgtggtcggccatgtgcaggaagccacggtcgaagacgtcgacaacgccattcaatgcgccctgaacgccgcaccgatctggcaggccaccccgccggccgaacgtgccgcgattctggaacgtgccgctgacttgatggaaggcgagatccagccgctgatgggcctgctggcccgcgaagccggcaagaccttcgccaacgccatcgccgaagtccgcgaagccgtcgatttcctgcgttattacgcggtgcaggcacgcaacgatttcagcaacgacgcccaccgcccactgggcccggtggtgtgcatcagcccatggaacttcccgctggcgatcttcagcggccaagttgccgcggcactggccgccggtaacccggtgctggccaaaccggccgaacagactccgctggtcgccgcacaagccgtacgcctgctgctcgaagccgggattccggaaggcgtgctgcaactgctgccgggtcgcggtgaaaccgtcggcgccggtctggtcggcgatgaacgcgtcaaaggcgtgatgttcaccggctccaccgaagtcgcgcgtctgctgcaacgcaacatcgccggtcgcctcgacaaccagggccgtccgattccgctgatcgccgaaaccggcggccagaacgcgatgatcgtcgactcttcggcactgaccgaacaggtggtgatcgacgtggtgtcgtcggccttcgacagcgccggtcagcgttgctcggccctgcgcgtcctgtgcttgcaggaagattccgctgatcgcgtcatcgaaatgcttaaaggtgcgatggctgaaagccgtctcggcaacccggagcgcctgtccgtggacatcggcccggtgatcgacgccgaagccaaggccggcatcgagaagcacatccagggcatgcgcgacaaaggtcgcaacgtgtaccaggtggctattgccgataccgaggaagtcaaacgcggcaccttcgtcatgccgaccctgatcgagctggaaagcttcgacgaactgcaacgcgagatcttcggcccggtgctgcacgtggtgcgctacaagcgtaaagagatcgaccagttgatcgcccagatcaacgcctccggttacggcctgaccctcggcgtgcacacccgcatcgacgagaccatcgccaaggtgatcgacaacgtcaacgccggtaacgtctacgtcaaccgcaacatcgtgggtgccgtggtcggcgtccagccattcggtggtgaaggcctgtcgggtactggcccgaaagccggtggcccgctgtacctgtaccgtctgctgtcgacgcgtcctaccgatgccatcgaacaatccttcgctcgcgctgatgctgccgtggcgccggacgttcgtctgcgcgacgccatgagcaaaccgctgaccgctctgaaagcctgggccgacagcaacaagttcgccgacctgagcaccctgtgcgtgcagtacgcggcgcagtcgcaaagcggtatcacccgcgtactggccggcccgaccggcgagaagaacagctacgcgatcctgccgcgcgagcacgtgctgtgcctggcggacatcgaaggtgatctgctgacccaactcgctgcagtactggcagtaggcggttcggcagtctggccggaatccgacaccagcaaggcattgttcgcacgcctgccgaaggaaattcaggcgcgaatcaaactggtttccgactggaacaaggacgacgtggtgttcgacgcggttctgcatcacggccattccgaccagttgcgtgcggtctgccagcagatcgccaagcgtgccggcgccatcgtcggggttcagggcctgtcccagggcgagaccaacattgcactggagcgtctggtgatcgagcgtgcgttgagcgtcaacaccgcggcagcaggcggcaacgccagtctgatgaccatcggt

SEQ ID NO: 37381 - DNA, 645 bp, Pseudomonas fluorescens
atggttctgcgctcggaaattctggtgaacaaaaacgtgctaccgactaaagaacaagctctgcctggccgcgaaacaccgatggccctgcctgaaaaacactttgttttcaccgaaacgccgttgctgggtccgttctttcaggacgtcgacttcgcaatcttcgggctgggctgcttctggggtgccgagcgccgcttctggcagcgcgaaggcgtggtcagcaccgtggtcggttacgccggcggtttcacgccgaacccgacctacgaagaagtctgctcgggcctgaccggccacgctgaagtggtgctggtggtgttcgacaaggccaaggtcagctacgaagagctgctggcgatgttctgggaattgcacaacccgacgcagggcatgcgtcagggcaatgacatcggcacccagtaccgttcggtgatctacgcgacccatccggagcaactggatgcggcgctgaagagcaaagccgtttatcaggctgagctgtcgaaggcgggtctgggtgaaatcagcaccgagattgaacaggccccgacggtttacttcgccgagacctatcaccagcagtatctggcgaaaaacccggaaggctattgcgggattggcggcactggcgtgtgcatgcca

SEQ ID NO: 37382 - DNA, 1472 bp, Pseudomonas fluorescens
ccgtcgcctgccgctggcgtggtcacgctatcagcgtcaagttgaacgacgaagtcggcaccggcgacctgatcctggatctggaagtggcgggtgctgcggcccctgcggctgccgctccggcccaggctgctgcgccagccgctgcgccggcgccggctgctgcacctgccgcaccggttgccgacagcgttcaggacatccacgttccggacatcggctcggccggcaaggccaagatcatcgaagtgttggtcaaggctggcgacagcgttgaagccgaccagtcgctgatcaccctggaatccgacaaggcgagcatggaaatcccgtcgcctgccgccggcgtggtggaaagcatttccatcaagctggacgacgaagtcggcactggcgatctgatcctcaagctgaaagtcaaaggcgccgctccggctgctgccccggctccagctgccgctgctgctccgagcgctccggcgccagctgctgctccggctgccgctgcacctgctgctgccgctccggttgctgctccagccaagcctggtgcgaaagttcacgccggccctgccgtgcgtcaactggctcgcgagttcggcgtcgagctgagcgctgtcggcgccagcggtccgcacggtcgcatcctgaaagaagacgtgcagacctacgtcaaagccatgatgcagaaggccaaggaagcaccggccgcggctgctggcgcaaccggtggcgcgggcatcccgccgattccggtcgtcgacttcagccgtttcggcgaaatcgaagaagtgccgatgacccgcctgatgcaggtcggcgctgccaacctgcaccgcagctggcttaacgtgccgcacgtgacgcaattcgactcggcggatatcaccgagctggaggcgttccgcaccgcacagaaatctgtcgcagagaaggctggcgtcaagctgaccattctgccgctgctgctcaagtcctgcgcacacctgctcaaggaactgccggacttcaacagctcgctggcgccaagcggcaaggcgatcattcgcaagaagtacgtgaacatcggcttcgccgtcgacaccccggatggcctgctggtaccggtcatcaagaacgtcgaccagaagagcctgctgcaactggccgccgaagccgcttccctggctgaaaaagcccggaccaagaagctctcgtcggacgagatgcaaggcgcctgcttcaccatttccagcctcggccacattggcggcaccggcttcacgccgatcgtcaacgcgccggaagtggcgatccttggtgtttccaaggcaaccatccagccagtctgggacggcaaagccttccagccgaaactgatgctgccactgtcgctgtcctacgatcaccgcgtgatcaacggcgccgctgctgcacgcttcaccaagcgtctgagcgacctgctggcggacatccgcaccatcctgctgtaa

SEQ ID NO: 37383 - DNA, 1920 bp, Pseudomonas fluorescens
ctgctggtggccaaccgtggcgaaatcgcttgccgggtcatgcgtaccgccaaggcgctgggcctgaccaccgttgccgtgcacagcgccaccgaccgcgaagcgcggcacagccgtgaagcggatatccgcgtcgatctgggcggcagcaaagcggccgacagctatctgcaaatcgacaaactgatcgcagcggccaaggccagcggcgctcaggcgattcatccggggtatggctttctgtcggagaacgccggttttgcccgcgccatcgaagccgccggcctgattttcctcggcccgcccgcctcggccatcgatgcgatgggcagcaaatccgccgccaaatccctgatggaaaccgccggcgtgccgctggtgccgggttatcacggtgaggctcaggatcttgataccttccgcgatgcttgcgaacgcatcggttatccggtgttgctcaaagccacagccggcggtggcggtaaaggtatgaaagttgtcgaggacgtcagccaattgggtgaagcgctggcctcggctcagcgtgaagcgcagtcgtcgttcggtgactcgcggatgctggtggagaaatacctgctcaagccgcgtcacgtggaaatccaggtgttcgccgatcagcatggcaattgcctgtacctgaatgagcgcgactgctcgattcagcgtcggcaccagaaggtcgtcgaagaggcgccggcaccgggcctcagtccggaactgcgtcgggcgatgggcgaagcggcggtgcgttcggcgcaggccatcggctacgtcggcgccggcacggtggaatttctgctggacgcgcgcggcgagtttttcttcatggagatgaacacgcggctacaggtcgaacacccggtcaccgaagccattaccgggctcgatctggtggcctggcagattcgcgtcgcccgtggcgaagcgttgccgatcactcaggatcaagtgccgctgaacgggcatgcaattgaagtgcggttgtatgcggaagatccgtcgaatgattttctgccggcgaccgggcgtctggatctgtatcgcgaatccgccgcagggccggggcgccgtgtggacagcggcgttgaagaaggcgacgagatttcaccgttctatgacccgatgctcggcaagctgattgcctggggcgaagatcgtgagcaggcgcgtttacggctgctgagcatgctcgacgagtttgcgattggcgggctgaagaccaacatcaacttcttgcggcggatcatcgggcatccggcgtttgcggcggccgagctggataccgggttcattccgcgttatcaggaacaactgttaccagcgcctgctgcgctgagcgatgaattctgggaggcggcggcgcaggcttttgcgcagagcctgccggagatggctagggcggatgatcccgcttcgccttgggcgcttcagagcggtctgcgcgctgggttgccacgggaaatcactctgcatttgagttgcgaggggcaggatcgggcgttgacgctcggcgctggcggcaaagcaaaactgatcggcgaacaactggtgctcgagcacgatgggctgcgccgacaactgcgtgcgattcgtcgtggagaggctctgtttctgcaatgggacggcgagctgcgacgcgttgaaacgtacgacccgatcagcgctgtcgaagctagtcacagccatcaaggcggtctgacggcgccgatgaacggcagcatcgtgcgggtgctggtggaggccgggcaatcggttgaagccggggcgcaattggtggtgctggaagcgatgaagatggagcacagcatccgcgcgccccatgccggcgtgatcaaggtgctgtattgccaggaaggcgaaatggtcagcgaaggcagtgcactggtcgaactggaagaa

SEQ ID NO: 37384 - DNA, 786 bp, Pseudomonas fluorescens
atgagcgacttcaacaccctcgaattgcacagcgacccacggggtttcgcgaccctgtggctgagccgcgaagaaaaaaacaacgcgttcaacgccgagatgatccgcgaactgatcctggctttggacaaggtcgccagcgacgccagcctgcgtttcctactggtgcgcggacgcggcaaacacttcagcgccggcgccgatctggcctggatgcagcaatcggccgaactcgattaccacaccaacctcgacgacgcccgggaactggcggagctgatgtacaaccttgccaaactgaaaatcccgaccgtggccgtggttcaaggcgcggcgttcggtggcgcgctgggcctgatcagttgctgcgacatggcgattggcgccgatgacgcgcagttctgcctgtcggaagtgcgcattggcctggcgccggcggtgatcagtccgttcgtggtgcaagccatcggcgaacgggcggcgcggcgttatgcgctgacggccgagcgattcggcggacagcgggcgcgggaaatcggtttgttgtccgagagctatccagcgaccgagcttgaacagaaagtcgagcaatggatcgacaacctgctgctcaacagccccgccgccatgcgcgccagcaaggatctgctgcgtgaagtcggcaacggcgcgctgaccccggcactgcgtcgctacaccgaaaatgccatcgcccgcatccgcgtcagcccggaaggccaggaaggtctgcgggcctttctgcagaagcgtccgccgagctggcaa

SEQ ID NO: 37385 - DNA, 1161 bp, Pseudomonas fluorescens
atgagctacccatccctgaactttgccctcggcgaaaccatcgacatgctgcgcgatcaggttcagtccttcgttgccaaggagatcgcgccgcgtgccgcgcagatcgacagcgacaacctgttccccgctgatctgtggcgcaagttcggtgacatgggcctgctcggcatcaccgtaccggaagagtacggcggcgctggtctgggttacctggcgcacgtggtggcgatggaagaaatcagccgtggctcggcctcggtggcgttgtcctacggcgcccactccaacctctgcgtgaaccagatcaaccgcaatggcaaccacgaacagaaagccaaatacctgccaaaactgatcagcggcgaacacgtcggtgccctcgccatgagcgagccgaacgccggttccgacgtggtttcgatgaaactgcgggccgataaacgcggcgaccgtttcgtgctcaacggcagcaagacctggatcactaacggccccgacgccaacacctacgtgatctacgccaagaccgacctggaaaaaggcccgcacggcatcaccgcgttcatcgtcgaacgtgactggaaaggcttcagccgcagcaacaagttcgacaagctcggcatgcgcggctccaacacttgcgagctgttcttcgatgacgtcgaagtgccggaagaaaacatcctcggcgtgctcaacggcggcgtgaaagtgctgatgagcggcctcgactacgagcgcgttgtcctgtccggtggcccgaccgggatcatgcaggcgtgcatggacctgatcgtgccgtacatccacgaccgcaagcagttcggccagagcatcggtgaattccagctgatccagggcaaggtcgccgacatgtacacccagctcaatgccagccgcgcctacctctacgctgtggcccaggcctgcgagcgcaacgaaaccacccgcaaggatgccgccggcgtgatcctctataccgccgaacgcgccacgcaaatggctctggacgcgatccagattctcggcggcaacggctacatcaacgaattcccggccggccgtctgctgcgtgacgccaaactgtacgaaatcggcgctggcaccagtgagatccgtcgcatgctgatcggccgcgaactgttcaacgaaacccgc

SEQ ID NO: 37386 - DNA, 1614 bp, Pseudomonas fluorescens
ttgctggcgatgaccatcgggcagaagttcgacgagaccgtcgcgcagtacccggacggcgaggcgctggtggtgcgccaccagcagctgcgttacacctggcggcaactggccgacgcggtggacgtgcatgccagagcgctgctggcgttgggtttgcaggccggtgatcggctcggcatctgggcgccgaattgcgcgcagtggtgcatcactcagtttgccaccgcgaagctcggcgtgattctggtcaacatcaacccggcctaccgcagctctgaactcgaatacgtgctcaaacaatccggttgccaatggttggtctgcgccggcgccttcaaatcttcgaactatcacggcatgctgcaaggcttgctgccggaactggccgagcaatccatcggcgaactgcgcagcgagcgcctgccggagctgcgcgggttgatcagccttgatccccagccgccttcgggttttctcccgtggtcgcaactggcagatctggccgccagtgtctctccagaacaattgcgtgaacgcagcgacagcctgcacttcgatcagcccgtcaacattcagtacacctccggcaccaccggcttccccaagggcgcgaccctcagtcactacaacatcctcaacaacggttacatggtcggcgaaagcctcggcctgaccgccgctgatcggctggtgatcccggtgccgttgtatcactgcttcggtatggtcatgggcaacctcggctgtatcacccacggcagcacgatgatttatcccaacgatgccttcgatccgctgctgaccctgagcacggtcgccgaagaaaaggccaccgcgctgtacggcgtgccgaccatgttcatcgccatgctcgatcagccgcagcgcgccgagttcgacctgtcgaccctgcgcaccgggatcatggccggcgccacctgcccgatcgaagtgatgcgacgggtcatcaacgaaatgcacatgagcgaagtgcagatcgcctacggcatgaccgaaaccagcccggtgtcgctgcagaccggcccatccgacgaactggaactgcgcgtcaccaccgtcggccgcacccagccgcaactcgaaagcaaaatcatcgacgaggccggcaatccggtaccacgcggcaccatcggcgagctgtgcacccgtggttacagcgtgatgcttggctactggaacaacccgaatgccaccgccgaagccatcgacgcggcgggctggatgcacaccggcgacctagcgagcatgaacgacgagggttacgtgtgcatcgccgggcgtaacaaggacatgatcatccgtggcggcgaaaacatttacccgcgtgaactggaggagttcttcttcacccacccagcggtggcggacgtgcaggtgatcggcattccctgctcacgttacggcgaagaaatcgtcgcctggatcaaattccatcccggccacagcgccaccgagcaagaactgcaagcgtggtgcaaggagcgtatcgcccacttcaagacgccgaggtacttcaagtttgtggaggagtttccgatgacggtgaccggcaagatccagaagttccggatgcgcgagatcagtattgag

SEQ ID NO: 37387 - DNA, 1179 bp, Pseudomonas fluorescens
atggatttcgcttattcgcccaaggtgcaagaactgcgtgagcgcgtgaccgcgttcatggacacttacgtttacccggccgaagccgtgttcgagcgccaggtcgccgaaggcgatcgttggcagcccacggcgatcatggaagaactcaaagccaaggcgaaagccgaaggtctgtggaatttgtttctgcctgagtcggagcttggtgctggcctgaccaacctcgaatacgcgccgttggcggaaatcatgggccgttcgctgctcgggcccgagccgttcaactgctcggcgcccgacaccggcaacatggaagtgctggtgcgttacgccaacgaagaacagaaacagcgctggctcgaaccgctgctgcgcggcgagatccgctcggcgttcgccatgaccgaaccggacgttgcgtcctccgacgccaccaacatggccgcccgcgccgtgcgcgatggcgacgagtgggtcatcaacggcaagaaatggtggacctccggcgcttgcgatccgcgctgcaagatcctgatcttcatgggcctgagcaaccccgacgccccgcgtcatgcccaacactcgatgatcctcgtgccggtcgacacccccggcgtgaagatcatccgcccgctgccggtgttcggttacgacgacgcaccgcacggtcacgccgaagtgctgttcgacaacgtgcgggtgccgtacgaaaacgtcctgctcggtgaaggacgcggcttcgaaattgcacaaggtcgcctcggcccgggccgcattcaccactgcatgcgttcgatcggcatggccgagcgcgcactggaactgatgtgcaaacgttcggtaagccgcaccgcgttcggcaaaccgctggcgcgtctgggcggtaacgtcgacaagatcgccgactcgcggatggaaatcgacatggcgcgtctgctgaccctgaaagcggcgtacatgatggacaccgtgggtaacaaggtcgccaagagcgaaatcgcgcagatcaaggtcgtggcaccgaacgttgcgttgcgggtgattgaccgggcgatccagattcatggcggggcaggggtgtcgaacgatttcccgctggcctacatgtacgccatgcaacgtaccctgcgcctggccgacggcccggacgaagtgcaccgcgcggcgatcggcaag

SEQ ID NO: 37388 - DNA, 810 bp, Pseudomonas fluorescens
atgaagatcgtttccttcaacatcaacggactgcgggcccgtccgcatcagctggcggcgctgatcgagaagcatcagccggacgtgatcggcctgcaggaaaccaaggtccacgacgaccagttcccgctggaagaagtgcgggccctgggttatcacgtgtatttccacggtcagaaaggtcattacggcgttgccctgctctcgcgccaggaaccgattgccgtacacaaaggttttgccaccgatgaagaagacgcacagcggcgctttatctggggcacgttcgccgacgccaacggcgtgccggtgacgatcatgaacggctatttcccacagggtgaaagccgcgaccatccgaccaaattcccggccaagcagcgcttctacagcgatctgcaagcgctgctggaaagccagttccacaacgaacagccgctggtggtgatgggcgacgtcaacatttccccggaagactgcgacatcggcatcggcccggacaacatgaagcgctggctgaaaaccggcaaatgcagcttcctgccggaagagcgcgagtggatggcccgcctgaaaaactggggcctgaccgacagcttccgccatctgaacccggacgtgaccgacacgttcagctggttcgactaccgcagccgtggttttgaagacgagccgaagcgtggtctgcggattgatgtgattctggcgtctcatggcttgctgccgcgtgtgaaagccgccggtgtcgactatgaactgcgcgggatggaaaagccttcggaccatgcgccgatctggctggaattgagc

SEQ ID NO: 37389 - DNA, 1209 bp, Pseudomonas fluorescens
cgcatgcgccagcaacgcgacgccgtggtgaaactgctgatgtgggagatcggcaagaacctcaaggactcggaaaaagagttcgaccgcacctgcgactacatcgtcgacaccatcaatgcgctgaaagaactcgaccgccgctccagccgtttcgagctggaacaggacaccctcggccagatccgccgcgttccgctcggggtggcgctgtgcatggggccttacaactatccgctgaacgaaaccttcaccacgctgattccggcgctgatcatgggtaacaccgtggtattcaaaccggccaagctcggcgtactgctgatccgtcctttgcttgaagccttccgcgacagcttccccaccggcgtgatcaacgtcatctacggcagcggccgcgagaccgtcagtgcgctgatggccagcggcaagatcgacatcttcgccttcatcggcaccaacaaggccgccagcgacctgaagaaactgcacccgaaaccacaccgcttgcgcgcagcattgggcctggatgcgaagaaccccggcatcgtcctgccggaagtcgatctggacaatgcggtcagcgaagcggtcaccggctcgctgtcgttcaacggccagcgctgcaccgcgttgaagattctgttcgtgcatgaagatgtggtggacagcttcatcgagaaattcaacgccaaactggccagcctcaaaccgggcatgccgtgggacagcggggtttcgctgacgccgctgccagagtcaggcaaggtcgattatctgcatgggctggtggccgacgcgcagagcaaaggcgcccaggtggtcaatccgaatggtggcgagtcgcgggaatcgttcttctatccggcggtgctgtacccggtgacgccgcagatgcgcgtttatcaggaagagcagttcgggccggtggtgccgattgtgccgtaccgtcacctcgataccgtgatcgactacgtgctggaatcggacttcggccagcaactgagcatcttcggcaccaacccggtggccgtcggccgactggtcgacaccttcgccaaccaggtcgggcggatcaacctcaacgcccagtgccagcgcggcccggacacctacccgttcaacggtcgcaagaactccgccgaaggcacgctgtcggtacacgatgcactgcgggtgttttcgatccgcaccctggtggcgaccaag

SEQ ID NO: 37390 - DNA, 1278 bp, Pseudomonas fluorescens
atgcagacttcgaacgcaggcgtttcgcgcacccggcaagtggtcgccgccgtcatcggcaacgccctggaatggtacgacttcatcgtttatggctttctggcgagcatcatcgcccggcaatttttcccgtccgacgacgactacgcttcgctgctgatggcgctggcgactttcggcgtcggctttttcatgcggccggtgggcggcatcctgctcggcatctactccgaccgcaaaggtcgcaaagccgcgatgcaaatgatcatccgcctgatgaccgtgtccatcgccctgatcgcgttcgcgccgaactacgccgccatcggcatgggcgcgccgctgctgatcgtggtggcgcggatgcttcagggttttgccacgggcggtgaatacgccagcgccacggcgtttctggtggagagcgcgccggcccatcgcaagggcttgtacggttcgtggcaactggtcgggcaatgcctggcggtgttcagcggcgcggcgatggtggcgctggtcacgcacctgttttcccccgaggcgctggatagttggggctggcggattccgtttgtgctcggcctgttgatcggcccggtgggcttgtggattcgcaagcacatggaggaaccggaagagtttctcgaagcgcgcaagaaagccaaaggcgccgcgccgggcctgtggcaggtactgcgcgaacatcgccgcagcctgttggtgtcgatgggcctggcgtgcggggcgacggtgtcgttttacgtggtgctggtgaacatgccgaccttcgctcacaagaacctcggcctgccgctggatcaggtgttgctggtgcagatgctcgcggtggggttgatgaccgtggtgattccgttctccggcgcactgtcggatcgcctcggtcggcggccggtgctgatggctttcaccctggcgtttttcgtcatggtctatccgctttacgtgtgggtcgcgacggcgccgtcgatcgagcgtttgctggtgatgcaactgctgctgtgcacggcgattgggggggtcttcggcccggccccgacggcattggccgagcagtttccgattgaggtgcgctccaccggtgtgtcggtggcctacaacgtagcggtgatggtgttcggtggtttcgcgccgctgatcgtcacctggctgagcaaagttctgaacaccccggtggcgccgtcgttctatgtcttgttcgcttgcctgctgaccctgctcggtacttactgtttgcaggaggcaccacgcgcgaagaaa

SEQ ID NO: 37391 - DNA, 991 bp, Pseudomonas fluorescens
atgaaaattctggtcaccggcgcaagcggcttcattggcggacgctttgcgcgtttcgcccctggagcagggcctggaggtgcgggtcaacggtcgccgggccgagggtgtcgagcatctggtacgtcgcggtgccgagttcgttcaaggcgatctgagcgatccggatctggtgcgtgcgctatgcagcgatgtcgaagccgtggtgcattgcgccggcgcggtcggcttgtggggccgttatcaggacttccatcagggcaacgtgcaagtcaccgaaaacgtggtcgaggcctgcctgaaacaacgggttcggcggctggtgcatctgtcgtcgccctcgatctactttgacggtcgcgaccacctcggcctgaccgaagagcaagtgcccaagcgcttcaagcatcactatgccgcgaccaaatacctggccgagcaaaaggtcttcggcgcccaggaattcggcctcgaaaccctcgctctgcgcccgcgtttcgtcaccggcgccggcgacatgagcatcttcccgcgcttgctgaacatgcagcgcaaaggtcgtctggcaattatcggcaacggcctgaacaaggtcgatttcaccagcgtgcacaacctcaacgaagcattgctcagcagcctgctggccgatgcctccgcgttgggcaaagcctacaacatcagcaacggcgctccggtgccgctgtgggatgtggtcaattacgtgatgcgcaagatggaagtcccacaggtcacccagtaccgttcctacggtctggcctacagcgtggcggcgctcaacgaaggggtgtgcaagctctggcccgggcgtcccgagccgaccctgtcgcgcctgggcatgcaggtgatgaacaaaaatttcaccctcgacatcagtcgcgcccggcattatctggactacgatccgaaagtcagtctgtggacggctctcgatgagttctgcagttggtggaaagcccaggacattcgt

SEQ ID NO: 37392 - DNA, 1596 bp, Pseudomonas fluorescens
acgtgtggcgaagtactggtcaagttactcgaagattatggggtcgagcaggtgttcggcattcccggtgtgcataccgtggagctgtatcgcgggctggcccgttcgagcatcaaccacgtcaccccgcgccacgagcagggcgccggcttcatggccgacggctacgcccgtaccagcggcaaaccaggtgtgtgcttcatcatcaccggccctggcatgaccaacatcaccaccgccatgggccaggcgtacgccgattcgatcccgatgctggtgatctccagtgtgcagtcgcgcagccaattgggcggcggtcgcggcaagctgcatgaactgccgaaccagagcgcactggtcggtggcgtggcggcgttctcccacaccctgatgtcggcgtccgaattgccgggtgtgctggcccgtgcgtttgcgctgttccaggccgggcgtccgcgtccggtgcacatcgagattccgctggacgtgctggtcgaagaagccgacgaactgctgaccagcgtgccggtcaacatcgaccgcgccggagctgcgccggccgccgtgagccgcatgaccgaactgctggccggcgcccggcgtccgctgatccttgccggtggcggcgccatcgatgccgctgccgaactcaccgaactggctgagctgcttgatgcaccaatggctctgaccatcaacgccaaaggcatgctgccgtccagccatccgctgttgatcggttcgacccagagcctggtggcgacccgtgctctggtggccgatgccgacgtgatcctggcgatcggcaccgagctggcggaaaccgactacgacgtgaccttcgccggcggtttcgaaatccccggcaagctgctgcgtgtggacatcgatcccgaccagaccgtgcgcaactacccgcctcacgtggcgctggtggccgactcgcgcaatgccgcacaagcgttgctcagcgcgctgtcgcacaaaccgctggccgagcgccgcaacgattggggccaggtacgcgccgcccgtctgcgtgaagacctggccgcgacctgggacgcgccgaccctggcccagacccgtttcctcgaaaccgtgctgcacgaattgccgaacgcagtgttcgtcggtgactccacgcaaccggtgtacaccggcaacctgacgttcaacccggagcgtccgcgccgctggttcaactcgtccaccggttacggcaccctcggttacgccttgccggcggcgattggcgcgtggcttggcggcaacctcgaacacggcgcgcgtccgccggtggtgtgcctgatcggcgacggcggtctgcaattcaccctgccggaactggccagcgctgtggaggcgcgcacgccggtgatcatcctgctgtggaataaccagggttacgaagagatcaagaaatacatggtcaaccgtgccatcgagccagtgggcgtcgacatctacaccccggacttcatcggcgtggccaaggccctgggttgcgcggcgcaagcgatcagctccgctgaacatctgcgcggtgcactgcgcgccgccaccgatcgtcagggcccgaccctgattgaaatc

SEQ ID NO: 37393 - DNA, 1413 bp, Pseudomonas fluorescens
ctgtacatcaacggccaatggtccgccggccgcgaacacctgcgcgtcatcaatccggccaccgaagcgctgttgaccacggtcaatggcggtgacgaaagcgccgtccaccaggcggtaacggcagcgaccgaagccttcaaggcctggtcgaaaaccaccggcgccgagcgcgcctcgatactgcgcaacatcgccaatggcgtgcgcaacggccgcgaacatttgatgaacttgcagtcgagcaacaacggcaaaccgcagttcgaggcgggcatcgatgtcgacgacgtgatcgccacgttcgagtactacgccgaactcgccgaaggcctcgacgccaaactcgacagcaacgtgccgctgcccagcgacgatttcagcgcacgtctgcgccgcgagccgtgcggtgtggtcgggctgatcgtgccgtggaatttcccgatggtcaccaccgcgtggaaactcgcgccagctctcgccgccggttgctgcgtggtgctcaaaccgtctgaagtcacgccgctgccggagctggaactggcgaccatcatcgccgaatccggtctgcccaaaggcgtgttcaacctggtgtgtggcaccggtctggcggtcggtgcgccgctgtcggcggacccgcgcatcgccaaggtttccttcaccggcagcaacgccgtcggtgtgcaggtgatgcagcgcgccgctgaaaccgtgaagggcgtgagcctggaactgggcggcaaatcctcgctgctgattctggaagatgccgacctggatctggcggtggagctggcctgcggtggtggtttcttcaacgccgggcagatgtgctcggccaccagccgggtactggtcgccgatgaactggccgatgaattcctgattcgtctgaaggcccacgcggaaaaaatccgtgtggccgatccgttcgatcctgaagtcgagatgggcgcgctggtcaatcaggcgcagtaccaacgcgtactcggccacattgaccgtggcctcagtgccggggccaagctgatctgtggcggcaaccgtcctgccgatctgccgcgcggctatttcttgcagccgacaatcttcaccgaagtgcccctcgacagtgcgctgtggtgtgaagagattttcggcccggtgatctgcgtgcgcagttttgctacggaagccgaggcgattgccctggccaacgacagtcagttcgggctggtcgccagcgtggtcacgcgcaatgccgagaccgcggatcgggtcgccaacgccttgcaggcggggttggtgtggctcaacgcgcctcaggtgatcttcccgcagacggcgtggggcggctacaaacagagcagcatcggccgcgaattggggccgtggggtctggcggcatttcaggaaatcaagcacgtgatccgc

SEQ ID NO: 37394 - DNA, 1185 bp, Pseudomonas fluorescens
ttgcacccggttgccggttttgaactcggtattgcttcggccggtatcaaacgcccggggcgcaaggatgtcgtcgtgatgcgttgcgccgaaggttccaccgtggcgggcgtgtttacgttgaacgctttctgtgcagcgccggtgatcctggccaagaagcgcgtgcagaacgctgtgcgctacctgttgaccaacaccggcaacgccaacgcgggcaccggcgagccgggcctggccgccgccgagcgtacgaccgcgaagctggccgagctgaccggcgtcgatgccagccagattctgccgtactccaccggcgtgatcggcgagccgctgccggtcgagaagatcgaaggcgccttgcaagccgcgctggacgatctgtcggaaaacaactgggaagctgccgccactggcatcatgaccaccgacacactgccaaaaggcgcgagccgccagttccagcatgacggcgtgaccatcaccgtcaccggcatcagcaagggtgcaggcatgattcgtccgaacatggcgaccatgctcggctacatcgccaccgacgccaaagtctctcgcgacgtgctgcaaaacctgatgctggacggcgccaacaagtcgttcaaccgcatcactatcgacggcgacacctcgaccaacgactgctgcatgctgatcgctaccggcaaggccgcactgccggaaatcaaccgcgccgaaggcgaactgttcgccaagctgaaacaggccgtgtttgaggtgtgcatggacgtggcccaggccatcgtgcgtgacggcgaaggcgcgaccaagttcgtgaccgttgaagtcaacggcggcggcaatcaccaggaatgcctggacgtcggctacaccgtggcccactcgccgctgatcaagaccgcgctgttcgcctcggacccgaactggggtcgcatcctcgccgctgtcggccgtgccggcgtgccggacctggatgtgagcaagatcgacgtgttcctcggcgaggtgtgcatcgccagccgtggcgcgcgcgccgcgacctacaccgaagcccagggctcggcggtgatgcagcaggaagaaatcaccatccgtatcgaactgggtcgcggcgattgcagcgaaaccatctggaccaccgacctgtcccacgagtacgtgaagatcaacgccgaataccgcacc

SEQ ID NO: 37395 - DNA, 375 bp, Pseudomonas fluorescens
atgagcaacatcccagctgaactgcgttttgccgaaagtcatgaatgggcgcgtctggaagccgacggcaccgtcaccgtgggcatcagcgatcatgcccaggaagcgttgggtgatgtggtgtttgtcgagctggcagaagtgggcaaggtgttcgccgccggtgataccgccggtgtcgtcgagtcggtgaaggccgcttccgacatctactccccggtcggtggcgaagtgatcgccgtcaacgaagacctggccggttcgccggaagaactgaacaacgatccgtacgccgcatggatcttcaagctcaagccaagcgacaaggccgagctggacaagctgctcgacgctgccgcctataaggctgccatc

SEQ ID NO: 37396 - DNA, 1332 bp, Pseudomonas fluorescens
atgatccatatcccgaaagcggaatacgcccggcgccgcaaggcgctgatggcgcagatggaacccaacagcatcgcgatcctgcctgccgccgcggtcgccattcgcaaccgcgacgtcgagcatgtctatcgccaggacagcgacttccagtacctcagcggtttccccgagccacaggcggtcatcgtcctgatgcccggtcgcgaacacggcgagtacgtgctgttctgccgtgaacgcaacgccgaacgcgaactctgggacggcctgcgcgccggccaggaaggtgcgatccgcgatttcggcgccgatgacgctttccccatcaccgacatcgacgacattctgccgggcctgatcgaaggccgcgaccgggtgtattcggccatgggcagcaacccggaattcgaccgccacctgatggactggatcaacgttatccgctccaaggcgcacctcggcgcccagccgccgaacgaattcgttgccctggatcacctgctgcacgacatgcgcctgtataaatcggcggcagaagtgaaggtgatgcgcgaagcggcgcggatttccgcccaggctcacatccgggcgatgcaggccagccgtgccgggctgtatgagtacagcctcgaagccgaactcgattacgagttccgcaagggcggggcgaagatgccggcatacggctcgatcgtcgctgccgggcgcaacagctgcatcctgcattaccagcaaaatgacgcactgctcaaggacggcgatctggtgctgatcgacgccggttgcgaaatcgactgctacgccagcgacatcacccgcacctggccggtcaacggcaagttctccgccgagcagaaagcgatctacgaattggtgttggcctcgcaggaagcggcattcgccgaaattgctccgaacaagcactggaaccaggcgcacgaagccacggttcgggtcatcaccaccgggctggtgaagctggggttgttgcagggcgaagtcgacgaattgatcgctaccgaggcctacaaggcgttttatatgcaccgcgccggtcactggctgggcatggatgtgcatgacgtcggcgaatacaaggtcggcggcgaatggcgggtgctggaagtcggcatggcgctgaccgtggagccgggcatctacatcgccccggacaatcagaacgtagcgaagaaatggcgcggcattggcgtgcgcatcgaggatgacgtggtagtgaccaagagcggttgtgaaatcctgaccggcggcgtgccgaaaaccgtcgccgagatcgaagccctgatggcgcaagcacggacctgcgcggca

SEQ ID NO: 37397 - DNA, 1605 bp, Pseudomonas fluorescens
atcactcaccgctatggcgagcggcaagcgctggatggcatcgcgttcggcctgccggccggtacccgctgcggcttgattggccctgacggagcgggcaaatccagtctgttggggctgattgcgggcgtgaaagccctccagcaagggcaactggaagtgcttggcggtccgatccaggatcgcagccaccgcaacacgctgtacgcgcgtatcgctttcatgccgcagggattgggcggcaacctgtacccggaactgtcgatccgcgagaacgtgcattttttcgccaccttgttcggcctctccgccgacgaaagcgcgcagcgcctgcacaacctgttgctcgccactgatctgctgaggttcgccgatcgaccggccggcaaactctccggtggcatgaaacagaaactcggactgtgttgcgcactgattcacgaaccggatctgttgatcctcgacgagccgaccaccggcgtcgatccgctctcgcgccgcaagttctgggaattgatcgacgatgttcggcgccaacgaccgcagctgaccctgctggtcgccacggcctacatggaggaagctgaacaattcgagcattgcctgatgctcgacggcggccggatgatcgccaccggtctgagccgcgaactggctgctgtcacgcccagcggcaagcttgatgacgccttcactcattttcagggtgaaagccgtcacgccactcaaccgctgcacatcccgccttacaccggcaacaccgatattgccatcgaggctcacgacctgacgttgcgtttcggcaactttacggctgtggatcgcgtcagcttcgccatcgggcgaggcgagattttcggtttccttggctccaatggctgcggcaagaccaccacaatgaaagtcctgaccggactgatgcccgccagcgaaggtaacgcaacgctgctgggcaatccggtggatgcgaaggatctggccacgcgcaaacgggtcggattcatgtctcagagcttttcgctgtatggcgaactcagcgtgcggcaaaaccttgaactgcacgcacgcctgttcgatttgccgaaaaccgagagcgcccagcgcatcgacgcgctgattcaacgcttcgatctgcacggtgtcgccaatcaatcgtccggggccttgcctctgggaatacgccagcgcctgtcactggcggtcgcggtcttgcacagcccggaagtgctgattctggatgagccgacctctggagttgatcccgcggcgcgagacgatttctggcgcctgttgatcgaactgtcccgtgatcaaggcgtgaccattttcctttccacccatttcatgaacgaagctcagcgttgcgaccgcatttccctgatgcacgcgggcaaagtgctggcctgtgacacgccgacggcactgcaacaacagtttggcggcaagtccctggaggcggcgttcgtgacctgccttgaacaggctcagggtagtgccgaaaccgccccgcctcccgcgccgtcaccggccccgaaggcgccggccagctccgtcagggagcgggttttcagtttcggtcatctgacgccagtggctcgccgcgaa

SEQ ID NO: 37398 - DNA, 852 bp, Pseudomonas fluorescens
atgccgattgcgcaactgatcagcccgaccgcactggatgcccgcaaggcgcaaccggggctggtgattctcgattgccgttttgccctcgaagacccggattacggccagcgcagctacgccgaggggcacattgccggggcacatttcgccgatcttgaacgcgacctcagcggcccggtgaccaagggcgtgaccggtcgccatccgctgccggagccggcggcgctgatcgagcgcctgcaagcattcggcatcaacaatgacagtgacgtggttctgtatgacgacggcccgggcgcctatgcggcgcgggcctggtggttgctggcgtggctgggcaagcgcgacggcgtgttcattctcgatggcgggctcaaggcctggcatgcggcggggctgccgttgagtcttgatccaccgtcagcggcccggggcagcttcagcggccagccggacatgagcctgctgctcagcgccgagcaattgcagcagcgcctcggtcagccggccctgaccctgctcgatgcccgcgccttgccgcgcttcaagggcgaagtggagccgatcgacccgatcgccgggcacattcccggcgcgcaatgcgcggcgtttaccgacaacctgggcagcgacgggcgtttcctgccggctgatcagctcaaacagcgtttcgccgcgaaactcggcgagcgttcgccgagcgatctggtggcttactgcggctccggggtgacggcgtgtcacaacctgttcgccctgtgcctggcgggttacccgttgggttcgctgtatgccggatcgtggagcgaatggatcaacgatcctgcgcgcggtatcgcttcgggcgag

SEQ ID NO: 37399 - DNA, 1365 bp, Pseudomonas fluorescens
gcagcccaacaggtttaaaaacgaatgaatgctctagcccgccgcgccgcaggcctgctgctcagcacagtctgcctgcccctttcggccctggcggccgacccgcaaccgacacacgaattcaccctcgacaacggcctgaaggtcgtcgtgcgcgaagaccatcgcgcgccggtggtagtgtcgcaggtctggtacaaggtcggctccagctacgaaactccgggccagaccggtctgtcccacgccctcgagcacatgatgttcaagggcagcgagaaagtcggccccggcgaagcctcgctgatcctgcgcgacctcggcgccgaagagaacgcgttcaccagcgacgacttcaccgcttattaccaggtgctggcccgcgaccgtctgggcgtggccttcgaactggaagccgaccgcatggccaacctgcgcctgccggccgacgagttcgccaaggaaatcgaagtcatcaaggaagagcgccgtctgcgcaccgacgacaagccgatggccaaggcctacgagcgctacaaggccatggcctacccggccagcggttaccacacgccgaccatcggctggatggccgaccttgagcggatgaaggtcgaagagctgcgccactggtatcagtcctggtacgtgccgaacaacgccacactggtggtggtcggcgacgtgaccccggacgaggtgaagaccctcgcccagcgctacttcgggccgatcccgaaacgcgacgtgccgccggcgaaaaagccgctggaactggccgaaccgggtgaacgccagatcaccctgcacgtgcagactcaactgccgagcctgatgcttggtttcaacgtcccgagcatcgccaccgccgaagacaaacgttcggtcaacgccttgcgcctgatttcggcgctgctggacggcggctacagcggtcgcatcccgacccaactggagcgtggcgaagaactggtgtccggcggttcgtcgagctacgacgcctacacccgcggcgacagccttttcaccctgtcggccacgccgaacacccagaagaaaaagaccatggcccaggcggaagccggcctgtggaaactgctggagcagctgaaaaccagcgcaccgtccgccgaagaactggaacgcgtgcgtgcgcaggtcatcgccggtctggtcttcgagcgtgattcgatcaccagccaggccaccgccatcggccagctggagaccgtcggtctgtcgtggaagctgatggacaccgaactggccgacctggaaagcgtcaccccgcaagacatccagaacgccgccaagctgtatttcacccgcgaacgtctcagcgtcgcccacgtcctgccactggag

SEQ ID NO: 37400 - DNA, 816 bp, Pseudomonas fluorescens
atgagcaacacacgtattgcctttatcggtgccggcaacatggccgccagcctgatcggcggcctgcgggccaagggtctggaagctgcacacatccgcgccagcgatccgggtgaagaaacccgcgccaaagtcagcgccgaacacggcatcgaaaccttcgccgacaacgcccaggccatcgacggcgccgatgtagtggtactggcggtcaagccacaagccatgaagctggtgtgcgaagcgattcgcccgagcctgaaaccgaatcaactggtggtgtccatcgccgccggcatcacctgcgccagcatgacggcctggctcggcgaacagccgatcgtgcgctgcatgccgaacaccccggcgctgctgcgccagggcgtgagcggcttgtacgccacaggcaaagtgagcgccgaacagcgtcaacaggctgaagaactgctgtccgccgtgggcatcgccctgtggctgaacgaagagcagcaactggacgcggtcaccgctgtctccggttccggcccggcgtacttcttcctgctgatcgaagccatgaccgccgccggcgtcaaactcggcctgccgaaggaaaccgccgagcagctgaccttgcagaccgcgctgggcgccgcgcagatggcggtatccagcgacgtcgacgcggccgaactgcgccgccgcgtgacctcgccggccggcaccacggaagctgcgatcaaatcgttccaggccggcggcttcgaagccctggtggaaaaagcactcggcgccgccgcgcaccgctcggccgaaatggccgaacaattgggcaaa

SEQ ID NO: 37401 - DNA, 999 bp, Pseudomonas fluorescens
atgacgcctctagataccaagcgcccgctgcagctcaatgatcagggccagctgcgccacttcctctcgctcgacggcctgcgccgcgagttgctgacggaaatcctcgacaccgccgactcgttcctcgaagtcggtgcccgggccgtgaagaaggttccgttgctgcgcggcaagaccgtgtgcaacgtgttcttcgaaaactcgacccgcacccgtaccaccttcgaactggcggcccagcgcctgtcggcggacgtgatcaccctgaacgtgtcgacctcttcggccagcaagggcgaaaccctgctcgacaccctgcgcaacctcgaggccatggccgccgacatgttcgtcgtgcgccacggtgactcgggcgccgcgcacttcatcgccgaacatgtctgcccgcaagtggcgatcatcaacggcggcgacggccggcacgcgcacccgacccagggcatgctcgacatgctgaccatccgccgtcacaagggcggtttcgagaacctctcggtggccatcgtcggcgacatcctgcactcgcgggtggcgcgctcgaacatgctcgccctgaagaccctcggctgcccggatatccgcgtgatcgcaccgaagaccctgctgccgatcggcatcgagcaatacggtgtgaaggtctacaccgacatgaccgaaggactgaaagacgtcgacgtggtgatcatgctgcgcctgcagcgtgagcgcatgactggcggtctgctgccgagcgaaggcgagttctatcgcctgttcggcctgaccaccgcgcgcctggccggcgccaagcccgattgcatcgtcatgcacccggggccgatcaaccgcggcgtggagatcgagtcggcggtggccgacggcccgcactcggtgatcctcaatcaagtcacctacggcatcgcaatccgtatggccgtgctgtcgatggccatgagcggacagactgcccagcgccaattcgagcaggagaacgcc

SEQ ID NO: 37402 - DNA, 1761 bp, Pseudomonas fluorescens
atgatcccgatgctttcctcgcgccaccgccgggccttgcgcctgaccagttctttccttgccccttatcgctggccggcctttggtgcgctgctggcactgatcgtcacggcgggcatcaccctgtcgatggggcagggcatcaagttgctggtcgatcaaggcttcatgactcaatcgccgcacttgctcaatcaatccatcggcctgttcatgctgttggtgctcggcctcgcggtcggcacgtttgcgcggttttatctggtgtcctggatcggtgagcgcgtggtggcggacatccgtcggcaggtgttcaaccatctggtgtacctgcatcccgggttttacgaggacaaccgcagctcggaaatccagtcgcggctgaccgctgacaccacgctgctgcaatcagtgatcggctcgtcgctgtcgctgttcctgcgcaatttgctgatggtcattggcggtgtggtgctgctgttcatcaccaaccccaagctcaccagcatcgtggtaatagcactgccgctggtgattgcgccgatcctgatttttggccgccgcgtgcgtaacctctcccggctgagtcaggaccggatcgccgacattggcagttacgtctcggaaaccctcggccagatcaaaaccgtgcaggcctacaaccatcaggtgcaagacgaacagcgtttcgccagcaccgtcgagcaggcattcgagactgcgcgcaaacggattttccagcgggcctggctgatcacgctggtaatcgtgctggtgctcggcgccgtcgcggtgatgttgtgggtcggcggcatggacgtgatcgccgggcggatttctgccggtgaactggcggcgttcgtgttctacagcctgatcgtcggcagtgcgtttggcacgttgagcgaagtgatcggagagttgcagcgagcggctggcgccgccgagcgcatcgccgaattgctgcgttcggaaaacatcatccagccaccgaccacaggattggtgacgctgccggagcgggtcaaaggcgagctggagttgcaggatgtacgtttttcctacccttcgcgtcccgatagcctcgccgtcgatggcttgagtctgacgatcaacgccggggaaaccctcgcgctcgtgggaccgtccggcgcgggcaagtccacggtgtatgacttgctgctgcgtttctacgatccccgggaagggcggatcctgatcgatggcgtaccgctgacgagcctcgatccgctggacctgcgtcgctgcttcgcgctggtctcgcaaaccccggcactgttcttcggcagtgtcgaagagaacattcgctacggctgcccgaccgccacgctggagcaggtgcgggaggcggccagaatcgcccacgcccacgacttcatcgaacagatgcccgacggctaccagacccatctgggcgacggtggcctcggtctgtcaggcggacaacgccagcgcctggccattgcccgggcgttgctggtcgacgcgccgatcctgctgctcgacgaagccaccagcgcccttgatgcccaaagcgaacacctgattcagcaagcactgccgagcctgatgcaaaaccgcaccacgctggtcattgcccaccggttggcgacggtgaaaaacgccgaccggattgcggtgatggatcagggcaaactggtggcgatcggtacgcatcaggagttgatcgccagtaatccgctgtatgcgcggttggcggcgttgcagttcagtgatggt

SEQ ID NO: 37403 - DNA, 2733 bp, Pseudomonas fluorescens
atgccgtccctcgatagtctgaattctctgaaaaccctcaaagtcgatgacaagacttaccactatttcagcctgccggatgccgccaagaccttgggcgatcttgacaagctgccgatgtcgctgaaagtcctgctggaaaacctgctgcgctgggaagatgaaaaaaccgtcaccggcgccgacctcaaggcgcttgccgcgtggctcaaggagcgccgctccgaccgcgaaatccagtaccgccctgcccgcgtgctgatgcaggactttaccggcgtaccggccgtggtcgatctggccgcgatgcgcgccgccatggccaaggccggcggtgatccgcagcgaatcaacccgctgtcgccagtggatctggtgatcgaccactcggtgatggtcgacaaattcgccagcgccagcgccttcgaacagaacgtcgacatcgaaatgcagcgcaacggcgaacgctatgctttcctgcgctggggccagagcgccttcgataacttcagcgtggtgccgccgggcaccgggatctgccaccaagtcaacctcgaatacctcggccgcacggtgtggaccaaggacgaagacggccgcacctatgccttccccgacacgctggtcggcaccgactcccacaccaccatgatcaacggcctcggcgtacttggctggggcgtcggcgggatcgaagcggaagccgccatgctcgggcaaccggtgtcgatgctgattccggaagtgatcggtttcaaactcactggcaagctcaaggaaggcatcaccgccaccgatctggtgctgaccgtgacccagatgctgcgcaagaaaggcgtggtcggcaaattcgtcgagttctatggcgacggcctcgccgacctgccgctggccgaccgcgcgaccatcgccaacatggccccggaatatggcgcgacctgcggtttcttcccggtggatgacgtgaccctcgactacttgcgcctgtccggccgcccgcctgaagtggtgaaactggtcgaggcgtacaccaaggctcagggcctgtggcgcctgcccggtcaggaaccggtgttcaccgacagcctggcgctggacatgggcagcgtcgaagccagcctcgccgggcctaaacgtccgcaggaccgtgtctcgctgccgaatgtcggccaggcgttcagtgacttcctcgacttgcagttcaaacctaccagcaaagaagaaggacgtctggaaagcgaaggcggtggtggcgtggcggtgggcaatgccgatctggtcggcgaaacggactacgagtacgacggccacacctatcgcctgaaaaacggcgcggtggtgattgccgcgatcacctcctgcaccaacacctccaacccgagtgtgatgatggcggctgggctgctggcgaaaaaagccgtggaaaaaggcctgacccgcaagccgtgggtgaagagttcgctggctccgggttcgaaagtcgtcaccgattactacaaggccgccggattgacgcagtacctcgatcagctcggtttttcgctggtcggctatggctgcaccacttgtatcggcaactccgggccgctgccggaaccgatcgaaaaagccatccagaaagccgacctgaccgtggcttcggtactgtccggcaaccgcaacttcgaaggccgggtgcatccgctggtgaaaaccaactggctggcctcgccaccgctggtcgtcgcttacgccctggccggcagtgtgcgcaccgacatcagcagcgagccgctgggtaacgaccagcagggcaatccggtttacctgcgagacatctggccgagcagcaaggaaatcgccgacgcggtaaatcaggtcaatacggcgatgttccacaaggaatacgccgaagtgtttgccggcgacgaacagtggcaagccatcgaagtcccgcaagcggcgacctatgtctggcaagcggattcgacctacatccagcatccgccgttcttcgatgacattgccgggcctttgccggtgatcgccgatgtgaaaggtgctcgagtgctggctttgctgggcgattcggtgaccaccgaccacatctcccccgccggcaacatcaaggccgacagcccggccggacgttacttgcgcgagcaaggcgtcgagccacgggacttcaactcctacggctcacgccggggcaaccacgaagtgatgatgcgcggcacgtttgccaacatccgtatccgcaacgaaatgctcggcggcgaagaaggtggcaacacgatctacattccgaccggcgagaaactggcgatctacgacgcggccatgcgttatcaagcctcaggcacgccgctggtggtgattgccgggcaagaatacggcaccggttccagccgtgactgggctgccaagggcaccaacctgctgggcgttaaagcggtgatcgccgaaagcttcgagcgcatccaccgttccaacctggtgggcatgggcgtgctgccgttgcagttcaagctcgatcagaaccgcaagagcctgaacctcaccggcaaggaaaccctggatattcagggcctgagcggtgtcgagctgacgccacggatgaacctgaccctggtcatcacccgtgaaaacgggcgtcaggagaaaatcgaagtgctgtgccgcatcgacaccttgaacgaggtggagtacttcaagtccggcgggattctgcattacgtgttgcgccagttgatt

SEQ ID NO: 37404 - DNA, 603 bp, Pseudomonas fluorescens
atcaaactctacaacttcccgcgttccggccacgcccatcgtgtcgagctgatgttgtcactgttgcaactgccgaccgagctgatctttgtcgatctggccaaaggcgagcacaaacagcccggctacctggcgatcaacagcttcgggcaagtaccggccattgatgacaacggcgtggtactggccgactccaacgcgattctcgtctacctggcacagaaatacggcaacggccgctggctgccaagcgatccggtcggcgccgcgcatgtgcagcgctggttgtcggcagccgccgggccgattgccttcggtcctgccgccgcccgcctgatcacggtgttcggggcgaagttcaacgctgaggaagtcatcacccgcgcgcacaattttctcaaggtgatggacttggaactgggcaaaaccccgtatttggcgggcactgagccgaccattgccgatgtctcggcctacagctacatcgcccacgcgccggaaggcaatgtatcgctggacgactacgctaacgttcgcgcctggctctcgcgtatcgaagcgctgcccggttttgtcggcatgccgcgcaccgttgccggcctg

SEQ ID NO: 37405 - DNA, 777 bp, Pseudomonas fluorescens
caggccgatgcacgattgcaggccaaggcattgggggacagctggcggccattgcgcgtggcaaaagtcgaaatggaaagccgtcacatccgctcgatctatctggagccgaacgatggcgcaggactgccggtgtttctcgccgggcagcatctgccgctgcggttcacccttgatggcgaggtgcacatccgcacctacagcctgtccggcgcgccgtcggacgattttttccggatcagtgtcaagcgcgaaggacgggtgtcgacgcacctgcatgagcagattcgcgtaggcgatgtgctggaggcgcgcttgcctcaaggacatttcaccgtcgcggcactggagcgcaagccattggtgctgctcgccgccggcgtcggcatcacgccgttgctgtcgatgctgcgtgaggtggtgtatcagggcctgcggacgcgacggattcgtccgaccctgtttgttcagagttcccgcagcctcgccgaccagccgttccgcgcagaggtggatcggttgctggaggatgccggtgatgccgtgaaagtgttgcgagtgctaagtcagccggaagacgatctggtagaaggaaaagacttcgacctgcgtggtcgtatcgatggcgatctgttgcgcaatctgctgaccgacgaggacttcgatcaggtcgacttcgtgctctgcggtcccggcggttttacccagggtatttacgacatcttgcgcgaactgaatgtgcgggacgggcagatccatgccgaaaccttcggccct

SEQ ID NO: 37406 - DNA, 969 bp, Pseudomonas fluorescens
atgacaaaaagtgcattgatcaccgggatcaccggccaggacggcgcgtatctggccaagctgttgctcgacaagggttacaaggttcacggcctcgtggcacggcgcagcagcgactcgcgctggcgtctgcgcgagatgggcgttgaagccgacatcgtttacctggacggcgacatggccgacgcctgctcggtgcagcgcgcggtgatcaagtcggcgccggacgaggtgtataacctggcggcccagagcttcgttgccgcctcctgggaccaaccggtaaccaccggcatcgtcgatggcctgggcgtgactcacctgctcgaagcgatccgtcagttcagcccgcacacgcgtttctatcaggcgtccaccagcgaaatgttcggtctgatccaggccgagcaacaggatgagaacaccccgttctacccgcgcagcccgtacggcgtggccaaactctatggccactggatcaccgtcaactaccgtgaaagcttcaacctgcacgccagcagcggcattttgttcaatcatgaatcacccctgcgcggcatcgaattcgtgacccgcaaggtcaccgatgccgccgcccggatcaaacagggcaaacagcaggagctggccctgggcaacatcgatgccaagcgcgactggggcttcgccggtgactacgtcgaggccatgtggctgatgctgcaacaggacaagcccgacgatttcgtggtcgccaccggcgtcaccaccaccgtgcgcgagatgtgtcgcatcgccttcgatcacgtcggcctcaactatcgggattacgtgaagatcgacccggcgtttttccgcccggccgaagtcgaagtgctgctcggcaatccggccaaggcccagcgcgtgctgggctggaaaccgaaaaccgacctcgacaccctgatccgcatgatgatggatgcggacatgaaacgcgtcgccaaggag

SEQ ID NO: 37407 - DNA, 2712 bp, Pseudomonas fluorescens
atggccactatccacgtagacggcaaagcgctcgaagtcgacggggcagacaacctgttacaggcatgtctgtcgctgggcctcgacatcccttatttctgctggcaccccgcgcttggtagcgtcggggcctgccgccagtgcgcggtcaagcagtacaccgacgaaaacgacacccgtggtcgcatcgtcatgtcctgcatgaccccggccaccgacaatacctggatctccatcgacgatgaagaatccaaggcattccgcgccagtgtcgtcgaatggctgatgaccaaccacccgcacgactgccctgtgtgcgaggaaggcggtcactgccacctgcaagacatgaccgtgatgaccggccacaacgagcgccgttatcgcttcaccaaacgcacccaccagaaccagcaactgggcccgttcatttcccacgaaatgaaccgctgcatcgcctgctaccgctgcgtgcgtttctacaaggactacgccggcggcaccgacctcggtgtattcggcgcccacgacaacgtgtacttcggtcgcgttgaagacggcaccctcgaaagcgagttctccggcaacctcaccgaggtctgcccgaccggtgtgttcaccgacaagactcactccgagcgctacaaccgtaagtgggacatgcagttctcgccgagcatctgccatggctgctcgagcggttgcaacatttccccgggcgagcgttacggcgaactgcgtcgcatcgaaaaccgttacaacggttcggtgaaccagtacttcctgtgcgaccgtggccgtttcggttatggctacgtcaaccgcaccgaccgtccacgtcagccgctgctggccgacggcaccaagcttggactggatgctgcgctggacaaagccgccgacctgctgcgcggtcgcaacatcgtcggtatcggttcgccacgtgccagcctggaaagcaactacgcgttgcgtgaactggtgggcgccgagcacttctactccggtatcgaagcctccgaactggaacgcatccgtctggtcctgcaagtgctgaaagacagcccgctgccagtgccgaacatgcgcgacatcgaagaccacgacgctgtgttcgtcctcggtgaagacctgacccagaccgccgcccgcatggccctggccctgcgtcagtcggtcaaaggcaaggccgaagacatggccgaagccatgcgcgttcagccttggctcgacgctgcggtgaagaacatcggtcagcacgaactgaacccgctgttcatcgccagcctggctgaaaccaagctcgatgacatcgccgaagaatgcgtacacgccgctcccgacgatctggcgcgcatcggtttcgccgtggctcacgccctggacgccagcgcgccggccgttgaaggtctggacgccgaagccctggaactggccaagcgcatcgccgatgctctgctcgcggccaagcgtccgctgatcatcgccggtacttcgctgggctccaaagccttgatcgaagccgctgcgaacatcgccaaggccctgaagctgcgcgagaagaacggttcgatcagcctgatcgtgccggaagccaacagcctcggcctggccatgctcggtggcgaatcggtcgatgccgcgctgcaagcggtcatcgacggcaaggccgacgccatcgtcgtgctggaaaacgatctgtacacccgtaccgccaaggccaaggtcgatgcggcactgaacgctgcgaaagtggtgatcgttgccgaccatcaaaagaccgccaccagcgaccgcgcgcatctggttctgccggccgccagcttcgctgaaggcgacggtacactggtcagccaggaaggtcgtgcccagcgcttcttccaggttttcgacccgcaatacatggacgcgagcattctggtccacgaaggctggcgctggctgcacgccctgcgcgccaccctgctgaaccagccgatcgactggacgcaactcgaccacgtgaccgctgccgttgcgtcgagcacgccgcaactggcccgtattgtcgacgcagcaccgtccgcctcgttccgcatcaagggtctgaaactggcccgtgagccgctgcgttactccggtcgcaccgcgatgcgcgccgacatcagcgttcacgaaccacgcaccccgcaagacaaagacaccgcgttcgccttctcgatggaaggttactcgggctccgccgaaccgcgtcagcaagtgccgttcgcctggtcgccgggctggaactcgccgcaagcctggaacaagttccaggacgaagtcggtggtcacctgcgcgctggcgatccgggcacccgcctgatcgaaagcaccggtgattcgctgaactggttcgccagtgttccgcgcgcgttcaacccggcccagggcacctggcaagccgtgccgttctaccacctgttcggcagcgacgagaactcgtcgaaagccgctccggtccaggaacgcatcccggccgcctacgttgcactggccaagtccgaagcggatcgcctgggcgtgaacgacggcgcactgctgagcctcaatgttgccggccagaccctgcgtctgccgctgcgcatcaatgaagaactgggcgcaggtctggtggcattgcctgcaggcatcgccggcattccaccggcattcgctggcgtatccgttgatggtctgcaggaggcagcgcaa

SEQ ID NO: 37408 - DNA, 1242 bp, Pseudomonas fluorescens
aagattcaggttccagccgtcggcgacaaaatcaccgtcaacgcagaccattctctcaatgtccctgataacccgatcattcccttcatcgaaggtgacggcattggcgtcgacgtcagccctgtgatgatcaaagtggttgatgctgccgtagagaaagcctacgggggtaagcgcaagatttcctggatggaggtttatgctggcgaaaaagcaactcaggtctatgaccaggacacctggctgccccaggaaaccctggacgcggtcaaggattacgtggtctccatcaaaggcccgctgaccactccggtcggtggcggcatccgttccctcaacgtcgccctgcgccaacagctcgatctctatgtctgccttcgccctgtggtgtggttcgaaggtgtgccgagcccggtgaaaaagcctggcgacgtcgacatggtgatcttccgcgagaactccgaagacatttatgccggtatcgaatggaaagccggctcccctgaggccaccaaggtcatcaaattcctgaaagaagaaatgggcgtcaccaagatccgtttcgaccaggattgcggcatcggcatcaagccggtttccaaagaaggcaccaagcgtctggtgcgcaaggcgctgcaatacgtggtggacaacgaccgcaagtcgctgaccatcgtgcacaagggcaacatcatgaaattcaccgaaggtgccttcaaggactggggctacgaggtggcgaaggaagaattcggcgccgagctgctcgatggcggcccatggatgaaattcaagaacccgaaaaccggccgcgaagtcgtcgtcaaggacgccatcgccgacgccatgctccagcagatcctgctgcgtccggccgaatacgatgtgatcgccaccctcaacctcaacggtgactacctgtccgacgccctggcggcggaagtgggcggtatcggtatcgcgccgggtgccaacctgtccgacaccgtagccatgttcgaggcgacccacggtactgcgccgaaatatgccggcaaggaccaggtcaacccgggttcggtgattttgtcggcggaaatgatgctgcgccacctgggctggaccgaggcggccgacctgatcatcaagggcaccaatggcgccatcaaggccaagaccgtgacctacgacttcgaacgtctgatggaaggcgccacactggtgtcttcttcgggcttcggtgaagcgctgatcaagcacatg

SEQ ID NO: 37409 - DNA, 2247 bp, Pseudomonas fluorescens
ctcgaagtcaccctcaatcttgccttcaaggaggcacgttcgaaacgtcatgagttcatgaccgtcgaacacctgctgctggccctattggacaatgaggctgccgccaccgtattgcgtgcctgcggcgcaaacctcgacaaactcaagcacgacctgcaggagttcatcgactccaccacgccgctgatccctgtccatgacgaggatcgcgaaacccagccaaccctgggcttccagcgtgtactgcaacgtgctgtctttcatgtgcagagctcgggcaaacgcgaagtaaccggcgccaacgtgctggttgcaatcttcagtgagcaagagagtcaggcggtgttcctgctgaaacagcagagcgttgcacgcattgatgtcgtcaactatatcgcccacggcatatccaaagtgccggggcatggcgatcactctgaaggtgaacaagatatgcaggacgacgagggcggtgagtcttcttcttcaggcaatccgctggacgcttatgccagcaacctcaacgaactcgcacgccagggtcggatcgatccgctggtcggacgtgaaacggaagtcgagcgtgtcgcgcagattcttgcgcgccgtcgcaagaacaatccgctgctggtgggcgaggcgggcgtgggtaaaaccgcgattgccgaaggcctggccaagcgcattgtcgacaaccaggtgccggacctgctggccaacagcgtcgtttactcactcgatctgggcgctctgctcgcgggcaccaagtatcgcggtgatttcgagaagcgcttcaaggcgctgctcaacgagctgaaaaaacgtccgcaggcgatcctgttcatcgacgagatccacaccattatcggtgcaggtgccgcttcgggcggcgtcatggatgcctcgaacctgctcaagccgctgctgtcgtctggcgacattcgctgcatcggttcgaccacgttccaggaattccgtggcatcttcgaaaaagaccgcgccctggcgcgtcgcttccagaaggtcgatgtcgtcgagccatcggtggaagacaccatcggtatcctgcgtggcctgaaagggcgttttgaacagcatcataatatcgaatacagcgatgagtcgctgcgcgccgctgcggaactggcttcgcgctacatcaatgaccggcacatgccggacaaggccatcgatgtgatcgacgaggccggcgcctatcagcgtctgcaaccggtcgagaagcgtgtgaaacgcatcgaagtccctgaagtcgaggacatcgttgcgaaaatcgcgcggattccgccgaagcacgtcaccagctccgacaaggaactgctgcgtaacctcgagcgtgacctgaagctgacggtgttcggtcaggacgcagcgatcgattcgctgtcgactgcgatcaagctgtcccgtgccggtctcaagtcgcctgacaagcctgtcggttcgttcctgttcgcagggccgaccggtgtcggtaaaaccgaagccgcgcgtcaattggccaaggcgctggggatcgaactggtgcgtttcgacatgtccgagtacatggagcgccacaccgtatcgcgtctgatcggtgcgcctccgggttatgtcggtttcgaccagggcggtctgttgaccgaagcgatcaccaagcagccgcattgtgtattgctgctcgatgaaatcgagaaggcgcatccggaagtcttcaacctgctgctgcaggtgatggaccacggtacgctgactgacaacaacgggcgcaaggcggacttccgcaacgtaatcgtgatcatgaccaccaacgccggtgctgaaacggcggcacgtgcttcgatcggcttcacccatcaagaccactcgtccgatgcgatggaagtgatcaagaagagcttcacgccggaattccgcaaccgtctggataccatcattcagtttggtcgcctcagtcatgaggtcatcaaaagtgtggtggacaagttcctcaccgaacttcaggcgcaattggaagacaagcgtgtgcttctggaggttaccgatgcggcgcgcagctggctggcggccggtgggtacgattcggccatgggcgctcgtccgatggcgcgtctgatccaggacaagatcaagcgtccgctggcggaggagattctgtttggcgagctggccgagcatggcggtgtggttcatatcgacatcaaggatggtgagctgacgtttgacttcgagaccactgcagaa

SEQ ID NO: 37410 - DNA, 1185 bp, Pseudomonas fluorescens
cacttcgacgccatcggccgagtgcccggcgacccgatcctcggtctgatggaggcctacgcgcaggattccaacccgcgcaagttcgaccttggcgtgggcgtctacaaggatgcccagggcctgacgccgatccccgaggcggtgaaaatcgccgaggcgcgtctggtcgagagccaggacaccaagacctacatcggtggccacggcaatccgctgttcggcaaggtcatcaatgagctggtgcttggcgtcgattcgaagctgatcgccgagcaacgcgccggcgccacccaaacgccgggcggtactggcgccctgcgtctggcggcggacttcatcgcccaatgcctgccgggcaagggtgtatggctgagcaacccgacctggccgatccacgaaacgattttcgcggccgccggggtcaagatcagccattacccgtacgtcggcagcgacaaccgcctcgacgtcgatgcgatgctcgccgtgctcaacgaagtgccgaaaggtgatgtggtgctgctgcacgcgtgctgccacaacccgaccggtttcgacctgagccacgacgactggcagcgagtgctggaggtagtacgccgccgtgacctgctgccgctgatcgactttgcctaccagggctttggcgacggtctggagcaggatgcatggtcgacccggctgttcgccgccgagttgcccgagctgctgatcaccagctcctgctcgaagaacttcggtttatatcgcgaccgcaccggtgcgttgatcgtcagcgcgaaaaccgctgacaagctgatcgacatccgcagccagttggcgcacatcgcccgcaacctgtggtcaacgccaccggatcacggcgcggctgtggtcgccacgatcctcgccgacccggagctgaaacgccgctgggccgacgaagtggaagccatgcgtctgcgcatcgcccagttgcgcagcggactggtggaagcgctggaaccgcacggcctgcgcgagcgttttgcgcacatcggcgtgcaacgcgggatgttctcctacaccggactgtcgccggaacaggtgaagaacctgcgtgagcatcacagcgtgtacatggtcagctcgggccgggccaacgttgccgggattgatgcgacgcgtctcgacctgctggccgaagcgatcgccaacgtctgc

SEQ ID NO: 37411 - DNA, 1402 bp, Pseudomonas fluorescens
atgagtggacaaaactcgcaatcaggcgagctgaaacgcggcctgaaaaatcgccacattcaactgatcgccctcggtggcgcgatcggtaccggattgttcctcggttcggccggggtgctgaaatccgccggcccgtcgatgatcctcggctatgccatctgcggcttcatcgccttcatgatcatgcgccagctgggcgaaatgatcgtcgaagagccggtggccggatccttcagccactttgcgcacaaatactggggcggtttcgccggcttcctgtcgggctggaactgctggatcctgtacatcctggtgggcatgtcggagctgaccgcggtcggcaaatacatccactactgggcgccggagatcccgagttgggtcactgccgcggcgttcttcgtgctgatcaatgcgatcaacctggccaacgtcaaagtcttcggtgaagccgaattctggttcgcgatcatcaaggtcgtggcgatcgtcggcatgatcgccctgggcagctacctgctggtcagcggccatggcggcccgcaggcttcggtcagcaacctgtggtcccacggtggtttcttcccgaacggcgtcagcggtctggtgatggccatggcgatcataatgttctcctttggcggtctggaaatgctcggtttcaccgcagccgaagccgacaagccgaaaaccgtgatcccgaaagcgatcaaccaggtgatctaccggatcctgattttctacatcggcgcactggtgatcctgttgtcgctgactccgtgggacagtctgctggaaaccctcaacgcttctggcgattcctacagcggcagcccgttcgtgcaggtgttctcgatgctcggcagcaacaccgctgcgcacatcctcaacttcgtggtcctgaccgcggcattgtcggtgtacaacagcggcacctactgcaacagccgcatgctgctgggcatggccgagcaggggcgatgcgccgaaagcgctggcgaagatcgacaagcgcggcgtgccggtgcgttcgatcctggcctcggcggccgtgactctggtggcggtgctgctcaactacctgatcccgcaacacgcgctggaactgctgatgtcgctggtggttgcaacgctggtgatcaattgggcgatgatcagcttctcgcacttcaagttccgccagcacatgaacaagacccaccagaagccgctgttcaaggcgctgtggtacccgtacggcaattacatctgcctggcgttcgtcctgttcatcctcggcgtgatgctgctgatcccgggcattcagatctcggtgtacgcgattccggtgtgggtggtgttcatgtggatctgctacgtgatcaagaacaaacgtggcgcgcagcaggcactgcacgca

SEQ ID NO: 37412 - DNA, 1617 bp, Pseudomonas fluorescens
accgctctgcctgcctggcaagcgttgaaagatcaccgccaagccatgcaggatttcagcatgcgcgaagccttcaacgccgatccgcagcgcttcaatcagttcactctcagcagctgcggactgtttctcgactattcgaagaatctgatcaacgccgagacccgcaacctgctggtgggtctggccaatgaagtcgatctcaaaggcgcgatcaaggcgctgttcgacggcgaaatcgtcaactcctccgaaggccgcccggcactgcacaccgccctgcgtcgcccggtcggcgacaagctgtcggtcaacggtgtcaacgtgatgcctgaggtacacaaggtgctgaaccagatcaccgatctcgtgggccgcatccacgacggtctgtggcgcggttacaccgagaagccgatcactgacgttgtgaacatcggcatcggcggctcgttcctcggccccgagctggtctccgaagccctgctgtcctacgcccagaaaggcgtgcgttgccattacctggcaaacatcgacggcagcgaattccacgagctgacgcaaaaactgcgcgccgagaccacgctgttcatcgtttcgtcgaaatcgttcaacaccctcgaaaccctgaaaaatgcccaggccgcacgcgcctggtacctggcccagggtggttcggaagccgagctgtatcgccacttcatcgccgtatcgagcaacaatgccgccgccgtggccttcggtatccgcgaagaaaacatcttcccgatgtgggactgggtcggcggtcgttactcgctgtggtcggccatcggcctgccaatcgcgctggccatcggcatgtccaacttcaaggaactgctgtccggtgcctacaccatggaccagcatttccagagcgcgccgttcgaacagaacatgccggtgctgctggccctgctcggcgtgtggtacggcaacttctggggcgcgcaaagccacgcgatcctgccgtacgaccactacctgcgtaacatcaccaagcacttgcaacagctggacatggaatccaacggcaagagcgtgcgtcaggacggcaccccggtgtcgaccgacactggcccggtgatctggggcggcgtcggttgcaacggtcagcacgcttatcaccagttgctgcaccaagggacccaactgatcccggccgacttcatcgtgccgatcgtcagcttcaacccggtctccgaccaccatcagtggctgtacgccaactgcctgtcgcagagccaggcgctgatgctcggcaagaccctgccggaagccgaagcggaactgcgcgacaagggcatgagcgaagaccaggtgcagaaactcgcaccgcacaaggtgatcccgggcaaccgtccgagcaacaccctggtggtcgagcgcatcagcccgcgtcgtctcggcgcactggtggcgatgtacgaacacaaagtcttcgtgcaaagcgtggtctggggcatcaacgccttcgaccagtggggcgtggagctgggcaaggaactgggcaagggcgtgtacaaccgtctggtcggcagcgaagaaaccgccgctgaagacgcgtccacccaaggcctgatcaactacttccgc

SEQ ID NO: 37413 - DNA, 1949 bp, Pseudomonas fluorescens
aacaagaataaggaaccgtcatgttcgatatcagcacgttccccaaagccgatgccgtccgccgggctgcacagttgagtcaggacgactaccagcgcctgtaccgcgaatccattgaacaccccagcaccttctgggccgaacaggccacccgcttcctcgactggagcacgccgtggcagaccgtccagcgctatgacctgaagaccggcgacgccgcctggtttgccggtggcaagctgaacgtcagctacaactgcatcgaccgccatctggaaacgcgcggcgatcagactgccatcctctgggaaggcgacgaccctgccgaatcgacgcaaatcacctacagcaaactccatcaccacgtctgccgcctggccaacgtgctgaaaagccgtggcgtaaaaaaaggcgaccgggtgtgcatctacatgccgatgatccccgaagcggcctacgccatgctcgcctgcgcacggatcggcgcgattcactcggtagtgtttggcggtttctccccggactcattgcgcgaccgcattctcgacgccgactgccgcaccgtgatcaccgccgacgagggcgtgcgcggtggcaaattcgtgccgctgaaacagaacgtcgacaaagccctgcagagttgtccgaatgtcagcaccgtcgtggtggtcgagcgcacccagaacaaagtcgactgggtcgaaggccgcgacctctggtatcaccaggccgtgcgcgacgtcagcgacgaatgcccgccggaaccgatggacgcagaagacccgctgttcatcctctacacctccggcagcaccggcaaacccaaaggcgtgctgcacaccaccggcggttacctgctgcaagcggcgatgaccttcaagtacgtcctcgactaccgcgatggcgaagtgttctggtgcaccgccgacgtcggctgggttaccggccacagctatatcgtctacggcccgctggccaacggcgccaccacactgatcttcgaaggcgtgccgagctacccgagcacttcgcggttctggcaggtgatcgacaaacacaaggtcaacatcttctacaccgcccccaccgccctgcgcgcattgatgcgtgaaggcgccgggcccttgcaggaaacgtcgcgacaaagcctcaaattgctcggcagtgtcggtgagccgatcaacccggaagcgtgggaatggtatttcaacgtcgtaggcgaacagcgctgcccgattgtcgatacgtggtggcagaccgaaaccggcggcatcatgctcagcccgttggtcagcgctcagcagatcaaaccaggctgcgccacccggccgatgttcggcgtgcaaccggtgctgctcgatgagcacggcaaggaaatcaagggcgccggcagtggcgtactggcgatcaagtcgagctggccggcgcagatccgcagcgtttacggcgatccgcagcgcatggtcgacacctacttcaagccctaccccggttactacttcaccggcgacggtgcccgtcgtgacgaggacggcgattactggatcaccgggcgcatcgatgacgtgatcaatgtctccggccatcgcatcggcaccgccgaggtggaaagtgcgttggtgctgcacgacagcattgcagaggccgccgtggtcggttatccccacgacgtcaaaggtcaggggatttatgcgttcgtcacaccgatgaatggcaccgaacccaacgatgagctgaagaaagaactgctggcccacgtcagcaaggaaatcggcagcttcgccaaaccggacctgatccagtgggccccggccctgccgaagacccgctcgggcaagatcatgcggcggatcctgcgcaagatcgcctgcaacgagctcgacagccttggcgacacctcgacgctggcggatccgagcgtggtgcagggtttgatcgataaacgcttg

SEQ ID NO: 37414 - DNA, 3486 bp, Pseudomonas fluorescens
ttgcggctcaagtgcatcaagctggcggggttcaaatccttcgtcgatccgaccacggtgaacttccccagcaacatggcggcggtcgtcgggccgaacggttgcggcaagtcgaacatcatcgacgccgtgcgctgggtaatgggcgaaagctcggccaagaacctgcgcggcgagtcgatgaccgacgtcatcttcaacggctcgaccagtcgcaaaccggtgagccaggcgagcatcgagctggtgttcgacaactccgacggcacgctgctgggcgagtgggcggcgtatgcggaaatttcgatccgccgcaaagtgacccgcgacagccagacgacttattacctcaatggcgccaaatgccgtcgtcgcgacatcaccgacatcttcctcggcaccggcctcgggccgcgcagctactcgatcatcgagcaggggatgatctccaagctgatcgagtccaaacccgaagacctgcgtaatttcatcgaagaagccgccggcatctccaagtacaaggagcgccggcgcgagaccgaaaaccgcatccgccgcactcacgaaaatcttgcccgtctgaccgacctgcgtgaagagctcgagcgccagctcgaacgcttgcaccggcaggccgaggccgccaagaagtatcaggaatacaaggccgaagaacgccagctcaaggcgcaactgtcggccctgcgctggcaggatctgaacgatcaggtcagccagcgtgaatcgatcatcggcaaccaggaaatcagcttcgaagcgctggttgccgagcaacgtaacgccgacgccgccattgaacggctgcgcgacggtcaccatgacctgtccgagcgcttcaatctggtgcaggggcgcttctattcggtcggcggcgacatcgcccgggtcgagcagagcatccagcacggtcagcagcgcttgcgccaattgcaggacgatctgaaagaagccgagcgcgcacgcctcgaaaccgaatcgcacctgggccacgaccgcaccttgctgctgaccctcggcgaagagctcgatcaactgacccctgagcaggaaatcaccaacgccgccgccgaagacgccgccgctgcgctggaagattccgaaaccgtcatgcacggctggcaggagcagtgggacgccttcaacctgaccgccgccgaaccccgtcgtcaggccgaagtgcagcagtcgcgcatccagcagctggaaaccagcatggagcgtctggccgatcggcaaaagcgcctgagtgaagagcgggcgctgctgtcggccgatcccgaggatgcggcgatcatggaactcagcgagcagctcgccgagtccgaagccacccttgaagatttgcagaccagcgaagcagcccaggtcgaaaaacttgagcaactgcgccaggaattgcagcaggcgctgaccgcgcagcaacaggcgcagggcgatttgcagcgcctcaatggccgactcgcatccctcgaagccttgcagcaggctgcgctcgatccgggcaccggcactgccgaatggctgaaagaacacaacctcgccgaacgcccgcgcctggccgaaggcctgaaggtcgaggccggttgggagctggcggtggaaaccgtactcggcgccgacctgcaagcggtgctggtggatgatttcgacggcttcgatctgtccggttttgcccagggcgatctgcgtttgctcagccccggcaatgacggcgtgcgcgtggccggcagcctgttggacaaggtcgaggcacaggtggatttgtcgccttggctcgctcaggtcaaaccggtcgacagccttgaacaggcgctggccctgcgcggccaactggctgccgggcagagcctgatcagtcgtgacggttactgggttggccggcactttctgcgggtgcgccgcgccagcgaagccgaaagcggcatgctcgcgcgcggccaggaaatcgaatcgctgcatgccgaacgcgaagagcgcgaagccacggtcgaggccatggaagcccgtttgcaaaccctgcgcgcgcaacagcgtcagcaggaaaacggtcgcgaacatctacgtcgtttgctgcaagacgaagcccgtcagcaaggcgagttgaaagctcaactgtccgccggcaaggccaaggccgagcagttgaacctgcgtcgcacccgcctcgacgaagagctggtcgagctcgccgagcagcgcgaactggaacacgaaaacatcggcgaagcgcggatccagttgcaggaagctctcgacgccatggccctcgacaccgagcagcgcgaattgctgctggcccagcgcgacagcctgcgcgaacggctggatcgggtacgtcaggaagcccgtcagcacaaggatcacgcccatcaattggccgtgcgtcttggctcgctgcgggcccagcatgattcgactcgccaggcccttgagcgtctggaaatgcaggccgagcgcctcaccgaaaaacgtgaacagctcagcctgaatctggaggagggcgaggcgccgctggaagagctgcgcctcaagcttgaagaattgctcgacaagcgcatgagcgtcgacgacgaactcaagaccgcccagatcgccctcgaagatgccgatcgcgaactgcgcgacgcggaaaaacgccggactcaggccgaacagcaatcgcaattgatccgtggccagctcgaacagcaacgcatggaatggcaggccctgaccgtgcgccgcaaggccctgcaggatcaactgctggaagacggctacgatctgcacggggtgctcaacaccttgactgccgaggccagcgagagggctgccgaggaagagcttgaacgcattgccgcgcgcattcagcgcctgggcgcgatcaacctcgcggcgatcgacgaataccagcaacaatccgagcgtaaacgttatctggatgcccaggacgccgatctggtcgaagcactggagaccctggaaaacgtcatccgcaagatcgacaaggaaacccgtaaccgtttcaaagatacctttgatcagatcaatggcggtttacaggcacttttcccgaaagttttcggtggcgggcgggcgtatttggaactgacgggcgaagatctactcgatacaggggtgacgatcatggcgcaaccgcccgggaagaagaacagcaccatccatttgctctccggcggcgagaaagccctgacggcactggcactggtttttgcgatcttcaaattgaatccggcgccgttctgcatgctcgatgaggttgacgcaccactggatgacgctaacgttggacgctacgcacgattggtcaaagagatgtcgcagaccgtgcagttcatctatatcacccacaacaagatcgccatggaaatggctgaccagttgatgggcgtgacgatgcacgagccgggttgttcgcgactggtagccgtggatgtcgaggaggcgatggcgatggtggatgcc

SEQ ID NO: 37415 - DNA, 1011 bp, Pseudomonas fluorescens
atgtacaccctggcccgtcagctgttgttcaaactttccccggaaacctcccacgatctgtcgctggatctgatcggcgcgggcgggcgtttgggcctcaacggtttgctgtgcaaggccccggcgtcgctgccggtgaatgtcatgggcttgcaattcccaaatcctgtggggctggcggccggtctggacaagaacggcgcggccatcgacggcttcgcgcaactgggtttcggttttgtcgaaatcggcaccgtgactccgcgcccgcagccgggcaacccgaaaccacggattttccgtctgccggaagccgaggcgatcatcaatcgcatggggttcaacaacctcggtgtggataacctgctggcgcgggtggcggcggccaaatacaagggcgtgctggggatcaacatcggcaagaacttcgacaccccggtcgagcgcgctgtagacgactacctgatctgcctggacaaggtctacgcccacgccagttacgtcacggtcaacgtcagctcgccgaacactccgggcctgcgcagcctgcaattcggcgattcgctcaagcaattgctggcggacctggccacgcgccgcgccgaactggccctgcgccacggcaagcatgtaccgctggcgatcaagatcgcgccggacatgaccgacgaagaaaccgcgcaagtcgcccaggcgctgatcgaaaccgggatggacgcggtgatcgccaccaacaccaccctcagccgcgtgggcgtcgaaggcatggaacatggtgacgaggcgggcggtctgtccggcgcgccagtgcgtgaaaagagtacccataccgtgaaagtgctggcgtccgagctgggcggcaagctgccgatcatcgcggcgggcggtatcaccgaaggcaagcatgcggctgagaagatcgctgccggcgcgagcctggtgcagatctactccggcttcatctacaagggcccggcgctgattcgcgagtccgtggacgcgatcgccgcc

SEQ ID NO: 37416 - DNA, 2097 bp, Pseudomonas fluorescens
acgaccgcctcgacctgctgctattgcggggtcggctgcggcgtgctgatcgagcatgacggcgagcgcatcctcggcgtcagcggcgatccggcgcatccggccaacttcggcaaactgtgcagcaaaggctcgaccctgcacctgaccggcgatctggcggccagagcgttgtatccggaattgcgcttgggcaaaggcctggcgcgcagtcgttgcgactgggacaccgcgctggatcacgccaccaacgtgttcgccgacaccatcgccgagcacggcccggacagcgtggccttctacatctccgggcagttgctgaccgaggattactacgccttcaacaaactggcgcgggcgctggtcggcaccaacaacatcgacagcaattcgcggctgtgcatgtcttcggcggtggtcggctacaaacgcagcctcggcgccgacgcaccgccatgcagctatgaagacctggagttgagcgattgcgtggtgatcgtcggcagtaacatggcctatgcccatccggtactgtttcgccgtctcgaagaagccaaatcccgccgcccgcagatgaaagtcgtcgtcattgatccacggcgcaccgacacctgcgatctggcggacctgcatctggcgattctgccgggcaccgatgtcgcgctgttccatgggattttgcatctgctgttgtgggaagactggatcgaccgcgacttcatcaaggcccacaccgatggcctcgccgagctgaaaagcctggtgcgcgattacaccccggcgatggtttcgcagctgtgcgggatcagcgtcgagcagttgcagcaatgcgccgagtggatcggcaccgcgccgagttttctgtcgctgtggtgcatgggtctgaaccagtccaccgccggcagtgccaagaacagcgctctgatcaatctgcatctggccaccgggcaaatcggccggccgggtgcaggacctttctccctgaccggtcagccgaatgccatgggcgggcgcgaaaccggcagcctttccaatctgttgccaggccatcgtgaagtcgccaatccagagcatcgcgctgaagtggcggcgtattggggcgtggataagctgccggaaaacaccgggctcagcgccatcgaactgtttgaacaagtgcgcggcggcaagatcaaggcgttgtggattgcctgcaccaacccggcgcaatcgatgccggaccagaccgctgtgcgcgcagcgctggagacttgtccgttcgtggtgttgcaggaggcgtttcgcaccaccgaaaccgcggcgtttgccgatctactgttgccggcggccagttggggcgagaaggaaggttcggtgaccaactccgagcggcggatttcccatgtccgccaagccattgccgcaccgggtgaagcgcgtccggactgggcgattaccgttgatttcgcacaacgcctggagaaacgtctgcgcccgcaacagcccggtctctttgccttcgagcaaccggcgcagttgtttgacgagtacaaacaactgacccgggggcgcgatctggatttgtccgggatcagccatgggttgattgatgagctggggccacagcaatggcccttccccgctggcgctcgccaaggcacagcccggctgtatggcgacgggatctttcctacagcgaacgggcgcgcgcggttcgttgccgatccctatcgcgccgccaaggaacaacgcgacgcgcgctttcccctgaccctgatcaccggccgcctgcgtgatcaatggcacggtatgagccgcaccggcacggcggcgcagttgttcggccatgtcagcgaagccgtgttgagcctgcatccggacgaattgcgccgtcaccgcttgcagccgggggatctggtgaatctgaaaagtcgtcggggcgcggtgattgtggcggtcgccagcgatgacagcgtgcgtccgggccaggcgttcctgccgatgcactggggcgatcgtttcctcaagggcggcgtgaacagcctgaccctgcccgccttcgatcctttgtcgaaacagccggaactcaagcacagcggtgtacggctggaaccggtg

SEQ ID NO: 37417 - DNA, 381 bp, Pseudomonas fluorescens
atgagcgagttgcgttttactgaagatcacgaatggctgcgcgccgaagccgatggttctgtcaccgttggcatcaccgctttcgcgcagaacgccctgggcgacgtggtgttcgtgcaactgcctgaattgcaggcttacgagaaaggcgccgaagccgccaccgtggaatcggtaaaagccgccagcggcgtttacatgccactggacggtgaagtcctggccaccaacccggccctggaagacagccctgaactggtgaacgaagatccgctgggcgaaggctggttcttccgcttcaagccagccgacgcgaccgccgtcgccaagctgctggatcaggacgcctacgaccgcctgatcaaagcccaagccgaagcc

SEQ ID NO: 37418 - DNA, 1012 bp, Pseudomonas fluorescens
atggcgttcaacattcacaaccgtaacctgctcagcctggaacaccacaccccacgtgagctgcgctacctgctcgacctgtcgcgcgacctgaagcgcgccaagtacaccggcaccgagcagcaacacctgaagggcaacaacatcgccctgatcttcgaaaaaacctcgacccgcacccgctgcgcgttcgaagtcgccgcttatgaccagggcgccaacgtcacctacatcgacccgaactcctcgcagatcggccacaaggaaagcatgaaggacaccgcccgcgttctggggcgcatgtacgacgccatcgagtaccgtggcttcaagcaggaaatcgtcgaagagctggccaagttcgccggcgtaccggtgttcaacggcctgaccgatgaatatcacccgacccagatgattgccgacgtgctgaccatgcgtgagcacgccgacaagccgatccacgagatcagctacgcctacctgggcgacgcgcgcaacaatatgggcaactcgctgctgctgatcggcgccaaactcggcatggacgtgcgcatctgcgcgccgaaaggccctgtggccccacgatgatctggttgatcgctgcaagaaatacgcagaggaaagcggcgcccgcatcaccctgaccgaagacccgaaagcggcggtcaaaggcgtggacttcatccacaccgacgtctgggtatcgatgggcgagccggtggaagcctgggccgagcgtatccagcaactgctgccgtatcaggtcaacgccgagctgatgaaagccaccggcaacccgcgcaccaagttcatgcactgcctgccggcgttccacaacagcgataccaaggtcggcaaacagatcgccgaacaatatccgcacctgaaaaacggcatcgaagtgaccgacgacgtgttcgagtcgccggcctgcatcgccttcgagcaagcggaaaaccgcatgcacaccatcaaggcgattctggtgtcgaccctggctgatctgtaa

SEQ ID NO: 37419 - DNA, 1254 bp, Pseudomonas fluorescens
atgaccacggaaaaagctaagtacggcgtccattccgaagccggcaaactgcgcaaagtcatggtttgctccccaggtctggcccatcagcggctgaccccgaacaactgcgatgaactgctgttcgacgacgtgctgtgggtcgctcaggccaagcgcgaccacttcgacttcgtgaccaagatgcgtgagcgcggaatcgacgtgctggaaatgcacaacctgctgaccgacatcgtcggcaaccccgaagcgctggactggatcctcgagcgcaaggtcaccgccgactcggtgggcctgggcctgatcaacgaagtcaaatcctggctgaaaagcctggagccgcgacacatcgccgaattcctgattggcggcgtgtccgccgatgacctgccggacagcttcggtggcaagaccatccagatgttccgcgacttcctcggccactccagtttcattctgccgccgctgccgaacacccagttcacccgcgacaccacctgctggatctacggtggcgtgacgctgaacccgatgtactggccggcgcgtcgtcaggagaccttgctgaccaccgccatctacaaattccatccgcagttcaccaacgccgatttcgagatctggtacggcgacccggacaaggatcacggcagctcgaccctcgaaggcggcgacgtcatgccaatcggcaacggcgtggtgctgatcggtatgggcgagcgctcgtcgcgtcaggccatcggccaactggcgctgaacctgttcaagaacaaggccgtggaaaaagtcatcgtcgccggcctgccgaagtctcgcgccgcgatgcacctcgataccgtgttcagcttctgcgaccgcgacctcgtcacgatcttcccggaagtggtcaaccagatcgtcgccttcaccctgcgccctgacgaaagcaaacagggcggcatcgacatccgtcgcgaagaaggcacgttcctcgacgtcgtggccaaagccctcaacctgccgaaactgcgcgtcgtcgaaaccggcggcaacagcttcgccgccgaacgcgagcaatgggacgacggcaacaacgtggtggccgtggagccgggcgtggtcatcggctacgaccgcaacacttacaccaacaccctgctgcgcaaggccggggtcgaggtcatcaccatcagcgccggcgaactcggtcgcggccgtggcggcggccactgcatgacttgcccgatcatccgcgaccctatcgattac

SEQ ID NO: 37420 - DNA, 1425 bp, Pseudomonas fluorescens
atgtcgcaaccgacgcaaaaactgcgccttggcgcactgatcgccctggtggtgggttcgatgattggcggggggattttttccttgccgcaaaacatggcagcccgggccgatgccggcgccatcctgatcggctggggcatcacggcgatcggcatgctcaccctggcgttcgtgttccagactttggccaatcgcaagccggaactggactccggcgtgtatgcctacgccaaggccgggttcggcgattacatgggcttttcttccgcgtggggttactggatcagcgcctggctgggcaacgtcgggtatttcgtgttgctgttcagcaccctcggctacttctttccggtattcggccagggcaatacgccgattgcgattggctgcgcttcggtgttgctgtgggccgtgcactttctggtgatgcgcgggatcaaggaagccgcgctgatcaatcagttgaccaccgtggccaagatcattccgctgatcatgttcgtggtcatcgccgccgtggcgttcaaggctgacgtgtttacccgcgacatctggggccgcagcaacccgaatttcggcggtgtgatggatcaggtgcgcaacatgatgctggtcaccgtgttcgtgttcatcggtatcgaaggcgccagcgtttactcggcccgggcggagaagcgcaccgacgtgggccgtgccacggtgatcggtttcctcggtgtgctggcgctgctggtgctggtcaatgtgttgtcgctggggatcatgagccaaccggaactggcgaccttgcagaacccgtcgctggccgccgtgctggaacacatcgtcgggccctggggcgcgctgctgatcagcgtgggcctggccatttcattgctcggtgcgttgctgtcgtgggcgctgttgtgcgccgagatcctgttcgccactgccaaggacaacacgatgccggcgttcctgaaaaaggaaaacgccaaccatgtgccggtcaatgcgttgtggctgaccaacgtgatgatccagattttcctgctgatcacgctgttttccgccggtacttacaccagcctgatttacctcgcctcgtcgatgattctggtgccgtatctgtggtcggcagcctacgccgtgttactcagcggacggggtgagacctatgaacatgcctccgccgaacgtaccaaggatctgctgatcggcggtatcgcgctgtgctacgcggtgtggctgttgtatgccggcggggtgaaatacctgctgctgtcggcgctgttgtatgcgccgggcgtgatcctgttcgccaaggccaagcatgagcagggcgagccgttgttcaccacgctcgagaaggggattttcacctgcgtcatcgccggggccgggcttgcggcctacgggttgtacagcggcgtgttgtccctg

SEQ ID NO: 37421 - DNA, 1440 bp, Pseudomonas fluorescens
acggttgaaccgtgcaccttcgccttgttcggcgccttgggcgatctggccctgcgcaagctgtttcctgccctttatcaccttgatggcgccggcctgctgcacgaggacacgcgcattattgcactggcccgtgaggcgggcaccgagcagcagcacctggcgttcatcgccgccgagctgcgtcgttatgtgggcaaggagctggacgaggccgtggccgagcgctttctggcgcgcctgacctacctgcacgtcgacttcctcaaggctgaagattatgtggcgctggccgaactggccggcagcacgcaacgcatgattgcctacttcgccaccccggcggcggtgtacggagcgatctgcgagaacctggcgaacgtcggtctggcggaaaacacccgcgtggtactggaaaaaccgatcggctccgacctcgaatcctcgcgcaaggtcaacgacgccgtggcgcagttcttcccggagaaccgcacctaccgcatcgaccactacctcggcaaagaaaccgtccagaacctgatcgccctgcgtttcgccaacagcctgttcgaaacccagtggaaccagaactacatctcccacgtggaaatcaccgtggccgagaaggtcggtatcgaaggccgctggggttacttcgacaaggctggtcagctgcgggacatgatccagaaccacctgctgcaactgctctgcctgatcgccatggatccgccggccgacctgtccgccgacagcatccgcgacgagaaggtcaaggtgctcaaggccctggcgccgatcagtccggaaggtctgaccacgcaagtggtgcgcggccaatacatcgccgggcacagcgaaggcaagtccgtgccgggctacctcgaagagccgaattccaacgcccagagcgacaccgaaaccttcgtcgccctgcgtgccgacatccgcaactggcgttgggccggcgtgccgttctacctgcgcaccggcaagcgcatgccgcagaaactgtcgcagatcgtcatccacttcaaggagccgtcgcactatatcttcgcccccgagcagcgcctgcagatcagcaacaaactgatcatccgcctgcaaccggacgaaggtatttccttgcgcgtgatgaccaaggagcaaggtctggacaagggcatgcaactgcgcagcggcccgctgcaactgaatttttccgacacctggcgcagcgctcgaattcccgatgcctacgagcggttgttgctggaagtgatgaacggcaatcagaacctgtttgtccgtaaagatgaaatcgaagccgcgtggaaatggtgtgaccaactgatcgccgggtggaaaaaatccggtgacgcgcccaagccgtatgcggccgggtcgtgggggccgatgagctccattgcattgatcacgcgggacgggaggtcgtgg

SEQ ID NO: 37422 - DNA, 927 bp, Pseudomonas fluorescens
ttctggctggacgcgagtgaccgcagccgcctcttcgtcaaccattggctgccgaacgcgccgctgaaagcggtgattctgctggcccatggcatggccgaacacagcggtcgctatgcacggctggcagaggcgttctgcgctgaaggctacggtgtgtacgcacccgatcaacgcggccatggcaagacggccgatcatgggacgctcgggcacttcgctgacgacgacggctggtgcaaggtggttggggatctcgcgagtctcaaccagttcctcggccaacgtcattcgggcgtgccgatcgtgctgctcgggcacagcatgggcagttacattgcccaggcttatctgctgcatcacagcgccagcctgcacggcgcgattctcagcggttcgaatttccagccggttgcgctgtaccgcgcggcccggcagatcgcccggttcgaaaagctgcgccagggcgccaagggccgcagcgcgctgatcgagtggctgtcgttcggctcgttcaacaataaattcaaaccggcgcgcaccgcgtttgactggctcagtcgcgacccggccgaggtcgacaagtacgctaccgacccgctgtgtggctttcgctgcaccaatcagttgtggatcgacctgctcggcgggttgcagcaaatcagcaaagcgtccaatctcgcccagattgatccgggcctgccgctgctggtgattggcggcgaatgtgatccggtgagcgaaggcaagcgtctgactgatctggccaacgccttgcgcgcggccggcagccagaacctgcaactcaagatctacccacaggcgcggcacgaattgttcaacgagagcaaccgcgacgaagtgaccgccgatgtgatggcctggatcgaccatgccctgagccatcgccggccgcaccgcagcgaa

SEQ ID NO: 37423 - DNA, 1686 bp, Pseudomonas fluorescens
atgcaacctgatttctggaatgacaaacgcccggcgggcgtacccctggacatcgatgcgggtgagttcaagtcggtgatcgaggtgttcgagcgttcctgcaagaaattcgctgatcgcccggcgttcagcaacatgggcgtgaccctgacctacgccgagctggagcgccagagcgccgccttcgccggttatctgcaagcccacaccgacctggtgccgggggatcgcatcgcggtgcagatgcccaacgtcctgcattatccgattgccgtgttcggtgctctgcgcgccgggctgatcgtggtcaacaccaacccgctgtacaccgcgcgggagatgcgtcaccagttcaaggactccggtgcccgggcgctggtgtacctgaacatgttcggtcagaaggtccaggaagtgctggcggacaccgacattcagtacctgattgaagcgaagatgggcgacctgatgcccaccgccaagggctggctggtcaacactgtggtcagcaaagtgaagaaaatggtcccggcgtactcgctgccccaggcgatttccttcaagagcgcgttgcgcatgggccggggcctgggcatcaagccgctgaaggtcggcctggatgacatcgccgtgctgcaatacaccggcggcaccaccggcctggccaagggcgcaatgctgacccacggcaatctggtggcgaacatgcaacaggtgcgcgcctgtctcggccagttcggcagcgacggccagccgctgctgcgcgaagggcaggaggtaatgatcgcgccgctgccgctgtaccacatctatgccttcaccgcgaattgcatgtgcatgatggtgtcgggcaaccacaacgtattgatcaccaacccgcgtgacatcggcggcttcatcaaggagctgaagaactggaagttttcggcgctgctggggctcaacacgctgtttgtcgcgttgatggatcatccggacttcaagaccttggatttctccaccctcaagctcaccaactccggcggcaccgcgctggtcaaggccaccgccgagcgttgggagcagatcaccggttgccggatcaccgaaggctatgggctgactgaaacctcgccggtggcctgcaccaatccgtacggcgagctgtcgcggatcggaacggtcggcctgccggtgccgggcaccttgttgaaagtcatcaacgacgacggcgtcgagcagccgctgggcgagcgtggcgaactgtgcatcaagggcccgcagatcatgaagggctactggaacaagcccgaggccaccgccgaagtgctggatgccgagggctggttcaagtccggcgacattgcagtcattgacccggacgggttcgtgcgcatcgtcgaccgcaagaaagacatgatcattgtctccggtttcaacgtgtacccgaacgagatcgaagacgtggtgatggcccacccgaaagtcgccaactgcgcggtgatcggggtgccggacgagcgctcaggcgaggcagtgaagctgtttgtggtggcgcgggaaaccggcgtgagcctggaagaactgaaggcttactgcaaagagaatttcacggcgtacaaggtgccgaaacatatcgtgctgcgcgagtcgttgccgatgacgcctgtcgggaaaattctgcggcgggagttgcgcgatatcgca

SEQ ID NO: 37424 - DNA, 1686 bp, Pseudomonas fluorescens
atgatcgaagacttttggaaggataagtaccccgctggaattgctgccgacatcaatccagacgagtacccgaatattcaggcagtgttgaagcaatcctgccaacgcttcgccgacaaaccggcgttcagcaacctgggcaagaccctcacctacggtgaactgtacgaattgtccggtgcgtttgccgcttatctgcaacagcataccgatttgcagcccggtgatcgaatcgccgtgcaactgcccaacgtgttgcagtacccggttgccgtcttcggtgccatccgtgccgggctgatcgtggtcaacaccaacccgctgtacaccgcgcgggaaatggaacaccaattcaacgactccggtgccaaggcgctggtatgcctggcgaacatggcgcatctggccgaaaccgtggtgccgaaaaccggtgtcaaacacgtcatcgtcaccgaagtcgccgacctgctgccgccgatcaagcgtctgctgatcaacagcgtcatcaagtacgtgaagaagatggtgccagcctatcacctgccaaaagccgtcaagttcaacgacgtgctgagcaagggtcagggccagccggttgccgaagccaacccggacagcggcgacgtcgcggtgctgcaatacactggcggcaccaccggcgtggccaagggcgcgatgctcacccatcgcaacctcgtcgccaacatgctgcagtgcaaggcgctgatgggctccaacctcaatgaaggttgcgagatcctgatcacgccgctgccgctgtatcacatctatgcgttcacctttcattgcatggcgatgatgctgatcggcaaccacaacatcctgatcagcaacccgcgcgacctgccggcgatggtcaaggaactgtcgaagtggaagttcagcggcttcgtcggcctcaacaccctgttcgtggccctgtgcaacaacgaaggtttccgcaagctggacttctcggcgctgaaagtcaccttgtccggcggcatggccctgcaactggccgcagccgagcgctggaaagcggtcaccggttgcccgatctgcgaagggtacggcatgaccgaaaccagcccggtggccacggtcaacccgatccagaacatccagatcggcaccatcggcattccggtaccgtcgaccctgtgcaaagtcatcgacgatgccggtgtcgagcagccgctgggcgaaatcggcgagctgtgcgtcaagggcccgcaagtgatgaagggctactggcagcgtcaggaagccaccgatgaaatgctcgacagcgaaggctggttgaaaaccggtgacatcgcgttgatccagccggacggctacatgcgcattgtcgatcgcaagaaagacatgatcctggtctccggtttcaacgtgtacccgaacgagctggaagacgtgctggcggccctgcccggcgtgttgcagtgcgcggccatcggcgttccggacgaaaaatccggcgaggcgatcaaaatcttcatcgtcgccaaaccgggcgtcacgctgaccaaggagcaggtgatggagcacatgcgcgccaacgtcaccggctacaaggtgccgcgttcggtggaattccgcgatgcgctgccgaccaccaacgtcggcaagatcctgcgccgcgaacttcgcgacgaagagctgaagaagatcaaggcgaag

SEQ ID NO: 37425 - DNA, 1353 bp, Pseudomonas fluorescens
atttccgcccgcatcgaccgcctcccggcagtcgccacgatctggcggctggtggcgctgctgtcgatcggtggtttcttcgaactctacgatctgttccagaccgcctatatcagccccggcctgatccgcgatggcatcttcgccatcggcaatcagggcgtgttcggtttctccgatcaggccgcgttcgcctcggcgacgttcctcggactgtttctcggcgccagtctgctgagcccgatggcggatcgcttcgggcggcgggcgatcttcactttcgcgctggtctggtacaccgtcgccacagttttaatgggcgtacagagttcagcgctggggatcatctgcatgcgttttctggtgggtatcggcctcggcatcgaactggtgaccatcgacgcctacctctcggaactggtgcccaagcgcatgcgcagttcggcgtttgccttcgcgtttttcgtgcagttcctgtcggtgccggcggtggcgctgatgtcctggtggctggtgccgcaggcgccgttcggcatcagtggctggcgttgggtggtgttggcgagcgcggtgtttgcgctgttcatctggtggctgcgcaaacgtctgccggagtcgccgcgctggctggcgcagcatggccgcttcgatgaggcgaaccggattctcgacggcatcgaggcgcgttgtgagaaggatcaccgtcagccactggatgcgccggaagcagtagccgtcgatgtcgagggcaagggccgtttcgccgatatctggcagccaccgtaccggcgccgcgcgctgatgctgattgtcttccacatcttccaggcgatcggtttcttcggcttcggcaactggctgccagcgctgctttccggtcagggtgtcagcgtcacccacagtctgatgtacgcgttcatcatcaccctcgcctacccgctcgggccgttgctgttcgtcaaattcgccaaccgcttcgagaacaagtggcagatcgtcggctcggccctcggcgccatgactttcggcaccctgttcgcgttgcagaccagcgccgtcggcctgatcttctgcggtgtgatgatcaccttctgcaacgcctggctgagcttcagttaccactcctatcagagcgaactgttccccaccaacatccgcgctcgggccgtcgggttctgctattcgttcagtcgtttgtcgacggtgttcagcagcctgttgatcggtctgttcctcgaccacttcgggacaccgggcgtgttggcgttcatcgtcgccagcatgttgatcgtgatgctgaccatcggctgtttcggtcctcgcacccgaaacctggcgctggaaaacatcgcc

SEQ ID NO: 37426 - DNA, 2394 bp, Pseudomonas fluorescens
atgaagaccaccatcgaattgcctctcctgccattgcgtgatgtcgttgtgtatccgcacatggttatcccgctgttcgtggggcgcgagaaatccatcgaagccctcgaggctgcgatgacgggcgacaagcagatcctgctgctggcccagagaaacccggctgacgacgatcccggtgaagaagctctctatcgcgtaggtactatcgccactgttctgcagttgctgaagctgccggacggcaccgtcaaggttctggtcgagggcgagcagcgtggtgctgtcgagcgcttcagcgaagttgatggccactgccgtgctgaagtgtcgctgatcgacgaagtcgacgccgccgagcgcgaatccgaagtgttcgtgcgcagcctgctgtcgcagttcgaacaatatgtgcagctgggcaagaaagtcccggctgaagtcctgtcgtcgctcaacagcatcgacgagcctggccgcctggtagacaccatggccgcgcacatggcgctgaagatcgagcagaagcaggaaatcctcgaaatcatcgatttgtcggcccgggtcgagcacgttctggccttgctggacgccgagatcgacctgctgcaagtcgaaaaacgcattcgtggccgcgtcaaaaagcaaatggagcgcagtcagcgcgagtactacctgaacgagcagatgaaggccattcagaaagaactcggcgacagcgacgaaggccacaacgaaatcgaagacctgaaaaagcgcatcgacgctgccggtctgccgaaagatgccctggccaaggccactgccgagctgaacaagctcaagcaaatgtcgccgatgtccgccgaagccaccgtggtgcgctcgtacatcgactggctggttcaagtgccgtggaaggctcagagcaaggtacgtctggacctggcccgtgccgaagacattctcgacgccgatcactacggcctggaagaggtcaaggaacgcatccttgaatacctcgccgtgcagaaacgcgtgaaaaagatccgtggcccggtgttgtgcctggtcggtcctccaggcgtgggtaaaacctcgctggccgagtcgatcgcccatgccaccaaccgcaaattcgtgcgcatggccctcggtggcgtgcgtgatgaagcggaaatccgtggtcaccgtcggacttacatcggttcgatgccaggaagattgattcaaaagatgacaaaagtgggtgtgcgcaacccgctgttcctgctcgatgaaatcgacaaaatgggcagcgacatgcgtggcgacccggcgtcggcgttgctggaagtgctcgatcctgagcagaaccacaacttcaacgaccactatctggaagtcgattacgacctctcggatgtgatgttcctgtgcacctcgaactcgatgaacattccaccggcgctgctggaccggatggaagtcatccgtctgccgggctacaccgaagacgagaagatcaacatcgcggtcaagtacctgtcgccaaaacagattgcagccaatggcctgaagaagggcgagctggaattcgacgaagaagcgatccgcgacatcatccgttactacacccgcgaagccggtgtacgtggcctcgagcggcagattgccaaggtctgccgcaaggcggtcaaagagcacgcgctggaaaaacgtttctcggtaaaagtgacagctgatctgctggagcatttcctcggcgttcgcaagttccgctacggtctggccgagcaacaggatcagatcggtcaagtgaccggcctggcctggactcaggtgggcggcgaactgctgaccatcgaagccgccgtggtgccgggtaaaggtcaactgatcaagaccggttcgctgggtgacgtaatggtcgaatcgatcactgcggccctgaccgtggtgcgtagccgtgccaagagcctgggcattcccctggacttccacgagaagcgcgacacgcacatccacatgccggaaggtgctacgccgaaagacggcccgagcgccggtgtaggcatgtgtactgcgctggtgtcggctttgacggggattcctgtgcgtgccgatgttgccatgaccggcgagatcaccctgcgtggtcaggttcttgccattggcggtctgaaggaaaaactgctggccgctcaccgtggcggaatcaagactgtgattattccggaagagaacgtgcgcgatctgaaggagattcctgacaatatcaagcaggatctgcagatcaaaccggttaaatggattgacgaggtcctgcaaattgcgctgcaatacgcgccggagcccttgccggatgtggctccggagatagttgccaaggacgaaaaacgtgagtctgactctaaggaaagaattagcacgcat

SEQ ID NO: 37427 - DNA, 1470 bp, Pseudomonas fluorescens
cttgatcgtctaggtgtgaacccggccctgtaccagaacggcaaagtgccggtgcattcgcccatcgacggcagccgcatcggcgccgtgaactgggaaggcccggccgaagtcgagcagcacatcagtcgcgccgatcatgcgttcgaacaatggcgcaaggtgccggccccgcgtcgcggcgagctggtgcgtcagttcggcgaagtgctgcgtgaatacaagaccgaactcggcgaactggtgtcctgggaagcgggcaagatcacccaggaaggccttggtgaagtgcaggagatgatcgacatttgcgatttcgccgtcggtctgtctcgccagctgtacggtttgaccatcgcctccgagcgtccgggccaccacatgcgtgaaacctggcacccgctgggcgtggtcggcgtgatcagtgcgttcaacttcccggtcgcggtgtgggcgtggaacaccacgctggcgctggtctgcggcaacccggtggtgtggaagccgtcggagaaaaccccgctgaccgcgctggcctgtcaggcgctgttcgaacgcgtactgaaaaatttcagcgatgccccggcgcacctgagccaggtgatcatcggcggtcgcgatgccggcgaagcgctggtggatgacccgcgtgtcgcgctgatcagtgccaccggcagcacccgcatgggccgcgaagtggcgccgaaagttgccgcacgcttcgctcgcagcatcctcgaactgggcggcaacaacgcgatgatcctcggcccgagcgccgatctggacatggccgtgcgcgccattctgttcagcgccgtcggcactgccggccagcgttgcaccacgttgcggcgcctgatcgcccatgaatcggtgaaagaagaaatcgttacccgcctcaaagctgcgtactccaaggtccgtattggccatccgctggaaggcaatctgatcggcccgctgatcgacaagcacagcttcgaaaacatgcaggacgcgctggagcaggccttgagcgagggcggtcgggtgttcggcggcaagcgccaactggaagatcaattccctaacgcctactacgtgtcgccggccatcgttgaaatgccggagcagagcgacgtggtgtgcagcgagaccttcgcaccgatcctgtacgtggtcggctacagcgatttcgaagaggcgctgcgcctgaacaacgccgtgccgcagggcctgtcgtcgtgcatcttcaccaccgatgtgcgcgaggccgagaaattcatgtcggcggtcggcagcgactgcggcatcgccaacgtcaacatcggcccgagcggtgcggaaattggcggcgcgttcggtggcgagaaagaaaccggtggcggtcgtgagtcgggctcggatgcatggcgcgcgtatatgcgtcggcagaccaataccgtgaactactcgctggaattgccgctggcgcagggcattacgttc

SEQ ID NO: 37428 - DNA, 1344 bp, Pseudomonas fluorescens
atgagccaaccctggagccctgacagctggcgcgccctgccgatccagcaacaaccccaataccccgacgccgcgcatctgcgccaggtcgagcagacgctggccagctatccgccgctggtatttgccggcgaagcgcgcgagctgcgtcgtcagtttgccgaagtcacccagggccgggcgttcctgctgcagggcggcgattgcgcggaaagcttcgccgagttctccgccgcgaagattcgcgacacttttaaagtattgctgcaaatggcgatcgtcatgaccttcgccgccggctgcccggtggtgaaagtcgggcgcatggccggtcagttcgccaagccccgctcggccaacgacgagaccatcgacggcgtgaccctgccggcctaccggggcgacatcgtcaacggcatcggtttcgactcggccagccgcgtaccggatccggagcgtctgctgcagtcctatcaccagtccaccgccaccctcaacctgttgcgcgctttcgcccagggcggttttgccgacctgcatcaggtgcacaagtggaacctcgatttcatcgccaactcggcgctggcggagaagtacagccacctcgccgaccgcatcgatgaaaccctggcctttatgcgcgcctgcggcatggacagctcgccgcaactgcgcgagaccagtttcttcaccgcccacgaagcgctgctgctgaactacgaagaagccttcgtgcgccgcgacagcctgaccaacgattactacgattgctcggcgcacatgctgtggatcggcgaccgcacccgtcagctcgacggcgcccacgtcgaattcctgcgcggggtgaacaatccgatcggtgtcaaagtcggcccgagcatgaaccccgacgatctgatccgcctgatcgacgtgctcaacccggacaacgatccgggccgcctcaacctgatcgcgcgaatgggcgcgaacaaggtcggcgttcacctgccggcgctgatccgtgcggtgcaacgtgaaggcaagcaggtgctgtggagttccgacccgatgcatggcaacaccatcaaggccagcagcggctacaagactcgcgacttcgcgcagatccttggcgaggtgaagcagttcttccaggttcacgaggctgaaggcagctacgctggcggcatccacatcgagatgaccgggcagaacgtcaccgagtgcatcggtggcgcgcggccgatcactgaagatggcttgtcggatcgctatcacactcactgcgacccacggatgaatgccgatcagtcgctggaactggcgttcttgattgccgagacgttgaaacaggtcaaacgc

SEQ ID NO: 37429 - DNA, 1708 bp, Pseudomonas fluorescens
atgggtctttgcggatgcacttagaggcagacccatgacccaggaaatcggcggcttcgccgctcttgaacttcatcccaatattgtcgctgcagtagtcgctaccggctatgaagagccttcggccattcagcagcagtcgatcccgatcatcctcgccggtcacgatatgattggtcaggcgcaaaccggtaccggtaaaaccgctgcctttgccctgcctatcctgcaccgcattgatccgtccaagcgcgagccgcaagctctgatcctggccccaactcgtgagttggcgctacaagttgcaaccgctttcgaaacctacgccaagcaaatgccgggcgtgactgttgtggctgtctacggcggcgcgccgatgggcccacaattgaaagcaatccgtaatggcgcacagatcgttgtcgccactccgggccgtctgtgcgaccacctgcgtcgcgacgaaaaagtgctgcagaccgtgaaccacctggttctcgacgaagcagacgaaatgctcaaactgggcttcatggacgacctcgaagtgatcttcaaggccatgccggaaacccgtcagaccgtattgttctcggcgaccctgccgcaatcgatccgtgccatcgccgagcgtcacctgcgcgatccaaagcacgtgaagatccagagcaagacccagaccgttaccgcgatcgaacaggctcacctgttggttcacgctgaccagaagacctctgccgttctcagcttgctggaagtggaagatttcgacgctctgatcatgttcgtgcgcaccaagcaagcgaccctggatctggccagcgccctcgacgccaaaggctacaaagccgccgcgctgaacggcgacatcgcccagaaccagcgtgagcgcgtgatcgactcgctcaaggatggccgtctggacatcgttgtggcgaccgacgttgccgcccgtggtctggacgttccgcgtatcacccacgtgttcaacgtggacatgccgtacgatccggaatcctacgtgcaccgtatcggccgtaccggccgtgccggtcgcgaaggccgcgcgctgctgctggtgacgccacgtgagcgccgcatgctgcaggtgatcgagcgtgtgaccggtcagaaagttgccgaagtgcgtctgcccgacgcccaggccgttcttgatgcccgcatcaagaaactgaccaacagcctgtcgccgctggtggctgacgccgaatcgactcacggtgatctgctggatcgcctgaccgctgatatcggttgcaccccacgcgccctggctgccgcactgctgcgcaaggccaccaatggtcaggcgctgaacctggcagcgatcgagaaggaacgtccactggtgccgaacagcgcgccacgtggcgaccgtcctgagcgttccggtgatcgtccggaccgtggtgaccgcgagcgtcgtgctccgatgccactgggcgaaggccgtgcccgttgccgtaccgcgctgggcgcgcgtgacggtatcgcggcgaaaaacctgctgggcgccatcctcaacgaaggtggtctggcacgtgaagccatcggtcgcatccaggtgcgtgacagcttcagcctcgtcgagctgccggaagatggtctggacaaactcctgaccaagctgaaggacactcgcgttgccggcaagcagctgaaactgcgtcgctaccgcgaagattga

SEQ ID NO: 37430 - DNA, 768 bp, Pseudomonas fluorescens
atgcacccgtatttctccctgcaaggccgcaccgccctggtgaccggcggcacccgtggtatcggcaaaatgatcgccaaggcctatgtcgaggccggcgcccgcgtgtacgtctgctcccgtgacgcggaagcctgtcatcaaaccgctgaagaactcagtgctctgggcacttgtctgggcatcgcagcgaatctggcgacggaagaaggcgtgaaagagctggccgcgcgactgggcgaacagatcactcatctggacattctggtgaacaacgccggcacgacgtggggcgcgccgctggagagctacccggtcaagggctgggaaaaggtcatgcaactcaacgtgacgtcggtgttcagctgcatccagcagtttctgccgttgttgcgtaaatccgggtcggcggccaatccggcgcggatcatcaacatcggttcggtggcggggatttcttccttcggcgaacaggcctacgcctacgggccgagcaaggccgccctgcatcaactgtcacggattctcgcccgggaactggtgagccagcacatcaacgtcaacgtcatcgcaccggggcgcttcccgagcaagatgacccagcacatcggcagcgaccagcaggcgctggccgatgacaccgcgctgatcccgatgaaacgctggggccgcgaggaagagatggcggcgctggcgatcagcctggcgagtaccgccggggcgtacatgaccgggaatatcattccgctggatggcgggttcagtctt

SEQ ID NO: 37431 - DNA, 2673 bp, Pseudomonas fluorescens
atgatcaacgtagacctgcaacaactcatccaggcgctggacgccgaaacccgtcgcgatctggagcgttcggccgagcgctgcgtggcccgtggcggcagcaagattctggtcgaagacttgctgctcggcctgctggagcgcccgaacggtttgctctcgcgggcactgcaggatgccgacgttgatgccggcgaactgagcgccgccctgcaatcgcgggtcgagcacagcgcttcgcgcaacccggtgttcgctccggaactggtgcagtggctgcaagacgcgctgctggtggccaaccttgaactgggccagacctcggtcgaagacgcggcgcttatcctcgcgctgctgcgcaacccgatgcgctacgccggcagccgctaccagccgttgctggccaaactgaacatcgatcgcctgaaggaatttgcgctgtcgcaacagcctcaggcagcggccaacggtaagccggccgcccagggcgaatcgctgctggagcgcttcacccataacctgacccaacaggcccgcgacggcaaactcgacccggtgctgtgccgcgatggcgcgatccgccagatggtcgacatcctcgcccgtcgccgcaagaacaatccgatcgtggtcggtgaagccggtgtcggtaaaaccgccatcgtcgaaggcctggcctcgcgcatcgctgccggtgaagtgccgcaggtgctcaagggcgtcgagctgctgtcgctggacatgggcctgttgcaggccggcgccagcgtcaaaggtgaattcgaacgtcgtctgaaaggcgtgatcgacgaggtcaaagcctcgccgaagccgatcatcctgttcatcgacgaggcccacaccctgatcggcgcgggcggtaatgccggcggttccgatgcggccaacctgctgaagccggcactggcgcgcggcgaactgcgcaccatcgccgcgaccacctgggccgagtacaagaaatacttcgaaaaagacccggcgctggcccgtcgtttccagccggttcaactgcacgaaccgaccgtgagcgaagccgtcaccatcctgcgtggcctggctcaggtctacgaaaagagccacggcatctacctgcgtgacgacgcggtggtttccgcagccgagctgtctgctcgttacctggccggtcggcaactgccggacaaggccgtcgatgtgctcgacaccgcgtgcgcccgcgttcgcatcagcctcgctgctgccccggaaagcctggaacgcctgcgtggcgaactggctgaaggcggtcgtcagcgtcaggccctgcgccgcgatgccgaagccggtctgctgatcgaccacgaagcgctggaggcactggaagcgcgcctggacgaagccgaagccgaaatggtcgcactggaaacccagtggaccgagcagaaacaactggccgagcgcctgctggaactgcgccagcaactggccaaggcccgtgaagccgctgcggtcgagccggtggtgaccgttgaagaagacgccgaaggcaccgtgatcgaaacccacgccgccgaagttgacgaagctcttagcgtcgaagcgctggaagcacaactcaacgaaacccacagcgccctgaccgccgctcaggtcaaggagcgtctggtcagcttcgaagtctgcccgcgtctggtggccgaagtgatcagcgcctggaccggcgtgccgctggcgcaactggcccgcgagcacaacgccaaggtcgccagcttcgccaccgacctgcgcacccgcatccggggtcaggaacaagccgtgcacgccctggatcgctcgatgcgcgccaccgcagccggcctgaacaagcctgacgcaccggtcggcgtgttcctgctggtcggcccgagcggcgtcggcaagaccgaaaccgcactggcacttgccgacctgctgtacggcggcgaccgtttcatcaccaccatcaacatgtccgagttccaggagaagcacaccgtttcccgcctgatcggtgcaccgccaggttacgtcggttacggcgagggcggcatgctcaccgaggccgtgcgccagaagccgtactcggtggtgctgctcgatgaagtcgagaaggccgacccggacgtgctcaacctgttctaccaaatcttcgacaaaggcgtggccaacgacggcgaagggcgcgagatcgacttccgcaatacgttgattctgatgacctcgaacctgggcagcgacaagatcagcgacctctgcgaagacggcgcgcgtccgactgccgaagtgctggaagaaaccattcgcccggtgctcagcaaacacttcaaaccggcgctgctggcgcggatgaaagtggtgccgtactacccggtcggcggcccggtgctgcgcgagctgatcgagatcaagctcggtcgcttgggcgagcgtctgaaccgtcgccagctggatttcacctggtgccagaacctcgtcgatcacctgtccgagcgctgcacccaaagcgaaagcggtgcacgcctgatcgaccacttgctcgaccagcacgtgctgccgctggtggccgaccgcttgctcgacgccatggccaccggtgaaagcctcaagcgcgtgcatgcgacgctcgacggtgaagccagcgtgacctgcgagttcgcctgaggtgagtgtgatgtt

SEQ ID NO: 37432 - DNA, 741 bp, Pseudomonas fluorescens
atggatcatgtttttcagggcaagcttgccgtcatcaccggtgccagttcgggcataggcctggccgctaccgagcgtctgctcgatcaaggcgcgcgcgtattggccatgtcgcgaaagctcggcgcactggccgaactgcttgagcggtatccgcagcaactggtgtggcactccggcgatgtcgctcaagccgctgaccttgccgctttggccgagcaagctgcacgcatcggtccggtaagtttcgtggtgcccaacgccggtatcgcagaactggccgacgggctcgacagctcggcattcggtcgccaatgggcagtaaacggcgccggcgccctgaacaccttggccgccctgcgcccgcaccttgcagacaaggcgtcagtggtgttcatcggtacttttctggcccgaatcagtttcgcgggattggccgcctacatcgcgtcaaaagcggcgttgatcgcccatgcccgaacccttgcagtcgagctggcaccccacggtgtgcgcatcaattgcgtttcccccggcccgaccgcaacgccgatctggtcgacattgggcctgagtgacgaagcgctcggcgacgtggcccaaggcgtcaacaaacgactgctgggcggacaattcctagaacctgcggcagtggccgacgtcattctgttccagctgggcaatggcgcacgcggcgtcatcggtcaggactgggtagtcgacagcggatacaccttgagc

SEQ ID NO: 37433 - DNA, 1368 bp, Pseudomonas fluorescens
caatctctgaacaccacgctgctgatcatcggcggcggtcctggcggttacgtgacggccattcgtgccgggcaactgggcatttcgaccattctggtcgagggtgaatcgctgggcggcacctgcctgaacatcggctgcattccgtcgaaagcgctgatccacgtggccgagcagtttcaccagacgcaacatcacaaccagcattcggcactgggcatcagcgtttcggcgcctaccctcgacatcactaaaagcgtcgagtggaaggacggcatcgttgatcgcctgaccaccggcgtcgccgcgctgctgaagaagaacaaggttcaggtcatcaacggctgggccaaggtcatcgacggcaagaccgtggaagtcggcgacacccgcatccagtgtgaacatctggtgctggccaccggctcgaaaagcgtcaatctgccgatcctgccgattggcgggccgatcatatcgtccaccgaggcgttggcgccgaagtcggtgccgaaacgcctgatcgtggtcggcggtggttacatcggtctggaattgggcattgcctatcgcaagctcggcgccgaggtcagtgtggtcgaggcgcaggatcggatcctgccggcctacgacgccgaactgactcaaccggtgcacgacgcgctgaagcaactgggcgtgaagctctacctcaagcacagcgtgctgggtttcgacggtacgttgcaggtgcgcgatccgaacggtgacacgctgaatctggaaaccgatcaggtgctggtggccgtcggtcgcaaacccaatacccagggctggaaccttgaagcgctgaacctggacatgaacggctcggcgatcaagattgacagccgctgccagaccagcatgcgtaatgtctacgccatcggcgacctgagcggcgagccgatgctggcccaccgcgccatggcccagggcgaaatggtcgccgagctgatcagcggcaagacccgcgaattcaacccgaccgccatcgctgccgtgtgctttaccgacccggaactggtggtcgtcggcaagacgccggacgaggccaaggcggcgggacttgactgcatcgtgtcgaacttcccgttcgcggccaatggccgggcgatgacgctggaatcgaaaaccggcttcgtgcgggtggtcgcccgtcgagacaatcatgtgattgtcggctggcaggcggtcggtgtcggggtctcggagctgtcgactgcgttcgcgcaaagcctggaaatgggcgcgcgactggaagacatcggcggcaccatccatgcacacccgactctgggtgaagcggtgcaggaagcggcgttgcgtgcgcttgggcacgcgttgcacctg

SEQ ID NO: 37434 - DNA, 1269 bp, Pseudomonas fluorescens
atgggcacgcacgttatcaagatgccggacatcggagaaggcatcgcagaagtagaactgtcgcagtggcacgtcaaggttggcgacctggtcgttgaagatcaggtgctggcggacgtgatgaccgacaaggcgatggtcgacattccgtcgccggtccacggcaaggtgattgcactcggcggtcagccgggcgaagtgatggcggtcggcagtattctgatcagcatcgaggttgaaggcgccggcaatctgaaggagtccgacaaaccggcgcctgttgcggcgaaagaaacacccgtcgcgccaaaagttgaagctgtcgttgaaagcaaacccgccgcaccacgtacggctccggtttgccagggcccgatggttgctcgccaagccgatgagcgcccactggcctcgccggccgtgcgcaaacatgcgctggatctgggcattcaattgcgtctggtgcgcggctccggcccggccggccgcgtgctgcacgaagacctcgacgcctatctggcgcagggtcagtcgaatgcttcggcgccggtcgccgctgcgtacgcccagcgtaatgatgaagaacagattcaagtgatcggcatgcgccgcaagattgcccagcgcatgcaggacgccacccagcgtgcggcacacttcagttatgtcgaagaaattgacgtcaccgcgattgaagaactgcgcgcccatttgaacgaaaaacacggcgcgagccgtggcaagctgaccttactgccgttcctggtgcgcgcactggtcgtcgccctgcgcgatttcccgcagatgaacgcccgttacgacgacgaagcccaggtcatcacccgcctcggcgcggtgcacgtcggcgtcgccacccaaagcgacgtcggcctgatggtgccggtggtgcgtcacgccgaagcgcgcagcctgtgggacagcgcggcggaaatctcccgcctggccaacgccgcccgcaatggcaaggccagccgcgatgaactgtccggctcgaccatcaccctgaccagcctcggcgcccttggcggcatcgtcagtaccccggtgctgaacctgccggaagtggccatcgtcggcgtgaacaaaatcgtcgaacggccaatggtcgtcaaaggccaggtggtgatccgcaagatgatgaacctctccagctccttcgatcaccgcgtggtcgacgggatggacgcggcgctcttcatccaggccattcgtggtctgctcgaacaacccgcgaccctgtttgtggag

SEQ ID NO: 37435 - DNA, 1056 bp, Pseudomonas fluorescens
atgaacgatcacaacaacaatattcagttggaaaccgccatgaccacgaccaccatgaccatgatccaggccctgcgctcggccatggatgtgatgcttgagcgtgacgacaacgtggtggtgttcggacaggacgtcggctacttcggcggcgtgttccgttgcaccgaaggcttgcagaccaagtacggcacctcgcgggtgttcgatgcgccgatttccgagagcggtatcgtcggcgtcgcggtgggcatgggcgcttatggcttgcgtccggtggccgagattcagttcgccgactacgtgtacccggcgtccgaccagatcatttccgaggccgcccgtctgcgttatcgctcggccggcgagttcaccgccccgatgaccctgcgcatgccttgcggcggtggcatctacggcggccagacccacagccagagcatcgaggcgatgttcactcaggtctgcggtctgcgcaccgtcatgccgtccaacccgtatgacgccaaaggcctgctgatcgcctccatcgaaaacgatgacccggtgatcttcctcgagccaaaacgcctgtacaacggcccgttcgacggccaccacgaccgcccggtgaccccgtggtcgaaacacccgcaagcccaggtgccggacggttactacaccgtgccgctggacgttgccgcgattacccgtccgggcaaggacgtgaccgtgctgacctacggcactactgtgtacgtgtcgcaagtcgctgctgaagaaagcggcgttgacgctgaagtcatcgacctgcgcagcttgtggccgctggacctggaaaccatcgtcaaatccgtgaagaaaaccggccgttgcgtcgtggttcacgaagctacccgcacctgcggattcggcgccgaactggtgtcgctggtgcaagagcattgcttccatcacctggaagcgccgatcgaacgcgtcaccggttgggacaccccctacccgcacgcgcaggagtgggcgtatttccctgggccgtcccgagtgggcgcggcgctgaaacgggtcatggaggtc

SEQ ID NO: 37436 - DNA, 905 bp, Pseudomonas fluorescens
  unsure (1)..(905): unsure at all n locations
gaattgatcgtcgacgcccgcaacgcggtgggtgaaagcccggtgtgggtgccgcaggaaaatgcgctctactgggtcgatatccccaacggtggcctgcaacgctgggatgccgacactggccatgttcacgcctggaaggctcccgagatgctcgcctgcctcgcccgacacagccggggcggctgggtggccggtatggagagcgggttctttcaactgcgcccccacagcgatggcagccttgacagcgacctgctcgcgaccgtggaacacagccgccaggacatgcgcctgaacgacggccgctgcgaccgtcagggccggttctgggccggcagcatggtgctgaacatgggcctgaatctgcccgaaggccggctctatcgctacgccgccgggcaaacaggcgcgatcgaggcacagcttgatggcttcatcgtgcccaacggtctgggcttcagtccggacggcaaaaccatgtacctgtcggactcgcacccgaacgtgcaactgcatctgggccttcgattacgacatttgctcagtcgggcacacccctttccaaacccgacggggtggttccgttggngacatgtaaacccatttttacggccgtcccgacgcgctgccggntgcggggcaaattgcccgatagctgctactggatctgcgccaacgatgtcggcctgatccaccggttcaccccggaaggtcgccttgaccgctcgctgccggtaccggtgaaaaaacccaccatgtgcgccttcggtggcagccggatggacaccttgttcgtgacctcgatccgccccgccgacgaccaggacccgcattcgctggccggcggcgtgttcgccctcaaccccggcataaaaggcctgccggagccattgttcgacgac

SEQ ID NO: 37437 - DNA, 1302 bp, Pseudomonas fluorescens
gtgaaaccggtcaaagtaggcatctgtgggttagggaccgtcggtggcggaaccttcaacgtacttcagcgcaacgccgaggaaattgctcgtcgtgccgggcgtggaatcgaagtggcacaaattgccatgcgcacgccaaagcctcagttccagacgaccggtattgcgattaccaacgatgtcttcgaagtggccacgaaccctgagatcgacatcgtcatagagctgatgggcggctataccgttgcccgcgagctggtactcaaggccatcgagaatggcaagcatgtggtcaccgcgaacaaggctctgattgccgttcacggtaatgaaattttcgccaaggcacgcgagaaaggcgtgatcgtggcgttcgaagcggcggtagccggtggcattccagtgatcaaggcgatccgtgaaggcctgtccgccaaccgtatcaactgggtcgccgggatcatcaacggcaccggtaacttcatcctcaccgaaatgcgcgagaagggtcgcaccttcgaagacgtgctggccgaggcccaagcactgggttacgccgaagccgatccgaccttcgacgtcgaaggcatcgacgccgcgcacaagctgacgatcctggcctcgatcgcattcggtgttccgctgcagttcgacaaggcttacaccgaaggcatcaccaagctgaccaccgccgacgtgaattacgccgaagcgctgggctaccgcatcaagcacctgggcgtggcacgcagcaccgccgccggtatcgagctgcgcgtacacccgacgctgatcccggccgatcgtctgatcgccaacgtcaacggcgtgatgaacgcggtgatggtcaacggtgacgctgccggttcgaccctgttctacggcgccggcgccggcatggagccgaccgcttcgtcggtgatcgcggatctggtggacgtggttcgcgccatgacctccgacccggaaaaccgcgtgccgcacctggccttccagccggactcgctgtcggcccatccgatcctgccaatcgaagcctgtgaaagcgcctactacctgcgcattcaggccaaggaccatccgggcgtattggctcaggtggcaagcatcctctcggagcgcggcatcaacatcgagtcgatcatgcagaaggaagtcgaggaacacgacggcctggtgccgatgatcctgctgacccaccgcgtgctggagcagcacatcaacgacgcgatcgccgccctcgaagcgctggcgggcgtggtcggtccggttgtgcggatccgcgtcgagcacttgaac

SEQ ID NO: 37438 - DNA, 1422 bp, Pseudomonas fluorescens
atgcaaaccaaactcttgatcaacggccaactggtcaacggcgaaggtccggcgcagccggtgctcaacccggcgcgtggcgaagtgctggtggaaatcaacgaggccaccgaggcccaggtcgatgccgccgtgcgcgccgccgacagtgccttcgccgaatggtcgcagaccacgccgaaagaccgttcgctgttgctgctcaaactcgccgacgccatcgaagcccacggcgaagaactggcgaaactggaatcggacaactgcggcaaaccctacaacgccgcgctgaacgacgagatcccggcgattgccgacgtgtttcgtttcttcgccggcgccagccgttgcatgagcggttcggccggcggcgaatacctgcccggccacacctcaatgatccgccgcgacccggtgggcgtaatcgcctctatcgcgccgtggaactacccgctgatgatggtcgcctggaaaatcgccccggccctcgccgccggtaatacagtggtgctcaagccgtcggaacaaaccccgctgaccgcgttgcgtctggccgaactggcgtcggacattttcccggcgggtgtactcaatctggtgttcgggcgtggaccgagcgtgggcagtccgctggtgacccatccgaaagtgcgcatggtctcgctgaccggctccatcgccactggttcgaacatcatttccagcaccgccgacagcgtcaaacgcatgcacatggaactgggcggcaaggcgccggtaatcatcttcgacgacgccgacatcgacgcggcagtcgaaggcattcgtaccttcggtttctacaacgccggccaggactgcaccgccgcgtgccggatctacgcccagcaaggcatctacgacaagttcgtcgagaagctcggcgcagcggtcagcagcatcaagtacggcttgcaggatgatccgtcgaccgagctcgggccgctgatcaccgcccagcatcgcgaccgcgtggccgggtttgtcgaacgcgctgtggcgcaaccgcacattcgcttgatcactggcggcaaggcggtggacggcaacggtttcttcttcgaaccgacggtgctggccgacgcgcagcaggacgacgaaatcgtccgccgcgaagtgttcgggccggtggtgtcggtgaccaaattcaccgacgaagcccaggcgctggagtgggccaacgattcggactacggcctggcgtcctcggtgtggacggcggatgtaggacgcgcccatcgcttgtccgcacgcttgcagtacggctgcacctgggtgaatacgcacttcatgcttgtcagcgaaatgcctcatggcggtcagaaactgtccggctacggcaaggacatgtccatgtacgggctggaggactacaccacggttcggcatgtgatgttcaagcac

SEQ ID NO: 37439 - DNA, 1422 bp, Pseudomonas fluorescens
atgcataccgcgttgctgatcgacggcgaactggtcgccggccagggttttgtcgaaccgatcctcaacccggccaccggcgaagtcctgacccagatcgccgaagccagcaccgagcaagtcgaagccgccatcctcgccgcccaccgcgcttttgccgagtggtcgcgcaccaccccgcaacaacgttcgaacctgctgctggaaatcgccaacgccgtcgaaaagcacgctgaccacctcgcccgcctcgaagcactgaactgcggtaagccgctgcatctggcgcggcaggacgatttaaccgcgaccatcgatgtgttccgcttcttcgccggcgccgtgcgctgccagaccggccagctcagcggcgaatacgtgccgggttacaccagcatggtgcgccgcgatccgattggcgtcgtcgcctcgattgcgccgtggaactacccgatcatgatggccgcgtggaagatcgccccggccctcgccgccggcaatacgctggtgttcaagccttccgagcacacgccgctgtcgattctggcgctggctccggcgttggccgaaatcctgccgcgcggggtgatcaatatcgtctgcggtggcggcgaaggggttggcagtcacttggtcgggcatccgaaagtgcgcatggtgtcgctgaccggcgatatcgtcaccggccagaaaattctccaggccgccgccaaaaccctcaaacgcacgcacctcgaactcggcggcaaggccccggtgatcgtgtgcaacgatgccgatctcaaagccgtggtcgaaggcgtgcgcacttatggctattacaacgccgggcaggactgcacggcggcttgccggatttacgcccaggccgggattcacgacaaattggtcgccgagctcggtgcggcggtcagcagcctgcgcttcgccggcaaacgcgacgccgacaacgagatcggtccgctgatcagcacccgccagcgcgaccgcgtggccagcttcgtcgagcgcgccctcggccagccgcacatcgagcgggtgaccggcgcggcggtgcattccggcgccgggttcttctatcagccaaccctgctggccggttgcaaacagagcgatgaaatcgtccagcgcgaagtgttcggcccggtggtgaccgtgacccgcttcgacgaactggcgcaagcggtggactgggccaacgactcggaatacggcctcgcttcgtcggtctggacccagaacctggacaaggcgatgcaggtcgccgcacgcctgcagtacggctgcacctggatcaacagccatttcatgctggccagcgaaatgccccacggcgggttgaaacgctccggttacggcaaagacttatccagcgattcgctgcaggactacagcgtggtgcggcacatcatggcccgccac

SEQ ID NO: 37440 - DNA, 1028 bp, Pseudomonas fluorescens
ttgacttcaaaaatgcttgaggaggcgctgtcctcgttcgaggccgtgcaagcccaactgcaacagctcgacccgccaatgatcgagatcgccggacgcctgcgccgtcagccaccgcaagtggcgatgaccgttgcccgtggcagctccgaccatgccgcgagttacttcgcctacctgaccatgcagcaactcggcgtaccggtggcgtcgttgccgatgtcagtggtgaccatgcaacaggcgccgttgaaggtcagcggtcaggtcgcgttcgccttctcgcagtcgggccaaagcccggatctggtcaacagcctgcgcctgctgcgcaagcgcggcgccctgagcgtgtcgatggtcaacgccgccgattcgccgctggaagccgcctgtgaattcagcctgccgttgctggccggcaccgaaagcagcgtcgccgcgaccaagagtttcatcgccaccctcagcgccagcgcccgtctgatcgcgcactggaaagaggacgccgaattgctggaggcgcacaacgccctgcccgaaggcctgcgcgaagctgcgcaacaggactggagcccggccatcgacgccctgcgcgattgcgagcggttgatggtgatcggccgtggcgccggttttgccatcgcccaggaagccgcgctgaaattcaaggaaacctcggcgatccaggccgaagccttcagcagcgccgaagtccgtcacggcccgatggccctgatcgacgaacactaccccttgctggtgttcgccccgcgcggcgccgaacaggccggtctgctgagcctggcagccgagatgcgtcagcgcggtgcccgcgtgttgctggctgcgccggatgacgtgagcgaacgcgacctgaccctcagccgtgccgcacaccccggccctcgatccgatcctggcgatccagagtttctacgtgatggcggccggcctggccgtggcccgtggcatggaccacggatcagccgcgacacctgagcaaagtcacccgtacgcagcagacg

SEQ ID NO: 37441 - DNA, 2475 bp, Pseudomonas fluorescens
gccccgctcagcggcccggtgctcacgctcgccaaagtcccggacgcggtgttcgccagcggcgcgatgggcgacggcattgccattgatccgctgaacgacaccctgtattcgccctgcgccggggtggtgatccacgtcgcccgcaccggccatgcgctgaccgtgcgcgccgacaacggtgccgagctgttgctgcacctcggtctggacacggtggagttgcagggcgaaggcttctcgatgctggtcaaggaaggcgcgcgggtcagcaatggccagccgctgctgcgctatgacctggacaaggtcggccgccagtgcaaaagcctggtcagcctgctgatcctgaccaacagccaggatttccaggcgcgccccatcaccctgaaaacggtgaaggtcggcgaaccgctgctgcacatcgtcgctcgtcacagcgcagcggcgaatacagaagaactcggcggcccgcaagttcacggtcacgtaaaggtcgcccatcgcggcggtctgcatgcgcgcccggcggcgttgatccgccagaccgcgcaagggttcaagagccagtcgcagctgcatttcgccggcaaatcggcaccgtgcaacagcctcatcggtttgatgggcctggcgattggcgaacaggacgaagtgcaggtcagttgccagggtccggacgcacaggctgcgttgcaagccttgctcgtcgcgctggcaacagccctgccggaggatcatcacgccgctgcaccgcttgccgccactccacgcaatcgcccggccgaggccggcgtgttgcacggcgtgtgcgccgcaccgggtctggtcggcgggccgctgtttcgcctgaacgcgatcagcctgccagccgacagcggcaatcatcagcccgagcaacaactacagattctcgacacggcgctgaatcaggttcgcagcgaaatcgacggcaccctcgcccaggcgaaaaaacagcgcaatgccgacgaagaagccatcttcgctgcgcacctggccttgctggaagacccggccctgctcgacgccgcccggcaatcgattgaaaccggcacggcggcgactcacgcctggagccagtccatcgacgcgcaatgccaagtgctgcaaaacaccggcagcccgctgctggccgaacgcgccaacgatctgcgcgacctcaagcaacgggtgctgcgcgccctgctcggcgaagcctggcattacgacgtgccggccggcgccatcgtcgccgctcacgaactgacgccttcggatttgctgcaactgagcgcgcaaggcgtcgccggtttgtgcatggccgaaggtggcgcgacttcccacgtggcgattctggcccggggcaaaggcctgccgtgcatggtcgcactgggctcggttttgctggatcaaactcaaggtcaatcagtggttctcgatgccgacggcggtcgcctcgaactgacgccgaatgccgagcgtctggccgaagtccaacaagcacagatcgaccgccaacaacggcgcgacgcccagcaagcccaggcccatctgccagccgaaacccgcaacggcgtggccatcgaagtagtcgccaacgtcgcctccagccatgaagcggcggatgcatttgccaacggcgccgacggcgtcggcctgttgcgcaccgagttcctgttcgtcgatcgccacactgcgccggacgtcgaagaacaacgcgccgcctatcaagctgtgatcgatgccatgggcgacaagtcggtgatcatccgcaccatcgacgtcggcggcgacaaacaactcgactatctgccgctgcccgtggaagccaacccggtactcggcctgcgcggcattcgcctggcccaggcccgcccggaaatcctcgaccagcaactgcgcgcactgctgcaagtcagcccgttgcagcgctgccggatcctgctgccgatggtcaccgaagtcgacgaactgctgcacatccgccagcgggtcgatgcgctgtgtctggaactgggcatcaatcaacgtccggaaatcggcgtgatgatcgaagtcccggccgctgcattgcaggctgaacaactggccgagcacgccgacttcctgtccatcggcaccaacgacctgtcgcaatacaccctggccatggaccgcgatcacgccggcctcgccgcacgggtcgatgccttgcacccggcgctgctgcgcctgatcgccatgacctgcgaaggcgcggcggtgcataaacgctgggtcggcgtgtgcggcgccctcgcctcggacccgctggcgacgccggtgttgatcggcctgggcgtgagcgaactgtcggtgagcccggtacagatcggcgaaatcaaggaccgcgtgcgccagctgcacgaagccgaatgccaacgcctcgcccgggacctgctcaagctgagcagcgccgccgcggtgcgtcatgcctgtcatcaacattggcctctg

SEQ ID NO: 37442 - DNA, 1314 bp, Pseudomonas fluorescens
atgcgcatcagcatatttggtttgggttacgttggcgcagtatgtgccggttgcctgtctgctcggggccacgacgtggtgggcgtcgatgttgccaaagacaagatcgacatgatcaacgctggcaaatctcccattgttgaaccgggcctgggtgagttgctcgcacaaggtatccagaccggtcgtctgcgcggtacgaccaacttcgccgaagcgattcgcgacaccgacctgtcgatgatctgcgtcggtacgccgagcaagaagaacggcgacctggaactgaactacatcgaagcggtatgccgcgagatcggttttgtcctgcgtgaaaagtccacccgtcacaccatcgtcgtgcgcagcaccgtactgccgggcaccgtggcaaacgttgtcatcccgattctcgaagactgctccggcaagaaagccggcgtcgatttcggcgtggcggtcaacccagagttcctgcgtgaatccaccgcgatcgccgactacgacctgccaccgatgaccgtcatcggcgagttcgacaaggcgtcgggtgacgttctgcaatcgctgtacgaagaactcgacgcaccgatcatccgcaaggacatcgccgtcgccgagatgatcaaatacacctgcaacgtctggcacgccaccaaagtgaccttcgccaacgagatcggcaacatcgccaaagcagtgggcgtcgatggccgcgaagtgatggacgtggtctgccaggacaagaccctcaacctgtcccagtactacatgcgcccgggcttcgctttcggcggttcgtgcctgcccaaagacgtgcgcgccctgacctaccgtgccggctcgctggacgtggaagcgccgctgctcaactcgctgatgcgcagcaacgaatcgcaagtacagaacgccttcgacatcgttgaaagccacgacaaacgcaaagtcgccctgctcggcctgagcttcaaggccggcaccgacgacctgcgcgaaagtccgttggtggaactggccgagatgctgatcggcaagggttacgacctgagcatctacgacagcaacgtccagtacgcccgtgtccacggcgcgaacaaggactacatcgagtcgaagatcccgcacgtatcgtccctgctcaattcggacttcgattcggtgatcgacaactccgacgtgatcatcctcggcaaccgcgacgagaagttccgcgccctcgccgaagaagcgccgcagggcaagcaggtgatcgacctggtgggcttcatgtccaaggccaccagtgccggtagccgcaccgaagggatctgctgg

SEQ ID NO: 37443 - DNA, 1119 bp, Pseudomonas fluorescens
aagacccgcttccacgatttcaaactcgccccggaactgatgcacgccatccacgacctgggtttcccgtattgcacaccgatccaggcccaggtgctgggttataccctcgccggcaaagacgccatcggccgcgcacagaccggcaccggcaagaccgccgcgttcctgatctcgatcatcacccagctgctgcagaccccgccgccgaaagagcgctacatgggcgaaccacgggcgctgatcatcgcgccgacccgcgagctggtggtgcagatcgccaaggacgccgccgacctgaccaagtacaccggtctcaatgtcatgaccttcgtcggcgggatggacttcgacaagcagctcaagcacctcgaagcgcgccattgcgacatcctcgtcgcgaccccgggccgcctgcttgacttcaaccagcgcggtgacgtgcacctggacatggtcgaagtgatggtgctggacgaagccgaccgcatgctcgacatgggcttcatcccgcaggtccggcagatcattcgccagaccccgccgaaaagcgaacgccagactctgctgttctccgcgaccttcaccgatgacgtgatgaacctcgccaagcagtggaccaccgatcctgcgatcgtcgaaatcgaagtcaccaacgtggccaacgaaaacgtcgagcagcacatctacgcggtggccggtgccgacaaatacaaactgctgttcaacctggtcaacgacaacggctgggagcgggtcatcgtgttcgccaaccgcaaggacgaagtgcgccgcatcgaggaacgcctggtgcgtgacggcatcaacgccgcgcaactgtccggcgacgtgccgcagcacaagcggatcaagacgctggaaggcttccgcgaaggcaagatccgggtgctggtcgccaccgacgtggccggtcgcggtatccacatcgacggcatcagccacgtgatcaacttcactctgccggaagtcccggacgactacgtgcaccgcatcggccgtaccggtcgcgctggcgccgacggtgtgtcgatcagcttcgccggtgaggacgactcctatcagttgccgtccatcgaagaaaaactcggtcgcaagatc

SEQ ID NO: 37444 - DNA, 654 bp, Pseudomonas fluorescens
atgaccgagcccttgattcttcagcctgttaagcccgcagacgcctgcgtgatctggctgcacggcctcggcgccgaccgctacgacttcctgccggtggccgaagcgcttcaggaaagcctgctgagcacgcgtttcgtcctgccccaggcgccgacccgtccggtgacgataaatggcggatatgccatgccgagctggtacgacatcaaggcgatgagcccggcccgggcgatcgaccgcgatgagctggaagcgtctgccgatcgcatcatcgaattgatcgaagaacagcgaagcagcggaatagacgcctcgcggattttcctcgccggtttttcccagggcggcgccgtggtctatcacaccgcattcctgaagtggcaagggccattgggtggggtactggcactatcgacatacgcgccgaccttcagtgatgaactggagttgtccgccagccagcagcggattccggtgctggcgctgcacggccagttcgacaacgtggtgcagaactcgatgggacgcacggcttatgagtatctcaaggccaatggtgtcaccgtgacatggcaggaatacccaatggagcacgaagtgttacccgaagaaattcgcgacatcggcacatggttgagcgaacgcctgcgc

SEQ ID NO: 37445 - DNA, 2892 bp, Pseudomonas fluorescens
atgcaaaccgacacaactcgcgagaacccgcagggcaccttgccgcaggccgccgattcgaattcggatctggctgccaccgcgcctggtcaactgcgtgtgatcaagcgtaatggcactgtcgttccttacaccgatgacaagatcaccgtcgctatcaccaaagcgtttctcgcagttgagggcggcaccgctgccgcctcgtcgcgaatccacgacaccgttgcccgcctgaccgaacaggtcaccgcgaccttcaagcgtcgcatgccatcgggcggcaccatccacatcgaagaaatccaggaccaggtcgaactggccctgatgcgtgccggcgagcagaaagtggctcgcgactacgtgatctaccgcgatgcccgctccaaggaacgcgccacccgcaccaccgccgaagctccggtacaggcgcacccgtcgatccgcatcacccgcgccgacggcagcctcgcgccgctggacatgggccgcttgaacaccatcgtcaccgaagcctgcgaaggcctggccgaagtcgacggcgacctgatccagcgcgaaaccctgaagaacctgtacgacggcgtggccctgaacgacgtcaacaccgctctggtaatgaccgcccgtaccctggtcgagcgcgagcccaactactcgttcgtgaccgcccgcctgctgatggacaccctgcgcgccgaaggcctgggcttcctgggcgtggccgagagcgccactcaccacgaaatggccgacctgtacgccaaggccctgccggcctacgtggccaaaggtatcgagttcgaactgctgaaccctgtgctggcctccttcgacctggaaaaactgggcaaggcgatcaaccacgagcgcgaccagcaattcacctacctcggcctgcagaccctgtacgaccgttacttcatccacaaggatggcgtgcgtttcgaactgccgcagatcttcttcatgcgcgtggccatgggcctggccatcgaagagaagcagaaagaagaccgtgcgatcgagttctacaacctgctgtcctcgttcgactacatggcttcgaccccgaccctgttcaacgccggtaccctgcgtcctcaactgtcgagctgctacctgaccaccgtgccggatgacctgtcgggcatctaccacgcgatccacgacaacgccatgctgtcgaaattcgccggtggcctgggcaacgactggaccccggttcgtgcgctgggttcgtacatcaagggcaccaacggcaagtcgcaaggcgtggttccgttcctgaaagtagtgaacgacaccgccgtcgccgttaaccagggtggcaagcgcaaaggcgctgtgtgtgcctacctggaaacctggcacatggacatcgaagagttcatcgagctgcgcaagaacaccggtgatgaccgtcgtcgtacccacgacatgaacaccgccaactggattcctgacctgttcatgaagcgtgtcttcgatgacggcaagtggaccctgttctcgccatccgaagtaccggacctgcacgacctgaccggcaaggccttcgaagagcgctacgagtactacgaagccctgaccgaatacccgggcaagatcaagctgttcaagaccatccaggccaaagacctgtggcgcaagatgctgtccatgctgttcgaaaccggccacccatggctgactttcaaggatccgtgcaacctgcgcagcccgcagcagcacgtcggcgtggttcacagctcgaacctgtgcaccgagatcaccttgaacaccaacaaggacgagatcgcggtctgcaacctgggctcgatcaacctgccgaaccacatcgtcgacggcaagctggacaccgccaagctcaagcgcaccatcgacgtcgccgtgcgcatgctcgacaacgtgatcgacatcaactactactcggtaccgcaggcgaagaactccaacttccgtcaccgtccggtcggtctgggcatcatgggcttccaggacgcgctgtacctgcagcacatcccttacggttccgacgctgccgtcgagttcgccgacaagtcgatggaagcggtcagctactacgcgatccaggcgtcctgcgacctggccgacgagcgcggctcgtacgagacgttccagggttcgctgtggtccaaaggcgtactgccgctggattcgcaacagatcctgatcgaagcacgtggccagaagtacatcgacgtcgacctgaccgagtccctggactgggcaccggttcgcgcccgtgtacagaaaggcatccgtaactcgaacatcatggccatcgcaccgaccgcgaccatcgccaacatcaccggcgtctcgcagtcgatcgaaccgacctaccagaacctctacgtgaaatcgaacctgtcgggcgaattcaccgtgatcaacccgtacctggttcgcgacctgaaggctcgcggtctgtgggattcggtcatgatcaacgacctgaagtactacgacggttcggttcagcagatcgagcgcatcccgcaagaactcaaagagctctacgcgaccgcgttcgaagtggacaccaagtggatcgttgacgccgccagccgtcgtcagaagtggatcgaccaggcccagtcgctgaacctgtacatcgccggcgcatcgggcaagaaactggacgtgacctaccgcatggcctggtaccgtggtctgaaaaccacctactacctccgtgccctggccgcgaccagcaccgagaagtcgaccatcaacaccggcaagctgaacgctgtatccagcggcggcaaccacggcgacgactcggtcctggcagcccctgccggcccggctccagtaccgaaagcttgcgccatcgacgagccggattgcgaagcttgccaa

SEQ ID NO: 37446 - DNA, 1675 bp, Pseudomonas fluorescens
tccaagaccggccccgttacgccggtcaatttcctgcgcccgatcatccaggcggacctggactcgggtaagcacacgcagatcgtcacccgtttcccgccagagcccaacggctacctgcacatcggccacgccaagtcgatctgtgtgaacttcggcctggcccaggagttcggcggcgtcactcacctgcgtttcgacgacaccaacccggccaaggaagaccaggaatacatcgacgcgatcgaaagcgacgtcaaatggctgggcttcgaatggtccggcgaagtacgctacgcctcgcaatacttcgaccagctgcacgactgggccgtcgagctgatcaaggccggcaaggcctacgtcgacgacctgacgcctgagcaagccaaggaataccgcggcagcctgaccgagccgggcaagaacagcccgttccgcgaccggtcggtggaagagaacctggactggttcgcccgcatgcgcgccggcgagttcccggacggtgcccgcgtactgcgtgccaagatcgacatggcctcgccgaacatgaacctgcgcgacccgatcatgtaccgcatccgccacgctcatcaccaccagaccggtgacaagtggtgcatctacccgaactacgacttcacccacggtcagtcggacgccatcgaaggcatcacccactcgatctgcaccctggagttcgaaagccatcgtccgctgtacgagtggtttctcgacgcactgccagtgccggcgcgtccgcgtcagtacgagttcagccgcctgaacctcaactacaccatcaccagcaagcgcaagctcaagcaactggttgacgagaaacacgtcaacggctgggacgatccgcgcatgtcgacgctgtcgggcttccgccgccgtggctacaccccggcatcgatccgcaacttctgcgagatgatcggcaccaaccgttccgacggcgtggtcgacttcggcatgctcgagttcagcatccgtcaggacctggacgccaacgccccgcgcgccatgtgcgtgctgcgtccgttgaaagtcgtgatcaccaactacccggaagatcaggtcgagaacctcgaactgccgcgtcatccgcagaaagaagaactcggcgtgcgccagctgccgttcgcccgtgaaatctacatcgaccgcgatgacttcatggaagagccgccgaagggctacaagcgcctggagccgaacggcgaagtgcgtctgcgcggcagctacgtgatccgtgccgacgaagcgatcaaggacgccgacggcaacattgtcgagctgcgttgctcgtacgatccggacacctgggcaagaaccctgaaggccgcaaggtcaagggcgtgatccactgggtgccggccgctgccagcatcgagtgcgaagtgcgtctgtacgatcgcctgttccgttctccgaacccggagaaggccgaagacagcgcgagtttcctggacaacatcaaccctgggctcactgcaagtgctgaccggttgtcgtgccgagccttcgctgggcaatgcacagccggaagaccgtttccagttcgagcgcgaaggctacttcgtcgcggatatcaaggactcgaaaccaggtcagccggtattcaaccgtaccgtgacccttgcgcgattcgtggggccagtgatcaagt

SEQ ID NO: 37447 - DNA, 324 bp, Pseudomonas fluorescens
gacaccctgacccgcctcgctcaggtgctggaagagcgcaagggcgctgctgccgacagttcgtatgtggctagtctgtatcacaagggcttgaacaagattctggaaaaggtcggcgaagaatcggtcgaaacgatcatcgccgccaaggacgccgccgtcagcggcgactgcagcgacgtgatctacgagaccgccgacctgtggttccacagcatggtcatgcttgcccagctggggcagcatccgcaggcggtgctggatgaactggatcgccgtttcggcctgtccggacacgtcgagaaagcctcgcgcccgtccgcc

SEQ ID NO: 37448 - DNA, 1266 bp, Pseudomonas fluorescens
atgtctgatctgaaaactgccgctctcgaatatcatgccaatcctcgtccaggaaagctgagtgtcgagctcaccaaggccactgctaccgcccgcgacctgtcgctggcctacagccccggcgtagctgaaccagtgcgcgagatcgcccgcgatcctgaactggcctacaagtacaccggcaagggcaacctggttgcagtcatttccgatggcaccgcgattctgggcctgggtaacctcggcccactggcttccaagccagtcatggaaggtaaaggcgtgctgttcaagcgcttcgccggcatcgacgtcttcgacattgaagtcgactccgagagcccgcaagccttcatcgacaccgtaaaacgcatttccatcaccttcggtggcatcaacctggaagacatcaaggcacctgagtgctttgagatcgaacgcgctctgatcgagcagtgcgacattccggtcttccacgatgaccagcacggcaccgcgatcgtgaccgctgcgggcatgatcaacgccctggaaatcgcgggcaaaaccctggccgacgccaagatcgtctgcctgggcgctggcgccgccgccatctcctgcatgaaattgctggtgagcatgggcgccaaggtcgaaaacatcttcatggttgaccgtaccggcgtgatccacgctggccgtgacgacctgaaccagtacaaggctgtgttcgctcaccctaccgagaaacgcaccctggacgacgccatcgaaggtgctgacgtattcgtcggcctgtcgggtccaaacctgctgagcgccgagcaactcaagcgcatggcagccaacccgatcgtcttcgcctgctccaacccggatccggaaatctccccggaactggctcatgccacccgtaacgacgtgatcatggccaccggccgttcggactacccgaaccaggtcaacaacgtgctgggcttcccgttcatcttccgtggtgccctggacgttcgcgccaagcgcatcaacgaagaaatgaagatcgctgccgccaacgccctgcgcgaactggccaagctgccggtcccgcaggaagtctgcgacgcctacggcggtatctccctggaattcggccgtgagtacatcattccgaagccaatggacaaacgcctgatcaccgtgatctccgacgccgtggccaaggccgcgatcgagactggtgtggcgaccctgccgtatccgaagaactacccgctgaaaagcgtggatgacgtgttcaacggc

SEQ ID NO: 37449 - DNA, 510 bp, Pseudomonas fluorescens
aatttgattcttgtaggaccgatgggggctggaaaaagcaccatcggccgattactggccaaagagctgcgcctgccgttcaaggattccgacaaggaaattgaactgcgtacgggcgccaatatcccgtggatcttcgacaaggaaggcgagcccggctttcgtgaccgtgagcaagcgatgatcgccgagctgtgcgcgttcgacggcgtggtgctggcgaccggcggcggcgcggtgatgcgcgatgccaaccgcaaggccctgcacgagggcgggcgggtggtgtatctgcacgcctccgtcgagcagcaggtcggacgcacctctcgcgaccgcaaccggccgttgctgcgcaccgccaatccggagaaaactctgcgcgacctgctggcgatccgtgatccgctctatcgggaaatcgccgatctggtggtagaaaccgacgagcggccaccgcgcatggtcgtgctcgatattctcgaccgcctggcgcagcttccgccccgt

SEQ ID NO: 37450 - DNA, 1098 bp, Pseudomonas fluorescens
atgcagacactcaaggtcgacctaggcgaacgcagctacccgattcacattggcgagggactgctggaccagccagagttgctggccccgcatatccatgggcggcaagtggcaatcatctccaacgagaccgttgcgccgctctatctcgagcgtctgacccgcagcctggcgcagttctcggtggtttccgtggtgctgcccgacggcgaagccttcaagaactgggaaaccctgcaactgatcttcgacggcctgctgaccgcccgtcatgatcgccgcaccacagtgatcgccctcggtggcggtgtgatcggcgacatggccggtttcgcggccgcctgctaccagcgcggcgtcgatttcatccagatccctaccacgctgctttcccaggtcgattcgtcggtgggcggcaagaccgggatcaaccatccgctgggcaagaacatggtcggcgcgttctatcagccgaacgtggtgctgatcgataccgcgtccctgaagaccctgccagcgcgtgagctctcggctggcctggcggaggtcatcaagtacggtctgatctgcgatgaaccgttcctgacctggcttgaagacaacgtcgacgccctgcgtgcgctggatcaaacggccctgacctatgccatcgagcgctcctgtgccgccaaggcggcggtggtcggcgccgacgagaaggaaaccggcgtgcgcgccacgctcaatctcggccacacctttggtcacgccatcgaaacccacatgggctatggtgtctggttgcatggtgaagcggtcgccgctggcaccgtgatggcgctggaaatgtccgcgcgcctgggctggatcagcgagcaggagcgtgatcgcggcatccgcctgttccagcgtgccggtctgccggtgatcccgccggaagagatgaccgaagccgattttcttgaacacatggcaattgacaaaaaagtgatcgacggtcgcttgcgcttggtgctgctgcgccggatgggcgaagcggtggtgaccgacgattatccgaaagaggttctacaggccacgctgggagcggattaccgcgctctggctcagcttaaaggt

SEQ ID NO: 37451 - DNA, 1675 bp, Pseudomonas fluorescens
caaagggagttcgttgcaatgatcgtcgggattgacctgggaaccaccaacagccttgttgccgtatggcgcggcgatgccactgagttggtgcctaacgcccctggggcagttcctgacacccagcgtggtgggcctggacgatcagggccggattctggtcgggcaagctgcccgcgaacgcctgcacactcatccgcgtctgaccgcgtcgctgttcaagcgtcatatgggcagtgcgacggaggtctacctcggggataaaaaattccgtcctgaagagctgtcggcgctggtactcaagagtctgaaagaagacgtcgagcgcacctacggccagaccgtcacggaagccgtgatcagcgttccggcgtatttcagcgacgcccagcgcaaggccacgcgcatcgccggtgagctggcgggcctgaaagtcgaaaagttgatcaacgaacccaccgccgccgcactcgcctacggactgcaccaacgggacaaggaaacttcgttcctggtgttcgacctgggcggcggtacgttcgacgtgtcgattctcgaactcttcgaaggcgtcatggaagtgcgcgccagcgccggtgacaacttcctcggcggcgaggatttcgacaacgtgctgctcgagcactttatcgatcagcatcgcaacgtatcggatttccccgagcgctcgaccatcctccagccgctgcgccgcgaagccgagcgtgtacgccgcgcactgggccaggacgccagcgccgaattcagattgcaggtcggcgaaaagcaatggacccagaccatcactcaggcgcaaatggcgacgctgtacatgccgttgctcgaacgcctgcgcgcgccgatcgaacgggccctgcgcgacgcacgcatccgcgtcagcgatctcgatgaaatcctgctggtcggcggcaccacccgcatgccgctggtgcgcaaactggctgccgggctgttcggccgtttcccgtcgatcagcctcgatccggatcaagtggtcgctcagggcgcggcgattcaggcagcgctaaaagcccgttcggccgcgctggaagaagtggtgctcaccgatgtctgctcctacaccctggggatcgagacctctacgcaggtcggtcgccagtatgaaagcggtcattacctgccgatcatcgagcgcaacagcatcgtcccggtcagccgggtgaaaaccgtgcagacccttcacgacaatcaggaacaggtcgtcgtgaaaatctttcagggcgaaagccgtctggtcaaagacaacgtggcgctcggccaactggacatcaaggtgcccaagcgcaaggccggcgaagtcgagctggatgtgcgcttcacctacgacaacaacggcctgctcgaagcccaggtcagcattcctctgaccggtcagcagcattcgctggtcatcgagaacaaccccggcgtgctgacgcccgaggaaatccagcagcgtctgcaagccctggcgcaactgaagatccatccgcgcgagcagcaagtgaacaccctgctcagtgcacggctggaacgtctgtatcaggaaagcctgggcgacctgcgcgatcagatcggctattgggccaagcaattccagcaggcgctggactcccaggacgagcggcagatccgtgaaacccgtaccgaactg

SEQ ID NO: 37452 - DNA, 939 bp, Pseudomonas fluorescens
gtgtccaagatgatggtctttacggggaacgctaaccccgatctggctcggcgtgtcgtacgtcagctgcatatccctctcggtgacatctctgtcggtaaattttccgacggcgaaattacagccgagatcaatgaaaacgttcgtggtaaagacgtcttcattattcagccgacttgcgctccgaccaacgataacctgatggaactggtagtgatggctgatgccttccgccgctcctcggctactcgtatcactgctgttattccttattttggttatgcccgtcaggatcgccgtccgcgttccgcacgtgtggctatcagcgcgaaagtcgttgctgacatgctcaccgtagtcggcatcgaccgtgttctcacggtggatctgcatgctgaccagattcagggtttcttcgatattccggtagataacatctacggctccccggttctggtggatgacattgaagatcagcgcttcgagaacctgatgatcgtgtccccggacattggtggcgtcgtgcgtgcacgtgccgttgccaaatccctgggtgtggatctcgggatcatcgacaaacgccgtgagaaagccaatcactctgaagtgatgcatatcatcggcgatgtcgaagggcgtacctgcattctggtcgatgacatggtcgataccgccggcactctgtgccacgcggccaaggccctgaaagagcatggcgcagccaaggtctttgcctactgcacacaccctgtgctgtcgggtcgggccatcgagaatatcgaaaattccgtgctggacgagctggtggtcactaacaccatcccgctgtccgctgcagcacaagcctgtgcacgtatccgtcaactggatatcgcaccggttgttgccgaagcggttcgccgcatcagcaatgaagaatcgatcagcgcgatgttccgt

SEQ ID NO: 37453 - DNA, 837 bp, Pseudomonas fluorescens
cgcctcactttgccttcaccggccaaactcaacctgatgttgcacattctcggtcgccgtgaagacggttatcacgaattgcagacgctttttcagttcctcgactacggcgacgaaatcaccttcgccgtccgtgacgacggcgtgattcgcctgcacaccgaattcgacggagtgccccacgacagcaacctgatcgtgcgcgcggcgaaaaaactgcaggaacaatccgcctgctcgctcggcatcgacatctggatcgacaagatcctgccgatgggcggcggcatcgggggcggcagctcgaatgcggccaccaccctgcttggcctcaatcatttgtggcgactgggttgggatgaagatcgcctggctgcactgggcctgacgctgggcgccgacgtgccggtgttcgtgcgtggtcatgcggcttttgccgaaggtgtcggtgagaaactgaccccggtcgagcccgccgaaccgtggtacgtcgtgctcgttccgcaagtctctgttagtacggcagaaattttttcagatcctttgttgacacgtaacacgccgcccattaaagtgcgccccgttcccgagggaaacagtcgaaatgactgcttgccggtggtctcgaggcgttatccagaagtacgtaacgcattgaatttgttaggtaattttaccgaagcaaaacttaccggaactggaagttgtgtgtttgggggcttcccaagcaaagctgaagctgataaagtctcggcccttctgacagagacccttacagggtttgtagcgaaaggaagcaacgtttcgatgttgcatcgcaagctgcaaagtctgctc

SEQ ID NO: 37454 - DNA, 1071 bp, Pseudomonas fluorescens
gccaccgcttttaatactttgccgctgtccgccgccatgctggctaacctcgactccctcggttatgcccagatgacgccgatccaggcgcagagcttgccggtgatcctcaaggggatggacctgatcgcccaggccaagaccggcagcggcaagactgccgcgttcggtatcggcctgctgaacccgatcaatccgcgctacttcggttgccaggcgctggtaatttgcccgactcgcgaactggctgaccaggtcgccaaggaaatccgccgtctggcccgtgccgaagacaacatcaaggtcctgaccctgtgcggcggcgtgtccttcggcccgcagatcggctcgctggagcacggcgcgcacatcatcgtcggcaccccgggccgcatccagcagcacctgcgcaagggttcgctggtcctcgacggcctcaacacgctgatcctcgacgaagccgaccgcatgctcgacatgggtttctacgacgccatcgaagacatcatcgagcagaccccggcccgtcgtcagaccctgctgttctcggcgacctacccggtgggcatcaagcaactggcgtcgaagttcatgcgcgatccgcaaacggtcaaggccgaagcgttccacgacgatacccagatcgagcagcgcttctacgagatttctccggaagagcgcatgagtgcggtgaccaaggttctgcaccacttccgtccggcctccaccgtggcgttctgcttcaccaagcagcaagtgcaggaaactgtcgatcacctgacctccaaaggcatttccgccgtcggcctgcacggcgatctggagcagcgtgaccgcgatcaggtgttggcgatgttcgccaaccgcagtacttcggtactggttgccaccgacgttgccgcccgtggtctggacattgatgcactggacatggtgatcaacgtcgaactggcccgcgactcggaaatccacattcaccgtgttggccgtaccggtcgtgccggcgagaaaggcatcgcggtcagcctggtggcgccgtccgaagcgcaccgcgcgcaagccatcgaacaa

SEQ ID NO: 37455 - DNA, 1680 bp, Pseudomonas fluorescens
atgtcccaagaattcgattacatcatcgtcggtgccggctctgccggtaacaccctggcgacccgtctgactgaagacgaaggcgtcaccgtcctgctgcttgaagccggcggcccggactatcgtttcgacttccgtacgcaaatgccggccgctctggcattcccgctgcaaggtcgtcgctacaactgggcgtacgaaaccgatccggagccacacatggacggtcgccggatggaatgcggtcgcggcaagggcctcggcggttcctcgctgatcaacggcatgtgctacatccgcggcaacgcaatggactacgacggctgggccaaactgccaggcctggaagactggtcctacctcgactgcctgccgtatttccgaaaagcggaaacccgcgacatcggcccgaacgactaccacggtggcgacggcccggtcagcgtgaccacgccgaaagcgggcaacaacccgctgttccacgccatggttgaagctggcgtgcaggccggttacccgcgcaccgaagacttgaacggctatcagcaggaaggctttggcccgatggaccgcaccgtgacgccgaatggccgtcgtgcttccaccgcccgtggttacctggacgtggccaagaagcgttcgaccctgaccatcgttactcacgccctgaccgacaaggttctgttcgaaggcaagcgtgccgttggagtgcgttacctggtcggcgccgctgaagagcgcgtcgaagcccgcgcccgcaaagaagtcatcgtctgctccggcgcgatcgcttcgccgcaactgctgcaacgctccggtgtcggcccggcgaaactgctggaaagcctcgacatcccagtggttcacgatctgccaggcgttggcgaaaacctgcaggatcaccttgagctgtacctgcaatacgcttgcacccaaccggtctcgctgtacccgtcgctgctctggtacaaccagccggccatcggtgccgagtggctgttcaacggcaccggcattggcgccagcaaccagttcgaagccggcggtttcatccgtacccgtccggaattcgagtggccgaacatccagtatcacttcctgccggtggcgattaactacaacggcagcaacggtgtgaaagagcacggtttccaggcgcacatgggttccatgcgttcgccgagccgcggtcgcgtccaggtcaaatccaaggatccgcgccagcacccgagcatcctgttcaactacatggccaccgagcaggactggcaggaatttcgcgacggcatccgcctgacccgtgaaatcatgcaacagcctgcactggacgccttccgtggccgcgaaatcagcccgggcatcgaagtgcaaaccgatgagcagctggacaagttcatccgcgagcacgccgaaaccgcgttccacccgtcctgctcgtgcaagatgggcaccgacgacatggccgtagtggatggcgaaggccgcgtgcatggcatgcagggtctgcgtgtggtcgatgcgtcgatcatgccgatcatcaccaccggcaacctgaacgcgccgacgatcatgatggccgagaaaatcgccgacaagatccgtggccgtcagccgctgccgcgcagcaaggcgccgtactacgtcgctggcgatgcgccagtgaaaggcaaggcgatgcgt

SEQ ID NO: 37456 - DNA, 1470 bp, Pseudomonas fluorescens
atggcccgtttcgaactgcaaaaactctacatcgatggcgcgtactccgacgccggcagcgatgccaccttcgaagccatcaacccggctaacggtgaagtcctcgcacacgtgcaacgtgcgaccaaggaagacgtcgagcgtgctgtggtcagcgccgaaaagggccagaaaatctgggccgcgatgaccgccatggagcgttcgcgcatcctgcgtcgcgccgtcgacatcctgcgcgagcgcaacgatgaactggctgccctggaaaccctggacaccggtaaagccttctccgaaaccaagtacgtcgacatcgtcaccggcgccgacgtgctggaatactacgcaggcctggtacccgccatcgaaggcgagcagatcccgctgcgtgacacttccttcgtttacacccgtcgcgagccgctgggcgttgtcgctggtatcggcgcgtggaactacccgatccagatcgccctgtggaaatccgcgccagccttggcggccggtaacgcgatgatcttcaagccaagcgaagtcacatcgctgaccaccctgaaactggctgagatctacaccgaagccggcgttccgaacggcgtgttcaacgtactgaccggcagcggccgtgaagtcggcacctggctgaccgagcacccgcgcatcgagaagatctctttcaccggcggcaccgacaccggcaagaaggtcatggccagcgcttcggcttcgtcgctcaaagacgtgaccatggaactgggcggcaagtccccgctgatcatctgcgacgacgccgatcttgatcgcgccgccgacaccgccatgatggccaacttctacagctccggtcaggtctgcaccaacggcactcgcgtgttcgtgccgagccacctgaaagccgctttcgaagccaagatcgtcgagcgcgttgcgcgcatccgcgttggcaacccggaagacgaaaacaccaacttcggcccgctggtcagcttcccgcacatggaaagcgtgctgggctacatcgccaagggtaaagaagaaggcgcccgcgttctgtgcggtggcgagcgtctgaccgacggcgaattcgccaaaggcgcgttcgtggctccaaccgtgttcaccgactgcaccgacgacatgactatcgtccgtgaagaaatcttcggcccggtgatggcgatcctgagctacgaaaccgaagaagaagtgatccgtcgcgccaacgacaccgacttcggcctggccgccggcatcgtcacccgcgacctgaaccgcgcgcaccgcgtgattcatcaactggaagccggtatctgctggatcaacgcctggggcgagtccgacgcaaaaatgccggttggcggctacaagcagtcgggcgtcggccgtgagaacggcatcagctcgctgaacaacttcactcgcatcaaatcggtgcaggtcgagctgggcgattacgtctcggtgttc

SEQ ID NO: 37457 - DNA, 975 bp, Pseudomonas fluorescens
atgagcccagccgaattacacgccgacagcatcgttatcgacggtctgatcattgccaaatggaaccgcgagctgttcgaagacatgcgcaagggcggtctgacggcggccaactgcaccgtgtcggtgtgggagggctttcaggccacggtcaacaacatcgccgccagccagaaactgattcgcgaaaacagcgacctggtgatccccgtccgcaccaccgccgacatccgcaaggccaaggagcagggcaagaccggcatcctcttcggcttccagaacgcccatgcgttcgaagaccagatcggttatgtcgaggtgttcaagcagctcggcgtcggcatcgtacagatgtgctacaacacccagaacctggtgggcaccggttgctacgaacgtgacggcggcctgtcgggcttcggtcgcgaaatcgtcgccgagatgaaccgtgtcggcgtcatgtgcgacctgtcccacgtcggctccaagacctccgaagaagtcatcctcgaatcgaaaaaaccggtctgctattcccactgcctgccgtcggggctgaaagagcacccgcgcaacaagtccgatgaagagctgaagttcatcgctgaccacggcggtttcgtcggcgtgaccatgttcgcgccgttcctggccaagggcatcgattcgaccatcgacgactacgccgaagccatcgaatacaccatgaacatcgtcggcgaagacgccatcggcatcggcaccgacttcacccagggtcacggccaggacttcttcgaatacctgacccacgacaagggctacgcccgccgtctgaccaacttcggcaagatcatcaacccgctgggcatccgcaccgtcggcgagttcccgaacctgaccgaaaccctgctcaagcgcggccactccgagcgcgtggtacgcaagatcatgggcgaaaactgggtgaacgtcctcaaagacgtttggggcgag

SEQ ID NO: 37458 - DNA, 1210 bp, Pseudomonas fluorescens
gaacaggctgcgttgatcgcccagttgcagagcgaaaccgctgcgttgcgcgaagagctcgacgaaaccaatcagggcgtgctggccctgtacgccgaactcgacactcaggccgaacaactgcgccaggcatccgacctgaaaagccgcttcctgtcgtacatgagtcacgagttccgcacgccgctgggctcgatcctgagcatcaacagcctgctcgccgacgaactcgacggccccctcagccccgagcaacacaagcaggtggcgtttgtcagcaccgccgcccgggaactcagcgacatggtcgacgacctgctcgatctggcgaagatcgaggccggacgcatcagcatttctgcggcgtggttcgacatgttcgacctgttcgccgcactgcgggggatgttccggccgattgtcgatgccacggccgtagacctgattttcgaagagccggtaggcctcccgcgtctttacaccgacgacaagaagctggcgcagatcctgcgcaacttcatttccaactcgctgaagttcaccacccgtggcgaggtccggatctcggcgcgtcttgagggtgagggcaaggtgcggttcgccgtcagcgacaccggcatcggtatcgctgcggagctgcacggcaccttgtttgaagacttttcccaggtcgactcaccgctgcaaaaacgcctgcgcggcaccgggctcggcctgtcgctgtgcaaacgcttcgctgaattgctcggtggtgaggttggtgtcgaaagtacgccgggcgtgggctcaagctttttcgtgatcattccgctggcacttgcccaggagaacgtcgatgaaacatgacatccgtctgttgatcgtcgatgacaacgtcgccactcgctatgccttgcgccgacgactggagcgccacggttacgaagtgctcgaggccggcaccggcggcgaggggctggccctgatcgccagtcagtcgctcgatgcgctgatcctcgacgtcaacctgccggacatgagcgggttcgacatcgtgcgtaaactgcgcgccgacccgggcaccgccctgcttccggtgatccacgtgtccgccgcgtcgatccagaccggcgacatcatcaccggcctcgatgccggggccgatgcctacctgattcatccggtcgatcccgacgtgctgctggcaacgttgcgcaccctgctgcgggtg

SEQ ID NO: 37459 - DNA, 1719 bp, Pseudomonas fluorescens
aacaccctcgaacaggaatacgacatcgtcgtgatcggcggcggcactgccggcccgatggccgcgatcaaggccaaggaaaagaacaaggaactgcgcgtgctgctggtcgacaaggccaacgtcaagcgcagcggcgcgatcagcatgggcatggacggcctgaacaacgcgatcatccccggccactcgacgcccgagcagtacaccaaggaaatcaccatcgccaacgacggcatcgtcaatcaggcagcggtctatgcctacgccacccacagtttcgaaaccatcgagcagctcgaccgctggggcgtgaagttcgagaaggacgaaaccggcgattacgcggtgaagaaagtccaccacatgggcgcctacgtgctgccgatgccggaagggcacgacatcaaaaaagtcctgtatcgccagttgaagcgcgcaagggtcaacatcaccaatcgcctggtctgcacccgtttgctgactgacgaggagggcgccgtcaacggtgtgatggggttcgactgccgcactgccgacttccatgtgatcaaggccaaggcagtgatcctcgcgtgtggcgctgccgggcgcctcggtctgccgtcctcgggttatctgatgggcacctacgaaaacccgaccaacgccggcgacggttacgcgatggcgtatcacgccggggccgaactggcgaacctcgagtgcttccagatcaacccgctgatcaaggattacaacggcccggcctgcgcctacgtcaccggcccgctcggtggctacaccgccaacaacaagggcgaacgcttcatcgagtgcgactactggagcgggcagatgatgtgggaattccaccaggaactggaaagcggcaacggtccggtgttcctcaagctcgatcacctggccgaggaaaccatccagaacatcgaggaaatcctccacagcaacgaacgtccgagtcgcggccagttccatgccaatcgctgcacggattaccgcacgcagatggtcgagatgcacatctcggaaatcggtttttgcagcggccactcggcgtccggcgtgtgggtcaacgagcgcgccgaaacctcggtgaaaggtttgtactcggccggtgacatggccgccgtgccgcacaactacatgcttggcgcgttcacctacggctggttcgcgggcaacaacgcggcggagtttgttgccgggcgcgagttctccgtgctggatgccgagcagatcgaaaaggaaaaggcccgggtctatgcaccgctggatcgcgaacacggtctgccgccagcccaggtggagtacaagctgcggcgcttcgtcaacgactacctgcaaccgccgaaagtgaccaagaaaatggaaatcggcctgcaacgcttcagcgacatcgagcgcgatctcaacgagatgaaggccaacaacgcccacgaactgatgcgcgccatggaaaccagcgtgattcgcgactgcgccgaaatggccgcccgcgcttcgctgttccgcgccgaaagtcgctggggcctgtaccactaccgcgtcgatcatccgcaacgggacgaccgcgaatggttctgccactgccacctgaagaagggcgaagacgggcgcatgaccagtttcaagaaagccgtcgagccttacatcatccccctcgatgccgaggaaatgcaggcctacgaccgcctccgggtcggcgcattcgccgct

SEQ ID NO: 37460 - DNA, 1431 bp, Pseudomonas fluorescens
tccgtccgtcgtaccaaaatcgtcgctacccttggcccggccagtaactcgccggaagttctcgaacagctgattctggctggcctggacgtcgcccgtctgaacttctcccacggcacccccgacgagcacaaggctcgcgcgaagctggtgcgtgacctcgcggccaagcacggtcgcttcgtcgccctgctgggtgacctgcaaggcccgaaaatccgtatcgccaaattcgccaacaagcgcatcgagctgaagatcggtgaccagttcaccttctccaccagccatccgctgaccgaaggcaaccagcaagtggtcggcatcgactacccggacctggtcaaggactgcggcgtgggcgacgagctcctgctcgatgacggccgcgtggtcatgcgcgttgaaaccgccaccgccaccgagctgaactgcgtcgtgaccatcggcggtccgctgtccgaccacaaaggcatcaaccgtcgcggtggcggcctgaccgcgccggccctgactgaaaaagacaaggccgacatcaagctcgccgctgaaatggaagtcgactacctcgccgtgtccttcccgcgtgacgccgccgacatgaactacgcccgtcaactgcgcgacgaagccggcggcaccgcctggctggtggcgaagatcgaacgcgccgaagccgtggccgacgacgaaaccctcgacggtctgatcaaggcttccgacgcggtgatggttgcccgtggtgacctcggtgtggaaatcggcgacgccgagctggtgggcatccagaagaaaatcattctgcacgcacgccgccacaacaaggcggtgatcgtggcgacccagatgatggagtcgatgatccagaacccgatgccgacccgcgccgaagtgtccgacgtggccaacgccgtgctcgactacaccgacgccgtgatgctgtctgccgagtccgctgccggcgcttacccgctggaagccgtgcaggcgatggcgcgcatctgtgtcggcgctgaaaagcacccgaccagtaagacctccagccaccgtatcggcaaggaattcgagcgctgcgacgaaagcatcgcgctggcgaccatgtacaccgccaaccacttcccgggcgtcaaggcgatcatcgcactgaccgaaagcggctacaccccgctgatcatgtcgcgtatccgctcctcggtgccgatctactgcttcaccccgcaccgagaagcccaggctcgcgcggcaatgttccgtggcgtgtacaccgtaccgttcgacccggcttcgctggcaccgaacgaagtcagccagaaagccatcgacgaactggtcaagcgcggcgtagtggagaaaggcgactgggtcatcctgaccaagggcgacagctaccacaccaccggcggcaccaacggcatgaagatcctgcacgtg

SEQ ID NO: 37461 - DNA, 762 bp, Pseudomonas fluorescens
atgcccgaagccatcctgctgcaccgcgaacgcggtttgctgaccctgcgcctcaaccgcccggacaagaaaaacgccctgacccgcgccatgtacagccaattggccgatgcgctcaagcaggcgaatcacgaccccgaaatcaacgccgtgctgatcaccggcagcgccgagtgcttcaccgccggcaacgacatcgccgacttcatccaacaaccgccgagcgacctcgacagcccggtgtttcacttcatgctcaacttgcttgaatgccgtaaaccggtgatcgccgccgtggccggggcggcggtggggattggcacgacgctgctgttgcattgcgatctggtgtacgtggcgcgggatgcacggttacgcatgccgttcgtcaatctagggttgtgccccgagtttggctccagcctgatcctgccgcgcttgctcgggcaggccaaagcctcggagttgctgctgctcggtgaaggcttcacaggtgagcaagccgcgcaatgggggatcgccaccgaggcgctgggcagcggcgaagccgcattgaccaaggcgcgggagatggcgctgcggtttgacgagttgccggccgaggcggtgcggatcagcaagcaattgatgcgcgcgccggatcgcgagttgattcgcaaagtgatcgaggaggagggcgcactgttcacccagcggctgcgctcgccggaggcgctggcggcgttgacggggttcatcaaacggcattgagatatccgccga

SEQ ID NO: 37462 - DNA, 1404 bp, Pseudomonas fluorescens
atgtcagtcgccaccagccttatcgaagagtcgtcggcccggatcgcctccgcgccggcggaaacgctgtatcagttcaatgaatcgccgttgctggcccgtcagagccggcaggaatccaatgcccgcagctacccgcgtcgtattcccctggcgctcaagcgcgccaagggcctgtacgtcgaggacgtcgagggccgcagcttcatcgattgcctggccggcgccggcaccctcgcgctggggcataaccatccggtagtgatcgaggccattcagcaggtactgtccgacgaattgccgctgcacaccctggacctgaccacaccggtgaaggatcaattcgttcaggacctgttcggcctgctgcctccggcattggccaaggaagcgaaaatccagttctgcggcccgactggcaccgacgcggtggaagccgcgctgaaactggtgcgcaccgccaccgggcgcagcactgtgctgtcgttctccggcggttaccacggcatgagccagggcgccttgagcctgatgggcagcctgggcccgaaaaagccgctgggtgcgctgctcagcagtggcgtgcaattcatgccgttcccgtacgactaccgttgcccgttcggcctcggtggcgcggcgggtgtgaaagctaatctgagctacctggaaaacctgctcaatgatccagaggctggcgtgcaattgccggcagcggtgatcgtcgaagcggtgcagggcgagggcggtgtgatcccggctgacatcgagtggctgcgcggtctgcgccgtatcaccgaaaaggccggcgtggcgctgatcatcgacgaaatccagagcggtttcgcccgcaccggcaagatgtttgccttcgagcacgccggcatcattccggatgtggtcgtgctgtccaaagccatcggcggcagcttgccgctggcggtggtggtgtatcgcgaatggctcgacagctggcagccgggcgcccacgccggtacgttccgtggcaaccagatggcgatggctgctggttccgcggtgatgcgttatctggtcgagcacaaggtctgcgaacacgctgccgccatgggcgagcgcctgagtgagcacctgcgcattctgcagcgcgatttcccgcaactgggcgacattcgcggtcgtggtctgatgctaggtgtcgaactggtcgatccaagcggcacgccggacgctcttggacatccgccggcgtttgcgcgtctggcgccgctggttcagcgtgaatgcctcaagcgcgggctgattctggagctgggcgggcgccatggtgcagtggtgcggttcctgccgccgctggtgatcaccgctgcggaaatcgaccgcgtcgccgagatcttcggccgtgcactcagcgcggcgaccgcc

SEQ ID NO: 37463 - DNA, 1977 bp, Pseudomonas fluorescens
cccagcaccctggtccaagccctccagcgccgcgcggccctgacgccggatcggctggccttgcgctttctcgccgaaaccgaggaacaggctgtggtgctcagttatcgcgaactcgatcaacgtgcgcgcactattgccgccgcattgcaggccgaggccggattcggtgatcgcgcggtgctgctgttcccgagcggcccggattacgtcgcggcgttttttggttgtctgtacgcgggcgtgatcgcggtgccggcttatccgccggaatcggccaagcgtcatcatcaggagcgcctgctgtcgatcattgccgacgccgagccgcgtctgctgctgaccagcgccgacctgcgcgacgccttgcagcaaatcgaaggcgcgccgccgctgttgtgcgtcgacactctcgacgctgagctggtcgaacgctgggtcgaaccgaccttgccgcaagaccacatcgcctttctgcaatacacctccggctccaccgcgctgcccaagggcgtgcaggtcagccacggcaacctggtggccaacgagctgctgattcgccacggtttcggcatcgacgtgaacccggatgacgtgatcgtcagctggctgccgctgtaccacgacatgggcctgatcggcggtctgctgcaaccaatcttcagtggcgtgccgtgcatcctgatgtcgccggcgtacttcctcggacggccgttgcgctggctcgaagcgatcagccaatacggcggtaccatcagtggcggcccggacttcgcttatcgtctgtgcagcgagcgggtcagcgaatcggcgctggaacgcctcgaactgagccgttggcgcgtggcctattccggctccgagccgatccgtctcgacaccctcgaacgcttcgccgagaaattcaccgcgtgcggtttcagtgaagacagcttcatggcgtcctacggtctggccgaagcgaccctgttcgtcgccggcacaccgcgcggcaccgggattcctgcactgcgcgtcgatgatcaggctctggcacagaaccgtgccgaagcgggcgagggcagtccgatcatgagctgcggcatcagtcagcccgatcatgcggtgctgatcgtcgagccgaacaccctcgaagaactggccgacaccgccgtgggtgaagtctgggccgccggcccgagcatcgccctcggctactggcgcaaccccgaggcgactgccaagaccttcgtccagcacgccggccagacctggctgcgcaccggtgacctgggcttcatgcgcgacggtgaactgttcatcaccggccgcctgaaagacatgctgatcgtgcgcggccacaacctctatccgcaggacctcgaaaagacggtcgagaacgaagtggaggtggtgcgcaagggccgcgttgcggcgtttgcggtcaatcagaatggcgaggagggcatcggcatcgcggcggaaatcagccgcagcgtgcagaaaatcctcccgcccgaagcattgatcaaatccattcgccaggccgtggccgaggcgtatcaggaagcaccgagcgtggttgtgctgctcaatccgggcgcattgccgaagacttccagcggcaagctgcaacgttcggcctgccgcaatcgcctggccgacggcagcctcgacagctacgcggtgttcccgtcgaccaccgctgaaaccagcgagtcgacggcgtccgtctccgaactggaaaccgtgatcggcaagatttgggccgagcaactgaacgtcaaacaggtcaatggcgacgatcatttcttcctgctcggcggcaactctatcgccgcgactcaggtgatcgccaaggtccgtgaggagttgggcctggagctgaacctgcgtctgctgttcgaagccccgaccctgtccgcgttcgccgccgccgtggcgcagcagcaacaggacggcggcagcgcccaaggcgaaatcaccgcactatcgcgc

SEQ ID NO: 37464 - DNA, 759 bp, Pseudomonas fluorescens
tcgattttcagggctgatctgttcagcggtcagaccgtcatcgtcaccgggggcggcagtggcatcgggcgttgcaccgcccatgaactggcggcgctgggggccaacgtggtgctggtcgggcgcaaaccggaaaagctgcaaaccgtcgccgccgaaattgccgaggacggcggtcgggcgcactggcaggcctgcgatatccgtgacgaagaagcggtgaaggcgctggtcagcgaactgatccgtgaacacgggccgatccacggactggtcaacaatgccggcgggcagtacccgtcgcccctggcctcgatcaatcagaaaggcttcgaaaccgtactgcgcaccaatctggtcggcggcttcctgatggcccgggaagtgttcaatcaatcgatgagcaaacacggcggcaacatcgtcaacatgctcgccgacatgtggggcggcatgcccggcatgggccactccggcgccgcacggtcgggcatggacaacttcaccaaaacagcggcattcgaatggggttatgccggggttcgggtgaatgcggtggcgccgggctggatcgcgtccagcggcatggacacctatgaaggtgcgttcaaagccgtgatcccgaccctgcgcgaacacgtgccgctcaagcgtatcggcaccgaatcagaggtcagcgcggcgatcgtgtttctgctcagcccggctgccgcgttcatcagcggcagcaccttgcgcatcgacggcgcggccagcctg

SEQ ID NO: 37465 - DNA, 1122 bp, Pseudomonas fluorescens
atcttcaccccggaacacgaagctctgcgccgcaccgtccgccagttcgtcgagcacgagatcaacccccatgtcgatgaatgggaaaaggccgggcgctttccgatccacgagattttccgcaaggccggcgacctcggtctgctggggatttccaagccggaaaaattcggcggcatgggtctggattacagctattcgatcgtcgcggccgaagagttcggcaccatccactgcggcggcattccgatgtcgatcggcgtgcagaccgacatgtgcactccggccctcgcccgcttcggttccgatgagttgcgcgaagagtttctgcgcccagccatcactggcgagcaggtcggctgcatcggtgtctcggaagtcggcgccggctccgatgtcgccgggctcaagaccaccgcgcgcaaggatggcgacgactatgtgatcaacggcagcaagatgtggatcaccaactcgccgagcgccgacttcatctgcctgctggccaacacctcggacgacaagccgcacatcaacaaatcgctgatcatggtgccgatgaacacgccgggtatcagcctcagttcgcacctggacaagctcggcatgcgcagctcggaaaccgcccaggtgtttttcgacaacgtgcgcgtgccccagcgcaatcgcatcggccacgaaggcgccgggttcatgatgcagatgctgcagttccaggaggaacgcctgttcggtgcggccaacatgatcaagggcctggaatactgcgtcgacagcaccatcgagtactgcaaggagcgcaagaccttcggcaacgcgctgatcgacaatcaggtgattcacttccgcctcgccgagttgcagaccgaaatcgaatgcctgcgggcgctggtctatcaggccaccgagcaatacgtcaaaggccaggacgtcacccgactggcgtcgatggccaagctcaaggccggacgtctcggtcgggaagtcagcgacagttgcctgcaatactggggcggcatgggcttcatgtgggacaacccggtggcccgcgcctaccgcgacgtgcggctggtatcgattggcggcggcgccgatgaaatcatgctggggatcatctgcaaa

SEQ ID NO: 37466 - DNA, 822 bp, Pseudomonas fluorescens
atgtcgctaaaaggcaaaaccttgttcatcactggcgccagccgtggcatcgggcgcgagattgcgctgcgggctgcacaggacggggccaatatcgtgatcgcggccaagagcgccgagccgcacgccaagttgcccggcaccatccacagcgtcgccgttgaagtcgaagcggccggcggcaaggccctggcgctgcaactggatgtgcgggatgaggaggcggtgcgacaggcgctggcccaggccaatcaacattttggcgggatcgatgcgctggtgaacaacgccggggcgatcaagttgaccggtgtgcagcacatcgaactcaagcgtttcgacctgatgcaccagatcaacacccgcgcggtgttgctgtgcagccaggcggccttgccctacctgaagaaatcctccgggcacatccttaacctgtcaccgccgctgaatctggccagtaagtggttcgcccagtacagcccctacaccgtgaccaagtacggcatgagcatgctgacggtcgggatgagcgaggagtttgccaactacggcatcagcgtcaattcgctgtggccgcagaccatgattgccacggcagccatcgagtttcagctgggcaatcgggagtcgttcaagcatgcgcgcacaccagcgatcatggcggatgcggcgcatgtgattctgagcagcagcgggcggcggattaccgggcggttgttgattgatgaagagatcttgcgcgaaagcggcgtgagcgaattcgaccactatcggtttgagccgaagagtgacgcgaagttgatgacggatctgtttatcgac

SEQ ID NO: 37467 - DNA, 1720 bp, Pseudomonas fluorescens
atcaaggaacactacgacgtgatcgtcatcggctccgggtatggcggcggcattgccgcgtcgcgcctgtccagggaccggtaaaagggtctgtctgctggaacgcggtcgggaaatccagcccggcgaataccccaacaccatgatcgccgcgaccgaggagttgcaggtacacgatccggacggccacatcggctcgcgcaccgggttgttcgacctgcacgtcaacgcccagcagaacgtggtggtcggctgcggcctcggcggcacgtcgctgatcaatgccaacgtctcgctggaaccgaccgccgacgtgttcaaggatccacgctggccactggcggtgcgcgaggatcacgacggcttactcaaggcgggttacgaaaaagcccgagagatgctcaagcccaatccctacccaagcaccgcgccgaacctgccgaagcttgatgccaacaaaaaatcggcagacttcctcaagcaaggcgcgcatttctacaagccgccgatcaacgtgaccttcgacaaactgcccaacaacctcaatcacgtcggcgtcgagcaactgccgtgcaaccactgtggcgactgcgtgtcgggctgtaacaacaaggccaagaacaccacgctgatgaactacctgccggacgccaccaatcacggcgcggagattttctgtcaggcccaggtgcggcatctggagcgcgacggcaatggctggatcgtgcactttcagtacctggacagcggtcgcgaaaaattcgacgcgccgacgctgtttgtgaaagccgacatcgtcgtggtctccgccggcaccctcggctccactgaaattctgctgcgctcgcgggacaaaggcctggtgatgtccggccagctcggcgagaacatgagcggcaacggcgacatcctcggcttcggccacaactgcgagcagaccatcaacggcatcggtttcggcgcgcattcggccaaggaactgcaaccggtcggcccgtgcatcacctcgatcatcgacatgcgcaccgagggtgaccgcagcagtcgcatggtcatcgaggaaggctcgatccccggcgcccttggccggccgatggtgccggcgatggccgggttcgccgagatgatcggcaagcccaccgacgacagcttcagcggcaaggtgaagtacaaggagcgcgaagccgaaagcttcctgcgcggcccgtaccacggcgcgctgcacaacatgcagacctacctgatcatgagccacgacagcggccagggacgcatggtcctcgacaacaaggatcaactgcgcatcgactggccgggcgtcggcgagcaggaaaacttcaagatcggcaacgaacgcttgtaccagagcaccaaggccctgggcgggatctgggtcgagaatccgatctggaccaagttgctcaagcacagcatcgtctcggtgcatccgctgggtggttgtgtgatgggtgaagatgccgcgcaaggcgtggtcaatcacaagggccaggtgttcagcggcgccagcggcaccgatgtctacgccaacctgtacgtgaccgacggcgcggtgatcccgacatcactggcggtcaatccgctgctgaccatctccgccgtgagcgagcgcaacatgggcctgctggcggccgatcgtggctggacgatcgactacacgctgccgtcggcgccgcgcaaacagaccgcgccgccgaccctt

SEQ ID NO: 37468 - DNA, 1290 bp, Pseudomonas fluorescens
atgaagaaggcaaagcttagcctcgcctggcagatcctcatcggtctggtattgggaattgcaatcggtgcgttgctcaaccatttcagtgccgagaaggcctggtggatcagcaatgtcctgcaaccggcaggcgatatctttatccgtctgatcaaaatgatcgtgatcccgatcgttatctcttccctgatcgtcggcatcgccggcgtgggcgacgccaagaagctcgggcgcatcggcctgaagaccatcatctacttcgaaatcgtcaccaccatcgccatcgttgtcggcctgctgctggccaacctgttccacccgggtgccggcatcgacatgagcaccctgggcactgtggatatctccaagtaccaggcgaccgccgccgaagtgcagcatgaacacgcgttcatcgagaccatcctcaacctgatcccgtcgaacatcttcgcggccatggcccgcggcgagatgctgccgatcatcttcttctccgtactgttcggtctcggtctgtcgagcctgcagtcggacctgcgcgagccgctggtaaagatgttccagggcgtctcggaaagcatgttcaaagtcacccacatgatcatgaactacgccccgatcggcgtattcgccctgatcgcggtgaccgtggccaacttcggtttcgcctcactgctgccgctggccaaactggtaatcctggtttacgtcgccatcgccttcttcgccttcgtgattctcggcctgatcgccaagatgttcggtttctcggtgatcaagctgatgcgcatcttcaaggatgagttggtgctggcttactccaccgcttcctcggaaaccgtgctgccacgggtgatcgagaagatggaagcctacggcgcaccgaaagccatctgcagtttcgtagtgccgaccggctactcgttcaacctcgacggctcgaccctgtaccagtccatcgcggcgattttcattgcccagctgtacggcatcgacctgtcgatcagccagcaactgctgctggtcctgaccctgatggttacctccaaaggcatcgccggcgtaccgggcgtgtccttcgtggtgctgctggccaccctgggcagcgtgggtattccgctggaaggcctggccttcatcgccggtgtcgaccgtgtgatggacatggcgcggaccgccctgaacgtgatcggcaacgccctcgccgtactggtcatcgcccgttgggaaggcatgtacgacgacgccaagggccagcgctactggaactcgctgccgcattggcgc

SEQ ID NO: 37469 - DNA, 1578 bp, Pseudomonas fluorescens
ccgcataacgagatccccactggtggctcggctcacgacaccttctgggacttcgtgtcgctggtgccggaatcggcacacatggtcatctgggccatgtccgaccgggctatcccgaaaagcctgcgcagcatgcagggcttcggtgtgcacaccttccggctgatcaatgccgagggcaaatcgcgcttcgtcaaattccactggcgccctaccgccggcacctgttctttggtgtgggacgaggcgcaaaaacttgcgggcaaagacaccgactaccatcggcgcgatctctgggaagccatcgaaatgggcgactacccggaatgggaactcggcgttcaggtcatcgaagaggaaaacgaacacgacttcgatttcgacattctcgacccgaccaagctgattcccgaggaaattgttcctatcacgccattgggcaagatgaccctcaaccgcaacccggacaacttcttcgccgaaaccgagcaggttgcgttttgccccggccatatcgtgccgggcatcgacttctccaatgacccactgctgcaaggccggctgttttcctacaccgacacgcagatcagccgactcggcgggccgaactttcatgagttgccgatcaatcgcccagtggcaccgttccacaacggccagcgcgatgcccagcaccgtacggtgatcgacaaggggcgcgcctcgtatgaacccaattccatcgatggcggctggccgaaagaaaccccaccggctgcgcaggacggcgggtttgaaagctatccggaacgcatcgacgccaacaagatccgccagcgcagcgagtcgttcagcgaccacttctcccaggcgcggttgttcttcaacagcatgagcgcgcacgagaaagagcacatcatcgccgcctacagtttcgaactcggcaaggttgagcgtgaattcatccgggcgcggcaagtgaacgagattctcgccaacatcgatctggagctggccaaacgcgtggcggccaacctgggtctgccagcgccaggcaaaggcaccgtcgacgtaccgaaaacatcgctggatcgctcaccatcgttgagtcaggccaacctgttgccggagaacatcaagacacgaaaagtcgcgatccttgcagccaatggtgtcgatggtgcggcaattgatgcgatgaagaaggcgctggcggcagaaggtgcgcacgccaaactgctcggcccgacctcggcgccggtgaagaccgccgatggcaaaagcctggcggtggatgcgtcgatggaaggtttgccttcggtggcgttcgatgcggtgttcgtgccgggtggcgcggcgtcggtcaaggcgttgagcggggatggcgtagcgttgcattacctgctggaggcgtacaaacacctgaaggcgattgcgctgcagggtgaggccaagcagttgctggatgtgctgaagctggaggcggatgccgggctactggagggcaaggatgttggcgcgctgaccaaaccattcttttctgcgatcgggcagcatcgggtatgggatagggaagccaaggccaaggcgattccggcc

SEQ ID NO: 37470 - DNA, 1305 bp, Pseudomonas fluorescens
atggacgtgagcgtatttggtacgggctatgttggcctgatacaagcagccgcacttgccgatgtcggacatcgcgtattgtgcgtcgatattgacccgaacaagattaaacaactgcaacaggcagtaccgcctattagcgaaccgggtctttcggcaactttggaagaaaacatcaaggccgggcgtttgttgttcagcacccaggccagcgatgcggtggaacatgccggactgatcttcatcgccgtgggcacgccggccgacgaagacggctccgccgacctcagccatgtgctcaacgtggcgcggcagatcgcaagctgcatggaggacgatcggacgctgatcatcaaatccacggtgccggtcggcacggcggatcaggtgctgcacaccgctgaagaagaactgcagcgtcgcggcaaaaacggtctggcggtgcgggtggtgtccaaccccgagtttctcaaggaaggcagcgccctcgccgactgcatgcgtccggacaggatcattgtcggcactctggaccctgaagcccgggagcagatgagcgagctgtacgcaccgttctgccgcaaccacgaaaaactgatgttcatggacaaccgcagcgccgagctgaccaagtacgcggccaacgcgatgctcgccacccgcatcagcttcatgaacgagctggccaacctcaccgaactgctcggcgccgacatcgaagcggtgcgcaaaggcatcggctccgatccgcgcatcggctatcacttcatctacccgggctgcggcttcggtggctcgtgctttcccaaggacctgcgcgccctgctgcacaccgctgaacacaacggcatgccgctgaaactgctgcgcagcgtcaccgacgtcaacgacgcgcaacggcacatcctgttcagcaaactcagggcgcaatttcctcaaggcctggccggcaagtccatcgcgatctggggcctggcgttcaagccgaataccgatgacatgcgtgaagccccgagtcgttacctgatggaagcgctgtgggccgaaggcgccagcgtgcaggcctacgatccggaagcgatgtccgagtgccggcgcatttacggttaccgcaacgacctgcacctgtgtgccacccgcgacgacaccctggaagatgccgatgcactagtgatctgcaccgagtggaaaaactttcgtgtggtggactttgaactgctcgccgagaagctgcgcgcgaaggtcatcgtcgacgggcgcaacctttacaacccggaacaagtggcggccgccggcctgcattac

SEQ ID NO: 37471 - DNA, 2406 bp, Pseudomonas fluorescens
gtggccgcattccgcgacgccgtcctgaccaaactcacctacgcggtgggcaaagacccggatcacgccttcgaccatgactggttcgaagccatcgccctggcggcgcgcgatcacatggtcgagcactggatggaccacacccggcagatttaccgcaaaggccagaagcgggtgtattacctctcgctggaattcctcatcgggcgcctgctgtacgacagcctgagcaacctcggtttgctggacgtcgcccgtgaagccttgaccgagctgggcgtcgatctggagcgcatccgcatcctggagccggatgcggcgctgggcaacggtggcctcggacggttggcggcatgcttcatggaaagcatgtcgaccctcggcatcgccggccatggctatggcattcgttatgaacacgggctgttccgtcaggccatcgtcgacggttggcaacaggagcagaccgagcactggctggatttcggcaacccctgggagttcgagcggccggaggtggtctatccgatcggctttggcggcagcgtcgagaccgtcaccgacgccaatggcaactcccggcaggtctggcacccggcggaaaccgtccgggcgattgcctacgacaccccagtggtcggctggcgcggggcgagcgtcaataccttgcgcctgtggcgggcccgagcgatggaggacttgcacctggagcgcttcaacgccggcgaccacctgggcgccgtcgccgaagtggcccgggccgaaagtatctcccgcgtgctctacccggcggacagcaccgaagccgggcaggaactgcgcctgcgtcaggaatacttcttcgtcgccgcctcgcttcaggacctgctgcgccgtcatcgcaacatgcacacctcggtgctgaccctcggcgatcacgcggcgatccagctcaacgacacccacccttcgatcgccgtcgccgaactgatgcgccaactggtcgatgtctacgacgtggcctgggacgcggcgtggcaagtgactgtcgatacgctgtcgtacaccaaccacacgctgctccccgaagcgctggaaacctggccggtggggctgatggaacgcatgctgccgcggcacatgcagatcatttacctgatcaacgcccagcacatcgattcgctgcgggccaagggcatccacgatttcgacgtgctgcgcgcggtgtcgctgatcgaggaagacaacgggcgccgggtgcgcatgggcaacctcgcgttcctcggctcccacagcgtcaacggcgtgtccgggctgcacacgcaactgatgcgcaaaaccgtgttcgctgaactgcacaagctgtatccggagcgaatcaacaacaagaccaacggcatcaccttccgccgctggctgtaccaggccaacccggagttgacctcgatgctggtcgatgcccttggcccggacgttctggataaccccgaagagcgtctgctcgatcttgaaccgttcgccgagaaacccgccttccgcaaagccttcgccgagcaacggttgcacagcaaaaaggccctcgcttacctgatccatgaacggctggggatcgcggtcaacccggcggcgatgttcgacgtgcaggtcaaacggatccacgaatacaaacgccagctgctcaacctgatgcacaccgtcgcgctgtatcaggcgatccgtgccgagccggaaatcgactgggtgccacgggtgaaaatcttcgccggcaaggctgcggcgagttatcaccaggccaagctgatcatcaaactgaccaacgacatcgcccgggtggtgaacaacgacccgaccgtgcgcggcctgctcaaagtggtgttcctgcccaactacaatgtcagcctggcggaaagcatcattccggcggcggacctgtcggagcagatctccaccgccggtttcgaggcctcgggcaccagcaacatgaagttcggcctgaacggtgcgctgacgatcggcaccctcgacggcgccaacgtggaaatgtgcgaaaacatcggcgccgagcacatgttcatctttggtctcagtgcccagcaggtcgaggcgcgcaagcagaaccacgagttcagcgcggtgccggacattgccgcgtcccatcgcctcaacgatgtattgcaggcgatccgcagcggggtgttctcgccggacgacacgtcgcgctacaccgggctgatcgattcgctggtggattacgaccggttcttcgtctgcgccgatttcgactcctactgggaggcgcagatgcgtgtcgatgcgcattggcacgacgccaacaactggtggcgttcggcggtgctgaatacctctcgcatgggttggttctcgtccgaccggactatccgcgagtacgccacggatatctggaag

SEQ ID NO: 37472 - DNA, 1524 bp, Pseudomonas fluorescens
atgactaccacgcctaaacctttggtcctgatgattctcgacggcttcggtcacagcgacagccccgagtccaacgccgtctatgcggccaagaagcctgtgctggatcgcctgtgggccaccgtgccgaacggcttgatctcgggcagcggcatggacgtcggtctgccggacggccagatgggcaactccgaagtcggccacatgaacctcggcgccgggcgcgtggtgtatcaggacttcacccgtgtgaccaaagcgatccgcgacggcgagttcttcgagaacccgaccatctgcgccgccgtggacaaggccgtggctgccggcaaggccgtgcacttcatggggctgctgtcggatggcggcgttcacagccaccaggatcacctgatcgccatggccgaactggccttcaagcgcggcgccgaaaaaatctacctgcacgccttcctcgatggccgtgacaccccgccgaaaagcgctgcctcgtcgatcgaactgctcgacgcgaccttccaggcgctgggcaagggccgcatcgccagcctcattggccgctactacgccatggatcgcgacaaccgttgggatcgcgtggcccaggcctacaacctgatcgttgatggcaagggcgaaatcaacgccgccaccgcccaggaaggtctggaagccgcttatgcccgtggcgagagcgacgaattcgtcaaagccaccagcatcggcgagccggtaaaagtcgaagacggcgacgccgtggtgttcatgaacttccgcgccgaccgtgcccgcgagctgagccgcgtgtttgtcgaagacggcttcaaggaattcgagcgcgcacgccagccaaaagtgcagtacgtgggcctgacccagtacgccgaaagcatcccggcccccgccgccttcgcgccgggcagcctggaaaacgtgctcggcgactacctggctaaaaacggcaagacccagctgcgcatcgccgaaaccgagaaatacgcccacgtgaccttcttcttctccggtggccgcgaagaaccgttcccgggcgaagagcgcatcctgatcccgtcgccgaaagtcgccacctatgacttgcagccggaaatgagcgcgccggaagtcaccgaccgcatcgtcgaggccatcgagaaccagcgttacgacgtgatcgtggtcaactacgccaacggcgacatggtcggccatagcggcgtgttcgaagccgcggtgaaagccgtggaatgcctggacacctgcgtaggccgcatcgtcgaggctctggaaaaagtcggcggtgaagcgctgatcaccgccgaccacggtaacgtcgagcagatggctgacgaatccaccgggcaagcgcacaccgcacacaccaccgagccggtaccgttcatttatgtcggcaagcgcgatctgaaagtccgcgaaggcggcgtgctggcggacgtggcgccgaccatgctgaaactgctgggtctggaaaaaccggcggaaatgactggcacttcgattctggtc

SEQ ID NO: 37473 - DNA, 768 bp, Pseudomonas fluorescens
atggcgctggccaaacgcatcatcccttgcctggacgtggacaacggccgggtcgtcaaaggtgtgaagttcgagaacatccgtgacgccggcgatccggtggaaatcgcccgtcgctacgacgagcagggtgccgacgagattacttttctcgacatcaccgccagcgtcgatggccgtgacaccacgctgcacaccgtcgagcgcatggccagccaggtgttcatcccgctgaccgtcggcggtggcgtgcggaccgtgcaggacattcgcaacctgctcaatgccggtgcggacaaggtgtcgatcaacaccgctgccgtgttcaacccggaattcgtcggcgaagcggcgcagcatttcggctcgcaatgcatcgttgtcgccatcgacgcgaagaaggtctccggcccgggcgaaaccccgcgctgggagatctttacccatggcggccgcaagccgaccggcctcgacgcggtcgagtgggcgaagaaaatggaaggcctgggtgccggtgaaatcctcctgaccagtatggatcaggacggcatgaaaaacggtttcgacctcggcgtgacccgcgccatcagcgatgcgctgggtattccggtgatcgcgtccggcggcgtcggcaacctgcagcatctggctgacggcattcttgaaggtcacgccagcgcggtgctggcggcgagtattttccacttcggcgaatacacggttcaagaagccaaggcttacatgtctaaacgcggcatcgtaatgcgt

SEQ ID NO: 37474 - DNA, 585 bp, Pseudomonas fluorescens
atggccgaacgtaaggcgtctgtcgagcgcgacactctggaaacccagatcaaagcctcgatcaaccttgatggcaccggaaaggcccgattcaatatcggtgttccttttcttgagcacatgctggatcagatcgcccgtcacgggttgatcgacctggatatcgaatgcaagggcgatctgcatatcgacgaccaccacacggtggaagacgtcggtatcaccctcggccaggccttcgcgcaagccattggcgacaagaaaggcatccgtcgctacggccacgcctacgtgccgctcgatgaagcgctgtcgcgcgtggtgatcgacttctccggccggccgggcctgcagatgcacgtgccgtacacccgcgccaccgttggcggcttcgacgtcgacctgttccaggaattcttccagggcttcgtcaaccacgcactggtcagtctgcacatcgacaacctgcgcggcaccaacacccaccaccagatcgaaaccgtgttcaaggctttcggccgcgcgctgcgcatggccgtcgagctggacgagcgcatggccggccagatgccttcgaccaagggc

SEQ ID NO: 37475 - DNA, 1374 bp, Pseudomonas fluorescens
ctcgcaaaggtagttccaatgagcagtacccaaagctccaatggcctcgaacaggggctcaaaccgcgtcatgtgaccatgctgtcgatcgccggggtgatcggtgcaggtctgttcgtcggctccggccacgccatcgccgctgccggtcccgctgttctgctggcttacgccgctgctggcgcgctggttgtgttggtgatgcgcatgctcggcgaaatggcggttgcctcgcctgacactggctcgttctcgacttacgccgaccgcgctatcggtcactgggccggtttcaccatcggctggctgtactggtggttctgggttttggtgattccgctggaagccaacgccgccgcaaccatcctgcatgcgtggttcccgggtgtggatatctgggcgttcgccctgatcatcaccatgctgctgaccgtgaccaacctgttcagcgtgaaaaactacggtgagttcgaattctggttcgccctgctcaaagtcgtggcgatcatcggtttcatcattcttggcgtcgcggccattttcggtttcctgccgaacagccaggtcagcggcgtttcgcacatcttcgacacccagggcttcctgccgaacggcatgggcgcggtgctgggcgcgatcctgaccaccatgttctccttcatgggtaccgagatcgtgaccatcgcggccgccgaatcgaagaacccgggcaagcagatctccaaggccaccaactcggtgatctggcggatcggcctgttctacctcgtttcgatcttcatcgttgtggccctggtgccatggaacgacccggttctggccagcgtcggttcctaccagaccgtgcttgagcgcatgggtatcccgaacgccaagatgatcgtcgatatcgtggttctggttgcggtgaccagctgtctgaactcggcgctgtacacctcgtcgcgcatgctgttctccctcggcaagcgtggtgacgccccggtcatgtcgacccgcaccaacaagagcggcaccccttactgggcggtgatgctgtccactggcgcggcattcctgtgcaccttcgccaactacgtggccccggctgcggtgttcgagttcctgctggccagttcgggcgccatcgcgctgctggtgtatctggtgatcgcgatttcgcaactgcgcatgcgtaaacaacgcatggctcgcggcgagaaaatcgtcttcagcatgtggctgttcccgggcctgacctacgcggtgatcgccttcatcgtggcagccctgaccatcatgctgttccaggacgcccaccgcgtggaaatcctcgcgaccggcctgctgagtctggtggttgtggcgaccggcctgttggtggctcgtcgtcgt

SEQ ID NO: 37476 - DNA, 1599 bp, Pseudomonas fluorescens
gacaatctgatcgaaatccgcgacctggccgtcgaattcggtttcggcgagcgtgtgcaccgggtcgtggaaggcgtgagtttcgacatcaagcgcggtgaaaccctcgcgttggtcggcgaatccggctcgggcaaatcggtgaccgcgcactcgatcctgcgcttgctgccctacccgctggcgcggcatccggccggcagcatcaattattccgggcagaacctgctggaactgggcgaaaagaccatccgtcacattcgcggcaaccggatcgcgatgatctttcaggagccgatgacctcgctcaacccgctgcactcgatcgagaagcagatcaacgaggtgctgggtatccacaagggcctgaccggcaaagtcgcgaccaagcgcacgctggagttgctggagatggtcggcatccccgagccgcacaagcgcctcaaggccctgccccacgaattgtccggcggccagcgtcagcgggtgatgatcgccatggccctggccaacgagccggaactgctgatcgccgacgaaccgaccactgcgctggacgtgaccgttcagctgaaaatcctcgacctgctcaaggaattgcaggcccgattaggcatggcgctgttactgatcagtcacgatttgaacctcgtgcgaagaattgcgcatcgtgtatgtgtcatgcagcgcggttgcatcgtcgaacaggcatcgtgcgaagagctgttccgttcgccgcagcatccgtacactcgggaactgcttggcgcagagcccagcggaggcccggcgagcaataaaatcggggcgccgctgcttgaagtcgaggatctgaaagtctggttcccgatcaagaaaggcctgctcaagcgcacggtggatcacgtcaaggcagtggacggcatcaatttcagcctgcctcagggtcagaccctggggatcgtgggggaaagcggttccggcaaatccaccctgggtctggcgatcctgcggttgatcggcagcaaaggtgcgatccgttttgaaggcaagcagctagactgcctgacgcaaagcgaagtccggccgttgcgccgggagatgcaggtggtgtttcaggatccgtttggcagcctgagcccgcgaatgtgcgtgaatgacatcgttggtgaaggcctgcggatccacaagatgggcaccgctgccgagcaggaagcggcgattattgcggcattgaaggaggtaggtctggatccggaaacccggcaccgctacccccacgaattttccggtgggcaacggcagcgaattgccatagcccgggccttggtgctcaaaccggcgctgatcctgctggacgagccgacttcggccctcgaccggacggtgcagcggcaagtggtggagctgttgcgctcactgcaagccaagtacaacctgacgtatttgttcatcagccatgacctggctgtcgtcaaagcgctgagccaccagctgatggtggtcaagcatggccaagtggtcgaacagggagacgcgcaaagtatctttgccgccccccaacattcgtatacacagcagttgctggaggccgctttcctggcaccagccactgcgcaa

SEQ ID NO: 37477 - DNA, 792 bp, Pseudomonas fluorescens
atgggttttctcgccggtaagcgcgtactgatcgtcggtgtcgccagcaagctgtccatcgcatccggcatcgctgccgccatgcatcgcgagggcgctgagcttgccttcacttatcagaacgacaaactgaaaggtcgcgtcgaagagttcgcacagggctggggttcgagcccggagctgtgcttcccgtgcgacgtggccagcgatgaagaaatcgccaaggtcttcgaagaactgagcaagaagtgggacggcctggactgcatcgtgcactccgtcggcttcgccccgggcgaccaactggacggcgacttcaccgaagccaccacccgtgaaggcttccgcatcgctcacgacatcagcgcctacagcttcgtggctctggccaaagccggtcgcgaaatgatgaaaggccgcaatggtagcctgctgactctgtcgtatctgggcgccgagcgcaccatgccgaactacaacgtgatgggcatggccaaggcttcgctggaagccggcgtacgttacctggccggctccctgggcccggacggtactcgcgtcaactgcgtatcggccggtccgatccgcaccctggcagcttccggcatcaagaacttccgcaagatgctggccgccaacgaagcgcaaaccccgctgcgccgcaacgtcaccatcgaagaagtcggcaacgccggcgccttcctgtgctccgacctggcgtcgggcatcagcggtgaaatcatgtacgtggacggcggcttcaacaccaccgccatgggcaacatcgaagag

SEQ ID NO: 37478 - DNA, 828 bp, Pseudomonas fluorescens
atgggatttgtcacaacgaaagacggcgtcgaaatcttctacaaggactggggcccgaaagacgccccggtgatccacttccaccacggctggccgctcagcgcggacgattgggatgcgcagatgctgttcttcctcgcccagggcttccgggtcgtggcccacgaccggcgaggtcacgggcgttcgagccaggtctgggacggccacgacatggatcactacgccgacgacgtggcggcggtggtcaaccatctggggacgcagaaagccgtgcatgtcggccactccaccggtggcggcgaggtgattcattacatcgcccggcatggcgaggatcgggtgtcgaaagccgcgatcatcagtgccgtgccgccgctgatggtgaaaaccgagagcagccccggtggcttgcccaaatcggtgttcgacgatcttcaggcgcaactggcagccaatcgcgcgcagttctatcgcgacgtgcccagtgggccgttctacggctacaaccgccctggcgccaagccatcggaagggatcattgcgaactggtggcgccaaggcatgatcggcagcgccaaggcgcactacgacgggatcgttgccttttcccagaccgacttcaccgctgacctcaaaagcatctcgatcccggtgctggtgatgcacggcgacgatgaccagatcgtgccctatgaaaacgccggcgtgctgtcggcgaaactgctgaaaaacagcacgctgaagatttatccgggcttcccccacgggatgccgaccaccgaggcgccgacgatcaacgcggatctgctggcgttcattcgcggc

SEQ ID NO: 37479 - DNA, 2139 bp, Pseudomonas fluorescens
ctggccaactgcgccgacgagccgatccgctttcccggcgcgatccagccgcacggtttgctgctgaccctgagcgagccggacctttcgatcattcagatcagcgccaacgtcgagaccttgctcgcgcgcccggcgcaagagctgatcggccagccactgcaaagcctgatcggcgatgcccatgccgcgcaggttcgcgaagccttgcagcaagcagccttgtccgatgcgccgccgctgcactttcgccttaatggcacggcgttcgaaggcttgctgcaccggcatcaggatgtgctgattctggagctggaaatccacgtcgaaaatttccagccacgcaacgtcgccggcaccgaaacccacctgggacggatgctcgcgcgcctgcaaaaggcccagagcctgcaagcgctgtacgacatcagcgtcaaggaaatccaggccatgaccggttacgaccgggtgctgatttatcgcttcgaagaggagggccacggtcaggtcatcgccgaagcgtccgatccgtcgatggaagtcttcaacggtctgtttttccctgcctccgacatccccgagcaagcccgcgagctgtaccgcaccaactggctgcggatcattccgaacgcggactaccaaccggtgccgctggtgcccaagttgcgtccggacacccagaccccgctggacctgagcttcgccacgttgcgcagcgtgtcgccgatccactgccagtacatgaaaaacatgggcgtgctgtcctcgatgagcatttccctgctcaagggcgacaagctctggggcctgatcagttgcggcaatcgccagccgctgcatgtaccgcatgaattgcgcaccgcgtgccaaaccatcggccaggtgctgtcgttgcagatcagcgcgatggaagcgctggaggtcagccgtcaacgggaagaaaagctcgaggcgctggcgctgctcaatcaggcgatgatcgactcgccacagaacgtcttcgatggcctggccaaccagccacaagtcttgatggcgctggccaatgccggcggcattgcgatcatcgaagacaagcaattgcaccgttacggcaactgcccggagccggaagaaatccgcgccctgcacaaatggctgcaggagcgtggcgagccggtgtttgccagtcatcacctggccagcgtctacccgccggccgcgcactaccagcaggtcgccagcggcgtgctcgccatgagcctgcccaaaccggtggacaacggcgtgctgtggttccgccccgaagtcaaagagaacatcaactggagcggcgacccgcgcaagccgctggacctggaaaactccgacgccggcctgcgcctgcggccgcgtacttcgttcgaaatctggaaggtcgagatggccgggatttccaccaagtggagccacggtgatctgttcgccgccaacgacttgcgtcgctcggcgctggaaaatgatctggcccgccaagtacgccgcgagcaagaagcggtgcgcgcccgtgatgaactggtggcggtggtttcccacgatctgcgcaacccgatgaccgtgatctcgatgctctgcggcatgatgcagaaggcgttcagctcggacgggccgcacacttcgcggcgcatctcgactgcgatcgacaccatgcaacaagccgccgggcgcatgaacacgctgctggaagacttgctcgacacctcgaaaatagatgccgggcgctacaccatcgcgccgcagaaactcgatgtcgcgcagatgttcgaagaggcgcaatcgctgctcgcgccgctggcgctggacaaggacatcagcatctcgttcgaggccgatcctgacctgagcatccatgccgaccccgagcggttgtttcaggtgctgtcgaatctggtcggcaacgcgatcaagttcactccgcgcctgggcacggtcgacgtgtatgccaaatcggtcggtgatgacatcgtcttcacggtgcgtgacagcggcgaaggcattcccaaggatcacttgccgcacgtatttgaccgttactggacggtgaaggaaggcaatccgaccggcaccgggctgggtctgtacatcacgcagggcatcgtcgaggcccatggcgggcagatc

SEQ ID NO: 37480 - DNA, 2574 bp, Pseudomonas fluorescens
atgaacacagaatttcgcaagaacctgcccggcacgccgctggactttttcgacgtccgcgcggcggtcgatgggatccagcccggcagctacgataccctgccgtacacctctcgcgtgctggcggaaaacctcgtgcgtcgctgcgacccggccacgctcaccgattccctgaaacaactgatcgagcgcaaacgcgacctcgacttcccatggttcccggcccgcgtggtgtgccacgatattctcggccagaccgcgctggtggatctggccggcctgcgcgacgcgattgcccagcagggcggcgacccggcgcaggtcaacccggtggtgccgacgcaactgatcgtcgaccactcgctggcggtggaggcgggcggttttgacgcccaggcgttcgagaagaaccgcgccatcgaagaccgtcgcaacgaagaccgtttccacttcatcaactggaccaagaaggcgttcaagaacgtcgacgtgatcccgccgggcaacggcatcatgcaccagatcaacctggagaaaatgtcgccggtgatccaggtgcgcgacggcgtggcgttcccggatacctgcgtcggcaccgacagccacaccccgcacgtcgatgcgctgggcgtgatcgccatcggtgttggtggtctggaagccgagagcgtgatgctcggccgcgcgtcgtggatgcgcctgccggaaagcgtcggtgtcgaactgaccggcaagctgcaaccgggcattaccgccaccgacatggtgctggcgctgaccgaatacctgcgcaaacagaaagtggtcggcgcgtggctggagttcttcggcgaaggcgcttccgcgctgaccctcggcgaccgcgcgaccatctccaacatggctccggaatacggcgccacggcggcgatgttctacatcgaccagcagaccatcgattacctgaaactcaccggtcgcgaagaccagcaagtgcaactggtcgagcaatacgccaagcagatcggcctgtgggccgacagcctgaaaggcgcgcaatacgagcgcggcctgaccttcgatctgtcctcggtggtgcgcaacatggccggcccgagcaacccgcacgcccgcgtggcggtgtcggatctggcggccaaaggcatcgccggtcagtgggaagacgtccctgggcaaatgcccgacggcgcggtgatcatcgccgccatcaccagttgcaccaacaccagcaacccgcgcaacgtgatcgccgccggcctgctggcgcgcaacgccaacaagctcgggctgacccgcaagccgtgggtcaagtcgtcgctggcaccgggctcgaaaaccgtggcgctgtacctcgatgaagcggggctgaccacggagctggagcagctcggtttcggcgtcgtcgccttcgcctgcaccacctgcaacggcatgtccggcgcgctggacccggtgatccagcaagagatcatcgaccgcgacctgtacgccactgctgtgctgtccggtaaccgcaacttcgacgggcggattcacccgtacgccaagcaggctttcctcgcttcgccgccgctggtggtggcctacgcgattgccggcaccatccgtttcgatatcgagaaagatgtgctgggcgtggtcgacggcaaggaaattcgcctgaaagacatctggccgagcgacgaagaaatcgacgcggtggtgaaatcttcggtcaagcctgagcagttccgtcaggtctacatcccgatgttcgccatccatgaagacaccggtccgaaagtcacgccgctgtacgactggcgcgaaatgagcacctacatccgccgtccgccgtactgggagggcgcgctggccggggcgcggccgctcaagggcatgcgtccgttggcggtattgccggacaacatcaccaccgatcacctgtcgccgtcgaacgcgatcatgctcgacagcgccgccggcgagtacctggcgaaaatgggcctgccggaagaggacttcaactcttacgcgacccaccggggcgaccacttgaccgcacagcgcgcgaccttcgccaacccgaaactgttcaacgaaatggtcgtggaaaacggcaaggtcaagcagggctcgctggctcgagtcgagccggaaggccaagtgatgcgcatgtgggaagccatcgaaacctacatggagcgcaagcagccgctgatcatcatcgccggcgccgactacggccagggctcgtcccgcgactgggcggccaaaggcgtgcgtctggcgggggtggaagcgattgccgccgaaggtttcgagcgcattcaccgcaccaacctggtgggcatgggcgtgttgccgctggagttcaaaccgggcactgaccgcaagactctgggcatcgacggcagcgaaacctacgacgtgatcggtgagcgcacgccgcgcgccgacctgacgctggtgatccatcgcaagaacggcgaacgcgtcgacgtgccggtgacctgccgcctcgacaccgccgaagaagtgtcgatctacgaggctggcggcgtgttgcagcgcttcgctcaggacttcctcgaa

SEQ ID NO: 37481 - DNA, 1125 bp, Pseudomonas fluorescens
atggccgaagcaaaagtactcagtggcgccgggctccggggccaggtcgccgggcaaaccgcactgtccaccgtgggccaggccggtgccgggctgacctatcgcggctacgacgtgcgcgaactggcagccgacgcacaatttgaagaggtggcgtacctgctgctctacggggagctgccgaccaaggcgcaactcgccgactatcaaggcaagctgagcaagctgcgcgacctgccgcaagcgctgaaagaagtgctggagcgcatccccgccgacgcccacccgatggacgtgatgcgcaccggttgctcgttccttggcaatatcgagccggagaaagacttctccgagcaacgcgacaagaccgaccgcctgctggccgcgtttccggcgatcatgtgctactggtatcgcttcagccacgacggcaaacgcatcaactgcgtgagcgacgagccgtccatcggcggccacttcctgcacctgctgcacgacaagaagccgagcgagctgcacgtcaaagtgatgaacgtgtcgctgatcctctacgccgagcacgaattcaacgcctcgaccttcaccgctcgggtgtgtgcttcgaccttgtccgatctgtattcctgcgtcacggcggccatcggctcgctgcgcggcccgctgcatggcggcgccaacgaagcggcgatggaaatgatcgagcgcttctcgtcgccggaagaggcggtcaagggcaccctcggcatgctcgaacgcaaggacaagatcatgggcttcggtcacgcgatctataaggacagcgatccgcgcaacgaggtgatcaagggctggtcgaaaaaactcgccgacgaagtgggcgacaaggtgttgttcgcggtttcggaagccatcgacaagaccatgtgggagcagaagaaactgttccccaacgccgacttctaccatgcctcggcgtatcacttcatgggcatcccgaccaagctgttcaccccgatcttcgtctgctcgcgcctgaccggctgggcagcgcacgtgttcgagcagcgtgccaacaaccgcatcatccgtccaagcgccgagtacaccggcgtcgaacagcgcaagttcgtgcccatcgaacagcgc

SEQ ID NO: 37482 - DNA, 705 bp, Pseudomonas fluorescens
gacgtcgtggaactcgccacgacctatgccaacaaatccgcgcaggacatcctcaaactcgcgttcgccgagttcggcgatgacctgtggatatctttcagcggcgccgaggatgtggtgctggtggacatggcctggaagctgaacaagaacgtcaaggtgttcagtctcgacaccggccgcctgcatccggaaacctaccgtttcatcgatcaggtgcgcgagcactacaagatcgacatcgaactggtctcgccggactacacgaaacttgaaccgttcgtgaaggaaaaaggcctgttcagtttctacaaggacggtcacggcgaatgctgcgggatccgcaagatcgagccgctgcgccgcaagctgtccggcgtcaaagcctgggccaccggccagcgccgcgatcaaagccctggcacccgcagcgctgtggcggtgatggaaatcgatacagcgttctccaccccggagcgcaccctgtacaagttcaacccgctggcacagatgaccagcgaggaaatctggggctacatccgcatgctggagctgccgtacaacagcctgcacgagcgcggctttatcagcatcggctgcgaaccgtgcactcgtcctgtcctgccgaaccagcacgaacgtgaaggtcgctggtggtgggaagaagcgacccaaaaagaatgcgggttgcatgccgggaacatc

SEQ ID NO: 37483 - DNA, 729 bp, Pseudomonas fluorescens
ctcagcggtaaagtcgctctgattcaaggcggctctcgcggcatcggtgccgccatcgtcaaacgcctggccgctgaaggcgccgcggttgcctttacctacgtcagctcggccgccaaggctgaagaactgcaaaacagcatcaccgccaccggcggcaaagccctggcgatcaaggctgacagcgccgacgccagcgccatccgcaacgcggtgaacgccactgtcgaaacctttggccgcctcgacattctggtcaacaacgccggtgtactggccgtcgccccgctggaagacttcaaactggaagacttcgaccagaccctggcaatcaacgtgcgcagcgtgttcatcgccagccaggaagccgccaaacacatgggcgaaggctcacgcatcatcaacatcggcagcaccaacgccgaccgcatgcccttcgccggtggtggcgtgtatgcgatgagcaaatctgcactggtgggcctgaccaaaggcctggcccgcgacctcggcccacgcggcatcaccatcaacaacgtgcagcctggcccggtcgacaccgacatgaacccggcccacggcgagttcgccgacagcctgattccgctgatggccgtcggtcgttatggcacggccgaggaaatcgccagcttcgtcacctacctcgcaagcccggaggccggttatatcaccggggccagcctgaccatcgacggtggtttcggcgcc

SEQ ID NO: 37484 - DNA, 636 bp, Pseudomonas fluorescens
atggacggtttgctgctggacaccgagggcatctacaccgaggttacctcgctgattgccgagcgttacgggcgcacgttcgattggagcatcaaacagaacatcatcgggcgcggcgccggcgatctcgcgcgttatgtggttgaagcgctggacctgccgatcaccgccgaagagtttctggtgatccgcgagccgctgatgcgtgagcgttttcccaccgcgcaagcgatgccgggcgccgaggaactgatccgccacctcaaggcgcacaacattccgattgcggtcggcaccagttcgtcgcgtcagtcgttcggtcagaaaaccaccttgcaccgcgactggtttgcgttgttcgacttcatcgtcaccgctgacgacccggaagtcggtgcggccaaaccggcgccggacatcttcctcaccgccgctcgccgcctcggtgttgcgccggaagattgcctggtgtttgaagattcgccgttcggtgtgacagccgcgaaagcagccggcatgactgccatcgccattcccgatgccgccatggccgatgaaaaatacgcacacgccgacgggattcttcgtacgttgaaagcgttcacgccgagtgcttgcgggttgccggcgctcgac

SEQ ID NO: 37485 - DNA, 558 bp, Pseudomonas fluorescens
atgacccgttccctgcccgagaattaccgcgagatcctgatcggcctcggtgaagatcccgaccgtgaaggcttgctcgacacaccggtgcgcgcggccaaggccatgcagtatctgtgtcacggctacgaacagagcgtcgacgagatcgtcaatggcgcgctgtttgcctccgacagcgacgagatgatcatcgtcgccgacatcgagctctattcgttgtgcgaacatcacctgctgcccttcatcggcaaggcccatgtggcttatattccgacgggcaaggtgctggggctgtcgaagatcgcgcggctggtggacatgttcgcccgccgcctgcagatccaggaaaacctcacccgccagatcgccgaggcggtccggcaagtcaccgatgccgccggtgtcgcggtggtcatcgaagcccggcacatgtgcatgatgatgcgcggtgtcgagaaacagaattcgaccatgaacacctcggtcatgctcggcgccttccgcgagtcgagcaacacccgtcaggagttcctgcaattgattggacggagcaag

SEQ ID NO: 37486 - DNA, 696 bp, Pseudomonas fluorescens
accgctcccatccttatcaccggcgccggccagcgggtcggcctgcattgtgcgcagcgtctgctggaagatggtcatcgggtgatcttcacttaccgcagcgaacggccgggtgtgaagaccttgcgggatctgggcgccctagggctgcacgcggacttttccagcgaagcttcgatcctcgccttcatcaccgagctgaagtcacacaccgacagcctgcgcgcgatcgtgcacaacgcctcggagtggctggcggaaaccgctgacggcgaagccgaagccttcagccgcatgttcaacattcacatgctggcgccgtacctgatcaatctgcattgcgctgaattgctgcaacgttcgagtcctgccgacatcatccacatcagcgatgacgtcacccgcaagggcagcagcaaacacatcggctattgcgccagcaaggccgggctcgacagtctcacgctgtccttcgccgcgcgctacgcgccgtcaatcaaggtcaacggcatcgcaccggccctgctattgttcaatcccgacgacgacgcggagtaccgtgccaaggcgctggccaagtccgcgctgggcatcgaacccggcagcgaagtgatttatcagagcctgcgttatctgctcgacaacccgtatgtcaccggcaccaccctgaccgtcaacggcgggcggcacgtcaag

SEQ ID NO: 37487 - DNA, 909 bp, Pseudomonas fluorescens
atgaatgagtctgtgcgtttcgaagataaagtcgtgatcgtcaccggagccggtggtggcctgggacgcgctcacgctttgctgttcgccaaacagggcgccaaagtgctggtcaacgacctcggcggctcgactcagggcgaaggcgccaacgcttcggccgccgaccgcgtggtggcggaaatccgcgaggccggcggcatcgccgaagccaaccacgattcggttaccgacggcgacaaactggtacagaacgccctcgacgtgttcggtcgcgtcgatgtcgtggtcaacaacgccgggatcctgcgcgacaagaccttccataaaatggaagacgccgactgggatctggtctaccgcgtccacgtcgaaggcgcctataaagtgacccgcgccgcctggccccatctgcgcgagcaaaattacggccgggtgatcttcaccgcctcgacctcgggcatctacggcaatttcggccagtccaactacggcatggccaaactcggcctctacggcctgacccgcaccctggccatcgaaggtcgcaagaacaacatcctggtcaacgccatcgctcccaccggcggcacccgcatgaccgaaggcctgattccgccgcaagtgttcgaacaactcaagcctgaactggtcagcccgctggtggtgtacctggccagtgaacagtgccaggaaacctcgggcctgttcgaagtcggcggcggctggatgggcaaggtgcgctgggagcgcagcctgggcgccggcttcgatccacgcgtcgggttttccccggaagacgtcgcggcgcactggcagcagatctgtgatttcgaaggtgcggcgcatccgaaggacaatatcgaggcgctgaaggaaatgatggggaatttgcagaagtattcgttg

SEQ ID NO: 37488 - DNA, 1293 bp, Pseudomonas fluorescens
atgaacctcgattcagccctggcttaccagtccggtttcggcaacgaattcagctcggaagcgttgcccggcgcactgcccgtcggccagaactccccgcagaaagccccgtacggtctgtacaccgaactgttctccggcaccgcgttcaccatgacccgcagcgaagcgcggcgtacgtggatgtaccggatccagccgtcggccaatcacccggcattcgtcaaactggagcggcaactggcgggcggcccgttgggtgaagtgacccccaatcgcctgcgctggaacccgctggacctcccgaccgaaccgaccgacttcatcgacggtctggtgagcatggcggccaactccggcgccgacaaaccggccggcatcagcatctatcactatggcgccaaccgttcgatggagcgcgtgttcttcaacgccgacggcgagctgctgctggtaccgcaactgggtcgcttgcgcatcgccaccgaactgggtgtgctggacgtggcgccgctggaaatcgccgtgttgccacggggcctgaaattccgcgtcgaactgctcgacccgcaagcacgcgggtacgtcgccgagaaccatggcgcgccactgcgcctgccggacctggggccgatcggcagcaacggcctggccaatccacgggatttcctgaccccggtcgccgcctacgaaaacctgcaacaaccgaccaccctggtgcagaaattcctcggccagttgtggggtaccgaactcaatcactcgccgctgaacgtggtcgcctggcacggcaacaacgtgccgtacaagtatgacctgcgccgcttcaacaccatcggcaccgtcagtttcgatcacccggacccatcgatcttcaccgtgctgacctcgccgaccagcgtccacggtctggccaacctcgacttcgtgatcttcccgccgcgctggatggtggccgagaacaccttccgtccgccgtggttccaccgcaacctgatgaatgaattcatgggcctgatccagggcgaatacgacgccaaggccgaaggtttcgtgcccggcggcgcgtccctgcacagctgcatgagcgcccacggcccggacggcgagacttgcaccaaagccatcaacgcggacctcaaaccggcgaagatcgacaacaccatggccttcatgttcgagaccagccaggtgctgcgcccaagccgcttcgccctcgactgcccgcaattgcaatccacttacgacgcctgctgggccacgctgcccgccacgttcgatccgacccggaga

SEQ ID NO: 37489 - DNA, 952 bp, Pseudomonas fluorescens
gtggacaagattcttcaccaaccactgggcggcaacgaaatgccgcgcttcggcggcatcgccaccatgctccgactcccccatgttccgaccgctgccggcctggacgctgcctttgttggcgtgccactggacatcggtacttcgctgcgccccggcacccgcttcgggcctcgcgacatccgcaccgaatcggtgatgatccgcccgtacaacatggccaccggcgctgcgccgttcgactcgctgtcggttgccgacatcggtgacgtggcgatcaacaccttcaacctgctcgacgccgtgcgcatcatcgaagaagcctacgacaacatcctcgagcacaacgtgatcccaatgaccctgggcggcgaccacaccatcaccctgccgatcctgcgtgcgatccacaaaaagcacgggcaaggtcggtctggtacacatcgacgcccacgctgacgtcaacgatcacatgttcggcgagaagatcgcccacggtacgaccttccgtcgtgcggtcgaagaaggtcttctggactgcgaccgtgtggtgcagatcggtctgcgtgcgcagggctacaccgctgacgacttcaactggagccgcgatcagggcttccgcgtggtgcaggccgaagagtgctggcacaagtcgctggcaccgctgatggccgaagtgcgcgagaaagtcggtggcggcccggtgtacctgagcttcgacatcgacggcatcgacccggcctgggcgcctggcaccggcaccccggaaatcggtggtctgacgaccattcaggcaattgaaatcgttcgcggctgccagggcctcgacctgatcggctgcgatctggtagaagtctcgcccgcttatgacaccaccggcaacacctcgctgctggccgccaacctgctgtacgaaatgctctgcgtactgccgggcgtggtccaccgctga

SEQ ID NO: 37490 - DNA, 1128 bp, Pseudomonas fluorescens
gaggtagcacccgtgttttcccaattcgccctgcacgaacgcctgctcaaagccgtggccgagctgaaatttgtcgagccaacgcctgtgcaagccgcggccattccgctggcgcttcaggggcgtgacctgcgggtgacggcgcaaaccggtagcggcaagaccgccgctttcgtcctgccgatcctcaaccgcctgatcggcccggccaaggttcgcgtcagcatcaagaccctgatcctgctgccgacccgcgagctggcccaacagaccctgaaggaagtcgagcgcttttcgcagttcactttcatcaagtccggcctgatcaccggcggtgaagacttcaaggtccaggccgccatgctgcgcaaggtgccggacatcctgatcggcaccccgggccggatgatcgagcaactgaacgccggcaacctcgacctgaaagaagtcgaagtgctggtgctcgacgaagccgaccgcatgctcgacatgggtttcgccgaagacgtgcagcgtctggtcgacgaatgcccgaaccgtcagcagaccatgctgttctccgccaccactggtggttccggactgcgcgagatgatcgccaaggtgctgaacaaccctgagcacctgcagctcaacgcggtcagccagctgaacgacaccacccgtcagcagatcatcaccgccgaccacaaccagcataaagaacagatcgtcaactggctgctggccaacgagacctatcagaaggccatcgtcttcaccaacacccgggccatggccgaccgcatctacggtcgtctcgtcgcccaggaatacaaggcgttcgtgctgcacggagaaaaagaccagaaggatcgcaaactggcgatcgaccgtctgaagcagggcggcgtgaagatcctggtggctaccgacgtggcggcccgtggtctggacgtcgacggtctggatctggtgatcaacttcgacatgccacgcagcggcgacgaatacgtgcaccgtatcggtcgtaccggccgagccggcaacgacggtctggcgatctcgctgatctgccacggcgactggaacctgatgtcgagcatcgagcgttatctgaagcagagcttcgagcgccgcaccatcaag

SEQ ID NO: 37491 - DNA, 1818 bp, Pseudomonas fluorescens
ctctatcgccgtttcgaacaactgatcgacatattccgcgacgccccgacggcgtctccgccggaccgcgttctgcccttctatacctattacctgaagcaggtctggccgagtttcgccgccctgctgatcgtcggcctgttcggtgcactgatcgaagtggcgctgttcagctacctgagtcgcatcatcgacctcgcccagggtacgccgaacgtcgacttcttcaaggtgcacggcgtcgaactggcgtggatggcggtggtagcgttactgctgcgcccgctgttcctggcgctgcacgacatgctggtgcaccagaccctgagcccgagcatgaccagcatgattcgctggcagaaccacagttacgtgctcaagcagagcctgaatttcttccagaacgacttcgccgggcgcattgcccagcgcatcatgcagaccggcaactcgctgcgcgattccgccgtgcaagcggtggatgcgctgtggcacgtgctgatctacgcgatcagttcgctggtgctgttcgccgaggccgactggcgcctgatgatcccgctgctgacgtggatcgccgcctacatcggcgcgctctattacttcgtgccacgggtcaagaaccgctcggtggaagcctccgatgcgcgctcgaagctgatgggccggatcgtcgacggctacaccaacatcgccaccctgaagctgttcgcccacaccaatttcgaacagcactacgcccgcgaagcgatccaggaacagaccgaaaaagcccagctggccggccgcgtggtcaccagcatggacgtggccatcaccaccatgaacggcctgttgatcgtcggcaccacggcgctggccctgtggctgtggacgcaatcgctgatcagcgtcggcgcgatcgccctggccaccggtctggtgatccgcatcgtcaacatgtccggctggatcatgtgggtggtcaccgggatcttcgaaaacatcggcatggttcaggatggtctgcagaccatctcgcaaccggtcagcgtcaccgaccgggagcaggccaaaccgctggccgtcgcccgtggcgaagtgcgtttcgagcacgtggattttcactacggcaagaagaaaggcatcatcggcgaccttaacctgaccatcaaaccgggcgagaaaatcggtttgatcggcccgtccggcgccggcaaatcgaccctggtcaacctgctgttgcgcctgtacgacgtcgagggcgggcggatcctgatcgacggccagaacatcgccgaagtcggccaggaaagcctgcgcgcacggatcggcatgatcactcaggacacctcgctgctgcaccgctcgatccgcgacaacttgctgtacggcaagcccgacgccactgacgcggagctctgggaagcggtgcgcaaggctcgcgccgatgagttcatcccgttgttgtcggacgccgaaggacgcaccgggttcgatgcgcatgtcggcgaacgcggggtgaaactgtccggtggtcagcgtcagcggatcgcgattgcgcgggtgctgctcaaggacgcgccgatcctgatcatggacgaagcgacctcggccctggactcggaagtcgaagcggcgatccaggaaagcctggaaaccctgatgcagggcaagaccgtgatcgccatcgctcaccgcctctcgaccattgcccgcatggaccgactggtggtgctggagaacggcaagatcgccgaaagcggcaaccatgccgaactgctggcccatggcggattgtatgcgcggttgtgggcgcaccagaccggagggtttgtc

SEQ ID NO: 37492 - DNA, 1047 bp, Pseudomonas fluorescens
gtgcagtctttcaatacctacgtcgcccagttcaatgcggacaacgccgaagccatcgccagcggcgaagtccaggccctgaccgagtccagcgccgcgttcatcgaaaaagcttccggcatcaagagccgctttgtcatggacaaggatggcatcctcgaccctgcgcgcatggcgccacgcctgccggagcgttccaacgacgaatggtcggtgctttgccagatggccatcggcgctgccgaacaagccctgcaacgtgccggcaagactgccgccgacatcgacggcgtgatcgtcgcctgctccaacctgcagcgtgcctacccggccatcgccatcgaagtccaggaagcgctgggcatccagggtttcggtttcgacatgaacgttgcctgctcgtcggcgaccttcggcatccagcaagcggccaacaccgtgcaactgggccaggcccgggcgatcctgatggtcaacccggaagtctgcaccggtcacctgaacttccgcgaccgcgacagccacttcatcttcggtgacgcggccaccgccgtgattatcgagcgcgccgatctggcaacctccaagcaccagttcgatgtggtcagcaccaaactgctgaccaagttctccaacaacatccgcaacaacttcggcttcctcaaccgcgcagcggaagagggcatcggcgcccgcgacaaactgttcgtgcaggaaggccgcaaggtgttcaaggatgtttgcccgatggtggccgaactgattggcgagcatctggaagagaacaagctcaatgtcggtgacgtaaaacgcttctggctgcaccaggccaacctgagcatgaaccacctgatcgtgcgcaagctgctgggccgcgaagccaccgaagaagaagccccggtgattctcgacacctacgccaacaccagctccgccggttccgtgattgcgttccacaaatatcaggacgatctggcggccggttcgctggcggtgctgagttcgttcggtgccggttactcgattggtagcgtgattctgcgtaaa

SEQ ID NO: 37493 - DNA, 1434 bp, Pseudomonas fluorescens
ctgacgactgccgcgggcgcgcccgtggttgataacaacaacgtacagaccgccggccccagaggcccgatgctgttgcaggacgtatggttgctggaaaaactggcgcacttcgatcgggaagtcatccccgagcggcgcatgcacgccaagggttccggcgcgttcggcaccttcaccgtgacccacgacatcacccgtttcaccaaggccaggctgttttccagcgtgggcaagaccaccgatgtgttcgtccggttttcgaccgtggccggggagcgtggcgcggcggatgccgagcgtgacatccgtggattcgccatcaagttctataccgagcaaggcaactgggacttggtgggcaacaacacgccggtgttctttctgcgcgatccgttgaaattccccgacctcaaccatgcggtcaaacgcgacccacgcaccaacatgcgcagcgcccgcaacaattgggatttctggacgttgctgccggaagcgctgcaccaggtcacgattgtcatgagcgatcgtggcctgccgcgcacctaccgccacatgcacggtttcggcagccacaccttcagtttcatcagcccggcgaacgaacgtttctgggtgaagttcacctggaagactcaacaaggcatcgaaaacctgaccgaccaacaggccgcgaccctgatcggcgatgaccgcgaaagcgcccagcgcgacctgtacaacgccatcgaggaaggtcacttcccgcaatggaagctctacgtgcaagtgatgccggagctggatgccgagacttacccgatcaacccgttcgacctgaccaaggtctggccccacgcggattacccgctgatcgaagttggtgtgctcgaactcaaccgtaatccggacaactacttcgccgacgtcgaacaggcggccttcaacccggccaacgtggtgcccggcatcagtttctcaccggacaaaatgctccaggcgcgccttttctcctatggcgatgcccagcgctatcgcgtcggcgtcaaccatcatcagatccccgtgaatgccccacgctgcccggtcaacagttatcaccgggacggccagatgcgcaccgatgcgaacgcgggcagcacaatcgggtacgagcccaacagctatggccagtgggccgagcaaccggatttcagcgagccaccgctggccctgaaaggcagcgccgggcactggaatcaccgtgaggacgacgattacttctcgcaaccgggcgcgctgttccgggccatgtccaccgcccagcaacaggtcttgttcgagaacaccgcgcgctcgatccatggcgccagtgcccagacccggcaacgccacatcgataactgcactcgtgccgatccggcgtacggtgcgggtgttgcacaggccatcgaagcactgggctgatccgcaatg

SEQ ID NO: 37494 - DNA, 1338 bp, Pseudomonas fluorescens
tacatcgatggcgcgttcgtgcccgttcagggccgtgaaacgatcgaatgcatcaacccggcgacggaatccgtcatcggaacggtcaccctggccaatcgcgaggatgccaggcaagccatcgccgccgcccagcgtgcgcaagtcacgatgggccgcacctcgaaagccgagcgcatcgacatgctcaggcgcctgcaggcggcggtgctggagagcaccgaagaaatacgcgacaccgccatcgacgaatacggcgcaccgttggcccgtgcgcaatgggtcagccagtacgcttcgcagtcctttgccaatacagcgcaggtgttggagaaccaccagttggtccggcctgtgggccgtgcaacggtggtcatggaaccggtcggagtgtcggcgttgttcgcgccctggaacagcaccgccggtacggtgtgcagcaaactggcggcggcgattgccggcggttgtgcctcggtcatcaaaccgagtgaactcagtccgttgcagactcaggtgcttgcgctcgccttgcaccgagcggaactgcccaacggggtgatcaatattgtcctgggccgtgggagcgatgtgggcgacgagatcagcaccagcccgcacatcgcgaagatctcgttcaccggctccactgccaccggaaaactcatcgcccgcgccggcatcgagaccatgaagcgggtgagtctttcgctcaccggcaagtcggcatccatcgtgctcgacgacgcggatctcgaaacggccattcccatggccctgaatgccgcgttcatgaacaacggtcaggcctgcgtcgccggcacgcggctgttggtaccgcgcgggtgcttgccgcaggtgatcgaacgggtgaaaaccctggtcgacgcgacagtggtcggcgatccccgggacccggctaccgccatcggcccgttggtcaaccaggcccagtttgatcgcgtgcagggttttatccggcgcggtctggagcagggcgcgcgattgatcgtcggcggggagggcaggcctcacggactgagcaaaggctatttcgtgaagcccacggtgtttgccgacgtcagcaacgacatggacatcgcccgggaagagattttcggcccggtgctgtcgatcatcgcctacgacgacgaggaagacgccatccgcctggccaatgccagcgtctacggtttgcaggcctatgtgtttacccgcgaggtcgaacgtggccgacgcatcgctgcgcgcctggaggccggttcggtgttgatcaaccggatcgcaccggagctgctcgcgccgtttggcggggtcaaacagtcggggatcggcagg

SEQ ID NO: 37495 - DNA, 966 bp, Pseudomonas fluorescens
atcatgaaagcagtagtcatccaggcctttggcgggcctgaagtgttgacggtacacgacattcaactggcagaaccggggcccggacaggtcgtggtcaaggtcatggcggcaggtatcaatttcatggacaccggtgcccgacgcgggctcggtgccgcgtgggagctgcctttgacactgggtgcagaaggcgccggcgtggttctggccagcggcccgcaggtgacggaattcgcggtcggtgcccgcgtggcctggcattacgtaccgggcagctacgccgaacaggtgatcgccccggtcagccagttggtgccgttgccggacgatatcgacttcagcaccgctgccagcctgatgatgcagggcctgactgccagcaatctggtggacaaggtgcatgcgatccagccgggtgacgtggccttcgtgcacgccgcggcggggggcgtggggctgatgctgactcagatgatcaaactgcggggcggcaaagtcattggccgggtgtcccatgccgacaaagtggaggcggtgctcgcggccggggctgactatgtcgtgatcgggcgagcgcaaaacattgccggacaggtcatgcgcctgaccgaggggcagcgggtgaatgtggtgtacgacggcacgggcgcggaaggtttcgccgactcgctggagatgttggactacttcggcaccctggccttgtacggaccgttcatgaatccgacaccgccgatcgatatcttcagcatgccgcgcagcatcaagctgacgtatccctcggtcatgcactacgtgcgcgatcgcgaggtgctgctggaaaaatcccggcaactgttcgcgtgggtcagcaccggcaaactgaaaaccttcatcggcaagcgttattcgctggacgaagcacaacaggcccatattgatatcgagtcgcgcaacacgacgggcaagctgatcatcgtccct

SEQ ID NO: 37496 - DNA, 1446 bp, Pseudomonas fluorescens
ttccatcgactgatgctgcggcagagcctttcgttcttctccgacgagttttccggtcgggtcacgaccaaggtgatgcagacggcgctggccgtgcgcgaggtgctgttcaccgtcatcgaaatcgcaccgggtatcggcgtctatttcattgcgatcatcgccctggccggcggcttcgccctgaaactcatgctgccgttcattgcctgggtcgcgctgttcgggctggcgatgctgtatttcgtaccgcgcctgggccaggtcggccaggaacaggcccatgcgcgctcgtcgatgacgggccgggtgtcggacgcctacaccaacatcaccaccgtcaaactgttctcccactccaaacgtgaagcgcattttgcgcgggcggcgatggaggatttcaagcagaccggtttccgccagatgcgtctggtcagccagttcgagatcgtcaatcaggcgctggtggtcgggctgatcatgggcgccggcggctacgccttgtggctgtggcatcagggcgaagtcggcaccggggcggtggcggcgattacggccatggcgttgcgcatcaacggcatgtcgcactggatcatgtggcagatgacgtcgctgttcgaaaacatcggcacggtgcaggacggcatggacaccctgacccgtggccccaaggtccaggatgcgccggacgccggcgtgctggtgccttccggcggcgccgtggaattcgacaacgtgagcttcaactacaacggcgaacgccaggtgctcgacggcttgagcctgagcatccgaccgggggaaaaaatcggtctggtgggccgctccggcgccggtaaatccacgctgatcaatctgctgctgcgcttctatgacgtggatcgcggcgagattcgcatcgacgggcaaaacatcgcgcaggtgacacaggacagcctgcgcagcgcgatcggcatggtcactcaggacacgtccctgctgcaccgctcgattcgcgacaacatcgcctacggccgaccggacgccaccgacgaacagatccagcgtgctgcggccaacgcccaggccgacggcttcatcaaccagctcagcgaccgccagggccacaccggctacgacaccctggtgggcgagcgcggcatcaagctttccggtggccagcgccagcgcattgccattgcccgggtgatgctcaagaacgcgccgatccttctactggacgaagcgacaagcgccctggattccgaagtcgaagtcgccatccaggaaagcctcgatgaaatgatgcagggcaagaccgtgatcgcgattgcgcatcgactgtcgacgattgcggcgatggatcgactgattgtcatggatgaggggcgcatcatcgagcaaggcacccacaccgaactgctggccaagaacggcacctatgcgcggctttggcagcaccagagt

SEQ ID NO: 37497 - DNA, 1194 bp, Pseudomonas fluorescens
ctggtgtggcaaatcgttgccgggctgttgcttggcgtgctcgttggttggtacttcaacacccatccgcagtatcagtcgtgggtcagtgcggagatcctgaaaccgcttggcgatatcttcatcaagatgatgaagatggtggtcgtgcccatcgtgttgtgttgcatgatcctgggtatcgccggtggcggggataacaagtcgttcggccggatgggcatcaagtcgctgggctatttctttgcgatcaccggcctggccatcgtgatcggcctgtgtttcgcgaacctcttcgaacccggtacgggcaccgatatttcgggcatcgcgcatggtgctaccgccatcacgatggagccttcgaagggcgcgctcgtgattatgcaaaacatcgttccggataacgttctggtggcgatgtccgaggcgaagctgctttcggtcctgttcttcgcggtgttgttcggtgtcgcgctgaacgcattgcccaaggaaaaaagtgcacctgtggttgcgctggtccaaggcatttcggatgcgatgttcaggatcgtctcgatcgtcatggcctatgccccgataggggtgttcggcatgatcggtgcgaccgtcgcgaccttcggttttgcctcgttgttgcccctgctcaagttgattggtgtggtttatctggcgctgatcgtcttcgcattggtagtgctcggaggaatcagttacctgatcggcgagaacatcttcaagttgatcaggtatttccgcgacgagttgattcttgcgttctccagtgctgcctctgcagcggtcatgccgcagttgatgagcaagctggagaactacggcgtaccacggcgcattgtcagttttgtggtgccagtggggtacgcgttcaaccttgatggcgcgtcgatcttcctcggggtggcgacaatctttatcgcccagctttatggaatcgatctgtcgctttctcaggaaatcctgctggtggtgaccatggtgctgacctccaaaggtgctgccggggtgcctggattcgccatcgtcatcctgtcggccacattggcgtctgccggtcttccgctggagggcgtggcactgatcgccggcatcttcaggattatcgacagcggcaccaccaccctgaatgtgttgggcaatgcgatcgcgcccctggtgatcgccaaatgggag

SEQ ID NO: 37498 - DNA, 1296 bp, Pseudomonas fluorescens
gccgtctcctcccggcggctgccgacacgacggcgctggttcatgctctcgctgctgctgattgcgacgatcatcaactacatcgaccgggtgaacatctcgattgccgctccgttcatggccaaggacctgggcctggacaagattgaaatggggctgatcttctccgcctttgcctggacctacgcactggcgctggtgccggccgggtttatcgccgaccgcttcggctcacgttttacctacggggtttcactgatcagttggtcgaccgtcacggtgtttcaaggcttcgccacgggattcgcttcgctgttcggcctgcgtctggccgtcggggcgatggaagcgccggcgtttccggccaacagccgtgcggtgaccgtttggtttccggcgcgggaacggggcatggccagcagcatctacgtctgcgggcaatacctgggcacggcgctgtttaccggtgcactgctgtggctggccacaacctttgactggcgccacgttttctacagtaccggcgcgctcgggatcgtcttcggcgtgctgtggttgtatctgtatcgcgatccgttgaactgcaagaaagtcagcaaggaggagctgaaatacatcgaggccggtggcggactggtcaagagcagtcaggaacgcactcgtttcaactggcggcagatcgccgagctgttcagttaccgtcaggtctgggccatttgcatcggcaagttcgccagcacctcggcgctgtacttcttcctcacctggttcccgacctatctgattgaagaacgccatctgaccacgatcaaggccgggatctttgccgtgatgcccttcgtgggcgcaacggtcggcatcctgctcgccggcatcgtctccgacctgttgatccgtcgtggttattcaatgtctttcgcccggaaactgccgctggtggtcgggtcgatgctgggcatgtcgatcgtgctggtgaacttcaccgactcgaacgtcatctgcatcgccgtgctgaccattgcctttttcgctcagggcatcgcgtcgtcctcgtgggcggcggtgtcggaggtggcgcccaaggaactgatcgggctgaccggcgggatcaccagcctggccgcgaacatcggcggcatcgtcactccgatcgtgatcggcgccatcgtccacgccaccggctcgttcgcctgggcgttctggttcatcggtgccgtggcgctgatcggcaccctctcgtattcgttgctgctcggccgcctgtaccgcatcgagttgaaaacgcgctgaagccag

SEQ ID NO: 37499 - DNA, 678 bp, Pseudomonas fluorescens
aaagtggccctggtgaccggcgccggcagcgggatcggccgttccgtagccctgggcctgctggccgacggttacaccctggtgctggccgggcgccggcccgaccccttgcaggccttggtcgatctggcggccggcgaaggacgcgaagccttggcggtgcccaccgatgtacgcgaccccgccagtgtcgaccagctgtttgcaaccattgccgaggtctacggacgcctggacgtggtcttcaacaacgccggggtcaatgcccctgccgtgccgctggacgaactgaccttcgagcagtggcgaaacgtgatcgacaccaacctcaatggcgttttcctctgtgcccgtggcgcgttcgggctcatgcgccggcaacagccacagggtggccgcatcatcaacaacggttcgatttcggctcacaccccgcgtcctttcagcagcgcgtacaccgccagcaaacacgcggtactgggattgaccaaatcgctggcgctggatggtcgggacttcaatatcgcctgcagccagatcgatatcggcaatgccttgaccgaaatgtcggtacgcatgaccaaaggcgtgcgccaggccaacggcagcatcgccgtggagccgatggtcgacgtcaagcatgtcgccgacgccgtgcgctacatcgccggtctgccc

SEQ ID NO: 37500 - DNA, 1434 bp, Pseudomonas fluorescens
aacaagacgcttacgaccgccagtggcgcacctgtcgccgataaccagaactctcgctcctccggccctcgtggtccgttgttgctcgatgatttccacctgatcgagaagcttgctcacttcaaccgggaaaacattcctgaacgtcgtgtacacgccaagggttcgggcgcatacggcactttcacggtcactcgcgacattacgcagtacaccagcgccaagctgttctctgctgtcggcaagcagacgccgaccttcctgcgtttctccacggtcggtggtgagcgtggttcggccgataccgagcgcgatccgcgtggcttcgccctcaagttctacaccgaagaaggcaactgggacatcgtcggcaacaacacgccggtgttcttcattcgcgatccgctgaaatttcctgactttatccacacccagaaacgcctgccgcaaagcaacctgaaaagcgcgcagatgatgtgggacttctggtcgcattcgcctgaagcgctgcaccaggtcacgatcctgttctccgatcgcggtataccggacggctatcgccacatgcacggcttcggcagtcacacctacagcctcatcagcgctcaaggcgagcgccactgggtgaagtggcactacaagaccaagcaagggatcaagaacctcgcgccggcagacgcggcacgtctggcaggcacagacccggactacgcccagcgcgatctgttcgaagccatcgagcgtggtgacttcccgaaatggagcgtatgcatccagatcatgaccgaagcccaagccgctgcgcactatgagaacccgttcgacgtgaccaagacctggtcgcaaaaggagtttccactgatcgaggtgggtgagttggagctgaaccgtaatccgctcaactactttgccgaagttgagcaagctgcgttcggcccgagcaacatggtgcctggcgtaggtctgtcgccagatcgcatgctgcaaggtcgagtattcgcgtacgccgatgcccaccgctaccgcgtaggcaccaaccaccagcagctgccagttaacgccccgcgcagcccggtgaatacttaccagcgcgacggttctatggcttttggcagcaatggtggcgcggcgcctaactacgagccaaacagctacgtagagtcgccgaaacaagcgccacattatgccgagcctgcgctggccctgagtggtgcggctgatcgctacgatcaccgcgaagacagcgactactacagccacgccggtgcgctgttccgtttgatgagcgacgaacagaaagcgttgctggtcagcaacatcgccggtgcgatggggggtgtttcgagtgatgtgatcgaccgtcagctgcagcatttctacaaggccgatccggcgtacggagaagcaatcgcaaagctgctcaacgtacagctt

SEQ ID NO: 37501 - DNA, 2142 bp, Pseudomonas fluorescens
gtgctcaagaaactgggaatcaaaggtcgcgtattgttgctgaccctgttgccgaccagcctgatggcactggtgctgggcgggtatttcacctggacgcagcagtccgacctgcaaacccaactgatgcagcgcggcgaaatgatcgccgagcaactggctccgctggtggcaccggccatgggccacggcgatgccgaactgctcgagcgcatcgccacccagtccctcgaacagccggacgtgcgcgccgtcacctttctcgcgcccgaccgctcgccccttgcccacgccggcccgaccatgctcaatcaggcgccgagcggcgacagcgcgcacttgctgcgacgcagcggcaacgacgccacgcgctatctgctgccggtcttcggcaaacaccgcaacctcgccggcgaactgatcccgcaagagtccgaccgcctgctcggctgggtcgaactggagctgtcgcacaacggcatgttgttgcgcggctatcgaagcctgttcgccagcctgctgctgattggcgcggggctggccggcgccgccttgctggccttgcgcatgggccgcacgatcaaccgcccgctgagccagatcaaacaggccgtcgcccagctcaaggacggtcacctggaaacccgtctgccgccattgggcagtcaggagctggatgaactggcgtccggcatcaaccgcatggccggcaccctgcaaaacgcccgcgaagaattgcagcacagcgtcgatcaggccaccgaagacgtgcgccagaacctggaaaccatcgagatccagaacatcgaactggacctggcccgcaaggaagcgctggaagcgagccggatcaaatccgaatttctcgccaacatgagccacgagatccgcacaccgctgaacggcattctcggtttcacccacctgttgcagaaaagcgagctgaccccgcgccagctcgactacctgggcaccatcgaaaaatccgccgacagcctgttggggatcatcaacgagatcctcgacttctcgaagatcgaggccggcaagctggtgctcgaccatatcccgttcaacctgcgcgacctgttgcaggacaccctcaccatcctcgcccccgctgcccacgccaagcagctggaactggtgagtctggtgtaccgcgacacgccgctgtcgctggtcggtgatccgctgcgcctcaagcagatcctgacgaatctggtgagcaacgcgatcaagttcacccgcgaaggcaccatcgtcgcccgcgccatgctcgaagaagaaaacgacgacagcgtgcagttgcgcatcagcattcaggacaccggcatcggcctgtcgaaccaggacgtgcgcgcgttgttccaggccttcagccaggccgacaactcgctgtcgcgccaacccggcggtaccggtctggggctggtgatttccaagcgtctgatcgaacagatgggcggcgaaatcggggtcgacagcacgccgggcgaaggttcggagttctggatcagcctgaacctgcccaagacccgcgacgacgccgaagacctgcccgccgcgccattgctcgggcgtcgggtggcggtactggaaaaccatgaactggcgcgtcaggccctgcagcatcaactggaagactgcggcctcgacgtcacgccgttcaataccctggaaagcctgaccaacggcgtcaccggcgcccatcagaccgatcaggccatcgatctggccgtgctcggcatcaccagcaacgacatgccgcccgaacgcctgaaccagcatatctgggatcttgagcacctcggttgccgggtgctggtgttgtgcccgaccaccgagctgacgctctatcacctttcggtgcccaatcctcacagccagctgcaatcgaaaccggcctgcacccgcaaactccgtcgtgcgctgtcggacatggtcaacccgcgccagtcgcgcagcgaaccgggcgaaccgctgtcgagccgcgcgccgaaagtgctgtgtgtcgacgacaacccggccaacctgttgctggttcagaccctgctcgaagacatgggcgccaaggtgctggccgttgaaagcggttacgccgcggtcaaggcggtacagagcgaaagcttcgatctggtg

SEQ ID NO: 37502 - DNA, 1212 bp, Pseudomonas fluorescens
atgcgccgcgtcgttatcactggtctgggcatcgtttcgtgcctgggcaatgacaaagagaccgtctccgctaacctgcgtgcaagccgccctggcatccggttcaacccggaatacgccgaaatgggtctgcgtagccaggtttccggctccatcgacctcaaccttgaagagctgatcgatcgcaagatctatcgcttcgtcggccacgcagcggcttacgcctacctggccatgaaagacgccatcgccgactccggtctgaccgaagagcaagtgtccaacccgcgtaccggcctgatcgcaggttccggcggcgcgtcgaccctgaaccagatggaagcgctggacatcctgcgcgagaaaggcgtcaagcgcgtcggcccataccgtgtaacgcggaccatgagcagcaccgtttcggcttgcctggccacgccgttcaagatcaagggcctgaactactccatcgcttctgcctgcgccaccagtgctcactgcatcggtaccgccatggaacagatccagatgggcaagcaggacatcgtgttcgccggcggcggtgaagaggagcactggagccagtcgttcctgttcgacgcaatgggcgctctgtccagcaagcgtaacgacaccccggaacaagcctcccgcgcctacgacgccgaccgtgacggtttcgtcatcgctggcggtggcggcatggtcgtggtcgaggagctggaacacgctctggcccgtggcgcgaaaatctacgcggaaatccgtggctacggcgcaacgtccgacggctacgacatggtggccccgagcggcgaaggcgcgatccgctgcatgcagcaggcgctgtccaccgtcgataccccgatcgactacctgaacacccacggcacttcgactccggtcggcgacgtcgcggaaatgaaaggtgtgcgtgaagtattcggcgacaaggccccggccatcagctccaccaagagcctgtcgggtcactccctgggcgccgccggcgttcacgaagcgatctactgcatgctgatgatggaaggcaacttcatcgccggttcggccaacatcgacgaactggaccctgaagtggccgatctgccggtgctgaccaagacccgcgagaacgccaccatcaacaccgtgatgagcaacagcttcggcttcggtggcaccaacgccaccctcgtgctgaagcgctgggaa

SEQ ID NO: 37503 - DNA, 1902 bp, Pseudomonas fluorescens
cgttgggacatcaacacccgcacccagttgatcagcctgggccctgcgctgttgctgaccttgctgctgatcagctttttcacctttgtgcgcattcaggatttgcgtcaggagctgaaccacaccggccaactgatcgccaaccagctcgcaccggccaccgagtacggggtgatttccggcaacaacgaagtgctggaaagcctgctcaaggccacgctggccacgccgaacgtgcggtttctggaagtgcaggacagcgccaatcggattctctcttacgtcgaacagccggcggatgcgcacaatcgtccgcatcaggtcgaagtgttccaggcgccggtgcggctgcaacgcatcgccttgcacaacgatttctttcaggacggcaagagcagccccggcgtggccagcgaggactatctgggacgggtgatcgtcggtctgtcgaatgacgcgttcagtcagcgccaacaggaaattttgctcaaggccgggattctcgcgttgttcgccctgctcttcacgttcgtcctggcgcggcggctggccggcagtctgtcgcagccgattcgcgacatcggcaatgcggtcaaggcgattcaggacggcgattacaagaccccactgccgattgtagacgacaccgaactgggcgccctgtcccagcacatcaacaacctggcccaggcgctggaacaggccagccgcgagcagcatcaggcgatggcgcaactgatccagacccgcgaagaggccgagaaagccaacaacgcgaaatcggatttcctggcgatgatgagccatgaactgcgcaccccgatgaacggtgtgctgggcatgctgcaattgctcgaaaccaccgacatgactgaggagcaggtcgagtacgcggcgctggcttccgagtccaccgagcatttgctcaaggtgatcaacgacattctggatttctcgcgcatcgagcgttcggaactggagctggagcacattccgttcaacctcgccgaagtgatcggcgcctgcgcccagtcgttccagcacagcgcggcgcaacgcgggttggccctgcagctgcgaatccccgaagacttgcgcgacttgcaggtccagggcgatccgacgcggatccggcagattctggtcaacctggtcggcaatgccttgaagttcaccgaacagggacgcgtcagcatcgaggcgcagtggcagtcgctggatcacgagttgctgtggttcacctgtgcggtgcgtgacagtggcatcggtatttcgccggagagcctggagctgatgttcaacgcgttccagcaggctgacagttcgatttcccgtcgttatggcggcaccggcctgggcctgccgattgcccgcacgctcgccgaacggatgggcggcaccttgcgcgcccagagtgaagaaggtcgcggctcggtgttcaccctggaaataccactggccctatataagcaggcgctgcccgcgcttgccgcaccgcgcacattgaacggtgcaagtcacggcgaaggccgaaatgtgctgctggtcgaggacaacccggtcaaccagacggtgatcgaagcgatgctgcgcagcctgggctttaccgtcagcgtcgccaccgatggcgtgcaggcggtgcgcagtgccggggacaaccgtttcgaagcgattctgatggattgccgcttgccgctgatcgacggttacgaagcgacccggcggatccggcagctgcccggctgcggccaggtgccgatcatcgccctgaccgccaatgctttacagggcgaccgggaaaactgcctcgcggcgggcatgaacgattacctggccaagccattcaaacacaatgatctgcagcagattctgcagcgatgggtgcagtaacagggccctttc

SEQ ID NO: 37504 - DNA, 1020 bp, Pseudomonas fluorescens
atgactgaacagcgcccgattgcggtcctgggaggcggaagtttcggtaccgccgtggccaatctgttggccgagaacggccatcaagtccggcagtggatgcgtgacccggaacaggccgaggctatccgggtcaatcgcgagaacccgcgttacctcaaaggcatcaagattctgcccggcgtgaccgcggtcaccgacctgcaggaaaccctcgacgcctgcgagttgtgtttcgtcgcgttgccgtccagcgcactgcgcacagtgctggcggcgcatgccgaacgcctgagcggcaagatgctggtcagcctgaccaaaggcatcgaagcgcagaccttcaaactgatgagccagattctcgaagaaatcgccccgcaggcacgcatcggcgtgctgtccgggccgaacctcgcgcgggaaatcgccgagcacgcgctgaccgccaccgtggtcgccagcgaagacgaagaactctgcaaagccgtgcaggctgcattgcatggccgcactttccgcgtctacgccagcgccgaccgtttcggcgtggagctgggcggcgcactgaaaaacgtctacgcgatcatcgccggcatggcggtggcgctggaaatgggcgagaacaccaagagcatgctgatcacccgcgccctggccgaaatgacccggtttgcggtgaatcagggcgccaacccgatgaccttcctcggtctggccggtgtcggcgatctgatcgttacctgctcgtcgccgaaaagccgcaactaccaggtcggtttcgccctcggtcagggcttgagcctcgacgaagcggtgtcgcgcctgggtgaagtggccgaaggcgtcaacaccctgaaagtgctcaaggccaaggcccaggaggtcggcgtgtacatgccgctggtcgccggactgcatgcaatcctgttcgaagggcgcacgcttgagcaggtgatcggtctgctgatgcgtgccgaaccgaaaaccgatgtcgactttatttccaccagtggtttc

SEQ ID NO: 37505 - DNA, 1632 bp, Pseudomonas fluorescens
ccgctggacgtgttttacgaacgcgaggcccggcacccgcgtcagcgttttctggtgcagccgatcggcggcgggcaggtcgagacactgacctgggccgacgtcggccatcaggctcgctgcgcggcgcactggctgcgatcccgggaattgccgcaaggcagccacatcgccctgatctcgaaaaactgcgcgcactggatcatcgccgatctggcgatctggatggccgggcacgtttcggtgccgctctatccgaacctcaccgccgaatcggtgaatcaggtgctgacccactcggaaagcgtgctggcgttcatcggcaaactcgatgactggccgggtatgtcgccaggcgtgccggcgggcctgaccaccgtcagcctgccgctgcacccaccgggcacgttcgatttcaactgggatgacctgcaacgcagctcgccgatccaggacgatccacgtcccgccgccgagcaactggcgacgattatttacacctccggcaccaccggcctgcccaagggcgtgatgcacagcttcgccaatctcggattcgcgacgacgcgcggtacgcagctgttcggcctcaatgagaacgaccggctgctgtcgtatttgccgctgtgccatgtggccgagcggatgttcgtcgaactggcgtcgatctacaccgggcagacggtgtttttcgccgagagcctcgacaccttcctcgccgatctcaagcgggcgcgaccaacggcgatgttcggtgtgccgcggatctggaccaagttccagatgggtgtctacagcaagatcccggcgaaacgtctggatttcctgctcggtctgcccttcatcggcaagcgggtcggtcacaaggtgttggcggggttggggctggatgccttgcgcgtagcgctgtctggcgcggcgccggtgccgctgaccttgttgcgctggtatcagaaactcgggctcgacgtgctggaggtctacggcatgaccgaaagctgcggttattcgcacatctgcctgccggggcaatacaaggaaggctggatcggccggccgtgccccgaagttgaagtgcggatcgacgagtccggcgaagtgcaggtgcgcagccaggcgaacatgctcggctatttcaaggaaccgcagaaaaccgccgaaactctcactgaagacggcttcctgcgcactggcgacaagggcgagcaggacgccgaagggcgcttgcgcctgaccgggcggctcaaggaaatcttcaagaccagcaagggcaaatacgtcgccccggcgccgatcgaaaaccggctggcggtgcattcgcggatcgaacaggtctgtgtggtcggtgatggcctgagtgcaccgctggggttgtgcgttctttccgccgtgggccgggaagagccccgcgcgccgctgcattcgagcctggaaaaactgctggaggaggtcaacgccgtgctcgacaaacacgagcgtttgcgccggctggtggtggtcaaggacagctgggcggtggagaacggcttcctcacgccgaccctgaaaatcaaacgcaacatcatcgaagacacctacggagcacgcttcgaagaatggagcgagcgcagcgaggcggtgctgtggcaggat

SEQ ID NO: 37506 - DNA, 756 bp, Pseudomonas fluorescens
ggtcaggtagccgtcgtcaccggcgcggccaacggcatcggccgcgcgacggcccaggcgttcgccgccgaaggtctgaaagtggtggtggccgatctggatgcggccgggggcgagggcaccgtggcgctgattcgtacagccggcggcgaagcgaccttcgtgcgctgcaacgtgaccgtcgaaagcgaagtgaagaatctgatggacgaggtgatcaatacctacggccgtctcgactatgccttcaacaatgccgggatcgaaatcgagaagggcaaactggccgaaggctcgatggatgagttcgacgcgatcatgggcgtcaacgtcaagggcgtgtggctgtgcatgaagtaccagctgccgttgctgctggctcagggcggcggggcgatcgtcaacactgcatcggtggctggattgggcgctgcgccgaagatgagcatctatgccgcctccaagcacgcggtaatcggtctgaccaagtccgccgccatcgaatacgccaagaagaaaatccgcgtcaacgccgtatgcccggcggtgatcgataccgacatgttccgtcgcgcctatgaagcggatccgaagaaaggcgaatttgccaacgcgatgcacccggtcggccgtatcggcaaggtcgaggaaattgccagcgccgtgctgtacctgtgcagtgatggtgcggcgtttaccaccggccattcgctggcggtggatggtggcgtgactgccttctaaggtggcgtcggc

SEQ ID NO: 37507 - DNA, 897 bp, Pseudomonas fluorescens
agttccgctctgtccatccggcagctaaccaaaacctacggcaacgggttccaggccttgagtggtatcgatctggacgtcgccgaaggtgacttcttcgcattgctcggccccaacggcgccggcaaatccacgaccatcggcattctctcgaccctggtcaacaagaccagcggcaccgtgaacatcttcggccacgacctggacaagaacccggcggcgctcaagcgctccatcggcgtggtgccccaggagttcaacttcaaccagttcgaaaagactttcgacatcgtcgtgacccaggccggttactacggcattccggcaaggatcgccaaggagcgcgccgagcaatacctgacccagctcggcctgtgggacaagcgcgatgtgccgtcacgttcgctgtccggcggcatgaagcgtcgcttgatgatcgcgcgggcgctggtgcatgaaccgcgtctgctgatcctcgacgagccgactgccggcgtcgacatcgaactgcgtcgctcgatgtggacgttcctcaccgaactgaaccagaaaggcatcaccatcatcctcaccacgcactatctggaagaggctgagcagttgtgccgcaacatcggcatcatcgaccacggcaccattgtcgagaacaccagcatgcgtcagctgctcggtcagttgcatgtggagaccttcctgctggacctgaagaacgacctgagcgccgcgccgcaactggcgggttatccagcgcgtctgctggacggccacaccctggaagtccaggtcgacaagtccgtgggcattaccgcgctgttcggccaactggccctgcagaatatcgaagtgctgagcctgcgcaataaaaccaatcgcctcgaggagctgttcgtgtccctg

SEQ ID NO: 37508 - DNA, 882 bp, Pseudomonas fluorescens
ctcatgtccaacattcacggcatcatcggctacaccatcaccccgttcggcgccaacggcgaaggcgttgacctgccggccctcggccgctccatcgaccgtctgatcgccggcggcgtccacgccattgcgccactgggcagcaccggcgaaggcgcctacctgagcgatgcggagtgggatcaggtcgccgagttcagcatcaagcacgtggccaaacgcgtgccgaccgtggtcagcgtgtccgacctgaccaccgccaaagcggtacgccgcgcacgctttgccgaagcccatggcgccgacgtggtgatggtgttgccgacgtcctactggaagctcaccgaagcggaaatcctcgcccactaccgcgccatcggcgacagcatcggcgtgccgatcatgctctacaacaacccggccaccagcggcaccgacatgtcggtggagctgatcctgcgcatcgtcaacggcgtggagaacgtgaccatggtcaaggagagcaccggcgacatccagcgcatgcacaagttgcaactgctcggcgaaggccgggtgccgttctacaacggttgcaacccgctggcgctggaggcgttcgccgccggggccaagggttggtgcacggcagcgccgaacctgatcccgcagctcaacctggatttgtacgaagccacactggcgggggatctcggcaaggcgcgggagctgttctaccgccagttgccgctgctggacttcatcctcaagggcggcttgccggcgacgatcaaggccggtctgcgactgaccggtctggaagtcggcgatccgcgtttgccggtgttcccgctggctgaggccgggcgtacgcaattgcaggccttgctgtacaccttgcgc

SEQ ID NO: 37509 - DNA, 1140 bp, Pseudomonas fluorescens
agcagcacctttttcattcccgcggtaaacatcatgggcagcggctgcctcgatgaagccatgaatgcgatccgcaactacggttttcgcaaggcgctgatcgtcaccgatgccgggctggccaaggccggcgtggcgacgatgattgccgagaaactggcgatgcaggacatcgattcggtggtcttcgatggcgccaaacccaatccgagcatcgccaacgttgaggcggggctggcgctgctcaaggagagtcgctgcgacttcgtggtgtcgttgggcggcggttcgccccacgactgcgccaagggcattgcgttgtgtgccaccaacggcgggcagatccgcgactacgaaggcgtcgatcaatcgaccaagccacaactgccgctgatcgccatcaacaccaccgccggcaccgccagcgagatgacccggttctgcatcatcaccgacgaaacccgtcacgtgaaaatggccatcgtcgaccgcaacgtcacgccgctgctgtcggtcaacgacccggcgctgatggtcgccatgccgaaaagcctgaccgccgccactggcatggacgcgctgacccatgcaatcgaagcctatgtgtccaccgccgccaacccgatcaccgacgcctgcgcgctcaaggccatgaccctgatcagcaacaacctgcgcctggtcgtgcgcgacggcagcgacctggcggcgcgggaaaacatggcgtatgcgcagttcctcgccggcatggcgttcaacaatgcctccctcggttacgtgcatgcgatggcgcaccagttgggcggtttctatgacttgccccacggtgtttgcaacgcggtgctgctgccccatgtgcagacgttcaacgcacaggtctgtgccggtcgcctgaccgatgtggcccacgccatgggcgccgacattcgtggcttcagcccggaggagggcgcgcaggccgcgattgccgcgatccgttgcctggccagggacgtggagattcccggtggcctgcgtgatctcggcgccaagtgcaccgacatcccggtgctcgccgccaacgccctgaaagacgcctgcggcttcaccaatccgcgagtggcggatcagcggcagatcgaggagattttccgcagcgcg

SEQ ID NO: 37510 - DNA, 867 bp, Pseudomonas fluorescens
tactcgcagaccctgatcgtccaggaagtctcgccccgggacggcctgcagatcgagccgacctgggtcgagaccgaagacaagatcgccctgatcgatcaactgtcccgggcaggattcagccgcatcgaggccggctcgttcgtctcgcccaaagcgatcccggccctgcgcgatggcgagcaggtgttcaagggcatccagcgccagccgggggtgatttacgtcgcgctgattcccaacctcaagggggcgcaacgggcactggagtccggcgctgatgaactgaacctggtgatgtccgccagccagacccacaacctggcgaacatgcgcatgcgttgcgaagcctcgctggtggcgttcggcgaaatcgtgaccttcgccagcggctcgggcgtgcggctcaacggcagtatcgcaacgactttcggttgtccgtttgagggcaggatcgacgaagaccgcgtgctgcaaatcctcgaggcctatcaacagctcggcattcagggcatctccctggccgacaccaccggcatggccaatccgcgacaggtcgaccgactggtgcggcgggtgttgcagcgggtttcggcggcggatctgactctgcactttcacaacacccgaggcctgggattgtgcaacgtgctggcagcttacgaagcgggcgcccggcgtttcgacgcggcgctgggcgggctcggcggctgtccgttcgcgcccggcgcatcgggcaacatctgcaccgaagacctggtcaacctctgcgatgaagtcggcattcacaccggcatcgatctgccgttgctgctgaaactatcccgtggcttgccagcgctgctgggccacgacgtgccggggcaa

SEQ ID NO: 37511 - DNA, 1323 bp, Pseudomonas fluorescens
ttcgaaaaagtcctgattgccaaccgtggcgcgattgcctgccgcattctgcgcaccttgcgtgaactgcacgtcgaaggcgtcgcggtgtactccgaagccgatgccgccagcctgcacatcctgcaagcggacgaagcccacagcctcggtgaaggcgccgcggccagcacctatctggccgtggacaagattctcgccatcgccaaagccactggcgccaccgcgatccatccgggctacggctttctttccgagaacgcggcgttcgccgaagcctgcgccaaccatggcattgccttcatcggcccgacaccggagcaactgcgggtgttcggcctcaagcacaccgcacgggccctggccaaacagcacggcgtgccaatgctcgaaggcaccgaactgctcgacagcctcgacgccgcgctgattgccggcgcgcaggtcggttatccggtgatgctcaaaagcaccgccgggggcggtggcatcggcatgcgcgtgtgccgtaacgccagcgaactgagcgagtcgttcgaggcggtgaagcgcctcggccagaacaacttcagcgacgccggagtgttcatcgagaagtacatccagcgtgcgcggcatctggaagtccaggtgttcggcgacggccaaggcgcagtgatcgccctcggcgtgcgcgactgctcggtgcagcggcgcaatcagaaagtccttgaggaaaccccggcaccgaacctgcccgatggcatggcggatgagctgtgcgcggcggcgatcaaactggccaaagcagtgaattaccgcagcgccggcaccgtcgaattcgttttcgacagcgatgcgcagcgcttctattttctggaagtgaacacccggttgcaggttgagcacggcgttaccgaacaggtgtggggcgtcgatctggtgcgctggatgattgaactggcggcgggagatctgccgccgctgagcacattgtttgagggcctgaaaccggacggccacgcgattcaggcgcggctgtacgcggaggatccggggcgcgatttccagccgagcccagggctgctgaccgctgtggagtttcctgcggccaacggcattcaactgcgcatcgacacctgggtcgaggctggctgcgagatcccgccctacttcgatccgatgatcgccaaactcatcagctgggcgccaacccgcgaacaggcccgcgccgaactgcaccaggccctcggcgacagcctgctgtacggcgtggaaaccaaccgcgactacctgcggcagattctgctcgatacaccgttcgccagcggtcagccctggacc

SEQ ID NO: 37512 - DNA, 2037 bp, Pseudomonas fluorescens
ttgctcaatatcgggatgtcggggttggccgcgagttcatcctctctggctgtgacgggcaacaacattgccaacgtcgacaccgccggttattcacgccagcaaaccgtgcagggcaccaagtcctcgattcagtacggtaacgtgttcatcggtaccggtacgactctggccgacgtgcgccgggtgtacaactcctacctcgaatcgcagctgcgtaccgccacgtcgctcaatagcgaagccgccgccttcggtgcgcaggcgaccgcgctggacggctcgctgtccgacaccaacactggcctgaccggtgtgctgcagaaattcttcacctcgatgcaaggcgtgtcgacctcggccaccgacgacacttcccgccagtcggtgctgaccggcgcccaggccctgaccagtcgcttcaatgcgctggccaagcagatgaacgatcagaacgccacgctcaatggcaacctgtccgacatggcgtcccaggtgaacaaactggcaacctcgattgccacgctgaaccagaagatcggcgagatctccaccagcggcggccagccgaacgatctgctcgacagccgtaacgaagccgtgcgtcaactctccgagctgaccggcgcgcaagtcgttgagcgtggcaccagcttcgacatctacatcggcagcggccagccgttggtcatcggcaataccaccaataccctgagcaccgtgccgctcaagggtgacccatcgcgcatgggcatccagatggatcgtggttcgagcaccatcgacatcacctcggcgatgaccggtggtgaaatcggcggtctgctgacttatcgcaaggaagtgctcgatcctgcactcaacgagctgggccgtgtggcactggtcgttgccgaccagatcaaccgccagcaagcccagggcatcgacaagaacggtgactttggcgcggccattttcaacaacatcaacagtgccgccctgatcagtcagcgcagcatcgcccagtccggcaacagtgcaggttcgggcaatcttgatgtcaccatcaaggacaccggcaagctgaccaccagcgactatcaggtcaccttcaccagcgcgaccaactacacggtcaagcgctccgacggcaccgacatgggttcgttcagcaccacgaccacgccgcctccggtaatcgacggctttaccctggcccttaacggtggtgcgctgagcgccggcgatacgttcaaggtcaccccgacccgcaacgcggcgtccagcattcagaccgtgcttaccgacccgaagaaaatcgccgccgccggaccattgaccggcgtggccagtgccaacaactcaggcacctacactcagccgacgctgactgacgtcgtcgatatctacaacccggcgtcccaggcagagttgcagaacgcgctcaagtattcgaccccggtcaaactggtattcggtgccaccaccagcggcagccagacttacaacatggttgatgccaagggggccacgatcggttccggcgtcatcgttcccggtcaggcgaacaccctgaacctgaagatcggcatggtcgactccaccggtgctccggtgatggacaccaccgtcatcccgaacgtgcaaaagaccttcaccgtgcagaccactgtgggcgcgacgccgaagtccggcgaaaccttcaccatcaacctgaccggcgcggcctcttcggacaaccgcaacgcccaggcactggtcggtttgcagaccaaacagaccgttgacaccggcacggcgagcaagggcatcagcctgaccgacgcttacaacaaactggtaaccaacgtcggtacccaggctgcccagagcaaatccgacagcgcagccaccacggtgatcctggatcaggcccagggtgcacgggactcgctgtcccaggtcaacctggatgaagagaccggcaacctggtcaagtatcagcagtactacacagcgtcttcgcagatcatcaaagctgcgcaggaaaccttcgccacgctgatcaacagcctt

SEQ ID NO: 37513 - DNA, 837 bp, Pseudomonas fluorescens
tttagccagaaggccgcaatgcgcaaaaagcagcgcgcagccctgtgacgaacgagaggggagaccatgaaggcagttattttggcgggtggcctgggcacgcgcatcagtgaagagtcgcacctcaagccgaaaccgatgatcgagatcggtggcaagccaattctctggcacatcatgaaacagtattccgcccacgggattcatgacttcgtgatttgccttggctacaagggctacgcgatcaaggacttcttcgccaactacttcctgcacacctccgacgtgacgttcgacatgcgtgaaaatcgcatggacgttcaccagaactacagcgaaccgtggcgcgtgacgctgatcgacaccggcgaggaaaccatgaccggtggtcgtctgcgccgcgccgcacgctatctggaaaacgaacaagccttctgcttcacctatggcgacggcgtctccgacctgaatatcagctcgctggtggatttccacctgactcacggcaagttggcgacagtcaccgccgtacaaccgccgggccgctatggcgcgctggatcgtgacggcgaccgggttctcggtttcacggaaaaaccgcgcggtgacggtggctggatcaacggtggtttctttgtgctctcgcccaaggttttgccgctgatcgaaggcgacgaaacctcgtgggagtccggcccgctcgacggtctggccgagcgcggcgagttgatggcgtaccagcacgaaggcttctggcagccaatggacaccttgcgtgacaagaaccacctcgaagccttgtggcagagcggggaggccccatggaagcaatgggac

SEQ ID NO: 37514 - DNA, 1041 bp, Pseudomonas fluorescens
ttctggcgcggcaagcgggttctggtcaccggccacaccggtttcaagggcagctggctgaccctgtggctgcaaagcctcggcgcgcaagtcagcggtttttccctcgatccgtcgaccgagccgagcctgttcgaactggcgcgcgtgagcgaaggcatcaacgaccagcgcggcgacctgcgtgacctcggcgccttgctcgagatcatcgctgacaccgagcctgagatcgtcctgcacctggcggcccagccgctggtgcgtgaaggttatcgcgatccgctggggacttattccagcaacgtcatgggcaccctcaatctgctcgaagcgattcgtcaggtcggttgcgtgcgggcctgcgtgctggtgaccaccgacaaggtctacgccaacaaggaatggctgtggccgtaccgcgaggacgaagccctcggtggtcacgatccttacagcagcagcaaggcctgctgcgagttgctggcgcagtcttacgcggcatcgttcttcccggccgacaagtacgccgagcatggtctggccctggccaccgcgcgcgccggcaacgtgttgggtggtggcgacttcgccccagaacggctgattcccgatgtactgaaagcctggtcggccgacgagccggtgaccttgcgttacccgcaagccgtgcgcccgtggcagcacgcgctggagccgctggccggctatctgcaactggccgccgggctctacgaacaaggcccggagtacgccggcgcgtggaacttcggtccgggcgaggcggacatgtgcagcgtcggtgaagtggtcgaactgctctccaaccgctggcctcaggcccgtgggctgcgcctcgaaaagagcgacctgcacgaagccggtctgctgcgcctggacagcagccgcgcccgtcaggtgctcggctggcaaccgcgctggacgttgcagcaatgcctgacccagaccctcgactggcacctggcgtggcagaacggcgacgacatgcgcaccgtgaccctcggccaactgaacctgtac

SEQ ID NO: 37515 - DNA, 891 bp, Pseudomonas fluorescens
agctacgttcctgtagccggcgtggataactacgcacaaggtgcgaaattcgagaaggatgaagagttcatccttggcaagatcggttcggccttcctgccgcgcaaagacgcggaacaggagacctccgatctgtgcgttgaagcggccaatgcgttgtttgccagcaatccggatctgaaacgcgagtccatcgacgcactgatcgtcgtcacccagaacggtgacgaagaaggcctgccgcacaccgcagccatcgttcaggacaagcttggtctgccaaccaacgtggccgcgttcgacatttccctggggtgctccggttacgtctacggcatctatgcgatcaaaggtttcatggaagctgccggcctcaagaacggcctgctgatcaccgctgacccgtattcgaagatcgttgacccggaagaccgcaacaccaccatgctgtttggcgacgctgctaccgccacctggatgggcgaagacccggtctgggcgctgggcaaggccaagttcggcaccgacggttccggcgcaccgcacctgaaagtcaccgatggcgtgttcttcatgaacggccgtcaggtgttcaacttcgcgctgctcaaggtgccggcccacctgcacgaactgctcgacgattccggtctcaaggccgatgacatcgatgccttctgcattcaccagggcagtgcggcgattgtcgacgccgtggcgcggcgcttcgaaggcgagccggagaagttcatcaaggacatggtcgagaccggcaacaccgtgtcgtccagtgtgccgctgctgctggaaaaacacgtgatggattccgactggaatcgcattgcaatcagtggtttcggtgtcggtttgtcatgggggtcggcgattatt

SEQ ID NO: 37516 - DNA, 1341 bp, Pseudomonas fluorescens
atgcgccttgaacgcaccagcttcgccaagcgcctgagcacttacgccgaggccaccgaaatcgccggtgcgccgatcctcgaagggcgccttttgcgcatggtcggcttgacgctggaagccgaaggcctgcgcgccgccatgggcacccgctgcatggtgatcaacgacgacacctaccacccgtcccaggtggaagccgaagtcatgggcttctccggcagcaaggtatttctgatgccggtcggcagcgtggccggcattgccccgggcgcccgcgtggtaccgctggccgataccggccgcctgccgatgggcatgagcatgctcggtcgtgtgctggacggcgccggacgtgcgctggacggcaagggcggcatgaaggccgaagactgggtgccgatggacggcccgaccatcaacccgctcaatcgtgacccgatcagcgtgccgctggatgtcggcattcgtagcatcaacggtttgttgacggtcggtcgtggtcagcgtctgggtctgttcgccggtaccggtgtcggtaagtcggtgttgctgggcatgatgacccgcttcaccgaggccgacatcatcgtcgtcggcctgatcggcgagcggggtcgtgaggttaaggaattcatcgagcacatcctcggtgaagaaggcctcaagcgctccgtggtggtcgcgtcgccggcggacgatgcgccgctgatgcgtctgcgtgcggcgatgtactgcacgcggatcgccgagtatttccgcgacaagggcaagaacgtcctgttgctgatggattccctgacccgtttcgcccaggcccagcgggaaatcgccctggccatcggtgagccgccggcgaccaagggttatccgccgtcggtattcgccaaactgccgaaactggtggagcgtgccggtaacgcggagaagggcgggggttcgatcaccgcgttctacaccgtattgtccgaaggcgatgaccagcaggatccgatcgccgactccgcgcggggggtactcgacgggcatatcgtgctgtcgcggcggctggccgaggagggtcattacccggccatcgacatcgaagcctcaatcagccgggtgatgccggcagtcgtggcgccggaacacatgcagcgcgctcaatacttcaaacagctgtggtcgcgctatcagcagagccgcgacctgatcagcgtcggcgcctatgtcgctggcggtgaccgcgagactgaccttgccatcaatctgcaaccacaactggtcagatacctgcgtcaggggctcaacgacaaaatcagcctgggtgaaagcgaggcgtacctcgaaacgattttcgcc

SEQ ID NO: 37517 - DNA, 2172 bp, Pseudomonas fluorescens
gatctctcccttctgctgaactccctcaacgatgcccaacgccaggccgtagcggctcccgttggtcgtcaattggtcctggccggtgccggctccggcaaaacccgagtgctggtgcaccgtatcgcctggttgatccaggtcgagaacgcctcgccccactcgattctgtcggtgaccttcaccaacaaggccgctgccgagatgcgtcaccgcatcgaacaattgctgggcatcaatccggccggcatgtgggtcggcaccttccacggcctggcgcaccgcctgctgcgggcgcactggcaggaagccgggctgagccagaccttccagattctcgacagcgacgaccagcaacgcttggtcaagcgggtgatccgcgagctggggctggacgagcaacgctggccggcccgtcaggcccaatggttcatcaacgggcagaaagacgaaggtctgcgtccgcaacacattcaagccagcggcgatctgttcctggccaccatgcgcggcatttatgaagcgtacgaggccgcatgccagcgtgccggcgtcatcgatttctccgaactgctgctgcgcgccctcgacctgtggcgcgaccacccgggcctgctggcgcactaccagaagcgcttccgacacattctggtggacgaattccaggacaccaacgccgtgcagtacgcctggttgcgtctgctgggcaagggcggcgacagcctgatggtggtcggcgacgacgaccagtcgatctacggctggcgcggcgcgaaaatcgagaacatccaccagtattcttcggacttcccggactcggtgaccatccgtctggagcagaactaccgctccacggccggcatcctcaaggccgccaacgccctgatcgccaacaacaccgggcgtctgggcaaagagctgtggaccgatggcggcgatggcgaagcgatcaatctttacgccgccttcaacgagcacgatgaagcacgctacgttgtcgaaaccatcgaaagcgcgctgaaaaccggcttggcccgcagcgatatcgcgattctctaccgctccaacgcccaatcgcgcgttctggaagaagccttgctgcgtgaacgcattccgtaccgcatctatggcggccagcgcttcttcgagcgggcggaaatcaagaacgccatggcttacctgcgtttgctggaaggtcgcggcaatgatgcggccctggagcgggtgatcaacgtcccagcgcgcggcatcggcgagaaaaccgtcgaagcgatccgcgaccatgcccgtcacagcgatgtgtcgatgtgggaagccatgggccagctggtggccaacaaaggcctgaccggtcgcgccgccggtgcgctgggcgcgtttatcgaactgatcgaaaacctggctgccaagtgcgccgagatgccgttgcacctgatgacccagaccgtcatcgagcaatccggactgatcgcctaccacgaagcggaaaaaggcgagaaaggccaggcccgggtggaaaaccttgaggaactggtcagcgctgcgcgcaacttcgagaacaccgaagaagacgaagaactgacgccactggcggcatttctcggccacgcttcactggaggccggtgacacccaggccgacgagcacgaagacagcattcagttgatgaccctgcacagcgccaagggcctggaattcccttacgtgttcctggtgggcatggaagaaggcttgttcccgcacaagatgagcctggaagagccgggacgccttgaggaagaacggcgcctggcctatgtcggcattacccgggcgatgcagaatctggtgatgacctatgctgaaacccgacgcctgtacggcagcgaaacctacaacaaggtgtcgcgtttcgtacgggaagtaccgaaaggcctgattcaggaagtacgcctgtccaacagcgtcagccggccgttcggcggtaaccagtcgatgggcggcagcaacctgttcagcggcagcgagattccggaaaccggcctgagccttggccaggctgtccgtcactcgatcttcggcgacggcgtgatcctcaacttcgaaggcgccggcgcccaggcccgggtgcaggtgaatttcgccgaaggcagcaagtggctgatgctcgggtacgcgaagctggaagccata

SEQ ID NO: 37518 - DNA, 3230 bp, Pseudomonas fluorescens
ataacaaagatcctgatcgccaaccgtggtgagattgccgtacgaatcgtgcgtgcctgcgccgagatgggcatccgctcggtcgcgatctactccgacgccgaccggcatgccttgcatgtgaagcgtgcggacgaggcccacagcattggtgccgagccgctggccggttacctgaacccgcgcaagctggtgaacctggccgtggaaaccggttgcgatgcgctgcaccccggctacggtttcctctcggaaaacgccgagctggcagacatctgcgccgaacgcgggatcaaattcatcggcccgtcggcggaagtcatccgccgcatgggcgacaagaccgaagcgcgccgcagcatgatcaaggccggcgtgccggtcacgccgggcaccgaaggcaacgtctccggcatcgaggaagcattgagcgagggcgaccgcatcggttacccggtgatgctcaaggccacttccggtggtggcggtcgcggtatccgtcgctgcaacagccgcgaagaactcgaacagaacttccctcgcgtcatttccgaagccaccaaggccttcggttcggcggaagtgttcctggaaaaatgcatcgtcaatcccaagcacatcgaagcgcagatactcggcgacagcttcggcaacgtcgtgcatctgttcgaacgtgactgctcgatccagcgccgtaaccagaagctgatcgaaatcgccccgagcccgcagctgaccccggaacagcgcgcctacatcggcgacctgtcggtgcgtgcggccaaggccgtgggttacgagaacgccggcaccgtggagtttttgctcgccgagggcgaggtgtacttcatggagatgaatacccgggtgcaggtggaacacaccatcaccgaagaaatcaccgggatcgacatcgtccgcgaacagatccgcatcgcctccgggctgccgctgtcggtgaagcaggaggacatccagcatcgcggttttgccctgcaattccggatcaacgccgaagacccgaagaacaacttcctgccgagcttcggcaagatcacccgttactacgcccccggcggacctggcgtgcgtaccgacacggcgatctacaccggctacaccattccgccgttctacgactcgatgtgcctgaaactggtggtctgggcactgacctgggaagaggcgatggaccgtggtctgcgcgccctcgacgacatgcgcctgcaaggcgtgaagaccaccgccgcgtactaccaggaaatcctgcgcaacccggaattccgtagcggccagttcaataccagcttcgtcgaaagccaccccgaactgaccaactactcgatcaagcgcaaacccgaagagctggccctggccatcgccgccgccatcgccgcccacgcaggcctgtgaggaatagaacaatgactaaaaagattttcgtaaccgacaccatcctgcgcgacgcccaccaatcgctgctcgccacccgcatgcgcaccgaagacatgctgccgatctgcgacaagctcgacaaagtcggctactggtcgctggaatgctggggcggcgcgaccttcgacgcctgcgtgcgtttcctgaaagaagacccgtgggagcgtctgcgccaactgcgcgccgcgctgcccaacacccgtctacaaatgctcctgcgcgggcagaacctgctgggctaccgccactacagcgatgacgtggtgaaggcgttcgtcgccaaggccgcggtcaacggcatcgacgtgttccgcatcttcgacgcgatgaacgatgtgcgtaacctgcgcgtggcgatcgaagcggtgaaagctgccggcaaacacgcccagggcaccatcgcttacaccaccagtccggtgcacaccatcgacgcgttcgttgcccaggccaagcaaatggaagccatgggttgcgactcggtggcgatcaaggacatggccggtctgctgaccccgtacgcgaccggtgagctggtgcgtgcactgaaagccgagcagtcgctgccagtgttcatccactctcacgacaccgccggcctggcagcgatgtgccagctcaaggccattgaaaacggtgccgaccacatcgacaccgcgatctccagcttcgcgtcgggcaccagtcaccctggcaccgaatcgatggttgctgcgctgaaaggcaccgagttcgacaccggtttgaatctggagctgctgcaagagattggcctgtacttctacgccgtgcgcaagaagtaccaccagttcgaaagcgaattcaccgccgtcgatacccgtgttcaagtcaaccaggtgccgggcgggatgatttccaacctggccaaccagttgaaagagcagggcgctctgaaccgcatgggcgaagtgctggcggagatcccgcgcgtacgtgaagacctcggcttcccgccgctggtgaccccgacttcgcagatcgtcggcacccaggcgttcttcaacgtgttggccggcgagcgctacaagaccatcaccaacgaagtgaagctttacctgcaaggcggctacggcaaggcgccgggcactgtgaacgagaagctgcgtcgtcaggccattggcagcgaagaggtgatcgacgtacgcccggccgatctgctcaagccggaaatgaccaagctgcgtgccgatatcggcgcattggccaagtccgaagaagacgtgctcaccttcgccatgttcccggacatcggccgcaagttcctcgaagagcgtgccgccggcactctcaccccggaagtgctgctgccgatcccggaagcgggcaaggtggcttcggccggcggcgaaggcgtaccgaccgagttcgtcatcgacgttcacggcgagacctaccgtgtggacatcaccggtgtcggcgtcaaggctgaaggcaagcgtcacttctacctgtccatcgacggcatgccggaagaagtggtgttcgagccgctcaacgaattcgtcggcggcggcagcagcaagcgcaagcaggcttcggcaccgggccacgtcagcaccaccatgccgggcaacatcgtcgatgtgctggtcaaggaaggcgacaccgtcaaggcgggccaggccgtgctgatcaccgaagcgatgaagatggagaccgaagtccaggccgcgattgccggcaaggtcaccgccatccacgttgccaagggcgaccgggtcaacccgggcgaaatcctgatcgagatcgaaggc

SEQ ID NO: 37519 - DNA, 1434 bp, Pseudomonas fluorescens
atgatttctatcatgtcctccgctgcatcattccgcacagaaaacgacctgcttggcaccctcgaagtccctgctcaagcgtattacggcatccagaccctgcgagcggtgaacaacttccgtctctccggcgttccgatttcgcactacccgaagctggttgtcggtctggcgatggtcaaacaggctgccgctgacgccaaccgcgagctgggtcacctgagcgaagccaagcacgctgccatcagcgaagcctgtgcccgtctgatccgcggcgatttccacgaagagttcgtggtcgacatgattcaaggtggcgccggtacctccaccaacatgaacgccaacgaagtgatcgccaacatcgcgctggaagcgatgggtcaccagaaaggcgaataccagtacctgcacccgaacgacgacgtgaacatggcgcagtcgaccaacgacgcctatccgaccgcgatccgtctgggtctgctgctgggtcacgacgcgctgctggccagcctcgacagcctgattcaggcgttcgcggccaagggtgaagaattcaatcacgtcctgaagatgggccgtacccaactgcaagacgccgtaccgatgaccctgggtcaggaattccgtgctttcgccaccaccatgggcgaagacctggcccgtctgaagacgctggccccggaactgctgactgaagtgaacctgggcggcaccgcgatcggtaccggcatcaacgctgacccgcgttaccaggccctggccgtacagcgtctggcgctgatcagcggtcaaccgctggttccagccgccgacctgatcgaagccacctccgacatgggcgcctttgtactgttctctggcatgctcaagcgcaccgcggtcaaactgtcgaagatctgcaacgacctgcgcctgctgtccagcggcccgcgcaccggcatcaacgaaatcaacctgccggcgcgtcagccaggcagctcgatcatgccaggcaaggtcaacccggtaatcccggaagccgtgaaccaggtggcattccaagtcatcggtaacgatctggcgctgaccatggcagccgaaggcggccaactgcagctgaacgtgatggagccgctgatcgccttcaagatcctcgactcgatccgcctgctgcaacgcgccatggacatgctgcgcgagcactgcatcgtcggcatcaccgccaacgaagcgcgctgccgcgaactggtcgaacactcgatcggcctggtcaccgcactgaacccgtacatcggctacaaaaacgccacccgcatcgcccgtatcgcccttgaaagcggccgcggcgtactggaactggtgcgcgaagaaggtctgctcgacgaagccatgctcgccgacatcctgcgcccggaaaacatgattgctccgcgtctggtgcctctgaaggcc

SEQ ID NO: 37520 - DNA, 981 bp, Pseudomonas fluorescens
ctgttccctgccacccgcctgcgtcgcaatcgccgtgatgatttttcccggcggctggtgcgtgagaatgtgttgacggtcgatgacctgatcctgccagtgttcgtgctcgacggtgaaaatcgccgcgaagctgtggcttcgatgccgggtgtcgagcgcctgaccatcgatctgctgcttgaagaagccgccaaatgggtcgagctgggaattccggcgctggcgctgttcccggtcaccccgcctgaactcaaatccctcgatgccgccgaagcgtggaatcccgaaggtatcgcccagcgcgccacccgtgcgctgcgtgaccgattccccgagctgggcgtgatcaccgacgtcgccctcgacccgttcaccactcacggtcaggacggcattctcgatgaagaaggctatgtgcagaacgacatcaccgtcgacgcactggtcaaacaagccttgtcccacgccgctgcgggcgcccaggtggttgccccgtcggacatgatggacggccgcatccaggcgatccgcgaagcgctggagctggccggtcacgtcaacgtgcggatcatggcctactcggccaaatacgccagcgcctattacggcccgttccgcgatgccgtgggttcggcggcgaacctgggcaaggcgaacaaggcctcctatcagatggacccggccaacagcgacgaagccctgcacgaagtgggcgcggacttgtctgaaggcgcggacatggtcatggtcaagcccggcatgccgtacctggatattttgttccgggtaaaagatgccttcaaagtgccgaccttcgtctatcaggtcagcggcgaatacgccatgcacatggcggcgatccagaatggctggttgagcgaaggcgtgatcctcgaatccctgaccgcctttaaacgtgccggcgctgatggcatcctgacttactttgctgtccgtgccgctcaattgttacgagag

SEQ ID NO: 37521 - DNA, 741 bp, Pseudomonas fluorescens
gtgaccgcctggcgcctgctgctgacgcgcccggcggaggactgttcggcgctcgccgccgtgctggccgaacaagggtttttcagcagctgtctgccgcttttggaaatcgcccctctgccggtctctgacacaatgcgccgcacgatcatgcaactgccgcgctacagcgcggtgatcgtggtcagcaagccagcggcgcggatcgcggtggatctgctcgacgctctgcggctggcgacgccgacgatgccgtggttcagcgtgggcgcggcgaccgccgctatccttcgggatcgggggctggatgtgagcttcccggacgcgggcgacgacagcgaagccttgctgcaattgccgcgtctgcttgaggcggtggccatgcccggttcacaggtattgatcctgcgcggggagggcggacgcgagctgctgggcgagcgcctgcgcacgcttggtgctagtgtcgaatacttggagttgtaccgtcgcgacctgccggactatccgccgcaggagctgccccgcaggattgcagcggaacgcctgaacgggctggtggtcagcagtggacagggtttcgagcacctgcgccaactggccggcgacagctggcctgcactggcgcagttgccgttgtttgttccaagcccaagggttgccgagcaggcaagtgccgccggggcccgaacagttgtggattgtcgcggcgccagtgctgcggccttgctgacggcgtta

SEQ ID NO: 37522 - DNA, 936 bp, Pseudomonas fluorescens
atgtcctctcgcgaaatccgcatcgccacccgcaaaagtgctctggccctctggcaggccgaatacgtcaaagcccgtctggaagcagcccacccgggcctgctggtgacgctggtgcccatggtcagtcgcggcgacaagctgcttgattcgcccctgtcgaaaatcggtggcaagggcctgttcgtcaaggaactggaaaccgcgctgctggaaaacgaagccgacattgccgtgcactcgatgaaagacgtgccgatggattttcccgaaggccttggtctgttttgcatctgcgagcgcgaagatccgcgtgacgcgtttgtctccaatacgtattccagcctcgatgcgttgccagccggcagcatcgtcggcacgtccagcctgcgccgtcaggcgcagttgctgacgcgccgtcctgatctcgagatccgtttcctgcgcggcaacgtcaacacccgtctggccaagctcgacgccggcgagtacgacgcgatcatcctcgcggcagcgggcctgatccgcctcggtttcgaagatcgcatcacctcggccatcagcgtcgacgacagtctgccggccggtggccagggcgccgtcggtatcgaatgccgcagcgccgacactgaaatccatgccttgcttgcgcccctgcatcatgccgacaccgctgaccgtgtcacggccgagcgtgccctcaacaaacacctgaatggcggctgccaagtgccgatcgcctgctacgccgtgctcgaaggcgatcagttgtggctgcgcgggctggtgggcgagccgagcggcggcaagctgctcaacgcacaagcccgtgcaccgcgtgcggcagccgagacgctgggcgtgcaggtggccgaagacctgctcagccagggcgccgacgatattctcaaggcagtctacggcgaggcaggtcac

SEQ ID NO: 37523 - DNA, 1368 bp, Pseudomonas fluorescens
aatcagtcctggggcggccgcttcagtgaacccgtcgacgccttcgtcgcccgcttcaccgcctccgtcactttcgaccagcgcctgtatcgccacgacatcatgggctcgatcgcccacgccaccatgctggccaaggtcggcgtgctgacggatgccgagcgcgacagcatcatcgatggcctgaagaccatccagggcgaaatcgaggccggccagtttgactggcgcgtcgacctcgaagacgtgcacatgaacatcgaagcacgcctgaccgaccgcatcggcgtcaccggcaagaagctgcacaccggccgtagccgcaacgaccaggtcgccaccgacatccgcctgtggctgcgtgacgaaatcgacctgatcctgagcgaaatcacccgcctgcaaaaaggcctgctggagcaggccgagcgtgaagccgccagcatcatgccgggctttactcacctgcagaccgctcagccggtgaccttcgggcaccacatgctggcctggttcgaaatgctcagccgcgactacgagcgtctggtcgactgccgcaagcgcaccaaccgcatgccgctgggcagcgccgcactggccggcaccacttacccgatcgaccgcgaatacaccgcacaactgctgggcttcgacgccgtcggcggcaactcgctggacaacgtgtccgaccgtgacttcgccatcgaattctgctcggccgcgagcatcgcgatgatgcacctgtcgcgcttctccgaagagctggtgctgtggaccagcgcgcaattccagttcatcgatctgccagaccgtttctgcaccggcagctcgatcatgccgcaaaagaaaaaccccgacgtgccagagctggtacgtggcaagaccggccgtgtgttcggcgccctgatgggcctgttgaccctgatgaaaggccagccactggcctacaacaaggacaatcaggaagacaaggaaccgttgttcgacgccgccgataccctgcgcgactcgctgcgggcttttgccgacatgatcccggcgatcaagccaaagcacgcgatcatgcgtgaagcggcactgcgcggtttctccaccgccaccgacctggccgactacctggtacgccgtggcctgccgttccgtgattgccacgagatcgtcggtcatgccgtgaagtacggcgtcgacaccggcaaggatctggcggaaatgagcctggaagaactgcgtcagttcagcgaccagatcgagcaggacgtgtttgcagtgctgaccctggaaggttcggtaaatgcccgtgaccacatcggcggcactgcgccggcgcaggtcaaggctgccgtggttcgtggtcaggcgttgatcgcc

SEQ ID NO: 37524 - DNA, 543 bp, Pseudomonas fluorescens
atgtccctggaacagaattacaccgcgattctcggccaactgggcgaggacgtctcccgcgagggcctgctcgacacgccaaagcgtgccgccaaagccatgcagtacctctgccgcggttatcaacagacgctcgaagaggtcaccaacggtgccctgttcagctccgacaacagcgaaatggtgctggtcaaggacatcgagctctactcgttgtgcgaacaccacctgctgccgttcatcggcaaggcccacgtcgcgtacatcccgagcggcaaagtgctgggcctgtcgaaggtcgcgcggatcgtcgacatgtacgcccgccgcctgcagatccaggaaaacctcagccgccagatcgccgatgcggtccagcaggtcaccggcgcgctgggcgtggccgtggtgatcgaggccaagcacatgtgcatgatgatgcgcggtgtggagaaacagaattcgtcgatgatcacttcggtgatgctcggtgagttccgtgaaaacgcggcgacccgcagcgagtttctcagcctgatcaag

SEQ ID NO: 37525 - DNA, 1089 bp, Pseudomonas fluorescens
atgtccggcaatacctacggcaagctgttcactgtcaccaccgcgggcgaaagccatggtccggcgttggtcgccattgtcgacggctgcccgccgggcctggagatttcccttgaagatctgcaacgcgacctcgaccgtcgcaagccgggcaccagccgccacaccacccagcgccaggaagccgacgaagtcgaaatcctttccggcgtgttcgagggccgcaccaccggctgctccattggcctgctgattcgcaacaccgaccagaagtccaaggactactcggcgatcaaggacctgttccgcccggcccacgccgactacacctaccaccacaaatacggcgagcgcgattatcgcggcggcggtcgcagctccgcgcgggaaaccgccatgcgcgtcgcggctggcgccatcgccaagaagtacctggccagccaaggcatcgtcattcgcggctacatgagccagctcggcccgatcgaaatcccgttcaagacctgggaatcggtcgagcagaatgccttcttcagcccggacccggacaaagtgccggagctggaagcttatatggatcagttgcgccgcgatcaggattccgtcggggcgaagatcaccgtggttgccgaaggcgtgatgccgggcctgggcgagccgatcttcgaccgtctcgatgccgaactggcccatgcgctgatgagcatcaacgcggtcaaaggtgtggaaatcggcgccggtttcgcctgcgtcgcccagcgcggcaccgaacaccgtgacgagctgaccccggaaggtttcctcagcaacaacgcgggcggcatccttggcgggatctcttcggggcagccgatcgtcgcgcacctggccttgaagccgacctcgagcatcaccaccccgggccgttcgatcgacatcgatggcaacccggtcgatgtcattaccaagggccgtcacgacccatgtgtcggtatccgcgccacgccgattgccgaggcgatgatggccatcgtgttgatggatcacctgctgcgccaccgtggccagaacgccgatgtgcgcgtgagcaccccggtgctgggtcagctt

SEQ ID NO: 37526 - DNA, 1836 bp, Pseudomonas fluorescens
atgcgccacgcgccgagcgacacgattacctggggcatgatgctccgcaaactgccgatgattgccaaagccatcccgcgggtggtgaaaggcatgaaggtggccaacgtcaaggatccgacccaaacctgtggcctgggctggacattcgagcaagcgaccctgcgcaatcccgaaggccccgcgctgctgtcgggcgaggtggtgctgagttattcacaggtcaaccagtgggccaaccgcattgcccactatttgatcggccagggtatcggcaagggcgatgtggtggcggtgttcatcgagaaccgcccggaactgctggtgacgattctggccctggccaaggtcggcgccgtcagcgcgctgctcaatacctcgcagacccgcgatacgctgatccacagcatcaatctggtgacgccggcggcgattgtcgtcggtgaggaactgctgccggcatttgcggcggtacgcgagcaagtgtcgatcccggcaacgcgcgcctggttcgtcgccgatcaggataccttcagccatccgggcatcgcgcccgagggctacatcaacctgatcagcgccagtgccgacgcctcgggcgacaacccggccagcagccggcagattttcttcgacgacccctgtttctacatctacacctccggcaccaccggtttgcccaaggccggcgtgttcaagcacggccgctggatgcgcagttcggcgagcttcggcatgatcgccctcgacatgcgcccggacgacatcgtctattgcaccttgccgctgtaccacgccaccgggctttgcgtgtgttggggttcggcggttaatggcgcttcgggtttcgcgattcgccgcaagttcagcgcccgccagttctggagcgacgtgcgccgctaccgcgcaaccaccatcggttacgtcggcgagttgtgccgttatctggtggatcagccgctcagcgccgacgacagccgtcacgacgtgcgcaaaatgatcggcaacggcctgcggcccggcgcgtgggccgagttcaagacccgtttcggcgtggatcacatttgcgagctgtacgcggccagcgacggcaatattggcttcaccaacatcctcaatttcgacaacaccatcggcttctcgctgatggcctgggaactggtcgcctacgaccaggacagcggcgagccgattcgtggcgctgacgggttcatgcgcaaggtcggtcggggcgagcgaggcctgctgctggcgcggatcgacgacaaggcgccgctggacggctacaccgatccgcagaaaaccgccaaagtcgtgctgcaggacgtgttcatcaaaggggatcgctttttcaataccggcgatctgctgcgcaacatcggttttggtcatgcacagtttgtcgaccgcctcggcgacacctaccgctggaagggagagaacgtctcgaccaccgaggtcgagaacctgctgctccaacatccgcacatttccgaagccgtggcctatggtgtggaaatccccaacaccaacggtcgcgccgggatggcggcgatcaccccggccgagtctttggcgaccctggatttcgccgaactgttggccttcgtccgccagcgtatgccggcctacgcggtgccgttgttcttacgggtcaaggtgaaaatggaaaccaccggcaccttcaaataccagaagacgcgcctgaaaaacgaaggcttcgatccccgccagacaggcgatgacccgatttatgcctggctgccagggacagaaacctacgtgcaggtctcggatggaatccttgcggacatccgggcaggcaagttccgttat

SEQ ID NO: 37527 - DNA, 507 bp, Pseudomonas fluorescens
atgtccgaccaaagccgccagatgaccccagaagaagccgccgaattcaccgagcaggtattcaacaaggcgcgtgagggcgatgcggtaatgctggatcgcctgatcactgccggtctgccggtgaacctgaccaacagcaagggcgacaccctgctgatgctcgccagttactacgggcatgtggacgcggtgcaagtgttgctcaagcacaaggccgacccggaacaacgtaacggcaacggccaaagcccgattgccggcgcggcgttcaagggtgacctggccgtggtcaaggcgttggtcgaaggtggggcgcagattgaaggtgcctctttcgacggacgcacggcgttgatgatggcggcgatgttcaaccgggttgaaatcgtcgactacctgatcgaccagggcgccgatccgaaagccaaggatgccaacggcatcaccgcgctggacgcggcccgcaccatgggcgctgtggacaccaccgcgcagctggaaaaa

SEQ ID NO: 37528 - DNA, 1200 bp, Pseudomonas fluorescens
acccaagctttgattttcgacgcgttacgcacgccccgtggcaagggcaaggccgacggttcgctgcacagcgtcaaaccggtgaacctggtggcagggctgctgaccgctttgcaagcgcgcactgcgctggacaccagccaggtcgatgacgtggtgctgggttgtgtcacgccgatcggcgatcagggctcggacatcgccaagaccgcggtgcaggtggccgattgggacgtcagcgtcgcgggcgtgcagatcaaccgcttctgcgcctcgggactggaagcggtgaacctgggggcgatgaaagtgcgctccgggtttgaagagctggtggtggtcggcggcgtcgaatccatgtcccgcgtgccgatgggcagcgacggtggcgcctgggcgctggacccgcaaaccaacctgcacagccatttcacgccacaaggcgtcggcgccgacctgatcgccaccctggaaggcttcagccgtcaggacgtcgatgcctacgcgctgcactcgcaacagaaagccgctcgcgcccgggccgacggttcgttcaacaagtcgttggtgccggtgcaggaccagaacggcatcatcctgctcgatcacgatgagttcattcgcgccgagtcgacccttgaaggcctgggcaagctcaagccgagtttcgagatgatcggccagctgggcttcgacgccacggcgctgcgtgtctacagccatgtcgagcggatcaaccatgtgcacacgccgggcaacagctcggggatcgtcgatggcgcggcgctgatgttgatcggctccgaagccaaggggcgcgcgttgggcctgcaaccccgggcgcggatcgtcgccacggcggtcaccagcaccgatccgacgatcatgctcaccggcccggcgccggccactcgcaaggcattggccaaggccgggctgcgggtggaagacatcgaccttttcgaggtcaacgaggcattcgcctcggtggtgctgaaattcatcaaggacatggccgtcgacccggacaaggtcaacgtcaatggcggctcgatcgccatcggccacccgttgggggccaccggttgcgcgatcctcggcaccttgctcgatgaactggaagcccgacgcctgcgctacggcctggcgacgctgtgcgtcggcggcggcatgggcatcgccaccatcatcgaacgcctc

SEQ ID NO: 37529 - DNA, 687 bp, Pseudomonas fluorescens
atgagcgacctgattgcctaccacctcgaagacggtatcgcgaccctgaccctgagcaacggcaaggtcaacgccatttccccggacgtgatcgcggccttcaacgcggcgctggatcaggcggtggcggatcgtgccattgtgatcatcaccggtcagccaggcattctctctggcggctatgacctgaaagtgatgactgctggccctaaagaggccgtgtcgctggtgaccgccggctcgaccctggcccgtcgcctgttgtcgcacccgttcccggtaatcgttgcttgcccggggcatgccgtggccaaaggcgcgttcattctgttgtccgccgactatcggatcggtgtcgacggcccgttcagcattggtctgaacgaagtgcagatcggcatgaccatgcaccacgccggcatcgagctggcccgtgatcgcctgcgtcgctcggccttccaccgctcggtgatcaacggcgagatgttcgatccgcaaagtgcagtggatgccggcttcctcgacaaagtggtcgcagccgaagaactgcaaggcgctgccctcgccgccgcgcgtcagttgaagaagatcaacatgaccgcgcacaagaacaccaagctgaaagtgcgcaaggcgctgctggaaaccctggacaacgcaatcatccaggatcaggaacacttgggc

SEQ ID NO: 37530 - DNA, 534 bp, Pseudomonas fluorescens
atggcagaactgaccacgttggcccgaccttacgctaaggcggccttcgagcacgctcaggcccaccagcaactggccaattggtcagccatgctcggcctggcagcagcggtgtcgcaagacgacaccatgcagcgcgtgctcaaggccccgcgactgacgagcgcagaaaaggccgccacgttcattgacgtgtgcggcgacaagtttgatgccaaagcacagaacttcatcaatgtcgttgccgaaaacgaccgtctcccgcttctgccggagatcgccgctctgtttgacctgtacaaggccgagcaagagaaatcggtagatgttgaagtgaccagtgcttttgcattgaaccaagaacagcaagacaaactcgccaaggttctcagtgcacgactcaaccgggaagtgcgcctgcaagtcgaggaagacagctcccttatcgggggggtggtcatccgcgccggcgacctggttatcgatggctcgattcgcggcaaaatcgcgaaacttgccgaagcattgaaatct

SEQ ID NO: 37531 - DNA, 1530 bp, Pseudomonas fluorescens
ctcaatccttccgaaataagtgaaattatcaagggccgcatcgaaaagctcgatgtgacctcccaagcccgtaacgaaggcactgtcgtcagcgtatctgacggtatcgtgcggattcacggtctggccgacgtcatgtacggcgagatgatcgagtttccgggcggcgtctacggtatggccctcaacctggagcaagactccgtaggtgccgttgtactgggcgcatacacgactctggctgaaggcatgagcgccaagtgcaccggccgcatcctcgaagttccggttggtaaggaactgctgggtcgcgttgtcgacgcactgggtaaccctgttgacggcaaaggtccactgggcaacaccgagaccgacgcggtcgagaaagttgctccgggcgtgatctggcgtaagtcggtagaccagcctgtacagactggctacaaggctgtcgatgccatgatccctgtcggccgtggccagcgtgagctgatcatcggtgaccgtcagatcggtaaaaccgctctggcgatcgacgcgatcatcaaccagaaagacagcggcattttctgcgtctacgtggcaatcggtcagaagcaatcgaccatcgccaacgtggttcgcaagctggaagaaaacggtgcactggctaacaccatcatcgttgcagcgagcgcttcggaatctgcagcactgcaattcctggctccgtactccggttgcaccatgggtgaattcttccgcgaccgcggtgaagacgcgctgatcgtttatgacgatctgtccaagcaagcagtggcttaccgccagatttccctgctgctgcgccgtccaccaggccgtgaagcttacccaggcgacgtgttctatctccactcccgtctactggagcgcgcatcccgcgtttcggaagagtacgtagagaagttcaccaacggcgcagtgaccggcaaaaccggttccctgaccgcactgccgatcatcgaaacccaggctggcgacgtttccgcgttcgttccgaccaacgtgatttccatcaccgacggtcagatcttcctggaatcggccatgttcaactcgggcatccgccctgcagtgaacgccggtgtttcggtatcccgtgtgggtggtgccgctcagaccaagatcatcaagaagctgtccggtggtatccgtaccgctctggctcagtaccgtgaactggcggcattcgcccagttcgcttctgacctggacgaagcgacccgcaagcaacttgagcatggtcagcgcgttaccgagctgatgaagcagaagcaatacgcgccaatgtcgatcgccgacatgtcgctgtcgctgtatgccgctgagcgtgggttcctgaccgacatcgaaatcaccaagatcggcagcttcgaacaagcgctgatcgctttcttcaaccgcgatcacgccgatttgatggccaagatcaacgttaaaggtgacttcaatgacgaaatcgacgctggcctgaaggctggtatcgagaagttcaaggccacccaaacc

SEQ ID NO: 37532 - DNA, 858 bp, Pseudomonas fluorescens
atggcaggcgcaaaagagattcgcagtaagattgcgagcatcaaaagcacgcaaaaaattaccagcgccatggaaaaagtggcggtcagcaaaatgcgcaaggcacaaatgcgcatggctgctagccgtccttatgcggagcgtatccgccaggtaattgggcatctggccaacgccaacccggaataccgccacccgttcatgatcgatcgcgaagtaaagcgcgtcggttatgtcgtagtgagcagtgaccgtggtctgtgcggcggcttgaacaccaacctgttcaaggccctggtcaaggacatggcggtaaaccgcgaaaacggcgtcgagatcgatctgtgtgtcgttggtagcaagggtgcggcctttttccgcaacttcggcggtaacgtcgttgcagctatcagccacctgggtgaagagccgtcgatcaatgatctgatcggcagcgtcaaggtgatgctggatgcctatctggacggccgtattgaccgcctgtccgtggtatccaacaagttcatcaacaccatgacgcaacagcctaccgtggagcagttgattccactggtggcgaccccggatcaagaactcaagcaccactgggactacctctacgaaccagacgccaaagagctgcttgacggcttgatggtgcgttacgtggagtcgcaggtgtaccaggcggtggtcgagaacaacgcggctgaacaggctgcgcggatgatcgcgatgaagaacgctaccgacaacgccggtgatttgatcagcgatttgcagctgatctacaacaaggcgcgtcaggctgcgatcacccaagagatctcggaaatcgtcggcggcgctgccgcggtt

SEQ ID NO: 37533 - DNA, 1374 bp, Pseudomonas fluorescens
atgagtagcggacgtatcgttcaaatcatcggcgccgttatcgacgtggaatttccacgcgacagcgtaccgagcatctacgacgccttgaaggttcaaggcgccgaaaccactctggaagttcagcagcagctgggcgacggcgtggttcgtaccattgcgatgggctccaccgaaggcttgaagcgcggtctggacgtcaacaacactggcgcagccatctccgtaccggtcggtaaagcgactctgggccggatcatggacgtactgggcaacccgatcgacgaagctggcccgatcggcgaagaagagcgctggggtatccaccgcgccgctccttccttcgctgaacaagccggtggcaacgagctgctggaaacaggcatcaaggttatcgacctggtttgcccgttcgccaagggcggtaaagtcggtctgttcggtggtgccggtgtaggcaagaccgtaaacatgatggaactgatccgtaacatcgccatcgagcacagcggttattccgtgttcgccggtgtgggtgagcgtactcgtgagggtaacgacttctaccacgagatgaaggactccaacgttctcgacaaggtagccctggtctacggtcagatgaacgagccaccgggaaaccgtctgcgcgtagcgctgaccggtctgaccatggccgagaagttccgtgacgaaggtaacgacgttctgctgttcgtcgacaacatctatcgttacaccctggccggtaccgaagtatccgcactgctgggccgtatgccttcggcagtaggttaccagccgaccctggctgaagagatgggcgtgctgcaagagcgcatcacttcgaccaagcaaggttcgattacttcgatccaggccgtatacgtaccagcggacgacttgactgacccgtcgccagcgaccacgtttgctcacctggacgccaccgtcgttctgtcccgtgacatcgcttctctgggtatctacccggcggtagacccactggactcgacttcgcgtcagctggacccgaacgtgatcggcaacgatcactacgagaccgctcgtggtgttcagtacgtgctgcagcgttacaaagagctgaaggacatcatcgcgatcctgggtatggacgagctgtcggaagccgacaagcagttggtaaaccgtgctcgtaagatccagcgcttcttgtcgcagccgttcttcgtggctgaagtcttcaccggtgcttcgggtaaatacgtttccctgaaagacaccattgctggcttcaaaggcatcctcaacggtgactacgaccacctgccagaacaagcgttctacatggtcggcggcatcgaagaagcgatcgagaaagccaagaaactg

SEQ ID NO: 37534 - DNA, 1830 bp, Pseudomonas fluorescens
atgtgtggaattgtcggcgccgttgctgaacgtaatatcaccgccatcctgctcgaaggcctcaagcgtctggaataccggggctatgacagtgcaggcgtcgctgtcttgaccaacgacggaaccctcgagcgcacgcgccgggtgggcaaggtcagtgaactggatgctgcgctggccgagcacccactggtcggtcgcctcggtattgcccacacccgctgggcaacccatggtgcgccgaacgaacgtaacgcccacccgcatttctccggcggcatcgccgtggtgcacaacggcatcatcgaaaaccacgaagcgctgcgcgaacaactcaaggcgctgggttacgtgttcacctcggacaccgacaccgaagtcattgcacacctgctcacccacaagctcaaggatctgcacgatctgaccgttgccctcaaggccaccgtcaaggaactgcacggtgcttacggtctggcggtaatcaacgcgcagcagccggatcgtctggtcgctgcccgcagcggcagtccgctggtgatcggcctgggtctgggcgagaacttcctcgcctccgatcaattggccctgcgtcaggtgaccgaccgcttcatgtacctggaagagggcgatatcgccgagattcgccgtgacagcgtgcagatctgggacgtgaacggccaggcggtcgagcgccagaccgtgcagtacagcgatggcgccgaagcggcagaaaaaggcgagtaccgccactacatgctcaaggaaatccacgagcagccggtcgtggtgcaacgtaccctcgaaggtcgcctgagcgagaatcaggttctggtacaagcgttcggcccgcaggccgccgagctgttcgtcaaggtgcgcaacgtgcagatcgtggcgtgcggcaccagctatcacgccggcatggttgcccgttactggctcgaagagctggccgggattccatgccaggtcgaagtcgccagtgaattccgctaccgcaaggtggtggtgcagccggataccctgttcgtcaccatctcccagtccggcgaaaccgccgacaccctggccgccctgcgcaacgcgaaggaactgggcttcctcgccagcctggcgatctgcaacgtcggcatcagttcgctggtgcgcgagtcggacctgaccctgctgacccaggccggtcgtgaaatcggcgtggcctcgaccaaagccttcaccacgcaactggtgggtctgctgttgctgacgctgtccctgggccaggtacgtggcacgctggccgatggcgttgaagccagactggtcgaagaattgcgccgtctgccaacccgcctcggcgaagccctggcgatggacggcaccgtggaaaagattgccgagctgttcgccgagaagaaccacaccttgttcctgggtcgtggcgcgcaattcccggtggcgatggaaggagccttgaagctcaaggaaatctcttacatccacgccgaagcctacccggccggcgaactgaaacacggcccgctggcgcttgtggataacgacatgccggtggtcaccgtcgcgccgaacaacgaactgctggagaagctcaagtccaacttgcaggaagtccgtgcccgcggcggcgaactgatcgtgttcgccgacgaaaaagccgggatgaccaacggcgaaggcacccacgtggtgcagatgccgcacatccacgacatcctgtcgccgattctctacaccattccgctgcaactgctgtcgtactacgtcgctgtgctcaagggcactgacgtggatcagccgcgtaacctggcgaagtcggtgacggtggaa

SEQ ID NO: 37535 - DNA, 462 bp, Pseudomonas fluorescens
caatctttacataggcttccccccgaaatgatggacatcaacgagattcgcgaatacctgcctcaccgttacccgttcctgctggtggatcgggtagtggagctggatacggaaggcaagcgcattcgcgcctacaagaatgtcagcatcaacgagccgttcttcaacggtcacttcccggcgcacccgatcatgccgggcgtgctgatcatcgaagccatggctcaggctgccgggatcctcggtttcaagatgcttgacgtgaaaccggccgacggcaccctttattacttcgttggctccgacaaactgcgtttccgccagccagtgctgccgggcgatcagttgatcctcgaagccaagttcatcagttgcaagcgtcagatctggaagttcgaatgccaggcttcggtcgatggcaaaccggtctgctcggctgaaatcatctgtgcggaacgcaag

SEQ ID NO: 37536 - DNA, 1293 bp, Pseudomonas fluorescens
atggcaaaaatcgtcgacatcaaaggtcgtgaagttctcgactcccgtggcaatcccaccgtggaagcggacgtgcttctcgacaacggcatcatcggcagcgcttgcgcgccgtccggtgcatccactggctcgcgtgaagcgctcgagctgcgtgatggcgacaagagccgttacctgggcaagggcgtgctcaaggcggtagccaacatcaatggtccgattcgcgatctgctgctgggcaccgacccaagcgaccagaaagccctggatcaggcgatgatcaagctcgacggtaccgaaaacaaagcgaccctgggcgccaacgcgatcctcgccgtgtccctggctgcggccaaggcggctgcacaggatcaggacctgccgctgtacgctcacatcgccaatctgaacggcaccccgggcgtgtactcgatgccggttccgatgatgaacatcatcaacggtggcgaacacgccgacaacaacgtcgacatccaggaattcatggttcagccggttggcgccaagtccttctcggaaggtctgcgcatgggcaccgagattttccatcacctcaaagccgtgctgaaggcccgtggcctgagcactgccgtcggtgacgaaggcggtttcgcgccgaacctggcttccaacgaagacgcactgaaagtgatctccgaagcagtcgccaacgctggttacaagctgggcaccgacgtgaccctggctctggactgtgcggccagcgaattcttcgaagacggcaagtacaacctgtccggcgaaggccaggtgttcaccgctgaaggtttcgccgactacctcaaaggtctgaccgagcgttacccgatcatctcgatcgaagacggtctggacgagtccgactgggctggctggaagatcctcaccgacaagatcggcgagaagacccagctggtcggcgacgacctgttcgtgaccaacaccaagatcctcaaagaaggcatcgataaaaagatcgccaactcgatcctgattaagttcaaccagatcggtaccctgaccgaaaccctggaagccatccagatggccaaggctgccggttacaccgccgtgatctcgcaccgttcgggcgaaaccgaagattccaccattgccgacctggccgtgggtacttcggctggccagatcaagaccggttcgctgtgccgttccgaccgcgtttccaagtacaaccaactgctgcgtatcgaagagcagttgaatggcaaggccaagtacaacggtcgcagcgagtttcgcggctgagca

SEQ ID NO: 37537 - DNA, 1113 bp, Pseudomonas fluorescens
agcatgatcaagtcgcgcgccgccgttgccttcgaggccaaaaagccgctggaaatcgtagaagtcgatgtcgccatgcccaaggccggtgaagtattgctgcgcgtggtggcttccggggtttgccacactgacgcttacaccctgtccggcgcggacccggaaggtatcttcccgtcgatcctcggccacgaaggcggcgctatcgtcgaagcgatcggcgaaggcgtgacatccgtggccgtcggtgatcacgtgattccgctttacaccccggaatgcggtcagtgcaaattctgtaagtcgggcaagaccaacctgtgtcaggcgattcgcgccacccagggcaagggcctgatgccggacggcacttcgcgcttttcctacaagggccaaacgattttccactacatgggtacttcgacgttctccgagtacaccgtgctgccggaaatctccgtggccaagatctccaaggatgcgccgctggaaaaggtctgcctgctcggttgcggcgtgaccaccggtatcggtgcggtgatcaacaccgccaaggtcaaaccgggtgacaccgtggccatcttcggtctcggcggcatcggactgtcggccgtgatcggcgcggtgaaggccaaggcctcacggatcatcgccatcgacatcaacccggccaagttcgaaatcgccaaacaattgggtgccaccgactgcgtgaacccgaaagacttcgatcgtccgatccaggaagtgatcgtcgacatgaccgatggcggcgtcgacttctccttcgaatgcatcggcaacgtgcaacttatgcgcgcagccctcgagtgctgccataaaggctggggcgagtcggtgatcatcggtgtggccggtgccggccaggaaatctccacccgtccgttccagctggtgaccggtcgcgtctggcgcggttccgcattcggcggcgtgcgtggtcgtaccgaattgccaagctacgtcgacatggcgcaaagcggcgaaatcccgctggatactttcatcactcacaccatgggcctggaagacatcaacaaggccttcgacctgatgcacgaaggcaagagcatccgtaccgtcattcatttc

SEQ ID NO: 37538 - DNA, 633 bp, Pseudomonas fluorescens
atgacgtcccagcgaacccgtgagcgcctgatccagcgtctgtacgaagagggcgtttccaacgccagcgtgctggaagtgatccgccgcaccccgcgacacctgttcgtcgatgaagcgctggcgcatcgtgcctatgaagacaccgcgctgccgatcggcaacaaccagaccatttcccagccttatatggtggcgcgcatgagcgagctgctgctggaagccgggccgctggataaggtgctggagatcggcaccggatccggttaccagacggcagtgttgtcgcagttggtcgagcgggtgttctcggtagagcgcatcaaggtgctgcaggatcgggccaaggaacgcctgatcgagctcaacctgcgcaacgtggtatttcgctggggcgatggttgggaagggtggccggcgctagcgccgtacaacggcatcatcgtcacggcggtcgccaccgatgtgcctcaggctttgcttgatcaactggcaccgggtgggcggatggtgatcccggtcggttcgggcgaagtgcagcaattgatgctgatcgtgcgcgaagaaaacggtttctcccgacacgttctgggggcggtgcgtttcgtgccattgctcaacggtccgctggcc

SEQ ID NO: 37539 - DNA, 2559 bp, Pseudomonas fluorescens
ctgtcctcccacaccccgatgatgcagcagtactggcgcctgaagaatcagcacccggaccagctgatgttctaccgcatgggcgacttctacgagatcttctacgaagacgcgaagaaggcggctaagttgctggacatcaccctgaccgcgcgcgggcagtcggcgggtcaggcgattccgatgtgcgggattccgtatcacgcggcggaaggttatctggcgaagctggtcaagctcggcgagtcggtggtgatctgcgagcaggtcggcgacccggccaccagcaaaggcccggtggaacgtcaggtggtgcggatcatcacccccggtacggtcagcgacgaagcgttgctggatgagcgccgcgacaacctgatcgcggcggtgctgggcgacgagcgcctgttcggtctggcggtgctggacatcaccagcggcaacttcaccgtgctggagatcaagggctgggaaaacctgttggcggagctggagcgggtcaacccggtcgagttgctgatcccggatgactggccgaaggatctgccggcggaaaaacgccgtggcgtacgtcgtcgtgcaccgtgggatttcgaacgtgattcggcgctgaaaagtctctgccagcaattctccacccaagacctcaaaggttttggctgcgaaaccctgaccctggccatcggcgccgccggttgcttgctggcgtacgccaaggaaacccagcgcaccgccctgccccatttgcgcagcctgcgccatgaacggctggacgacaccgtggtgctggacggcgccagccgccgtaacctcgaacttgacactaacctggccggtggccgcgacaacaccctgcaatcggtggtcgaccgttgccagaccgcgatgggcagccgcttgctgacccgatggctcaaccgtccgctgcgcgatctgaccgtgctgctggctcgccagacctcgatcacttgcctgctcgaccgctatcgctttgaaaacctgcaaccgcagctcaaggaaatcggcgacatcgagcgtatcctggcgcggatcggcctgcgcaatgcccgccctcgcgacctcgctcgcctgcgcgacgcgctcggtgcgctgcctgaactgcaagtggcgatgaccgatctcgaggcgccgcacctgcaacgtctggcgaccaccaccagcacttatccggaactggcggcgctgctggaaaaagccatcatcgacaacccgccggcggtgatccgtgacggcggcgtgctgaaaaccggttacgacagcgagctcgacgagctgcaatcgctgagcgagaacgccggccagttcctgatcgatctggaagcccgggaaaaggcccgtaccggcctcgccaacctgaaagtcggctacaaccgcattcacggctacttcatcgagttgccgagcaagcaggctgaatcagcgccggcagactacatccgtcgtcagaccctcaagggtgccgagcgcttcatcaccccggaactgaaagagttcgaagacaaggcgttgtcggccaagagccgcgccctggctcgcgagaaaatgctttatgaagcgctgctggaagatttgatcagccagctgccgccgctgcaggacaccgcaggtgccctggccgagctggacgtgctgagcaacctcgccgaacgtgcgctgaatctcgacctgaattgcccgacgttcgtcagcgaaccgtgcatgcgcatctcccagggccgtcatccggtggtcgagcaagtgctgacaacgccgttcgtggccaacgacctgagcctggacgacaacacccgcatgctggtgatcaccggtccgaacatgggcggtaaatccacctatatgcgccagactgcactgatcgtgctgctggcacacatcggcagcttcgtgccggcagccagttgtgaactgtcgctggtggaccggatcttcacccggatcggttccagcgacgacctcgccggcggacgctcgaccttcatggtggaaatgagcgaaaccgcgaacatcctgcacaatgccaccgagcgcagtctggtgctgatggacgaagtcgggcgcggcaccagcacctttgatggtctgtccctggcgtgggcggcggcggagcgtttggcgcagctgcgggcctatactctgtttgcgacgcactatttcgaattgaccgtgttgccggaagccgaaccgctggtggccaacgtgcacctcaacgccaccgagcacaatgagcgcatcgtattcctgcaccatgtgttgccggggccggcaagccagagttatggccttgcggttgcgcagctggccggtgtgccaagcgaagtgatcgtgcgtgctcgtgaacacttgagccgcctggaagataccgcgctgccacatgaggcgccgaagccggccgccaagggcaaaccggcagcgccgcaacagagcgacatgtttgccagccttccgcatccggtgctggatgagttggccaaactggatctggatgacgttacaccgcgtcgtgcgctcgaaatgttatatgcacttaagaaccggatc

SEQ ID NO: 37540 - DNA, 1146 bp, Pseudomonas fluorescens
atgcccgccttccaggaatacttcgatcccagccaccaaatggtccgcgacagcgtcagtcgtttcgtcgaacgcgagatcctgccggatatcgatgcgtgggaagaagccgaaaactttccccgtgagctgtacctcaaggccggcgcggccggcatcctcggcatcggttaccccgaagcgctgggcggcagtcacgaaggtgatctgttcgccaagatcgccgccagcgaagaactgatgcgttgcggctccggcgggctggtggcagggctcggttcgctggatatcggtttgccgccgatcgtcaaatgggcccggcccgaagtccgcgattgcgtcgtcccccaagtgctccgcggcgagaagatcagcgccttggccgtcaccgagccgggcggcggttccgacgtcgccaacctgcagacccgcgccgtacgcgatggcgattattaccgggtcagtggcagcaaaaccttcatcaccagtggggtacgcgccgactactacacggtcgcggtacgtaccggtgcgcctggttttggcggcatcagcctgctgctgatcgagaagagtacgccaggtttcactgtcggccggcaactgaagaaaatgggctggtgggcgtcagacaccgctgaattgttcttcgacgattgccgggtgcctgtaggaaatctgattggcgcggagaacatgggctttgcctgcatcatgggcaactttcagagcgagcgtctggcgctggcgctgatggccaacatgaccgcacaactggcgctggaagagagcgtgaagtgggcgaaggagcgtgaagcgttcggcaaacccatcggcaagttccaggtgatcaagcatcgcctcgcggaaatggccacgacgctggaagtctcgcgggagttcacctaccggcaggcggcgaagatggcggcggggcagagcgtgatcaaggagatttccatggccaagaactttgccacggacacttcggatcgcatcaccaatgaagcggtgcagattctcggtgggctgggttacgtgcgcgaaagcctggtggagcggctttatcgggataaccgcattttgtcgattggcggcgggacgcgggaagtgatgaacgagatcatcagcaagcagatgggactg

SEQ ID NO: 37541 - DNA, 546 bp, Pseudomonas fluorescens
atggtcttcgactccttcgacatcaaatccctgatccgccccgtgatcgacttcccgaaaccgggcgtgatctttcgcgacatcaccccgctgttccagtcgcccaaggccctgcgcctggtgatggacagcttcgcccaccgctatgttgaagccgacttcacccacatcggcgcgatggatgcgcgtggtttcctgatcggttcggtgctggcttatcaactgaacaagccgctggtgctgttccgcaagcaaggcaaactgccggcggacgtgctggccgaaggttacgcgaccgagtacggcgaagcgttcctcgaagtgcacgccgacagcctgtgcgaaggcgattcggtggtgatgttcgatgacctgatcgccaccggcggcacgctgatcgcggcggccaacctgatccgccgcatgggcgcccgcgttcatgaagcggcggcgatcattgatctgccggagctgggtggttcgcagcgtcttgaggacatggggattccgacgttctgcctgacgcagtttgcgttgactgataaa

SEQ ID NO: 37542 - DNA, 2394 bp, Pseudomonas fluorescens
atgaccaccccgatcccctgctaccactgcgccctgcccgtcccgtccggcagccgcttcaccgccgtcgtgctcggggagtcccgcgagttctgctgccccggctgtcaggccgtggccgaagccatcgtcgccggtggtctggaaagctattaccagcatcgcagcgaagcctcggccaaccccgaagcgctgccggtgcaactggtcgatgagcttgagctgtacgaccgcgccgatgtgcagcaaccgtttgtgcgccacgaaggtgaactggccgaaaccacgttgctgatggaaggcatcagttgcgccgcctgcggctggctgatcgagaaacacctgcgcaccctgcccgccgtggccgaggcgcggctgaacctgtccaatcatcgcctgcatgtgcgctgggctgacgctcagctgccactgagccagatcctcggcgaactgcgccacatcggctacgccgcgcacccgtatcaggccgaccgcgcgagcgaacaactggccagcgaaaaccgtctcgccctgcgccaactcggggtcgccgggctgctgtggtttcaggcgatgatggcgaccatggcgacctggccggaattcaacatcgacctcagcccggagttgcacaccatcctgcgctgggtcgcgctgttcctcaccacgccgatcgtgttctacagctgcgcgccgtttttcaaaggggccatgcgcgacttgcgcacccgtcatctgaccatggatgtctcggtgtcgctggcgatcggcgcagcgtatgtcgccggaatctggacctctattaccggggttggcgagctgtatttcgatgcggtgggcatgttcgcgctgttcctgctcgccggccgctacctcgaacgccgcgcccgcgagcgcaccgctgccgccaccgcgcaactggtcaatctgctgcccgcctcgtgcctgcgcctcgacgacgccggccagagcgagcggatcctgctcagcgaactgcgcctcggtgaccgggtactggtgcagcccggttcggtgctgccggcggacggcaagatccttgatggccagtcgagcatcgacgaatcggtgctgaccggcgaatacctgccgcaaccgcgtgccaagggcgatgccgtcaccgctggcacgctgaacgtggaaggtgcgctgaccgtcgaggtgcaggcgctgggtcaggacacgcgactctcggcgatcgtccgcctgctggatcgcgcccaggcggaaaaaccacggctggcggaaatcgccgaccgcgccgcgcaatggttcctgttgctgtcgttgatcgcggcggccgccatcggcttactgtggtgggaactggattcgtcacgggccttctggatcgtcctcgccatgctggtggcgacctgcccgtgcgcgctgtcgctggcgacaccgaccgccctcaccgccgccaccggcaccctgcacaaactcggcctgctgctgacccgcggccatgtgctggaaggcctgaaccagatcgacacggtgattttcgacaagaccggcaccctcaccgaggggcgtctggtattgcgctcgatccgcccgctcggcgccctcgacaacgatcattgcctgagcctcgccgccgccctggaaaaccgttccgaacacccgattgcccgcgccttcggccgcgcgccgctggctgccgaagatgtccacagcacgccgggcctggggcttgaagggttggttggcgaacaacgcttgcgcatcggccaggcggattttgtctgtgatctcagcggcgcgccggtgccatcgatgccgaacgagccgggtcaatggctgctgctcggtaaccgtcaggggccgctggcctggttcgccctcgacgaccgtctgcgcgacgacgccccggccctgctcgcggcgtgcaaggcgcgcggctggcgcacgctgctgctgtcgggcgacagttcgccaatggtcgccagtgtcgccgccgaactgggcatcgacgaggcccgtggcggcttgcgtccggacgacaagttgcaagtgctgcaacaactgcacaggaacggccgcaaggtgttgatgctcggcgacggggtcaacgacgtgccggtactggccgctgcggacatcagcgtggccatgggttcggccaccgatctggcaaaaaccagtgccgacgcggtgttgctgtccaaccgtctcgacgccttggtacaagccttcacgctggcccgccgcactcgccgggtgatcatcgagaacctgttgtgggccgcgctgtacaatggcctcatgttgccgttcgccgccctcggctggatcactccggtgtgggccgccgtcggcatgtcgatcagttcgctgaccgtggtgctcaacgccctgcgcctgactcgc

SEQ ID NO: 37543 - DNA, 786 bp, Pseudomonas fluorescens
atgcagatttccctcgcccgccaagtggctcttgtcaccggcgccagttccggcatcggccacggcgccgccaaagccctggccgctgccggtgccgctgtcgtcatcaactacaaccgccaggccgagcccgccgaagcgctggcccggcagatcgtcgccgacggtggtcaggccatcgcgattggcgcagatgtttcgaaagaagaagacgtggagcggctgttccagcaaaccctcgacgccttcggcacactggacattctggtggccaattccggcctgcaaaaagacgcggcggctgtggatatgtcgctggccgactggaacgcggtgatcgacgtcaacctcaccggccagttcctctgcgcccgcgccgcgctgcggatcttcaatcgccagggcgtgcgcgaaggcgtgtcccgggccgccggcaagatcatccacatgagctcggtgcaccagcgcattccgtgggctgggcacgtcaattacgcagcgtccaagggcggcgtcgatcagctgatgcagaccctggcccaggaagtcagccaccagcgcatccgcatcaacggcatcgcgccgggggcgatccgcacggccatcaacaaagacgccaccgaaggcgacgccgcgcaggccctgctcaaactcatcccttacgggcgcatcggcgatgtcgaggacgtggccaacgcggtggtgtttctcgcctccgatgcctccgactacatcgtcggcaccaccttgttcatcgacggcggcatgagcctctatccggagttc

SEQ ID NO: 37544 - DNA, 978 bp, Pseudomonas fluorescens
atgactgaaatcgaatcctcagtcgacgacttgctgatgagcgaagagcaggccaacaacctgacttatttcgccttcgccaagcaacataatgccgaacccgcgctggcgccgaccaaggccagcgtcggcgcactgccggatgttctggcaggccgctaccacctcgagcgtctgctcggggccggtggcatgggagcggtttaccgggcccgggatctgctgcacgagcagttcggcgatcccgatccttacattgcgctgaaaatcctcagcgaagaatttgccgagtcgccggacgccagtgccttgctctacagcgagtttgccctgacccgacgcctgcgccacgacaacgtgctgcgaccgcacacgttcgaagtcgacaccgattgccagcgggccttcatcaccatggaactcatgcgtggcctgactctggacaaactgctctgcgagcggccgctgggcctgccgtggaaagaactgcgcgacatcgcgctgccgctgctcgacgcgctggcctacgcccaccgtcgcggcgtgctgcacggtgacatgaagccgagcaacgtcatgctcagcgaagacggcgtgcgcctgttcgacttcggtctcgggcaagccgaggagggcatcctgcccggcctgccgcacctgagccgcgagcgcttcaacgcctggacaccgggctacgccgcccccgaactgcttgagggccaaccgctgtcggccagcgcggacgtgtacggcgtggcctgcgtgatctatgaactggcgggcggcaaacacccgttccgccgcttgccctcgacccaggcccgtgacgaacacctggagcgcgagctgcaagccccggcaaatctaccgacacactgctggcccgcgctgcgcaccgcgctggcctttgacgcggcagagcgcaacatttctgccgaacaattgcgtgacgccttgggcgccacttcgtcctggctg

SEQ ID NO: 37545 - DNA, 777 bp, Pseudomonas fluorescens
atgcggatcatcagtgtgaacgtcaatggtattcaggctgcagtcgagcgcggtttgctcagttggctgcaagcacagaatgccgacgtcatctgcctgcaggacacccgtgcctccgcctttgaactggatgacccagccttccaactggacggctacttcctttatgcctgcgatgctgaagtccctgcccaaggcggcgtggctttgtattcgcggttgcaaccgaaggctgtcatcagcggtctcggtttcgagacggccgaccgctacgggcgctacctgcaagcagatttcgacaaagtcagtattgccaccttgctgcttccttcggggatgaacggcgatgaggatttgaaccagaagttcaagctcatggacgacttcggcaagtacctggacaaacagcggcgcaaacgtcgcgagtacatttattgtggctcgctgtacgtcgcgcagcagaagctcgacatcaagaactggcgcgacagccagcaatccccgggcttcctggcgccggagcgcgcctggatggacgagattgtcggcaacatgggctacgtagatgccctgcgcgaagtcagccgcgaaggcgaccagtacagctggtggccggacaacgaacaggccgagatgttgaatctgggctggcgcttcgactaccagatcctgactccgggactgcggcgcttcgtgcgcagcgcacgcctgccacgtcagccacggttctcgcagcatgcaccgctgatcgtcgactacgactggacgctgaccatc

SEQ ID NO: 37546 - DNA, 900 bp, Pseudomonas fluorescens
atgaccctcgaacgcgatgccgccgccaacactgccaaggtcctgtccgaagcgctgccttatatccgccgatacgtcggcaagaccctggtgatcaaatacggcggcaacgcgatggaaagcgaggagctgaaaaccggcttcgcccgcgacatcgtgctgatgaaggccgtgggcatcaacccggtagtggtgcacgggggtggcccgcagatcggtgatctgctcaagcgcctgtcgattgaaagccatttcgtcgatggcatgcgcgtcaccgacgccgcgaccatggacgtggtggaaatggtcctcggcggtcaggtcaacaaaagcatcgtcaacctgatcaaccgtcacggcggcagcgccatcggcctgaccggtaaagacgccgggctgattcgcgcgaagaagctcaccgtcacccgccagaccccggagatgacccagccggaaatcatcgacatcggccatgtgggcgaagtggtcgggatcaacaccgaactgctgaacctgctggtcaaaggcaatttcatcccggtgatcgcaccgatcggcgtgggtgaaaacggcgagtcgtacaacatcaacgcggacctggtggccggcaaggttgctgaagcgctgaaagccgagaagctgatgctgctgaccaacatcgccggcctgatggacaagtcgggcaccgtgctgaccggcctgagcacccagcaggtcgacgacctgatcgccgacggcaccatctacggcggcatgctgccgaagatccgttgcgcgctggaagcggttcagggcggtgtgggcagctcgcttatcatcgacggccgcgtaccgaacgcgatcctgctggaaatcttcaccgacaccggtgtgggtacgctgatcagcaatcgcaagcgt

SEQ ID NO: 37547 - DNA, 1353 bp, Pseudomonas fluorescens
atcttccgcgcctacgacattcgcggcaccgtgccggaattcctcaatgccgaaaccgcctactggatcggccgcgccatcggctcccaaagcctggcccaaggcgaaccgaacgtgtccgtcggtcgtgacggccgcctgtccggtccggaactggttgccgcactgatccgcggcatcgccgagagcggctgccacgtcagcgacgtcggcctggtgccgaccccggcgctgtactacgccgccaacgtgctggccggcaaatccggcgtaatgctcactggcagccataacccgtcgaactacaacggcttcaagatcgtgatcgccggcgataccctcgccaacgaacagatccaggccctgcacgagcgcctcaagaccggcaacctgagcagcggcaccggcagcgtgacccaggtcgaaatcctcgaccgctacaacaccgaaatcgtccaggacatcaaactggcccggcgcctgaaagtcgtggtcgactgcggcaacggcgcggccggcgtgatcgccccgcaactgatcgaagcgctgaactgcgaagtcatcccgctgttctgcgatgtcgacggcaacttcccgaaccatcacccggacccgggcaagcctgagaacctcgtcgacctgatcgccaaggtcaaggaaaccaacgccgacatcggcctggccttcgacggcgacggcgaccgcgtcggcgtggtgaccaacaccggcaccatcgtgtttccggaccgcctgctgatgctgttcgcccgtgacgtggtggcgcgcaacccggacgcggagatcatcttcgacgtcaaatgcacccgtcgcctgatcccgctgatcaaggaatatggcggtcggccgctaatgtggaagaccggtcactcgttgatcaaaaagaaaatgaaacaatccggcgcgctgttggccggcgaaatgagcgggcacattttcttcaaggaacgctggttcggtttcgacgacggcatttacagcgccgcgcggctgctggaaatcctcagcaaggaaaaatcttcggccgaggagctgttcgcgaccttcccgaacgatatttccacgccggaaatcaatatccatgtgaccgaagagagcaaattcagcatcattgatgcactgcacgatgcgcagtggggcccaggcgccgacctgaccaccattgacggcgtgcgggtcgactacgccaaaggctggggcctggtgcgcgcatccaacaccacaccggtgctggtgctgcgtttcgaggccgatgacgaggctgaactgcagcgcatcaaggctgtgttccatgcccaactgaaacgcgttgcacctgatctccaactaccgttc

SEQ ID NO: 37548 - DNA, 1473 bp, Pseudomonas fluorescens
gccgactgggaacaacgcgcccgcgacctgaagatcgaaggccgcgcctatctcaatggcgagtacaccgatgccgtctccggcgagaccttcgagtgcatcagcccggtcgatggccgtctgctgggcaagattgccagctgtgacgccgacgacgcccagcgcgccgtggaaaacgcccgcgccaccttcaattccggcgtgtggtcacgcctggcgccgaccaaacgcaaagccaccatgatccgtttcgccggcctgctaaagcagcacgccgaagaactggccctgctcgaaaccctcgacatgggcaagccgatcagcgattcgctctacatcgacgtgccgggcgctgcgcaagccctgagctggagcggtgaggcgatcgacaagatctacgatgaagtcgccgccaccccgcacgaccaactgggtctggtaacccgcgaaccagtgggcgtggttggcgccatcgtgccgtggaacttcccgctgatgatggcctgctggaaactcggcccggccctgtcgaccggtaactcggtgatcctcaaaccgtcggaaaaatccccgctgaccgccatccgcatcgccgaactggcggtcgaggccggcatcccgaaaggcgtgctgaacgtgctgccgggctacggccacaccgtcggcaaggcgctcgcgctgcataacgacgtcgataccctggtgttcaccggttcgaccaagatcgccaagcaactgatgatctattccggcgaatcgaatatgaagcgcgtctggctggaagccggcggcaagagcccgaacatcgtgtttgccgatgcaccggacctgcaggctgccgccgaatccgccgccagcgccatcgccttcaaccagggcgaagtctgcaccgccggttcccgcctgctggtcgagcgttcgatcaaggacaaattcctgccgatggtgatcgaggcgctgaaagcctggaaaccgggtaatccgctggatccggccaccaacgttggcgcgctggtcgatacccagcagatgaacaccgtgctgtcctatatcgagtcgggccactccgatggcgccaaactggtggccggcggcaagcgcattcttcaggaaaccggtggcacctacgtcgagccgacgattttcgacggcgtgagcaatgcgatgaagattgcccaggaagaaatcttcggcccggtgctttcggtcattgcgttcgataccgccgaggaagcgatcaacatcgccaacgacacgccttacggcctggcggcagcggtctggactcaggacatttccaaggcgcacctgaccgccaaggccctgcgggccggcagcgtgtgggtcaaccagtacgatggcggcgacatgaccgcaccgttcggcggcttcaagcagtcgggcaacggccgtgacaagtcgctgcacgcgttcgacaaatacaccgagctgaaggcgacctggatcaagctg

SEQ ID NO: 37549 - DNA, 1260 bp, Pseudomonas fluorescens
gatcagcgtcgagtagttgtcacgggtatgggcctggtatcgcccttgggaagcggcgtcgaagtggtctggcagcgcttgctggccgggcgttcgggattgcgaaacctgccggacgcggtcatcgccgatctgccgacccgggtcggcggcgtggtgccgacgatggaggaggatgccgaagccggtttcgatccggatcgcgccacgccgcccaaagaacagaagaaaatggatcgtttcattctgttcgcgatggaggctgcgcggtaggcgcttgaacaggccggctggcacccgaccgaatccggcgctcaggaacgcaccgccaccatcatcggctccggtgtcggcggcttcggcgctatcgccgatgcggtgcgcaccaccgacagccgtggtccgcgacggttgtcgccgttcaccattccctcgtttctggtcaatctcgccgcagggcatgtctcgatccagcacggtctcaagggcccgctcggcgctccggtcaccgcgtgtgccgccggcgtgcaggcgatcggtgacgctgcgcgattgattcgtgccggtgaggccgacatcgcggtgtgcggcggtgcggaagcctgcatcgatcgcgtcagtcttgccggttttgcggcagcgcgggctttgtccagtggctacaacgacacccctgagcgcgcctcgcgcccgttcgacagcggacgtgacggtttcgtgatgggcgagggcgccggtctgctggtgatcgagtcgctggagcacgcgctggcgcgcggcgcacagccgttggtcgaactggtcggctacggcacgagcgctgacgcctatcacctgaccgccgggccggaggatggtagcggtgcccgccgggcgatggcattggcgctggcccaggccggtatcacgccggatcaggtgcagcatctgaacgcccatgcgacatcgacgcctgtgggcgacctcggtgagctggcggcgatcaagtcggtgtttggcgcgcaaagcgcaatcgccgtgacctcgaccaaatccgcgacggggcatttgctgggtgcggcgggggggctggaagcgatcttcacgctgttggcgatccgcgatcaaatcgttccgccgaccctcaacctggaaaatccagatccggtgagcgaaggcgtggatatcgtccacggtcaggcgcggtcgatgccgatcgagtatgcgttgtccaacgggttcggtttcggcggggtcaatgccagcgtgctgttcaagcgc

SEQ ID NO: 37550 - DNA, 828 bp, Pseudomonas fluorescens
tctgattcggatattgcgatcaaggttgaaaatctgagcaagtgttaccagatttacgaccagccccacgatcgtctgaagcagttcctggtgaagggccgcaaattctatcgagagttctgggcgctcaacgacgtttcctttgagatcaggaaaggtgagacagtcggtatcatcggtcgtaacggcagtggcaagtccacgctgttgcagatgatttgcggcacgctcaatccaaccagcggcagtgtacagacccatggtcgtatcgctgcgcttctggagctgggttcagggttcaaccccgagttcaccggacgcgaaaacatctacatgaatgctgcggtgctgggtttgagcaccgaggaaaccgacgcccgctacgacagaatcgtcgagttcgcggacatcggcagctttatcgaacagcctgtcaaaacctattccagcgggatgatggtgcgtctggcgttctcggtggcgattcacgtggaaccggacatcctgatcgtcgatgaagcgttgtcggtcggcgacgcctacttccaggccaagtgcgcaaaaatgatccaggggatcatcgcggcaggctcgacggtcttgttcgtcagccatgacaccgcctcagtcaagtcactttgcagtcgggccctgttgctcgagtccgggcgaagtcagtatctgggcgatgtgaacacggcagtggaaaagtattactctgccttgatcgaaagccagcgtgtggaccgaggccccgaggaagttgtcaagcagactgcggcggtggcgtcggaatataccgatggtgtcgagtcattccagtccatg

SEQ ID NO: 37551 - DNA, 852 bp, Pseudomonas fluorescens
aaaggcatcatcctcgctggcggctcgggcactcgtctgcatccgttgacccttggtgtttccaagcagatgttgccgatttacgacaagccgatgatcttctatccgttgtcggtactgatgctggccggcatgcgtgaaatcctgattatctccacgccggaagatttgccctgtttcaagaagctgctgggtgacggcagcctgtacggtatcaagttgagctatgccgaacagccatctccggatggtctggcgcaggcgttcatcatcggcgaagagttcatcggcaaggatccttgctgcctgattctgggcgacaacatcttttacggtcagcacttctcggacaatctgcgttctgccagtgcccaggcgtccggtgctaccgtgtttggctaccacgtttccgatccggagcgtttcggtgtcgtcgagttcgacaagacgggccaggcactgagtattgaagagaagccactgaagccgaagtccaactacgctgttaccggcttgtacttctacgacaacgatgtggtcaagatcgccaaaggcatcaagccatcggagcgcggagagctggaaatcaccgacgtcaaccgtgcctatctcgagcagaagtcgctcaaggtggagatgttgggtcgtggttttgcgtggctcgacaccggtacgcatgactcgctgcttgaggccagtcacttcgttcatacgatcgagcagcgtcagggcttgaaagtggcatgtctcgaagagatcgcctatcacaatggctggatcactgccgagcagctgtccgctcaggccgacgcgttgaagaaaaccggatacgggcaatacctgcagaaactg

SEQ ID NO: 37552 - DNA, 1326 bp, Pseudomonas fluorescens
atgcgagttacagttttcggcaccgggtatgtcggactcgtcacgggcgcttgccttgcagatgttggacatgacgtgatgtgtgtcgatgtcgataacgcgaaaatcgagagcttgaagcaaggcatcatcccgatctacgaaccgggactggacgcactggtggcacagaaccaacgcgagggccgcctgcacttcacaaccgacgccaggcaagccgtggactttggccaattgcaaatgatcgcggtgggcaccccgcccaacgaggatggttctgccgacctgcagcatgtgctggccgtcgctcgcaccatcggcgagtacatgaccgagcacaaagtgatcgtgaacaagtcgacggttccggtaggcactgccgacaaagtcagccggaccgtcgacgcgatcctgcaggccagagacgccgggctcgacttcgatgtctgttccaatcccgagtttctcaaggaaggctcggccatcgaggactttgccaaaggtgcccgtattatcgtcgggaccgaatccgaaacggtcaaagcaatcatgcgcgagtgctacgcaccttatagccgcaaccacgacaaattgattttcatggatgtgcgcgccgccgaactgacgaagtatgcggccaatgcgatgctggcgaccaagatcagcttcatgaacgaaatcgcacagatggcagagcggctgggggccgatatcgaacaggtccggctgggtatcggctccgatccacgtatcggtttccagttcatttaccccggttgtggatacggcggctcatgcttcccgaaagacgttcaggcgctcgcccgcacggctcaggaaatcggctatgaggcgcaactgttgaacgccgtcgaggccgtcaacaaccgccagaagaacgtgatgttcgagaagctgtccctcgccttcgatcacgacctgaagaacaagaccatcgctgtctggggcttgtctttcaaacccaacactgacgacatgcgcgcagcgcccagtcgcaatctgatcgaagcaatctgggcggcaggtggaaaagtccaggcattcgacccggccgccatgagcgaggccacgcgcatttacggagcacgcgacgatctgcaactgacagccaatcgtgaaatggcactggaaggcgccgatgccctggtaatttgcacagaatggaaacaatttcgcactgtcgacttcaagaagctgaaaacctgccttaattacccggtactggtcgacgggcgtaacctgtttgaccctgccgcggccaaggaggcagggttcatgtactacgcaatcggtcgtgctgactcg

SEQ ID NO: 37553 - DNA, 1658 bp, Pseudomonas fluorescens
atgagcaagcaaccctccctgagctacaaggacgccggtgtagacatcgacgccggtgaagcattggtcgaacgcatcaagagcgtcgccaagcgcactgcgcgcccggaagtcatgggcggcctgggcggtttcggcgccctctgcgagatcccggccggttacaagcagccggtgctggtttccggtactgacggcgtcggcaccaaactgcgcctggcgctgaacctgaacaagcacgacagcatcggccaggacctggtcgccatgtgcgtcaacgatctggtggtgtgcggcgccgagccgctgttcttcctcgactactacgccaccggcaagctgaacgtcgacgtagcggccaccgtggttaccggtatcggtgcaggctgcgaactggctggctgctcgctggtcggcggcgaaaccgctgaaatgcctggcatgtacgaaggcgaagactacgacctggccggcttctgcgtcggcgtcgtggaaaaagccgaaatcatcgacggctcgaaagtcgccaccggtgacgccctgatcgccctgccatcgtccggcccgcactccaacggttactcgctgatccgcaagatcatcgaagtgtccggtgccgatatcgaaaccgttcagctcgacggcaagccgctgaccgaactgctgatggccccgacccgcatctacgtgaagccgctgctcaagctgatcaaggacaccggcgcggtcaaggccatggcccacatcaccggtggcggtttgctcgacaacatcccgcgcgttctgccaaaaggcgctcaggccgtggttgacgtggccagctggaaccgcccggccgtcttcgactggctgcaagagaaaggcaacgtcgacgaaaccgaaatgcaccgcgtgctgaactgcggcgtgggcatggtgatctgcgtggctcaggagcacgttgaagttgcgctgaacaccctgcgtgacgccggcgagcagccttgggtcatcggtcagatcgctgccgctgccgaaggcgcggcccaggtcgaactgaagaacctcaaggctcactgatgtcccagacctgtgatgtcgtggtgctgttgtccggcaccggcagtaacttgcaggccctgatcgacagcacgcggaccggcgacagcccggtccgcatcgctgcggtgatttccaaccgcgccgacgcctacggcctgcaacgcgccagtgacgcgggtatcgccacccgctcgctggatcacaagggattcgagggccgcgaggccttcgataccgctctgatcgaactgatcgacgaattcaatcccaaactcgtggtactggccggcttcatgcgcattctcagcgctgacttcgtccgtcactaccagggtcgcctgctcaacatccacccgtcgctactccccaaatacaaagggttacacactcatcagcgcgcgctggaagccggcgacgccgaacacggctgctccgtgcacttcgtcaccgaggaactcgatggcggaccactggtcgtacaggcagtaataccggtagagttgcacgattcgccgcaaagtctggcgcagcgggttcacgctcaggaacacctgatctacccgatggccgtacgctggttcgccgaaggacggctgagcctcggcgagcaaggtgct

SEQ ID NO: 37554 - DNA, 1902 bp, Pseudomonas fluorescens
atgagtgtggaaactcaaaaggaaaccctgggcttccagaccgaggtgaagcaactgctgcacctcatgatccattcgctgtattccaacaaggaaatcttccttcgcgaattgatctcgaacgcctctgacgccgtcgacaaattgcgcttcgaagccctggccaagcctgagctgctcgaagatggcgctgaactgaaaatccgtgtgagcttcgacaaggacgccaagaccgtcaccctcgaagacaacggcatcggcatgaaccgtgacgatgtgatcacccacctgggtaccatcgccaaatccggcactgccgatttcatgaaaaacctgtccggcgatcagaagaaggattcgcacctgatcggtcagttcggtgtgggtttctactcggccttcatcgttgctgacaaagttgacgtgtacagccgtcgcgccggcactgctgccagcgaaggcgtgcactggtcgtcgaaaggcgagggcgaattcgaagtcgccaccatcgacaagccggagcgcggcacccgcatcgtcctgcacctgaaatccggtgaagaggagtttgccgatggctggcgcctgcgcaacatcatcaagaagtactccgaccacatcgcgctgccgatcgagctgccgaaagaagtggccgctgccgaaggcgaagagaagcctgaagttgaatgggaaaccgtcaaccgcgccagcgccctgtggacccgccctcgcaccgaagtgaaggacgaggaataccaggagttctacaaacatatcgctcacgacttcgaaaacccgctgtcgtggagtcacaacaaggttgaaggcaagcttgagtacagctcgctgctgtatgtgccggcccgcgcaccgttcgatctgtaccagcgtgaagcgccgaaaggcctgaagctgtacgtgcagcgcgtgttcgtgatggatcaggccgagtccttcctgccgctgtacctgcgcttcatcaagggcgtggtcgattccaacgacctgtcgctgaacgtgtcgcgggaaatcctgcagaaagacccgatcatcgactcgatgaagtcggcgctgaccaagcgtgttctggacatgctggaaaaactggcgaagaacgagcctgagcaatacaagggcttctggaaaaacttcggtcaggtcatgaaagaaggcccggcagaagatttcgccaacaaggaaaaaattgccggtctgttgcgtttcgcatcgaccaacggcaccgatggcgagcagatcgtcggtctggccgagtacctggcgcgcgccaaggaaggtcaggacaagatctactacctcaccggcgaaacctacgcgcaggtcaagaacagcccgcacctggaagtcttccgcaagaaaggcatcgaagtgctgctgctgaccgaccgtatcgacgagtggctgatgagctacctcagcgaattcgacggcaagacgtttgtcgacgtcgcgcgcggtgacctggacctgggcaacctggactcggaagaggacaagaaggccgcagaagaagtcgccaagtcgaaagaaggtctggtcgagcgtctgaaaaccgcactgggcgattccgttgccgaagtccgggtttcccatcgcctgaccgattcgccggccatcctggcgattggcgagcaggacctgggtctgcaaatgcgtcagatccttgaagccagtgggcagaaggtgccggattcgaagcctatcttcgaattcaacccgagccacccgctgatcgagaagctcgacaacgaggccagcgaagatcgcttcagcgacctgtcgcacatcctcttcgaccaggccgccctggcggcgggcgacagcttgaaagacccggccgcttacgtgagccgtctgaacaagctgctggttgagctgtcggcc

SEQ ID NO: 37555 - DNA, 876 bp, Pseudomonas fluorescens
gtcctgatcaataaagacaccaaagtaatctgccagggcttcaccggtgcgcagggtactttccactccgaacaagccattgcctacggcaccaaaatggttggcggcgtgacgccaggcaaaggtggcaccactcacctgaacctgcctgtgttcaacactgtgaaagaagctgtagaagccactggcgccaccgccagcgtaatctacgttccggctcctttctgcaaggactcgatcctggaagcagctttcggcggcatcaagctgatcgtctgcatcaccgaaggcattcctaccctggatatgcttgacgccaaagttaagtgcgacgagctgggtgttaccctgatcggccctaactgcccaggcgtgatcaccccaggcgaatgcaagatcggcatcatgccaggtcacattcacttgccaggcaaggtcggtatcgtttcccgttccggcaccctgacctacgaagctgtgaagcagaccactgacgccggtttcggtcagtcgacttgcgtcggcatcggtggtgacccgatcccgggttcgaacttcatcgacatcctgaagctgttccaggaagacccgaagaccgaagcgatcgtcatgatcggcgagatcggcggttcggctgaagaagaagcggctgcctacatcaaggccaacgtgaccaagccggttgtttcctacatcgctggtgtgactgctcctccgggcaagcgcatgggccatgctggcgcaatcatctccggcggcaaaggcactgcagacgagaaattcgctgctctgcaagacgcaggcgtgaaaaccgtgcgttcgctggcagacatcggcaaggccctggccgagctgactggctgggaagtgaagaag

SEQ ID NO: 37556 - DNA, 1170 bp, Pseudomonas fluorescens
atgaatcttcacgagtatcagggtaagcagctgttcgctgaatacggcctgccagtttccactggtttcgcagtagacaccccggaagcagcagcagaagcttgcgacaaaatcggcggcaacgagtgggttgtcaaagcccaggttcacgccggtggtcgcggtaaatcgggcggcgtcaagctggttcgcagcaaagaagacgccaaagccttcgcacagcagtggctgggcaagcgtctggtgacttaccagactgacgccaacggccagccagtcaccaagatcctggttgaatcgtgcactgatatcgctaaagagctgtacctgggcgctgtcgttgaccgttcgagccgtcgcatcgtgttcatggcttccaccgaaggtggcgtggacatcgagaaaatcgctcacgacactccagaaaaaattctgaaagccactatcgatccactggttggcgctcagccattccagggtcgcgagctggcattccagctgggtctggaaggcaagcaggttgctcagttcgccaagatcttcgtaggtctggccaagctgttcaaggatcacgacctggctctgctggaagtgaacccgctggtgatcaaggctgacggcgatctgcactgcctggacgccaagatcaacatcgacgccaacgcaatgtaccgccagcctaagctgaagactttccacgatccgtcgcaggacgatccgcgcgaagcgcacgctgccaagttcgaactgaactacgtagcactggaaggcaacatcggctgcatggtgaacggtgccggcctggccatgggtaccatggacatcgtcaacctgcacggcggcaagccagccaacttcctcgacgtaggtggtggtgctaccaaagaacgcgtaaccgaagctttcaaaatcattctgtccgacagcaatgtcgctgcagtactggttaacatcttcggcggcatcgttcgttgcgacatgattgccgaaggcatcatcggtgcagtgaaagaagtcggcgtgaaaatcccggttgttgttcgtcttgaaggcaacaacgctgaactgggcgctaaagtactggcagaaagcggtttgaacatcatcgctgctaccagcctgaccgacgctgctcaacaagtcgttaaagctgcggagggcaagtaatga

SEQ ID NO: 37557 - DNA, 1434 bp, Pseudomonas fluorescens
atgtcgcagaaatttgacgtagtagtgatcggtgcgggccctggcggctacgtggcagctatcaaggccgcgcaactcggcctgagcactgcctgcatcgagaagtacaccgatgctgaaggcaagcaagccctgggcggcacctgcctgaacgtaggctgcattccttccaaggcgctgctggacagctcctggaaatacaaggaagcgaaagaaagcttcaacgtccacggtatctcgaccggcgaagtcaaaatggacgtcgctgcgatggttggccgcaaggctggtatcgtcaagaacctgaccggcggtgttgccaccctgttcaaggccaacggcgttacttcgattcagggccacggcaaactgctggccggcaagaaagtcgaagtcaccaagccggacggctcggttgaagtcatcgaagccgaaaacgtcatcctggctccaggttcgcgtccgatcgacattccaccggctccggtcgatcagaaagtcatcgtcgattcgactggcgctctggaattccaatccgtacctaaacgtctgggcgtgatcggcgctggcgtgatcggtctggaactgggttcggtgtggtcgcgtttgggtgcagaagtgactgttctggaagccctggacaccttcctgatggcagcggacaccgcggtttccaaggaagcgctgaaaaccctgaccaaacagggtctggacatcaagctgggcgcccgtgtaaccggctcgaaagtgaacggcgacgaagtcgttgtgaactacaccgacgccaacggcgaacagaccatcactttcgacaagctgatcgtagccgttggtcgccgtccggtgaccactgatctgctggctgccgatagcggcgtgaccctggacgagcgcggtttcgtgcacgttgacgatcactgcgccaccaccgtaccgggcgtttacgccatcggcgacgtggttcgcggcatgatgctggctcacaaggcctcggaagagggcatcatggttgtcgagcgcatcaagggtcacaaggcccagatgaactatgacctgatcccttcggttatttatactcacccggaaatcgcatgggtcggtaaaaccgagcaggccttgaaagctgaaggcgttgaagttaacgtcggcaccttcccgttcgcagcatccggccgtgccatggccgccaacgataccggtggtttcgtcaaggtcatcgccgatgccaagactgaccgcgtattgggcgtgcacgtgattggcccgagcgccgcagaactggttcagcagggcgcgatcggtatggaattcggcaccagcgctgaagatctgggcatgatggttttctcccatccgaccctgtctgaagccttgcacgaagccgctttggcagtgaatggcggcgccatccacattgccaaccgcaagaagcgt

SEQ ID NO: 37558 - DNA, 1221 bp, Pseudomonas fluorescens
atggctatcgagatcaaagcccccactttcccggaatcggttgccgatggcaccgttgccacctggcacaaacaaccgggcgacgccgtcaagcgtgacgaactgatcgtcgacatcgaaaccgacaaagtcgtactggaagtgctggctaccgccgacggcgtgctgggcgcaatcgtcaagggcgagggcgaaaccgtcctgtccgacgaagtcctgggctccatcgttgaaggcggcgctgcatccgctgctccggctgccgctgctgctcctgccgctgccgccgctgcacctgctgccgctgatggcgaagacgacccgatcgctgctcctgctgcgcgcaagctggctgaagagaacggcatcaacatcgcttccgttgccggcaccggcaaaggcggtcgcgtgaccaaggaagacgtggttgcagccgttgctgccaagaaagccgctccggctgctgcgcctgccaaggctgctgctccggccgccgccgctcctgtgttcgccgctggcgaccgcatcgagaagcgcgttccgatgacccgcgttcgtgccaccgttgccaagcgtctggttgaagctcaatcgaacatggcgatgctgaccactttcaacgaagtcgacatgaccgaagtcatggccctgcgttcgaagtacaaggatctgttcgagaagtcccacaacggcgtacgcctgggcttcatgtcgttcttcgtgaaggctgccaccgaagcgctgaaacgcttcccggcggtcaacgcttcgatcgatggcaacgacatcgtttaccacggttatgccgacatcggcgtcgctgtttccagcgaccgcggcctggtggttccggttctgcgtaacgccgaacacatgagcctggctgaaatcgaaggcggcatcgccaccttcggcaagaaagcccgtgacggcaaactgtcgatggacgaaatgaccggcggtaccttcaccatcaccaacggtggtaccttcggttcgatgatgtcgaccccgatcgtcaacccgccgcaggcagcgattctgggcatgcacaacatcatccagcgtccgatggccatcaacggtcaggtcgtgatccgtccgatgatgtacctggcactgtcctacgatcaccgtctgatcgatggcaaagaagctgtaaccttcctggtgaccatcaagaacctgctggaagatccggctcgtctgttgctggatatc

SEQ ID NO: 37559 - DNA, 2823 bp, Pseudomonas fluorescens
atgcaagaaagcgtgatgcagcgcatgtggaacagcgcctacctttcaggtggaaacgctgcctatgtggaagagctctacgagctctacctgcacgaccctaacgctgtgccagaagagtggcgcacctactttcagaagctgcctgccgacggcagctctgccaccgatgtttcgcactccacaattcgcgatcatttcgtgctgctggcaaagaaccagcgccgcgcccaaccggtttccgccggcagcgtgagcagtgagcacgagaagaagcaagttgaagtgctgcgattgatccaggcctaccgtatgcgtggccaccaggcagcccagcttgacccgctggggctgtggcagcgtcctgcacctgcagacctgtcgatcaatcactacggcttgaccaatgccgatcttgatacgaccttccgtgccggcgacctgttcatcggcaaagaggaagcgagcctacgcgaaattcacgaagcgttgcagcagacatattgccgcaccatcggcgctgaatttacgcacatcaccgattccgagcagcgccagtggttccagcagcgtctggaaagcgtgcgtggccgtccggaatattccgcggacatcaagagccacctgctcgagcgcgtgacggccggtgaaggcctggaaaaatacctgggcaccaaatacccgggcaccaaacgtttcggtctggaaggcggcgaaagcctgattccgatgctcgacgaactgatccagcgttccggttcctacggcaccaaggaagtcgtcattggcatggcccaccgtggccgtctgaacgtactggtcaacaccttcggcaagaacccgcgcgagctgttcgacgagttcgaaggcaagaagaaggtcgagctgggttccggtgacgttaaataccaccagggcttctcgtccaacgtaatgaccaccggcggtgaagttcacctggccatggcgttcaacccgtcccacctggaaatcgtttccccggtggtcgagggttcggttcgcgcccgtcaggatcgtcgcaacgaccctaccggtgagaaggttctgccgatctccatccacggtgatgctgcattcgccggtcaaggcgtggtcatggaaaccttccagatgtcgcagacccgcggtttcaagaccggcggtaccgtgcacatcgtgatcaacaaccaggtcggtttcaccatcagcaacccgctggactcgcgctccaccgagtacgcgaccgacgttgcgaaaatgatccaggcgccgatcctccatgtgaatggtgatgatccggaagccgtgttgttcgtgacccagctggccatcgactaccgcatgcagttcaagcgtgacgtggtgatcgacctggtctgctaccgtcgtcgcggccacaacgaggccgacgagccaagcggcacccagcctctgatgtatcagcagatcaccaagcagcgcaccacccgtgagctgtacgctgatcgtctgacccaggccggtgtactggacgcagagcgtgttcaggcgaaagtcgacgaataccgcaacgcgctggacaacggtctgcacgtcgtgaaatcgctggtcaaagagccgaacaaagagctgttcgtggactggcgtccgtatctgggccacgcctggactgcgcgtcacgacactcgcttcgacctcaagaccctgcaggaactgtccgccaagctgctggaaattccggaaggcttcgtggttcagcgtcaggtcgcgaagatctacgaagaccgtcagaagatgcaagccggcggcctgccgatcaactggggttacgccgaaaccatggcgtacgcgaccctggcgttcgaaggtcacccgatccgcatgaccggtcaggacattggccgcggcacgttctcgcaccgtcacgctgtgctgcacaaccagaaagatgccggtacctacattccgctcaagcatctgtatgaaggtcagccacgcttcgacctgtacgactcgttcctgtcggaagaagccgtactggcgttcgaatacggctactcgaccaccacgccaaacgcgctggtgatctgggaagcccagttcggcgacttcgccaacggtgcacaggtcgttatcgaccagttcatcaccagcggcgagcacaagtggggccgtctctgcggtctgaccatgctgctgccacacggttacgaaggtcagggccctgagcacagctcggcacgtcttgagcgttacctgcagctgtgcgccgagcacaacattcaggtgtgcatgccgaccaccccggcccagatctaccacttgctgcgccgtcaggtgattcgcccgctgcgcaagccattggtcgttctgactccaaagtcgctgctgcgccacaagctggccatctcgactctggaagatctggccgaaggttcgttccagaccgttatcccggaaatcgatgcactggacccgaaaaaggtcgagcgcgttgttctgtgcagcggcaaggtctactacgacctgctggaaaaacgtcgtgccgaaggccgcgaagatatcgccatcgtgcgtatcgagcagctgtacccgttccctgaggacgacttgaaagaagtcctggctccttacaccaatgccaaagcggccgtgtggtgtcaggaagagccgatgaaccagggcgcctggtactgcagccagcaccacctgcgtcgcagcatcagcaacctcaacaaatctctcgtactcgagtacgcgggccgtgaggcttctgctgccccagcatgtggttacgcatcgatgcacgccgagcagcaggaacaactgctgcaagacgcgttt

SEQ ID NO: 37560 - DNA, 699 bp, Pseudomonas fluorescens
atgttgcaagtcagtgtttatcgttacaaccctgatcaggacgctgcgccgttcatgcaggaattccaggttgataccggtggtaaagacctgatggtgctggacgtgctggccctgatcaaagagcaggacgaaggtttctcctatcgtcgctcctgccgtgaaggcgtctgtggctccgatggcatgaacatcaacggcaagaacggcctggcgtgcatcacgccgctgtccgctgtcgtcaaaggtaacaagctgatcgttcgtccgctgccaggtttgccggttatccgtgacctggttgtcgatatgagcatcttctacaagcaatacgagaaggttaagccattcctgcagaacgacacgccggctccggccatcgagcgtctgcagtcccctgaagagcgtgaaaagctcgacggtctgtacgagtgcatcctgtgcgcctgctgctcgacctcttgcccgtccttctggtggaacccggacaagttcctgggtccagctgccctgctgcaagcgtaccgcttcctggcagacagccgtgataccaagacgtccgagcgtctggcgtccctcgatgacccgttcagcgtcttccgctgccggggcatcatgaactgcgtcaacgtatgtccgaaaggcctgaacccgactaaggccatcggtcacatccgtaacatgctgctttcgagcggc

SEQ ID NO: 37561 - DNA, 1761 bp, Pseudomonas fluorescens
attccaacgatttctttcgacgccatcattattggtggcggcggtgccggcatgcgcgcagcgctgcaactggcacagggcggtcacaagactgccgtgatcaccaaggttttcccgacccgttcgcacactgtgtccgcacagggcgggatcacctgcgccatcgcttcggccgacccgaacgatgactggcgctggcacatgtacgataccgtcaagggttccgactacatcggtgaccaggacgctatcgaatacatgtgtcaggaaggcccggctgccgttttcgagctggaccacatgggtctgccgttctcgcgtaccgagcaaggccgtatctaccagcgtccgttcggcggtcagtcgaaggattacggtaaaggcgggcaggctgcccgcacctgcgccgcttccgaccgtaccggtcacgcgctgctgcacaccctttatcagggcaacctgaaagccggtaccacgttcctgaacgagtactacgctgtcgacctggtgaaaaaccaggaaggcgaattcgtcggtgtgatcgcgatctgcatcgaaaccggcgaaaccacctacatccgcgccaaagccaccgtactggctaccggcggtgcaggtcgtatctatgcatccaccaccaacgccctgatcaacaccggtgacggcgtcggcatggctctgcgtgctggcgtgccggtacaagacatcgaaatgtggcagttccacccgaccggcatcgccggcgccggtgtactggtgaccgaaggttgccgtggtgaaggtggttacctgatcaacaagcacggcgagcgtttcatggagcgttatgctccgaacgccaaagaccttgccggtcgtgacgtggttgcccgttcgatggttaaagagatcatcgccggtaatggttgcggtccgaatggcgaccacgtgatgctcaaactcgaccacctgggcgaggaagtgctgcacagccgtctgccaggcatctgcgaactgtcgaagactttcgcacacgttgatccggtggttgctccggttccggttgttccgacttgccactacatgatgggcggcgttgccaccaacattcatggccaggcgatcacccaggacgccgaaggcgtggatcagatcattcctggtctgttcgcggtaggtgaagtggcttgcgtatcggttcacggtgccaaccgtctgggcggcaactcgctgctcgacctggtggtattcggccgcgctgccggcctgcacctggagaaggcgctgaccgacggcatcgaatacgacgacgctaccgaagccgacatcgaagctgccctggcacgtctgaacgccctgaacaaccgtaccgacggcgaagacgtcgctaccctgcgtcgcgagctgcaaagctgcatgcagaactacttcggtgtattccgtaccggcgaatacatgcagaagggtattgcccagctggccgatctgcgcaagcgcatcgccaacgtgaagatcaacgacaagtcgcaggcgttcaacactgcccgtatcgaagcgctggaactgcaaaacctgctggaagtggctgaagctaccgccatcgctgccgaagtacgtaaagagtcccgcggtgctcacgcccgtgaagacttcgaagatcgtgacgacgaaaactggctgtgccacaccctgtacttcccgggtgagaaacgcgtcgccaagcgtgccgtgaacttctcgccgaagactgttccgactttcgaacctaaagtccggacttat

SEQ ID NO: 37562 - DNA, 1284 bp, Pseudomonas fluorescens
atggctgacaaaaaagcgcagttgatcatcgagggcgcagcccccgtcgagctgcccattttaaccggcaccgttggtcccgatgttatcgatgttcggggcctgacggccacgggccgcttcactttcgaccccggtttcatgtcgaccgcttcctgcgaatcgaagatcacctatatcgacggcgacaacggcatcctgctgcaccgcggctacccgatcgaacagctggctgaaaagtcggactacctggaaacctgctacctgctgctgaacggcgaattgccgactgcagagcaaaaggcccagttcgtcggcaccgtgaagaaccacaccatggttcacgagcagctgaaaaccttcttcaacggcttccgccgtgacgcccacccgatggctgtcatgtgtggtgtagtcggcgccctctcggccttctaccacgactccctcgacatcaataacccgcagcatcgcgaaatctccgcgatccgcctggttgccaagatgccgaccctggccgcgatggtttacaagtactccatgggccaacccatgatgtacccgcgcaacgacctgtcgtacgcggaaaacttcctgcacatgatgttcaacaccccgtgcgagatcaaaccgatcagcccggtactcgccaaggccatggaccggatcttcatcctccacgccgaccacgagcagaacgcctcgacctccaccgtgcgtctggcgggctcctcgggtgccaacccgttcgcctgtatcgccgccggcatcgccgcactgtggggccctgcccacggcggtgcgaacgaagccgtgctgaccatgctcgatgaaatcggcgatgtttcgaacatcgacaagttcatcgccaaggccaaggacaagaacgatccgttcaaactgatgggcttcggtcaccgcgtctacaagaaccgcgaccctcgcgcgactgtcatgaagcagacctgcgacgaagtgctgaaggaactgggcatccagaacgacccgcaactcgaactggccatgcgcctggaagagatcgccctgaccgatccgtacttcatcgagcgctcgctgtacccgaacgtcgacttctactcggggatcatcctcaaggcgatcggcattccgaccagcatgttcactgtgatcttcgccctggcacgtactgtcggctggatttcgcactggaaggaaatgctctcaagcccgtacaagattggccgtccgcgtcagctgtacactggttatgagtcgcgggatatcaccaagctggaagaccgc

SEQ ID NO: 37563 - DNA, 1062 bp, Pseudomonas fluorescens
atggcacttatcagcatgcgccagatgctggaccacgcagccgagttcggctacggcgttccagccttcaacgtcaacaaccttgagcagatgcgcgccatcatggaagccgctgacaagactgactccccggtgatcgttcaggcttcggccggtgcccgcaaatacgccggcgccccgttcctgcgtcacctgatcctggcggcgatcgaagaattcccgcacatcccggtgtgcatgcaccaggaccacggcaccagccctgacgtctgccagcgctcgatccagctgggcttcagctcggtcatgatggatggctccctcggcgaagacggcaagaccccgaccgactacgaatacaacgtccgcgtgacccaacaaacggtagccatggctcacgcctgcggcgtttcggtagaaggcgagctgggctgcctgggttcgctggaaaccggcatggccggtgaagaagacggcatcggcgccgaaggcgttctggatcacagccagatgctgaccgacccggaagaagccgccgacttcgtcaagaagacccaggttgatgccctggccatcgccatcggcaccagccacggcgcctacaagttcaccaagccgcctaccggtgacgtgctggcgatcgaccgcatcaaggaaatccacaaacgcatcccgaacacccacctggtgatgcacggttcctcgtcggttccgcaagagtggctggcgatcatcaaccagtacggcggcgacatcaaagaaacctacggcgtaccggttgaagaaatcgtcgaaggcatcaagcacggcgtgcgcaaggtcaacatcgacaccgacctgcgtctggcatccactggcgccatgcgtcgcctgatggccaccaacccgagcgaattcgacccacgtaaattcttcggcgaaaccgtgaaggcgatgcgcgatgtatgtatcgctcgttacgaagctttcggtactgccggcaacgcttcgaagatcaaaccgatctcgttggaagcaatgtttcagcgttacctcaaaggtgagttgaacgctaaggtgaac

SEQ ID NO: 37564 - DNA, 1158 bp, Pseudomonas fluorescens
atgaccgtgttgaagatgtccgacctcgatctgcaaggtaagcgcgtattgatccgcgaagacctcaacgtcccagtcaaggacggtgttgtcaccagcgatgcgcgtatcctggcttcgctgccgaccatcaagctggccctggaaaaaggcgcggccgtgatggtctgctcgcacctgggtcgtccgaccgaaggcgaattctctgccgagaacagcctcaagcctgtcgccgactacctgagcaaggccctgggccgcgaagtgccgctggtggccgactacctgggcggcgttgacgtcaaggccggcgacatcgtgctgttcgaaaacgtgcgcttcaataagggcgagaaaaagaacgccgacgaattggcccagcaatatgccgccctgtgcgacgtgttcgtgatggacgctttcggcaccgctcaccgtgctgaaggttcgacccacggcgtcgccaagttcgccaaagtcgccgctgccggcccgctgctggctgctgagctcgacgcactgggcaaagccctgggcgccccggccaagccgatggcggccatcgttgccggctccaaggtctcgaccaagctcgacgtactgaacagcctgagccagatctgcgatcaactgatcgtcggcggcggcatcgccaacaccttcctcgcggcggccggtcacccggtcggcaagtcgctgtacgagccggacctgctggacaccgcgcgcgccatcgccgccaaggtcagcgtgccgctgccggtcgacgtggtggttgccaaggaattcgctgaaagcgccgaagcgaccgtgaaactgatcgctgacgtcgctgccgacgacatgatcctcgacatcggcccgcaaaccgcggccaacttcgccgaactgctgaagtcgtcgaaaaccatcctgtggaacggcccggtcggcgtgttcgaattcgaccagttcggcaacggcaccaaagtgctggccgaagccatcgcagaaagcgcggcgttctcgattgccggcggtggcgacaccctggcggccatcgataaatatggcgtagcggaaaagatctcctacatttccaccggcggcggcgcgttcctcgaattcgtcgaaggcaaggtgctgccggccgttgaagtcctggaaagccgggccaag

SEQ ID NO: 37565 - DNA, 1020 bp, Pseudomonas fluorescens
ccctacaaagttgcactcaacggctacggccggatcggtcgttgcgtcttgcgtgcgttgttcgagcgaggctcggcggcagggtttgaaattgtcgcgatcaacgatctggccgacatggccagcatcgaatacctgacacgcttcgactccactcacggccggttcccgggcgaggtgaaggtcgagggcgattgtctgcatattaatggccactgcgtgaaggtcctgcgcagtgccacccccgaaggcatcgattgggcgtcgctgggtgtcgatctggtgctcgaatgctccggcgcctggcacacccgcgcagacggccagcgttttctcgacgccggcgcgccgcgtgtgctgttttcgcagccgatggccagcgaggcggatgtcgatgccaccatcgtctacggcgtcaatcaggattgcctgaccggcgacgaactgctggtgtccaacgcctcctgcaccaccaactgcggcgtgccgctgttgcgtctgctggatcaggcggtcggactggattacgtgtcgatcactacgattcactcggcgatgaacgatcagccggtgatcgacgcctatcaccacgaagacctgcgccgcacccgctcggcgttccagtcggtgatcccggtgtccaccggtctggcgcgtggtatcgagcgcctgctgccggaacttgccgggcgaattcaggccaaagccgtacgcgtgccgacggtcaacgtgtcctgcctcgacatcacgatgcagaccgcgagcgacaccgacgccggcgaggtcaaccggatcctgcgcgacgctgccaccagcggcccgctcaaaggcctgttggcctacaccgagctgccccacgccagttgtgatttcaaccatgacccacattcggccatcgtcgatgccagtcagacccgcgtttccggcccacggctggtgaacatcctggcctggttcgacaacgaatggggttttgccaaccgaatgctggatgttgcagaacactatctgcaaacagcg

SEQ ID NO: 37566 - DNA, 1995 bp, Pseudomonas fluorescens
atgcctagccgtcgtgagcgtgccaacgccattcgtgccctcagcatggatgccgtgcaaaaagccaacagcggccatcccggtgcccctatgggtatggcagatatcgccgaagtgctttggcgcgactacctcaagcacaacccgagcaatccattgttcgccgaccgtgaccgctttgtgctgtccaacggccacggctcgatgttgatctactcgctgctgcacctgaccggttacgacctgtcgatcgacgatctgaagcaattccgtcaactgcacagccgtaccccgggtcacccggaattcggttacaccccgggcgttgaaaccaccaccggcccgctgggtcagggtctggccaacgccgtgggcttcgccttggcagaaaaagtcctgggcgcgcagttcaaccgtcctggccacaacatcgtcgaccaccacacctacgtgttcctgggtgatggctgcatgatggaaggcatttcccacgaagtcgcttccctggccggtaccctgggcctgggcaagctgattgccttctacgatgacaacggcatctccatcgacggcgaagtcgaaggctggttcaccgacgacacgccgaagcgtttcgaatcgtacaactggcaagtgatccgcaacgtcgacggtcacgacccggaagagatcaagaccgccatcgagaccgctcgcaagagcccgctgccgaccctgatctgctgcaagaccaccatcggtttcggttcgccgaacaagcaaggcaaggaagattgccacggcgccccgctgggtgacgcggaaatcgccctgacccgtcaggcgctgaactggaaccacggcccgttcgaaatcccggccgacatctatgccgagtgggatgccaaggaaaaaggccgcgccgccgaagccgagtgggatcagcgtttcgctgcctactccgccgcgttcccgaccgaagccaacgaactgatccgtcgcctgagcggcgagctgccggccgacttctccgagaaggccgatgcctacatcgctgaagtcgcggccaaaggcgaaaccatcgccagccgtaaagccagccagaacgccctgaacgcgttcggcccgctgctgccggaagtgctgggcggttcggctgacctggccggttccaacctgaccctgtggaaaggctgcaaaggcgtcagcgccgaagacgccagcggcaactacatgtactacggcgtgcgcgaattcggcatgaccgcgatcatgaacggcgttgccctgcacggcggtctggtgccttacggcgcgaccttcctgatgttcatggaatacgcccgcaacgccgtgcgcatgtccgctctgatgaagcagcgtgtgatccacgtctacacccacgactccatcggtctgggcgaagacggcccgacgcaccagccgatcgagcaactgaccagcctgcgcagcacgccgaacctcgacacctggcgtccagccgatgccgttgaatcggccgtggcctggaaaaacgctctggagcgcaaggacggcccgtcggcgctgatcttctcgcgtcagaacctgcagcaccaaacccgtgatgccggccagatcgccgacatccgtcgtggtggttatgtgctgaaggactgcgcaggcgagcctgagctgattctgatcgccaccggttcggaagttggtctggccgttcaggcctacgacaaactcaccgagcagggccgcaaggtgcgcgtggtttccatgccatgcaccagcgcgttcgacgctcaggacgccagctacaagcaatcggtcctgccgttgcaggttggcgcgcgtatcgcgatcgaagcggctcacgccgacttctggttcaagtacgtgggtctggaaggtcgcgtgatcggcatgaccacctacggcgaatcggctccggcttcggcactgttcgaagagttcggcttcaccctggaaaacatcctgggtcaggctgaagagctgctggaagac

SEQ ID NO: 37567 - DNA, 1188 bp, Pseudomonas fluorescens
atgagcgaatactccctcttcacctccgagtccgtgtctgaaggacatccggacaaaatcgccgaccagatttccgatgcagtgctggacgccatcatcgcccaggacaagcacgcacgcgttgcggtggaaaccctggtcaagacgggcgtggccatcgttgccggtgaagtgaccaccagcgcctgggtcgacctggagcagatcgttcgtgacgtgatctgcgacatcggctacaccagctccgacgtcggcttcgacggcgcgacctgcggcgtgatgaacatcatcggcaagcagtcccctgacatcaaccagggtgttgaccgtgccaagcctgaagatcagggcgccggcgaccagggcctgatgttcggctacgccagcaacgaaaccgacgtgctgatgccggcaccgatcaccttctcgcaccagctggtacagcgtcaggccgaagcccgtaaatcgggtctgctgccttggctgcgtccggacgccaagtcgcaagtcacctgccgttacgaaggcggcaaggttgtcggtatcgacgccgtggttctgtcgacccagcacaacccggaagtgtcgtacaacgacctgcgcgaaggcgtgatggagctgatcgtcaagcacgtgctgcctgccgaactgctgagcaaggacacccagttccacatcaacccgaccggccagttcatcattggcggcccggtaggtgactgcggtctgaccggtcgcaagatcatcgtcgacagctacggcggcatggcccgtcacggcggcggcgcgttctccggtaaggatccatccaaggttgaccgttcggcggcctacgctggccgttacgttgccaagaacatcgtggcggccggcctggccgagcgttgcgagattcaggtttcctacgcgatcggtgtggcccagcctacctcgatctcgctgaacaccttcggcaccggcaagatcagcgacgacaagatcatcaaactggtccgcgaagtgttcgacctgcgtccatacgcgatcaccaccatgctggatctgctgcacccgatgtaccaggaaaccgcagcctacggccacttcggccgtgctccgcagaccaagaccgttggcgaagacaccttctccacgttcacctgggaaaaaaccgaccgcgccgacgctctgcgttccgctgccggcctg

SEQ ID NO: 37568 - DNA, 1407 bp, Pseudomonas fluorescens
atgagcgctgttatcacgcctgccgattttaacgattacaaagttgccgacatatccctggctgcctggggtcgtcgcgaaaccatcatcgccgagtcggaaatgccggccctgatgggtctgcgccgcaagtacgcttccgagcagcctttgaaaggcgcaaaaatcctcggctgcatccacatgaccatccagaccgccgtgctgatcgaaaccctggttgccctgggtgccgaagtacgctggtcgtcctgcaacattttctcgactcaggatcaggccgctgcttccatcgctgctgccggcatcccggttttcgcctggaaaggcgagactgaagaagagtacgagtggtgcctggagcagaccatcctgaaggatggccagccatgggacgccaacatgatcctcgacgacggcggcgacctgaccgagctgctgcacaagaaatacccacaggttctggaccgtgttcacggcgtgaccgaagaaaccaccaccggcgtgcaccgtctgctggacatgctggccaagggcgagctgaaaatcccggccatcaacgtcaacgactcggtgaccaagtccaagaacgacaacaagtacggctgccgtcacagcctgaacgatgccatcaagcgtggcaccgaccacctgctgtccggcaagcaagcgctggtcatcggttacggtgacgtgggcaagggttcggcccagtccctgcgtcaggaaggcatgatcgtcaaagtctccgaagttgacccgatctgcgccatgcaagcctgcatggacggtttcgaactggtttcgccgttcatcgacggtatcaacgacggcaccgaagcgagcatcgacaaagcgctgctgggcaagatcgacctgatcgtgaccaccaccggtaacgtcaacgtttgcgacgcaaacatgctcaaagccctgaagaagcgcgccgttgtctgcaacatcggtcacttcgacaacgaaatcgacaccgctttcatgcgcaagaactgggcatgggaagaagtgaagccacaggtacacaagatccaccgtaccggcgctggctcgttcgatccacagaacgacgactacctgatcctgctggccgaaggccgtctggtgaacctgggcaacgctaccggtcacccaagccgcatcatggacggttcgttcgccaaccaggttctggcgcagatcttcctgttcggccagaagtacgccgacctgtcgccagcccagaaagccgagcgcctgaccgttgaagtactgccgaagaaactcgacgaagaagtggccctggaaatggttcgcggcttcggcggcgtggtcactcaactgaccaagcaacaggctgactacatcggcgtgaccgtcgaaggtccgttcaagccacacgcttaccgctac

SEQ ID NO: 37569 - DNA, 1866 bp, Pseudomonas fluorescens
atgtcctttgcttccctcggtctctccgaggctttggtccgcgctatcgaagacgcgggctataccgagcctactccggtgcaacagcgggccattcccgccgtgttgcaaggtcgcgacctgatggttgcggcacagacaggtaccggtaaaaccggcggtttcgcccttccgatcctggagcggctgttccccaacggtcacccggacaaatcccagcgtcacggcccgcgccaaccgcgcgtgctggtcttgaccccgacccgcgaactcgcggcgcaggttcacgacagtttcaagatctacgcccgcgacctgaaattcgtcagcgcgtgcatcttcggcggcgtcggcatgaatccgcaggttcaggccatgtcccgtggcgttgacgtgctggtggcgtgccccggtcgtctgctcgacctgtgcggccagggcagtgtcgatctgtcccacgtcgaaattctcgtgctcgacgaagccgaccgcatgctcgacatgggcttcgtccacgacgtgaagaaagtcctcgcccgtctgccggccaagcgccagaacctgctgttctcggcgaccttctccaaagacatcacggatcttgccggcaaactgctgcacaacccggaacgcatcgaagtgacgccgccgaacaccacggtcgagcgcatcgaacaacgcgtcttccgtctgccggccagccacaagcgtgcactgctggcccacctgatcaccgctggcgcgtgggaacaggtgctggtgttcacccgcaccaagcacggcgccaaccgtctggccgagtacctggacaaacacggcctgccggctgtggcgatccacggcaacaagagccagaacgcccgcaccaaagccctggccgacttcaaggccggtgaagtgcgcattctggttgccaccgacatcgcggcacgcggtctggacatcgaccagttgccacacgtggtcaacttcgaactgccgaacgtcgatgaagactacgtccaccgcatcggccgtaccggccgggccggtcgttcgggcgaggcgatctcgctggtcgcaccggacgaagaaaaactgctgaaaagcatcgagcgcatgaccaagcagaaaatcgccgacggcgacctgatgggcttcgatgccagtaccatcgaggccgagaagcctgaagttcgcgagcgtccggacatgcgcaacccgcgcaatgcccgcggcccacgcggtgacggcccgaatggcggcggcggtggcggcggtcgtaaagacaaaggcaaagacaagggcaaggaaaaaccggccggcgaacgtggcgagcgtccagcccgtcaacagaagccgcgcgaaggcaccccggcccgcgaacaacgccagccaagccagccgccacgcgccgctgctgatcgcgctccggacgagttcctcgacgacgatatcgataacttcggtaaccgcgtcgactacgtgccgaagcaggctccgaccggtggtcgcaaccgtcgtccaggcgctccggcgcaaggcgcaggttcaggcgcaccccgcggcggtcagtcgcaaggtcgccagaacggcccgcgtaacagcaacggttcgagcaccggcacgccgccaggcaagcgcagcggcccacgcaacggtgcaccgcgtgacggccagggtcgtcgcgatgaaaactcgcgcaaccgccgcccggcccgtgatgatcagcaacgcgctgaaccggccgtgcagaacccgcgcagcagcgggccgaagatcatgcacaaggaatcgaaagccgaccgcttcccgacccctgagcagctggatcaactgccaagccgcccacgcggtgaaaaaccggccttgctgacccgcaatcgc

SEQ ID NO: 37570 - DNA, 1476 bp, Pseudomonas fluorescens
atgtctgtcggttggctgcgcgcctgtgcgctggtggtgttggggctgtttagcgttacggcgctggccaaggataaaaccgcaatcgtgatcggcggcggcctgtcgggcctgacggcggcttacgaactgcagaacaagggctggcaggtcacgctgctggaagccaagccgagcctgggcggtcgctcgggcatggccaccagcgagtggatcggcaacgacaagactcaaccggtgctgaacaagtacgtttcgacgttcaagctgagcaccacgccggcgcctgaattcgttcggaccccgggttacctgatcgatggcgagtatttctccgccgccgacctgaccaccaaacaacctgccacggccgaagcgctgaagcgctacgagaaaacccgtgacgatctggcgcgctcgatcgacgatccgcagaacccggccgcgaccaacaccctgcacgccctggaccagatcaacgtctcgagctggctcgacaagcagaacctgccggccaccgcacgtcagctgatcaaccaggacatccgcacccactacgacgagccttcgcgcctgtcgttgctgtacttcgcacagcagagccgggtgtatcgcggcgtgtccgaccgtgacctgcgcgcttcgcgtctggtcggtggcagcccggtgctggcccaggccttcgtcaaacagctgaaaaccatcaagaccaactctccggtgtccgcgatcacccaggacaaggacggcgtgaccgtcaaggtcggcagcgtcggctaccaggccgattacgttgtgctggcggtgccgttgcgcgccctcaacaagatccagctgaccccggcgctggacgcccagcacctggctgctatcaagggcaccaactacggctggcgcgaccagatcatgctgaagttcaagacgccggtgtgggaaagcaaggcgcggatgtccggcgagatctatagcaacaccggtcttggcatgttgtggatcgagccagccctgaagggcggcgccaacgtggtgatcaacctgtccggcgacaacgcccgcgtcatgcaggccttcggcgacaagcagatggtcgatcaggtgctgatccgtctgcacgcgttttatccacaggcccgtggctcgttcaccggctatgaaatccgtcgctacagcaccgatccatcgaccggcggttcttacctggccttcggccctggccagatcagcaaatactggcgtctgtgggagcgtccgctgcaacgcatagcgtttgccggcgaacacaccgacaccttgtacccgggcacgctggaaggcgcactgcgcaccggtcagcgtgcagccagtcaggttgaagacctggcggcgggcaaatccttcgaaccggtcaaggtcggcccggcagcggccaccgccgcagcggcgggtgcgggtgcggcagtggcggcgaagaaaggcaacttcttcaccaacctgttc

SEQ ID NO: 37571 - DNA, 1404 bp, Pseudomonas fluorescens
atgggcctgaacaaccagtggatgcaacgcgatctcgcggtgctgtggcatccctgcacccagatgaaagaccacgaacagctgccgctgatcccgatcaagcgcggtgaaggcgtctggctggaagacttcgaaggcaagcgttatctggatgcggtcagctcctggtgggtcaacgtgttcggccacgccaacccgcgcatcaaccaacgcatcaaggatcaggtcgatcagctggaacacgtgattctggccggtttcagccatcagccggtgatcgaactgtccgagcgtctggtgaagatgacgccggaaggcctgaaccgggtgttctacgccgataacggttcgtcctgcatcgaagtcgcgctgaaaatgagctttcactactggctcaaccgcggccagccgaacaagaagcgcttcgtcaccctgaccaacagctaccacggcgaaaccatggcggcgatggcggtcggtgacgtgccattgttcaccgaaacctacaaagccctgctgatggacaccatcaaggtgccgagcccggattgctacctgcgcccgcagggcatgagctgggaagagcattcgcgcaacatgttcgcggccatggaacagacgctggcggaaaatcatgacagcgtcgcggccgtgatcgtcgagccactgatccagggcgccggcggcatgcgcatgtaccacccggtctatctcaagctgctgcgcgaagcctgcgaccgttacggtgtgcacctgatccacgacgaaatcgccgtcggcttcggccgcaccggaacgatgttcgcctgcgaacaggccggcatccgcccggacttcctgtgcctgtcgaaagccctgaccggcggttatctgccgttggccgcgtgcctgaccaccgacgaggtgtacagcgcgttctacgacgattacccgaccctgcgtgcgttcctgcattcgcacagctacaccggcaacccgctggcgtgtgcggcggcgttggcgaccctggatattttcgaacaggacaacgtgatcgagaacaaccgggcgctggctcaacgcatggcctcggcgacggcgcatctggtggatcatgcgaatgtttcggaagtccgtcagaccggcatggtgctggcgatcgagatggtcaaggacaaagccacgaaagaggcctatccgtggcaggaacgtcgcgggttgaaggtgttccagcatgcgctggagcgcggcgcgttgctgcgcccgttgggcagcgtggtgtatttcctgccgccgtacgtgatcaccccggagcagatcgacttcctcgccgaagtcgccagcgaaggcatcgacattgctacccgcgacagcgtcagcgtggcggtgccgaaagatttccatcccgggttccgcgatccgggc

SEQ ID NO: 37572 - DNA, 903 bp, Pseudomonas fluorescens
gtgagcagtctgctggtgtttcccggtcagggcgcgcaacagcccggcatgcttcagcgtttgcctcgggaaacgctgatcgaggccagcgacagcctcggtgaagatgtcttgcagttggattccagcgaagcgttgcgcagcacgcgggcggttcagctctgtctgttgatcgcaggggtcgcagcctcgcggcgattgttgcaggacggactcacagcggactacgtcgccggcctgtccatcggtgcctacccggcagcggtggttgccggagccttgagcttcagcgatgcgctgcatctggtcagcctgcgcggcgagctgatgcagcaggcttatccacagggcttcggcatgaccgcgatcatcggcctgcaattatccaccgtcgaaacgctgctggcgcaggtgcatggcgcagaaacgccggtatacctggccaacatcaacgccgataaccaggtggtgattgccggcagcgacaaggcgatgcaagcggtcgccgagttggcacgcgctcgtggcgccggtctggcaaaacggctggcggtcagcgtgccgtcgcactgcccgttgctggatgaacacgcgcaaaccctcgccgaagcgttcaccagggttgaactgaaatcaccaaaaatcgcttacctgagcggcagtcgcgccaggcctgtgacccaggtagaagcgctgcgcgacgatctcgccttcaacatgtgccgcgtggtggactggcgcggcaccgtgcaaagcgcttacgagcgcggcgtacgtttacagatcgaactgccgcccggtgcggtgctgaccgggctggcgcgccgggtgtttgaacaggggactgtcgctgccttcgacagtgcccggctcgacaccttgcaggcgctgttgcgtgaagag

SEQ ID NO: 37573 - DNA, 648 bp, Pseudomonas fluorescens
agctggaaggaggcactgcgtgccgaattcgaccagccctacatgacagagttgcgcacttttctgcagcaggagcgggcggccggcaaggaaatctatccgccgggaccgatgatcttcaacgcgttgaactcgacgccgctggacaaggtgaaagtggtcattctcggccaggatccgtaccacggcccgggccaggcccacggcttgtgcttctcggtgcaaccgggcgtgccggcgccgccatcgttggtcaacatctataaagagttgaagcgcgacctgaacatcgacatccccaaccacggctatctgcagagctgggccgatcagggcgtgttgatgctcaacaccaccatgaccgtcgagcgtgccaacgccaacgcgcacaaggacaagggctggcagttcttcacggaccggatcattgaggtggtcagccagaaacaaccgcatctggtattcatgctgtggggcgcccatgcgcagagcaagcagaagctgatcgatgccaccaagcatctggtactgacttcggtgcacccgtcgccgctgtcggcctatcgcggtttccttggctgcgggcatttcagccgcaccaacaaattcctggagcagaacggcgaagcgccgatcgagtggcgcctg

SEQ ID NO: 37574 - DNA, 1608 bp, Pseudomonas fluorescens
atgagccaacagtttcaacacgatgttctggtgattggcagcggcgctgccggtttgagtctcgcgctgaccctgcccggtcacttgcgcatcgccgtactgagcaaaggcgatcttgccaacggctcgacctattgggcacagggtggcgtcgcagccgtgctggacgacaccgacactgtcgaatcccatgtcgatgacaccctcaatgctggcggcggtttgtgccatgaagacgcggtgcgtttcaccgtcgagcacagcaaggaagcgatccaatggctgatcgaccagggcgtgccgttcactcgcgacgaacagtccggcaccgaagacggcggcttcgaatttcacctcacccgcgaaggcggtcacagccatcgacggatcatccacgccgccgatgccactggcgctgcgatcttcacgaccctgctggcccaggccaaagaacgcccgaacatcgaactgctcgaacagcgggtagcggtcgatctgatcaccgagcgtcggctggggctggaaggcgaacgctgcctcggcgcctacgtactcaaccgcaaaaccggggaagtcgataccttcggtgcacgcttcgtgatcctggcgtccggcggcgccgcgaaagtctatctatatacaagcaaccccgacggcgcctgtggtgacggcatcgccatggcctggcgctcgggctgccgagtggcgaacctggagttcaaccagttccaccccacctgcctctaccacccgcaagccaagagttttctggtaaccgaagccctgcgcggtgaaggtgcccatttgaagctgccgaacggcgaacgcttcatgcagcgcttcgactcacgcgcagaactggcaccacgggacatcgtcgcccgcgccatcgaccacgaaatgaagcgcctgggtgtcgattgcgtctacctcgacatcagccacaaacccgaagccttcatcaaatcgcacttcccgaccgtctacgaacgctgcctcggattcggcatcgacatcaccaagcaaccgatcccggtcgtaccggctgcgcattacacctgcggcggagtgatggtcgatcaacagggccgcaccgatgtgcccggcctgtacgccattggcgaaaccagcttcaccggcctgcatggcgccaaccgcatggccagcaactcgctgctggaatgcttcgtttacgcccgatcggcagcggcggacattctcgagcaactgcccgacgtcttgatcccgcgcgccctgcccgcctgggacgccagccaggtgaccgactccgatgaagacgtgatcatcgcccacaactgggacgaattgcggcgcttcatgtgggactacgtgggcatcgtgcgcaccaacaagcgcctgcaaagggcacaacaccgcgtgcgtctgctgctggatgaaatcgacgagttctacagcaactataaagtcagtcgcgacctgatcgagttgcgcaacctggcgcaagtagcggaactgatgatccgctcggccatggagcgcaaggaaagccgaggcctgcattacacactcgactacccagacctgctgcccgaagcactcgacactattctggtgccgcccacctac

SEQ ID NO: 37575 - DNA, 873 bp, Pseudomonas fluorescens
atgattgcgggcagtatggtggcactggtcacacccatggatgcacaagggcgtcttgactgggacagcctcagcaaactcgtggacttccatctcaagaacggcacccatgccattgtcgcggtcggcaccaccggcgagtcggcaacccttgatgtagaagaacacatcgccgtcatcaaagccgtggtcaaacaggttgccggtcgtattccggtgatcgccggtaccggcgccaactcgacccgcgaagctgtcgagctgacccgcaatgccaaggaagccggcgccgatgcctgcctgctggtagtcccgtactacaacaagccgacccaggaaggcctgtaccagcacttcaagcacatcgccgaagcggtcgacatcccacagattctctataacgttcccggccgcacctcctgcgacatgcaggccgagaccgtgatccgcctgtccaccgtgccgaacatcatcggcatcaaggaagcgaccggcgacctgaaacgtgccaaggcgatcatcgacggcgtgagcaaggacttcatcgtgctgtccggcgatgatccgaccgccgtcgagctgatcttgttgggcggcaagggcaacatctccgtcaccgccaacgtcgcgccacgcgaaatggccgacctgtgcgaggccgcgctcaagggcgacgccgagaccgcacgggccatcaacgaaaaactgatgccgctgcacaaggacctgttcatcgaagccaacccgattccggtgaagtgggctttggtcgaaatgggcctgatgcaccaaggcatccgcctgccgctgacctggctgagcgctccttgtcatgaaacgctgcgctcggccctgcgccagtgcaacgtcctg

SEQ ID NO: 37576 - DNA, 1223 bp, Pseudomonas fluorescens
gacgagaaagccagcgacgcgattcacagacgtacagccccgtctggcccgcatctgggtgcgtatcctatcatcgcttccaaggacccgatcctgataagacatcaacggcacgcatcgagcaaggtctggctgagccgccaagctgctggtcggtcgcgttgataaaggccgcatgaccgcccgcgaaaatggctgaagtgctcaacggcattcgtccgaccctgtcctacggtgatttcggtcacgtcgacctggtcgttgaagccgtggtcgagaatccgaaggtcaagcaagccgttctggcggaagtcgaagacaaggtcaaagaggacaccatcctcgcgtccaacacttcgaccatttccatcagcctgctggccaaggccctcaagcgtccggaaaacttcgtcggcatgcacttcttcaacccggtgcacatgatgccgctggtggaagtgatccgtggcgagaagtccagcgagctggccatcgccaccaccgttgcctacgccaagaaaatgggcaagaacccgatcgtcgtcaacgactgcccgggcttcctggtcaaccgcgtactgttcccgtacttcggcggtttcgccaaactggtcagtgccggtgtggacttcgtccgtatcgacaagatcatggaaaaattcggctggccgatgggcccggcgtacctgatggacgtggtcggcatcgacaccggtcaccacggtcgtgacgtgatggctgaaggcttcccggaccgcatgaaggacgaccgtcgttcggccatcgacgtgctttacgaagccaagcgtctcggtcagaagaacggcaagggcttctatgcctacgaggccgacaagaagggcaagcagaagaaagtcgccgatccgtcggtactggaagtgctcaagccgatcgtctacgagcagcgcgaagtcactgacgaggacatcatcaactggatgatgatcccgctgtgcctggaaaccgtgcgttgcctggaagacggcatcgtcgaaaccgccgccgaagccgacatgggtctggtctacggtattggtttccctccattccgtggcggtgcgctgcgctacatcgactcgatcggtgttgccgagttcgttgccctggccgaccagtacgctgatttgggcgcgctgtaccacccgaccgcgaagctgcgtgaaatggccaaaaacggccagagcttcttcggttaagcgccc

SEQ ID NO: 37577 - DNA, 1251 bp, Pseudomonas fluorescens
  unsure (1)..(1251): unsure at all n locations
atgagcttgaatcctagagacgtcgtgattgtcgacttcggtcgtactccgatgggccgctccaagggcggcatgcaccgcaacacccgcgccgaagacatgtcggcacacctgatcagcaaactgctggaacgcaacaccaaggtcgatcctgccgaagtcgaggacgtgatctggggctgtgtgaaccagaccctggaacaaggctggaacatcgcgcgcatggcgtcgctgatgacccagatcccgcacacctcggccggccagactgtcagccgtctgtgcggctcgtcgatgagcgcgctgcacactgctgcgcaagcgatcatgaccggcaacggtgacgtgttcgtggttggcggcgtcgagcatatgggtcacgtaagcatgatgcacggtgtcgatccgaacccgcacatgtctctgtacgcggcgaaagcctcaggcatgatgggcctgaccgctgaaatgctgggcaaaatgcacggcatcactcgcgaacagcaggacgcctttggcgtgcgttcccaccagttggcccacaaggcgactgtggaaggcaagttcaaggacgaaatcatcccgatgcagggttacgacgagaacggtttcctgaaaaccttcgactacgacgaaaccattcgtccggaaaccaccctggaaagtctggcggctctgaagccggcgttcaatccaaagggcggcaccgtgaccgccggtacttcgtcgcagatcaccgatggtgcttcgtgcatgatcgtgatgtcggcgcagcgtgcacaggacctgggtatccagcctctggccgtgattcgctccgatggcggtagcgggtgtggacccgngccatcatgnggctatnggtccgnngtaccggctactcangaaagcactganaacgtgccggnncctgggtattcaacgatattcgacttcttcgagccctcaatgaagcgttnncgccgcacagggnnccctgccagtgggctgaaagacccctgaaagtgctcccgacaagatgannatgagcaaggtnntaaccctgggcacgggcgnnggcgcgantnncgcccnntgggnntcacnnccgtnnntcggttngnnctccggnnntgcccgtnnatttcccgnngcactttgctgaacgtgatgaagcagaatggcggcaccttcggggtggccaccatgtgcattggtctcggccaaggcatctccaccgtcttcgaacgcgtttaagcgtctcgtcgatgg

SEQ ID NO: 37578 - DNA, 2610 bp, Pseudomonas fluorescens
atgggcaaatcgctggtcattgtggaatccccggctaaggccaagaccatcaacaagtatctgggtaaccaatacgtggtgaagtcgagtatcggccatatccgagacctgcccaccagcggttcggctagcgccagcaaggagcctgccgccaagcgcggcaaggctgctgcgggcgaagcgccagcgctgtcgccgaaagagaaggcgcgcaagcagctggtctcgcgcatgggtgtcgatcccgagcacggctggaaagccaagtacgagatcctcccaggcaaggaaaaggtcatcgaagagctgcgccggctcgccaaggatgctgacaccatctatctcgcaaccgacttggatcgcgagggggaagccattgcctggcacctgcgcgaagccatcggtggtgacgacagccgctacaagcgcgtggtgttcaacgaaatcaccaagaaggcgattcaggaagccttctcggagccgggcgaactcgacatcgatcgagtgaacgcgcagcaggcccgtcgtttcctcgaccgcgttgtcggctacatggtttcgccgctgctgtgggcgaagatcgcccgtggcctgtccgccggtcgcgtgcaatcggttgccgtgaagctggtggtggagcgtgagcgcgagatccgtgcgttcaacccggaagagtactgggaagtgcacgccgacctcggcaccgccaaaggctcgaccgtgcgtttcgaagtcgctcgcgagaaaggcgaagcgttcaagccgctgaacgaagcgcaggccacggccgcgctggagaagctcaagtcctccagctacagcatcgtcaagcgtgaagacaaaccgaccagcagcaagccgtcggcaccgttcatcacctccacactgcaacaggccgcgagcaaccgcctgggcttcggtgtgaagaaaaccatgatgatggcccagcgtctgtacgaagccggctacatcacctatatgcgtaccgactcgaccaacctctcggctgatgccgtagcgatggcgcgcgattacatcgaaaccgagttcggcaagaagtacctgccggagtcgccgaacgtttacagcagcaaggaaggcgcacaagaggctcacgaagcgattcgtccttccgacgccaacaccacgccagccaagctggccggcatggagcgcgacgctgagcgcctctacgagctgatctggcgccagttcctggcttgccagatgctgccggcgcaatacctgtcgaccaccgtcagcgtcgctgctggcgacttcgagctgcgcgccaagggccgcatcctgaagttcgacggttacacccgcgtgctgccgcaaatcaccaagcctggcgacgatgacgttctgccggacatggcgcagggcgacgtgatgaagcttataaagctcgatccgtcccagcacttcaccaagccgccggcccgttattcggaagccagcctggtgaaggaaatggaaaagcgcggcatcggtcgtccttcgacctacgcagcgatcatctcgaccattcaggatcgcggctacgtgaccctgcacaatcgtcgtttctattcggaaaagatgggcgacatcgttaccgagcgtctgtcggaaagcttctcgaatctcatggactacggcttcaccgccggcatggaagagaacctcgatgacgtggcccaaggcgagcgcgactggaaaaacgtgctggacgagttctacggcgacttcaagaaaaaactcgaagtggctgaaaacccagaagctggcatgcgtgccaaccagccggtgatgaccgacattccgtgcaccacttgcggccgtccaatgcagatccgtactgcatcgaccggcgtgttcctcggctgctccggctacagcctgccgccgaaagagcgctgcaaggccaccgtcaacctggtgccgggcgatgaaatcgcggcggacgacgagggcgagtcggaatccctggtactgcgcggcaagcatcgctgcccgatctgcagcacggcgatggacgcttacctgctcgacgagaagcgcaagctgcacatctgcggtaacaacccggattgcgccggctacgagatcgaagagggcagctaccgcatcaagggctacgaaggcccgagcctggaatgcgacaagtgcggcagcgagatgcagctcaagaccggccgtttcggcaagttcttcggttgcaccaatccgacgtgcaagaacactcgcaaactgctgaagagcggtgacgcggcaccgccgaagatggatccggtgaagatgcctgagctgaaatgcgaaaaggtcaacgacacctacattctgcgtgacggtgcttccggcctgttcctggcggctagccagttcccgaaaaaccgcgagacccgtgctccgctggtgattgagattctgccgcacaaggatgagatcgatccgaagtatcacttcctgtgcgaagcgccgcagaaggatccggatggtctgccagccgtgatccgctacagccgcaagaccaaggagcaatacgttcagaccgaagtcgacggcaagccgactggctggaaagcattctttgacggtggcaaatggacggttgaagacaagcgt

SEQ ID NO: 37579 - DNA, 1383 bp, Pseudomonas fluorescens
atgattccgcttatcggtcagctctaccgcaacaacaacgtggtgagctcgatctatggccgcagcctgatcaaccagtctgtcatcgcgattctcaaagctcaccgctttgctcgccaccgttctgccgacgacagcgaactctccgtccacgaaacattcccactgctcaaggccatgagcgagctcaagctcggcgcggcctcggtagatctgggcaaactggcgtacaaattccgcaacgaaggcaacggccgcaccgccgagcagttcgtccgcgaagaaatggctgacgtggttggccagcaaaacgcttcggcccgcaaaggcaccgacgttgttctgtacggcttcggtcgtatcggccgtctgctggcgcgcatcctgatcgagaaaaccggtggcggcgacggcctgcgtctgcgtgccatcgtggtgcgcaagggcgccgaaaacgacctgaccaagcgcgccagcctgctgcgtcgcgattcggtacatggttcgttcaacggcaccatcaccatcgacgaagaaaacaacaccatcaccgccaacggcaacctgatccaggttatctacgcgaagaaccctaccgaagtggattacacccagtacggcatcaaagatgcgctgctggtggacaacaccggtgtatggcgtgatgccgatggcctgggccagcacctggcgtgcccgggtatcgaccgcgttgttctgactgcgcctggcaagggcaagctgaagaacatcgttcacggtatcaaccacaacgaaatcactgctgacgacaagatcgtgtccgccgcttcctgcaccaccaacgccatcgtgccggtgctgaaagccgtgaatgacaagttcggcatcatcaacggtcacgtcgaaaccgttcactcgtacaccaacgaccagaacctgatcgacaacttccacaagggcgatcgccgtggccgtagcgccgcgctgaacatggtgatcaccgagaccggtgctgccaccgctgctgccaaggccctgcctgagctggccggcaagctgaccggtaacgcgatccgtgttccgacgccgaacgtgtcgatggccattctcaacctgaacctcgagaaagccgccacccgtgaagagatgaacgagtacctgcgctacatggcgctgcactccgatctgcacaagcaaatcgacttcgtcaattcgcaggaagtggtttcgaccgacttcgtgggctcgcgtcacgccggtgtggtcgacgctgaagcgaccatcgttcaggacaaccgcgttgttctgtacgtctggtacgacaacgagttcggttacagctgccaggtggttcgcgtaatggaagacatggccggtgtaaacccgccagcgttcccgcgc

SEQ ID NO: 37580 - DNA, 945 bp, Pseudomonas fluorescens
atggctgtctacaactacgacgtggtggtgctgggttccggcccggcgggagaaggcgcggcaatgaacgccgccaaagcagggcgcaaggtggcgatggtcgatagccgtcgccaggtcggcggcaactgcacccacctgggcaccatcccgtccaaggccctgcgtcactcggtgcggcagatcatgcagttcaacaccaatccgatgttccgtgcgatcggcgagccgcgctggttctccttcccggatgtgttgaaaagcgccgagaaagtcatctccaagcaagtcgcttcgcgtaccggctactacgcccgtaaccgcgtcgacgtgtttttcggcaccggcagctttgccgacgagcaaaccatcgaagtggtctgcgccaacggcgtggtcgaaaaactggtggccaagcacatcatcatcgccaccggttcgcgtccttatcgcccggcggacatcgatttccaccacccgcgtatctacgatagcgacactatcctcagcctcggccacaccccgcgcaaactgatcgtttacggcgccggcgtgatcggttgcgaatacgcttctatcttcagtggtctgggcgtgctggtcgagctggtggacaaccgcggccagttgctgagcttcctcgactcggaaatctcccaggcgttgagctaccacttcagcaacaacaacatcaccgtgcgtcacaacgaagaatatgaccgcgtcgaaggcgtggacaacggcgtgatcctgcacctgaagtccggcaagaagatcaaggccgatgccttgctctggtgcaacggccgtaccggtaacaccgatcagttgggtctggaaaacatcggggtcaaggtcaacagccgtggccagatcgaagtcgacgagaattaccgtacctgcgtgcagaacatctatggcgccggtgacgtgatcggctggccg

SEQ ID NO: 37581 - DNA, 921 bp, Pseudomonas fluorescens
atgacttccaagctggaacaactcaaacaattcaccaccgtcgtggccgacaccggcgacttcgaagcgattgcccgggtcaaaccggtcgacgccaccaccaacccctccctgctgctcaaggcagcggcgattccggcctacgccgaactgctgaacgccagcgtgcgcgactgcaagggcgatgtcggcctggccagcgaccgtttcggcgtcgcggtcggtcaggaaatccttaaagtgatcccgggccgcatttccactgaagtggatgcgcgcctgtcgttcgaccaggacgcggtgctcaagcgcgcccatcgcctgatcgagctgtatgacaaggccggcgttggccgtgaccgcgtgctgatcaagatcgcctcgacctgggaaggcatccgcgccgccgagatcctcgagaaggaaggcatccagaccaacctgaccctgctgttctccttcgctcaggccgctgcctgcgccgatgccggcgtgttcctgatctcgccgttcgtgggtcgcatctacgactggtacaagaaggccaacggcaacgactacaccggtgccgacgatccgggcgtacagtccgtgacgcgcatctacaactactacaaggccaatgactacaagaccgtggtcatgggtgcgagcttccgcaacctcagtcagatcgagcaactggccggctgcgaccgcctgaccatcagcccggacctgatcgagaaactggcggccgacaccggcaagctggaacgcaaacttgctccgggccatgctggcgaagcgcgcctgagcctcaacgaagcgcaattccgctggttgtccaacgaagacgcgatggctaccgaaaagctggccgaaggcattcgtcagtttgcccgcgaccaggaaaaactcgaggcgctgctgcaagccaag

SEQ ID NO: 37582 - DNA, 831 bp, Pseudomonas fluorescens
atgatccgtaaatgtttgttccccgctgccggttatggcacgcgtttcttgccggccaccaaagccatgcccaaggaaatgctgccgatcgtcaacaagccgttgatcgaatacgccgttgaagaagcacgggacgccggcctgcaacacatggccatcgtcaccggccggggcaagcgcgcactggaagaccacttcgacatcagctacgaactcgaacaccagatccgtggcaccgagaaagagaagttcctggccggcactcgtgagctgatcgacacctgcaccttctcctacacccgtcaggtggaaatgaaaggcctgggccacgcgattctcagcggtcgaccgttgatcggcgacgagcccttcgctgtggttctcgcggacgacctgtgccttaacctcgaaggcgacggtgtgctcacgcagatgatcgagctgtacaagaaattccgctgctcgatcgtcgccatccaggaagtcccgcgcgaccagacccacaaatacggcgtgatcgccggcgaggcgatttccgagggcatctaccgggtcaaccacatggtggaaaaaccggccccgcaggacgcaccgtcgaacctggcgatcatcggccgctacatcctcacgccggacatcttcgacctgatcgccgacaccgagccgggcaagggcggcgaaatccagatcaccgacgccctgatgaaacaggcgcagaacggttgcgtgctggcctacaaattcaagggcctgcgcttcgactgcggcgacgccgagggttacctgcaggcgaccaacttctgctacgaaaacgtttacctgaagggccgc

SEQ ID NO: 37583 - DNA, 1728 bp, Pseudomonas fluorescens
agcttgaaaatctacttccgcctgctcggctatgtccggccgtacatcagtctgttcctgatcagcatcgtcggttttctgatttttgcctcgacccagccgatgctcggctacatcctcaagtactttgtcgacggtctgtccaatcccgaggcagtgctgtttcccaccgtgccttacctgcgcgacctgcaactgctgcaggccgtaccgttgctgatcatcctgatcgccgcgtggcaggggctgggatcttatctgggcaactatttcctggccaaggtttccctgggcctggtgcatgacctgcgggttcagctcttcaacaacctgctggtcctgcccaaccggtatttcgacaagcataactccggacatctgatttcgcgtatcaccttcaacgtgacaatggtcacgggggcggcaacagatgcgatcaaggtcgtaatccgtgaaggcatgacggtgatcttcctgttcgcctccctgctgttcatgaactggaagctgacgctggtgatggttgcgatcctgccgctgatcgccgtaatggtgcgcactgccagcaagaaattccgcaagcagagcaagaaaatccagctggccatgggcgacgtgacccacgtcgcctcggaaaccatccagggctatcgcgtggtgcgcagcttcggtggcgaagcctacgaggaaaaacgctttctcgatgccagccagggcaacaccgacaagcagttgcgcatgacccgcaccggggccatctacacgccgctgctgcagctggtgatctacagcgccatggcgatcctgatgttcctcgtgctgtaccttcgcggcgatgcgtcggccggtgatatggtggcctacatcacgctggcgggcctgctgcccaagccgatccgccagttgtccgaagtcagttcgaccatccagaagggcgtggccggtgccgaaagcattttcgagcaactggacgtcgaaccggaggtcgataccggcacggtcgagcgcgactcggtcagcggtcgcctcgacgtgcgcaacctgagtttcacctacccgggcaccgagcgtcaggtactcgacgacatcagtttctcggtcgagccggggcagatggtggcgctggtggggcgttctggcagcggcaagtcgaccctggccaacctgattccgcgcttctatcaccacgacaagggcgagatcctgatcgacggcgtggaagtggagcaatacaagctgctcaacctgcgccgccacattgcccaggtgacccagcacgtcacgctgttcagcgacaccgtggccaacaacatcgcttatggcgatctggccggggcgccgcgcgaagacatcgagaaggccgcgcgtgatgcttatgcgatggacttcatcgcgcaactgcctgaaggcctggacacccaggtcggcgaaaacggcgtgctgctctccggcggtcagcgccagcgtctggcaattgcccgcgccctgctcaagaacgcgccgctgctgattctcgacgaggctacctcggcactcgacaccgaatccgaacggcacattcaggccgccctggatcaagtgatgaagggccgcaccacgctggtgatcgctcaccggctgtcgaccatcgagaaggccgacctgattctggtcatggaccagggccggatcgtcgagcgcggcacccacgacgacttgctggcacagaacggctactacgcgcgtctc

SEQ ID NO: 37584 - DNA, 594 bp, Pseudomonas fluorescens
cacagtctggcgacaacgcccgccatcagcccctataacctggcgctgccgcgccaggcccgggccgcgctcaacgggcagcggccgcgttgcctgtggctgaccggattatccggcgccggcaagtcgaccctggccaattcgctggagctgcacctgcatcaattcgggcggcacacctttctgctcgatggcgacaacgtgcgcaatggcctgtgccgggacctgggtatggacgatgccggtcgccgggaaaacatccggcgcatggccgaagtcgcccggctgatggtcgatgccgggctgatcgtcatcgttgcggcgatttccccgtttcgagccgaacgggatgctgcgcggcgactgtttgccgagggcgacttcgtcgaagtgcatgtgagcacttcgctcacggtgtgcgagcgccgtgatccgaaaggtttgtatcaggcggtgcgtcagggtcgtatccagcatttcacgggcatcgacagtccttacgaggctccgctggcggcggaatgccgtatcgacacggaagagatcgagccaagcgaggcctgcgaacggctggcggctttgctgcttgaaaaa

SEQ ID NO: 37585 - DNA, 843 bp, Pseudomonas fluorescens
aaagagcgtttgtttatcatcagccagtacctgctgccgcatcacttgctgtcgcgccttgccggctgcattgccgagtgccgcgtgcgctggttcaagaatgccttcaccacctggttcgccaagcgttatcaagtggacatgtcgcaggcactggttgaagacgtgaccgcttacgagcacttcaacgccttcttcacccgcgccttgaaagacggcgctcgcccactggatcagaccccgggcgcgatcctcagcccggccgacggtgcgatcagccagctcggcccgatcgaacacggtcgtatcttccaggccaagggccacagcttcagcgtgctggaactgctgggcggcgacgcggccaatgcggcaccgttcatgggcggtgaattcgcgactgtttacctgtcgccgaaggactaccaccgcgtgcacatgccgctggccggcaccctgcgagaaatggtctacatcccgggccggatcttctcggtcaaccagaccaccgcagaaaacgttccggaactgttcgcccgcaacgagcgtgtagcgtgcatcttcgacaccgagcgcgggccaatggccgtggtgctggtgggcgcgatgatcgtggcctcgatcgaaaccgtgtgggccggtctggtcacgccaccgaagcgcgaactgaaaaccttccgttacgacgaagccgcccgtgcgccgattcatctggagaaaggtgcggaactggggcgcttcaagctgggttcgaccgcgatcgtgctgttcgggccggatcaggtgaaatgggttgaagaattgaaagccggctcgccggtacagatgggtcaggccctggca

SEQ ID NO: 37586 - DNA, 813 bp, Pseudomonas fluorescens
atgtctgatttctctggcctggccctggtgatcgagccgagcgatctgctgccgcgcctcgaatcccgcgatctgattctggtggatctgaccagtgccgcccgctacgccgaaggacacattcccggcgcacgttttgtcgatccgaaacgcacccagctgggtcaggcgccggctccggggctgttgccgagcaaggaaaaactcgaagaactgttcggtgagctgggccatcgcaaagatgcggtttacgtggtctatgacgacgaaggcggcggctgggccgggcgcttcatctggctgctcgatgtgatcggtcacgaccaataccactacctcaacggcggcctgccggcgtggctggcggagggttcaccgatgtcgatccagattcctccggcggtgggcggcccggttgccttgaccctgcacgaggaaccgaccgccacccgcgaatacctgcaaagccgtctcggcgccgctgacctggcgatctgggatgctcgcgggccgctggagtattccggtgagaaggtcctggcggccaagggcgggcacatccccggcgcggtcaatttcgaatggacggcgggcatggatcaggcgcgccaactgcgcatccgtaccgacatgccgcagatcctcgaagacctcgggatcaccagggacaaagaaatcattacccactgccagacccatcaccggtccggtttcacttatctggtggccaaggccctcggttatccgcgggtcaagggctacgccggttcctggggcgaatggggcaaccaccccgacacccccgtcgagctt

SEQ ID NO: 37587 - DNA, 594 bp, Pseudomonas fluorescens
atgaaaattctgttgatcggcgcgggcggcaccatcggttcggccgtggacaaagagctgtcgcagcgtcatgaagtcattcgtatcggccgcagcagcggcgatttccaggtggatatcagcgacagcgcatcgatccgcaagctgttcgaacagaccggcaagttcgacgcgctggtctgcgccgccggcaacgtgaccttcgccccgctgggtgaaatgaccgaagacagcttcgccctcggcctcaaagacaagttgatgggccaggtcaatctgctgctgatcggccgcgaattcgccaacgacggcgcatcgttcaccttcaccaccggcgtgctcagccacgatccgatccgcagcggcgtctcggctgcactggtcaacggcgcgctggacagcttcgtccgcgcagcggccatcgaactgccacgcggcctgcgcgtgaattcgatcagcccgaccgtgctggtcgaagccatgggcagctatgccccgtacttccgtggctacaagccggttcctgcggcggatgtggcattggcctacgccaaaagtgtcgaaggcttgcagacaggtcagacatttcacgtg

SEQ ID NO: 37588 - DNA, 639 bp, Pseudomonas fluorescens
atgatcgacctgtattactggaccacgcccaacggccacaagatttccctgttcctcgaagaagcgggcctgcgttacgacgtgcacccgatcaatatcagccagggcgagcagttccagccgcactttctgaaaatcgccccgaacaaccgcatcccggccatcgtcgatcatgagccggccgatggcggcgaaccgttgtcgctgttcgagtccggggcgatactgctgtacctcgcggaaaagaccggcaagttcctgcccaaggatctgcgtggccgccaggtggcgctgcaatggttgttctggcaaatgggcgggctggggccgatggccgggcagaaccatcatttcagccagttcgcgccggaaaaaatcccctacgcgatcaagcgctacgtcgatgaaaccgcccgcctgtacggggtgctggacaagcaactggccaacaatgagttcgtcgccggcggcgaatacagcatcgccgacatggcgatctacccgtggatcgtctcgcacaaatggcaaagccagaaccttgaagacttcccgaacgtgcagcgctggttcaaccacatcaaggatcgcccggcgaccgtgaaggcctacgcgctggtgcagaagatcaatccaccgaag

SEQ ID NO: 37589 - DNA, 1134 bp, Pseudomonas fluorescens
  unsure (1)..(1134): unsure at all n locations
cgtctctggggtgcccgtttcaaaagcggcccgtccgctgccctggcggccctgtcccgttgccccgagcgctatttccgcctgacgccgtacgatctggccggctccaaggcccacgccggggaactgcaacgtgccggtctgctggacgagcaggaaacccgcacgatgatcgaagccctggacggcatcggtgccgatttcgctgccgggcgcatcgccccgacgctggacgacgaagacgttcacaccttcatcgagcgcctgctgaccgaacgcctcggcgcactgggcggcaagctgcgcgccggccgttcacgcaacgaccagaccgccaacgacctgcgcctgttcctgcgtgatcacgtgcgcaccctggccgtggaagtgctggccctgcaaacggcgctagttgatcaggccgagcagcacgtcgaaagcatctgcccgggcttcacccacttgcagcaagcgcaaccgatcgtgttcgcccatcacctgttggcccacgcgcaatcgatgctgcgtgacgtgcagcgactgatggactgggacgcccgcacttcgctgtcgcccctcggtgccgcagccatggccggctccgcgatcgctcgtcagccgcaacaatcggccaaggaaatgggctatgccggggtctgcgaaaactccatcgacgccgtggccagccgcgatcacgtcgccgaattcctgttcatcgccagcatgctcgggatcaacatctcgcgtctggccgaagaattctgcctgtggtcgtcgcgccagttccgctgggtcgatctggacgatgcctacgccaccggcagctcgatcatgccgcagaagaaaaaccccgacatcgccgaactggcccggggcaaggctggccgtctgatcggcaacctgaccggcctgctgtcgacgctcaaatccctgccgctgtcgtacaaccgcgacctgagcgaagacaagaacggcgtgctcgacagcgtcgacaccctgctgctggtgctgccggcgatggccgggatggtcgcgancatgaccgtcaacgtcgaggaactgcggcgtcaggcgccgctgggctttaccctcgccaccgaaatcgccgactggctgcgcgtgcccggagtgccg

SEQ ID NO: 37590 - DNA, 1341 bp, Pseudomonas fluorescens
atgaaaatcacagtatttggtagcggttatgtcggtctggtgcaggctgccgtcctggccgaggtgggtcacgacgtggtgtgcatggacatcgacgagaagaaaatcgaactgttgcgccagggccacgtcagcatcttcgagccggggctggccagtctggtccgcgaaggcctggatgccgggcgcctgcaattcacctgcgatgaaatacttgcggtgcaacatggcaaggttgcgttcattgccgttggcaccccgtccaacgaggacggttcggccgacctgcgttatgtgctgtcggtgggcgatgccgtggcccggcaccgtgagaaaccgctgatcctggtggagaaatccaccgtaccggtcggcaccggtgacactttgcgtgcgcatctggataaagccttggtcaaggccggacgtctgttgcagttcgatatcgtctccaacccggagtttctcaaggaaggttcggccgtcgccgactgccgtcggccggaccggatcgtcatcggctgcgaacgcgaagaagtacgcgacgtgatgcgagacctgtactcgccgttcaaccgcaaccacgaccgcatcatgttcatggacctgcgcagcgccgagctgaccaaatacgccgccaactgcatgctggcgaccaagatcagcttcatcaaccagatcgccgaactggccgagcacctgggcgcggacatcgaatcggtacgccagggcatcggcgccgacagccgcatcggctaccacttcatctaccccggctgcggttacggcggctcgtgttttcccaaggacatgcgcgcgctgatccacagcgccgaagaggcgcactgctccagcgacttgctgcaagccgtggaagcgatcaaccagcggcagaaacacaagctgttcgaacggatcaacgcgttttacaagggcgaactgcgcggcaagaccttcgcggtctggggcctggccttcaagccgaacaccgacgacatgcgcgacgcgccaagccgggtcttgctcgaatcgctgtgggccgctggcgccaatgtgcgggcgttcgacccggaagccatgcaggaaacccagaacctgtacccggacgaatcgaagctgatgttgatgggcactccggaatcggtactcgccggttccgatgcgctgatcatctgcaccgaatggcagcagttcaaggcgccggacttcgacctgatccaacaacgcctcaaggccccggtgatcttcgatggccgcaacctctacgacgccgaacgcctggcccgtaacggcttccactacttcccgatgggccgtggcgaatcgcgcaccttgccgatt

SEQ ID NO: 37591 - DNA, 1377 bp, Pseudomonas fluorescens
atgaatgtgagcgtattcggtattggttacgtaggccttgtccagggtgctgcattggccgaggtcgggcacaacgtgctctgcgtcgacgtcgacgccggcagggtcgaggcattgaaagagggcacgctgccgctctacgagccgggcctgaaaatcctggtgcgcgacaactaccaaagcggccgactgcagttcggcacagacctggtggacgccgttcaccatggcgatgtgctgttgatcgccgtcggcacaccgcccgacgaagacggttcggcggatctccaatacgtgttgagcgtggcgcggaccatcgcgctgaacctggaccggcaccagatcatcgtcgacaaatccaccgtgcccgtcggtaccggcgatcgggtgcgagcctgtatcgagcaagtattggccgacaacggtcgcggcgatctgacgttcgacgtggtttcaaacccggaatttctcaaggaaggctgcgcggtcgaggactgcatgcgcccggaccggatcatcatcggcaccgacagcccgcgtgccgaagaggtcatgcgcgaactgtatgagccgttcaatcgcagccgcgaaaaaatcattgtcatggacgttcgcagcgctgaactgaccaagtacgccgccaattgcatgctggcaaccaagatcagcttcatgaacgaaatggcctgcctcgctgaaaagctcggcgccgacatcgaaaaggtgcgccacggcatcggtgccgacccgcgcatcggttaccagtttatctacccaggtctgggctacggcggctcgtgttttcccaaggacgtgaaggcgctgatacaggcggccgacggtgtcgacatcgacgcccgggtgctcaaggccgtggaagcgcgcaaccaggaacagaaagccagcctctatcgcaaggtattcgatcacttcgacggtcaccttcgcggcaagacgtttgccctgtgggggctgagtttcaaacccaataccgacgacatgcgcgaagcccccagccgggtactgatggaggctttgtggcaagccggcgccagcgtgcaggcgtttgatcccaaagccatggaagaggcccagcgcctttacggctcgcgcgatgacctgaccctgacaggcaccaaggaagcggcgctgaaaaatgccgacgccctgatcatcgtcaccgagtggcaatcgtttcgggcaccggacttcgaccagctcagccggttgctcaaacagccgttgattttcgacgggcgcaatctgttcgatccgcagcgtttgagcaaacgcggtttcacctacgtctccgtgggtcggcagaccccttcagtcctctgaaaggagcggcgccatgttcaaactggaaatagtcgg

SEQ ID NO: 37592 - DNA, 1425 bp, Pseudomonas fluorescens
tcctacgatcagctttatcttttcatcggtggtgaatggatcgatgcgcaaggtcgctctacggcagccgtcgtcaaccctgcgaccgggcgtgaaatcggacgtgttcccctcgccactgccggcgaccttgaccgcgccctggaagtgtcccgagtgggcttcgaacaatggcggcaaacggtgccggaccagcgcgcgaaaatcctcaaacgcgccgccgatctgatcctggaacgagccccgcacattgcagcgcagatgaccctggaagaaggcaagccactgagcgaaagcatggatgaagtggtgcgagccgcagagtatttcgaatggttcgccgaaagcgctcggcgcatcgacggccgtgttgtacctgccaaccgccccggtgtactgcaactggtcaaacgccaggccattggcccggtcgcagctttcacgccgtggaattttccggctatcacgcctgcacgcaaactgtcggcggccctggcggcgggttgcagcgtgattctcaaacccggagaagaaagtccctccaccgcgctggccctggcacgggcgctggacgacgcaggcctgcccaaaggcgtgctgcaggtggtcttcggcgtaccggatcaggtgtccagccagctcattgcgtctgcgatcatccgcaaggtgacgttcaccggctcggtgcccattggacggctattgtcggcccgcgccgccgagggcgtgaaacccatcaccctggaactgggaggccacggcccggtgttggtattcgccgacgctgatgttgagaaagccgcagtagagggggtcgcaaaccgctttcgcggtaccggccaggtgtgcatctcgtcgacccggttcatcgttcagcgtggcgcctatcaagcgtttgtcgatcactttgtcacggccaccaaagccctgaaaatcggcgacggcttcgatccacagactcaggtcggaccgctcgccaacccaaggcagttggtcaagatggagcaattgatagccgatgccgtcgagaaaggcgcacgggtcttggtcggtggcgaggcgcttcccggagacggctttttcttccagcccaccgttttggcagacgtgcccatgaacgcccgcatcatgcacgaagaacctttcggccccatcgccgtgttgatgcctttcgacgagctggccgacggcctgcaagaagcgaatcgattgccgtatggcctttcggcctacgcgttcacttccaatgcacgaacagccatcgacgtggccgacggactggaagccggaatgatcgggataaaccagtaccgcatcgtcgccaccgagcttccgttcggcggcatgaaagaaagtggtcacggctccgaaggcggcgttgaaggcatcgagcactacctcacccacaaattcatcagccaggtt

SEQ ID NO: 37593 - DNA, 933 bp, Pseudomonas fluorescens
gatcccctgattcacatcctcgatgacagcttcctcgacctgcgtgttttcaacgccagtgtggaaaaacttgccaccgggatgcgctgggccgaaggaccggtctggatcggtgatggccgctacttgctggtcagcgacatccccaataatcgcattatgcgctgggatgaaatcaccgagaccttcaccgtctaccgtgagcactcgaacttctccaacgggatgtgccgggatcgccaagggcggcttatcgtctgcgaaggctctaccaccacaagcgaaggccgccgcatcacgcgcaccgaatacaacggcacgaccaccgtgctggccgacagcttcgagggcaagcccttcaactcgcccaacgacatcgtctgcaaaagtgacggatcgatctggtttaccgatccgccattccagaccggcaacaactacgaaggccacaaaatcaccccgagccaaccccacgccgtttaccgcatcgacggtgagagcagaaaggtcactcgggtcatcgacgacctgaacggccccaatggtctgtgcttttctcccgacgagaagaccctgtatgtcgtcgaaggccgcgccaaacccaatcgcttgatctgggcaattgccgtgaaggacgacggcacactgggcgagcgccgcaagcacatcgaggggctggactatgcggcaatcgacggtatcaagtgcgacgaaacgggcaacctgtggtgcggctggggcggcaatggagatcccagggccgacctggaaaaactcgacggcgtgcgggttttcaacccacagggcaaggccatcggccatatttcgctgccagagcgctgcccgaacctgtgcttcggggggcgcgaagggaacaggctgttcatggcaagcagtcactcgatctactcgctttttgtgaatactcgcggg

SEQ ID NO: 37594 - DNA, 636 bp, Pseudomonas fluorescens
atgagcctcagacttggcgatatcgcccccgatttcgaacaggattccagcgccggcaagattcgtttccacgaatggctgggcgatagctggggcgtgctgttttcccacccggcggacttcaccccggtctgcaccaccgagctgggcttcactgccaagctcaaggacgaattcaccaaacgtggcgtgaaagccattgcactgtcggtcgacccggtggactcgcaccacaagtggatcgaggacatcaacgaaacccagaacaccatcgtcaatttcccgatcctggccgatgccgatcgcaaggtgtccgatctgtacgatctgatccacccgaacgccaacgacaccctgaccgtgcgttcgctgttcgtgatcgatccgaacaagaagatccgcctgaccatcacttacccggcgagcaccggccgcaacttccacgagattctgcgggtgatcgattcgctgcagctcaccgacaactacaaggtggccaccccggccaactggcaggacggtgaagaggtggtaatcgtgccgtcactcaaggacgaagacgaaatcaaacaacgctttccgaagggctaccgcgcggtgaagccgtacctgcgccttacaccacagccgaacaaa

SEQ ID NO: 37595 - DNA, 1332 bp, Pseudomonas fluorescens
aacccgcaaacccgtgagtggcaagccctcagcagcgatcaccacctggctccgttcagcgacttcaagcagctgaaagaaaaaggtccacggatcatcaccaacgccaagggcgtgtacctgtgggacagcgagggcaacaagatcctcgatggcatggcgggtctgtggtgtgtggcgatcggttatggacgcgacgagctggccgatgcggccgccaagcagatgcgcgaactgccttactacaacctgttcttccagaccgcccacccgccagcactggagttggccaaggccatcgccgacgtggcgccggaaggcatgaaccacgtgttcttcaccggctccggctccgaaggcaacgacaccatgctgcgtatggttcgccactactgggcgatcaagggccagccgaacaagaaggtcatcatcagccgcaagaacggctaccacggttccaccgtggccggcgcaagcctgggcggcatgacttacatgcacgaacagggcgacctgccgattccgggcatcgtccacatcgcccagccgtactggttcgccgaaggcggcgacatgaccccggaagagttcgggatctgggcggccaatcagctggaggaaaagattctggaagtcggcgtggataacgtcggtgcctttattgccgagccgatccagggcgctggcggcgtgatcattccgccggacacctactggccgcgcatcaaggaaatcctcgccaagtacgacattctgttcgtggccgatgaagtgatctgcggtttcggccgtaccggccaatggttcggcagcgatttctacgacctcaaaccacacatgatgaccatcgccaaaggcctgacgtccggctacatcccgatgggtggcctgatcgtgcgcgatgaagtggtggcggtactcaacgagggcggcgatttcaaccacggcttcacctactccggtcacccggtggcggcggcggtgggtctggaaaacatccggattctgcgcgaagagaaaatcatcgaacgcgcccatgaagaaacggcaccgtatttgcagaaacgtctgcgcgaactgaacgatcacccgttggtgggtgaagtgcgcggggtcggtctgctgggggccatcgagctggtgcaggacaaggccactcgcaagcgttacgaaggcaagggtgtgggcatgatctgccgccagttctgcttcgacaacgggctgatcatgcgtgccgtgggcgacaccatgatcatcgcgccgccgctggtgatcagcaaggcggagatcgatgagctggtgacgaaggcacgcaagtgcctggacctgacc

SEQ ID NO: 37596 - DNA, 1389 bp, Pseudomonas fluorescens
atgaccaatcctgccctgattgatgaactgaagaccctggtcgagcctggcaaagtcctgaccgatgccgactccttgaacgcttacggcaaggactggaccaaacacttcgccccggcgcccagcgccatcgtgtttcccaagaccatcgagcaggtgcaggccgtcgtccgctgggccaacgaacacaaagtggcgctggtgccgtcgggcgggcgcacggggctctccgccgcagccgtggcggccaatggcgaagtggtcgtgtcgttcgactacatgaaccagattctcgacatcaacctgaccgaccgcaccgccgtctgtcagccgggcgtggtcaccgagcaattgcagaacgcggccgaagaacatgacttgtactacccggtggacttcgcttcggccggttccagtcagattggcggcaacatcggcaccaatgccggcgggatcaaggtcattcgctacggcatgacccgcaactgggtcgcaggcatgaaagtcgtgaccggcaagggcgatgtgctggaactgaacaaagacctgatcaagaacgccaccggatatgacctgcgccagctgttcatcggcgccgaaggcaccctgggtttcgtggtcgaggccaccatgcgtctggaccgtgcgccgaaaaacctgaccgcaatggtcctcggcaccgccgatttcgattcaatcatgccggtactgcacgcctttcagggccggctcgacctgactgcgttcgaattcttctccgacaaggccctggccaaggtcatgggccgtggcgatgtcccggcgccgttcgaaaccgactgcccgttctatgccttgctggaattcgaggcgaccaccgaagaagtggccaacaccgccctggaaaccttcgaacactgcgtggagcagggttgggtgctggacggcgtgatgagccagagcgaaacccagttgcagaacctgtggaagctgcgcgagtacatctccgaaaccatctcccactggacaccgtacaagaacgacatctcggtcaccgtctcgaaagtccctgcatttttgcaggaaatcgatgcgatcgtcggcgaacattacccggatttcgaaatcgtctggttcggccacatcggcgacggcaacctgcacctgaacatcctcaagccggacaacctgagcaaggacgagtttttcgccaagtgcgccaccgtcaacaagtgggtgttcgaaaccgtcgagaagtacaacggttcgatttctgccgaacacggcgtgggcatgaccaagcgcgactacttgacctacagccgctcgccggtggaaatcgaatacatgaaagcggtcaaggcggtgttcgacccgaacggcatcatgaacccgggcaagattttcgcg

SEQ ID NO: 37597 - DNA, 2274 bp, Pseudomonas fluorescens
atgctcaatacgctgcgcaagatcgtccaggaagttaactccgccaaggatctcaaggcggcgttggggattattgtgttgcgcgtcaaagaggccatgggcagccaggtctgctcggtctacctgcttgatccagagaccaaccgcttcgtgctgatggccaccgagggcttgaacaagcgctcgatcggcaaggtcagcatggcacccaacgaaggtctggtcggcctggtcggcacgcgtgaagaacccctgaacctcgaaaacgccgcggatcacccgcgctaccgttacttcgccgaaaccggcgaggagcgctacgcctcgttcctcggggcgccgatcattcaccaccgtcgcgtcgtcggcgtgttggtcatccagcagaaagaacgccgccagttcgatgagggtgaagaagccttcctcgtgaccatgagcgcgcagctcgcgggcgtaatcgctcacgccgaggccacaggttccatccgtggtctgggccgtcagggcaagggcatccaggaagccaagttcgtcggcgtgccgggttcaccgggtgcagcggtcggtaccgcggtggtcatgttgccaccggcggatctggacgtggtgccggacaagaccatcaccgacatcgacgcggaactggcgctgttcaagaccgccattgaaggcgtgcgcgccgacatgcgtgcgttgtcggccaaactcgcgacccagctgcgtccggaagagcgcgccctgttcgatgtctatctgatgatgcttgacgatgcctcgctgggcagcgaaatcaccaacgtgatcaagaccgggcagtgggcccagggcgcgttgcgtcaggtcgtgaccgatcacgtcaatcgcttcgatttgatggacgacgagtacttgcgtgagcgggcgtcggacgtcaaggacctcggccgccggctgctcgcctatctgcaggaagagcggcagcagaacctggtctacccggaaaagaccattctggtcagcgaagaactgacgccggcgatgctcggcgaggtgccggaaggcacgctggtcggtctggtatcggtgcttggttcggggaactcgcacgtcgcgattctcgcccgggccatgggcattccgacggtcatgggtctggtcgacctgccgtacgccaaggtcgacggcatcgaaatgatcgtcgatggcacacgaggcgaggtctacaccaaccccagcgaagtgctgcgcaagcagttcaccgaggtggtggaggaagagaagcaactggcgctggggctcgataccctgcgcgacctgccgtgcgtgaccctcgatggtcatcgcatgccgctatgggtcaacaccggcctgctggccgatgtggcgcgggcgcagaagcgcggcgccgaaggcgttggtctgtaccgcaccgaagtgccattcatgatcaaccagcgcttcccgagcgagaaggaacaactggcgatctaccgcgagcagctcgccgcgttccacccgcaaccggtgaccatgcgcagcctggacatcggcggcgacaagtcgctgtcgtacttcccgatcaaggaagacaacccgttcctcggctggcgcgggatccgcgtcaccctcgaccacccggaaatcttcctggtgcagacccgcgcgatgctcaaggccagcgaaggcctgaacaacctgcgaatcctgctgccgatgatctccggcatccacgagctcgaagaggcgctgcacctgatccaccgggcctggggcgaagtgcgcgacgaaggcaccgacgtgccgatgccgccggtgggcgtgatgattgaaattccggcggcggtctaccagaccaaagagctggcgcggatggtggacttcctgtcggtcggctccaacgacctgacccagtacctgctggcggtggaccgcaacaacccacgggtggccgatctctacgactacctgcacccggcggtgctgcaagccctgcaaaccgtggtacgcgacgcccatgccgaaggcaagccggtgagcatctgcggcgagatggccggtgacccggcggcagcggtgctgttgatggcgatgggtttcgacagcctgtcgatgaacgccaccaacctgccgaaggtgaaatggatgctgcgccagatccacctgagcaaggccaaggatctgctggcggaactgatgaccatcgacaacccgcaggtcatccacagctcgctgcaactggcgctgaagaacctcggtctggcgaagatggtcaatccggcggcggtcaaaccg

SEQ ID NO: 37598 - DNA, 2178 bp, Pseudomonas fluorescens
gttcattcgagtgaagactcgtgctgttcgtcgaaagtcgccgcaccttcgcttgttcaactgagtgaggcaaaaagcgccgacgcccggttgagcagcttccgcatcgaagcgatggactgcccgaccgaacagacgctgatccagaacaagctcggcaaactggccgggatccagcagctggaattcaacctgatcaatcgcgtgctcggcgtgacccacaatctgccggacaccgcgccaatcatcgacgcgatcaaatccctcggcatgcaggccgagccgctggaggcgggcgttgaatcgacggttgcagcgccggtgaaaaaacattggtggccactggcgctgtccggcgtcggtgcgctcgctgccgaagtgatccacttcaccagcgccgcgccgacctgggtggtggcgatcatcgcgctgacttccatcctcagcggcggcctcaccacctacaagaagggctggatcgccctgaagaaccgcaacctcaacatcaacgccctgatgagcatcgccgtgaccggcgccgtattgatcggccaatggccggaagcagcgatggtgatgttcctgttcaccgtggccgagctgatcgaagcgcgctcgctggatcgcgcacgcaatgccatcagcggcctgatgcagatgacgccggagcaggcaacggtgttgcaggcggatggcaactgggtcgagctcgacgtcaaaagcatcgatctcggcgcccgcgtgcgggtgaaacccggtgaacgcatcgcgctggacggtgaagtcgtcagcggcagttcgaccatcgatcaggcgccgatcaccggtgaaagcctgccggtggagaaaaccgtcggcgacaaagtgttcgccggcaccatcaaccaggccggttcgctggaatatgcggtgactgcagcggcgaacaattccaccctggcgcgaatcatccacgccgtggagcaggcgcaaggcgcgcgggcgccgacccagcgtttcgtcgatcagttctcgaaaatctacaccccggtggtcttcgtcctggccctggccgtggcgatcatcccgccgctgttcatggccgccgcgtggttcgactggatttatcgcgcgctggtgctgctggtggtcgcttgcccgtgtgcgctggtgatttccaccccggtgaccatcgtcagcggccttgcggcagcagcgcgcaaaggcattctggtcaagggcggcgtgtacctggagggcggtttcaagctcgactatctggccctcgacaagaccggcaccatcacccacggcaaaccggtacagaccgattacctgtccctcgacccgaccgccgacgccacggccccggccattgccgccgcgctggccggtcgctccgatcaccccgtatcgctggccatcgccaacgcggctgtggataaaggtttcgcggctctgcttgtggataacttcgaagcgctggctggccgtggggtaaaaggcgaggtcaacggtcaggtctaccacttgggcaaccaccgactggtggaagaactgggcctgtgttcgccgcaactggaagaaaagctgttcgcactggagaaacaaggcaagtccgtggtgttgctgctcgacagctccggcccgctggcgctgttcgccgtggccgacacggtcaaggaaaccagccgcgaagcgatccgccaactgcacgatctgggcgtgaaaaccctgatgctgaccggcgacaacgtccacaccgcgcaagcgattgcggcgcaggtcgggatcgatcaggccaagggcgacttgctgccgaccgacaaactgcaagccatcgaagacctttacgccaaagggcgccgggtcggcatggtcggcgacggcatcaacgacgcaccggcactggctcgggccgagatcggttttgcgatggcggcggccggcaccgatacggcgatcgaaaccgccgatgtcgccctgatggacgacgatctgcgcaagataccggccttcatcagcctgtcgcgtcataccgccgctatcctgaaacagaacatcgcactggcgctggtgatcaaagcgatctttcttggggtaaccttcgccgggctcgccaccatgtggatggcggtgtttgccgacatgggcgtgagcctgctggtggtgttcaacggtttgcgcctgctgcgcaaa

SEQ ID NO: 37599 - DNA, 492 bp, Pseudomonas fluorescens
cccctcagcctgattgcagccctcggtgaaaaccgtgtgatcggcgtcgacaacagcatgccctggcacctgccgggggacttcaaatacttcaaggccacgacgctcggcaagccgatcatcatgggccgcaagacctgggactcgctgggtcgcccgttgccgggccgtctgaatatcgtggtcagccgtcaggccggtctggtgctggagggcgcggaagtctatccgtcgctggaagcggccgtggttcgcgccgaagaatgggcgaaagatcagggcgtcgatgagttgatgctgattggcggggcgcagttgtatgcgcaggggctggcgcaggcggatcgtctgtatctgacccgtgtggcactgagcccggaaggcgatgcgtggtttccggagttcgatctgaaccagtggaagctggtgtcgaacgtgccgaatccggctgaaggcgacaaaccggcttacaatttcgaagtctgggaaaaa

SEQ ID NO: 37600 - DNA, 1386 bp, Pseudomonas fluorescens
atgaatctgcccctgattctcaacttgctggtgttcctcgccctgctcttcggtctggcgcaaacccgtcacacctcgtggagcctggcgaaaaaagtcctgctcgcgctggtgctgggcgtggcattcggcatcgcgttgcacacgatctacggtgccggcaacccggtgttgaaagcctcgatcggctggttcgatctggtcggcaatggttacgtgcaactgctgcaaatgatcgtgatcccgctggtgttcgcctcgatcctcagcgccgtggcccgtctgcacaacgcttcgtcgctgggcaagatcagcttcctgaccatcggcacgctgctgttcaccaccgcgattgccgcgctgatcggcatcggcctgaccaacctgttcggcctgaccgccgaaggtctggttgccggcacgcaggaaatggcccgtctgcaaaccattcagaccgactacgcgggcaaggtcgccgacctgaatgtgccgcaactgctgctgtcgttcatcccgcagaacccgttcgccgacctggcccgggccaagccgacctcgatcatcagcgtggtgattttcgctgcgttcctgggggttgccgcgctgcaactgctcaaggatgacgtcgagaaaggtcagaaagtgatcaacgccatcgacaccctgcaagcctgggtgatgcgtctggtgcgtcttgtgatgaagctgaccccgtacggcgtgctggcgctgatgaccaaagtggtggccggttccaacctgcaggacatcatcaagctcggcagtttcgtagtggtgtcgtacctcggcctgggcctaatgtttgtggtgcacggcttgctggtgtcggcggccgggatcaacccgctgcgtttcttccgcaagatctggccggtgctgacatttgcgttcaccagccgctccagcgccgcgagcatcccgctgagtatcgaagcgcagacccgtcgtctgggcattccgcaatcggtggcaagcttcgctgcttcgttcggcgcgaccatcggccagaacggctgcgccggtctgtacccggcgatgttggcggtgatggttgcgccaaccgtcggcatcaacccgctggatccgctgtggatcgcgacgctggtggcgatcgtgaccctgagttcggccggtgtggcgggcgtgggtggcggtgcgaccttcgccgcgctgatcgtgctgccggccatgggcttgccggtttcgctggtggcgttgctgatttcggtagagccgctgatcgacatgggtcgcacggcgctgaacgtgagcggttcgatcaccgctggcgcgattaccagccaggtgatgcagcagaccgacaaggcactgctggatgccgatgagcatgcggagcttgctcag

SEQ ID NO: 37601 - DNA, 1590 bp, Pseudomonas fluorescens
atgcccgtacccgacccgtttcgcgaaggccttgcccgtggctggaaaacctacaacggcgcgcaactcaccgatgacctgaccctggaagccgatgtcgccatcatcggcagcggcgccggcggcggcaccaccgcggaaatcctcagcgccgccggctacaaggtgctgctgatcgaagaaggtccgctcaagaccagcagcgatttcaaactgctggaggaccaggcctacagcagcctctatcaggaaggcatcggccgcatgagcaaggacggcgcgatcaccatccttcagggccgcgcggtcggcggcaccacgctgatcaactggacatcgagttttcgcacgcccgagccgaccctcgaacactgggccaaagagcacaacgtcaaaggccacagccccgccgacatggcgccgtggttcgaaaaaatggagcagcgcctcggcgtcgccccgtggatggtgccgcccaacgccaacaacgacgtgatccgcaaaggctgcgaacaactcggctacagctggcacgtgatcccgcgcaacgtgcgcggctgctggaacctcggctattgcggcatgggctgcccgaccaatgccaagcaatcgatgatggtcacgaccattccggcaaccctggaaaagggtggcgagctgctttatctggcccgggccgaaaagctgttgatcaacggcgacaaggtcaccggcctgcaatgcgtggcgatggacgaacgttgcgtcgagccgactggacgcacgatcaccgtcaaggcacggcattacgtgctggccggcggtgggatcaacagcccggcgctgctgatgcgttcggacgcaccggatccgcacaaacgcctgggcaagcgcaccttcctgcatctggtgaacatgtccgccgggcgtttcgacgaggtcatcaacccgttctacggtgcgccgcagtcgatttactcggaccatttccagtggaaggacggcaccaccggcccgatggcctacaaactcgaagtgccgccgctgcacccggcgctggccgccacgttgctcggtggttttggtcaggaaagcgcgcaacacatggcggacctgccgcacacccacgcgatgctggccctgctgcgcgacggttttcacccggacagtcagggcggcagtgtcgagctgcgcggtgacggctcgccggtgctcgactatcaggtgtcgccttacacctgggagggtctgcgccgctcattccacagcatggccgagatccagttcgccggcggcgccaaagcggtgatgccgatgcacgccgatgcacgttacgtgaacagcctggccgaggcccgctcattgatcgacagcctgagtctggagttgtatcgcacgcgtctgggcagcgcccacgtcatgggcggttgcgccatgggcgaggacccgaaaaccgccgtcaccgacagcctcggccgccatcatcaactgcgcaatctgtcgattcatgacggctcgctgttccccaccagcatcggcgccaacccgcagttgtcggtgtatggtctgacggcgcaactggcgacatccctcggcgaacggttgagaaaa

SEQ ID NO: 37602 - DNA, 1014 bp, Pseudomonas fluorescens
ccgctgaccggcgcgctcgcggccggcaaccgggtgatgctcaagctcagcgaatcgaccccggccaccggcctgttgctcaaggaactgctggcgcggatcttccccgaagatctggtgtgcgtggtgctcggcgaggccgatgtcggcgtggcgttttcgaaaatgcgcttcgaccacctgctgttcaccggctccaccagcgtcggcaggcatgtgatgcgcgcagcagcagaaaacctgacaccggtgaccctggaactgggcggcaaatccccggccatcgtttcccacgacgtaccgctcaaggacgccgccgaacgcatcgctttcggcaagaccctcaacgccggccagacctgcgtggccccggactacgtgctggtgccggaagcgcgcatcggcggtttcgtcgaagcctatcgccaggcggtgcgcgggttttatccgacgcttgccgacaacccggactacaccgccatcatcaacgagcgccaactggcgcggctcaacagctacctcagcgacgccaccagcaagggcgcgctgctgattccgttgttcgaccagggccagggccggcgcatgccgcacagcctgctgctgaatgtcagcgacgagatgacggtgatgcaggacgagatcttcggcccgctgctgccgatcgtgccgtatcaggatctggatcaggcatttgcttacatcaatcagcggccacgtcctctggctctttactacttcggctacgacaagcgcgaacagcagcgcgtgctcagcgaaacccattccggtggcgtctgcctcaacgacacgctgctgcacgtggcgcaggacgacatgccgttcggcggcatcggcccgtcgggcatgggccattaccacgggcacgaaggtttcctgacgttcagcaaggccaagggcgtgctggtcaaacagcgcttcaacgcggcgaagctgatctacccgccctacggcaaatccattcagaaactgatccagaaactgttcattcgc

SEQ ID NO: 37603 - DNA, 1239 bp, Pseudomonas fluorescens
atggctttgatcgtacagaaatttggaggcacctcggtcggcactgtcgagagaatcgagcaggtcgccgacaaggttaagaaattccgcgatgccggcgatgacctggtggttgtgctgtctgcaatgagcggcgaaaccaaccgtctgatcgatctggccaagcaaatcagtggcgaagatcaaccggttccgcgcgaactggatgtgatcgtttccacaggtgagcaggtgacgatcgccctgttggccatggcgctgatcaagcgcggtgtgccggcggtgtcgtacaccggcaaccaggtgcggattctgacggacagtgcgcacaataaagcgcgtatcttgcagattgatgaccagaagattcgcggtgacctgaaagccggtcgcgtggtggtggtcgctggtttccagggcgtcgacgagcacggcaacatcacgaccctgggtcgtggcggttccgacaccaccggtgtggcgctggccgctgcgctgaaggctgacgagtgccagatctacaccgacgtcgatggtgtctacaccactgacccgcgtgtggtatcggttgctcagcgtctggacaagatcaccttcgaagagatgctggaaatggccagcctcggttccaaggtgctgcagatccgtgcggtggaattcgccggcaagtacaacgttccgctgcgcgtactgcacagcttcaaggagggtccgggcaccctcattactattgatgaagaggaaaccatggaacagccgatcatttccggcatcgctttcaaccgcgatgaagccaagctgaccatccgtggcgtgccagacaccccgggcgtggcgttcaagattctcggcccgatcagtgccgcgaacatcgaagtcgacatgatcgtgcagaacgtcgcgcacgataacaccaccgacttcaccttcaccgtgcaccgcaacgactaccagtccgcgcaaaccgtgctggaaaacaccgctcgcgagatcggtgcccgtgaagtggtgggcgataccaagattgccaaggtctcgatcgtcggcgtcggcatgcgttcccacgcaggcgtggccagccgcatgtttgaatccctggcaaaagaaagcatcaacatccagatgatctcgacctcggaaatcaaggtttccgtggtgatcgaagagaagtacctggaactggccgtgcgcgccctgcacacggctttcgaactcgacgctccggcccgtcagggcgag

SEQ ID NO: 37604 - DNA, 1449 bp, Pseudomonas fluorescens
tcgctatacatcgcaggtgagtggctggccggtcagggcgaggcctttcaatcgctgaacccggtgacccagcaagtgctgtggtcgggggagggcgccactgccgctcaggtcgagtcggccgtgcaggctgcgcgtcaggcgttcccgggctgggcccgtcgtaccctggaagatcgcatcagcgtgctcgaagcgttcgccgctgcgctgaaaaaccatgctgacgaactggcccgcaccatcggtgaggaaaccggcaaaccgttgtgggaagccgcgaccgaagtcaccagcatggtcaacaagatcgcgatttcggtacagagctaccgcgaacgtaccggcgagaagagcggcccgctgggcgacgccaccgccgtgttgcgccacaagccccacggcgtggtcgcggtgttcggcccttacaacttccctggccatttgccgaacggccacatcgtgccggcgctgctggccggtaacagcgtgctgttcaaaccgagcgagctgaccccgaaagtcgccgagttgacggtcaagtgctggattgaagccggtctgccggccggcgtgctgaacctgctgcaaggcgcccgcgaaaccgggattgctctggcggcgaacccgggcatcgacggtctgttctttaccggctcgagccgtaccggcaatcacctgcaccagcagttcgccggtcgtccggacaagattcttgcgctggaaatgggcggcaacaacccgctggtggtcgatcaggtcgccgatattgatgctgcggtgtacacgattattcaatcggcgttcatttccgccggtcagcgctgcacctgtgcccgtcgtctgctggtgccggaaggcgcgtggggcgacagcctgctcaagcgtctggtggaagtcagctcgaccatcgaggtcggtgcgttcgatcagcagccggcaccgttcatgggttcggtggtttcccttggcgcggcgaaagcgttgatggatgcccaggcgcatctgctggccaacggcgcggtgtcactgctggcgatgacgcagccacaggcgcagtcggcgctgctgaccccgggcatcgttgatgtgacggcggttgccgatcgctccgacgaagaactgttcggcccgttgctgcaggtgattcgctacgccgatttcgcggcggcgattgccgaagccaacgacactgcgtttggcctggccgcaggtctgctgtcggattccgaagagcgctaccagcagttctggttggaaagccgtgccgggatcgtcaactggaacaagcaactgaccggtgctgcgagcagcgcaccgttcggcggtgtcggcgcttcgggcaaccaccgcgccagcgcctactacgcggcggattactgcgcgtacccggtggcctcgctggaaaccccgagcctggtgttgccggcggccctgacgcctggcgtg

SEQ ID NO: 37605 - DNA, 1218 bp, Pseudomonas fluorescens
atgtccgttgagcacgctgcggtacaacgcgccgatttcgaccaggttatggttcccaactacgcgcctgccgctttcattccggtgcgtggcgccgggtcccgcgtctgggatcaggccggccgcgagctgatcgacttcgccggcggcatcgccgtcaacgtattgggccatgcgcacccggcgctggtcggtgccttgaccgagcaagcgaacaagctgtggcacgtgtccaacgtgttcaccaacgagccggccctgcgcctggcgcacaagctgatcgacgccacctttgccgagcgcgtgttcttctgcaactccggcgccgaagccaacgaggccgccttcaagctggcccgtcgtgtcgcgttcgaccgtttcggcaccgagaaatacgaaatcatcgccgcgctcaacagcttccacggccgtactctgttcaccgtgaacgtcggtggccagtcgaagtactccgacggtttcggtccgaaaatcaccggcatcacccacgtaccgtacaacgatctggcggcgctgaaagccgctgtttcggacaagacctgcgcggtcgttctggaaccgatccagggcgagggcggcgtgctgccggccgagctggcttacctgcaaggcgcccgtgaattgtgcgacgccaacaacgcgctgctggtgttcgacgaagtgcagactggcatgggccgtaccggcaacctgttcgcctaccagcattacggcgtgaccccggacatcctgaccagcgccaagagcctgggcggcggtttcccgatcgcggcgatgctgaccaccgaagcgctggccaagcatctggtcgtcggcactcacggcaccacttatggcggcaacccgctggcgtgtgccgtggccgaagcggtgatcgacgtgatcaacacccctgaggtgctgaacggcgtccatgccaagcacgacaagttcaagacccgcctgcaacagatcggcgagaagtacggcctgttcacccaggtgcgtggtctcggtctgctgatcggttgcgtgctgagcgacgcctggaaaggcaaggccaaggacatcttcaacgccgctgaacaagaaggcctgatgattctgcaggccggtccggacgtgatccgtttcgccccgagcctggtggtggaagacgcagacatcgacgccggtctggatcgcttcgagcgtgctgcggcgaaattgacccaagcc

SEQ ID NO: 37606 - DNA, 1978 bp, Pseudomonas fluorescens
gctacaacagggtcatacaaaaacaactattacaccgaggtaggaaagatgagtgcggcttccctgtatcccgttcgtcccgaggttctggccaatacgctgaccgatgaggcgacctacaaagccatgtaccaacagtcggtcgtcaaccctgacggcttctggcgcgaacaagccaagcgcctcgactggatcaagcctttcaccacggtgaaacagacttcgttcgacgatcaccatgtcgacatcaagtggtttgcagacggcaccctgaacgtttcctacaactgcctcgaccgccatctggccgagcgcggcgatcaggtcgccatcatctgggaaggcgacgacccttccgaaagccgcaacatcacctaccgcgagctgcacgaacaagtgtgcaagctcgccaacgcccctgcgtggccaggacgtacaccgcggcgacgtggtgaccatttatatgccgatgatccccgaagccgtggtcgccatgctggcctgcacccggatcggcgcgattcactcggtggtgttcggcggcttctcgccggaagccctggccggtcgcatcatcgactgccgctcgaaagtggtgatcaccgctgacgaaggcatccgtgccggcaagaagatttccctcaaggccaacgtcgacgacgccctgaccaacccggaaaccagcagcatccagaaagtcatcgtgtgcaagcgcaccggcggcgacatcaagtggaaccagcatcgtgacatctggtacgaagacctgatgaaagtggcgggcaccgtttgcgcgccgaaagagatgggcgccgaagaagcactgttcatcctttatacctccggctccaccggcaagccgaagggcgtgcagcacaccaccggcggctatctgttgtacgcggccatgactcacgagcgcgtgttcgactaccgtccgggtgaaatctactggtgcaccgccgacgtcggctgggtcaccggtcactcctacatcgtctacggcccgctggccaacggcgcgaccacgctgctcttcgaaggcgtgccgaactatccggacatcacccgggtggcgaagatcgtcgacaagcacaaggtcaacatcctctacaccgcgccgaccgcgatccgcgcgatgatggcttccggcaccgccgctgttgaaggcgcggacggcagcagcctgcgtctgctcggttcggtgggcgagccgatcaacccggaagcctgggactggtactacaagaatgtcggcaagtcccgttgcccgatcgtcgatacctggtggcagaccgaaaccggcggcaacatgatgagcccgctgccgggcgctcacgcgctgaagccgggttcggccgcacgtccgttcttcggtgtggtgccggcgctggtggacaacctcggcaacatcatcgagggcgaggccgaaggcaatctggtgattctcgattcgtggccgggtcaggcgcgcaccctgtacggcgaccacgaccgtttcgtcgacacctacttcaagaccttccgtggcatgtacttcaccggtgacggcgcccgtcgcgatgccgacggttactactggatcaccggtcgcgtggacgacgtgctcaacgtttccggccaccgcatgggtactgccgagatcgaaagcgcgatggtcgctcacccgaaagtcgccgaagcggcggtggtcggtgtgccgcacgacatcaaggggcagggcatttatgtctatgtcaccctgaaaaatggcgaagagccgagcgagcaactgcgcctggaactgaaaaactgggtgcgcaaggagatcgggccgatcgcttcgccggacgtgatccagtgggcgccggggctgccgaagactcgttcgggcaagatcatgcgccgcatcctgcgcaagatcgctaccgccgaatacgaagggttgggcgacatctccaccctggcggatccgggtgtggtgcagcatctgatcgat

SEQ ID NO: 37607 - DNA, 1248 bp, Pseudomonas fluorescens
atgctgagctgggacgaattcgacaaagaagacagtgaagtagcagcagtgaaaggcgccaacgccggccacgctagcgaagccaacatggaccgcctcgacagcgccggcggtgccgccgccctcgaagcccgcgccgtgaccgccgaagactcggccgccgtggcccgcgccaaggctgcactggattccctcgacgtcgccgaaggcctcgccgaactcgaaggctccgccgcccgtgtcgccgttgacgaaaagcgcatgatcaactgccgcgccgacctcaaccagctcgtgccattcaagtacgactgggcctggcagaaatacctggacggctgcgcaaaccactggatgccgcaagaagtcaacatgaccgccgacatcgccctctggaaaaacccggaaggcctgaccgacgacgagcgccgcatcgtgatgcgcaacctcggcttcttctccaccgccgactccctggttgccaacaacctggccctggccgtgtaccgcctgatcaccaacccggaatgccgccagtacatcctgcgccaggccttcgaagaggcgatccacacccacgcctaccagtactgcatcgaatcgctgggcatggatgaaggcgagatcttcaacatgtaccacgagatcccgtcggtcgcgaaaaaagccgcctggggcctgaaatacacccgcgccatctccgacccggaattcaacaccggcaccgtagagaccgacaaagaactgctgcgcaacctgatcgcctactactgcgttctggaaggcatcttcttctactgcggcttcacccagatcctctccatgggccgccgcaacaaaatgaccggcgtcgccgagcagttccagtacatcctgcgcgacgaatccatgcacctgaacttcggcatcgacgtgatcaaccagatcaaaatcgaaaacccacacctgtgggatgctgaaatgaaggaagaagcttcgcagatgatcctgcaaggcactcagctggaaatcgaatacgcgcgtgacaccatgcctcgcggcgtactgggcatgaacgcggcgatgatggaggactacctgaagttcatcgctaaccgtcgtctgtcgcagatcggtttgaaggaagagtacccagggacgactaacccgttcccttggatgagcgagattatggacttgaagaaagagaagaatttctttgagactcgtgtgatcgaataccaaactggtggtgctctgagctgggac

SEQ ID NO: 37608 - DNA, 762 bp, Pseudomonas fluorescens
ggaaaacccatgaaccgcaaaatcgcattgatcacaggtgccagccgtggcctgggcaagaacgccgccctgcacctcgccgcgcaaggcgtggacatcatcggcacctacaacagccgcgccgatgaagcccaggcgctggtgcaggaactggaagcactcggcgccaacgccgtgatgctgcaactggatgtcgggcgcagcgaaggttttgccgagttcgccgtgcgggtcgagcaggcgctgcaacaacttgaacgtccgcgcttcgatttcctgatcaacaacgccgggattggcgtgcatgcctccttcgccgacaccacgccggaacagttcgacctgctgatgaacgtgcagttgaaagggccgttcttcctgactcagcaattgctgccgctgatcaacgatggcgggcggatcatcaacatctccagcggtctggcccgtttcaccctgccgggttatgccgcttacgcggcgatgaaaggcgcgatggaagtgctgacccgttatcaggccaaggagctgggcgcgcggcagatcgccgtgaatatcctggcaccgggggccatcgaaaccgacttcggcggcggcgcggtgcgcgacaattcggcactgaacgccatggtcgccagcaacaccgccctgggccgtgccgggcagccggatgacattggtggcgcactggcgctgctgctgtcgccgggggcgcagtggatcaacggtcagcggattgaagcgtcgggcgggatgtttctc

SEQ ID NO: 37609 - DNA, 699 bp, Pseudomonas fluorescens
ttgatcatcatcaccggcgccagctcgggcatcggcgaagccaccgcccgccgcttgagcgcggccggccatccgctgctgttgctggcccggcgcatcgaacgcctggaagcactggccctgccgaacactctcagccgccgcgtcgacatcaccgaccgcgccgcattgctggccgctgttgccgaggcggaagcgcagttcggtccggccgatgcgctgatcaacaacgccggggtgatgctgctgggcgagatgagcaaacaggatccggcgcagtgggaccagatgctcgacgtcaacgtgaaaggtctgctcaacggcgtgcacgcggtggtcgccgggatgatcgagcgcaagcacggcacgatcatcaacgtcagctcggtggccgggcgcaagaccttccccaaccatgtggcctatgtcgggaccaagtttgcggtgcatgggctgtcggagaatctgcgtgaagagctgtcgccgcataacgtgcgggtgaccacgattgcgccgggtgcggtggaaaccgagttgctgagccacaccacggatgaggcgatcaagaccggttatcaggcgtggaagcaggacatgggtggcacggtgttgagcgccgaggatgtggcgacggcgattgcctatgcgtatgggcagccgcagggggtttgtattcgcgagattgtgatggctgcgact

SEQ ID NO: 37610 - DNA, 1197 bp, Pseudomonas fluorescens
atggctgaacaaggttcgccgcgccgctttgcgcgcattgatcgactccccccttacgttttcaacatcaccgccgaactgaagatggccgcgcgacgtcgtggcgaagacatcatcgacttgagcatgggcaaccccgacggcgccacaccgccgcacatcgttgaaaaactggtgcaggttgcacaacgcgaagacacccacggctactccacgtccaagggcattccgcgcctgcgccgggcgatttccaactggtacaaggaacgctacgaggtcgagatcgacccggaaagcgaagccatcgtcaccatcggttccaaggaaggcttggcgcacctgatgctggcgaccctggatcagggcgacaccgtgctggtgccgaacccgagctacccgattcacatctacggtgccgtgattgccggcgcccaggtgcggtcagtgccactggtgccgggcgtggatttcttcgccgagctggagcgggcgattcgcggctcgatcccgaaaccgaagatgatgatcctcggcttcccgtcgaacccgaccgcgcagtgcgtggagctcgacttcttcgaacgggtgatcgccctcgccaaacagtacgacgtgctggtggtgcacgacctggcttacgccgacatcgtctacgacggctggaaagccccgtcgatcatgcaggtgccgggcgccaaggacatggcggtggagttcttcaccctgtccaagagctacaacatggcgggctggcgcatcggcttcatggtcggcaacccggaactggtcagcgccctggcgcggatcaagagctaccacgactacggcaccttcaccccgctgcaggtggccgcgattgctgcgctggaaggtgatcagcaatgcgtgcgcgacatcgccgaacagtatcgccagcgccgcaacgtgctggtcaaaggcctgcatgaactgggctggatggtcgagaacccgaaagcctcgatgtacgtgtgggcgaagattcccgaagcctacgcgcacctcggctcgctggagttcgccaagaagctgctggccgaggccaaggtctgcgtctcgccaggtgtcggctttggcgagtacggcgacgatcacgtgcgcttcgcgctgatcgaaaaccaggaccggattcgccaggcggtacgcgggattcgcggaatgttccgggcggatgctctg

SEQ ID NO: 37611 - DNA, 513 bp, Pseudomonas fluorescens
atgaatcatcccatcaccgccctggtcatcatgggcgttgccggttgcggcaagacgtgcgtcagcgaggccctgtgccaattgagcggcgccactgccattgaaggcgatactttccatccggccgcgaacatcgaaaagatgagcgcggggatccccctgaacgacgaagaccgtgccggctggctcgacagcctgtgcgatgaactgcgtcgcgtcgatgccctgggcgaacgcccggtgctgacttgctcggccctcaagcacagttatcgcgaagtgctgcgcagcgccttgccgggcctgggcttcgtgttcctcgaattgacgcctgaagtggccgccgaacgtgtgtcccaccgtccgggccacttcatgccggccaccttgatcgaaagccagttcgccaccctcgaatcgcccaagggcgagccgttgaccctggccctgaatgcttcgatccacagcgttgaagaactggcggcgcaagcccacgtctggtggcaggcccat

SEQ ID NO: 37612 - DNA, 862 bp, Pseudomonas fluorescens
ggccaggtcatcattgacctggtcatggccgtggatgcgctgccgcaaattggcggtgacgtgctggcgcagtccgccagtttcgaagccggcggcggcttcaatgtgatggctgccgccgcgcgcaatggcttgccggtggtctatctcggccgccacggcaacggtcggttcggcgatctggcgcggcaggcgatgaacgccgaaggcatttgcatcggcatcgatcaacctgcagagcacgacaccgggatctgcgtggcgctgaccgatgcgtcggccgagcgcagcttcatttcctacatcggcgctgaaggcgaggtcacgacggcggagctgaacagcgtcaccgccgaggagggggactacgtctacgtcagcggctacagcctgctgcacagcggcaaggctcaggcattgctggactggacgctggcgctgccgaagacgatcaacgtggtgttcgatccgggcccgctggtggagtcgccggactcgccaatgatgcaggcgttgctgccgcgcatcgatgtgtggaccagcaacagcgtcgaggcattgcgtttcactggcgcgacggacatcgaaaccgcgctggaccggttggccgtgcacctgccacaggaggtgctgatggtcgtgcgcgacggcccgcagggttgctggattcatcagtgcggcgagcgtcagcacgtgccgggtttcaaggtgcaggcagtggacagcaacggcgcgggcgatgcgcatgccggcgtattcgtcgccgggctggcacaaggactggccgctcacgaagccgcaaggcgcgccaacgctgcggctgcgttagcggtcactcgctggggcccggcgaccgcccctg

SEQ ID NO: 37613 - DNA, 474 bp, Pseudomonas fluorescens
atgacgatcgagatccgcccggcgacccccagcgatgcaccgcaaatcctcgcgttcatcaccgaattggcagacttcgaaaaggcccgtcacgaagtcatcgccagcgtcgcggacattgaacgcagcctgttcagcgaaggcgccacggcacatggcctgatctgcctgcgcgacggcttgccgatcggttttgcggtgttcttcttcagctattcgacctggctgggcagcaactgcctgtacctcgaagacctctacatcaccccggaacaacggggcggcggcgccggaaaaaccctgctgcgccacctcgcaaaaatcgcctgcgccaacgactgcggccgcttcgaatggagcgtgctggactggaacaccccggccattgaattctacaaatccctcggcgcccagccgcaggaagagtgggtgaggtatcgcatggatggcaaggtattgcgggagtttgccgag

SEQ ID NO: 37614 - DNA, 1032 bp, Pseudomonas fluorescens
atcggctatgccgctcaaacggccaccacccccctcgccccgatgaagttcgaacgccgcagcccacgggccgacgacgtcgccatcgagatcctgtactgcggcgtctgccactccgacatccaccaggcgcgcaacgaatggggcatcgccgtttacccgttgatgcccggccacgagatcgtcggaaaagtcaccgccgtcggtgcgaacgtcaccaaacacaaggtcggcgacctggtcggtgtcggctgcatggtcgactcttgccgcacctgcgaagcctgccagtcgaacctcgagcaatactgcctcgaaggcccgaccatgacctacgccactccggaccgggtcgatggcagtaacaccatgggcggttattcggacagcatcgtggtcagcgaacacttcgtggtgcgcattcccgagaagctggatctggcggctgccgcgccgattctctgcgccggcatcaccacctactcgccactcaagcactacggcgtgaaggccggcgacaaggtcgggattctcggcatgggcggcctcggccacatgggcatcaagttcgccaaggccatgggcgccgaagtgacgctgttcacccgttcggcaagcaaagccgaggaaggtcgtcgacagggcgccgatcacgtcattgtctccaccgacgaagagcagatgaaagccgctgccggccgtttcgacttcctgctggacaccattccggtgcagcacgatctgaacccgtacctcgacaccctgcgcttcgacggcgtgcacattctggtgggtctgatcgaaccgatcgatccgccggtccacgccgcgaaactggtgctgggtcgtcgcgtattggccggctcgttgatcggtggcgtcgccgaaacccaggaagtcctggatttctgcgccgagcacaacatcagctgcgacatcgaaatgctcgacatccgccagatcaacgaagcctacgcccgcatgatcgccggcgatgtgaagtaccgcttcgtgatcgacatggcgactctg

SEQ ID NO: 37615 - DNA, 1182 bp, Pseudomonas fluorescens
atgcgtgaagtggtgatcgtcgacagcgtacggaccggcctggccaagtcctttcgcggcaagttcaaccagacccgtcccgatgacatggcggcccattgcgtcaatgcgttgctctcgcgcaacgacatcgacccggccagcgtcgaggattgcatcgtcggcgccggctctaacgaaggcgctcagggctacaacatcggccgcaacgtggcggtgctctcgcaactgggcaccggcaccgccggcatgaccctcaatcgtttctgttcgtcgggtttgcaggcaattgcgattgccgccaaccagatcgcgtcgggttgcagcgacatcatcgtcgccggcggcgtcgagtcgatcagcctgaccctgaaaagcgtcaacaccgatcacctgatcaacccgttgctcaagcagcagacgccgggcatctactacaccatgggccagactgccgaagtggtggcgcgccgttatggcgtcagccgcgaggcgcaggatcgttactcgctgcaaagtcagatccgcaccgcccaggcgcaggcagccggcctgttcaacgatgaaatcgtgccgatggcggtgaagtaccgcgttgaagacaagaacagcggtgacgtgcagatcctcgacggcatcgtcgatcgcgacgactgcaaccgcccggacaccacctatgaaagcctcgccgggttgaaaccggtgttcgccgaggacgggtcggtgaccgccggcaactcgtcgcagttgtccgacggcgcctcgatgacgctggtgatgagcctggaaaaagccctgcaactggggctcaagccgaaagcatttttccgtgggtttaccgtggccgggtgcgagccggacgaaatgggcatcggcccggtgttctcggtgccgaaactgctcaaggccaaaggcttgcaggtggcggatatcgatctgtgggaattgaacgaagcgtttgcctcgcagtgcctgtatgcccgtgatcgtctggaaatcgacaacgagaagtacaacgtcaatggcggctcgatttccatcggccacccgttcggcatgaccgggtcacggcaggtcgggcatctggtgcgcgagttgcagcggcgcaatctgcgctacggaatcgtgaccatgtgtgtgggcggggggatgggcgcgaccgggttgtttgaggccgtacgc

SEQ ID NO: 37616 - DNA, 1386 bp, Pseudomonas fluorescens
cgtatcgaaaccgacagcctgggccagatcgaggtcccggacgacgcttactggggcgctcagacgcaacgctcgctgatcaacttcgccatcggtcaggaacgcatgcccttgccggtactgcacgcgctggccctgatcaagaaagccgcggcccgggtcaacgaccgcaacggcgacctgcccgccgacattgcccgcctgatcgaacaggccgccgacgaagtgctcgacggccagcatgacgaccagttcccgctggtggtctggcagaccggcagcggcacgcaaagcaacatgaacgtcaacgaagtgattgccgggcgcgccaacgaactggccggcaacccgcgcggcggcaagacgccggtgcaccccaacgatcacgtcaaccgctcgcagagctccaacgactgcttccccaccgccatgagtatcgccaccgcgcaagcggtgcagacccaactgctgccagcgatcgccgagctgtcgggcggactggccgaactttcggcgcgacacatgaagctggtgaagaccggccgcacccacatgatggacgccacgccgatcacctttggtcaggagctctccggattcatagcgcagctggattacgccgaacgggcgattcgcgcggcgttgccggcggtctgcgaactggcgcagggcggcactgccgtcggcaccgggctcaactcgccccacggcttcggcgaagcgattgccgctgaactggcggcgttgtccggcctgccgttcgtcaccgcgccgaacaagtttgccgcccttgccggtcatgaaccattgaccaccctttccggcgccctgaaaaccctcgccgtggcgctgatgaaaattgcaaacgatctgcgcctgctgggctccggcccacgagccgggttcgccgaagtgcgcctgccggccaacgaaccgggcagctcgatcatgcccggcaaggtcaaccctacccagtgcgaggcgttgtcgatgctggcctgtcaggtgctgggcaacgacgtggcgatcggtttcgccgccagccagggtcacctgcaactgaacgtgttcaaaccggtgatcatccacaacctgctgcaatcgatccgcctgctggctgatggctgcagcaacttccagcagcattgcatcgccggtcttgagccggatgccgacgtcatggcgaaacatctggaacgcggcctgatgctggtgacggcgctcaacccgcacatcggctacgacaagtcggcggaaatcgccaagaaagcctacagcgaaggcaagaccctgcgcgaagcggcgctggagctgggttatctgaccgatgaagagttcgatgcctgggtgcggccggagaacatgatcgaagccggcgccaagggc

SEQ ID NO: 37617 - DNA, 1809 bp, Pseudomonas fluorescens
acgccagccgtcaagcgtgtcgaccggctgagctgggctgaagtccggcgactggcacttcatcacaaaaaatccctgtggatcgccaacggcgtggccgtactggcgacgctgtgcagcgtgccgattccgctgctgttgccgttgctggtggacgaagtcttgctcggccatggcgacgccgcgctgaaagtcatgaaccacctgctgccctcgatgtggcagcaggcggcgggctatatcggcctgatgctggtggtgacgctgaccctgcgttgcagcgccctgtgttttggcgtgttgcaggcgcgattgtttgcgcgactggccaaggacatcgtgtaccgcatccgcgtgcggctgatcgagcgtctgaaacggatctcgctgggtgaatacgaaagcctgggcagcggcaccgttaccacgcacctggtcaccgacctcgacaccctcgacaagtttgtcggcgaaaccctcagccgttttctggtggcgatgctgacgctggtcggcactgccagcatcctgatgtggatgcactggaaactggcgctgctgatcctgctgttcaaccccttggtgatttacgccacggtgcagttgggcaaacgggtcaaacacctgaagaaactggagaacgacagcacctcgcgtttcacccaggcgctgagcgaaaccctcgatgcgatccaggaagtgcgtgccggcaaccgtcagggcttcttcctggggcgccttggcctgcgggctcaggaagtgcgcaactacgcggtcaactcacagtggaagaccgacgcttcgaaccgcgccagcggcctgttgtttcagttcggcatcgatatctttcgcgcggcagccatgttgacggtgttgttctctgacctgtcgattggccagatgctcgcggtgttcagctacctgtggttcatgatcggcccggtcgaacaactgctgaacctgcaatacgcctactacgcggcaggcggggcgctgtcgcggatcaacgaactgctggcccgcgccgacgagccgcaataccccggcggcgtcgacccgttcaagggccgcgatacggtcgggattcaagtgcagggtctgagcttcggttacggcgacgaactggtgctggatcagttgaacctgtccatcgcccccggtgaaaaagtggcgattgtcggcgccagcggtggcggcaaaagtaccctcgtgcaattgctgctgggcctgtacacgccactggcggggacgatccgtttcggcggctcgagccagcaggaaatcggcctggaaacggttcgggaaaacgtcgctgtggtgttgcaacatccggcgctgttcaacgacaccgtgcgcgccaacctgaccatgggtcgtacccgcagcgatgaagcctgctggcaggcactggaaatcgcccagctcgaacccaccatccgcgccttgccggacggcctcgacagcatcgtcggccgctccggcgtgcgtctgtccggggggcagcggcaacggctggctatcgcccggatgatcctcgccgaacccaaagtggtgatcctcgacgaagcgacgtcagccctcgatgccgcgaccgagtacaacctgcaccaggccatggcgcgcttcctccatggccgcacaacgctgatcatcgcccaccgcttgtcggcggtgaaacaggcagaccgggtgctggtgttcgacggcgggcaagtggccgaagatggcgaccatcagcaactgattgccgatggtgggttgtacgccaagctttatgggcatttgcagcggttgtaggtcagttccata

SEQ ID NO: 37618 - DNA, 738 bp, Pseudomonas fluorescens
atgtttgattactccgctcgccccgaattgctcaaggatcggatcattctggtcaccggtgccgggcgcggcatcggcgcggctgccgccaagacctacgccgcccacggcgcgaccgtattgctgctgggcaagaccgaagccaacctgaccgaagtctacgacgagatcgaagcagccgggcatccacagcccgccgtgatcccgttcaacctcgaaaccgccctgccccatcaatacgatgagctggcggcgatgatcgaaaccgagttcggccacctcgacggtctgctgcacaacgcctcgatcatcggcccgcgcacgccgatcgagcagttgtccggtgaaaacttcatgcgtgtcatgcaggtcaacgtcaacgcgatgttcatgctcaccagcacgctgttgccactgctcaaactttcgcaggatgcctcggtggtgttcacctccagcagcgtcgggcgcaagggtcgtgcttactggggcgcctatggcgtatcgaagttcgccactgaaggcctgatgcaaacactggccgacgaagtcgaaaacgtcgctccggtacgctccaacagcatcaatccgggcgccactcgcaccagcatgcgtgcgcaggcttacccgggcgaaaacccgctgaataacccgacaccggaagagatcatgccggtctacctgtacctgatgggcccggacagcaccggtatcaatggccaggccttcaacgcccag

SEQ ID NO: 37619 - DNA, 1080 bp, Pseudomonas fluorescens
gtgagcaaacgagcctttaacttctgcgcaggtcccgctgcgctgcctgaagctgtcctgttgcgtgcccagtccgagatgctcgactggcacggcaagggtctgtcggtcatggaaatgagccatcgcagtgatgactacgtggccatcgccgagaaggccgaacaagacctgcgcgacctgctgtccatcccctccaattacaaagtgctgttcctgcagggcggtgcgagccaacagttcgccgagattccgctgaacctgctgcctgagaacggcactgccgactatgtcgaaaccggcatctggtcgaagaaagccatcgaggaagcgcgtcgcttcggcaacatcaacgttgctgccagcgccaagccttatgactacctggccatccctggccagaacgagtggaagctgaccccgggtgcggcctatctgcactacgcatccaacgaaaccatcggcggcctgcagttcgactgggttcccgaggccggtgacgttccgctggtggtcgacatgtcctccgatatcctctcgcgtccgatcgatgtgtcgcagtacggcctgatctacgccggcgcgcaaaagaacatcggcccgagcggtctggtggtagtgatcgtccgtgaagacctgctgggccgcgcccgcagttcgtgcccgaccatgctcgactacaagatctcggccgataacggttcgatgtacaacaccccggccacctattcctggtacctctcgggtctcgtcttcgaatggctcaaggagcagggcggcgtcgccgcgatggagcagcgcaacaaggcgaagaaagatcgcctgtacgccttcatcgacaacagcgacttctataccaacccgatcagcgtcaacgcccgttcgtggatgaacgtgccgttccgcctggctgacgagcgtctggacaaggcgttcctggccggcgccgacgcccgtggcctgctcaacctcaagggtcatcgttcggtcggcggcatgcgtgcctcgatctacaacgccctgggtctggacgccgtcgaagcgctggtcggctacatggctgaattcgagaaggagcat

SEQ ID NO: 37620 - DNA, 1099 bp, Pseudomonas fluorescens
  unsure (1)..(1099): unsure at all n locations
aacttcctcgctctggcacagccgggcgtgcagcaactttcgccatacgtgccgggcaagcccgtggacgaactggcccgcgagctggacctggatccggcaagtatcgtcaaactggcgagcaacgaaaacccgttgggcgcgagcccgaaagcgctggccgcgatccgcgaggcgctggacgaactgacccgctatccggacggtaacggtttcgcactgaaatccctgctggccgagcagtgccgtgtcgagctgaaccaagtgactttgggcaacggttccaacgacattctcgagctggtggcgcgcgcctatctggcgccgggcctgaatgcggtgttcagcgagcacgcgttcgcggtttacccgatcgcgacccaggcagtcggcgctcaggccaaggtcgttccagccaaagagtgggggcacgatttgccagcgatgctggcggccatcgatgcgaacacccgtgtcgtgttcatcgccaacccgaacaacccgaccggtacctggttcggcgccgaagcgctggacgacttcctgcaggacgtgccagagcacgtgctggtggtgctggacgaggcgtacatcgaatacgccgaaggcagtgatctgccggatggtctggacttcctcgcggcttatccgaacctgctggtctcgcgcacgttctccaaggcctacggtctggcggcgctgcgcgtcggttacggcctgtccaccccggtggtggcggacgtgctgaaccgtgtacgccangccgttcaacgtcaacagcctggccctggccgcggcgtgtgcggcgttgaaagacgaggaatatctggcgcagagccgccagctcaacgaatccggcatgcaacagctggaggcgggttttcgcgagctgggtctgagctggattccgtccaagggcaactttatctgcgtcgaccttggtcaggtggcggctccggtgttccagggcctgctgcgtgaaggcgtgattgtgcgtccggtggccaactacggcatgccgaaccatctgcgggtgaccatcggtctgccggcggaaaacagccgcttcctcgaagcgctgcgcaaggttctggctcgt

SEQ ID NO: 37621 - DNA, 2025 bp, Pseudomonas fluorescens
gatgtcactgcgctgcaatctgctgcacctatgatcgggcgcctggtggtggttggtctggggttgatcggtggttcgtttgccaaaggcttgcgtgaaagcggcgtctgtcgcgaagtggtcggggtcgatctcgacccgcaatcgcgcaagctggcggtcgagttgggcgtggtggatcgttgcgaagacgacctggtggcggcttgccggggcgcggacgtgatccagttggcggtgccgatcctggccatggaaaaagtgctggcccgtctggccggcatggatctggggcaggcgatcctgacggatgtcggcagcgccaagggcaatgtggtgcgtgcggcgaccgaagcgttcggcggcatgccggcgcgtttcgtgccgggccatccgattgccggctccgagcagagcggggtggaagcttccaactcagagctgttccgtcgtcataaagtgattctgaccccgttggagcagaccgatccggccgccctggccgtggtcgatcgcttgtggcgtgagctgggcgccgacgtcgagcacatgcaggtcgaacgtcacgatgaagtgctggccgcgaccagtcatctgccgcacctgctggccttcggtctggtcgattcactggccaagcgcaatgaaaaccttgagatcttccgttacgctgcgggcggtttccgtgatttcacaagaatcgccggaagcgacccggtcatgtggcatgacatctttctcgccaaccgcgaggctgtcctgcgcacactcgatacatttcgcagcgacctcgacgccttgcgcgacgcggtcgatgcaggggatgggcaccaattgttgggcgtcttcacgcgcgcccgggttgcccgcgagcatttcagtaaaatcctggcccgcagggcctatgtggacgctatgaattccaacgatctgattttcctggctcaacctggtggccgcctgtccggtcggattcgcgtaccgggtgacaaatcgatttcccaccgttcgatcatgctcggttccctggctgaaggcgtcaccgaagtcgaaggcttcctcgagggcgaagacgccctggcgaccttgcaggcgttccgcgacatgggcgtggtcatcgaaggcccgcatcacggccgcgtgaccatccacggtgtcggcctgcatggcctgaagcctgcgccgggcccgatctatctgggcaactccggcacttcgatgcgcctgctgtccggcctgctggccgcgcaggatttcgacagcaccctaaccggtgacgcttcgttgtccaagcgcccgatgaatcgcgtcgccaacccgctgcgggaaatgggcgccgtgatcgaaaccgctgccgagggtcgtccaccgatgaccattcgtggcggtcacaagcttaaaggcctgacctacaccatgccgatggccagtgctcaggttaaatcctgcctgctgctggcgggtctgtacgccgaaggtaagaccaccgtgaccgagccggcaccgacccgtgatcacaccgagcgtatgctgcgcggctttggctatccggtgagcgtcaacggtgccacggcatcggttgagtctggtggcaagctgaccgcgacccacatcgaagtgcctggcgacatctcgtcgtcggcgttcttcctggtggccgcatcgatcgctgaaggctcggagctggtgctcgagcacgtcggcatcaacccgacccgcaccggcgtgatcgacatcctgcgtctgatgggcgccgacatcactctggaaaaccagcgtgaagtgggtggcgagccggttgccgacctgcgtgtgcgagcagctaaactcaagggtatcgagattccggaagcgctggttccactggccatcgacgaattcccggtgctgttcgtggccgcggcctgtgctgaagggcgcaccgtgctgaccggcgccgaagagctgcgggtcaaggagtctgaccgtatccaggtcatggcggacggtctgctggcgctgggcgtcaagtgcgaaccgaccccg

SEQ ID NO: 37622 - DNA, 765 bp, Pseudomonas fluorescens
atgatacagatcagtgccctgcccgccttcaccgacaactacatctggttgttacaggatcatgccacccagcgttgtgcagtggtcgatccgggggatgccgccccggtgcaggcgtggctcgacgcgcatccgggctgggtgctcggcgacatcctcatcactcaccatcaccacgaccatgtcggcggcgtcgagacgctgaaaaaggccaccggtgccacggtctatggaccggccagcgaaaacattccggggcgggacgtggccctcaaggacaacgacacggtgcgcgtgctcggctgggacttcgatgtctatgccgttcccggccacaccctcggacacatcgcctactaccatcacggcctgctgttttgcggtgacaccctgttcgctgccggctgcggccgtctgttcgaaggcacgccgcaacaaatgcaccagtcgttgagccgtctggcggcgctgccggaagacacgctggtctactgcacccacgagtacaccctgagcaacctgaaattcgctgctgccgtggagccggacaaccgggacatcgccgcccgtctggaaaaagtcacccggcaacgtgagaacggtgtcatgaccctgccctcgacccttgcgctggaaaaactcacaaacccgtttttgcgcaccggtgaaatattagttacacaaaaagtggacgaacggaacggccctcagaaccgggcgccgagtgaggtttttgcggctctgcgggcatggaaagatacgttc

SEQ ID NO: 37623 - DNA, 2253 bp, Pseudomonas fluorescens
atgtacaaagatttgaagttcccggtgttgatcgtccaccgcgacatcaaggccgacacggttgccggtgaccgcatccgcggcattgcccgagagctggagctggaaggtttcagtatcgtttcggccaccgactacaccgaaggccggctcgtggcgtcgacccaccatggtctggcgtgcatgctgatcgccgcggaagacgccagcaccaactcccatctgttgcagaacatggccgaactgatcggtctggcccgggtgcgggcgccggatctgccgatctttgcactcggcgagcaagtaaccctggaaaacgccccggccgatgcgatggccgaactcaaccagttacgcggcattctctacctgttcgaagacaccgtgccgtttctcgcccgacaagtggcgcgggcagcgcgcaaatacctggacggcctgttgccgccattcttcaaggcgctggtccagcacaccgccgattccaactattcctggcacacccccggtcacggcggcggggtggcctatcacaagagtccggtggggcaggcgtttcatcagttcttcggggaaaacaccctgcgctccgatttatcggtctcggtgccggagctgggttccttgctcgatcacaccgggccgctggccgaggcggaagcgcgggccgcgcgcaatttcggcgccgatcacacctttttcgtgatcaatggcacctcgaccgccaacaagatcgtctggcactcgatggtcgggcgcgatgatctggtgctggtggatcgcaactgccacaagtcggtgctgcacgcgatcatcatgaccggcgcgattccgctgtacctgtgcccggagcgcaacgagctggggatcatcgggccgatcccgctcagtgaattcagtcgtgaatcgatccaggccaagatcgacgccagcccgttgaccaagggccgcgaaccgaaagtcaaactggcggtgatcaccaactccacttacgacggcctctgctacaacgccgagctgatcaagcagagcctgggcaacagtgtcgaagtgttgcatttcgacgaggcctggtacgcctacgccgcgtttcacgaattctttgccggccgttacggcatggccacctcgcgcagcgaggacagtccgctggtgtttaccacccactccacccacaaactgttggcggcgttcagtcaggcctcgatgattcatgttcaggacggtggggcgcggcagctggatcgcgaccggttcaacgaagcgttcatgatgcacatctcgacgtcgccgcagtacagcatcattgcttcgctggacgtcgcctcggcgatgatggaaggcccggccggacgctcgctgctgcaggaaaccttcgacgaagccctgagctttcgccgggccttggccaatctgcgtcagcacatcgccgctgacgattggtggttctcgatctggcagccgccgggtgtcgagggcatcgaccgggtgcagaccgaggactggctgctgcaacccgatgcggactggcacggtttcggcgaggtcagcgacgactacgtactgctcgacccgatcaaggtcaccctggtcatgccgggcctgaccgccggcggcgctttgagcgacaagggcatcccggcggccgtggtcagccgtttcctctgggagcgcgggctggtggtggagaaaaccggtctgtattcatttctggtgctgttctccatgggcatcaccaagggcaagtggagcacgctcctgaccgaactgctggagttcaagcgcagctacgacgccaacatcagtctcgacacctgcctgaagtgtgtcgagcaggaagatcctgtgcgctatcgcggcatgggcctgcgcgatttgtgcgatcagcttcacgcctgctatcgcagcaacgcgaccgccagacacctcaagcgcatgtacacggtgctgccggaaatcgcgatgaaaccggcccacgcttacgatcaattggtgcgcggcgaagtcgaggcggtgccgatcgatgagctggaaggccgggtggcggcggtgatgctggtgccgtacccgccgggcattccgctgatcatgcccggcgaacggtttaccgaatccacgcgctcgatcatcgaatacctcaggtttgcccgcacgttcgacacaacgtttccggggttcgtggtcgatgtgcacggtctgcaacacgaagatgagggcaatgggcggcactacaccgtcgattgcgtcaaggaa

SEQ ID NO: 37624 - DNA, 2265 bp, Pseudomonas fluorescens
ccgaacatggcaaatgaatcgaaatgcccgttcaatcacgccgccggcggtggcacgacgaaccgcgattggtggccgaatcaactgaacctgaaaatcctgagtcagcactcgcccgcatccgatccgatgggcaaggacttcgactacgccaaggctttcaaaagcctggatttccaggccctcaaacgcgatctgacggcgctgatgaccgactcccaggagtggtggccagcggacttcggccactacggcccgctcttcatccgcatggcctggcacagcgccggcacctatcgcacggctgacggtcgtggcggtgccggttccggccagcaacgtttcgccccgctcaacagctggccggacaacgtcagcctcgacaaggcccgccgcctgctgtggccgatcaaacagaaatacggccgcaacatttcctgggccgacctgatcgttctcaccggcaacgtcgcgctggaatccatgggcttcaagaccttcggtttctccggtggtcgcgcggatgtgtgggaaccggacgaagacgtgtactggggctcggaaaacaaatggctgggcggcgacaaccgttacggcaaggatccggaatccatgcagccgccgggcgaaggcacgctggtggccgaaccagccgagcacggcaatgaagagagccgcaccaaccagggcgaacgcaacctcgagaacccgctcgccgcggtgcagatgggcctgatctacgtaaacccggaaggtccggaaggcaatcccgacccggtggcttcggccaaggacatccgcgaaaccttcggccgcatggccatgaacgacgaggaaaccgtcgccctgatcgccggtggacatgccttcggcaagactcacggcgcaggcccggccgataatgtcggcccggaaccggaagccgccggcctcgaagaacaaggcctgggctggaaaaacagcttcggcaccggcaagggcgccgataccatcaccagcggcctggaagtgacctggaccaccaccccgaccaagtggagcaacaactatctggaaaacctgttcggcttcgagtgggaattgaccaagagccccgccggcgcccatcagtggaagccgaaaaacggcgccggggccggtaccattccgcacgcccacgacccgaacaaacgcatcgacccgaccatgctcacctccgacctggccctgcgtttcgacccgacctacgagaagatttcgcggcgcttcctggccaatcccgatcaactggccgatgccttcgcccgcgcctggtacaaactgatccaccgcgacatgggcccgctgtcacgttatctcggcccggaattgccccaggaagaactgctgtggcaagacccgattccagaggccacgcatccactggtggacgacagcgatatccgggcgctgaaaggcaaaatactggcgtcggggctgtccgtttcggaactggtttccactgcctgggcggccgcatcgaccttccggggctcggacaaacgcggcggcgccaatggcgggcgtctgcgtctggcaccgcagaaattctggcaggccaaccagccggagcaactggacaaggtattgaaagtcctcgaaggcattcagaacgagttcaacgccggggcggcaggcaagcaagtctcgctggcggacctgatcgtgctggccggtaatgccggggtcgaacaagcggcgcaaaacgccgggcacacggtgaccgtgccgttcaatccggggcgcaccgatgcgactcaggagcagaccgatgtcgagtcgttcggcttccttgaaccgcacaccgatggcttccgcaactacgcggccagcacttatcgcgtgccggccgaagcgttgctgatcgacaaggcgcaactgctgacgctttcggcgccggaaatgaccgtgttgatcggcggcctgcgcgtgctggacaccaacgtcggcaagacccagcacggcgtgttcaccgacagacctggcaccttgaccaacgacttctttcgcaacctgctggacatgggtgtggaatggaaaccaacgtccaaaaccgagttcgaaggccgcgaccgtaaaaccggcagcgtgaagtggacggcgacccgggtcgatctggtgttcggttccaactcggtgctgcgggccctggccgaggtgtatgccagttccgatgcgaaggaacagttcgtcacggacttcgttgcagcctgggcgaaggtgatggatctggatcggtttgatctg

SEQ ID NO: 37625 - DNA, 1134 bp, Pseudomonas fluorescens
atgattcccagaaccttgttcagctccgagcacgaattgttccgcgacagcgtacgaaccttcctcgaaaaagaggccgtgccgttccatgggcaatgggaaaaacaaggctacatcgaccgcaaactgtggaacaaggcaggggaggcggggatgctctgctcgaacctgccggaggaatacggcgggttgggggcggactttctttacagcgcggtcgtgatcgaagaagtcgggcggctgggtttgaccggtatcggtttttcactgcattcggacatcgtcgcgccgtacatcctgcattacggcagcgaagcgctgaagcagaaatacctgccgaaactggtgtctggcgagatggttaccgcgatcgccatgaccgagcccggcgccggttccgacctgcaaggggtcaagaccacggcggtactggatggcgacgaatatgtgatcaacggttcgaaaacctttatcaccaacggcttcctggcggatctggtgattgtcgtggccaagaccgatcccaaggccggtgccaagggtaccagcctgtttctggtggaggcgaacacaccgggcttcgacaagggcaaacgcctggataaggtcggaatgaaggctcaggacacgtcggaattgttcttccaggacgtgcgcgtgccgaaagaaaacctcttgggtcaggccggggcgggatttgcctatctgatgcaggaactgccgcaggagcgtctgactgtggcgattggcggtctggcttcagccgaggcggcgctgcaatggacgctggattacacccgcgagcgcaaggcgttcggcaagtcgattgccgacttccagaatacccgcttcaaactggcggaaatggccaccgagattcagatcggccgggtgttcgtcgaccgctgccttgagctgcatctgcaaggcaagctggatgtgccgacggcggcgatggccaagtactggggcaccgacctgcaatgcaaggtgctcgacgagtgcgtgcaactgcatggcggttacggtttcatgtgggaatacccggtggcccgggcctgggcggatgcgcgggtgcagcgcatctatgccggcaccaatgaaatcatgaaggagatcattgcgcggtcgctt

SEQ ID NO: 37626 - DNA, 1680 bp, Pseudomonas fluorescens
atgttgcagactcgcgttattccgcccgccgaaggggcgtaccagtatccactgctgatcaaacggctgctgatgtcgggcgcccgttacgagaaaacccgcgagatcatctaccgtgaccaactgcgctacagctacccgaccctgatcgaacgggtcgcgcagctggccaacgtgctgacggcggccggggtcaaggccggtgacaccgtggcggtgatggactgggacagccatcgctacctggagtgcatgtttgcgattccgatgatcggcgcggtgatccacaccatcaacgtgcgcctgtcgccggaacagatcctctacaccatgaaccacgccgaggaccgcttcgtgctggtcaacagcgagttcgtcgggctgtatcaggccattgcgccacacctgaccacggtggaaaaaaccctgctgctgaccgatctgccggaaaaaaccgccgatctgccgaatctggtgggcgagtacgagcaactgctggcggccgcgagtccgcagtacgacttcctggatttcgacgagaactcggtcgccaccacgttctacaccacgggtaccaccggcaatccgaaaggcgtgtatttcacccatcggcaactggtgctgcacaccatgggcgtgtcgaccatcatgggcgccatcgacagcgtgcggctgctgggcaccaacgacgtgtacatgccaatcaccccgatgttccatgtgcatgcgtggggcctgccttacgtggcgaccatgctcgggctgaaacaggtttatccggggcgttacgacccggaattcctggtcgagttgtggcgcaaggaaaaggtcacgttctcccattgcgtgccgactatcctgcagatggtgctcaacgccaagggcgcgcaaggcaccgacttcggcggctggaaaatcgtcatcggcggcagcgcgctcaatcgcacgctgtatgaaacggccaagagcaagggcattcagctgacggctgcctatggcatgtcggaaaccgggcctctggtttcatgtgcgcatctgaacgatgaattgatggccggcaccgaagacgagcgcaccacctaccggatcaaggccggtgtgccggggccattggtcgaagcggcgatcgtcgacaccgagggcaatttcctcccggcagacggcgagacccagggcgaactggtactgcgcgcaccgtggctgaccgagggctacttcaacgaaccgcagaagggcgccgagctgtgggccggcggctggctgcacaccggcgacgtagcgacgctcgacgccatgggtgtgatcgatatccgcgaccggatcaaggacgtgatcaagaccggcggcgaatggatctcctcgctggacctcgaagacctgatcagccgccacgtcgcggtacgtgaagtagcagtggtgggcatcgccgatccgcagtggggcgagcgcccgtttgccttgctggtggtccgtgaaggtcacgccatcggggcgcgcgagctcaaggaacacctcaagccgttcgttgaactggggcacttgagcaagtgggcgatacctagtcagatcgcccttgttactgaaattcccaagaccagtgtcggcaagctcgacaagaagcgcatccgcctcgacatcaccgaatggcaggccaacaacagcaccttcctctcgacgctc

SEQ ID NO: 37627 - DNA, 555 bp, Pseudomonas fluorescens
atgtccgctgatctcgagcatatccgtcaaatcatgcgagaggctgactgcctgtacaccgaagctgaagtcgaggctgccattgcccgcgtcggtgcacaaatcaacgaacaactggccgacagcaacccggtggtgttctgcgtgatgaacggcggcctgatcttctccggcaaactgctgacgcatctgcagttcccgctggaagcgtcctacctgcacgccacccgttaccgcaacgaaaccagcggcggcgacctgttctggaaagccaagccggaagtctcgttcatcgaccgtgacgtgctgatcatcgacgacatcctcgacgaaggtcacaccctgggcgcgatcatcgacttttgccgtcacgccggtgcacgtaaagtgcacaccgccgtgctgatcgacaaggatcacgatcgcaaggcccgtcctgacctgaaagccgatttcgtcggtctgccgtgcatcgaccgttacatcttcggttacggcatggactacaaaggctactggcgcaacgccaacgggatcttcgccgtcaaaggcatg

SEQ ID NO: 37628 - DNA, 1008 bp, Pseudomonas fluorescens
atgaccgatcacgccttgcttctggtcaacctgggttcgccggcctccacttcggtggccgacgtgcgccgctatctcaatcaattcctgatggatccttacgtgatcgacctgccgtggccggtgcggcgtctgctggtgtcgctgatcctgatcaagcgccccgagcagtcggcccacgcctacgcctcgatctggtgggatgaaggctcgccgctggtggtcctcagtcgtcgcctgcagcagcagatgaaggcgcaatggacccacggcccggttgagctggccatgcgttacggcgagccgtccatcgagacaaatctgctgaaactggtcgcggcgggacacaaacgcatcaccctcgcgccgctttatccacagtttgccgacagcaccacgaccaccgtgatcgaagaagccaagcgtgtggtgcgcgagaaaaaactcgatgtgcagctgtcggtgttgcagccgttctacgatcagccggaatacctcgacgcgctggtggcgagcgccagaccgcacttgcagcaggattacgatcacctgttgctgagcttccatggtttgccggagcggcacctgaccaagcttgacccgaccggtaaccattgcttcaagaatgaagattgctgcaagaatgcttcggctgctgtattggccacctgttatcgcgcccagtgcctgcgcacagcggcgctgttcgcagaacgcatgggcctgccggacggcaaatggtcggtgtcgtttcagtcgcggctgggccgggcgaaatggatcgaaccctacaccgaagcgcggctggatgagctggccaaaagtggcgtgaagaagattctggtgatgtgcccggcgtttgtcgccgattgcatcgagaccctggaagagatcggcgatcgcggcaaggagcagttccgcgaggcggggggagaagagttggtgctggtgccgtgtctgaatgacgacccgcaatgggcgaaggcgttggcaacgttgtgtgaacgg

SEQ ID NO: 37629 - DNA, 729 bp, Pseudomonas fluorescens
tggctgaccggtgccagcagtggcatcggtgcagcattggcagaagaaatcctcaagaccggtgcacatctggcggtcagttcccgtcaggtcgcgccgctcaaagtgctgtcgcaacgttatccgggacaggtactgctggtgcccggcgatctgaccaacagtcagaccgtgcgcgaaatcggcgaacagatcgcagcggactggggctcgctggactcggtgatcctcaacgccggcacctgcgaatacgtcgacgcccgtcaattcgacgcgtcgatcgtcgaacacgtagtgcgcaccaacctgctcgccagcagctattgcatcgaagccgccctgccgttgctgcgcaaaggtacggcaccgcatctggtggggatggccagctcggtgacctatgtgccgttgccccgcgccgaagcctatggcgcgtcgaaggccgggctgcgctatctgttcgaatccctgcgcattgacctggcggccgaaggcattgaagtcacggtaatcagtccaggcttcgtcgacacgcccctgaccgccaaaaatgacttcccgatgccgctcagttggcctgtggataaagccgcgcggcatatcttcgccaagctgaaggaccggccgcttgagatcgctttcccggcgctgttcatcgcggccctgtggccactgtcgaaaatgcccgcgcgggtacaactggcgatcggcaagcgcatggtgcgcagc

SEQ ID NO: 37630 - DNA, 1257 bp, Pseudomonas fluorescens
atggccttccttgcactcggtatcaaccacaagactgcttcagtagacgtccgcgagcgcgtggcctttacccctgagcagctggtggaggccttgcagcagctctgccgactcaccgacagccgcgaagctgcgatcctctccacctgcaatcgcagtgagctgtatatagaacaggatcagctttcggccgatatcgtgctgcgctggctggccgactatcaccatttaagcctcgatgagctgcgcgcgagtgcttatgtgcatgaagatgatgcggcagttcgtcacatgatgcgtgtcgcctccgggctcgactcgctggtgctgggcgaaccgcagattctcggccagatgaaatcggcctacgccgtggcccgcgaggccggcaccatcgggccgctgctggggcgactgttccaggcgaccttcaacgccgccaagcaagtacgtaccgacaccgccatcggcgaaaacccggtgtccgtggcgtttgccgccgtcagtctggccaaacagattttcagcgacctgcaacgcagccaggccctgctgatcggcgccggcgagaccatcaccctggtcgcccgccacctgcatgaactgggggtcaagcgcatcgtggtcgccaaccggacgctggagcgcgccagcctgctggccgagcagttcggtgcccacgcagtgttgctctcggacatcccggccgaactggtgcgcagcgacatcgtcatcagttctaccgccagtcagttgccgattctcggtaaaggcgcggtggaaagcgcgctgaagctgcgcaagcacaagccgatcttcatggtcgacatcgccgttccccgtgacatcgagccagaagtcggcgaactcgacgacgtttacctctatagcgtcgacgatctgcacgaagtggtcgctgaaaacctcaagagccgtcagggcgcagcgcaggcggccgaagagatggtttcggtcggcgccgacgatttcatggtgcgcctgcgcgagctggcggcagtcgatgtgctcaaggcctatcgtcaacagagcgaacgcctgcgcgacgaagaactgcaaaaggccctgcgcctgctggccaatggcggcaacgccgaagacgtgctcgggcaactggcccgtggcctgaccaacaaactcctgcacgccccgagcgtgcagttgaaaaagctttctgccgaaggccgcctcgatgcgctggccatggctcaggaactctttgccctcgagggctcaccg

SEQ ID NO: 37631 - DNA, 900 bp, Pseudomonas fluorescens
atgtccgcaaatgtagtggtaataggcagcctgaacatggacctggtcacccgggcgccgcgcttgccccggggcggtgagacgctgatcggtcattccttcgcgaccgtgtccggtggcaagggcgccaatcaggcggtggccgctgcgcgactgggtgcgcaagtgtcgatggtcggctgtgtcggcaacgatgaatatggcgtgcaattgcacgacgcgttgctggccgagcagatcgattgccaggcggtcagcgtggtggaggattccagtggtgtggccttgatcgtggtcgatgacaacagtcagaacgcgattgtcatcgttgccggcgccaatggttcgatgaccccggcggtcatcgaccggttcgacgccgtgctgcaggctgccgacgtgatcatctgccagctggaaatccccgatgccacggtgggccatgcgctgaaacgcgggcatgaactgggcaagatggtcatcctcaacccggcgccggccagtcgcccgctgccggtggactggtttgccgccatcgattacctgattcccaacgagagcgaggccgccgccctctgcggtttgccggtggactcgctggagaccgctgaaaaagccgcggcgcacctgatttcactgggcgccggcaaggtcatcatcacgctgggcgctcaaggctctttgttcgccaacggtacgggttaccagtattttcctgcacccaaagtgaaggctgtcgacaccaccgccgccggggacacttttgtcggcggatttgccgctgcactggcggccggcaaaaccgaggacgaggccattcgtttcgggcaggtcgctgcggccctgtcggttacccgggcaggtgcccagccgtccattcccaccacctccgacgtacag

SEQ ID NO: 37632 - DNA, 776 bp, Pseudomonas fluorescens
tggaacacacagagcgcaagcttctgtttcgcatcgaaccgggcaccgccggctggtatcacggtttgcccggcagcgtgcaggaactcgacctgcaaccgaaaagcttcaaggccgggcaaaacattcacgcctggtggtggccggcagagcgcgccgatgcaccggccattctttatttgcatggcgtacgctggaatctgacagggcaactgtttcgtatcgaacaattgcgcgcggcaggttattcggtattggccatcgactatcgcggtttcggccagagccgtggcgatctgccgtcggaaagcacggtgtacgaagatgcccgggtagcctgggaacgcttccagctgttgcaacccgatccgaacaaacgcctgatctacgggcattcattgggtggcgcggtcgccatcgatctggctgccgaactcggtcgcgacgccaccagaaaccacaccccattgccggtgcgcggactggttatcgaatccaccttcacctccttggcggatgttgcggcagccgtggccaacacctcccttccagtccgctggttgctgtcgcagaaattcgattccatcgacaagatcgccgagatccacatgccgttgctggtggtacacggcctggccgacgcattcgtgccgtcacgcttcagcgaacaactgttcgccgccgcccggcagccgaaacgcctgttgctggtgcccggcgcaacgcacaacaacagcatggcgctgggcggacagaactatcgcaaggcaatcgat

SEQ ID NO: 37633 - DNA, 966 bp, Pseudomonas fluorescens
atgcaaccccaagctttctaccgcgcggtggcggacgattttagcgccgtcgacggcatcatcaagaagcagctgacttcccgagtgccgctggtatcgaaaatcggcgattacatcacgtcggccggcggcaaacgcctgcgtcctttattggtgctgctgtgcggcaaggccctgggtcgcgaaggcgacgacatgcgcctgctggccgctaccatcgaattcctgcacaccgccaccctgctgcatgacgacgtggtcgacatgtccggcatgcgccgtggccgttcgaccgccaacgccatgtggggcaacgccccgagcgtgctggtcggcgacttcctgtactcgcgctcgttcgagatgatggtcgaactgggctcgatgccggtgatgaaaatcctgtcccaggccacgcgcatcatcgccgaaggcgaagtgctgcaactgtccaaggttcgcgacgccagcaccaccgaagaaacctacatggaagtcatccgcggcaagaccgcgatgctcttcgaggcttcgacacacagcgccgcagcactggctggcgcgaccgccgagcagagcgaagccctgcgcactttcggtgatcacctgggcgttgcgttccagctggtcgacgacctgctcgactacaagggcgacgccgaaaccctgggcaagaacgtcggtgacgatctggccgaaggcaagccgaccctgccgctgatctacaccatgcgcgaaggcacgccggagcaagccgcactggtacgccaggcgatccagaaaggcgggatcgaagacctggaaagcatccgtatcgccgtggaagcctccggttcgctggaatacaccgcgcaactggcccgtgattacgtggctcgcgcgatcaagtgcctcgacgcgctgccggccagcgaataccgcgatgcactggttgagctgagcgagttcgcggtcgcccgcacgcac

SEQ ID NO: 37634 - DNA, 1335 bp, Pseudomonas fluorescens
atgatcgaatccgtcgaatccttcctcgcccgtctgaaaaaacgcgatccggatcaacccgaattccaccaggccgtcgaagaagtcctgcgcagtctgtggccgtttctcgaggccaatccgcactatctgacctcgggaattctggagcgtatctgcgagccggagcgggcggtggtgttccgagtgtcgtgggtcgacgatcagggcagggtccaggtcaatcgcggtttccgcatccagatgaacagcgccattggcccctacaagggcggtttgcgtttccatccttcggtgaatctgggcgtgttgaaattcctcgccttcgagcagaccttcaagaattccctgacctcgctgcccatgggcggaggcaagggtggctcggacttcgatccgaagggcaagagcgacgccgaagtcatgcgtttttgccaggcattcatgagcgagctgtaccgccacatcggtgccgacgtggacgtcccggccggtgatatcggtgtcggcgcacgggaaatcggtttcctgttcggccagtacaaacgcctgagcaaccagttcaccagcgtgctgaccggcaagggcatgacctacggcggcagcttgattcgccccgaagccaccggtttcggttgcgtgtacttcgccgaggaaatgctcaagcgtcgcgagcagaccgtcgaaggcaaacgcgtggcgatctccggttccggcaacgttgcgcaatacgcggctcgcaaagtgatggatctgggcggcaaggtgatttccctctccgactccgaaggcacgctgtattgcgaggcgggcctgagcgaagaacagtggttggcgctgctggaactgaagaacgtcaagcgtgggcggatcagcgaattggcgtctgccttcggtctggagttccgcgccggtcagttgccatggtcgttgccgtgcgacattgcgctgccatgcgcgacccagaacgaacttgacgcggaatccgcccgcaccttgctgcgcaacggctgcgtctgcgtggccgaaggcgcgaacatgccgaccacccttgaggctgtggatatctttatcgaagcgggcattctgttcgcgccgggcaaggcctcgaatgccggcggcgtagcggtcagtgggctggagatgtcgcagaacgccatgcgcctgctgtggacgggcggcgaggtggacagcaagctgcacgggatcatgcagtcgatccaccacgcctgcgtgcattacggtgaggaaaacggccggatcaactacgtcaaaggcgcgaacatcgccggcttcgtcaaggtcgccgacgcgatgctcgcccaaggcgtggtt

SEQ ID NO: 37635 - DNA, 1485 bp, Pseudomonas fluorescens
ttggccgccagcctgctgaccctttccgtgaacgccgcccccctgacccgggataacggtgcggcagtcggcgacaaccagaactcgcaaaccgccggcgccaatggcccggtgctgttgcaggacgtgcaactgatccagaagctgcaacgtttcgaccgtgaacgcattcccgaacgtgtcgtgcatgctcgcggcaccggtgcccatggcacgttcaccacaaccaacgatctgagtgatctgagcaaggccaaggtgtttaccgccggccaggtcacgccggtgttcgtacgtttctcggcggtggttcacggcaatcactctccggaaaccctgcgtgaccctcgggggttcgcaaccaagttctacaccgctgacggcaattgggatctggtgggcaacaactttccgacgttcttcatccgcgatgcgatcaagtttccggacatggtgcatgccttcaagcccgatccgcgtactaaccttgacgatgactcgcgtcgcttcgatttcttctcccatgtaccggaagctacccgcacattgaccgagttgtattccaactcgggcactccggccagctatcgggagatggacggcaatagtgtgcacgcctacaagttggttaacgccaagggcgatgtgcactatgtgaagtttcactggaaaagtttgcaaggcatcaaaaatctcgatccgaaacaagttgagaaagttcaggggcgcgactacagccacatgactcacgacttggtagaaaacattcaaaaaggaaactttcccaagtgggacttgtacattcaagtcttgaatccgcaagacttgtccaagtttgaattcgatcctcttgatgcaaccaagatctggccaggtgttccagagcgaaaagttggacaaatggtgttgaaccgtaatcctgcgaatgtcttccaggaaactgaacaggtcgccatggcgccatcgaatgtggtgccgggcatcgagccttcggaagaccgtctgttgcaaggccggatatttgcctacgccgatacccagatgtatcgccttggcgccaacgccctgcaattgccgatcaatgccgccaaaactgctgtcaacaatggcaatcaggatggcgcgatgaatgccggtgcgagcacctcgggcgtcaactatgagcctagccgtctgcagccgcgtgaagagacggcaggcgcgcgatacagccagaccgcgctgcagggcagcacgcaacaggcgaagatccagcgtgaacagaacttcaagcaggccggagatctgtatcgctcgttcagcaagaaggaacgtcaggatctgatcgagagctttggcggttcgctggcgagtgccgatgacgagagcaagcacatcatgctgtccttcctctataaggcggatccggaatacggcgccggggtgaccaaagtggccaagggtgacctgagtcgggtcaaggcgttggcggccaaactggccgac

SEQ ID NO: 37636 - DNA, 435 bp, Pseudomonas fluorescens
atgccccctatcgttctggtgcttaacggcccgaacctgaacctgctcggcacccgtgaaccggcgacctacggtcacgaaaccctggccgatatctctgccctgtgcgggcgcgccgccgaagaattcggcctggccgtggagtttcgccagaccaaccacgaaggcgaactgctcgactggattcacggcgcccgccagcgctgcgccggcatcgtgatcaacccggccgcctggactcacacctcggtcgcgatccgcgacgctctggtcgccagcgaattgccggtgatcgaagtgcacctgtccaacgtccacgcccgcgagccgttccgtcatcactcgttcgtctccgccatcgccaccgccgtgatgtgcggcttcggcagccacggctatcgcctggccctggaacatttcagccagcggctgaag

SEQ ID NO: 37637 - DNA, 846 bp, Pseudomonas fluorescens
atgaatcgcaacaacgtgatactcgccgggctgatcggtgccggcatccaggcctcccgcaccccggccctgcacgaacacgaaggtgacgaacagggcctgcgttacctgtaccggctgatcgatctcgatcaactgcaactggacagcaacgccctgcccgacctgctgctggccgccgaacggatgaactacaccgggctgaacatcaccttcccgtgcaagcaggcaatcatcccgctgctcgatgaattgtccccggaagcccgaggcatcggcgccgtgaacacagtggtgctgaaggacggcaaacgcgtcggccacaacaccgattgcctgggttttgccgaaggttttcgtcgcggactgccagacgtcgcccgcgaacgtgtggtccagatgggcgccggtggcgcaggcgcggcagtcgcccacgccttgttgagcgaaggcgtacagcaactgagcatttttgatgtggacgtggagcgcgccgaaagcctggccaacaacctcaaccagcatttcggcgctggccgggcggttgccgggcatgatctggcgagcacactgagtcaggcgaatggcctggtaaacaccacgccgatgggcatggccaaattgccaggcatgcccgtgccgacggaattgctgcgacccgagttgtgggtagcggagatcgtgtatttcccgctggaaaccgaactactgcgcaacgcccgcgccctgggttgccgaaccctggacggcggcaacatggcggtatttcaggcggtgaaagcgtttgaactgttcagcggcagagtgccggatgcgcagcgaatgctcgcgcattttcaaagcatg

SEQ ID NO: 37638 - DNA, 786 bp, Pseudomonas fluorescens
ctgccaaaactcggcctcggcacctggccgatgcttggcgacgaatgcacccgcgccgtggagcaagcgctggaactcggttaccgccacatcgacacggcagcggcctacaacaacgaagacgcagtcggacaggcgttggcaaatacgccgacaccccgcgagcagatccacgtcaccaccaaggtctggtgggaccagctgcaaccggacgccatgcgtcactcgctggatcgcagcctcaaggcgttgcgcagcgagtacgtcgatctgttcatgatccattggccgaccactgactgggacctgccgcacacccttgaaaccctcgcgtcgttcaaggagcaaggtctggctcgcaacatcggtgtggcgaactttccgctgccgctgctgcgcaaagtcgtcgaggaatacggcatccctctgtcagccatccagatcgagtaccacgtcctgctcggacaaaacgccctgctcgactacgcccgtcaacacgatctggcgctgacggcctacacgccactggcgcgcaacaaggtctcggagattccacagattcagcagatcgccgaaaaacatggcgtgctgccgactcaagtggcgctgaagtggctgctggatcaggacaacgtcgcggcgattcccaaggccagcagcaagaccaatcaactggccaacctggcgtcactgcaggtcgaactggatgacgacgaccgagcgttgatcgccgcgttgtccaaacgcgaacgtcaggtcagcccggacttcgcgccggtgtgggat

SEQ ID NO: 37639 - DNA, 793 bp, Pseudomonas fluorescens
atgaagatcgatctgagcggaaaactggcgattgtcagcggcagcacggcgggcatcggtttgggcatcagccagtcgctggccgaggcgggcgccacggtggtggtgatcggtcgcgacgcggccaaggtcgaacaggcgcttacaagcattcgagcacaaggtgccgggcgcgcaactgcgcggtctgacggcggatctgggcacggccgaaggcgcgcagaaactgttcgccgccgaaccgaaagccgacatcctggtgaacaacctcggcatctacaacgccgtggatttcttcgacgcgccggacgatgagtggacgcgcttctatgagatcaacgtgatctccggcgtgcgcttgtcgcggcattacgtgccggcgatggtcgagcagggctggggccgggtgatcttcctgtcttcggaatccggcgtagccaccccggccgacatgatcaactacggcgtgaccaaaagcgccaacctcgcggtgtcccatggcctggccaaacgcctggcgggcaccggggttacggtcaacgcgatcctgccggggccgaccttcaccgacggtgtcgaggaaatgctcaaggatgccgccgccgagtctggccgcagcctgcgggacgaggctgacgcgtttgtccgccgggcccgcccgagctcgatcatccagcgcgtggcggatgtcgaagaggtcgcgcacctggtcacctacatcgcttcaccgctgtcttcagctaccactggcgccgcgttgcgggtcgacggtggcgtggtcgacagcctgact

SEQ ID NO: 37640 - DNA, 675 bp, Pseudomonas fluorescens
cgaggaagtgatcttttgtctgctcacgatgctgttttcaaccgcgcgttcggcgcgttcctgttcgacatggacggcaccgtcctcaattccatcgccgccgccgagcggatctggtccgcctgggccgtgcgccacggggtgaacgtcgaaacgttcctgccgaccatccatggcgtgcgcgccatcgacaccatcacgcgtttgaacctgccgggcgtggacgccgaggcgcaagcggcgttcatcaccgaggcggaaatcgaagacgtcgaaggcatcgtcgagatccccggcgcggcagcgtttctcaaatcgttgccggcggatcgctgggccatggtgacctcggcgccacgggatctggcgttgcggcggatgggcgcggcggggattcctgaaccggcggtgatgatcaccgctgaagatgtgaccgctggcaaaccggatccggccggttatcgtctggcggccagacgcctggggctggagccggcggattgcctgattttcgaagacgccactgtcggtattcaggccgctgaagccgcgggtgcgccgttgatgatcatcaccacgactcaccagcatccgctcgaaaccgcccacgcgaccatcgccagttaccgcgacattgcgctgagcatcgacagcgacggccagttgcgtctgcaa

SEQ ID NO: 37641 - DNA, 471 bp, Pseudomonas fluorescens
atggcctacacgttcatcaccctgccctcgcccgtcggcgagttgaagctggtcgcgaacggctcacgtctggccgccatcctctgggaaaacgacaaaccgaaccgagtgcgcctcgggccaatgagcgaggcaccggacaacccggtattgatgaaaaccgcgcgacagctggaagaatattttgcaggaacgcgaaacgcgttcgatctggagctggactttgccggcaccgagttccagaaaaaagtctgggccgcgctactgaccattccgtttggcgaaacccggacctacagccagatcgccgaacagatcggccacccgagcgcggtgcgtgccgttggcgcggcgaacgggcgcaatccgatttcgatcatcgcgccgtgccatcgagtcatcggcgcctcaggaaaactgaccgggtttgccggaggcctggaagcgaaggagcgcttgctgactctggag

SEQ ID NO: 37642 - DNA, 4399 bp, Pseudomonas fluorescens
ggctctgtaccgctggccttcgcggcgatctataacaacggcggcacgctcaacaccgcttacgtagagccgccgaccgcgaccatcgtgatggccgacacggccctgaaaatcggcgaaacctcgctggtgaccattaccttcagccgagcggtcaccggcttcaccaacgccgacctgacgattgccaacggcacgctgacagcggtcagcagcagcgatggcggcctgacctggacggcgaccttcacgccgaccaacaacattaccgacagcaccaacctgatcaccctcgacaacaccggggtgaccgccatcagcgacggcgtggcgggcgtcggcacgaccagctcggtcaattacgcgatcgataccgcacggccgaccgtgactatcgtgatgtccgacacggccttgaagatcggcgatacgtcgctggtgactttcactttcagtgaagcggtaaccggtttcaccaacgccgacctgaccatcgccaacggcacgctgagcgcagtgagcagcagcgacggcggcatcacctggaccggaacgtttaccccgacggccagcatcactgacaccaccaacctgatctctctggacaacaccggcatcgccgacctggcgggcaacgccggcagcggcaccaccgattcggccaattatgtgatcgataccgtgcgcccgacggcgaccattgtcgtcgccgacagcaatctggcggcgggcgaaacctcattggtgaccatcaccttcagcgaagccgtcagcggtttcaccaccgccgacctgaccgtggccaacggcaccctgagcgccctgagcagcagcgacggcggcatcacctggaccgtcacgctcacgccgaccagcaacattaccgacaccaccaacctgatcaccctggacaacaccggggtcgtcgatctggccggcaacgccggcagcggcaccaccaattccaacaattacgcgattgacaccgcgcgtccgaccgcgaccatcgtggtggctgacaatagcctgcggatcggcgaaacctcgctggtgaccatcaccttcagtgaggcgatcaccgggctcaccaacgccgacctgaccatcgccaacggcaccttgacggcggtcagcagcagtgacggcggcattacctggacggcgaccttcacgccgaccgccagcatcaccgacgcgaccaacctgatcacgctgaacaataccggcattgcagacctgaacggcaacgccggcagcggcaccaccgactccaacaactacgccatcgataccgtgcgcccgaccgcgaccatcgtggtggccgacaacaacctgcggatcggtgaaacctcgctggtgaccatcaccttcagcgaagcggtcagcggtttcaccaacgccgacctgacggtcgccaatggcacgttgagcgcgctcagcagcagcgatggcggcatcacctggaccgcgacgttcaccccgagcgccagcgtcaccgacaccaccaacctgatcacgctggacaataccggcatcgccgacctggcgggcaacgctggcagtggcaccaccgattccaacaactacgccatcgacacccagcgtccgaccgccaccatcgtggtcgccgacagcaacctcagcgccggtgaaacctcactggtgaccatcaccttcagcgaagcggtgaccggctttaccaacgccgacctgacggttgccaacggtacgctgaccgccgttagcagcagcgacggcggcattacctggacggccaccttcacgccgaacgtgggtgtcaacgatgcgaccaacctgatcacgctggccaataccggcatcgccgacctttcgggcaacaccggcagcggcacgaccaactccaacaactacagcatcgacaccgtgctgccgaccgcgaccatcgtcattgccgacaacgcgctgaaaatcggcgagacctcgctggtgacgattaccttcagcgaggcggtgaccggtttcaccaacgccgacctgacgattgccaacggcacgctcagcgcggtgagcagcagcgacggcggcatcacctggacggcgactttcacaccgaccaccagcatcaccgacgccaccaacctgatcacgctggacaactccggcgtgcagaacctttcaggtaatgccggcagcggcaccactgactcgaacaattacgcgattgatacggtccgtccgactgccaccatgcttggtcgccgacacggcccttggtatcggtcaaaccacgctggtgaccatcaccttcagcgaggcagtgagcggattcaccaacgccgacctgaccatcgccaacggcacgttgagcgcggtgagcagcagcgatggcggcatcacctggaccgcgacgttcaccccgagcgccagcatcgccgacaccaccaacctgattaccctggacaataccggcatcgccgacctggcgggcaacgccggcagcggtaccaccgattcgaacaattacgcgatcgatacggtacggccgaccgcgaccatcgtggtcgccgacagcaacctcagcgccggtgaaacctcactggtgaccatcaccttcagtgaagcggtgaccggctttaccaacgccgacttgacgattgccaacggcacattgagcgcagtgagcagcagcgacggcggcattacctggacggcgaccttcacgccgaccgtgggcatccatgacgccaccaatctgatcaccctggccaacaccggcatcgccgacctggcgggcaacgccggcagcggcacgaccaactccaacaactacagcatcgacactgtgctgccgaccgcgaccatcatcgtcgccgaccccagtctgaagatcggtgaaacctcgctggtgacgattaccttcagtgaagcggtgaccggtttcaccaacgccgacctgacgattgccaacggcacgctcagtgcggtgagcagcagcgacggcggtgtcacctggacggcgaccttcacgccgaccaccagcatcgccgacgcgacaaacctgatcacgctggacaacactggcgtgcagaacctgtcgggcaatgccggcagcggcactaccgattcgaacaattactcgatcgataccgtgcgtccgaccgccaccattgtggtcgccgacaccgccctgggcgtcggccagactacgctggtgaccatcaccttcagcgaagcggtgaccggtttcaccaacgctgacctgaccatcgccaacggtacgttgagcgctgtcagcagcagcgacggcggcatcacctggacggcaactttcaccccggcagcgggcatcaccgacacgaccaacctgatcacgctggacaacaccggcatcgccgacttggcgggcaacgctggcagcggcaccaccgactccaacaactacgcggtcgacagtcagcgtccaacggcgaccatcgtgctctccgacaacaccctcagtgctggcgaaacctcgctggtgaccatcaccttcagcgaggcggtgaccggtttcgacaattccgacctgagcgtcgccaacggcaccctgagcaacgtttcgtcgagcgacggcggcatcacctggacggccaccttcacgccgaacatcggcgtcatcgacctcaccaacctgatcgtcctgaacaacaccggcatcaccgacctggccggcaacaccggtaccggcaccaccaactcgccgaactacagcatcgacactgtgctgccgaccgcgaccatcgtcattgccgacaacgcgctgaaaatcggcgaaacctcgctggtgaccatcaccttcagtgaggccgtgaccggtttcaccaacgccgacctgaccatcgccaacggcacactcagcgcggtcagcagcagtgatggcggcattacctggacggccacgttcacgccgaccaccaacatcaccgacgccaccaacctgatcacgctggacaacactggcgtgcagaacctgtcgggcaatgccggcagcggcaccaccgattcgaacaactattcaatcgacacggtgcgtccgaccgccaccatcgtggtcgccgacacggcgctcggcgtcggtcagaccagcctggtgaccatcaccttcagcgaagccgtgaccggtttcaccaacgccgacctgatcatcgccaacggtacgctgagcgcggtcagcagcagcgacggcggcatcacctggacggccactttcaccccggcggcaggcatcaccgataccaccaacctgatcaccctggataacaccggcatcaccgacctggcaggcaacgccggcagcggcaccaccgattccaacaactatgcggtcgacagtcagcgtccgacggcgaccatcgtcatgagcgacattgacctgcgt

SEQ ID NO: 37643 - DNA, 561 bp, Pseudomonas fluorescens
gacgtattggcgccgaccgccagcatcagccgtgcccaacgcgaggcccgcaacggccatcgcggcacggcaatgctgctgaccggcttgccggcggcgggcaaatcgacccttgcccaggcgttgcatgccgagttgttcagtcgtggtctgcaaagtgtggtgctcgatggcgatggcctgcgcgtcgggctcaaccgtgacctgggttttaccgatgccgaccgcctggaaaacatccgccgcgccagtgagctggcggcgttgctggtggagaacgggcagatcgtgattctggcgatgatcgcgccgttggcggaactgcgcgaagtgtttgcccgccgtttgggcgaggactatcgcgaggtctggtgcagcgccgcgctggcagtgtgcgagcagcgcgatccgaaagggcattacgcccgggcccggcgtggcgagctggccgggtttaccggcgtgtcagcaccttacgaggcaccggcccaggcttcgctggtgctcgacaccggcacgctgacggtcgaagcctgtctcgaccggttgctgacctggctc

SEQ ID NO: 37644 - DNA, 1434 bp, Pseudomonas fluorescens
cagcttaaagacacccagttgttccgccagcaagccttcatcgatggcgcatgggtcgacgcggacaacggtcagacgatcaaggtcaacaacccggccactggcgagattctgggcaccgtgccgaagatgggcgctgccgaaacccgccgcgccatcgaagccgccgacaaggcgcttccggcctggcgtgcactgaccgccaaggagcgtgcaggcaaactgcgtcgctggttcgaactgatgatcgagaaccaggacgacctcgctcgcctgatgaccctcgagcaaggcaaaccactggccgaagccaagggcgaaatcgtttacgccgcttcgttcatcgagtggttcgccgaagaagccaagcgcatctacggtgacgtgattccgggccaccagccggacaagcgcctgatcgtgatcaagcaaccgatcggcgttaccgctgccatcaccccgtggaacttcccggcggcgatgatcactcgtaaagcgggcccggccctggccgccggttgcaccatggtgctcaagcctgcttcgcaaaccccgttctctgcatttgccctggccgaactggcccagcgcgccggcatccccaaaggtgtgttcagcgtggtgtccggcagcgccggcgacatcggcagcgagctgaccagcaacccgatcgtgcgcaaactgtccttcaccggttcgaccgaaatcggtcgtcagctgatgtcggaatgcgccaaggacatcaagaaagtctccctggaactgggcggcaacgcgccattcatcgtgttcgacgacgcggacctggataaggccgtcgaaggcgcgatcatttccaagtaccgcaacaacggccagacctgcgtctgcgccaaccgtctgtacattcaggattcggtttacgacgcgttcgccgagaagctgaaagtggcagtcgccaagctgaagatcggcaacggtctggaagaaggcaccaccacgggtccgctgatcgacgagaaagccgtggccaaggtgcaagagcatatcgctgacgcggtgagcaaaggcgcgaccgttctggccggcggcaagccgatggaaggcaacttcttcgagccgaccatcctgaccaacgtgccgaaagacgctgccgtggccaaggaagaaaccttcggtccgctggcgccgctgttccgcttcaaagacgaagccgacgtgatcgcgatgtcgaacgacaccgagttcggtctggcctcgtacttctacgctcgcgacctgggccgtgtgttccgtgtggcggaagccctggagtacggcatggtcggcgtcaacaccgggctgatctccaacgaagtcgcgccgttcggcggcatcaaggcctcgggcctgggccgtgaaggctccaagtacggcatcgaagattacctggaaatcaaatacctctgcctgggc

SEQ ID NO: 37645 - DNA, 1263 bp, Pseudomonas fluorescens
actaacgctgaactgatggcccgccgtaccgctgctgttccacggggtgttggccagattcacccgatcttcgccgagtccgcgaagaacgcgaccgtaaccgacgttgaagggcgtgaattcatcgacttcgccggcggtatcgctgtactgaataccggccacgtgcacccgaaaatcatcgccgccgtgaccgagcagctgaacaagctgactcacacctgcttccaggttctggcttatgagccgtacgttgagctgtgcgagaaaatcaacgctcgcgtaccgggcgacttcgccaagaaaaccctgctggtgaccaccggttccgaagctgttgaaaacgccgtgaagatcgctcgtgctgccactggccgcgctggcgtgatcgccttcaccggcgcttaccacggtcgcaccatgatgaccctgggcctgaccggtaaagtcgtgccttactcggccggcatgggcctgatgccaggcggcatcttccgcgcgttgtacccgaacgaactgcacggcgtgagcatcgacgactcgatcgcttccatcgaacgcatcttcaagaacgacgccgagccgaaagacatcgccgcgatcattatcgagcctgtgcagggtgaaggtggtttctacgtcgcaccgaaagaattcatgaagcgcctgcgcgccctgtgcgaccagcacggcatcctgctgatcgctgacgaagtgcagaccggcgctggccgtaccggcaccttcttcgccatggaacagatgggcgttgctgccgacctgaccactttcgccaaatccatcgctggcggcttcccgctggccggtgtgtgcggcaaggccgaatacatggacgccatcgcgccaggcggcctgggcggcacctacgccggtagcccgatcgcttgcgctgcggccctggccgtgatggaagtgttcgaagaagaaaaactgttggaccgctgcaaggctgttggtgagcgtctggtcaccggcctgaaagccatccaggccaagcacccggtgatcggtgaagtccgtgccttgggcgcgatgattgccgtcgagctgttcgaaaacggcgacagccacaagccaaacccgaccgccgtcgcggctgtcgtggccaaggcgcgtgacaagggcctgatcctgctgtcctgcggcacctacggcaacgttctgcgcgtcctggtaccgctgacctcgccggacgagcaactggacaaaggtctggcgatcatcgaagagtgcttctcggag

SEQ ID NO: 37646 - DNA, 1599 bp, Pseudomonas fluorescens
atgccgcaacgtcccaactttctggtgattctggccgatgacctcggcttctccgacatcggcgcgttcggcggcgaaatcgccacgccgaacctcgatgccctggccaacaatggcctgcgcctgaccgattttcacaccgcaccgacctgctcgccgacccgctcgatgctgctcaccggcaccgatcaccacatcgccggcatcggcaccatggccgaaaccctgaccccggagctgatcggcaaaccgggttacgaaggctatctcaacgaccgcgtcgtcgcgctgccggagttgctgcgcgaggccggttaccagaccttgatgagcggcaaatggcacctgggcctgaccgccgaactggcgccccacgcccgaggtttcgagcgttcgttctcgctgctgcccggcgcggccaaccactacggattcgaaccgacctacgacgaacacacgcccggcctgctgaaatccactccggcgctgtacatcgaggacgacacgttcatcgacgaattgccgaaggatttctattcctccgacgctttcggcgacaagctgctgcagtacctcaaggagcgcgatcagagccggccgttcttcgcctatctgccgttttccgcgccgcactggccgctgcaggcgcccgccgacatcgtcgaaaaatatcgcggccgctacgacgcggggccggaagtgctgcgcctcgagcgtctggaaaaactcaaatcgctggggctgatcgagccggatgtcgaaccgcatccgctgatcaagctgaccgcgcaatggggcgcgctgagcgatgaacaaaaacgcatttccgcccgggcaatggaagtctatgcagcgatggtcgagcgcatggactggaacatcgggcgcgtcgtcgattacctgcgccagcagggccagctcgacaacaccttcatcctgttcatgtccgacaacggtgccgaaggcgcgctgctggaagccttccccaaattcggtccggatctggtgacctacctgagccagcactacgacaacagcctcgacaacatcggccgcgccaattcctacgtctggtacgggccgaactgggcgcaggtggcgaccgcgccgtcacgcctgttcaaggcgttcaccaccgagggcgggattcgcgttccggcgctgctgcactatccgcaactgccgctgaagggacagatcagccacggtttcggcacggtgatggacatcacgccgactatcctcgatctggccggcgtgcgccatcccggcaagcagtggcacggcaaaccggtggcgccgttgcgtggtaaatcgtggctgggtttcctgtccggcgagacggcgcaggtgcatgacgaacacaccgttaccggttgggaattgttcgggcgccgggcgattcggcagggtcagtggaaggcggtgtggatccccgggccagtggggccggcgacctggcagctttacgacctggggagtgatccgggggagattcatgacctggcgtcgagtcagccgcagaagcttgaagcgctgatcgagcattggcagcggtatgtggaggagaccggggtgatcttgagtgagtcgccgttt

SEQ ID NO: 37647 - DNA, 705 bp, Pseudomonas fluorescens
atgagcaactcgaaaaaaaccgtcgttatcactggcgcctctcaaggtctgggcgaaggcatggtcaaggccttccgtgaactgggctacaacatcgtcgccacctcgcgctcgatcaagccgtcgaacgacccgcagatcctgaccatcgccggcgacatcggcgacccggccaccgctcaacgggtgatcagcgaaggcgtggcacgcttcggccgcatcgacaccctggtcaacaacgccggcatcttcgtcgccaaaccgttcaccgcctacaccccggaagactacgcggcggtgctgtcggtcaacctcaacggcttcttctacatcacccaactggccatcgccgagatggaaaaacagggcaagggccacgtggtcaacatcaccaccagcctggtcgaccacgccatcgacggcgtgccctcggtcctcgcttcgctgaccaagggtggcctcaacgccgccaccaaatccctggccatcgaatacgccaaacgcggaatacgggtgaacgcggtatcgccgggcatcatcaaaacgccgatgcacggcgaggaaacccatgaggcactgggcgcgctgcatccggttggacacatgggcgaaatcgacgacattgcgcaggcggtggtgtacctcgataacgcgaactttgtgactggcgagattctgcatgtggatggcgggcagagcgcaggg

SEQ ID NO: 37648 - DNA, 1260 bp, Pseudomonas fluorescens
ctgctggcgcgccgcgacgccagtttcgcccgtacccagaagcactattacgtcgacccgccgcgcatcgagcgcggctggcgcaatcacctgatcgacatgcagggccgctcctacctcgacatgctcaacaacgtcgcggtgctcggtcacggtcatccgcgcatggcggcggtggcgagccggcagtggtcgctgctcaataccaactcgcggttcaactatgcggcagtcgccgagttttccgaacgcttgctgaagctggcgccggagggcatggatcgggtgttcctggtcaatagcggcagcgaggccaatgacctggcgatccgcctggcgtgggccgccagcggtggtcgcgacatgatcagcgtgctggaggcctatcacggctggacggtcggcgcggacgcggtctcgacctcgattgccgataacccgaaagccctgagcagtcgcccggactgggtgcacgcggtgacggctcccaacacctatcgcggcgaatttcgcggcccggattcggcgccggattacgtgcgcagcgtcgagcaacatctggcgaagctcgatgagcagaaacgccagctcgccgggtttatctgcgagccggtctacggcaatgcgggcgggatttcgctgccgccgggttacctgaaaaaagtctatgaaatggtgcgtgcccgtggcggcgtgtgcatcgccgatgaggtgcaggtcggttacgggcgcatgggccacttcttctggggcttcgaagagcaaggcgtggtgccggacatcatcaccatggctaaaggcatgggcaacggccagccgctgggcgcggtgatcacccgccgggaaatcgccgaagcgctggaagccgagggctatttcttctcgtccgccggcggcagtccggtgagctgccagatcggcatggcggtgctcgatgtcatggaagaagaaaagctctgggaaaacgcccaggtggtcggcgcccacttcaaggcccggctggaggcgctgatcgatcaatatccgttggtcggcgcggtgcacggttccgggttctatctgggggtcgagctgatccgcaatcgggcaacgctggagccggcgaccgaggaaaccacgctgttgtgtgaccgcctgcgagagctggggattttcatgcagccgaccggcgattacctgaacgtcctgaagatcaaaccgccgatggtcacctcgcggcagagcgtggatttctttgtcgacatggtggcgaaggtgctg

SEQ ID NO: 37649 - DNA, 1215 bp, Pseudomonas fluorescens
atgagccagacatccttcgctattcagcaggccgccgtgatcggcgccggcaccatgggccgcggcattgtcatgtgcctggccaatgccggcgtgtcagtgcagtgggtcgataacaatccacagatgctcgaacaggcgctgtccagcgtggccgagacttacgcacacaacgtgcggcagggacggatcgatcaggccgaagccgatgcgcggattgcccgtgtcagcaaggcggccgactatgtggcgatccgcaatgtcgatctggtgatcgaagcggtgtacgagaatcttgagctcaagcagaagatcttccgcgagctcgatggcgtgctgaagcccgaggcgctgctggcgagcaatacttcggcgctggacatcgacgccattgccgccgcgacacggcgcccgactcaagtgttgggcctgcatttcttcagcccggcacacatcatgaagttgctggaaatagtccgtggcgcgcagaccgcaccggctgtgctggaggctgcgcttgagctgggcaagcgcatgggcaaggtcagtgtggtatcgggcaactgccacggctttatcggcaatcgcatgctccatccgtacgtgctcgaagcgcgcaagatgttgctcgaaggggcgtacccgcatcaggtcgatgcagccttgcagagcttcggttttgccatggggccgttccgcatgtacgacgtggtcggcatcgatctcgagtggcgtgcccgcgagctggcaggcaaggggcaggacgcgccggaggttcaggtggataaccgtttgtgcgagcagggtcggttcggtcagaagtccggcaacggttattaccattacgagccgggcagccgtcaggccgagcatgatcccgaggtcgatgcgctggtgttgagtgtcagcgaagggttgggatttcatcggcgggatatcggctcggaggagatcctcgagcggtgtctgctggcgttggtcaacgagggtgcgaagatcctgcaggaagggattgccgagtcggcgcatgacatcgatcaggtctatctgaatggctatggcttcccggcggagcggggcgggccgatggcctgggcggacgatcaggggctggccgatattcacaagcgattgctggcgctggagactcggcagggcgatcactggcggccggcgccattgatcggcgagctggcggcgcgaggcaagggtttt

SEQ ID NO: 37650 - DNA, 1539 bp, Pseudomonas fluorescens
atgacgcaagccaataacgccgtgtacaccgatctgagtgttgatgatctggtaaaagaagctctgaaccgcggtgagggcgagcttgccgataccggcgctctggttgttcgcaccggtcatcgcaccggccgttcgccagtcgaccgtttcatcgttgaagagccttccacccaggctgccatcgcctggggcccgatcaaccgcaagttcccggccgacaagttcgacgcgctgtgggctcgtgttgaagcattcaacaacgcgcaagagcatttcgtttcccacgtgcatgtaggcgcggccgaagatcactacctggccgtgaagatgaccacccagactgcctggcagaacctgttcggtcgttgcctgttcatcaacccggcccagtacaacccggccggtcgcgaagagtggcaagtgctgaacgtcgccaacttcgagtgcgtgcctgagcgtgacggcaccaactccgatggttgcgtgatcatcaacttcgcccagaagaaagtgctgatcgccggcatgcgttacgccggtgaaatgaagaaagccatgttctccgtgcagaacttcctgctgccggccgctgacgtgctgccgatgcactgcgctgccaacatcggcgaagaaggcgacgtgaccctgttcttcggtctgtcgggcaccggcaagaccaccctgtccgccgacgaaagccgttacctgatcggtgacgacgaacacggctggggcgaaggcgttgtcttcaacatcgaaggcggctgctacgccaagtgcatcgacttgtccgagaagaacgagccggtcatctggaaagccatcaagcacggcgcggtgctggaaaacgtcgtgatcgacgatgccaagcacgccgactacgccgatgtcagcctgacccagaacagccgcgcggcctacccgctggagcacgttgccaagcgttccgagaagaacctgggcggcgagccgaacgctgtgatcttcctgacctgcgacctgaccggcgtgctgccgccagtgtcgatcctcaacgaagaacaagcggcctaccacttcctgtccggctacaccgcactggtgggctcgactgaaatgggttcgggcagcggcatcaagtcgaccttctccacctgcttcggcgcaccgttcttcccgcgtccggccggcgaatacgctgaactgctgatcaagcgcatccgcggcttcggctccaaggtctacctggtcaacaccggctggaccggcggtggctacggcgtcggcaaacgcttcaacatcccgaccacccgcgcggtgatcgcagcgatccagagcggcgcgctgatcggtgcagccaccgagcacctggacaccatcaacctggacgtgccactggccgtaccgggcgtcgaaaccaacctgctcaacccacgcaacacctgggctgacaaggctgcgtacgacgaagctgccaaagcactggccggtctgttcatcgagaacttcaagaagttcgaagtgagcgacgcgatcaaggctgccgggcctaagttg

SEQ ID NO: 37651 - DNA, 1026 bp, Pseudomonas fluorescens
atgacttacaccgctgccgaaaaccgctatgactccatcccttaccgccgcgtcggacgcagcggtctggtgctgccggcgctgtctctgggcctgtggcacaacttcggcgacagcacgccgatcgacacccagcgctcgttgctgcgcacggcgttcgacctgggcatcaaccacttcgacctggccaacaactatggcccgccctacggcagcgccgagatcaacttcggccgtttgctgcgcgaagacttcaagcagtaccgcgatgaactgatcatctccagcaaggccggttgggacatgtggcccggcccttacggccagggtggcggttcgcgcaaatacgtgctggccagcctcgaccagagcctgcaacgcctgggcctggactatgtggatattttctattcgcaccgcttcgacccggacacgccactggaagaaaccgccagcgcccttgccacggcggtgcagcagggcaaggcgctgtacatcggcatctcgtcgtactccggagtgaaaacccgcgaaatcgccgcattgctcaaagagtggaaagtgccgctgctgatccaccaaccggcctacaacctgctcaaccgctgggtggaaaaggacctgctcgacaccaccgacgagctcggcactggcgtgattgccttcaccccgctggcgcagggtctgctgaccgacaaatacctcaacggcgtgccggcggatgcgcgggtcaaccgtccgggcggtggttctttgcaggcttcgcacttgtccgaggccaacatcgctcacgttcgggcgctgaacgagatcgccaagcgtcgtggccagagcctggcgcaactggcattggcgtggacactgcgggatccgcgggtgacttcggcgctgatcggcgcgagccggccggagcagattgtcgagaacgtcggggcgttgaagaatctgagcttcagtgctgaggaactggcggagattgaccggtttgcccaggagggcgggatcaatctttgggagaagccttcg

SEQ ID NO: 37652 - DNA, 1005 bp, Pseudomonas fluorescens
cgccagtacggaaccatgtccacacaaccgatcaaacaacagctgcaacgcttcaaccgcctcgacctgctcggccaaccgaccccactggaaaagctcgagcgtctgtccacctggctcggccgcgatgtctacatcaaacgcgatgacctgacgcctttggccatgggcggcaacaagctgcgcaagctcgaatacctcgccgccgatgccatcgcccaaggcgcggataccctgatcaccgccggtgcactgcaatcgaaccacgttcgccagactgccgcgctggccgccaaactgggcctgggttgcgtagcgctgctggaaaacccgctgggcaccgacgacagcaactacaccggcaacggcaaccgcctgctgctggacctgttcgacaccaaggtcgagctggtcgacaacctcgacaacgccgacgaacaactggccgccctcgccgtgcgcctgcgcagcaacggcaagaagccgtatctggtgccgatcggtggctccaacgccatcggtgcgctgggttatgtgcgcgccggtctggagctggcagaacagatcaaggacaccggcctgcaattctccgccgtcgttttggcctctggcagcgccggtactcacagcggtctggcgctggccctgagcgaagccctgccacaactgccggtgattggcgtgacggtgtcgcgcagcgaagaagatcagcgcccgaaagtccagggcctcgccgaacgcaccgccgacctgctgggtgtggcgctgccggacagcttcaaggtcgagttgtgggacgaatacttcggcccgcgctatggtgagccgaatgccgggacgctgtcggcggtgaagctgctggccagccaggacgccgtgttgctcgatccggtctacaccggcaaggccatggccggactgctcgacggcatcggtcgcgggcgtttcgacgacggcccgatcatcttcctgcacaccggcggcgccccggcgttgtttgcgtac

SEQ ID NO: 37653 - DNA, 1230 bp, Pseudomonas fluorescens
ctggcagacgcaaacgtccagagtgacctggacatcgccccgttgttgttgcctgcacaagtgctgcgcaacgacgctcaagccatcaaggccgcccatgagctggcgcaagtcgcccgcgtgcaggccgccaaacgtgatcgccagcgcaagctgccgtggtcggaaatcgaacagttcacccgcagcggcctcggcagcatcgcgattccgcgcgaatacggcggtccgcaggtttccttcgtgaccctggccgaggtgttcgcgatcatttcggcagccgacccggcattggggcagatcccgcagaaccagttcggcatcatcaacctgatcctcggcagcgccaccgaacagcagaaaaaacatttgctacagagtgtgctcgaaggctggcgcatcggtaatgccgggccggagcgtggcaccaagaacaccctggaattgaaagcgcgcatcaccgccgacggcgatgactacgtgatcaatggccagaagttctactccaccggcgccctgttcgcccactgggtcgcggtcaaggcgctgaacgatgacggtaaacaggttttggccttcgtccgtcggggcacgccgggcctgcgcatcgtcgatgactggtccggtttcggccagcgcaccaccgccagtggcacgatcctgttgaacaacgtgcgggtcgacgccggcctcgtggtggacaactggaagatcaacgaaaagcccaacacccagggcgcggtgtcgcagctgattcaagcggcgatcgacgccggcatcgcccgtggcgccatcgatgacgccattgagttcgtcaagactcgcgcccggccgtggatcgacgctaacgtcgaacgggccagcgatgacctctacgtcatcgccgacatcggcaaactgaaaatcgaactgcacgccgccgaagcgctgctgcgcaaggccgggcaggtactggatcaggtgcacgccgcaccgctgactgccgagtccgccgcccgcgcctcgattgccgtggccgaagccaaggtgctgaccaccgagatctcgctgctggccagcgaaaaactcttcgaactggccggcagccgcgcgaccctcgccgaattcaacctcgaccgtcactggcgcaacgcccgggtgcacaccctgcacgacccggtgcgctggaagtaccacgcggtcggcgcttatcgcctcaacggcaagttgccggctcgccattcctggatc

SEQ ID NO: 37654 - DNA, 1164 bp, Pseudomonas fluorescens
atcaccagcgacgagcaagccctgatcgtcgccagcgacctggccgaagatttccagcgcgacagcaacctgcgcgaccgcgaacgccggctgccgctgccggagctcgacgtgttttcccgttccggcctgtggggcatcagcgtgcccaaggagtacggtggcgccggcgtatccaacgtgaccctggccaaagtcatcgctttgatcgccagggccgatggctcgctcgggcagattccacagaaccatttttatgccctggaagtgctccgggtgaacggcagccacgagcagaaacaacgtctgtacgccgaagtcctcgccggccagcgttttggcaatgccctggcagaactgggcaccaggaccgcccacgaccgtgtcacccgcctcgaacgcgacggcagcggttatcgcatcaacggtcgcaagttctatgcgaccggcgccatttacgcccaacggattccaacgtccgtggtcgatgaaaacggcgtgcagcaactggcgttcgtcccgcgcgacagcaaaggtctgaccgtgatcgacgactggagcggcttcggccagcgcaccactggcagcggttcggtggtgttcgaaaacgtgtacgtcgccgccgaagacgtcattccgttccagagcgctttcgagcgcccgaccccggtcggcccgttggcgcagatccttcacgccgccatcgacaccggcatcgcccgcgccgcttacgaagacgcgttgcacttcgtgcgcagcaagacccgtccatggatcgattcgggcaacgacaaagccaccgaagacccgctgaccctcaagagcttcggccacttgagcattcgcctgcacgccaccgaagccctactcgaacgtgccggcgaattcctcgacgcggcccaggccgagactaacgccgagaccgttgcggcagcctcgattgccgtcgccgaagcacgggcaatcagcaccgaaatctccctggccgccggtagcaccctgttcgaactggccggcagccaggccaccctgatcgagcacggcctcgaccgccactggcgcaacgcccgggtacacaccctgcacgacccggtgcgctggaagtatcacgcggtgggcaattactacctcaacgatgaaaacccgccgctgcgagggaccatc

SEQ ID NO: 37655 - DNA, 877 bp, Pseudomonas fluorescens
aagtacaaaggaattctgctggcgggcggcgccggttcgcgtctgcacccgatcaccctgggcgtctcgaaacagtcgctgccggtgtatgacaaaccgatgatctattacccgctgtcggtgctgatgctggcggaaatccgcgagatcctgatcatctccaccccggaagatctgccgggtttccagcgcatgctcggcgacggcagtcagttgggcctgagcttgagttacgcggtgcaaccgagtccggacggcctcgctcaggcgttcatcatcggtcgtgaattcgtcggtgaagacaacgtctgcctagtgctcggtgacaacattttctacggcgccggcttcggtgaaaccctgctgcaagcggcggcgcgtgatgaaggcgcgacagtgttcggctattacgtggccgatcccgagcgctttggcgtggtggaattcgatgctgccggcaaggccttgagcatctgcgaaaaaccgagcgatccaaagtccaactacgccgtcaccggcctgtatttctacgacaacgaagtgctgcagattgccgccgacatcaagccgtcgccgcgcggcgagctggagatcaccgacgtcaacaacgtctacctgcaacgcggcaaattgaatgtgtcggtgatgggccgtggcatggcctggctcgacaccggcacccacgacgcgttgatggaagcgggcaatttcgtccaggccatcgagaaacgccagggcgctgaaaatcgcctgcctcgaagagatcgcctaccacaagggctggatcgacgacgcgcaattgctggtgcatgcgggcagcatgagcaagaccggttacggtcagtacctggcgcgtttgatccacgatgatgtggtg

SEQ ID NO: 37656 - DNA, 672 bp, Pseudomonas fluorescens
tccgggttgcacgtgatctcagacttgcacgcgctgggtctgcaaatcgaaaacaaggccagcctgatcgattgcatcagggcctcgcaaaacaccgacggcggatttgccgagcaaccggggcatctcagcgatgtgttcgccacctactgcgcggtgctgtcgctgcgagtgctgggcgcattgccgaacgatatcggcggttgcgtgcgttacctgcaagcgtgtcagaacccggacggcgggttcggcgatgtgccgggtttcggctcggacatctggcacaccaacctggcggtgctgtcgctgcatgcgcttgaagccaaggcgccggacgagcagggcgtgatggcgtttgccttgcgctgccgctcggccgacggcggtttcgccaacaagccgggttatccgccggacgcgttttcggtgtaccgcgtggtgtcgacgctgttcattctcaaccgacgcatcgttgatgccgaacagaccgtcgcttggcttcagagcctgcaactggccaacggctcgttccactaccggccgggtaaagcggtcagcctggtgggtacttacatggctatcgcagcaatgtatctgctcgacgcgcagccgacgtatctgcaggaatcgaaagactggatcgctgcccatcagaagcaggacggtggattc

SEQ ID NO: 37657 - DNA, 1572 bp, Pseudomonas fluorescens
aacagtccgacaaccaattcgtgacacacgcctcatctcaaggcgaacctttcgccttggctcctacgataaaaacaagttctggagaccagcatgaacgcatcgcttacgcccaacgaaaccacgatccagaaggtcaagctgctgatcgacggcgagtgggtcgagtcgcagaccaccgagtggcacgacatcgtcaacccggcgacccagcaggttctggccaaggttccgttcgccaccgccgctgaagtcgacgctgccgtcagcgccgcccagcgcgccttccagacctggaaactgaccccgatcggcgcgcgcatgcgcatcatgctcaagctgcaagcgctgatccgcgagcattccaaacgcatcgccgtggtgctgagcgccgagcagggcaagaccattgccgatgccgagggcgatattttccgtggcctggaagtggtcgagcacgcctgctccatcggcagcctgcaaatgggcgagttcgccgagaacgtcgccggcggcgtcgacacctacaccctgcgccaaccgatcggtgtctgcgccggcattacccccttcaacttcccggcaatgattccgctgtggatgttcccgatggccatcgcctgcggcaacaccttcgtcctcaagccatcggagcaggatccgctgtcgaccatgttgctggtggagctggcgattgaagcgggcattccggccggtgtgcttaacgtcgtccatggtggcaaggacgtggttgacggcttgtgcacccacaaggacatcaaggccgtttcgttcgtcggttcgactgccgtcggcacccacgtttatgacctggccggtaaacacggcaaacgcgtgcaatcgatgatgggcgcgaagaaccatgcggtggtgctgccggatgccaatcgcgagcaagcgctcaacgccttggtcggcgccggtttcggtgcggccggtcagcgttgcatggccacctcggtggtggtgctggtgggtgcggccaagcagtggctgccggatctgaaagcgctggcgcagaaactcaaggtcaacgccggcaatgagccgggcaccgatgtcggcccggtcatttcgaaaaaggccaaggcgcggattctcgatctgatcgaaagcggcatcaaggaaggcgcaaaacttgagctggacggtcgcgacatcagcgtgccgggttacgagaaaggcaacttcgtcggcccgaccctgttttccggggtgactaccgacatgcagatctacacccaggaaatcttcggcccagtgctggtggtgctggaggtcgataccctcgatcaggccatcgcgctggtcaacgccaacccgttcggcaacggcacgggcctgttcacccagagtggtgccgcggcgcgtaaattccagactgaaatcgacgtcggccaggtcggcatcaacatcccgattccggtgccggtgccgttcttcagcttcaccggttcgcgcggttcgaaactcggcgacctcggcccgtacggcaagcaagtggtgcagttctacacccagaccaaaacggtcacggcgcgctggttcgat

SEQ ID NO: 37658 - DNA, 1116 bp, Pseudomonas fluorescens
ttcgccaaggtctactacgcggtcaaggccaacccggccgtcgagatcatcgacctgctcaaagagaagggttcgagcttcgacatcgcctcgatctatgagctggacaaagtgctgagccgtggcgtcagcgcggatcagatcagctacggcaacaccatcaagaaatccaaggacattcgctacttctatgagaagggcgtgcgtctgttcgccaccgactcggaagccgacctgcgcaacatcgccaaggccgcaccgggcgccaaagtctatgtgcgcatcctgaccgaaggctcgaccacggccgactggccactgtcgcgcaaattcggctgccagaccgacatggccatggacctgctgatcctcgcccgtgacctgggcctggtgccgtacggcatctcgttccacgtcggttcgcaacagcgtgacatcagcgtctgggacgcggcgatcgccaaggtcaaagtgattttcgagcgcctgaaagaagaagacggcatccacctgaagctgatcaacatgggcggaggcttcccggccaactacatcacccgcaccaacagcctggaaacctacgctgaagaaatcatccgcttcctcaaggaagacttcggtgatgacctgccggaaatcattctggagccaggccgttcgctgatcgccaacgccggtatcctggtcagtgaagtggtgctggtcgcccgtaaatcccgcaccgccgtcgagcgttgggtttataccgatgtgggcaagttctcgggcctgatcgaaaccatggacgaagcgatcaagttcccgatctggaccgagaagaaaggcgagatggaagaagtcgtgatcgctggcccgacctgcgacagcgccgacatcatgtacgaaaactacaagtacggcctgccgctgaacctggcgatcggtgatcgcctgtactggctgtcgaccggtgcgtacaccaccagctacagcgccgtcgagttcaatggctttccgccgctgaagtcgttctacgtgtaagcgatgctggcgtaatgcaaaaagcccatgacgtgtcatgggcttttttgtggctgcgattcaggtgttctgtaactcggcgcaacgacgagcgta

SEQ ID NO: 37659 - DNA, 909 bp, Pseudomonas fluorescens
ggaggcgaagacgatgaaatgcagttgacggttatattttaagttgtacgatgacctacaacttcggcgaaggctgaacggtccactcacaaaaaacgttgctaccagggtgttcgaataatgaatccacaagaactgaagtccatcctctccgccggcctgctgtcgttcccggtgaccgatttcaatgcccagggcgatttcaaccgcgctggctacatcaaacgcctggaatggctggccccgtacggtgcttcagccctgttcgccgccggtggcaccggtgaattcttctccctggctgccagcgaatactcggaaatcatcaagactgccgtcgacacttgcgccagcagcgtgccgatcctcgccggtgtcggcggttcgacccgtcaggccatcgaatacgctcaggaagccgagcgtctgggcgccaaaggcctgttgttgctgccgcactatctgaccgaagccagccaggacggcgttgccgcccacgttgaagcggtgtgcaaatcggtcaacatcggcgtggtggtctacaaccgcaacgtctgccgcctgactgcgccgctgctggagcgtctggccgagcgctgcccgaacctgatcggttacaaggacggtctgggcgatatcgaactgatggtgtcgatccgtcgtcgcctcggcgatcgcttcagctacctcggtggtctgccgaccgccgaagtctacgccgctgcctacaaggccctgggcgtgccggtctactcgtcggcggtgttcaacttcatcccgaaaaccgcgatggacttctaccacgccattgcccgcgaagatcacgccaccgtcggcaagatcatcgacgacttcttcctgccgtacctcgacatccgcaaccgcaaggccggttacgccgtgagcatc

SEQ ID NO: 37660 - DNA, 1419 bp, Pseudomonas fluorescens
agtacgaaatgctcgctgcgctgatcgacaagcaaggtgcgcagtaacacacctctataaacaaggccgctgagcaatcagcggctttttgcgtcaggagaatgattcgtgaccaagcgctatgacaactacatcaacggtgaatgggtcgccggcaacgattactcggcgaacatcaacccgtccgaactgagcgataccatcggcgattacgccaaggctgacctggctcaagtcaatgccgccatcgacgccgctcgcgccgcgttcccggcgtggtcgacttcgggcattcaggcccgtcacgactcgctggacaaagtcggcactgaaatcctcgcccgccgcgaagaactcggcaccctgctggcccgggaagagggcaagaccctgcccgaagccatcggcgaagtgacccgcgccggcaacatcttcaagttcttcgccggtgaatgcctgcgtctgtccggcgactacgtgccgtcggtgcgtccgggcgtcaacgttgaagtcacccgcgaagccctcggcgtggtcggtctgatcaccccgtggaatttcccgattgccatcccgtcgtggaaaatcgccccggccctggcctacggcaactgcgtggtgttgaagccggcggatctggtgccgggctgtgcctgggcgctggccgaaatcatctcccgcgcaggcttcccggccggcgtgttcaacctggtgatgggcagcggtcgcgtggtcggtgaagcactggtcaacagcccgaaagtcgacggcatcagcttcaccggctccgtcggtgtgggccgtcagatcgcggtcaattgcgtgtcgcgtcaggccaaggttcagctggagatgggcggcaagaacccgcagatcattctcgacgacgccgacctcaagcaggcggtcgagctgtcggtgcagagcgcgttctactccaccggccagcgttgcacggcatcgagccgtctgatcgtcaccgccggcattcacgacaagttcgtcgaagccatggccgagcgcatgaagtcgatcaaggtcggtcacgcgctgaaggccggcaccgacatcggtccggtggtctcgcaagcgcagcttgagcaggacatgaagtacatcgacatcggtcagtccgaaggtgcgcgtctggtcagcggcggtggtttggtgacgtgtgacaccgagggctacttcctcgcgccgaccctgtttgccgacagcgaagcctcgatgcgcatcagccgcgaagagatcttcggcccggtggccaacatcgtccgcgtggccgattacgaggctgcactggccatggccaacgacaccgaattcggtctgtcggcgggcatcgccaccacgtcgctgaagtacgccaaccacttcaagcgtcattcccaggccgggatggtgatggtcaacctg

SEQ ID NO: 37661 - DNA, 1293 bp, Pseudomonas fluorescens
  unsure (1)..(1293): unsure at all n locations
gctgcacccgcgccgggccttcgccctgaggcccagcgcccggcaccaagaccccaaagaaaatgttttaacccgccaataaaaataantcagtgggagtacatctacatgcaatcgtccaagccgactcacgtccgctatttgatcctgctcatgctgttcctggtgaccacgatcaactacgccgaccgtgccaccatcgcgatcgccggttccagtttgcaaaaagacctcggcatcgacgcggtcaccctcggctacatcttctctgctttcggttgggcctacgtggccgggcaaattcccggcggctggctgctcgatcgcttcggctcgaaaaaagtctatgccctgagcatcttcacctggtcgctgttcaccgtgctgcaaggcttcgtcggtgagttcggcatgtccacggccatcgtcgcgctgttcatgctgcgctttctggtcggtctggccgaggcgccatcgttccccggtaacgcacgcatcgtcgcggcctggttcccgaccgctgagcgcggcaccgcttcggcgatcttcaactcggcgcaatacttcgccaccgtgctgttcgcaccgctgatgggctggatcgtgttctcctttggctgggagcacgtgttcatcgtcatgggcctgctcggcatcgtgttctcgctggtctggctcaaggttatccacagcccgcgccaacacccgatggccaacgaagcggaagtgaagttcatcgccgacaacggcggcatggtcgacatggaccagaaacaaggcaaaaaggctgacggcccgaaatgggattacatccggcagttgctgaccaatcgcatgatgctcggcgtttacctgggccagtactgcatcaacggcatcacctatttcttcctgacctggttcccggtgtacctggtgcaggagcgcggcatgaccatcctcaaggccggtttcattgcctcgttgccggcgatctgcggctttatcggtggcgtgctcggcggggtgatttccgattacctgctgcgcaagggccattcgctgaccttcgcccgcaaggcgccgatcattgccggtctgctggtttcgagcagcatcgtggcctgcaactatgtcgacgttgaatggatggtggtcggctttatggccctggcattcttcggcaaaggcgtgggtgcactgggctgggcggtggtctccgacacctcgccgaaacagattgctggtctgagtggcggcctgttcaacaccttcggcaacatcgcgtcgatcaccaccccgatcgttatcggc

SEQ ID NO: 37662 - DNA, 1374 bp, Pseudomonas fluorescens
tggagcgcctctcgctgtgcaagtgccggctcaaacgctggcaaagctacacctggcaattggcgacctgcgagttgcttccctcgattcctctcatagaactggtgcaaggattttcagatgaccaagacacgtattgagcgcgacagcatgggcgaactgcaggtgccggtggacgctctctacggcgcgcagacccagcgtgcagtggataacttcccgatcagcggcaagccgatgccaacccagttcatccgcgccctgattctggcgaaagcggccgccgcccgcgccaacgtcgaactcaaccagatcagcgccgcgcaaggcaaagccatcagcgatgccgcccaagggctgctggaaggcgacttcatgcagcattttccggtggacattttccagaccggttccggcaccagctccaacatgaacgccaacgaggtgatcgccacactggccagtcgtctgctcgaggagccattaaacgccaatgatcatgtgaactgcgggcaaagcagcaacgacattattccaaccactattcacgtcagcgccgcgctggccctgcacgaacaactgctgccggcgctgctgcacctggtgcaagtgatcgaacgcaaggccgagcaagtccatcaccacgtcaagactggccgcacccacctgatggacgccatgccggtgcgcatgagccaggtgctcaacggttgggcgcagcagctcaaagccaatatcggtcacctgcaggacttgctcccaagcctgcaatccctggcccagggcggcacggcagtcggtaccgggatcaatgcgcatccggaatttgctgcgcgtttcagccgccaattgagccagttgaccaacgtccagttcacgccaggcaaggatctgttcgccctgatcggctcgcaagacaccgctgtggccgtatcgggtcagctcaaggccaccgccgtttcactgatgaaaattgccaacgacctgcgctggatgaactccggcccgctcgccggcctcggtgagatcgaactcgaaggcctgcaaccgggctcgtcgatcatgccgggcaaggtcaatccggtgattccggaagccactgccatggtggccgcgcaagtgataggcaacgactctgtaatcaccatcgccgggcagtcaggcaatttcgagctgaacgtgatgctgccgatcatcgcccagaacctgttgagcagcatcgagttgctggccaactccagccgtctgctggctgacaaggccatcgccagcttcagggtcaacgagtcgcgcctcaaggaagcgctgtcgcgcaacccgattctggtcaccgcactcaacccgatcatcggttaccagaaagccgccgaaatc

SEQ ID NO: 37663 - DNA, 1263 bp, Pseudomonas fluorescens
gcatctatgcccatttgaacccttggatcgccgatggcagcatccacgcggtcactatgaaatttttcagcagcgcggcctgggccgagcgcacctgagccctagggcgtcgagattcttatggataaattgattattaccggtggcgctcgtcttgatggcgagatccgcatctccggggcgaagaactccgccctgccgatcctggccgccaccctgctgtgcgatggcccggttaccgtcggcaacctgccgcacctgcatgacatcaccaccatgatcgagctgttcggtcgcatgggcatcgagcctgtgatcgacgagaagctcagcgtcgaaatcgacccgcgcaccatcaagaccctgatcgccccgtacgaactggtgaaaaccatgcgtgcgtcgatcctggtgctgggcccgatggttgcgcgtttcggtgaagccgaagtcgcactgcctggcggttgcgccatcggttcgcgtccggtcgaccttcacatccgtggcctggaagccatgggcgcagtcatcgatgtcgaaggcggctacatcaaggccaaggcgcctgaaggcggcctgcgcggcgcgcacttcttcttcgataccgtcagtgtgaccggtaccgagaacatcatgatggctgccgctctggccaagggccgcagcgtgttgcagaacgccgctcgcgaacctgaagtggtcgacctggcgaacttcctcaacgccatgggtgccaaggtttccggtgccggaaccgacaccatcaccatcgacggcgtcgagcgtctgggctcggccttctataaggtcatgcctgaccgtatcgaaaccggcacctacctggtggccgctgcggttaccggtggccgcgtgaaggtcaaggacaccgatccgaccatcctcgaagccgttctggaaaaactccgtgaagccggtgcagaaatcacctgtggtgaagactggatcgagctgaacatgcacggcaagcgcccgaaagcggtcaacgtgcgcactgcgccgtatccggcgttcccgaccgacatgcaggcgcagttcatctcgctcaacgccattgccgaaggcaccggtgccgtgatcgagacgatcttcgaaaaccgcttcatgcacgtgtacgaactgcaccgcatgggcgcgcacatccaggtcgaaggcaacaccgccattgtgaccggtatcgaaacactcaagggcgcgccagtgatggcaaccgacctgcgtgcttcggcgagcctggtgatt

SEQ ID NO: 37664 - DNA, 1290 bp, Pseudomonas fluorescens
cgcccgtctatccgcctcatagccagaatctcaggtgcccaagcggaaacgactgctaagttagggcgcctgagtttttgccattcctatgaggctctcgctatgaccgcaccgactgcaattcgccgactcaacgctgctgacccggatttcgcgcatcatctggatcatctgctgagctgggaaagtgtgtctgacgactcggtcaatcagcgggtgctggacatcatcaaggctgtgcgcgagcgcggtgacgcggcgctggtcgagttcacccagaaattcgacggcctcgaagtcgcctccatggcagacctgatcctgccgcgcgagcgtctggaactggccctgacccgtatcaccgtggctcaacgcgaagcgctggaaaaagccgccgcccgtgtgcgcagctatcacgaaaaacagaagcaggactcctggagctacaccgaagccgacggcaccgtgctgggccagaaggtcacgccgctggatcgcgccggtctgtatgtgccgggcggcaaggcgtcgtacccgtcgtcggtgttgatgaatgcgattccggccaaggtcgctggcgtgactgaagtggtcatggtggtgccaaccccgcgtggcgaggtcaacgaactggtgctggcggcggcgtgcattgccggcgtcgaccgggtgttcaccatcggtggcgcacaagccgttgctgcgttggcctatggcaccgaaagcgtgccgcaggtggacaaggtcgtcggcccgggcaacatctatgtcgccactgccaagcgtcacgtgttcggtcaggtcggcatcgacatgattgccggcccgtctgaaatcctcgtggtgtgcgacggccagaccgatccggactggatcgccatggacctgttctcccaggccgaacacgacgaagacgcccaggcgattctggtcagcccggacgccgagttcctcgacaaggtcgccgcgagcatcgacaagctgctgccgaccatggatcgcgcaaccatcatcgaaacctcgatcaacggccgtggtgccctgattcacgtgcgcgacatggcccaggccatcgaagtcgccaaccgcattgccccggaacaccttgagctgtcggtcgccgaccctcaggcctggctgccgcagatccgccacgccggcgcgattttcatgggccgccacacctccgaggcgctgggcgactactgcgcgggtccgaaccacgtgctgccgacctccggcactgcgcgtttctcttcgccgctgggcgtgtacgacttccagaaacgc

SEQ ID NO: 37665 - DNA, 1050 bp, Pseudomonas fluorescens
cgaggccggcgcttcggagcttggcaagactgcatcgattctggcccgtggcgaatcgctgagcgcccacgcgcgtagcgccgaataccgcatcaaagacgacgtgaaggggaactgaacatgagcaaattctggagcccgttcgtcaaggatctggtgccttacgtgccgggcgagcagccgaagttgacccgtctggtcaaactcaataccaacgaaaacccgtacggcccgtcgccaaaagccttggcggcgatgcaggccgaactcaacgacaacctgcgtctgtatccggatccgaacagcgatctgttgaaaaatgccgtcgccaagtactacggcgtacagaacaatcaggtgttcctcggcaacggctcggatgaagtgctggcgcacatcttccacggtctgctgcaacacgatcagccgatcctgttcccggacatcagctacagcttctatccggtctactgcggcctttacggcatcacgttcgacgcggtgccgctggatgcccagttccggatcaacccggctgactacgccaagccgaacggcgggatcattttccccaacccgaacgcaccgaccggttgcctgctggcgctggaagcggtcgagcagattctcaagggcagcccggattcggtggtggtggtcgacgaggcctacatcgacttcggcggcgaaaccgcgatcagcctggtggaccgttatccgaacctgctggtgactcagaccctgtccaagtcccgttcgctggcgggcctgcgggtcggtctggcggtcggccatccggacctgatcgaggcgctggagcggatcaagaacagcttcaactcctacccgatcgatcgcatggcgaatgtcggtgctgcagcggcattcgaggatcgcgaatacttcgacaagacctgcgcactggtgatcgagagtcgcgaatgggtggttgcgcagttgcaggccaagggctttgaagtgctgccgtcagcggcgaacttcatcttcgcccggcatccgcaacacgatgcggcggggctggcagccaaa

SEQ ID NO: 37666 - DNA, 1863 bp, Pseudomonas fluorescens
acgcgaacttccgagcgccagggccgggtcatcgaccacgatggcgcaggctcgatggaagacaagaaacgtcagggttatttctaaggggttgtcatgtcgcacgcatctgatttgatcagcgaggacatcctcgcctacctgggccagcacgaacgtaaagagctgctgcgctttttgacctgcggtaacgtcgatgacggcaagagcaccctgatcgggcgcctgctgcacgactcgaagatgatctacgaagatcacctggaagccatcacccgcgattcgaagaaagtcggcaccaccggtgacgacatcgacctggcattgctggtcgacggcctgcaggccgagcgcgagcagggcatcaccatcgatgtcgcctaccgctatttctctaccgccaagcgcaaattcatcatcgccgacacccccggccatgagcagtacacccgcaacatggccaccggtgcctccacctgtgacctggcgatcatcctggtcgacgcccgttacggcgtgcagacccagacccgtcgccacagcttcatcgcctcgttgctgggcatcaagcacatcgtcgtggccatcaacaagatggacctcaagggcttcgatcagggcgtgttcgagtcgatcaaggccgactacctgaagttcgccgaaggcttgaagatgaagccgacgagcatgcacttcgtgccgatgtccgctctcaagggcgacaatgtggtgaacaagtccgagcgctcgccgtggtacaccggccagtcgctgatggaaatcctcgagaccgtggaagtggcgggcgaccgcaacttcaccgatctgcgtttcccggtgcagtacgtcaaccgtccgaacctgaacttccgcggtttcgccggcactttggccagcggcatcgtcaagaaaggcgacgaagtcgtggtcctgccgtcgggcaagagcagccgtgtgaaatccatcgtcaccttcgaaggtgagctggagcatgcaggtcctggccaggcggtaacgctgaccatggaagacgaaatcgacatctcccgtggcgacctgctggtccacgccgacaatgttccgccggtcaccgacagctttgaagcgatgctggtgtggatggctgaagagccgatgctgccgggcaagaaatacgacatcaagcgcgctaccagttacgtgccgggctccatcgccagcatcgtcaacaaggtcgacgtcaacaccctcgaagaaggcccggcgagcgcgttgcagctcaacgaaatcggcaaggtgaagatcgcgctcgacgcgccgatcgccctcgacggttacgacagcaaccgcaccaccggcgcgttcatcgtcatcgaccgtttgaccaacggcactgtaggcgccggtatgatcgtcgctcagccggtgacccatggcacggctacgcaccacggcaaactggcccatgtagcgaccgaagagcgcgctcagcgtttcggtcagcaaccggccactgtgttgttcagcggcttgtcgggcgctggcaagagcaccttggcgtacgcggtcgagcgcaagctgttcgatctgggtcgtgcggtgtttgtgctggatggtcagaatctgcgtcatgacctcaacaaaggtctgccgcaggatcgcgccggtcgcaccgagaactggcgtcgtgctgcacacgtggcgcgtcagttcaacgaagccggtctgctgacacttgcggcttttgtggcgccgagtgccgaaggtcgtgagcaggcgaaggatctgattggcagggagcgtctgttgacggtttatgtccaggcctcgccgactgtgtgcgccgagcgtgatccgcaaggtttgtacgctgcgggtggcgat

SEQ ID NO: 37667 - DNA, 2034 bp, Pseudomonas fluorescens
aaccctcttctgcagtcctacgacctgccgccgttctccgcgatccgtgccgaacacgtgcagccggccatcgaaaccatcctggccgacaaccgcgccgccatcgccgaaatcctcaagacccaaggccagaacccgacctgggccgggctggtgctggcgatggacgaactcaatgatcgcctgggcgctgcctggagtccggtcagccacctcaatgccgtgtgcaacagcgccgaactgcgtgaagcctacgagtcgtgcctgccggcattgagcgcctactccaccgaaatgggccagaaccgcgaactgttccaggcctatgaagccctggccaacagcccggcagccgccggtttcgacgtggcgcaaaaaaccattctggaacacgccctgcgcgatttccgcctgtcgggtatcgacctgccggaagccgaacagaaacgctacgccgaagtgcagagcaagctatcggagctgggcagccgcttttccaaccagttgctcgacgccactcaggcctggaccaagcacctgaccgatgaagccgccctcgccggcctgaccgattcggccaaggcgcaaatggctgctgcggcacaggccaagggcctcgacggctggctgatcaccctggaattcccgagctactacgcggtgatgacctacgcccaggaccgtgcgctgcgtgaagaagtctacgccgcctactgcacccgtgcgtcggatcaaggcccgaacgccggccagaacgacaatggcccggtgatggacgaaatcctcgacctgcgtcaggaactggcaaaactgctcggtttttccagcttctccgaactgagcttggccaccaaaatggccgagtccagcgatcaggtgctgagcttcctgcgtgatctggccaagcgcagcaaaccgttcgccgcccaggatctgcaacagctcaaggcttacgccgccgagcagggctgcgccgatctgcaaagctgggacagcggtttctacggtgaaaaactccgtgaacagcgttacagcgtcgctcaggaaaccctgcgcgcctacttcccgatcgacaaagtgctgggtggtctgttcgccatcgttcagcgcctgtacggcatcgaaatcgccgaactgaaaggcttcgacacctggcacccggacgtgcgcctgttcgaaatcaaggaaaacggtcagcacgtcggccgtttcttcttcgacctctacgcccgcgccaacaagcgcggcggtgcgtggatggatggcgcccgcgaccgtcgccgcaccgtcgacggcgtgctgcaaagcccggtggccaaccttgtgtgcaacttcaccccggccgacagcggcaaacctgcgctgctgacccacgatgaagtgaccaccctgttccacgaattcggccacggcctgcatcacctgctgacccgcgtcgagcatgccggcgtttccggtatcaacggcgtggcgtgggacgccgtcgagttgccgagccagttcatggaaaactggtgctgggagccggaaggtctggcgctgatttccggccactacgagaccggcgagccgctgccgcaggatctgctggaaaaaatgctcgcggcgaagaacttccagtccggcctgatgatggtgcgccaactggaattctcgctgttcgacttcgaactgcacgccacccacggtgacggccgcagcgtcgcgcaagtgctggaaggcgtacgcaacgaagtctcggtaatgcgacctccggcctacaaccgcttcccgaacagcttcgcgcacatcttcgccggcggttacgcggcgggttactacagctacaaatgggcggaagtgctgtcggcagatgccttctccaagttcgaagaagacggcgtgctgaatgccgacaccggtcgcgccttccgcgaagcaatcctcgcccgcggcggctcgcaggagccgatggtgctgttcgtcgacttccgtggccgtgagccatcgattgacgcactcttgcgccacagcggcctgagtgaggacgcggca

SEQ ID NO: 37668 - DNA, 1167 bp, Pseudomonas fluorescens
aaagctagcttcaactggatcgatcccctgctgctggatcaacagctgactgaagaagaacgcatgatccgcgacactgccgagcaattcgcccagcagagcctcgcgccgcgcgttctcgaagccttccgccatgagaagaccgatccggcgatcttccgtgagatgggtgaggtcggcctgttgggcgcgaccatccccgagcagtacggtggcagcggcctcaactacgtcagctatggcctgattgcccgtgaagtcgagcgtgtcgactctggctaccgttcgatgatgagcgtgcagtcttcgctggtgatggtgccgatcaacgaattcggtactgaagcacagaagcagaagtacctgccgaagctggcgtccggcgagtggatcggctgcttcggactgaccgagccgaaccacggttccgacccgggcgcgatgattacgcgtgcacgcaaagtcgacggcggctacagcctgaccggtgccaagatgtggatcaccaacagcccgatcgccgatgtgttcgtggtctgggccaaggacgatgccggcgacatccgtggtttcgtactggagaagggctggaaaggcctgagtgccccggcgattcacggcaaggtcggcctgcgggcttcgatcaccggcgaaattgtcatggacaatgtgttcgtgccggaagagaacatcttcccggatgtgcgtggactgaaaggtccgttcacctgcctcaactccgcacgttatggcatctcctggggggcgctgggtgctgccgagttctgctggcacaccgctcgccagtacaccctggatcgtcagcagttcggtcgtccgttggctgccactcagttgatccagaagaagctggctgacatgcagaccgagatcactttggcactgcaaggctgtctgcgtctgggtcgcatgaaggacgaaggcactgctgcggttgaaatcacatccatcatgaagcgcaactcttgcggcaagtctctcgagatcgcccgcatggcgcgtgacatgttgggcggcaacgggatctctgatgagttcggtgtggcccgtcacctggtcaacctggaagtggtgaatacctatgaaggtactcacgacgttcacgcgctgatcctcggtcgtgcgcagaccggcctgcaggcgttc

SEQ ID NO: 37669 - DNA, 558 bp, Pseudomonas fluorescens
atgaatatccctaatctgattaccgttctccgcgtcctgctcatcccgatcttcattctgttgttctatctgccttaccaatggagctatctggcctcaagttcggtattcgcctttgcggcggcaacggactggcttgacggctatcttgcgcgacgtctggagcaaagcacgccgtttggtgcgtttctggatcccgtcgctgacaaactgatggtggctgttgccctggtgttgctggtgcaagaacatggcaacctttggctcacactgccggccgctgtcatcatcggtcgcgagattgttgtctcggcgctgcgtgagtggatggccgaactcggtgcacgggcccatgtggccgtgtcgaatctgggcaagtggaaaactgctgcgcaaatgcttgcactggtgatcctcctggccaatcccaaggttttcagtttctgggttgtcatcggttacgcgttactgatggtgtctgcaggcctgaccttgtggtcgatggttcaataccttcgggctgcctggccacatctgaagactgatgttgaaaagaaa

SEQ ID NO: 37670 - DNA, 1056 bp, Pseudomonas fluorescens
atgaactcgtccgtttctgctctgccactgtccaccctgaaccctgccaacgaagcattgaccctgcgtctgccgagttcgctgcaactcaaacagcaattgcccctgagcaatgcgctgaaccagcaagtcgttgcacaccgccaggcggtccgcgcgattctcgatggccatgacccgcgtttgctggtgatcgtcggcccctgctcgatacacgaccctgagtccgcgcttgaatacgccagcaaactttcgcatctggccgaagaagtccgtgatgacatgctgctggtgatgcgtgcctacgtcgaaaaacctcgcaccaccgtcggttggaaaggccttgcctacgaccctcatctggatggcagcgacgacatggctgccggcctcaccctgtcgcgcgaactgatgctcgaaatgatccgcgtcggacttccgattgccaccgaactgctgcagcccatggccgccgggtacttcgatgacttgctgagctgggtcgccattggcgcccgtactaccgagtcccagatccaccgggaaatggccagtggactgagcatgccggtcggcttcaagaacggcaccgatggcggcgtgactgtcgccgttgacgcgatgcgttcggcagcacatccccatcgtcacttcggcgtcgacagccagggccacccggcaatcatccagaccccgggcaaccaggacacacatctggtgctgcgcggtggccaccaagggccgaactacgaccgcgaaagcgtttccagaatcaacgccgagttgaaccgcctgaagatcccgaagcggatgatggttgattgcagtcatgccaacagtggcaaggacccactccggcagccaggcgtgttcaacgatgtgctggagcaacgcttgaagggcgaccgctcgctggtcggcatgatgcttgagtcacacctgtttgaaggatgccagccgttgagcgagtcgcttcggtacggagtttcgattaccgatgcctgcctcgggttcgattccaccaggcagttgctgctggacgcagcgcatcgcatg

SEQ ID NO: 37671 - DNA, 765 bp, Pseudomonas fluorescens
actctttctggcaagaccgcactggttaccggctccaccagcggaatcgggctgggcatcgccctgacgctggccaaggctggcgccaacctgatcctaaacggctttggcgacgcctccaaggtgatcgccgaagtcgagcagttcggcggcaaggtcggccatcacccggcggacgtcagcgatcccgcccagatcgccgacatgattgcctacgccgaacgcgagttcggcggcgtggacattctggtcaacaacgccggcatccagcacgtcgcggcggtggaagaatttccggtggagcgctgggattcgatcatcgcgatcaacctgtcgtcggtgtttcacagcactcgcctgagtttgccgggcatgcgcgccaagggctgggggcgaatcgtcaacatcgcctcggtgcatggtctggtcggttccaccggcaaagccgcgtacgtggcagccaagcatggggtgatcggcttgaccaaagtggtcggcctggaaaccgccgccagcaacgtcacctgcaacgccatctgcccgggctgggtgctgacgccgctggtgcagaagcagatcgatgatcgcgcagccaagggtgtcgacccgcagcaggcgcaacacgatctgctggccgaaaagcagccgtcgctggagttcgtcacgccggcgcatctgggtgaactggtgctgttcctgtgcagcgaggccggcagccaggtgcgtggcgccgcgtggaatatcgatggcgggtggctcgcgcag

SEQ ID NO: 37672 - DNA, 1938 bp, Pseudomonas fluorescens
attctctggcagcccgatgccaaacgcattgcccggtcccgcatggacggctttcggcgcttcatcaatcagcgccaccacctgaagctcgacgactaccctgcgctgcaccaatggtccatcgaccagcgcgaagcgttctggcaagcgatcgtggatttcttcggcatcagttttcacacccaaccggacgccgttctgcgcggaggcctgaaaatgccgggtgccgagtggtttcccggtgccaccctgaacttcgccgagcatctgcttagccgacgcgacgatgccatcgccgtgatcgctatcggggaaaacggccagcgtgaactgctgacctgggccgagctggcccagcaagtcgccgggttccaggccagcctgcaagcggccggcgtgttggttggcgaccggattgcggcctgcatgcccaacacctggcaaaccctggtggcgatgctcgcgaccaccagtctcggggcaatctggtcatgctcctcgccggacttcggcacccacggcgtgatcgaccgcttcggccagatcgaaccgaaggtgctgatcacctgcgccggctaccgttacgctggcaaggagatcgaccagaccgtcaaggtcaatgaaatcctcgaacagctgccgtcactgcaacagctgatcatcgtgccctacgcgcgacctcaagcccatgccacggattaccggacacccgccaacgtcacgctgtgggacgacttctacgaaccgggcgatgagccgcaattcgtcccggtgccgttcgatcatccgctgtacgtgctttattccagcggcaccaccggcgtgccgaagtgcatcgtgcacagcaccggcggcgtgctgctgcaacacgtcaaggagcacgggctgcatgttgacctcggacccggcgaccgtttgttctactacaccacctgcggctggatgatgtggaactggctggtctcggcactggcggtcggcagcgcggtggtgctgtatgacggttcaccgttttatccggacaacgagcgcttgctggagctgctggacgacgaacaggtcagcgtgttcggcaccagcccgaaattcctcgcgaccctggaaagcagcggcatcaaaccgcgcgaaagctacgacctgagccacctgagaaccctgctttgcaccggctccgcactgtcaccgcagagttatgacttcgtctatcgcgacttcaaaccggatgtgtgcttgtcctcgatgtccggcggtacggacatcgtgtcctgcttcgtcaacggcaacccgatgtcagcagtccgccggggcgaaatcatgggcaagagcctggccatggcggtggaagtgtggaacgacgccgggcaaccggtcgttggcgaaaaaggcgaactggtgtgtacccggtcatttccggcggtgcctatcggactctggaacgatcccgatggcgagaaactgcgcaaatcctatttcagccagttccccggcgtctgggcccagggtgactacgccgaacaactgccccacggcgggatgctgattcacggccgctccgacgccgtgctcaaccccggcggcgtgcgcatcggcacggcggaaatctaccgtcaggtggagaaagtcccgcaagtgctggacagcgtcgccatcggccaacagtggcaggacgatgtgcgcgtggtgctgttcgtgcacctcaaggacggcgtaacgctggatgacacgctgcaacagcagatccgccaggtgatccgtgccaacaccacaccgcgccatgtgccggcgaagatcgtcgcggtcaccgacattccgcgcaccatcagcggcaaagtggtggagctggccgtgcgcaatgtggtgcacggtgaaccggtgaaaaacaccgatgcgctggccaatccgcaagcgctcgagcagtttcgcgatcgaccggaattg

SEQ ID NO: 37673 - DNA, 909 bp, Pseudomonas fluorescens
accccgcgcatcgccctgatcggcgaatgcatgatcgaactccagcaacgtgccgacggcagcctgcaacagagttttggcggtgacacgctgaacacggcggtctatctgtcccgcgcgatgggcggcaaggcgcaggtcgattacgtcacggcgctgggcgacgacagcttcagcgatgcgatgtgccgcatttgggccgacgaaggcattggtctggatctggtccagcgcttgcccggtcgtttgccgggcctgtattgcattcaaacggacgctgccggcgaacgtcgtttcctttactggcgcaacgaagccgctgtgcgcgactgcttcaccacgccggcgtccgcgccgattctggcggcgctggcggattacgacgtgctgtatttcagcggtatcacgctggcggtactcggagccctgggtcgggaaaaactgatcgagaccttgatcgaagcccgtcagcgtgacgcgcgaatcgtcttcgacaacaactaccgcccacgcctgtgggcttcagtggaggaggcgcgagcggcgtatcgcagcgtgttgcctcacgtcgatctggcattgctgacggtggacgacgaacaggcgctgttccatttcgaagactgtgacgcggtgtttgcagcgtacgcgcagatcggcacgccggaagtggtgctcaagcgtggcgccgaagcgtgcttgatccgttgtgacggggaagcgtttgaagtcccggcgcagaaggtcgagacagtggtggacaccacggcggcgggggattcgttcagtgcggcgtatctggcgagtcgcttgtccggcgcaagccctgtgcgggcggcggaggcggggcatcgcttggccagtcaggtcattcaagtgcctggggcgttgatccccaaggattgatgc

SEQ ID NO: 37674 - DNA, 996 bp, Pseudomonas fluorescens
atgaccgacaccccgcatttcccgctctccgccgtggtcggcgccgatgatttgaaactggcgctgtacctgacggccattgacccgaaaatcggcggcgtgctgatcgaaggcccgcgtggcatggccaagtcgacgctcgcccgggggctggcggatctgttggccagtggtcagttcgttaccttgccgttgggtgctactgaagagcgattggtcggcacgctggatctggacgcggcgttgagcgacggtcgtgcgcagttttctccgggtgtgctggcgaaggcggacggcggcgtgttgtacgtcgatgaggtgaatctgttgccggatcatctggtggatctgctgcttgatgtggctgccagcggcaccaacctgatcgagcgcgacggcatttcccatcgacattcggcgaagttcgtattgatcggcacgatgaacccggaagagggggaattgcgtccgcaattgctggatcgtttcggccttaacgtcgcgctgagcggtcatacggcgccggccgagcgggggcagatcattcgtcgtcggctggatttcgacagcgacccgcaggtgttttgtgcgcagtgggaggctgatcagcaagctctgcgtgagcgttgtgaaagcgcccgccatgccttggcgaatattcccctcgacgatgaagcgctggcacagatcaccgagcgctgctttgcggcaggcgtcgacggtttgcgcgccgatctggtctggctgcgtgcggcgcgggctcatgcggcgtggcgcggggctgaaaccattgccgagcaagacattgatgccgtggctgagcttgcattgcgccatcgtcgccgcgaacagtcttcatcccctgcacagccaccggcgcaatcgccgtccggtactcacgccgaaccgagcgaagggcaggggcaatggggtgaaatgccggcaccggcattggttaccggcgcacgccgtgaagttccgacctggccaaaaaag

SEQ ID NO: 37675 - DNA, 3768 bp, Pseudomonas fluorescens
atgcacctgctcaggacccagcccggcggattcgtgtcggacgacaacattgccgaccttggacaaacccccgccgagctggtgatcctgtgcagcggcgattccagcctcgcgctgctcgccgaagcggcgcagcaactgcccgaggattacccgagcgtgcggctggccaaccccatgcaggtgcagaaccatgcgtcggtcgacctgtacgtcgatgaagtgctgcgccacgccaaggtgattctgatttcgctgcacggcggcatcgcttattggcgttatggcgtcgagcggctggtcgaattgtccgagcgtggcgtgcaggtgattctggtgccgggcgatgaccgtcccgacccggaactcagcgacctgagcaccgtgggcgccgaggatcgcgaccgtctctggcagttcctgcgccagggtggccttggcaatgcgctggactttttccactgcctggccaatcgctggctggcgcgggattacgtgtggggcgagccgcaagcgctgccgcgcacggcgatttatcacccgaataaaaacaccgccgcactgagtgactggcaagccgattggcggcccggtcaaccggtcgcggcggtgttgttttatcgctcgcatttgcaagcggcgaacacggcgtttatcgacgtgttctgccaacggctgcaggttgccggactcaatccgctgccgatcgccgtggccagtttgaaagagcccggctgcctgtcggtggtcgaggactggcttgatgaggccggagcctcggtgattctgaacaccaccggtttcgctcagtccagcccggaagcgccgcatctgcggccattccgtcgcaacattccggtgattcaggcgatctgcgcccaggacaacgagcccggctggcgcgagagcgagcagggcctcggcccgcgggatctggcgatgcacatcgcgttgccggagctggacgggaggatcatcagccgaccgatcagcttcaaggatctggcctggcgcagcgagcgcagtcagtccgacgtggtgtgttatcgggcccaacccgagcgcatggatttcgtcgccgaactggcgcgccgctgggtcgatctggcgcgggtgccgaacgctgaaaagcgcatcgcgctgatcctcgccaattacccgacccgagacggacgcatcggcaatggcgtcggcctcgacacgcccgccgccgggttgaatatcctgcgggcgttgcaggccgaaggttatccgctgccggccgaactgccggacagcggcaccgaactgatccgacaattgctcggcggtgtcagcaacgatctcgatacgctcgatcagcgcccgtgccagcaaagcctggcgatggacgattacctgaagatgttcaatgcgctgccagaagccaatcgcgcggcggtgctggagcgctggggcttgccgcaaaacgatccgatgtgccgggacgggcgcatgatgatcgccggcctgcgctttggcctgactttcgtcggcattcaaccggcgcggggttatcaggttgatccgagcgcggtgtatcacgatcccgatctggtgccgccgcacgcgtacctcgcgttctatttctggctgcgccagacctacggcgctcatggcgtgattcacgtcggcaagcacggcaaccttgaatggttgcccggcaaaggcgtgggcctgtcggaaaactgctggccggacgcattgctcgggccgctgccgaatatctacccgtttatcgtcaacgatccgggcgagggtgctcaggccaaacgtcgcactcaggcagtgatcatcgaccacttgatgccgccgctgacccgcgccgagacctacggtccgctgcgcaatctggaattgttggcggacgagtattacgaagctcagttgctcgatccgcgccgcgcccgcgagttgcagcgcgacatcctccagttagtgcgtgacacgcagattgatcgcgaattgcagctggatgccgccctcgacagcgacgccgatgcggcgatctggctgccgcgtctggacacttatttgtgtgacttgaaggaatcgcagatccgcgatggcctgcatattttcggtgagtcgccgaccgggcgtttgcgcatcgacaccttgctggcgttgctgcggattccgcgcggcgatggcaaaggggctcagtcgagtctgttgcgggcgctggccaaggcgtttcagttggggttcgatccgctggattgtgcacttgccgaaccctggactggcctgcgcccaatggaactgcaatcgttgagcgatgaagtctggcgtacggcgggggatacccgtgaacgccttgagctgttcgcggcgcatttgatcgagcagtcgctggtgggtgatgtggcgcaactggatgcttcaggctggtcagatgtgcaggcgatcatccacgccctgcgcgaagtgatcgccccacgcctcgacgcctgcggcccggccgaaatgcgcggcttgctcgacgcgttgagcggccgattcgtccccgctggcccaagtggtgcgccaagtcgaggtcgcctcgacgtgctacccaccgggcgcaatttctattcggtggacgtgcgcaatctgccgaccaccacggcgtggcggatcggtttccagtccgcgaccctgattctcgaacgacacttgcaggaccacggcgatcacctgcgccaactcggcctgtcggtctggggcaccgcgaccatgcgcaccggcggcgatgacatcgctcaggccatggcgttgatgggcgtgcgtccggtgtgggccaccggcagtcagcgggtcgatgatttcgagattctgccgctgagcctgctcgaccgtcctcgggtcgatgtcacgctgcgggtctccggatttttccgcgatgcgttcgccaacctgattcgcctgttcgacgccgccgtacaagccgtggccgaactggacgagccggacgacctcaacccgctggccgccaaggtgcgtgccgaacgtgaggcgttgcgtcagtcggggctggatgacgaggctgcccggcgtcaggccggctggcgaatcttcggtgccaaacccggcgcatacggtgcgggcgtgcagggcgccatcgacggacgcctctggcaaacccgcgaggatctggccgaggtctacctgaactggggcgcctacgcttacggcggttccgacgagggcaccgccgcccgcgagcaattcgtccagcgcctgagccaggtgcaggcggtgctgcagaaccaggacaatcgcgagcatgacctgctcgattccaacgactattaccagttccagggcggcatgctcgccgccgtggaaagcctgcgcggcgaagcagcggccagttatcacggcgatcacagtcagccggacctgccgaaaattcgcaccttgaaagaagagctgaaccgggtcatccgctcccgggcggcgaatccgaaatggatcgacggggtcaagcgccacggctataaaggcgcgttcgaactggcggcgacggtcgacaacctgtttgccttcgatgccaccacgcaactgatcgacgatcaccaatacgcattgctggcggatgcctatctgctggacccggcgacccgcgagttcgtgcgcgagcataatccccacgcactgcgcgacatgaccgaacgcatgctcgaagcgcagcagcgcgggatgtggcaggagccgggcgcctacaaagaagccctggaaaacctgctgctggacatagaagaagag

SEQ ID NO: 37676 - DNA, 1656 bp, Pseudomonas fluorescens
atgtacgtatacgacgagtacgatcagcggatcatcgaggaccgcgtcaagcagttccgtgatcagacccgacgctatctggcaggtgagctgagcgaagaagaattccgccccctgcgcctgcaaaatggcctgtatatccagcgtttcgcgccgatgctgcgcgtggcggtgccttacggccagctgacctcgcgccaggtgcgcatgatggcgaaaatcgcccgcgactatgacaagggctacgcccacatcagcacgcggcagaacgtgcagttcaactggccggcggtggaagacatcccggacatcctcgcggaactggccaccgtgcagatgcacgccatccagaccagcggcaactgcctgcgcaacgtcaccaccgaccagttcgccggtgtcgcagccgacgagttgatcgacccgcgtccgtggtgcgaaatcgttcgtcagtggacgaccttccacccggaattcgcctacctgccgcgtaaattcaagatcgccgtcaacggttcgacctccgaccgtgcggccatcgaagtccacgacatcggccttgagccggtccacaacgctgccggtgaactcggtttccgcgtgctggtcggcggtggtctgggtcgtactccggtggtcggcgcgttcatcaacgaattcctgccatggcaggacctgttgagctacctcgacgcgatcctgcgggtctacaaccgctatggccgtcgtgacaacaaatacaaggcgcggatcaagatcctcgtcaaagcgctgactccagaagtcttcgcccagaaagtcgatgccgaaatggaacacctgcgcggcgggcagaccaccctgaccgaagccgaagtccatcgcgtcgccaaacacttcgtcgacccggactacaaggcgctgagcaatcaagacgccgaactggccgccctcgacaaagagcatccgggcttcgcccgctggcgcacgcgcaacaccctggcgcacaagaagccgggctatgtggccgtgaccctgtccctgaagccaaccggcgttgcaccgggcgacatcaccgacaagcagctcgacgccgtcgccgacttggccgagcgctacagcttcggtcaactgcgcacgtcccacgagcagaacatcattctggccgacgtcgagcaaagccagttgttcaccctgtggggcgagctgcgtgaagctggcttcgccacgccgaacatcggcctgctgaccgacatcatctgctgccctggcggtgatttctgctccctggccaacgccaagtcgatcccgatcgccgaatcgatccagcgccgtttcgacgacctggactacctgttcgacatcggtgaactggacctgaacatctccggctgcatgaacgcctgcggtcaccaccacgtcggccacatcggcatcctcggtgtggacaagaaaggtgaagagttctaccaggtctccctcggtggcagcgccagccgtgacgccagcctgggcaagatcctcggcccgtctttcgctcaggaagacatgccggacgtgatctccaaactgatcgacgtgtacgtggaacaacgcaccgaagacgagcgtttcatcgacacctaccagcgtattggcatcgacctcttcaaggaacgcgtctatgcagcgaatcat

SEQ ID NO: 37677 - DNA, 1095 bp, Pseudomonas fluorescens
gtcgcaggcgcgcgcggcccctattatcgacggctttccagtgggttcgttgagggcaggtttatggtcaaggtcggtatcgtcggcggcacgggttacaccggtgtcgaactgctgcgtctgttggcacagcatccgcaggcagaagtggtagtgatcacttcccgatccgaggccggtctggccgtggctgatatgtacccgaacctgcgcggtcactacgacggtctggcattcagcgtgccggacatcaagaccctgggcgcttgcgacgtggtgttcttcgccactccgcacggcgttgcccacgcactggccggcgagttgctggcggccggcaccaaggtcatcgacctgtcggcagacttccgtctgcaggacgctgatgaatgggccaagtggtacggccagccgcacggtgcaccggagctgctggacgaagcggtttacggcttgccggaagtcaatcgtgagcaaatcaggaaagcgcgcctgatcgcggtgccgggttgctatccgaccgcgacacagctgggtttcctgccgttgcttgaggcaggcattgccgacgcttcccacctgatcgccgactgcaagtccggtgtcagcggtgccggtcgtggtgctgccgtaggctcgctgtactccgagacgtcggaaagcatgaaggcctatgcggtgaaaggtcaccgtcatctgccggaaattcgccaggggctgcgtcgtgccgcaggcaaggatgtcggtctgacgttcgtgccacacctgacgccgatgatccgtggcattcactccacgctttacgcgaccgtggtggaccgctcggtggatctgcaggcgctgttcgaaaagcgttatgccaatgagccgttcgtcgacgtgatgccggctggtagccatccagaaacccgtagcgtgcgtggcgccaacgtctgccgcatcgcggttcaccgtccacaggatggtgatctggtggtggtgctgtcggtgatcgacaacctggtcaagggcgcgtcgggccaggcggtgcagaacatgaacattctgttcgggctggatgagcgtttgggtctgtcccacgccggcatgctgccg

SEQ ID NO: 37678 - DNA, 759 bp, Pseudomonas fluorescens
gctctgatcaccggcgcctccagcggcatcggcctggccatggccgaagccctggcacgccgtggccgcagcctgattctggtagctcgccagcgtgatcagctggaaagcattgcgattgaactgacccagcgcttcggtgtggaggtactgttccgcgcctgcgatctcggcgagccgctgcgcctgtccggtttcctgctggagcttgaagaaggcgaccggcagatcgatctgctggtcaactgtgccggcatcggtacttgcggcccgttcctggcccaggactggatgaccgaacaggacctgatcgaagtgaacatcctcgccctcacccggctctgccatgccatcggcaacagcatggcgttgcagggtggcgggcagattctcaatgtcgcgtcggtggcggccttcaaccccgggccctggatgagcacctactacgccagcaaggcgtacgtgttgcacttctcggaagcactgcgggtggaactgaagaagtgtgcagtcaaggtgtcggtgctctgccccggcccgacccgcaccgcgttctttcgcaccgcgcaactgaacaacgacaagctcaacgccagcaaactgttgatgagccccgaggaggtcgcgctgtataccgtgcgcgccctggagaaaaaccgcgcgatcatcattcccggacgccgaaaccgctggttcgcctttctgcctcggctcggttcgcgctggctcaatcgcacgattgtcggcatggtcaacaag

SEQ ID NO: 37679 - DNA, 1146 bp, Pseudomonas fluorescens
atgagtctttcctcgttcaagatcgctcacaaactgatcaccggcgccggggccatcgagcaactggcggccgaactcacgcggctggacatcgacaacccgctgatcgtcaccgatgccgcgctggtcaagtccggcacggtggagctggcgctggcgcagatcggcgagcgcgagtacgaaatcttcgaccgggtattgccggatccggaaatcgccatcgtcgaggattgcatgcgcgtctaccgcgaaggcgggcatgacggtctgattggcctcggtggcggcagtgccatcgacatcgccaagagcgtcgcggcgtacgccggctatcacggtgcgctggaagatctgttcggcgtcgatcaggtgccgcgcaaaggcccaccgttgattgcgatcccgaccactgccggcaccggttctgaagtgaccaacgtcgccatcctttcggacaaggtcgcccaactgaagaaaggcatcgtcagcgattacctgttgccggacgtggcgctggtcagtccgcagatgaccctgacctgcccgcgcagtgtcaccgccgccagtggcgtcgatgcgctggtgcatgccatcgaatcctatctgtcactgaatgcctcgccgatcaccgattcgctggccatcggcgcaatcaagttgatcgcccggtccttgcccaaggcctacgcgaacccctccaacctgcaggccagggaagacatggccactgccagcctgatggccggcatggcgttcggcaatgccggggtcggcgcggtgcatgcgctggcgtatccgctgggcgggcgattcaacattgctcacggcgtcagcaatgcgttgctgctgccgtatgtcatgacctggaacaagatggcctgcgtcgaacggatgcaggatatcgccgaagccatgggggtgaagaccgctcatctgagtctcaatgaagcggccgacagcgccgtcgccgcgatgaccgagctctgtgcggcggtggaaatcccgctgggtctgcgcagtttcggcgtgcccgaagaagcgatcccggccatggccgtggaggcagcgggaatcgagcgcctgatgcgcaacaacccgcgcaagctcagcgccgccgacatcgagaagatctaccgggcggcgtac

SEQ ID NO: 37680 - DNA, 654 bp, Pseudomonas fluorescens
aaggcaatgattctggcggccggcaaaggcgagcgcatgcgcccgctgaccctgaccacccccaaaccgctggtgcgagccggcggcgtgccgctgattgaatatcacctgcgtgccctggccgcggccggtttcaacgagatcgtgatcaaccatgcctggctcggacagcagatcgaagatcatctgggcgatggttcgcaattcggcgtgtcgatccagtactcgcctgaaggggaacctttggaaaccggcggcggaattttccgcgccttgccgctgttgggcgaagacgcgtttctggtggtcaacggtgacatctggaccgattacgacttcagcgtgctgcatcagccgatcaacggcctggcgcatctggtgctggcggacaatccggcgcatcacccgacaggggatttcaccctgaccgacggccaggtgcgtgatggccaggccgatttggcaaccctgacctacagcggcatagccgtactgcatccgcagttgttcgacggctgccgcgacggtgccttcaaactggcgccgctgttgcgtaaagccatggcggacgggcaggtgaccggcgagcggttgaaggggcactgggtcgatgtcggtacgcacgagcgtctggccgaagctgaagccttgata

SEQ ID NO: 37681 - DNA, 2459 bp, Pseudomonas fluorescens
attggcacttcactgttctggaagtgcccatgcctgcgccgacccatccccgtccccacaccgaaaccctggccaacggcttgcgcgtgaccctgcgccacgtgcccggcctgaagcgcagcgccgcggcgttgcgggtggctgccggcagtcatgacgtgccgttggcgtggccggggctggcgcattttcttgagcatttgctgttcctcggcaccgagcgttttcccgcaagccaaggcctgatggcctacgtgcaaggtcacggcggccaggtgaatgccagcacccgcgagcgcaccaccgatttcttctttgaattgccgccggcgtccttcagcggtgggctggagcgtctgtcagacatgctcgcccgtccgtgtatgaatccggacgatcagttgcgggaacgggaagtgttgcaggcggagtttgtcgcgtggtcgcaggatgctggagctcagcaaaaagaagcgctgttcgaagggttgtcagcatcgcatccgttgcgcggctttcataccgggaaccgcgacagtctgccggtagaacacgcggattttcagcaggcgttgaaagactttcatcagcagttttaccgcaccgggcagatgactctgagtctggtcgggccgcaaagtgttgaagagctgagaacgctggcagaacagtttgccgccgcgctgacagctggggataaaactgcacaggcagcccccgtttgcttgatggacaatccacagaaaagttatcaacaggtcggcgagcggcacggcaatctgctgtttgcgttggaggatttgccggagtcgtcggccgaggcactggcgtttttctgtcactggttgaacagcgccaaacccggtgggctgctcgctcacttgcagcagcagggattcgcggaagacttacaggcctgtgtgccttatcaatttgctgggcaggcttttctacatcttcagttcactggggcatccgggtcactcgacgccatccgcgcacagcttctcgactggttgagcttcttcgcagcgcagcaggactggccggcactacgcgaggaatattcggcacagcttcaacgtcagcagcaggtcagcggtgcgttgcaactggcgcgactcgacagcgaacaactcgaaagcggcctctccgaatcggccgttgcagcgctcaaagtgattctcggcaaaatcggcactgtggataacttcagcagtcactggcatctgcccgctgccaatccgttcctgcgcgcagccgaaccgctggccaacgccggcctgatccgcggccaaaccagcgcccaccgtgggctgcgcacgttcgctcaggatcgctcgcgcagccgacgcgaacgttcgccgatgcaattcagccaggcgctgccggataacgatgacgaaggtgcggtctatgttcgctggcagacggaagcagcggccacggccgagctgcaagcgaaactgcaacgcagtctgcgagaggtttccgacgacgcgcgtcaggccggggtcgagttgtccttcagcgcctcagctgatcagtggctgctgaaactcactggcctgcaggacacgctgcccgttgtcctggagcacgcgctgaaatctctgacacaagtgggcgccgatgccgcaaaaggcgagccgcaacctgcgctgataccgatccgccaactgctcaaagtactgccggaaaagtgcctgtcagcggtaggcgaatccgatgacgccgcccacctgtggacaacttcccgctgggacggtctggctttggggttaagcccgcaaacccagtcagccatgggcctggccctgagtcgcatccccggcatcccggacaatcaaattcccgcaccgtcggcaatcaacgccggataccggtggagtcagatcgacagcgcgtccagcgaacacgccttgttgctgttctgcccgaccgccagccacgaaatcgccgacgaagccgcgtggcgcctgctcgcgcacctgtgccagacgccgttctaccaacgcctgcgcgttgaattgcaactcggttatgcggtgttcagcggcctgcgccagctccacggccagaccggattgctgttcggtgtgcaatcgcccacggccaccgccgcgcaattgctcgaccacattcagcagtttctcgatggcctgccagcccttgtcgaacagctggatgccgccagcctcactcagcaacgccagacgcttgccgatcagttcgatgacaacgtcctgtccggcaaagatgcggccgaactcctgtggcaggcccgcctcgccggccactcgtcggattatctgctgcaattacgcagcgcagtcgctcaactggatcgcccggcgttgctggccgccgcacaacgtctgatccgcgccgagggcggctggcacggcctggccaacagcccttcgccgggcgcgccctggcacgcggctaaatgatca

SEQ ID NO: 37682 - DNA, 1167 bp, Pseudomonas fluorescens
gctgatggcctgaatgccgaacgtctgatgcccagcgtcgagcgtccgcagcaggtattcgttcgcggtcaaggctcctggctatgggacagcaatgaccgcgcctacctggacttttcccaggccggaggcgccaatagcctcggccacagcccttcggcgctggtcaaagccattgccaaccaggcccaggccctgatcaatcccggtttcaatctgcacaaccgcggcatgctcagccttgccgaacgtctttgtgcgagcactggcagtgatcaggcatacctgctcaacagtggcagcgaagcctgtgaggcggcgatcaaactggcgcgcaaatggggccagctgcatcgcggcggcgcctcgcggatcattgtcgccagacaaggctgtcacggacgtagtctggcgacgatttcggcgtcggacagttgcaacctgcacaaccgtttcgcaccgttgctgcccggtttcgatccggtaccgttcaatgacctgccggcgctgcatgcagcagtggatgcgcagaccgtagcaatcatgctcgaaccgatccagagcgatgccggagtaatccctgcgaccgagcattacctcaagggtgttgaacgcctctgccgtgagctggggattctgctgattctcgacgaggttcagaccggcatcggccgttgtggcaccttactcgccgaacagtcctacggcgtgcgcgccgatatcgtcgtgctcggcaaaggcctcggcggcggtgttccactggcggcgctgctggcgcgaggcaaggcctgctgtttcgattctggcgagctgggcggtactcatcatggcaacgcgctaatgaccgccgcagggctggtggtgctcgacagcgtgcaggaccgtgcattcctcgaacagatccgcgacaactgccagcatctgcgcgaagggctcgcccgtctggcctatcgttatgagcatggcgagttacgcgggcaggggctgttctggggactgagcctgtcggaagactccgccgaggccgttgtcaaagccgcgcttcacgaaggtttgctgctcaacgccccacaagccgactgcctgcgcttcacaccggcgctcaacgtcagcaaggccaacatcgacgaaatgctcctgcgcctggcccgcgccttctcccgggta

SEQ ID NO: 37683 - DNA, 1776 bp, Pseudomonas fluorescens
atggctgactacaaagcgccgctgcgcgatatgcgcttcgtcctcaatgaagtgttcgaagtcgccaaactctgggccgaactgccggccctggccgagaccgtggacgcggaaaccgttgaagccattctcgaagaggccggcaaggtcaccagcaaaagcattgcgcccctgagccgtgccgccgatgaagaaggctgccactgggccgacggtgccgtcacgacgccggccggttttccacaggcttatcagacttatgccgaaggcggctgggtcggtgttggcggtgatccggcctacggcggcatgggcatgccaaaagctgtctcggcccaggtcgaagaaatggtcaactccgccagcctgtccttcggtctgtacccgatgctgaccgccggcgcttgcctgtcgatcaacgcccacgccagcgaagaactgaaagccgcttacttgccgaacatgtacgccggtgtctgggctggttccatgtgcctgaccgagccacacgccggcaccgacctgggcatcattcgcaccaaggccgaacctcaggctgacggttcctacaaggtcagcggcaccaagatcttcatcaccggcggtgagcacgacctgaccgaaaacatcattcacctggtgctggccaaactgccggacgcaccggcggggccgaaaggcatttcgctgttcctggtgccgaagttcatggtcaatgccgatggcagcctgggcgcgcgcaacccggcgaactgcggttcgatcgaacacaagatgggcatccaggcgtccgctacgtgcgtgatgaacttcgacgaagccgtgggttacctggtcggcgagccaaacaagggcctggccgcgatgttcaccatgatgaactacgagcgtctgggcgtcggcatccagggcctggccaccggcgagcgctcgtaccagaacgccatcgaatacgcccgtgaccgcctgcaaagtcgttcgccgaccggcgcgcagaacaaggacaaggtggccgacccgatcattgtccacccggacgtgcgtcgtatgctgttgaccatgaaagcctcgaacgaaggcggccgtgcgttctccacttacgtggcgatgcagctcgacaccgccaagttcagcgaagacgccgcgacccgcaaacgtgcggaagatctggtggccttgctgacgccagtggccaaggcgttcctgaccgatcttggactggaaaccaccgtccacggccagcagatcttcggcggccacggctacatccgtgagtggggccaggagcaactggtgcgtgacgtgcgcatcacccagatctacgaaggcaccaacggcattcaggcgctggacctggtggggcgcaagatcgtcggcagcggcggcgcgttctacaaactgttcgccgacgagatccgccatttcaccgcaaccgccagtgccgatctgggcgagttcaccaagccgctgaatgacgccgtcgacaccctcgacgagctgacctcatggctgctggaccgggcgaaaaccaacccgaacgaaatcggcgcggcgtcggtcgagtatctgcaagtattcggctacaccgcttacgcgtacatgtgggcgctgatggccaaggcgtcgctgggcaaagaagcgcaggacgatttctacgcgagcaagctcggcacggcgcggttctatttcgcccgtctgctgccgcggattcactcgttgagcgcgtcggtgaaggccggcagcgagtcgctgttcctgctggacgctgcgcagttc

SEQ ID NO: 37684 - DNA, 1161 bp, Pseudomonas fluorescens
atgtctttcgatctcgccgcacgccttgctgcccgtcgtgccgacaatctctatcgccagcgaccgctgcttgaaagcccgcaagggccgcaagtggtggtcgacggtcagccgctgctggcgttctgcaacaacgattacctggggctggccaatcatccgcaagtgatcgaagcctggcgcgccggtgcctcgaagtggggcgtcggcggcggtgcctcgcatctggtgatcggccacagcggcccgcatcacgaattggaagaagctctggcagacctcaccggacggccgcgcgcgctgttgttcaccaccggttacatggccaatctcggcgcggtcacggcgctggtcgggcagggcgatacggtgctcgaagaccggctcaatcatgcgtcgttgctggatgccggattgttgtccggcgcgcgcttcaatcgttatctgcacaacgacgccgacagcctcgccaagcgtctggagaaagccaccggcaatacgctggtggtcactgacggcgtgttcagcatggacggcgacctcgccgatctgccggcgctggcccgggaaactaaagcgaaaggcgcctggctgatggtcgacgacgcccacggtttcggcccgctgggggcaaacggtggcgggatcgtcgagcatttcggtttgagccaggaagacgtgccggtgctggtcggcacgctcggcaaagcgttcggtacggctggcgcctttgtggccggcagtgaagagctgatcgaaagcctgatccagttcgcccgtccgtacatctacaccaccagccagccgccagcgctggcctgcgcaaccttgaagagtctggagctgctgcgcagcgaacactggcgtcgcgagcatctgcagacgctgatccgccagttccgccacggcgccgaacagatcggtctggaacttatggacagcttcacgccgattcagccgatcctgatcggcgatgccggtcgcgccgtgcgtctgtcgcagatgctgcgcgagcgtggactgatggtcaccgcgatccgcccgccgaccgtgcctgccggcagcgcgcggttgcgggtgacgctgaccgccgctcacagcgaggcacaggtgcagctattgttggaaggactggccgattgctttgcgcaactcaagtcg

SEQ ID NO: 37685 - DNA, 1884 bp, Pseudomonas fluorescens
atgcccacgacgtttcatgagattccccgcaagcgcccgaccacgcccctgctcgaccgcgcgaacacgccggacggcctgcgccggttaggcgaagccgagctggaaaccctggctgatgagttgcgcctggaattgctctacacggtcggccagaccggtgggcacttcggtgccggcctgggcgtcatcgagctgaccatcgcgttgcattacgtcttcgacaccccggacgaccggttggtgtgggacgtcggtcatcaggcctatccgcacaagatcctcaccggtcgtcgcgagcgcatggaaaccctgcgccagaaggacggcatcgccgccttcccgcgccgttccgagagcgagtacgacaccttcggcgtcggccactccagcacctcgatcagtgccgcgctgggcatggccatcgccgcccgcctgcagaacagcgatcgcaaggcgattgcggtgatcggcgacggcgccctgaccgccggcatggccttcgaggcgctgaaccacgcgccggaagtcgacgccaacatgctggtgatcctcaacgacaacgacatgtcgatctcgcgcaacgtcggcggtctgtcgaactatctggcgaagatcctttccagccgcacttacgcgagcatgcgtgagggcagcaagaaagtgctgtcgcgcctgcccggtgcctgggaaatcgcccgtcgtaccgaagagtacgcaaaaggcatgctggtccccggcaccctgttcgaagaattgggctggaactacatcggcccgatcgacggccacgacctgccgaccctgatcgccaccctgcgcaacatgcgcgatctgaaaggcccgcagttcctgcatatcgtcaccaagaagggcaaaggcttcgcaccggcggaagtcgacccgatcggttaccacgccatcaccaaactcgaaccgctggacgccccggccgctgcgccgaaaaaggccggcgggccgaagtattccggcgtgttcggtgagtggctgtgcgacatggccgctgccgacccgcgtctggtgggcatcacccccgcgatgaaggaaggctcggatctggtggcgttcagcgaacgcttcccgctgcgctacttcgacgtggcgattgccgagcaacacgccgtgaccctcgccgccggcatggcctgcgaaggcgcaaaaccggtggtggcgatctactcgacattcctgcagcgcggttatgaccagttggtgcatgacgtcgcggtacagaacctcgacgtgctgttcgccatcgaccgcgccggtctggtgggcgaagacggcccgacccacgccggcagtttcgacctgtcgttcctgcgctgcatcccgggcatggtcatcatgaccccgagcgatgaaaatgaactccgcaagatgctcaccaccggccacctgtacaacggcccggcggcggtgcgttacccgcgcggcaccggcccgaacgcgaccatcgagaaagacctcgaaccgatcgagatcggtaagggcgtggtacgtcgtcagggcagcaaggtcgccctgctggtgttcggcgtgcaaatggccgaagccctgaaagtcgccgagacgctggacgcgaccgtggtcgacatgcgtttcgtcaaaccgatggacgaagcgctggtacgcgagatcgccaacagccacgacctgctggtgaccatcgaagagaacgcgatcatgggcggcgccggtggcgcggtcagcgaattcctcgcccgcgagaacatcctcaagtcggtgctgcacctgggcttgccggacgtttacgtcgagcacgccaagccggcgcaaatgctggccgagtgcggactggatgaagtggggatcgaagcggcggtgcgggagcgcctggag

SEQ ID NO: 37686 - DNA, 885 bp, Pseudomonas fluorescens
atgattgcagcgtattcggccaccagccaggcacgggtcaatgcggcactggaaaccctgttcaacgctccgctgccagaactggcgcgcctttatgaagccatgcgctacagcgtgatgaacggcggcaaacgcgtgcgcccattgctggcctacgcggcgtgcgaagcccttggcggcaaggccgaacaggccaacggcgcggcgtgtgcggttgagctgatccacgcgtattcgctggtgcacgacgatttgccggcgatggacgacgacgatctgcgtcgcggccagccgaccactcacaagaaattcgacgaagcctgcgcaatcctcgccggcgacggcttgcagagcctggcgttcagtgccctgctcgacccgcgcctgagcgacctgagcgcggacatccgcctgcagcaggtcacagcactggcgcacgcggcgggcccggctggcatggtcggcggtcaggccatcgacctcggttcggtcggcctcaagcttgatcagaaagcgctggaacagatgcaccgacacaagaccggcgcgctgatcgaagtcagcgtcaagctcggcgccctggccagcggctgtgccgagaaggatgaactcaagtccctgcagacttatgcacaggccatcggcctggcattccaggtccaggacgacattctcgacgtcgaaagcgataccgaaaccctcggcaaacgccagggcgccgacatcgcccgcgacaagccgacctacccggcactgctcggtctggacgccgccaaggcctatgcgctggaactgcgcgatcaggccctgcacgcgctgcgaccgtttgacgcggctgccgagccgttgcgcgatctggcccggtatatcgtcgaccggcgcaac

SEQ ID NO: 37687 - DNA, 1518 bp, Pseudomonas fluorescens
atgcgttacgctcaccccggtactgaaggcgccaaagtctcgttcaagagcaagtacggtaactacatcggcggcgagttcgtcgcgcctgtcaaaggtcagtacttcaccaacacctcgccagtaaatggccagccaattgccgaattcccgcgttccacggccgaagacatcgaaaaagctctggacgccgcccatgccgctgccgatgcctggggctcgacttccgcccaggcccgttcgctgatcctgctgaaaatcgccgaccgcatcgaacagaacctcgaaaccctggcgatcatcgaaacctgggacaacggcaaagccatccgcgaaaccctcaacgccgacatcccgctggccgccgaccacttccgttacttcgccgggtgtctgcgcgcccaggaaggcagtgctgccgagatcgacggcaataccgtcgcctatcacattcatgaaccgctaggtgtggtcggccagatcatcccgtggaacttcccgatcctgatggccgcgtggaaactcgccccggccctggccgccggcaactgcgtggtgctcaaacctgccgagcaaaccccgctgggcatcagcgtgctgctggaactgatcggcgacctgctgccgccgggcgtgctcaacgtggtgcaagggttcggcaaagaagccggcgaagccctggccaccagcaagcgcatcgccaagatcgccttcaccggctcgaccccggtcggctcgcatatcatgaagtgcgccgccgaaaacatcattccatccaccgtggaactgggcggcaagtcgccgaacatcttcttcgaagacatcatgcaggccgagccaagcttcatcgaaaaagccgccgaaggcctggtgctggcgttcttcaaccagggcgaagtctgcacctgcccgtcccgtgcattggttcaggagtcgatctatccgcagttcatggaagcggtgatgaagaaagtcagccagatcaaacgtggcgacccgctcgacaccgacaccatggtcggcgcccaggcgtccgagcagcaattcgacaagatcctgtcgtacctggaaatcgccaagggcgaaggtgccgaactgctgaccggcggcaaggtggaaaaactcgagggcagcctggcgaccgggtattacatccagccgacactgctcaagggcaccaacaagatgcgggtgttccaggaagaaatcttcggcccggtagtgagcatcaccacgttcaaggacgaagccgaagccttggcgattgccaacgacaccgagttcggcctgggcgccggcctctggacccgcgacatcaaccgcgcctatcgcatgggccgcgccatcaaggccggtcgtgtgtggaccaactgctaccacctgtacccggcgcacgccgcgttcggcgggtacaagaagtccggcgtcggccgtgaaacccacaagatgatgctcgaccactaccagcagaccaaaaacctgctggtgagctacgacatcaacccgctgggcttcttc

SEQ ID NO: 37688 - DNA, 1254 bp, Pseudomonas fluorescens
atgactgagtccgttcttgactacatgacccgattgggtcgcgccgcccgcgaagcctcccgcgtcatcggccgtgccagcaccgcgcagaaaaaccgcgccctgctggctgccgccaatgccctggacgccgctcgcgccgagcttgcggcagccaatgaacaggatctggccaccggtcgcgccaacggcctggagccggccctgctggaacgtctggaactgaccccggcgcgcatcgacggcatgatcgtcggcctgcgtcaggtcgcagcgctgccggatccggtcggcgctatccgtgatatgagcttccgtccgtcgggcattcaggtcggcaagatgcgcgtgccgctgggcgtgatcgggatcatctacgaatcccgtcccaacgtgaccatcgatgccgccagcctgtgcctgaagtccggtaacgcgaccatcctgcgcggcggttccgaggcgattcattccaaccgtgcgatcgctgcctgcatccagcgcggtctggccgcagccgaactgccggctgccgttgtgcaagtggtggaaaccaccgaccgcgccgccgttggcgcgctgatcaccatgcccgagtacgtcgatgtgatcgtcccgcgcggtgggcgtggcctgatcgagcgcatcagtcgtgacgcccgggtgccggtgatcaagcacctggacggcatctgccacgtctatgtcagcgaacacgccgacctgccgaaagcccagcgcattgccttcaatgccaagacctatcgctatggcatctgcggtgcgatggagaccttgctggtcgatcaacgtgtggcgaaggatttcctgccgtcgatggccaaacagttccgcgaaaagggcgtcgagctgcgggggtgtgaacgcacccgggcgatcatcgaggccgtagccgcgaccgaagaagactggagcaccgagtacctggcgccgattctgtcgatccgcgtggtggatggcctggatcaggccatcgagcacatcaaccatttcggctcccatcacaccgactcgatcgtcagcgaaaacctcgccgacacccgccagttcgtggctcaggtcgactcggcgtcggtgatgatcaacaccccgacctgcttcgccgacggattcgaatacggattgggtgccgagatcggcatttctactgataagctgcacgcccgtggcccggtgggcctcgaagggctgacctgcgagaagtacatcgtggtcggtgatggtcagttgcgc

SEQ ID NO: 37689 - DNA, 1281 bp, Pseudomonas fluorescens
atgtctcgttccgaaaccctgtttgccaacgcccagaaacacattcccggtggcgtgaactcgccggtacgcgcgttcaagagcgttggcggcacgccgctgttcttcaagcacgccgaaggcgcctacgtcactgacgaagacgacaagcgttatgtggattacgtcggctcgtggggcccgatgatcctcggccacagccacccggacgtgctggacgcggtgcgcaaccagttgcagcacggcctgtcctacggcgcgccgaccgcgatggaaaccgagatggccgacctggtctgctcgctggtgccgtcgctggagatggtgcgcatggtcagctccggcaccgaagcgaccatgagtgcaatccgtctggcccgtggcttcaccggccgcgacagcatcatcaagttcgaaggctgctaccacggtcactccgacagcctgctggtcaaggccggttccggtgcactgacccaaggcgtaccaagctctgccggcgtacccgcagcgttcgccaaacacaccctgaccctgccgttcaacgacatcgacgccgttgaaaaaatgctcgccgaagtcgggcaggacgtggcgtgcatcatcgtcgagcccgtggccggcaacatgaactgcgtaccgccggcaccgggtttcctcgaaggcctgcgcagcctgtgcgacaagcacggcgtggtgctgattttcgacgaagtgatgactggtttccgcgtcgccctcggcggcgcccaggcttactacggcgtaaccccggacctgaccaccttcggcaagatcatcggcggcggcatgccggtcggttgcttcggcggcaagcgcttgatcatggagcgcatcgcgccgttgggcccggtctatcaggcgggcaccttgtcgggtaacccgctggcgatggctgccggcctgaccaccctgcgtctgatcagccgtccgggcttccacgccgagctgaccgactacaccacgcgcctgctcgacggcctgcaacagcgcgccgatgccgccggcattccgttcgtgaccacccaggcgggcggcatgttcggtctgtacttcagtggtgccgacgacattgttacttttgaagacgtgatggccagcgatgcggcgctgttcggtcgcttcttccacctgatgctggaaggtggcgtatatctcgcaccgagcgctttcgaagccggtttcacctcgatcgcccatggcgaagccgagctgaaactgaccctcgacgccgccgaacgcgccttcgccaagttgaag

SEQ ID NO: 37690 - DNA, 2336 bp, Pseudomonas fluorescens
tatttgttgatgttgctgttctgcttgcccctcctggcaagcgccgtcgagttcgacgagttcacccagagcctccccctgggtcgatccctgcaagtgttcgaagacccgagcggtcaggcgagcattgccgacgtccgcgcgcaagccgccgccggaaacttcaaaccccatgacaaagccacgctcaatgccggttattcgcgctcggcgttctggctgaagatcgacctgcattaccgcccgaccaatccgtcggcgcagcgcagctggttgctggagctggcgtatccgccgctcgatcatctcgacctgtatctgcccgatgcggccggcgactaccgtctggtgcggcagaccggggacgcctgccgttcgccagtcgcgaaatccgccagaacaattacctgttcgacctggcgttcaagccggatcagcagcgaaccgtttatctgcggttgtccagcgaaggctcgatccaggcgccgatgacgttgtggtcgagcaccgcgtacctcgaagaccagccggtgcgcctgtacgtgctgggggtcatctatggcgtgctgctggggatgctggtctataacctgttcatctacctcagcgtgcgcgataccagttacctctattacatcttctatatcgcttcgttcggcctctatcagctgtcggtcaatggcgcggcggtcgagtatttctggccggacaacccatggtgggccaacgccgccacgccgttcttcatcggttgcgcggggctgttcggcagccagttcgcccgcagtttcctgcagaccaggaaccacagccgctggctcgatcgcctgctgatcgccctgatcgcgttcggcgccatggtgatcggcctctcgttgatgaccagttatggcctggccctgcgtctggcgacgaccctggcgctgaccttcaccgtggtgatctttgccgccgggatcctcgcctggtggcgcggcctgcgggtggcgcgttatttcatcattgcctggtcggcgttcctgatcggcggcatcgtcaacaccatgatggtgctgggcctgctgccgaatgtgttcctgaccatgtacgccagccagatcggttcggccattgaagtggcgctgctgtcgctggcgctggccgaccgcatcaacgcgatgcgcgaacaacaggcgcagaccctgttcgatgcgggccagaagctcgaagtgctcaaccagcaactggcccatagcaacaagctcaaggacgaattcctcgcgaccctgactcacgaactgcgcacgccgatgaacggtgtgatcggttcgctggagctgatgcagaccgtcgaactcgatccggagctggagcaataccagcagaccgccgccggttcggcgcgggacatgatgcgcatggtcaacggcatcctgaccctgaccgaattgcaggccggcaagctcaaggccacaccgggcagtttcagcctgcgcggggtggtcgaggcgttgcggatgcagttcgatggcaacgcttcgagcaagtcgctggacttcaaggtcgacgtgctgccgaccctgccggatcgcctgcatggcgacagcgccaaactcgcgcaatgcctggagtgcctgctggacaacgcgatcaagttcacccgcgtcggcggtctggcattgcgggtcaccggcaaaccgtccacggacaatcggctggcgctgtccttcgcggtgatcgacaccggcatcggttttaccgatctgggcgaggccacgctgtatcagcggttcttccagctcgacggttcgatgacccgcgaatacggcgggctgggtgtcggtctggcgatctgccgtcaattggtggaactgctcggcggcaagctcacgcaccgttccgaaccggggagtggcagccgctttcaactggatgtcgagtttgagttgccggaagtggaagccgtgcccgcgttcagccgcgacaccgtgcgtgcgccgcaggattgcaccgtgttgctggtggacgacaacagcgtcaatcaattggtgatgcgcggcatgttgctcaagctcggtttccgggtgcgcaccgccgaccacggcgcggcggcgctcgactgtttgcagcgcgagcgcttcgatgccgtgctgatcgactgccagctgccaccgctcgacggggcatcgctgtgttgccagatccgtgacctgccgggatgcgcccatctgccggtgttcatgatcgcgctgggggcggatcgcgagcattgtgcgtcgggtggctcgatcgactacctgagcaaaccggtgaaattcgaggatctgcaggtggcgatgcagcggcgggtgttgagt

SEQ ID NO: 37691 - DNA, 2505 bp, Pseudomonas fluorescens
tctttgccgatcgacgaagttttacccgccctgcgtgaagcgttggcgacacgccacgaagccgtgctcgaagcaccgcccggcgccggtaaaaccacccgcgtgcccttggccctgctcaatgaagcatggctgaacgggcagaccattctcatgctcgaaccgcgtcgactggccgcgcgcgcagcggcggaacggctggccagcgagctgggcgagaaggtcggtgaaaccgtcggttatcgcatccgcctcgacagcaaggttggccccaacacccgcatcgaagtggtcaccgaaggcatcctcacccggcgtttgcaggacgacccggcactggaaggcgtgggtctgctgatcttcgacgaatttcacgaacgcagcctcgacgccgatctggcgctggccctcagtctgaacggtcgcgagctgtttcgagctgaacaaccgctgaagattctgctgatgtccgccacccttgaaggcgaacgtctggccggtttgctcgacaacgcgccaatcctgcgcagcgagggccggatgttcccggtgacgatgcgctggggccggccgtttcagcccggcgaatacatcgatcaacgtgtcacgcaaacggtgctcgaagcgctgcacgatgaaaccggcagcctgctggtgttcctgccggggcaggcggaaatccggcgggttcatcagcaactggcggacgccattggtgagcgcagcgacgtgatgctctgcccgttgcatggcgaactcgacctgaatgcccagcgtgccgccatcgacccggcgccggccggccagcgcaaagtggtgctggccaccaacatcgccgagaccagcctgaccatcaacggcgtgcgcgtggtgatcgacgccgggctggcgcgggtgccgcgtttcgaccccggcagcggcatgacccgcctcgacacccaacgcatctccaaagccagcgctacccagcgtgccggccgggccgggcgtctggaaccgggcgtgtgttatcgcctgtggtcgcaggatcagcatgaacaactcgcggcttatggcagtgcggaaatcctttcggcggatctcgcagggctggcgttgcaactcgggcgctggggcgtggcgccgagtgatttgatctggctggatgtgccgccagcggccgcttatgcacaggctcaggatctgttgcagcgcctcggtgcgctggacggtgaaagcctgaatcgccacggtcaggccatggctgaattgccggcgcacccgcgcatcgctcatttgctgttgcgcggtcaggctctggggctgtcgaacatggcttgtgatgttgccgcgttgctcggcgagcgcgacattttgcgcggtgcgggggcggatctgcacagtcgtctggtgctgctgtccggcgaagaacgcgcggcccgcggtgctcagggcggcgtgcagcgtgcccggcaactggcgcggcagtatcacggctacctgcgcggtaaggccagcgaaccggtcgccgacccggatcatccacgctggctcggcgcgctgctggcgctggcctacccggaccgcgtcgcccagcagcggcgggccggtggcgccgaatatcgactggccaacggccgcgccgcgctgttcgccgaacccgacagcctgatgaaggaaccgtggatcgtcatcgccgacctcggcagtcgccaaggtcagcgtgaagagcggatttatctggcggcggatttcgatccggcgctgttcgattcggtgctggcggaacaggtgcacaacgtcgatcaactggactgggacgaacgcgaaggcgtgctgcgcgccgagcgtcagcgcaaggtcggcgaactgatcctcagccgcgagccgctgaccggtctcgacgaaaacgcccgcagtcaggcactggtcaatctggtgcggcgcaaggggctggagctgctgccgtggaccccggaactgcgccagtggcaggcgcgagtcgcgttgctgcgtcagctcgacctggacgccaagggcgacagccaatggccggatgtcagcgacgcaacgttgctgaaaacactcgaagactggctgatgccttacctgggcaaagtctcgcgcctcagccatttcgccaacctcgacctgtcgagtatcgtgcgtaatctgctgccttggccactgccgcaacagcttgatgaacaggcgccccatcacctgagcgtgccgtcaggctcgtcgattcgcctcgactacagcgagcaaccaccgattctcgccgtgcgtttgcaggagctgttcggcctcgccgacacaccgcgcatcgccggcggtcggcaggtggtcaagctgcacctgctgtcgcccgcacggcgcccggtgcaggtgacgcaggatctggccaacttctggcgcagcacctatgccgaggtgaagaaggatctgaaggggcgctatccgaagcattactggccggatgatccgctggtggctgaagccaccgcacgagccaaaccgcgc

SEQ ID NO: 37692 - DNA, 1488 bp, Pseudomonas fluorescens
gtgttcgagcttgcagactggcagcgcaaggccgctgaattgagctatccgtaccaggccgtgatcgacggcaaattgcgtgcggcgcagtcggggcagacctttgccgcgatcaacccggccaccggccagctgctggcaaacgtcgccgcgtgcggtgaagaagacgtcgatgcggcggtgcagaatgcgcggcaggtgttcgaggccggcacctgggccgggcgttcaccgaccgagcgcaagcaagtgctgctgcggctggcggatctgattctggcccatcgcgaagagctggcgctgctcgattcgctgaacatgggcaaaccggtgatggacgcttacaacatcgacgtgccgggcgccgccggggtgttccgctggtacgccgaaagcctcgacaaactctacgatcaggtcgcgccaagcgcctcgaatgtgctggcgaccatcacccgcgaagcgctgggcgtggtcgctgcggtggtgccttggaatttcccgttggacatggccgcgtggaaactcgcgccggcgctggcggcgggcaactcggtgattctcaaacccgccgagcaatcaccattctctgcattgcgcctggccgagctggcgcttgaagccgggctgccggccggtgtgttgaacgtgctgccggggctcggcgaacagaccggcaaagccttgggcttgcacccggatgtcgattgcctggtgttcaccggctcgacccaggtcggcaaatatttcatgcagtattccgcgcagtcgaacctcaagcaggtgtggctggagtgcggcggcaagagcgccaacctggtgttcgccgactgccaggatctggatctggcggcgcagaaagccgcgttcgggatcttcttcaatcagggcgaagtctgctcggccaactcgcggttgctggtggagcgctcgattcatgacgagttcgtcgagcgactgaaggctcaggccgaacgctggcagccgggcgatccgctggacccggcgagtgcggccggggcgattgtcgacacccgtcagaccgaaagcattctgcgcttcatccaccaggccgagcgtgaaggcgcgacccgcgtctgcggcgggcggcagctaagtttcaacggttcggacaacttcgttcagccgacgattttcaccgacgtgcagccgcacatgaccctgtttcgcgaagaagtgttcggcccggtgctggcggttattccgttcgatgacgaggcccacgccttgcacctggccaacgacagcgtctacggtctggcggcgtcgctgtggaccgatgatctgcaccgcgcgcaccgggtggcgcggcaattgcgagccggtacggtgtcggtcaacagcgtcgatgcgctggacgtgaccgtgccgttcggcggtggcaagcaatcgggtttcggccgcgatctgtcgctgcactcgttcgacaaatacacccagttgaaaaccacctggtttcaactgcgc

SEQ ID NO: 37693 - DNA, 1368 bp, Pseudomonas fluorescens
atgaccacctcacgtgaaacccgcgactaccaggccgccgatgcagcgcaccacattcatgcgttcgtcgaccagaaagccctcaacgacgaaggcccacgggtgatggtgcgtggtgatcgcctgcatctgtgggacaacgacggtcggcgctacctcgacggcatgtccgggctgtggtgcaccaacctcggctacgggcgcaaggatctgaacgccgccgcgagccggcaactggagcagttgccgtactacaacatgtttttccacaccacccacccgcaggtgatcgagctctccgagctgctgttcagcctgctgccggggcactacagccacgcgatctacaccaactccggctccgaggccaacgaggtgctgatccgtaccgtacgccgttactggcaggtgctgggcaagcccgagaagaaaatcatgatcggccgctggaacggctatcacggttcgaccctggccgcgacggccctcggcggcatgaagttcatgcacgaaatgggcgggatgattcccgacatcgcgcacatcgacgagccgtacttcttcgcccacgaaggcaatctgaccccggcggaattcggtctgcgggcggcgcagcaactggaagcgaagatcctcgaactgggcgccgacaaggtcgccgggttcatcgccgaaccgttccagggcgcgggcgggatgatcttcccgccggaaagctactggccggaaatccagcgcatctgccgccaatacgacgtgctgctgtgcgccgatgaagtgatcggtggcttcggtcgcactggcgaatggttcgcccacgaatacttcggtttcgagccggacaccctgtccatcgccaagggcttgacctccggttacatccccatgggcgggctgatcctgtcgaagaaaatggccgacgtgctggtggagcagggcggtgtgttcgcccacggtctgacctattccgggcacccggtggcggcggcggtggcgattgccaacctcaaggcgctgcgcgatgaaggcgtggtgacgcgggtcaaggatgacatcggcccgtacctgcaacagtgtctgcgcgaggtgttcggcaatcacccgttggtgggcgatatccagggcacgggcatggtcgcggcgctgcaactggccgaagacaaggccacgcgcaagcgctttgccaatgagaacgacatcgcctggcgctgccgcacgatcggttttgaagagggggtgatcattcgctcgacactggggcggatgatcatggcgccggcgctgattgccagtcgtgaagagattgacgaactggtgggcaagacgttgaaagcgctggatcgtaccgcgcaggaatacggtcggctc

SEQ ID NO: 37694 - DNA, 627 bp, Pseudomonas fluorescens
gtcgccgcaccggcccacgccgcgccaaggttgcaggtggacaaggtcagcctgcgctacagcaaacccggcggcggtacattcaccgcgttggaagaagtgtcgttcgaggtgccggatcagcagttcgcggtactggtcgggccgtcgggctgcggcaagtcgagcctgctgtacctcactgccggcctggccgagccgacctccggcgaaatctacgtcggcggccagcaagtgcagggccccggcgcggatcgcgggatggtgttccagagctacacgctgtttccgtggctgacggtgcggcagaacgtcgagttcggcctcaagcgccggggcatgccggcggccaagcgcaaggagattgtcgatcactatgtgcacgaagtcggcctgtcgggatttgccgacaactacgccaagcagctctccggcggcatgatgcagcgggtggcgattgcccgggcactggccaacgatccgcagatcctgctgatggacgaacccttcggcgccctcgacagccagacccgcctgcaaatgcagcagctgttgttacgggtgtggggcaacagcaagaagaccgtgctgttcgtcacccacgacatcgacgaggcgatcctgctt

SEQ ID NO: 37695 - DNA, 753 bp, Pseudomonas fluorescens
ctcatcactggcgcctctaccggcattggcgccgtctatgccgaacgcttcgccaaacgtggtcacgatctggtactggtcgcccgcgatcaggcccgcctggacacactggcagcgcgcctgcgcagcgagcacgacgtcgccgtcgatgtcatcccggcagacctgacccaactcgccgatctgaccaccgttgaaagccgcctgcgcgacgacgcccgcatcggcattctcgtcaataacgccggcgccgcgctgtccggccacttcgtcgaccaaagcaccgacagcgtcgcgcaactggtggccctcaacaccacggcgctggtgcggctcgccagcgccatcgccccacgcctggccaaggccggcgacggcgcaatcatcaacatcggttcggtggtaggcctggcgccggagttcggcatgagcgtctacggtgcgaccaaggccttcgtgctgttcctgtcccagggcctgagcctggaactctcgccgcagggcgtctacgtgcaagccgtgctacccgccgccacccgcacggaaatctgggatcgctccggcgtcgacatcaacaccctgagcgaaatcatggaagtgggtgatctggtggatgccgcactggtcggttttgatcgtcgcgaacctgtgaccatcccgccgctgcacgaagccgagcgctgggatgacctgcagggcgcacgccagggcctgctgggacaaatccgccagtctgcggttgcccagcgctat

SEQ ID NO: 37696 - DNA, 954 bp, Pseudomonas fluorescens
cgcattggcgaagcgcccgcccccgcagtcggtgcccacgacgtcttgatcgaggtccatgcgagcagtgtcaacgtgctggattcgaagatcagcaaaggcgagttcaagctgatcctgccctacgcctttccgttgatattgggcaatgacctggcgggtgtcgtggttgaagtcggcccgcaggtgacacgcttcaaaccgggagacgaggtatacgctcgcccgcccgaagcgcggatcgggacgttcgcccaattgatcgctgtgaacgaaaacgcggtcgccctgaaacctgccaataccgacatggcacaagccgcatccctgcctttggttgcactgaccgcctggcaagtactggttgaaaccgcccggctgcaaaagggccagaaagtgctgattcacgcgggttccggcggcgtcggcacagttgcgattcagcttgccaaacacctcggtgcgtttgtcgccacaaccaccagtaccgccaatgtcgaatgggtcaaggcgctgggggccgatctggtgatcgactacacacagcaggacttcgcaagtgtcctgcatgactacgacgtggtgctgaacagcctcggcgccgacgtgctggagaagtcactcaaggtcctgaagcccggcggccaactcatttccatctcgggcccacccactgtgcagttcgcgagggagcatggattgtcctggccattgcagcaagtcatgcgcctgctgagccttggcattcgtcgcaaagcgcgcaagcaggatgtcagctacgcgttcgtgttcatgcgggccaatggcgctcaactgcaacacatcaccgcgctcgtggaggacgggatcatcaaacccgtggtcgatcgctccttcctctttgaatcaacggccgaggcattgaagtacgttgagcggggacgcgccaagggcaaggtcgttgttgcgctcaaa

SEQ ID NO: 37697 - DNA, 711 bp, Pseudomonas fluorescens
ggtaaagtcgcactggtcactggcgcggccagtggcatcggcaaggccatcgcactgctgctgcatgcccgcggcgcccaggtcattgctgaagatataaaccctgaggtggaagcactggcccgccccggcctggtccccctggtggccgacatcactcaggacggggcagccgaacgcgcggtcgccctggccgtcgagcaattcggacggctggacattctggtcaacaacgccggcatcatcatcaacaaactggtcatcgacatgacccgcgaagactgggaacgcattcaggcggtcaacgccacggcggcctttttgcatagccgggaggcggtcaaagcgatgatgcccaacaagtccggatcgatcgtcaacatcgcgtcctacgcctcctatttcgccttccccaccattgccgcctacaccgcctccaagggcgcgctggcccaactgacgcgcaccctggcgcttgaagtcattggccacggcatccgggtcaatgctgtcggtgtcggcgatgtggtgaccaacatccttaacaatgtggtcgacgacggccctgcctttctcgcccaacatggggaagcggcaccgatcggccgcgccgcccaaccggaagaaatcgccgaagtggtcgcgttcatcgcctcggatcgggccagtttcatggtcggttcggtggtcatggccgacggcggcatgacg

SEQ ID NO: 37698 - DNA, 738 bp, Pseudomonas fluorescens
agacttgaaggcaaaatcgcactgatcactggcggcaccaccggcatcggcctggcttcggcgcaggaattcgtcgcccagggcgccacggtattcatcaccggccgccgtcaggccgaactggacaaagcggtcgccgccatcggcccacgggccatcggcattcagggcgatgtggcgaagctggaggatctggatcgcatctacagcgagatttccgccaaggccgggcacctcgacatcctgttcgccaacgccggcggcggggacatgctgccgctgggctcgatcactgaagagcacttcgaccggattttcgacgccaacgtgaagggcacgctgttcaccgtacagaaggccttgccgctgctgcgcgatggcgcctcgattctgctgacctcgtcgaccacgtcggtgcagggcacggagaacttcagcgtctacagcgcgagtaaagcggcggtgcgcaacttcgcccgctcatggttgctggacctgaaaccacggcgtatccgcgtcaacgccatcagccctggcccggtgcgcacgccagggctggcagggctggtgccggcggaacacacccaggggctgttcgatcaactggcgtctatcgtgccgatcgggcgtctgggcgagccgagcgagattgccaaggccgcgctgttcttggcctcggatgacagcagcttcgtcaatggcatcgagttgttcgtcgaccgcggtactgcgcagatc

SEQ ID NO: 37699 - DNA, 1272 bp, Pseudomonas fluorescens
cgcccctcggcctgtccggggttgctgcgtatcgtccaggcgctggatggtggcatctgccggatcaagctcgatggaggttcgatcacggccgatcaggccgatgcggtggccaatgccgccgagcggtttgccggcggggcgatcgaggcgacaaaccggggcaatctgcagattcgcgggatcggcgaccagtccgccgcgctgatcgacagcctgctggccgccggtctcgggccgcgaaccgccgccggcgacgacgtgcgcaacctgatgctcagccccgccgccggcattgaccgacagatgcgcttcgatacccgtccattggccgggcagatcctcgagaccctgcaaagccatccgcgcttccacgagctgagcgccaagttcgccgtgcaactggatggcggtgaagcgctggcgatgctcaaacatccccatgatctgtggttgtcggcattcgaaagcggtgaaaacacgctgttggcgtttggcctggcgggttgcccgacggagcgaccgttggccgccgtggcgcttgtggacggacatgcgctggtggtcgcggtgctggagttgttccttgatctcgcccgaccggagcagacgcggatgcgccatctgctggatgaatgcccggcgccgctgttcctggaaaaactcggtcagcggatcagcctgaaagccgctggtgattggcagcgggcagccggaccggaagggttgcacctcggcattcaccctcagccatcggccggtcaggtctatgtcggtgccgcaccgccgctcggccgcctcggtccggacatgctgcgtggcgctgcgcaactggccataaccttcggcgacggcagcctgcgcttcaccccttggcagagtctgttgctgcccaatgtgcgggaaaccgatgcggttcaagtgctcgacgaattgggcaagctgaacctgctgacccatgtcgaagagcctttaacgcacctgatcgcctgcaccggcgccaacggctgcggcaaaggcctggccgacaccaaacacgatgcccgcctgctggctacgctgttgccacatgccgtggatgtgcacctgtccggctgcccgcgttcctgcgccgccgcacatcgggctgcggtgactctgctggcggtcggccccggtcactacgatctctattttcgcgatgcagcgctgccgggtttcggcgcgctgcacgctcacaaccttactatcgaagcggccgcgaccctgctcgccgcccgctcacggagcccc

SEQ ID NO: 37700 - DNA, 2766 bp, Pseudomonas fluorescens
ctcaggattgccataggcttcaccgtcacgctgttgaccttgctctgcatgctcccggcccaggccgcgcaaggcagtggctggtcggtattgcttgacgatcagggcaacctccagctgagcgacatccgctccgcccgctacaccaatcaattcagccccatcgagcttgaccgcctgaccgcggccgaacccgatggcgccttgtggctgcgtttcagactggcgcccggcaagcacgaacaagtgctgcggatcttcgcccccgacctgtcgcacctcaatctgtatgtactcgacggtgatcgactgatcgaacaacgcgacaccggcaccgctcagccccaggcggagcgaccgctgcccagcagcgatttcatgctgccgctgccccagagtgacaagcccctcgacgtctacctgcgactggtttccgatcaccagttgcgcccgtacatcaccctgcaagcggcggtgatggccgcggccaatcacaaccagacgctgatctacggcctgctgttcggctgtctggcgatgttgatcctgcacaacctgatccgctatgcctacacccgctcgcgcagcagcctgtggctcgcggtgtgtgaaggtctgttgagcctgagcctgttgctgttgctcaacctcgccggcccgtggttgccgaactggcacgcgatccagactcccggcgcctatctggccctgctgctgaccgcgcccgccggcctgatgttcgcctaccgtttcttcgccccgctcggcccgcatccgctgaacaagctgctgatcggcgacatcctgttcatcgtgatctgcagcctgttgctgttgttcgtcaacaccctgccgctgaacatcatcacctacgcgctggtggccctggccggcctgagcatgctgctggtgggtttctaccactggcagaaaggctaccgccctgcccggctgttcgttgccgcaatggtggtgttcaacatcggcacgctgatcatcctcccggccttgctggggctgaccctggtggcgccgcagggcctgatcatgaccctgatgggtttcatctgcatcagcggcctgttgatgagcatcgccctcggcgagcgtcaacgcagcatcaccgaaagccgtttcagcatcagccgcgacctcgcagcgagcaacgccgaaatcaacgccaaggccgagttcctggccaagatcagccacgaaatccgcacgccgatgaacggcgtactgggcatgaccgaactgctgctcggcacgccactgtcggtcaaacaacgcgactacgtgcagaccatccacagcgccggcaacgaactgctgaccctgatcaacgagatactcgacatctcgcggctcgagtccgggcagatcgaactcgacgatgtacagttcgatctcaacgcgctgatcgacgattgcctgagcatctaccgcgccaaggccgaacagcagaacgtcgagctcatcagtttcatccagccgcaagtgccacgggtcatcagtggcgacccgacgcgcctgcgtcagacgctgctgagcctgctggaaaacgccctgaagaaaaccgaagaaggcgaagtgctggtggtggtcgccctcgacgaacgcagcgccggcccacgcctgcgcattgccgtgcaggacagcggccagccgatggatcaggaagagcgcgacgcgctgatgcacgccgagttgcacagcaagcacttcctgtcggccaaccgcctgggcggcaacctcggtctggtgatcgcccgccaattgatccgcctgatgcagggcgagttcggcatcaagagcggcgccagccagggcagcacgctgtggctgactctgccgctggacccagatcgcctggagcatccgacctcggatctcgacagcccgctgcaaggcgcgcgcgtgctggtggtggacgacaacgacacctgccgcaaggtgctggtgcagcaatgcagcgcctggggcctgaacgtcagcgccgtgccgtcgggcaaggaagcgctggccctgctgcgcaccaaagcgcatttgcgtgattacttcgacgtggtcctgctggaccagaacatgcccggcatgaccggcatgcaactggcggccaagatcaaggaagacccgagcctgaaccacgacatcctgctgatcatgctcaccggcatcagcaatgcgccgagcaagatcatcgcgcgcaactcagggatcaagcgcatcctggccaaaccggtggccggctacaccctcaagaccacgctcgccgatgaactgaaccagcgcaatcgtggccaggtggtgttccagccacaggttgcgagccccgccgcgccggtcaaggtgccgagtgatttccgtattctggtggccgaagacaacaccatttcgaccaaggtgatccggggcatgctcggcaaactcaacctgcagcccgacaccgccagcaatggcgaagaagccttgcaggcgatgaaagcccagcgctacgacctggtgttgatggactgcgaaatgccgatcctcgacggcttctccgccacccagcaactgcgggcctgggaagtcggcaaccagcgcatccgcacgccgatcgtggcgctgaccgcgcacatcctcgccgagcacaaggaacgcgcgcgccaggccgggatggacgggcacatggccaaaccggtggagctgtcgcaactgcgcgagctgatcgagcactgggtggcccagcgtgatcagcagaaccgagcgacgacgcaaccgtcg

SEQ ID NO: 37701 - DNA, 1344 bp, Pseudomonas fluorescens
ttggaaaaagttctgatcgctaaccgcggtgagatcgccctgcggattctgcgtgcctgcaaagagatgggcatcaagaccgtcgccgtttactccaaggccgacaaagagctgatgcacctgggtctggcagacgaatccgtctgcatcggcccggcttctgccgcgcactcctacctgcacatcccggcaatcattgcggccgctgaagtgactggcgctaccgccattcacccaggctacggtttcctcgcggaaaacgccgactttgccgagcaggtcgagaactccggcttcgccttcatcggcccgaaagccgaaaccattcgcctgatgggcgacaaggtatcggccaagcacgcgatgatcgaagcgggcgtgccaaccgttccaggttccgacggcccgctgccggaagacgaggaaacggcgctgcgcatcggtcgtgaagtcggctatccggtgatcatcaaggccgccggcggcggtggtggtcgcggcatgcgtgtggtgcacaaggaagaagacctgatcgcctcggcaaagctgacccgctccgaagctggcgcggcgttcggcaacccgatggtctatctggaaaaattcctgaccaatccgcgtcacgtcgaagtgcaggttctgtccgacggccagggcaacgccatccatctgggcgaccgcgattgctcgctgcaacgccgtcaccagaaagttctcgaagaagcaccggcaccgggcatcgatgagaacgcgcgcaaggaagtcctggcccgctgcgtcaaggcgtgcatcgacatcggctaccgtggcgccggcaccttcgagttcctgtacgagaacggtcgtttctacttcatcgaaatgaacacccgtgttcaggtggagcacccggtttcggaaatggtcaccggtatcgacatcgtcaaggagatgctcagcatcgccgctggcaacaagctgtcgtatacccaggatgatgtggtgatccgcggtcactcgctggaatgccggatcaacgccgaagacccgaaaaccttcatgccgagcccgggcacggtcaagcatttccacgcaccaggcggcaacggcgttcgcgtcgattcgcacctgtacagcggttatgccgttccgccgaactacgactcgctgatcggcaagctgatcacttacggcgcgacccgcgacgaagccatggcccgcatgcgcaatgccctggacgaaatcgtggtcgacgggatcaagaccaacatcccgctgcaccgtgatctgacccgcgacgaaggcttctgcaaagggggcgtgaacattcactacctcgagcacaagctggctggcgagaagcac

SEQ ID NO: 37702 - DNA, 435 bp, Pseudomonas fluorescens
atggcaacgctactggtgctgcacggccccaacctgaacctgctcggcacccgggaacccgggacctacgggtcgaccaccctggcgcagatcaatcaggatctggaacgccgcgcccgtgaagccggccatcatctgctgtatctgcaaagcaatgccgagtacgaattgatcgatcgcatccacgccgcacgcggcgagggcgtggacttcattctgatcaacccggcagcatttacacacacaagtgtcgcattacgtgacgcgctgctgggagtgagcatcccattcatcgaagtgcatttgtccaacgtgcacaaacgcgaacctttccgccatcactcttacttctccgatgtagcggtaggagtgatctgcggccttggcgccagcggttaccgactggccctggaggctgcactagagcagcttgaa

SEQ ID NO: 37703 - DNA, 1890 bp, Pseudomonas fluorescens
tggacagttgcggacagccgcagtgtttacgggattcgccattggggggccgggtatttcgcgatcaatgacgccggtcgcgtcgaagttcgtccgaacggcccgagcagctcgcctatcgatctgttcgaacaagtcgaccagttgcgcaagagtggcttgtccctgccgctgctggtgcgtttccccgacatcctgcaagaccgcgtccgtcagctgaccggcgctttcgatgcgaacatcgagcgtctggaataccagagcaaatacaccgcgctgtacccgatcaaggtcaaccagcaggaagcggtgatcgagaacatcatcgccacccagaacgtttccatcggtctggaagccggctccaagcctgagctgctggcggtgctggcactggcgccgaagggcggcaccatcgtctgcaacggttacaaggaccgcgagttcatccgtctggcgctgatgggccagaagctcggtcacaatgtgttcatcgtgatcgagaaagaatccgaagtcggtctggtgatcgaagaagccgcctcgctgaaggtcaagccacaggtcggcctgcgcgtgcgtctgtcgtccctggcgtcgtcgaagtgggcggacaccggtggcgagaaatccaagttcggtctgtcggcggcgcaactgttgtcggtggtcgagcgcttccgcgcggcgggtctggatcagggcattcgtctgctgcacttccacatgggttcgcagatcgccaacctggccgattaccagcacggtttcaaggaagcgatccgctactacggcgagttgcgcaacctcggtctgccggtcgatcacatcgacgtcggcggcggtctgggtgtggactacgacggtacccactcgcgcaacgccagttcgatcaactacgacatggacgactacgccggtgtcgtggtcggcatgctcaaggagttctgcgacgcgcaggccctgccgcatccgcacatcttctccgaaagcggccgctcgttgaccgcgcaccacgcgatgctggtggtgcaggtgaccgacgtcgagaaacacaacgacgacgtgccgcagatcgagaacaaggaagcgctgccggaaaccgtgcagtggctggttgacctgctcggcccgaccgacatcgaaatggtcaccgagacctactggcgcgccactcactacatgagcgacgtggccgcccagtacgccgacggcaaactgaccctggccgagaaagccctggccgagcagtgctacttcgcggtgtgccgtcgcctgcacaactcgctgaaagcgcgtcagcgttcgcaccgtcaggtgctggacgaactcaacgacaagctggccgacaagtacatctgcaacttctcggtgttccagagcctgccggacacctgggcgatcgatcaggtcctgccgatcatcccgctgcaccgtctcgacgaagagccgctgcgtcgtgccgttctgcaagacctgacctgcgactccgacggcaagatcaaccagtacgtcgacgagcagagcatcgagaccagcctgccggtgcatgcgctgaacgaaggtgaagactacctgctgggcgtgttcctggtcggcgcctatcaggaaatcctcggcgacatgcacaacctgttcggtgacaccgactcggtgaacatctatcagaacgccgatggcagcgtgtaccacgccggcattgaaacccacgacaccatcgaagacatgctgcgttacgtgcacttgtcgccggaagagctgatgacccactaccgcgacaagtgcgccagtgcccgcatcagcgccagcgagcgcacccagttcctcgatgcattgcgcctgggtctgacccgctcctcctacctgtcttcctgaggccaggttccgctt

SEQ ID NO: 37704 - DNA, 1263 bp, Pseudomonas fluorescens
cgccgcgtcgcgatcattggtggcaaccgtattccgttcgcccgctccaacgggccgtatgccaccgcgagcaatcaggtgatgctcaccgccgccctcgaaggcctgatcgaacgctacaacctgcacggccagcgcatcggcgaagtggtcgcaggggcggtgctgaaattgtcacgggatatgaacctgacccgcgagtgcgtgcttggctcacgcctgtcaccggccaccccggcctacgacattcagcaggcctgcggaaccggcctggaagcggcgttgctggtggcgaacaagattgccctcggccagattgattgcggtattgccggcggcgtcgacaccacgtcggacgcgccgatcagcgtcagcgaaggcctgcgcaagatcctgctgcaagccaaccgcgccaagaccaccggcgacaagctcaagacctttctgcaattgcgcccgaaacacctgatccccgaattcccgcgcaacggcgaaccgcgcaccggcctgtcgatgggcgagcactgcgagtcgatggcgcagacctggaacattccccgcgaagaacaggatcaactggccttcgaaagccaccacaaactggcggcgtcctacagcgaaggctggcacaacgacctgatgaccccgttcctcggcctgacccgcgacaacaacctgcgcccggacctgaccctggaaaaactcgcgaccctgaagccggccttcgagaaaagcgccaagggcacgctgaccgccggcaactccacgccgctgaccgatggcgcctcggtggtgttgctgggtagtgaagagtgggcgaaggagcgtggtctgccaatccttgcgtatctgcgcgacggcgaagcagcggcggtggatttcgtcaacggcgccgaagggctgctgatggctccggtctatgcggtgccacgcttgctggcccgcaatggaatgaccttgcaggacttcgactactacgaaatccacgaggcctttgctgcgcaggtgttgtgcacgttgaaggcctgggaagatccggaatactgcaagacccggctcgggctggacgcgccgttgggggggattgatcgtagccgcttgaacgtcaagggcagctcactggcggcggggcatccgtttgccgcgacgggcgggcggatcgtggcgaacctggcgaagttgctggatgcggcggggcaggggcgggggttgatttcgatttgtgcggctggcggacagggtgtgacggcgatcatcgagcgc

SEQ ID NO: 37705 - DNA, 2367 bp, Pseudomonas fluorescens
atgtccgattccatcacgttcgatctgcccatcagcggcatgacctgcgccagttgcgccggccgtgtcgagcgggcgttgagcaaagtcagcggcgccagtgccgtcagcgtcaacctcgccaccgaacaggcccgggtgcaggcccccggcgacagcctgccggcgttgatggaggcggtcgaacgcgccggttacagcgtgccgcagcaaaccgtggaattgaacatcgacggcatgacctgcgcctcctgcgtcggtcgcgtcgaacgcgccctgaacaaggttgcgggggtgaaaagcgtcagcgtcaacctcgccaatgaacgcgcccacctcgaattgctcggcgcggtcgacccgcaaaccctgatcgccgccgtgagcaaggccggctattcggccagtctcttcgaactcgaacacccgcaaacagacaatcgccagcaacgcctgaaccatgaacgctgggcgttgatctgcgccatcgccctcgccttgccgttggtgctgccgatgctgctgcaaccgttcggcattcactggatgctcccggcctgggcgcaattcgccctcgcaaccccggtgcaattcatcttcggcgcacgcttctacgtcgccgcttggaaagccgtacgcgccggggccggcaacatggacttgctggtagcgctggggaccagcgccggatacggcctgagtctctatgagtgggccaccgccgccgggcgcatgccgcacctgtatttcgaggcctcggcagtggtcatcgcgctggtgctgcttggcaaatacctggaaagccgtgccaaacgccagaccgccagcgccatccgtgctctggaagcgttgcggccagagcgggcaattcaagtcatcgatggccgcgaacaggacgtcgctatcagcgccctgcgcctcggtgacctcgtactggtcaaacccggcgaacgtttcccggtggacggcgaagtgctggaaggccagagccatgccgacgaagcgttgatcagcggcgaaagcctgccggtgcccaaacaaccgggcgacaaggtcaccggcggggcgatcaacggcgaaggccgcttgctggtgagcaccacggcgctcggtgcggaaagcgtgctggcgcggatcatccgtctggtggaagacgcccaggccgcgaaggctccgatccagaaactggtggataaggtcagtcaggtgttcgtgccgacggttctgctgctggccctggccacgctgatcggctggtggctgtacggcgcgccgctggaaaccgcgctgatcaacgccgtcgcggtgctggtgatcgcctgcccttgtgccctcggtctggcgacacccaccgcgatcatggccggcaccggcgtggctgcgcggcacgggattctgatcaaggacgccgaggcactggaacgtgcccatgaagtcagcgccgtggtgttcgacaagaccggcaccctgacctccggcacgccacgcatcgcacatttcagtgcagtcgacggtgacgaaaacgccctgctgacagcggccggcgcgctgcaacgcggcagcgaacatccgctggccaaagctgtactggatgcctgtagcgagcgcaatctgacggtgcccgatgtcagcgacagccagtccctgcccgggcgcggcatcgccggcagcctcgatggtcggcgccgggcgctgggcaaccggcgcttgctggaagaaagcggtctgaatgccggagacctgagcgagtccgcaaaggcttgggaaaccgaggggcgaacgctgtcctggctgatcgagcaaagtccggcgccccgcgtactcggcctgttcgccttcggcgacaccctcaagccaggcgcgctgcacgcggtccaacaactggccgcccagcacatccacagccacctgctgaccggcgacaaccgcggcagcgccagggtggtcgccgaagcgctgggcatcgaaaacgtccatgccgaagtgctgccggcggaaaaagccgccaccgtcgccgagctgaaaaaaaccggggtcgtggccatggtcggcgacggcatcaacgacgcaccggcgctggccgcggccgacatcggcatcgccatgggcggcggcaccgacgtggccatgcacgccgccggcatcaccctgatgcgcggcgatccgcggctggtgccggccgccctggagatcagccgcaagacctatgcgaagatccgccagaacctgttctgggccttcgtctacaacctgatcggcattccgctggcggcgttcggcttcctcaatccggtgctggccggtgcggcgatggccctgtcgagcgtcagcgtggtgagcaatgcgctactgttgaaaacctggaaa

SEQ ID NO: 37706 - DNA, 1308 bp, Pseudomonas fluorescens
ccagtcagcggttatcaccggatcatcttcatcatcatcgccctggcgtttttcttcgactccatggatctggcgatgatgactttcctgctcggctcgatcaaagccgagttcggcctgagcagtgcgcaggccggcctgctggccagttcgagttttttcggcatggtgctgggggcgtcgctgtccggtctgttggctgatcggttcggtcgcaaaccggtgttccagtggagcatcgtcctgtgggggctggccagttacctgtgttccacggcgcagacggtcgagagcctgacgctgtttcgcattctgctgggaatcggcatgggcatggagtttccgattgcccagtcgatgctgtcggagttgatccccgcccagcgtcggggtcgttatatcgcgttgatggacggtttctggccgctgggttttgtggctgccggggtgctgtcgtatttcctgctgccattgattggctggcgcgacatctttctggtgctggcggtgccggcggtgttcgtcctggcgatccgctttttcattcccgagtcgccgcgctggctggaacaggccggcaagcatgacgaggcggacaaggttttacgcggcatcgaggcgcgggtacaggcctcactcggtggtgccgcattgccggagccggttcgcctgccgcgaagcgtgacacctccgggccatttcctttcggcgctcaaacagatctggtcgccgctgtatcgccagcgcacgacgatgatctggagcctgtggttcttcgcgttgctcggtttttacggcctgacctcgtggctcagcgcgttgctgcaacaatcgggttttgccgtgactcagtcggtgtattacaccgtgctgatttccctcggcgggattcccggcttcctgatggcggcctggctggtggagcgttggggccgcaagccggtgtgcatcgtcacgttgctcggcggtggggtgatggcgtttctgtacggacaaagcgccgtgtttggcggtaacgtggcgctgctgatcggtacggggctgttgatgcagtttttcctgttcggcatgtgggcggtgctctacacctacacgccggagctgtatccgacctcggcgcgggcgacgggctcggggttcgcctcggccattggacgcgtaggttctctgctcgggccattggtcaccgggctggtgttcccgatcaccgggcagggcggagtgtttgcgctgggagcgttgtgctttacgattgcggcgggggtggtgtggctgttcgggatggagacccggggcaagacgctggaa

SEQ ID NO: 37707 - DNA, 960 bp, Pseudomonas fluorescens
atgaaccaacttccgatcatcgacatctcgccgctctactccgacgaccagaacgcctggccggccgtcgccgaacagatcgaccacgcctgccgcgaatggggcttcttctacatcaaggggcatccgatttctgcgcagcgcattgcatccctgctcgatcacgcgcaacgcttcttcgcgctgccggaagcagaaaagctcaggatcgacatcacccagacccgtcatcaccgcggctacggggccatcgccaccgaacagctcgacccggacaaacccagcgacctcaaggaaaccttcgacatgggcctgcacctgccggccgatcatcccgaggtgctggcagtaaaacccttgcgcggtcccaaccgtcatccggccattcccggctgggaaacgttgatggaacagcactacctcgacatgcaagcgctcgcgcaaaccctgctgcgtgccatgacgttagcgctgggcatcgagcgcgacttcttcgacacgcgcttcaacgagccggtcagcgtgctgcggatgatccactacccgccgcgccacaccgccagttccgccgaacagcaaggtgcgggcgcgcacaccgattacggctgcatcacgctgctgtatcaggacgcggccggcggcttgcaggtgaaaaatgtcaaaggccagtggatcgacgcaccgcccatcgacggcaccttcgtggtcaacctcggcgacatgatggcgcgctggagcaacgaccgttatcgctcgaccccgcaccgggtcatcagcccgctcggcgtggatcgctactcgatgccattcttcgccgagccgcatccggatactcgcatcgagtgcctgcccggttgccaggacgcacagcatccggcgaaatatccgaccaccacctgcgccgaattcctgctgtcgcgcttcgccgatacctacgcctatcgacgggagcaggaagcg

SEQ ID NO: 37708 - DNA, 2514 bp, Pseudomonas fluorescens
ctgtcgaacctcggcacccacaccgatggcctgaccgatttcgaagtcgatgtgctgcgcgcgcagcacggcctcaacgaagtcgagcacgagcaaccgctgccgtggtggacccacctgtggcactgctacaagaacccgttcaacctgctgctgaccctgttggcggtaatctcgtggctgaccgaagacctcaaggccgccatcgtgattttctcgatggtggtgctgtcgacgctgctgcgcttctggcaggaaagcaaatccaaccaggccgccgacgcgctcaaggcgatggtcagcaacaccgccaccgtgctgcgccgggatgcgccgcgcgctgaactgccgatcaagcaactggtgccaggcgatctgatcgtgctgtcggccggcgacatgattcccgccgattgccgggtgctcagcgccaaggatctgttcgtcagccaggcggcgatgaccggcgaatcgatgccggtggaaaaattcccgcgtcaggccgatcgtgacacgcgcaatccgctggagctcgacaacatcctgttcatgggcaccaacgtggtgtccggcacggcggtggcggtgattctcaccaccggcaacagcacctatttcggtgcgctggcgcagcgggtcggggcgacggatcgcgcggtaacttcgttccagcaaggggtgaacaaagtcagctggctgttgatccgtttcatgttcgtcatggcgccgctggtgttgttcatcaacggtttcaccaagggcgactggaccgaagcgctgctgttcgcgctgtcgatcgccgtgggccttaccccggaaatgctgccgatgatcgtcacctcgacgctggccaagggcgcggtgttcctgtcgcgcaagaaagtcatcgtcaaacgcctggatgcgatccagaacttcggcgccatggacgtgctgtgcaccgacaagaccggcaccctgacccaggacaggatcttcctggcacgcaacgtcgatgtctggggcgaagactccgatgacgtgctggaaatggcttacctcaacagctactaccagaccggcctgaaaaacctgctcgacgtggcggtcctggaacacgtggaaatccaccgcgagctgaaggtcggcacggcgtttcgcaaggtcgacgagatcccgttcgacttcaaccgccggcgcatgtcggtggtggtcgaagggcgcggtcagccgcatcaactgatctgcaaaggcgcggtggaagaggttctgtcggtgtgcagccgggttcgtcacggtgaagtcgacgaagccttgagcgatgaattgctggcgaaaattcgtcaggtcaccgcagcattcaacgctgaaggcttgcgtgtggtagcagtggcagcacggtcgatgcctgaaggtcgcgacacttacagcctgggcgacgagcaggaactgacgctgatcggttacgtggcgtttctcgatccgccgaaggaaagcaccgccccggcactcaaggccctggccgagcacggcgtggccgtgaaagtgctgaccggcgacaacgagctggtgaccgccaagatctgccgcgaagtgggcctggcccagcaaggcctgctgatgggcaacgacatcgaacgcatgagcgacgcggaactggcagtggccgtggaaaccaccaatgtgttcgccaagctgacgccgtcgcacaaggagcgcatcgtgcgcatcctcaagggcaacggccacgtggtcgggttcatgggcgacggcatcaacgacgccccggccctgcgcaccgccgacatcgggatttccgtggacagcgcggtggatatcgccaaggaagcggccgacatcatcctgctggaaaagagcctgatggtgctggaggagggcgtgctggaagggcggcggaccttcgccaacatgctcaagtacatcaagatgactgccagctcgaacttcggcaacgtgttctcggtgctggtggccagcgcgttcattccgttcctgccgatgctgccgatgcacctgctggtgcagaacctgctgtatgacatttcgcagatcgcgatcccgttcgacaacgtcgacgacgagatgctgaaacagccgcaacgctggcagccaggggacgtcgggcgcttcatgctgttcttcggcccgatcagttcgatcttcgacatcacaacgttcgccttgatgtggtacgtgttcgatgccaacaccccggatcaccagaccctgttccagtccggctggttcgtggtcgggctgctgacccagacgctgatcgtgcacatgatccgcacgccgaagattccgttcctgcaaagccgcgcggccatgccgttgctggtgatgaccgggatcatcatggccgtgggcatcttcctgccgatggggccgctggcgcactacttcaaactgcaggcgctgccgtcgatgtacttcgtgttcctgccggtgatcctgctggcgtacatggcgctgactcaagcagttaaaggcttctacatccgccggttcggc

SEQ ID NO: 37709 - DNA, 801 bp, Pseudomonas fluorescens
atgtctgttcccgctttcggtcttggtacgtttcgcctgcaaggtcaggtggtcatcgattcggtgagcactgcccttgagctcggttaccgggtcatcgacaccgcccagatctacgaaaacgaagccgatgtcggcgaggccatcgctgccagcggtattgcccgcgacaaactgttcatcaccagcaagatctggatcgccaacttcgccaaggatcgtctgatcgaaagcctcaaggcgagcctgcaaaaactgcagaccgactaccttgacctgacgctgatccactggccgtcgccggaagatcaggtgcccgtcgaagagttcatgggcgcgctgctggaagccaaacgcctgggcctgacccggcagatcggcgtgtccaacttcaccatcgacctgatgaaacaggcgattgctgcggtcggcgcagaaaatatcgccaccaaccagatcgaactccacccgtacctgcaaaaccgcaaggtcgtcgagttcgcgcaaagtcagggcatccagatcacgtcatacatgaccctggcctatggcgaagtgctgaaggatccgctgatcgtgcagatcgccgagcgtctgcaagccaccccggcgcaggtcactctggcgtgggcgatgcaatcgggttacgcggtgattccgtcgtcgaccaaacgtgccaacctgcaaggcaaccttggcgccatggcgctgaccctgagcgacgccgacatggcgctgatcgccacactggatcgcggccatcgcctgaccagccccaaaggcatcgcgccgcagtgggac

SEQ ID NO: 37710 - DNA, 792 bp, Pseudomonas fluorescens
atgaaaaaaatgcgcattgccacgttcaacgtcaacggcctgcgtgcccgtctgccaaatctgctggaatggctcaggcgcgagcagccggacatcgtctgtctgcaagagctcaagatgctggacagcgcgtttcccgctgctgatctggaggccgccggctacggtgccatctggcacggtcaggcgtcttggaacggggtggcgattcttgcccgcgatgcgcaaccgctggagagccggcgcggtttgcccggcgatcccgacgataagcacagccgctacctcgaagcggcggtgcatggagtgttggtggggtgcctgtatctgcccaatggcaatccgcaacctgggccgaagttcgactacaagctggcctggttcgagcgtctgatcaaatacgcccgggatctgcaaagcagcgatcacccggtggtgctggccggcgattacaacgtggtgcccaccgatctggatatctacaacacccgttcgtggctcaaggatgcgttgttgcaaccggagagccgcgagtgctatcagcgcctgctggatcagggctggacggactctttgcggcatctgtatcccgaagatcggctgtacacgttctgggactatttccgtcagcactggcagaagaactccgggctgcggatcgaccatctgctgctcaatccgacactgagcccttatctgcacgaggccggtgtggatgcctgggtgcgcaacgaaccgcacgccagcgaccacgcgccgacatggattcgcatcggttcgcgtaaaagacgc

SEQ ID NO: 37711 - DNA, 810 bp, Pseudomonas fluorescens
aatctgaaacagtacctgcaacgcctgggattcgacgcgcccccggcaccgacccttgaaaccctgcgattgttgcaactgcgccataccggcgcctttcctttcgaaaacctgtcgacgctcagtggcgaacccgtcctgatcgatctgccctccattgagcgcaaggtcctgaacaacgcccgtggcgggtactgctacgagctgaacaacctgtttctggccttgctgctggagctggggttcgacgcgcggggcatcagcgggcgcgtggtcatgaatcagcccgaaggcagctggacggcacgcacccaccgcctgagcctggtgaccattgacgacgtgcgctacatcaccgacgtcggcttcggcggcatggtgccgaccgcgccactggtgctcgataccgacgccgagcaatacacgccgcacgaaccgtatcgcatcgaagtgcaggccgatggctacatgctgcgggccagagtcgctggcgaatggcggccgatgtacctgttcgatctgcagcgccaggaagacatcgattacaccctcggcaactggtacgtctcgacccacccggactcgccatttgcccagcgcctgatggtggcgcgtacgggcgacggctggcggcgcaccttgaacaacggcagtttcgcgatccaccgtatcggcgccgagagcgagcggcgtgaagtgacggatgtcgatgaactgatcgaattgctggaacgggaattcggcttgcgcctgccgcaccagctcggtgcgcgagaggctctggcgcgcttgattcagccagtttgaacg

SEQ ID NO: 37712 - DNA, 1194 bp, Pseudomonas fluorescens
atgagcctgttctccgctgtcgaaatggcaccccgcgatccaatcctgggcctcaacgaagcattcaacgccgatacccggaccaacaaggtcaacctcggggtgggtgtgtactgcaacgaagaggggcgaattccactcctgcgcgccgtcatcgaagccgaaaccattcgcgccgctcagcatgcctcccgtggctacctgccgatcgacggcatcgcggcctacgaccaggctgtgcaaaagctgctgttcggcaatgattcgccactgctggcggctggccgcgttatcaccactcaggccgtcggcggtaccggcgcactgaaaatcggtgccgacttcctcaagcaactgctgcccaatgccgtcgtggcgatcagcgacccgagctgggaaaaccaccgcgcgctgttcgaaaccgccggtttcccggtgcagaactaccgctactacgacgccgccacccacgacgtgaaccgtgccggcctgctggaagacctcaatgccctgccgaacggctcgatcgtcgtgctgcacgcctgctgccacaatccgaccggcgtcgacctgagcccggcggactggaacaacgtgctggaggcggtcaaggccaaaggtcacgtgccgttcctcgacatggcttaccagggtttcggtgacggcatcgccgaagacgccgctgccgtgcgtctgttcgcggaatccggtctgaccttcttcgtatcgagctcgttctccaagtcgttctcgttgtacggcgagcgcgtcggtgcactgtcgatcatcagcgaatcgaaagaagaaagcgcccgcgtcctgtcgcaagtcaaacgcgtgatccgcaccaactactccaacccgccgacccacggcgcaagcatcgttgccgctgtgctgaacagcccggaactgcgcgctcagtgggaagccgaactggctgaaatgcgcctgcgcattcgcggcatgcgcgagcagatggttgctctgctggccaagaaagccccgcagcgtgacttcagcttcgtcggtcgccagcgcggcatgttctcctactccggcctgaccaccgaacaggttcaccgcctgcgcaacgagttcggcatctacgccctggacaccggccgcatctgcgtcgccgcgctgaaccagagcaacatcgaagccgtgacggacgccatcgttcaggtcatc
